United States Patent 7,468,248 (METHODS AND SYSTEMS FOR INFERRING BOVINE TRAITS) - sequence listing, part 8

SEQ ID NO: 34275 - DNA, 2677 bp, Bovine  19866880418629
acccactgtatagcgcagggaaatctactcagtaacttataacaagctgtaatgtaaaagagtccgaaaatgatggttagatagcatcacgaactcaatggatgtgagcgtgagcaaactttgggaggtggtgaaggacagggaagcctggtatgctgcagtccatagggtcgcaaagtcggacacgacttagtgactgacaacatatacatatgtgtgtgtgtgtgtgtgtacacaaccactttgctacacacctgaagctaacacatcaactattcttcaattttaaaaaagcaattgcaaaataatttcacacagtgatgcctgctacaaagacaacacaccttgacaaagcgataaagagaaacctggatgaaaggaagggtctgttttagagaagagggcctctaaaaggtcaggagaggcctctctgagaccgagtcatcagttcagagatctgggccaaacacatcatggacagcgaggacacgaagacaaaggcccgcgtcatggcggacctgcatgcctgcgaattttcattaagctcctattcttcaacaaagtgaactcgacaaagcccttgcctttgaaggccccatggtgcagtgggggagacccagagacacaataagtgtaccccaaactgccacccgaaccccaatgggaaaagtccatgaaaatttctaaaaagtgacctttgaccatgaccttgactgaagagctggattttgccaccagacctgctagaaacaacattctgggcccaggaaatacgatgtgggaaagaacagtggcctgggaatgcatgacatgtctatgaatgacatctgcatcctacagaaattactcttatggcacagaagcacttaattgttctatgtcttcccccgcttgctagaatgcacattcttcaacagcaaacgtactcattttgaattgttatcctctggcactctgtactggatgaagagtaaaaagataggttcacggaagtttgtgaaggttggaaggtgaaggctggagacagctgaacttctttctgcaggtatgggggccattaaaggttttgcaattcacaagaagaccccaaggatgacagccgtgagcttaacctaccagtgaactcagaaacctgcccttataaagcctatactggtcgtgctgacagagcactgctgatgttgtttaaatgaagatatggctttttgtgtccttcactgaagagacgtatattaattacagtgctttttaaggcatgaaacatggttttaaaagcttgataatctcttctgctaaaggtttcctgctgtgattgtcaaacctaagtcttcaccccttccctgggagccacccctctgccatcacctggctcacaccgaatcagtcaagccacatgtatttatcatcttcctcctctatgcacggcaaggagcatcatgtgagggggcatccttcacacgtctgaactgtaaagtagccttaatggcctttgaatagaggaagaaagtttatggatgtttcctcctactgtacttgattatcagtccaactctttcatctcaccttacaaatctagtccaacccaggtaacttggttggttcctggaagagctcaaatgtccacttgggtttcctggcttcacatcatcaaggggccatgccttgtccttcttaggtatgtcaaaggttgcctaacacaagggctcagaacttaaaagctcagtgtatttcctcagattaattaatacaccctataggagcttagtcgctcagttgtgtctgactctttgtgatctcatggactgtaacctcctaggctcctctgtccatgggatttcccagacaagaatactggagtgggttgccattcccttctgcaggggatcttcccaacccaaggactgaacacgtgtctcctgccttgcaggtggattcttcactgtctgagtcaccagggaaatcctatgccccaccattgtaacaactctcatgtctgtgcccagcgtacctcttcaatctctattcccttttcagatgtcagggcatcaggctcatgaaagtcctaaagccatagagagctggcccccgatggcataactctgttcaccagcaggaactccggcatggcaacacatgcaacatttggccaaccagaaataacccaaatgtgaccacatatctttgagcatacaaggcactaagattagataagtgactgaagttcagtacaaatgaggcagacatgggtaaagctcagctgataaaatagatccactctcccaagagacccatcccaatcatgcaaaggcaccagggagttccactgatcaggttcaggttcaaactggacatcctaaatttcccaatctcactcattccctgacaagttcaataatctattgggatgaaaatctttagctatttagtctgcatggagttgcctggcttagacataaaaattaaaaaggaacttagtgattatctttaatagtacaatggattatcacaagcaaaataatgcaagcatagttgtccagatcaaagatgttgaaccaaattcagatcctcagagaaaacgtgaaacttcaataagtatgatgaatgtcccttccacttatgctagcggttttagttcaaattacttgttaatgatctactatcacctcattctacaaaa

SEQ ID NO: 34276 - DNA, 790 bp, Bovine  19866880434941
ttcttaattccttgtcttcatgggttatgttctctaactaggagcagtttagcatactctagcattccatctttcctgtagacatagcagatcacgcacagtctgggaaaactaagtacacattccattgttagcctttctgatggcctgtgccgagttcttcagattcacgtcattgttggcaaacgtgcattgacgcgctcttattaccttggactgattttacatggagcatattaaacaaatgtggtgcctgatccttcgaaagttagctttttcaattgactcttatttctctagataggcccagaaaagagcaaaatgcatgtgctacccaagtcagaaagatggcaccaacatcttttattgagatgaagtgatgtcatctacttggaaatgcccgcattagcaaggggacagaatgccttccatttatatttagaagacagtgactacagtgaggaaattatgcaatctaggcgattgattaggaaatgtaagacaaaaacatactaccttgccaaatcaatttcctagatctctgtgaattatccaataattagataatcttttactttggaagtgcaaattttatatgtgtaattatttgtcttaatcactgcattcccaagctgtattcagtggcaacacacagcctgttcaatttatactctatttctgttaactagataggattaatatcatacttcctctcaaaagagagagagggagatacaggtattttataagatttgccactgtcatagagctcatcagtgattattataat

SEQ ID NO: 34277 - DNA, 1034 bp, Bovine  19866880442842
attttggagacctcggtagaggttaaattggaaaaaagtgaggttgagatcaggtattaatgaccactcatgaggcttgttagattgtgaggaaaaggtgtaaaggtagatagaaaggagagagttttggataccaaaactctggattggggaagacagtaaatggagactctggggctcagtagtctggttgcggaaatggtgtgcagaaagataaagggtttagaagttgggaatgacataatgtggctctaagaattcttcctggtcttccctgttcagtctgtgtgttattggaccaagtactcctggagcagttttatcctaggcctcttgaaggtacaatttatttttttaaagtaattattttctacattaattctgatattcaacagaaaaaaatgctcagtagagaggagaggaaggaaaaattgttgatgtacgtggtggccagaatgttggtactttgtaaatacttaactgctccagggttaacattctgtgattcaatggattgaattaaattaaaccaccttgaattttcagcataatgggagggtaaagaagaataatggatgtcctcatagtacaggcaaagaaagacatcacattattttattgttggaagtaataaaaatttccctaatccttcagggggcaaatgattcttagagagaggtgttggggtcaggctatggtttcaaggagaagagatttgcaggaattcactaatgaagacatgaaaatgtcaaaacacaactgaagcattaaaacatatccaagggcatggatttgtaaaaagtgccttctttaagaaaatgccacggtatatatatctccaagaactaattgttattggaatatgaaaaagggcccctggttataaattcaaagaatactatttataatggctttggaggccctgcatatcctaacaattagccaaatcttcctttagaaattttatgaagaattggcattaatgaggagggatcgatgccctccttctcacttctgtaagtaaaaaagtcaga

SEQ ID NO: 34278 - DNA, 2788 bp, Bovine  19866880477602
cctggcggggtaaagtgcataggttcacacagtcagacaaaactgaatgcacctgaacgcacttatgctcagctgatgcagtcaccagcaaaagagaaagaaatgctgaatctccttttgactcgaggctccctgccctgttggctgaggcagggcatttttggaagtatgcctccacagtgtgctgcctctcatcactaattcctttctcttcctaatgtgacctatcaccaatcatccataagccaaagctgagtctctcaggacgatttgaatgcagttttccctcagagaattgtgtacccaaagcataattacacattgatctggtcgcaaattcttatgtcagcactcatttccatctcaaattctttctaaacccaagagaatactacagagttgtgaaattcaatgttgatttctggtgagaatcccccccgcctcctcccagattccagactgaagaaatttgaaatgcctaattctagagttgttttaaactctttgatcctctggaaacatttgtgtacactttatagaccatggtcttttgctgatgtccttgtttgtactccaaaatatagcattgtgactaagaaggcaagtttgagaatcctgtatttgaattctgggtgtgtctctgaataagtgtgatatttctttttttgtatcttagttgcctcctctgtaaaatggagaagataatattgtcctcagtggggtagctatgcaaataaaataatttatttgttagggctcatgatagattctgatgtatagatgcatgccactttacttttattttagagataaggaagctgaagtgtggaaaattaagaaacaacctcttggttgtttggtctttcccatttagctattcacagatcttaactataatgttaaaattttttttaattctcttgtcttgtagattgcattgtgagacaattggtctttcaggaaaacgaggcatccatcatagtaatttttggtagttcagaaaatgtgacaaaatatcacagcattaagtattaacttgaggtgacgtagcagcagcagcagcagcaaccgggctattagcctattgaattctgagatctctttgatgagaaaggcagtgctatacaactgcaagacccttgacaccttgcagcatctcagggagatatctgtgctataattcaaactgaatgctgtattttttgtgcctgataaatcctttaatgtaacacatttgaaccacttgaaaaatcagatttctgctctaagtgacccattccctattcttgacaatctttaaaaaaaaaaaaaaaaaactggagtgggaggctcatagctaaaatatttacttttaattccactaatgttattaactataccatttgtattttgtttctttcacaagattattatttcttgtattaccaagtatatgactgagccttcaacggaaatgatgattagacttgaagcagttgatcaaatgtatagttcgatatatgatcaatgattgtaatagtgtaactctagatggcagtggcaccccactccagtactcttgcctggaaaatcccatggacggaggagcctggtaggttgcagtccatggggtcgctaagagtcggacacgactgagcatcttcactttcacttttactttcatgcattggagaaggaaatggcaacccactccagtgttcttgcctgggaacagggacaggggagccttgtgggctgccgtctagggggtcacacagagtcggacacgactgaagcaacttagcagcagcagtagcagcaaccaacagcaggtacaaacaagaagttcccctgaaattcttataacttctgcaaagtctcctttaagagtttatctacttttatctttggttgtgaaaccataattgccacagttgatttcacttcatttgtccatagatataaatcagtttttaactgatttaatttttgtctccaatcctttagctatagtttctctgttcctgcattcattaaattgatttttttcaactatatttcagcaaatgtttcattgttagtccttttttatatttgttttatgaagtgtcatattcttgcatttcttatgtgcttgagtctttttgttgtctttataattgtaacattacttggctttgtattaattttttgaattatatcttcattcgcattgtgtagagattgattcctgtcttttggccttaaatactgctcttcaaacatttttaagtaaatattctttcactctcttatatgggattcagtggttttacttggttcttcatatatttctggaacttgactgggctagagctttttattgattattttgagcaatttttcccccaacaatatggtagttcctttcagttgacagatttaagtctttgtttcaggaaagctttattctcctttactttagaatattttttttttctattagttttgtttcttctatatactaggaacttcttcagtcatatttaccatatatatcattttctaaaatcattgttattattttttcttacatttcattttatttgactttctctggattctccattgactcttattcaatatacatttgcacttattttttattttactctaatgtatctctatttttattttttctaggaaaaaagctgtgcctatttatttggtattcaataaatattactgagtgaatttgattaaaatagattcaagaacaaagatttatgtatttaaaaaatgagtgaaaaatggcctctgttgttccaga

SEQ ID NO: 34279 - DNA, 2373 bp, Bovine  19866880500882
tgtgcatctcaggaatgtcatattacaaaacatgttcactaactatatcttgaatcaatggaaaaaaggctgtgtctgtcttttagacactccatcattctgtgagcttaacaaacaaaatctcattaacaccgaatgcatgggagcatgagaaatgtgtaatgcttttaatttcttattaagtgatttgtgtttattgaaaattggcttgaaggtacactgaacataattcataatattggatttaggtgagtctagatatctgagtcttttctgtacttagaatgtgcttacaagtgcactattgttatagggggtggaaagagtgatagcttattcctggaaggatttgctgaaatgagaagatgagtcagacttggggcatctttttctgatgctcctgtgccttttaggtctgtgtgaattgtgcaaggcccttattcgtgcaggcacactccgtacgtgtctacaagcagatgagaggcagcgagggcacttgggggctggtagaggcaaatgtgaatcccgttttttcgctggtaactcacgagacctgctgggtagcagcaggcactagcagacatttaattgtgtgctaggtaaggctggcacagctccagcatcacggtggagtcagaattaccctaatcagctgggatatactgcatatattgattagagttggattttgttatgcaaaaaaaaaaaaaaaaactttataaatagtgggaaagtaattgagagtaattaaaaggcagagagtttaactcacagttctttagatgaaaaggcattttgatcctttgcttccatgcagatttccgggcaggctggagcagtttgtgagggccacgtctgaatggtgggatgactatcccgctgccccggaaagagactgaatgggcaggctgtgtagttaaggcacgggggaccaagttccagcagcttcttctcggtggctctttgctgtgggaagccttcttctttatttgggtctggggccttttctttttcttggcctcactaatagcttttggttattattaatatccctgatgagaactgaattgagatcccagtgtcctagtgaacactgatgggaacattaaccacactggaattacctagaatttcagcgtgttttgtcattgcttccctctttccttaaactgagaaggctttgtagccatttggtatcatggaagctacttcatctctggagtgatgacctgaatagttatatgcctggagaattccatggacagaggagcctggcaggctacagcccatagcttcgcacagagtctaatatgactgaagagacttggcatgcacacacacacatcctttcttgcttcctagtcctttcattcatatgcaatgtctgccacaaaatgtatgcacaaaatacctgccggctggatgggtgaatggtagctgctgtatacgtttgggatgctggcatgatgtagcatctttgtgagaaattgtagatcatgtattgtggagttccaagatcattatatcagagatcgtgaacaacaaggaggcaaggggaatggggtatgaaagaagaaagggctacgatttattgagcatttactatttcgggctctttgcatgtgtactttccttccatcatccgtcatcttcttggaggtggttgttaccatcatctcacaggtgacaaatacgtgaccaggaattgaaccaaggcgacagactttaatcggcagggtcaggatttgaaccaacagccctagttgataatcagggttctcaaatgaagctgtacaagtccccttaccagcagaggaggatgtcagagcttggtggtggagcccagagataggccatgagcaccaggcagatttctttcaaggccgagtgtttttctacaaactatgggaattttacagtctcttccatactgtgtttggttaaatgtgaaatcatattttaaattacttggttatcaaagtaccagtacttaatttttctgtcccaaatctttacttacaatgaacccacctaaagttgctcctcctgtgtcctctgggactcctatgggcgttccatgaagagagaatcagagctggcagtttggttggaagagcgattgaggaacctatcttgaaattttgttccattaaagtgtggttttttacttagactgcatgtgtatttgcagtgacctggggctgttagtgaggagaagggtgctaaaacttcccgtgactttgtcttgtttatccaggagctttaagcttcctgatgtaactgctgtggatccaagtttgagaagcaggcacagaaccctacttccctgcattatttgagtgataattatgatgctccaaacaattgctgtgc

SEQ ID NO: 34280 - DNA, 1432 bp, Bovine  19866880515745
tagtcctctgtgccgaagactgatctgcaagcatcccctggacaatggtatttgaggtgctatgttggaagcacgtgcaaagagctgaggggcagagtgaccaagtcttccaagcactcagcctctgcaaagttcatctaaaaaaaaaaatccagcgcaggtttgctcaaacacagcatggcccaaggttgacaaatgaaaataacacgcaagtactctccgctgggatgggccctttccaagcacactggctttcttcccgtcctagtcctattcagtcctgaactccttgaggatttgccaggctctgatcctcataacatgatattccctttctcgtccctcacctttctgtaccttaaaacctaagagatggagtctttagaactggtgcaaaggtcagcgagctgcaaatttatcagctatttgttgcctttttttgcaaagcccatatcagatcccaagctccttttccaacatgattcctgttttcttaccttggtgaatcccacattgcatacagaaggaacccctcttgcattcacagaggtttgaacgcatttccatttctgtatcttttaacgtgctgcctccactgctgtgatgccctctctcctttttcttcacgtccatcctgcaaagccagctcagatgccacctcctccaccatcttcccaacagaattgtatttcatcccacaggtatgtgtttacatattcatcacacatttatgaaaaacctgtgctgtgttgtgcctggttactaggaaggtagagatgaatgaacagaatctgtgccaagttctcacaaaactcagagatctggatatacagaagtgcagtacaataggatacaagatttaataaagtcccaagaaaccttttgtgtttcttgggactttatttcccccattcctcaatgagtcagcaaaggctttaaagcagaagtcagctttaaattactttgaatttactttagggcaaggtcagggtctggttagtttctgcaaggtacagtagcccagtaaacagtgaaataaaggaataaatgcatgcatgaatgaatgacatagccaactcatcctgtggctctcattttgttcaaggcaaagactttcagaaagcaccaggattccagttgcacggagggcatcactagctcttcctgaattgaaggtgagaccagaagcttactcaagtgagtgaggccatcattaactgcaaatgttgcaaaagaaactggattcaactctttagggcattcactgaactgatagctaaaaattctctgaaacccaaactaggaaaaccaatgagtagagaatctaagaggtattacagagcccatgttctgatagaaccaggcctacctgactgtcacagtagcaagatgattcagaaagtgatctaaggtttaattcttgaggtggcag

SEQ ID NO: 34281 - DNA, 1286 bp, Bovine  19866880536387
gaacctggcaggctacggtccatggggtcgaaaaatttggacatgactgaagtgactgagcaaaagcacatatcccattctcaatgagtaatcacacttatttaagtcaacaacttgactagagtgaatttgccacttgtttgactttttgtacagaaaagataggttcactgtgaatctatcctttttttgctcattattgaaatatctcattcatgcatatagaggaagatcattggtgatgtatatttgcaactctatggtgacaactatgcaaatgttttcattatgtagcttatttttcaggggattagactttttcagggagtgtctactcttggcaaatcatgagtgagctctcaaataaggatatttaattttagaatgttggcagaagaccgcatgggactcttgccttctctctccatctctgactctgcctcctttatgctctctctctcacacacactcctaatgaaatgcaaaataaaaacacggaaccactggagatgtaagagctagtatctgtgtgcacttcagcttcacaaagaatctaaattaaaatgaaatttgccaggaccttatttctgaacaattttaatgatgatggacacatgcttgaatatgacatttgaaggattcaagtttaaacattcagagacttcattctctgagctattatttcattggcatttgaggcatgaaagctaaaagaaagtattttttcacccttggaagcaggcgcataactcccattaactccagaaggaggaattatacatgagaatgaggacagacaatacacaaataagtgtgcaaattcagtctctagattaaccccacagcctatgatagatctttggaagcctttatactctatgaaatcaataatccattatagctcatactggtgactaaatgacttcggggattggtaatggcatctgaaatcttttacctttaagccatggcttgtagtaaatcctacattctgaggcatcaccagccagttgcagtaaagatttttggattcaacaccttgaggcaaataatggcaaataatagatactcaatacatatttattgaatgaaaggatcaacaaataaaaaaaaatagtctttagtccatactcagatctcttctgatcctcacctctttaataacttggcatagttgggttctctttcttcgtgctaagtcccttcagtcgtgtctgactctttgtgaccctaaagaccatagcccattaggctcatctgtccatgggattctccaggcaagaata

SEQ ID NO: 34282 - DNA, 1537 bp, Bovine  19866880557598
ctgaggcatatttgcaatatggccaactaattaagaaactgcataatctggcaagtcacacaaaatacatgtaaagatgccaaaaaaggctggggggctctgacaagcacgttcgttgccagcagtggagtgtagtcctttttatactctgtattgtttagcatttgttggttcttaagaaatgtgtgttaaatgaatgcagctgggtgaaggtcttacaaataactgccaagcactccatttcttctttgagttacgacaaagaagacaaggcatgaggcctgggccactgcccctgcctgctcatggcaaggtgatgacaccccttctatgaactggagattcttccccagtacaggatggcagcagctttgaccaacctcccggacctggcttggatgaggaaatatgcttttaggatatttctttacagggctttcccgatagctcagctggtaaagaatctgcctgcaatgcaagagaccctggttcaattcctgggctgggaagatccactggagaagacagaggttacccactccagtactctggcctggagaattccatggactggatagtccatggggtcgcagagttggacacaactgagcagctttcacttcacttttataactttgtatattactgacagtttgaccagaggcaagttccctctctctctggattttctccttccttaaagataagcaccatgtcacttaattcatttcaactctaaaattgtctaattggatttctggcacacagtgggttcacatattgaaatgatatatatttgttagaaatacattcaattccactttcccatcaaatgggactgttaaattgtgaacatattttttgctttcctgcttcataaaatatgagcactctaatcccagatggcacatcctccagaaacatatggacaagacaatttataaggagtgctctttcaggagctggtttcacttagctaaggaggctgtgcgattttgccaagacctttcaagcaactcattgaggagggtgagcaggtcttagtcatgtagccaagggattgaaaaaagtctaacacaaagcccattttggaaaaggtctgggttttcacagtttagggaaggagcggcatagattgaggtgggaaatttctctctacagtgcagggagcaaagacgttggagtgaatataaagcatgatgctgttgttttcttttgtttgttacctatgacaaaatagaccatgcaggtcattccagtccaggcttagctcatttgcaatgaagaaaaatgacctgatgtttacttctcacctattacacaccattgtctaaatgcttgcgtaaatctttgtgtattaagaatgttgtattcaggatgctcatctggtctcatcacttcatgggaaacagctggggaaacagtggaaagagtgtcagactttatttttttgggctccaaaatcacttcagatggtgactgcagccatgaaattaaaagacacttactcctggaaggaaagttatgaccaacctag

SEQ ID NO: 34283 - DNA, 1269 bp, Bovine  19866880571887
aattatacagtattggtacatattgtcttcccctgtatttcaataaaatacatactttatattataaataaaatatgcttatgtgcactaatctaatcagatgactatttataatatttttctgtgggaaaagtatttcacattcaaaacaactggtttacaaacttttgcacatggcttgtttataaaagatgtcccattcccatagttgctatataacataaaagtgaggtaatcatttattacaagttccataaagtcttaaaagttagaaaagtagagttttctcttatgtcttttaatttaccttaagtcatagcgtcttattgcttcgcctctagtgcatctcagaaaaaagcagtctaggcgcagaacaaagaaagacttttgtctacttgctaaaaggaagaaatatactatcttctacccattcactgactaatgcaaaaaggaatgtgaaaaagaaatccatctaaactcaggggcccctgaaccaaagaaaaggaaaaagccttttcaagaagttagtgaacaaattatagcaattgattttattacctgatcttaattgaatcagcacagtattattaaaaataaatgttggcatattgccttaaattaaggaacatagacccccttttcattttgaattcatgaagagatctacttactcttatttttggaatactttagctcaacaaattaatacctatttcatttcactgggccgaatgttagccatgaatgttagcataatttttcaaaaatgaactgcatcaaactatttgcataacaaaaatgtcactgtgaaccagcaccttgctgcccctggtattgtcagaggaaactggaagagcatcatctatttttatatctgataactttgttcatccccaaataactacttgtcaaatacagttaattttcagtaaagtgaaaaaaaaaatgaaaactactgactctgaggaagtagcaggttcaaggatttgatcataggattaggttggttttttaaaattgattaattaatttacttttggcggtgctgggtgtttgctgctgcgtgagcgtttctccagctgtgacgccggggccgatctctagtcggggtgcgcaaacttctcactgtgttggctccgcttggtgcggagcacgggccctagagcaccaggcttcagtagttgccgcgcaggggcttagctgctctgtggcataggcaatctttccggactagggatcgaacctgtggtcccctgcatcggcaggcgg

SEQ ID NO: 34284 - DNA, 686 bp, Bovine  19866880582383
gtctgtacaggattttggaggctctcagatctgctctgtttaggggcaagactgtgggcaagttatctaacctcggtatttgctttatcatcagaaacgtgggactaatgatgcctacatcttatgattataaggattaaacaataatgtaatgatgctttttgcccagtgctgaaaataagtacaaagtaactctcccagtctgtttgcctctgtgatgtttttctgactgtgtggacttcaaattctattaacaacagaaagtaaataaaagctgtgatgtatctgtaagcccttaaaagtttcactacatattttaagcttcagatcccatcttgctaaaccgtgcaaacattatttagatatcctacaaatactagtcatcggattacagggacctggaaaaacacctcagcagactgtttgatctgccatggagcaaagggtctgggactctggcctgaccatcagtctaaaaggcaacataaaggattataaataactgttccagctgccagtgacctaaaagcaaagggaatgtcaggggaaagtgttgggagcacatgtgcagtgggggcaggtggtggtggaaggggtgtactgaaatagtccactgaaattctcatggaaacaatccaatgcctgttcatgcaagcatcacttatggatgggttcggtatgtatca

SEQ ID NO: 34285 - DNA, 976 bp, Bovine  19866880692659
tgcacactcagttcacacacactcatggtttccttcagtgacataggaatgctttaaatgtttggaatttatgatcaaggggtttccaagtgagcaaggttgtacatgactcatctgtaaaggttataaagcactgttgatcataagatacagaagccctccaaatttaagattgctaatattatgaacaaacaaggagacaaataaataaaaaggagatagtgaattagaaaaccaaagtacgaagccaaaagaaaatccaggtgtcatttagcatgtatgaatcaagccttttcttcctttttaaaaaataatcaggagtgtatttgatttacaatattgtgtttcaggtgtatagcagagcgactcaattatatatatttgtatttttcagattatttttcattatgtgttagtaaaagaataatagttccctgaataatcttcgttgcttatctattttatatatagtatgtgtatctgttaatcccatacacctaatttacctcttctctcctccctttcctctttggtaactgtaagtttgttttctgtctgtgaatctgtttctgttttatatgtagattcatttgtatttctttttagagtccacatataagtgatacataatacttgtctttctctgtctgacttcactaagtatctctacgtctatccatgttgctgcaaatgccagtattccttccttcttacatttttaaaattaaataaaaatgatttatttggcttcccagggtcttagttgtggcatgtggaaccttcactcttcctccaagcatgggctctttggttgtgccgtgtgaatttgtggttgtgtcctgtgggatctagttccctaaccagggattgaacccagaccccctgcactgggagcgtggagtcttagctactgggccaccaaggaagtcccatatttcattctttttatgatcaagccttttctaggtgtaagata

SEQ ID NO: 34286 - DNA, 2517 bp, Bovine  19866880717909
tgttctcctcccctactatgtgctcagataacaccctagaagcttatataggatatcaagtccctgatttttttctactgtgccactcttggaaaaactggattttccacaatctctgcagtaaatattgaactaatctagcccatcaggtggcctggagagattgcaataccttgggaacgtgccttcaagtcagcagagcttctgagagctgcaggagactgggactccctttggtgaagggctggcctcacaatttcctgttttcttggcggctgcctctgctgttgaactcacattagaacagactccccagagatgatctcttctcagttctctgattgggaccttgttctccaagaaaatgtaattcacatcgtatggggaaacaaattactcccagatagtagtttattttccttggctcttcataggatcaggcccactaataaaaatcgtaataatgatgagaatgatgctatagaaatgcagtcttcggactgtttttcttacaaaagtctgtttaataatgataattgtactgcatatttcagttggtgaggcagttgtttagttttccttcatcatcttctttcgtcactggtgtactgagtttccagatgcttattctactctgtgcttaattatctattgaaacaattgcattaaccatgctatcaattaaaaaacataagaaaaatgttttcaaagtgaaagaagagtgataagactatactgaatggtatcttcaaatttggggggaaatgcgtattgaaattgttacaggacaagctaaaccctcacaaaagggaatcgggacagtgaactcacctcccttggtgctgggtgagtggccccatgaagatgcatggatcccttatgctatccttttaaatcctgcccaccataatgacattgaaatggtggggaggggagagccatccctgaaaccaggtgaaatttatttaagaaatgcctctggagcctccccacacatctgtgaaatctgccttgagcacatatcaccagaatacaatccagggaaatcctcagctatgctaaggaaccccctttaatgcgccttttgcagacctgtccttccagaaaccatccagtactttgaattgttcttagacccctccctatggaaaaacgagacagaaggttctgctttataactgctcagacccttctgctccaattctacagccagaacccatgtatgtttaacatactaagtgggatcagccctctgaatccccaatgatgtccacagcgcaattttgtgtttccaaattttctcttcttccaagtatttgcattcttcgcaaggcaagtatgaaataggtgagcttaatcactttgcagtgcttaaggggctagacggacgtttggaggctctgcttgaggactggagtttgcgtctcctctttcctgcgcctttttctctccccgcccccactgccccatcgcccccaccttctcgcgacccagggcctttgaggcaactctatacccttctgatttgacttgcttctggtaaacgaattaaagtgtgagtgcagccgggctccatatttcctctcttaaaaggaaagtcaaactctgaaaaatcagtccacaggaagaggtaacttcaaaaataagggctcatgttccgcaagcctcttgagctctcatcggccccctggactatgcccttccaaagggaaactttacaaaagacctcggtagaaattgccggcagcgcctgagttgtctttgttagagataaggagttctggtcacctgtcatggctgtacagctgattccagtgttcattttgggaagcctttggcttccacggaaaagagtaggctttgagaacatgtaggtggctgaacaagtggtgacttgcaggagggaaaatcagaggttagcagtgttcatctctctcctctctaaaaaagagaagagcaggcttttccagttttaaggttcaacctcacatccatgaagttgggaactatggataatttaaagaaaatggtttttttttgttcactgtttgtgttttcatggatgtgattagcatcttagagatttgtactgcttgtgtcctctcttctcccatctctttgctgacttatttgaacataggatgtatcctgggtcataaatttctactaatgaatccaaggatgctttgatatctacaaattgtttaaactaattaaaagaaagtctgaagatcttgctgttggagtttttggaagaaaataaacttatggttaccaaagggggaaggggtggagagggattaaattgggaatttcggatttaaagatccacactactctatataaagtagatacaccacaaagacctactgtatagcacagagaaccatgctcatatcttgtcataacatatagaaaaaatcgagaatgaataggcatagatgtatatgaatatgtatgatttctaatatttcacacatacagcgaagtgattgttatacatatacatgcatatgt

SEQ ID NO: 34287 - DNA, 3244 bp, Bovine  19866880755022
tagactgtaaagattttttatttttacttgtaaaaattgtggtttgcattttcccctaattacaatgattggaaagttcaatatgtaaaattatacatagaaagcatggaaattcacagagaaagaagacaaaaattagctacaattctaccacaaagatacttgaaatgttaaaatttgcttcatgatctatcaggattttccataacttttctctgtataagtactatgatttaagaattgtcctgtagtctgttttatttttctcttagcaatataacaaaaacattttttccatgtcaatagagatttggctataatgccattttaaaatttctactttttaaaactattttattgtgtggatataatcctttttattaaatattaaatcctttattattaaacattgaagcttttctaaaaattgtaatacaaattttatccacatacttttgctatacctatttagatatttttgtgtgctggggtacttacatatacatatgaaaatagagtttaaccatgcaagtacagtttaaaatcttctcttgtttacactgatgagtgttttggaacattgaccaaaaggggcccctgatgatacatatttccaattttgtagctcagatgaaaataatacttccttgcagattcctggtggtgatttgtaagtgattcatttgtgcaagattagtaaggaacataactttatgtttctcaatgttttactcatacaatggaactactcatatacttgtctccaacttttgtggaagacaggagagtgtattaaagcacagaggagtatgttgctacatagagttttcatgattattatttttaaaatttttcttattgttcttttatactgtaattttggggtatttttgcggcccctcccatcttatgaatgagtggtgactctaaagtataatttcttttctgtttgtctgtgtcctgtggcttgctttctttttttataaggcaatattttgtgctacactgcaatacataataaatatatttctaaattacatttcaaaatgagctattgtttcaaagtgaacctcaaaatatgggaagtctctgaagtggaggaaaagatgaaacggacagattaaatgagatgtggccacctcaggggacattctacttcatacaagtcccagaaatctcaatgaaatcactacataatttaggcatgttcataaataatccatctcaacatttttctttaaggattcagttttcaagtgcataaactaagcaatcctggtgacccacctccagcatgagatgcggaaaatatatttcaagtctaaaaaaatgacttcatgggttgtggttaatggaatatttgctggttgctttatcaaggccaaagggacattagcaaatgcacaccctttgatcatttattaatgtatcatgtgctgtgcctgttaaaataattttagcattcaggagctggcttatgagaatggaagaaacttgagagaatggctaggctgtattttgaaaagtgcttttaccatcttcactgaactgtgctacataatcctctcccttgctatgattagacacaggtatcactgttacaactccagttttattagcaggattaaaaagtagcagaggagataaagggtagggttttgtttctggaatgattcagagtctgcccaaggaaagggaacattagggtctgatgcagaattctagtgtcccacctctgaggtctgcatgccaagccttggaagtgtctcgaagtattaaagagcacaggttttccctcactgatggatgggggtcttgccttagccagggtaggaggctcatgtgtggctaaaaacaggggattagccgtggggagaccagacatgctcatctttatctttcctgaaagttattccatgggcgaacagaccattcatcatcagtgaaaacacaattcacttccgtcttctcacacacaggattggtctcccaaatgtgcacatctggaaatattatctaggcctgtgtaatgaccagtgtttaagcataatctgtgtgtaagtgaattcagctgagagggagtttgcctttttgcttttactgtctgaagccctggtactactgagctttctttcttgaagttttatcatctgcccaagaaaattaataagagctaggaaagagaccctagacggctgattttacaaagaatgtggccatgcttcttgcaataatattgtataggctggttagcactgctggatatctcagtggctttcaaagctctgagtcagcttttgtggtcaatttggattaggaagtcttctaattacaagggtgtgtgtccacaaggaagggcaggtatagcacaaaggtctagactttgttttccttacgcatcacggacacagagtggtccagttgtctgttttaggttatctcaaataatccctacagagtcttgtgtgcacgtgtgcttactcactcagttgtgtctgactctgtgaccccaggggactgtagcccgccaggctcctctgtccatggggattctccaggcaagaatactgaagggggttgccataccctccttcaggggctcttcccaacctagggatcgaacccaggtctcctgcattgcagcgagattatttactgtctgagccaccttcaagagaggcattgctgcccatatttatagatgacaaaactgacggtcaaaggatgaagtgacatgcctaggaagtgttatggcagatactgaagaccttataacctcataagtttcctttacatatcgcttgtggaactcaagactccaccaatgcacatatgctgactttttttggtctactacatgattctctatatctgtgagtctgcttcttttttgttatattctctattgttatttttagaatttcacatataaatgaaattatcgtacagtatttgtctttctctgtctgatttatttcacttagcaaaatgcccttcaattccatccatgttgctacaaattgttcattcttctttatgcttgagtagtattccattgtgtatctatacagcgacttctttatctacacatctgtggatggacatttaggtttctcccatatcttgctattgtaaataatgtcgtatgaacattggggtgtgttatatttttgaagtagtgttttcttctttttctggacacataacttggagtgggagtactgggtcatgtggtagctctact

SEQ ID NO: 34288 - DNA, 1168 bp, Bovine  19866880765364
tggagagcaatcgcgcccgtctggggtgacctgcagggacctgcttaaagtgtgatgctgtgctttccactgtgtttctgctgtccttcctgctgacacccagtgctctgtgggtcttaggacctgagattcttcctgcctccatctctccttccctcccaccttccccgctctctccccttcccttcctccctccctccctcccttcctcttcctccttcccttccttctttccttctttctccctccatctctctcctcttccttcttttttgatcttcattctctcagctgaaaattccagaaagatctagcaaagctaatttagtgacaatgtctatttgttcaatatacactcagttaaaaccaacagacagagcacacacggatgaagacaattgtctgtcactatcggcgctgacagatttgaactaatgtcctagaatggaaagtgacctgccgctttctgtaagttaaatgcagtgattctgattgaagaagacagtactaaattagagacgtaatccataaattaaaaaaaaaaaacaaaactgaaaacaccttaaatcttgatccctaacatgtgtcctgaaaaggcttcattcttggaatactcatttatcatccaacaaacccttgttcactttgaagggaaataggaagtgagaaagaggtgcatttcctaggatgtagcctgtgtacataggactcagatgacttggggattttaggatgggagagcggatgtagacctgtggtctgttggagcccagtcgcagatggagccgggagcaggctgctcatgggcatgcaccagggtgctctcgtaggtgtgcgccacattttagttcattcacatcaatctttgctgcaactgagtacatatcctgtcttaggaagttggggaatatggtataggaggagagcagtctactgcaaaaagaagagacagagtgtgaggccgggctggtgctaaagagcggcattgactggattacatgagaacctggcctgtgagtgtgagacgagcagttacgcagtgaacaatttcaattgtgcagaaatgtggtggtgagaggcagacgacagctagataaattatgtaatgactgtggatgtttctgccagagaagtcactgggctacatttttttgtttgtttgtttata

SEQ ID NO: 34289 - DNA, 2156 bp, Bovine  19866880810426
tagaaaagctagcttcacagatgttgagaaatcgaccaagtggaaattatttactatagaaaggaaagaggacatcagcatctcaaagataaaaccaagagatgcaaaatggagaaaacaacaataattcatctttgtccagagacaatcccagagaggaggctagaggactggccagatggatacaggtagttcttaaacgatacaaaatctagaagagcaatcgaacctagaaaccacttaggagaacaaatgggcatttagctacattccaacactgttttatttgaagttggtcacagttaatattttataagagaatcataatttcctaacatttgaagtcattcagaaaagggaatgagtcttcatcagggttggttgtgtttgggtggcaggtggtgagtgacttcctgcaaagcaagatgatacccacctgttgcagagagagcatgttttcctcacagttccctctggcagaaagccttggccactgccaaaggcaggttcaaaatctatcaagagtttaatcccatatgtcatctcctatgcccataaattttaggacttgagatgaggctggctttggataagaaattgaaaaatcctgggtcataaaactactgtcaacacagccgtccaagaacagagcatgcaattataagtttgagaagaggaggttgagggtggaagagatgacgagtcaaagttgagatttcaatctgtttccctcagacttgaaagaagtgtaattttaaaagcagacttctttcactaggaaggacatatattgaggaagtgggtgggaaaaaaaggggaaaaaaaaaaaagcagcaaagacacacgggggaatgatcagcagcagtgggctgtcattgttcacagaaactgagtaccatatttttgaaatggaactttaactaaagtgtagaatgggttaggctgtcctgctgtaattcctaattagcacagggaaatgtgatgatcgctacctaggacccgtctgctttaattccattgtcctactgatagatatagtccttcataggaaatagcttcattatttagctgggaagaccaaccacttagagaattatatcttagtataattattctgtaaatagtatacaaactagtgtttgtacaacctagtataacaacttagaggataacatcttcatatatcataaatagcattaaaaactagaatatatgacacgtaccttaacagaagggcaatggaaacctgcaaaaaaatgctttctcttaaaaacagtcactaagagataatgcacttattctaaaatcgaaatacaaattctaatgtagaaacatattcagaacttaagctaaactttaaaaaaaattgagtatgtgtatgtgtgtatgcatctcattcatgtgtgtgctcagtcatgtctgactctgcagccccatggactgtagcccatcaggctcctctgcccatggaattttccaggcaacaacactggggtgaggtgccatttcctactccaagggatcttccagacccagggatgcaatccacatctcctgtttcttctgcattagcaggggtattctttactactatcatctcctgggaagcaccattacaaagactttaaaaaccacaacctatcttgaggggataaacccaagctctcctggagaattctctcattaagttcttcacatgcttttaaatgcctcacttttcactgtacttgcttttgtaccctcaatggaagtcttgatttgtctttgcatcctcagtgttgtgtgtgtgtgtctgtgtgtgtgttactcactcagtcatttctgactttttgcaacatcatggcctatagcccaccaggcttcctctgtccatggaattctccaggcaagatacctggagtgaatcgccattcccttttccagggatcttcctgaccatcattataatatcatgcaaagtattttcattttcctagaaatcctccatgccttcccccattcatctttccacactttgttagcccctggcaacagagatgactttattgtctctatacatctgccttttccaaaaggtcatgtgggcttaccaggtggcacgagtgataaggaacctgcctgccaatgcaagagacttaagagacatgggttcaacc

SEQ ID NO: 34290 - DNA, 649 bp, Bovine  19866880840683
ctgcaggcagattctttactgactgagctaccagggaagcctattgaagctgaaaaagagttgaagagtcaaagagttttgttttattctctgactcataagagtatatagtgaggccaataaaactaccatccctttgtttctaactttcagttacccacacacttacatgcttctttgcattagttcaccacgtgcctggtgttcacagctccaagactccaaggggaagtggcggcagactttatttcagagcctgctacctggaagaatgtttctggaaagacaagtgaatcctgagtgttcagctttgggattactttgtagcaatccccaaggtggcatcatccagacagctcccattctgtgactaaggtcagagagaaaagtgaagccctcacaggtaaatattgaaccagatgttaaaacaccagcagacaccatacattaacagcagctgctggaaagaacgtggagacctcattcctgggcaacagctcggattaaggcttcctcaagagacatggtgggagaaggaaaatctaacatccctgggtgtgtggccaggactgtgtccacacacatcaaactttcctcaaaaagtgcagggagggattactcagagactgttagaaaacagaaagcccag

SEQ ID NO: 34291 - DNA, 714 bp, Bovine  19866880867037
agacttcactttcacttttcactttcatgcattggagaaggaaatggcaacccactccagtgttcttgcctggagaatcccagggacgggggagcctggtgggctgctgtctatggggtcacacagagtcggacacaactgacacgatttagcagcagcagcagcagtcatgtctgactctttgcaaccccatggactgtagcccaccagactcctctgtccatggaattttccaagcaagaatactgaaataggttgccatttcctactccaggggaccttcccaatccaggaatcagaactatgttcctacattggcaagcagattcttgaccactgtgccacctcggaagtccataacagggctgtatgggaagtcagattttgaaaggaacttgtccttctatgcactaaaggtttgcacttgcaaacattagtgaccatggtgccagaaggagttctgaaagcagcccaggaggtcagtggaaaattaagtcagcaagcaggtaattgttctgtccatgatccaattagggacacaaagaaccacaattcacttcctgcagtcattaaaggcagcaagggacatgaactgccattgtcataaaaacataattaaacgtgcattgtgactgcaaatagggagaaacaaactgatttttcaataggccactaacatgttttagcacttactttgttcctagcaggcaacaa

SEQ ID NO: 34292 - DNA, 2084 bp, Bovine  19866880873342
tttattgctttgtacttcaccaacagttcccatgattttattttaaaaccttcatccttgatttaaaatctttgaatgtatccctagttgttccatgttatgtgttcttctggcagagttgttcagatgcgtactttttactaataataatggctacttttgttgagcagttcctaggtatcaggtcagggatttagctctacttgttagttaaatggattagcgtgtgttatggatgctgagaagacacagactcctggatcaagcataaaggactttttattgcttgtggtacagcaagcatcatgagcatcatcaaatgcagtggttctcctcaccctttgccgagtctcacagagatgaagtgctaagggtcccgtggatgctctgtgcatcatcaaatttcgttgcagctgaggaatattacatttggggacctcatcattttgcagctaacagtaaacagcgttctcttagatacagagggagacagttcttcattgttcaaagttgctccctgcaaatacaattcggagaaatgtttgggcaaaaacaatttgggctttgcattcttggtacatccagcaagaggtgcaggggttgggactcaaggcagtttgcctttctcaacactggttctaggaacaatgccaaatgctttaattgggcagtgtttcctggtagatcactatgtagccaatgttctgtgtatgtcttactccttttaacagggtcgcctctgggcaatgttataaattgggtccattttgtttgtacccctatcttcctgtggaaacctcttttccttgcacaaactcccacattcacgacttacattttaatggctctaatctgatctttgaatgtccattttcttggcctgagcccatgccacattcaactcatttcttttccttctttgtcctgaaacaaaatttacccattctgtggccaatttcttagaactcttctcacttgtaaagggtcactgagaaaaaaatggaaattaaaatatgttcatgtatagaaggtggctcatcagagaacaaaaaattttaagagaaaccttgtgaagacatactttagccaaggaatcatttgaatggtgggaatttgggatttcaagactatatatacaactccatatgtttgctctgtgcatggtgtgccctggatctcagggatatatttagtttgattttatatgaagcattggtttttgtgttctctgaaaaggaaaaaggatattttgaggtatagatttaaaagccatttccttttcactccctatcatccgagagtttatgagatagagttttagatcttagtgaaagctacaaggggtcgtgactaagtctttataatattaggagctgctctcctcctaataagcaaccattacccaaaccatactttttaatggagatgctgcccggggagttcatggcaatacattagaacgtggaaaacgaagcttacttaggccacaaagcagcggctccgtgacataacgcttctattggcacctgcatttggagtctgtaatgttttcttcactgtgctttcaagacccaagcgatttaaaaagaagtgactgtgttcataaaaatgggaaactaaaccaacataaatgtcagtttttatgttaatatttacatttatcccatggagagactgaattgtgtagtaatgtgattcaatatttgggggttagatattttggtaacatttacagatcaataaattagacacattccatcttaaatgatcagaaatagcttcgttttccaatgcgaggccaacttaaaatttccagcagggtacattccctgaagaattgttaattgcacaagtgctataatagtattacattttaactacaactgtggtagattttcaagcatctcagaggttataaactagtcattaaaattcattcctgttggcaattgggtctgcagagcctctagccagaaaagcacgcttctaatatttatgtgatttccattttaacacagccatttgaattgcttgtaatattccagcctttgtaatgcactccctttcctatcctgcccctacaa

SEQ ID NO: 34293 - DNA, 1732 bp, Bovine  19866880882569
tcaggtgggaggattaatgcgataaaggaaataaatgttgatcccccacacctcaagcaattacttagtttcacagcagttcttttgctccccaggaaagcatgtttggaaatatttgactcaagatagaaaaaaatccttctgaactgggcccagtttatcctctaccctcacaaggagcgagtgaatgatcagccagctctgtccaccagactgggaatcctgaggggctagagtcatagtcaatttattcttgtatctttagctcagttctggtttgccatgttatgggcacttcctaaatgcttgctatgttaaaggatgtctcaatctcagaaccccactgctatatgccaagcacctcaatgactttatctttatgatggcatttgaatttcttcaccatcagattagatcttatctcccgagtctccttcatttccagagctgttatctgcttagaaaacaataatttagaaagactttgtattaagaatgtcatttcaaaccgcttgactgtcttgggttatagccatttgattatatagccaaaagtggtactgtgaaagcctgcagctttcttggaaaacccatacggctcatactcgattataaaatcacgtttgctacaattggaacagagcttgtgtcagcagagtttctctgatgagaaggtgatttgaactgaaatgtctacattgttttgtttacttgaggtctaagtgtgtgaccatttcttcatgcttcattcaatcacattaaagccttactgtaaaacatcttactcaaacacaggatttaaaaaatttagtgaattccaaggatggggaaatgtacattgctccattatttctattttaggggtaaaagaaaaatgagactgagactaaaatgagtataggtcaaagagaagcccaggcgtccatacaatattattttggattaatgaaggggaaaggtttgtgtaaattagtgaaatctgaatatgtattacaaaagtacaagattattatttccagtgacataaaattatgcagagaaaatcttcccttgatatgttctacttagcaaattatttgataataagacagagggagttggaattaaaattgattttatgcaacattgatcctataagtgagagcagtcactaaaattctaagctaaactactgagtttccccacatttcatagaaattaaaaataagggaggaatagttgattaatcatgataacagatatcaaaattataggaagaaagtatcacagtggtcttaggccaagcactaaggattgcacgagtccggtcttggcccagctttgcttccttggttggaagtctctgcggaggtccatgtacaaagggcatgccccctcttgcaggggacactaccctttattacttaggattttggtccagtaagttaagctggaaccataaggagggtttctttttcctaggatatttaggattaaaagtacacagaaagtgaaatgtaagacctagtcttgctactttttaagtccaaagaggacttttccatctttcctcttagtgggaaaagaagccatccgaagcaaatcagagacagcaaggggagctaggacagaggggcgaggtggcttccctcgtgtgtgggctgaagtggcccaggcttgtttcctctgccctgccgtgctggggagagagagcaagacagacagagggacagacagagagaaagagaacaaa

SEQ ID NO: 34294 - DNA, 1613 bp, Bovine  19866880886455
ctgtagctcctaaagtgtggttccagatgaggagcactgaaaacctgccagataagcagtccttgaaccccaccgcaagtttacaaaatcatgaattatggagtgggtcacaggaatctatgcgttacaaaccctcccagagattctgatacaaactgcagtttaagaaccttgtgtgcacgtgcgtgaagtcacttcagtcgtgtctgactctttgagaccccatggactgtagcccaccaggctcctgtgtccatgggattctccaggcaagaatactggcgtgggttgccatgccctctttgaggggatcttcctgatccagggatcaaacccatgtctcttaagcctactgcactggcagccaggttccttaccactaatgccaccctgggaagccccttaggaaccttaggtcaacacaatgaccctaggcaatctccagggcttcaagtaccacccctgcatgtgccggcaactcttgagtcaagctctactgtgctctaagttagcactttgaactaacgcctggatatttacccttggaggctcattcagtcattcaacaaaccccttctcaatactctctataggatgaactgtgcaggagttgaatggacagatacaaatatgtttcatgtaatattggggatatacttatgcaaaagaattgctggttcttcaattcaaattcaatgagagatttgtgcttttatttactccacctagcaggagctataaagtgaacatcaaagagtaaatttttactcgagtagtacagagttcaatcaggaactcaatgacataaacacagtataaaaaatacagttaccctcaaattctcacatttcaaaaatatccctcccctcttcctatgggggaagaggttaacagttccaaggtctttttgggctaagctacttcaaaggcctcttctaaattttccccaaaaagagattccgaccctagaattgagggaaaaattgtaaggcagagaggagcattctaatcaagtgtgtgtataagaaaagggttgacatatgaatcacagtggaaagataaaggccttaaattaactcgggtgctcatttctttaaactctgatctttatccattgttatatataatgaacagtaacagcactgttatttactatatgttaaaggcattttaataaagattggatccatagtttaaaaaaatcatacccagtgaaaacttcatgatttggaatttggatctaaagttaaagtccttggcttacggttcggaccacagactgaagccttgtggctcatctggtagcatttttccctattagcaggccaaggatccagggagagctctttgacgttgggtttacgaaccctgatgacaacagtgaacgtagaacagtctatcaaccagcatctctggcaaaaagaaagccgatttctgaaacaatggattggggaggatgcaaaatgtttgacctgctaattttttattttctgacagttttctaaaacatagagcaaggcaattaaaacaacaacaacaaacaacaaaacccgggtttccagcaaagacatctctgtctaactcttaactccgagcgaactcattttttaaaa

SEQ ID NO: 34295 - DNA, 909 bp, Bovine  19866880906519
gtacacagagaaactagaaacccaacgaggagagagggaaacaactgctctcgaaggaatgggacccgtgggaaaacacatcttcaaagtagactaacacatgaagaactttttcttccacagttctgcacatttccatttactatgcacagaatcatttccttaagcagaatgcatttatctctccaagacagaaaaccgtaatttaattaaagttaaaatgaagaacttaaagatttgctacattattagtgccctttgaaagagttaaatgttcccttgctcagatctcctctcttcccgggcttcaagataagtactgggagatttatgtgccatgaatttccaattacccatctccaccagctgggctgtcaatcaccacttgtctcatcctagatgtcttcaccacccccatttccttgctgtgcacacagaaacaagcttattcttcccaaaagagcttaccaccagtcaggcaaatgctggtttttttaatgtccagcttttactggacagaatttctgactcaaatgactgccatcccaatcattccaacatattcaaataaagccagagctgccacagattgcaaacaatttaaaatttcaaaagagaatttacatcgtgtgtcttcccagtgtccagtgaagcagaattgatgagctctcaagagcaatccctcccccacctttgacatcttgaagcaggtgggagaattctaaatgattactacactcagacaccagaagaataaagaaaacagtgcgtttgcaaatgtatgcttacataatagttgcagatttggaggaaaaacagtggaagctcttccttgcttttggccacgggtttttgtctggaggatggacatcctaagctattaaaaactcttaaaaggactttagaagg

SEQ ID NO: 34296 - DNA, 1034 bp, Bovine  19866880965382
tgaggcagcaacatgggaaatgcattttatacaaaatcttcagcactctgatgtctttttcttagcaaactgagatttcaagtttgctcctgaccaggtgatcagaaagaccttgaacaaagaaaccatgcctatggccactgaataaagcaagcaaactacactaggaaagatcaatagggattgacagagattacgcagctccacgaaatcgcccaacgatctctttaaacagacaaggcttagaagagggaatagagaggagcacatgcctggaattaacatcatgacaactgcctgactctaggctctgcattttcttttatttattcatattccatctttccacaaaaaaaatgcaggagagagagtaaaggattctcatggctcaccaaatcttattaatccagcaagatgatgttacatacaataaaataagaaagcaaaggcaaaaataagttctgtattttgtgcttgatgtagaccgcactacagagtcaacatttaattgccatctcctcttttccctgacacctattgtctctcaagttgtgactcacacgtcacttcccaatggatgtcctctctaacatacagtcctatgcaaatttacaattacactatagcatcacatggacggggaggcctggcgtgctgcgattcatggggtcgcaaagagtcggacacgactgagtgactgatctggtcacgtggcaatttcatatggatgtgtctccgtcccttagatcccttaagcagtacaacagcagtggatacctaataatattcgttgggtaatgttatggactgaatactgtatcccttcaaatttgtataccaaagacccatcccacagtgtggctatatttggagatagggcctctaaaaaatgattcaggttaaatgaggtcttaaagattgggccccaaactgataagactcagtgcccttacaggaagggacactagagcccagagaacactcagtacctgtccctctctctctctcccccttcccctcccctcgtgtgtgca

SEQ ID NO: 34297 - DNA, 1424 bp, Bovine  19866880999957
catctataaatgggacagcatttttcccaataaaaattcaaaattcctcagggaaaagatgccatttagctttaaaatataactatattttagtgcacaattaggaaatagactttctcctcagcaccaactatgaacaattgaaacataatttgcctgatgtttacagctgagagggaatttgaggacacagccagcatgagtgataacgattatcaagatggatgataatgtctggaaatgggtaagaatggtgaggatactatttattattcttgcctttgtgtgactgtatttgtcaacttctttccagagagcaagttttgattaatgaagtgggaaacaggaacaggccactcaggacaagagagacctaataggggaaaagccagtagagaaaactagagtaagtgaagaacagctttgtttaggcaaaatactcatcctcatttcagaattcagaaaaggcaacaaaagtgagagaattgtagctatgcaaattatgtgtgtttccaagtgtaaggggaggcttgtggtcggatttgccacaccgtttcctcctcactgcccctgtctccccaaatttacaccttcctcctttctttcaatttctcttgaaccttctgaagaaagcttgctcctggccagggaatactcctccagccaacctggtttccaaatcagaaaaccaggaatcgccaagcacgagactgcaggcgcaagtttaaagtaaagtgcgtcaggtcccatgatggaacacagttattttatgatagtattacagttctttctttgctaattatccccaccattataataccagccatgctgttttcatttttcaaacacaattccttgttaacagtcagaaaatttgcaaaaggaaaatatctgatgagttagaacagtttttgtaattaattttgtaaaggtagaatgattactcccaatcaacttttcagatcaacaattaatcactttataatctggtgggtccttgtctgctacaaaggtgggacaaaaattttatgcaaaacagcaattattcacctatataagaatggtattaattttttatgacagaaagcttccttatattttccaaaaaaaatagctgtagaaaataagtgtaatttaaaaattaggttatatacatatatatatatatatctttataaaattctcttttgttttgtggcaccctgccaaaaaaaaaaaaaaaatcacattgctcacaagaaggcctgaattctcttgaccatgtgcaatttgtgtatacctttccagccaaagccaagccaaaatatctcagcaagacattctttccagcccttcttaagagtttaagaataaaaatattaagaaagatgtcaaaacaataatgatggtaaagagacggagacctatgtccagcatcaagttaa

SEQ ID NO: 34298 - DNA, 1673 bp, Bovine  19866881060850
cacaactgagctgtaaggtagaaaaaataattaaaataaaggatgtaataggcacattttaatttaaactatttagagttccatttggagtttttcctttgattgagaacattgcaatttaagaagaaagctggatttctagagtaacaagatgaagaagaaatttgaatttaccttacatgaggaataatccaaagaactaagaatttttgattgaacaactgagcccatggtagcttaacatttgaagaactattgtatgaaagagaggatacattttcctctgtgactccacagaatggaactaagactaataatttaaagtatcatgaagccggcttgcatagcataagttaaatttttccaacagagctgttggaaagtgtactggaatctctgtgtagtggtgagctgacaggcgctggaggtattcaagtagaaggtagctgatcgcttagttggaaaccagtataaaatcactggtagtctcagctaacttttaaatttcctttcagtgtttggagtctttaatattatagaaactgccatgtacttacagagtgggtgttagcacacctttcttaaaaggtaattttatcgaatactttcattatggaactagatttaaacagaaacaagtaacaacaacacagctgcaagttaaagcaggcaagtagtcggtatggagagaacaggatttatgtacaattccgttcactgttctaaacatttgccaaacaataattatttacttttggaggaaaatccctggtgtgtgtttccgacattctttaagggaactgatgctgaatgtttttctctccagctccagcttgagtcttaagtcttggcaaaggaagaagccaggggaacctttactctgcagaaggtgaatgttcttggctgtgatcgaggtaactctgcagttacatggggctcattatttccatctcatacattgaaaagacctcccaggaagagctgccaagatgtccacagcacacgtggacgcctcaagcaacactaggacctttgtggccacacggggggccatcatgcagcactctcagaagataagacctgttcttcccaccctcgctctccgccgaaactcccaccgccacttttctttactgatctgtagttaataaaaaatcatgcccatctgagtagaatcttgaaagcctccttttgtattttacaaccttggtactccaagtgtggtctgtggaccagaatcagcatcagagggagtttgttagaaatgcttagactcagaacagacctgctcagccagagcccccattttaataaaatctccaaatgatttctatgcacattaaaatctgaaaacctctcttttaaagtatctactcttgatattacacattttataagcatgctctatggtttggtagttcgtcacagtgttctatagttgttcttagccaaaaggccaagaagtgatttctctcacattgttctaacttcacttttcaatccttcaaggcatatctcttaggttgaggatgataagatttttggagtcttcaactaatctttgctctcaatcctcagcacccaattgcccaccaattatagaactttaaatcttcccttctgattgttccccctgactactggctacaacagaccgggtaagcctccatcat

SEQ ID NO: 34299 - DNA, 1024 bp, Bovine  19866881099920
acatatacgtgtgtgtgtgtgtgtatatatatatatatatatttacatatgttgttgcttgactggaagagacagagaagaagccctaaacaacaacaatctataaattcttttatgggtttaattggagggagttgaagtccaaactgaaaacttcaaaactgtctggggaggggacagtcaagacatggtcaagtcatcaggttagagtaggaggaaatattgcagatgcaaatgaggttggagcctgaaacagcaaagtcatttccaaggtcagaagcagcacaggtcagactggaaatatgggtaatttattgctttttcaagataagtggcagaaacaggtcaggcttgaggcgggatttctctagcccaggaagtaagccttacattttaaatacctgtatccccatgctctgcttctctttgtctgccctggattatgggttgatcctcatatacacagattgcatatttcttcaagatgaggaggttaagaaggtcaccccattaaggatgtcaaactccaggcaatggacaaacatgcaagtagagatgttttatgagcagttagaactcagctggagatgtagctggtggcaaggagaggtcggtttataggtgttagtgggtatttagtattggctgagctcactatgcattaatgcattcaggtgtctgtatctctcagaaattctcattttgtaaggcaatggcaccccactccagtactcttgcctggaaaatcccatggacggaggagcctggaaggctgcagtccatggggtcgctgagggtcggataccactgagcgacttcactttcacttttcactttcatgcattggagaaggaaatggcaacccactccagtgttcttgcctggagaatcccagggatgggggagccctagtgggctgccatctgtggggttgcacagagtcggacacaactgaaatgacttagcgtcatgaaataatcttctccgatccttagaaattataagatagtttgtaacccaagtt

SEQ ID NO: 34300 - DNA, 1050 bp, Bovine  19866881149163
aataaatcatctactggagtgacaaagcatcaccagcgaagtgtatccccactgccaaaactggggagagtttcccattaggaagtgtctctgatctaaagcctggagccagcaggaaagggagggagtcagtctccggggagaggagggagtcacgctgttgtcgaggagcagcctctgccagcactcccatcttggggaagagcattcgcagcagtattcaagatgctgccaagctgttcacccgctgcctgccatcctgcccaccgggcccgatcatcttctgaggaggggcaggcacgcaaattgggacattctacaaaacaaaacacagaatcccctcaatatgctgccatttccaccctctactgcctcaattcaacacacagaggcaaacgcataagtgcctagagagaatttttcttcgtttcggcatggaattaaaaatacaggaatgcctccccttagacaaaacactgccatgcacaacggagccagatcgaagacccttctgccaagatcctgcttttctccatgtataaaggaaacagttccaaattggactaagagatcacttcatggaaaccgaagagacctaactgcctgcgcccaggtgtcacaccgatgatcaaacagccactcaagtagatgcttcaagtgagatgcaaggaagggaagaccctctgaacagaacttggccagcacttcacaagcgcaccatcactccagccccagtatgccaactctctcccatttctccgcatacagttgcatagtccatttactcccattctggaaagtctgtttggcaaaacaatggtaatgataataccacattaacagataacagcttgttcccaggaaaaaactggatgtgtacacccacgtgtgtctaactggaaaaacaaacagactgggtaggttttccgaagacccagctgcacgtggagctgtgtacatgcaactcacaagcagagcctgctgagctgtctccactgcactgggctctctcattcctcccctgggacaaagggaagacatcagttccat

SEQ ID NO: 34301 - DNA, 794 bp, Bovine  19866881215643
tgtttcacttgatgtagcaatacatatttatgattttaattattgttttggcctcagaaagtgtctgttttataaagatcagcagggttcatgagagacttgatatgttgacttgttgactttttttttttccttagactattagcaattaaaataatacactgcggtggggaagtagtttaataaattcatttaaacatgttaaagcctttaagaaatataatgctgagacctcttttcattttaaagtaattataaagcccacagggtctggtgagcatggcataatccatgcagcatgtagagtgattaacttgtaaactgggggggaaagtctcacatgccacctcccctttctttacctcattctcatcttggtagatgagcagtggctccaagaggtggaggttaattaaatctgccatctgtgtgtgcccagtcgtgtctgaccctgcgaccccatgaactgtatcccgccagactcttctgtccatgggattttccaggcaagaacactgcagtgggttgccatttcttcccccaggggatcttccagactcagggatcgaacctgcatctcttgcattggcagggagattctttaccgcttctcaacccgtgaagcccatctgggctctggcacttctattccccagagactcaactcatcagctattcctctgtcctgtttcttcaagctcggccactgcctgtctctctgcctaaaaaatgttcatttccttccattaatataaaataatatcattagaaaatccttcacctttaacagagat

SEQ ID NO: 34302 - DNA, 1275 bp, Bovine  19866881322338
atcaggcagtgagtgatgaatgtgtcagttccgccagccccctagttctcagcccctagtctctctctagctctccatctgatcatgaactgttacccttcatgtcactatgtataaaacagataactagtgagaacatagtgtatagcacagggagctctacttaatgcactgtggtgacctcaatgggaaggacatccgaaagggaggagatatatgtatatgtggggcttccaaggtggcactagtggtcaagaatccaactgccaatgcaggagaagtaagagacatgggtttgatgcaggtgacttaagagatgtatgttcagtccctgagttaggaagatcccttagaggaggacaaccccctctccagtattcttacctggagaatcccttggacagaggagcctggtgggctacagtccacgggtcgcaaagagttggacatgactgaagcaactttgcatgcacatatgcatgtgtatatgtatggctgcttcattttgctctacagtagaaactaatacaacactgtaaagcaaagctatatgccaatgcaagctactttttaaaaaagtgttctgtttcagcattaaaaatgcatgtgtcaggggagtgtgtgatttcctcagttctgtcttgctgcagcaaatattttaaatggtgtaccagtgttacagctcggttacacctcagggttttattcggcaagtaaaggaaagtacacccttgaggcgtgagggcgggctgaccccaaaggaaaggcctcaatgtgtcttggcttcctctttttatatgttttgtctcctctcccctgagcccgccttatgcaaatttggctagccaagaagggccgtgtttgtttcacctgaagttctctctccggtcctcggattttcttttgttgcattttcgtgggctttttcctttctttgtctttcaaccactgccatttttcctattctaactacctaacaattacttaatgtaaatacagctggattaaaggtttatatagatgtacaaaaatattaaatatagcaataaatatcaaaaagttttctttaaaaaaaacccatctatgttgtcgatgtgttattgctcttctggtctcatgttcttattccattattctttataaatgaatgacatgatggtttaccatagattataaacttctagtgggtaggataatgcctacctaatcatttatactcagtgtcaatccaagcatcacaaaactttaaacactaaaagaaaaaatcaatttttt

SEQ ID NO: 34303 - DNA, 1431 bp, Bovine  19866881327537
tctgtacattaagacagtatcattgagaactcaccctcagtgtctgttaaaaaattaggatgaacaaccatcctcatttgcccaggaatgaggaggttcttgagatgtagaaccttcagtttttaaactgggatggaggagtttctcaagacatgaaactttcgttgctgtaactgtgactgtcttgggaaagcgttgttggtcaccctcctccaaaacaaacaaataaaaagacccaaaacaccaccaaaggaatacaagattctcttgaagctcaaataatgggaaaagaccaattctccttctaaaccaggatgttttcttttatctgctgatgagaggtttgaaagtctcatgtttccctctttgtcttgacctctaagaaggtccaaaggaagttctctgaataaggtcagtagcatctgtcagtctaggctgtctgagataattgtttcattgactctgctttgttttgtttaaatccttcttctcttcagaagtgttcacatggtataaattgcacccagaattacattaaataactgttgccaagcgaacgtgagagcacacctatgtctttggcttttttgcttctcttcaattggctattatttcattccacgggtgtattatttcaggggttggcaaactatggcctgtgggtcaaatttgggaccactgcatctttttgtaaataaacttttattggggataacatccatacgtattaatctacgtattgtccatggctgttttcaagttaccagggcagaggtgaatagttgtgatggacactgtgtggcccataaagactaaaatatttgctgtcaagtttgtccctttctccattatgtcacaaactgtaaaccctttggaaaagattgctatagaatttcaaattatacatatatatctgtataatttgttttcaaatgtagtttcaaagtttatatgtatgtatatatatatgttgtgtttacaaaagtaatatatgcttattataaaaatgttaacatcacagaagtatgtaatgatgacagtaaccatcctttgtaaaatagttttatctattggctgtgctgggtcttcgttgctgcacaggcattctctagttgcggtgctgagtggaggctagtttctagttgcagtgctcaggcttctcagggcggtggcttctcttgttgctgagcacaggctctaagggggatggggttcagtagttgcggttcccaggttctagagcacggctcaatagctgtgacacacacctttgttgctccgtggcatgtggaatcttcccagatcagggattgaatccgagtctcctgtattggcaggtgaattctttaccattgaaccaccaaggaagcccagtaaccctcctttttaaacttcaattcctattggggcctcagttagctagtaatatag

SEQ ID NO: 34304 - DNA, 575 bp, Bovine  19866881396954
tgtggttccccaagcctggctgctcgccttaacatctacacatcacgccctcctcccttctctttccctgctgcccctggcttcctactgccagagtggaaggagagagaaccgtttccttttgttagctctggctgaagtgacagagttgatcgatgagttgctgtgcctgtccaggaaaaccagtttgattgccctcctgtggctgggctgacagcattccgccttttatgaactgaagagtgaaggactctttggagctcagttttgcctgtttatgatggattccagctgtattttctatgtctgctgttgttatatcattgccattagtattaatttctggttagtttattggctgtggatttataatgactttacatcataaacataaaaagaggaaaagcaattgaatgaactttagatagcgagtagacccaagtgaaaaggagaagatacttgaggctaataagattcacgtagctggacaagtctagcttgcaggcagttgtgcttctgggaaatggagccctatttggattgtaacacttttccatacttgttgaaaatgaaat

SEQ ID NO: 34305 - DNA, 922 bp, Bovine  19866881580700
ttgtatccatttcactaaataaattatagagagagtgttatggttgatctttttattcctttccttactttagaaggtaaaatttaaatgcattctttttcttaaaaagaaaagtcacactgtgagagaccattgatttacattactttgtgtggatggaaacatatgctgatgaagaaaaagaaaaaccaaatcacctgtccatgaaaatataagcttagatgtgagctaatttgcccagctttacagcttcagtattatttctcattgatcagtgtgctttagttttctttcacattaaacaactatgccttttctcccagggatttagagttttagaactatgtgttcaaacagttaatatctgagggacttgtggtgactgcaacaggcagctctgatgtaaattgtactctccatgtaaaaatacagtcttcagctattaagtacaatggatatggtttctgagtgcctgtctaaaatgatttaaatgccttatatgtccaaactcaaataactacactttaaaatactgcaagcacattcattaattagattagcctttaaacttctattgttaactagaaccccattttgaaatttgaactgaattttccatggcttattatagtcattacagcttatcactaagatgtgattcgccagaattccagaagcatataccaatcatatgtccctaattttctcaatgaatgccagccttgcttagtattttcatatatttttatatagccattataaaagcacaggattattgacaaatggttactttctaactatagaactaaaacaagattctaataagggtgttctgtttgcacatgctagtatacattctgccctacgggttaagggtgtcagattattaccactaaaggttagctggcactttttaattgca

SEQ ID NO: 34306 - DNA, 587 bp, Bovine  19866881609245
tggcatatagtgaaaatagctctgaagttttgattaagaacaaaaaaggactgtaaaaagtccctcccctcctctctttctctgcctctttgctctttttggttgggtgggcgcttctgtgtctctgttgcagggcagagactgtcaatgctgggagacagccattaaggagacaaatccaagttcacggtagcctggaggccagtctggagttcaaagatcctgggcaagatttcaaattggctccattcaagagctatggacttgtgagtggcagactctgcttccaggtcactgctgatgcagtttctcagtgtcttccccagcaatgtgacggaggaccaccgaagatgtgtgaccaagttagggaacagcaccgacaaaagcaagaactgggaaagattgttattcagcaagacttgttaatgcaaaaccacaatgatccactgtttctacttaggatgaaaggatcattcagactaaacactagtcttccttccaagttaatcagttgttgcttagtcactaagtcgtgtttgactctttgtgactttatgaactgtagtccgccaggctcctcagtccat

SEQ ID NO: 34307 - DNA, 858 bp, Bovine  19866882060570
tgtgacttgaactgttcagtctattatgtcttagctccatcactttagcctcaacaagcagatacccaatatgccagaatctctccggcatcgttggagaaatgcttttcatttcattgtcaggacatgctgtgtcccctggtagtgttttgtgcacagtttctgattttcattctccggggggtatctgcagttctgaaacaattaagttcaacctggcatgtaaattgaagcatgtcttgcaaacatgaggtgcatgtggtgactgtagtaaaactacacattgatttctgacctaaggctctccaaggagtgtccccgatttcccaagggtaaagtttgtgagggaatctttgattaaactataagattaaagcaagtttaagtgactggacagctccctattcactgcatgttcgagacgtcttgagaacatgtgttattcttttcaaagttggttgtaaatcaaactctctaaattgcttccagatcagtcttttcaggcgaagcattaagatgatggttctaccagccaaaatgctaatgtttgctccaatcacacacacgattatatattcccctttcctaatatagaagaaggagatgccaatccagccagtcatcgcttctctaggtcagcagatgtgctgtctgcattagaagatgctgtcagcaatttggtcacgatatagctcagatttttgagagctcagttgtgtgtctccgtgaaaagactttggcataaattcccaaaatattcttcttctgaatactgaatgtaatatcagatgaaagtagaatactcaagctgaactaaagtagacattctgacaggaaaatattttatagttcttcaga

SEQ ID NO: 34308 - DNA, 905 bp, Bovine  19866880112089
aattgatgcttttgaactgtggtgttggagaagactcttgagagtcccttggactacaaggagatccaaccagtccatcctaaaggaaatcagttctgaatattcattggaaggactgatgttgaagctgaaactccaatactttggccacctgatgtgaagaactgacttatttgaaaagaccctgatgttgggaaagattgaaggtgggaggagaaggggatgacagaggatgagatggttggatggcatcactgacttgatggacatgagtttgagcaagctcctggagttggtgaaggacagggaagcctggcatgttgcagtgcttggggttgcaaagagttagacacaactgaacaattgaactgaactaaattgatgagtgtaaactgtgtaccttgatttccaatttgaaaccactaaacagttcatctgaattatatattaatttctctgaaataagtgacatttccactcagatataaggatctgagtgagattcagtgagaattaaaagcattaggagaaatttatttggcattaagaaattcaactgatcttttattataaaggaaatgaacaatgaccagtaaatctcattaaagaaaggaagcatttaatgtcttaaaaatacttcagagactcccctgttggtccggtggttaggactccacacttccagtgtgggggccccgagtttgatctctggtcagggaactaagatcctataggctgcacttcgcagcccatcacaaaataaaaaactcaagttttaggtttaaaaataagtttttttgtagtagaggccaaaacttttttcccacaaggagatttccttcttaaaagccagtatttttatataggagcatgattcttagaatcaataaaacatgttttttcct

SEQ ID NO: 34309 - DNA, 767 bp, Bovine  19866880380944
ctgacttgtctatttctaaattgctttgcactgaaactagtatagaaattgtcagatgaaatccaagttttgttgtattatagagggaaaaattgacactagtattttctactactttgtgtcacagcatttaaaaccctcatatttttagcagattcagatgctttttacttgatgtttaattcccgtgaacccaagtgaggaaactgacagcctcttaaatgggcttgtttcttttcctgtgttttgttataacatttctgatagatttatttgaaaagtatttactgagtagatgcattaagtattttgttagaaccaccttagaatatgaaagtgtctttacaaagcccataggaagtcagatctaggtttacggtgaatagagaaacttataaaagcatcaactatgatgacattctggaaccagttctgtagttgagaaagtgaataattgtttagtgatcaagttttgggattcttattctccttgtctctcctcaaattgtattactttgcaatcattattaacctggctgattcctccctcgccctcttctttgtgagatgtcattgttgctatcagtagatgcttctatgggaattctcaagttgcttttatcttatatatattataaatataaaatataaaaatttaaagagagattcctttaaaaaaaagagcaaaacaactgtggtccacaggcacacctcagagatactgcaggttcagttccagaccaacacagtcaagggacaggcaggaa

SEQ ID NO: 34310 - DNA, 2127 bp, Bovine  19866880514515
cagaaatttaaagccgatgatcgttttccttcttttagccctattagcatatctttgaagataaaacttttaaaatccaaatttgaagcctttggtgagtgtgagaattctggatgaaaggcctccctttgctatgcaccccctttctgaggggactcctggagagacgccctttataaatgcggccaggggcagctgggtgatgggggtcagccagcaacggagagcctggcaccagactgctgaggtgggttgggggacacaggagagaaatcagggttctgagggtgtgcccaggcagtgccagccagcactttcccatccccctcttccctggtggctcagatggtaaagaatctgcctgcaatgtgggagacctgagttcagtccccggctaaggaaagatcccctggaaaagggagtggcaatccacttcagtattcttacctggagaattccatggacaggggagcctggtgagctacagtccacgggatcgctaagagtcggacacaactgagtgattaacacacacatgtgatcagtgtccatgtctgcagctcgccaccttcttggcctctggtgcccccccatccacagactgctggcagcccaaagtggagcagtgaccgttgcaaaacaccttttaccagtgagatgagtcctctggcttgatacatagttgctggggaaggggaggaattggagaaccacttgcctgtatagaacctgcagtagtgtgggtttataaaatcacagcttcttctgtcccagaggctggactgggttcagggctcaggactccttgtgatattaggctttaggaagaagagaaagcaatgccagactgaacagttactgcctgggcagcaggcacatcagtgaggagtgtcactggctgcagcagcatatgctttcttctttgggaggtgaactcagagacatgccaactaaaggccttgccagctgcaagcctctgaggtctctttggaggcccccagcaaggtctgtggcattcgagcagtacaggcagcctgggtgccacagggtggagcggggcgggggcggggaggcaccgggcaggaagaaacagcagcccttgctctcctggactctctgcatcagcagccgccaccaccttcctatttcctggagatgtggccccaggcctcatgtcatcctctctccagagaaccaagtcttccagggacaaaggtcacgcccaggcagatgtgagtgagagctggggttccaagtccagggccagcactcacacttcatggtgtcctcagccagggcagggttggtctgaatctgtcatttcatttttctcatcactctccctcttggtcagcaggttcctgaatttctccagactatggaaaatccgaggagaaggggagagaaaggcagagagagaagggaggagaatgagcacgtggcccatccactacctcatggcaccagggtggtaaacatttggagagaagccaatcgtctggcgcctcaaatcttccacatctctccagccaagattcagacctgtatattctgggctctttctgccccatttcaccaggctttaaattacccagacctgggtctgggttattttgtccaaaactttcctctggaaatccagattgtgatgcaagatatacattcttggaatcagatttctgaggcctaaatgcacgacagtgtggacttagcagtctgcatcccatttccaccagcccatggggtgaatacacagtgaggtaatcatcacttcctgctggctcgggagacagcaatagtacagataaattgggataacctagccagggctcagcttgtcctggctattcagagagaataaggaagagggcctcagatgatttgtacaatcaatcccaaggttgtcaaattgttccttcactgtggaattattggtttcaaaatccacccctagattctgttatgacagaagatcattttggaaagacaaccaaagcccaatcccagagagtctcccaacaagtgctgtagtaataatactggtgataataatggggttaataaatatcactttgtgccggttaagttcaatgcttcacgtgggtctgggggagggcaaggaccatc

SEQ ID NO: 34311 - DNA, 1340 bp, Bovine  19866880567858
actccccaccctcgaagcatgactccctgtttctaacactatccttaaggaatctggcttctgcgacttccagtaattgtacaaatcacccatgatgaagcatctaagagcactgttagacaaaagaaacaaacattaagcaaataggaaactcattaaaatgctgcctttggttacttttattcctagcaatttatgttatcaaacaagtctttcttcattgcttttccctgaaagtaacacttcaaatgaatttcaatggccactgagtgattttctccagacccacataatccagccatgatatgcactttccctccccgccccccaccaaccagtactcctccttgtcaccctagagcctctgacttagctgtgttcacacccagaagtcccaggagagctttcttctcacattatacaacacaaaaaagcaggcaatgaacaaccaacccatgctcctaaatgcttgcgataaagccagactgagctgacctctcccatcccacagagctgcatatcaggcacataaacttaaaagaaccacgagcagcctgtgtgtgatatatataaacaaactaattaaaacccaaggtctttcattctagatagtgcctaataatgggaccaatatgcttgactctgtgcaaaaaaaaaaaaatcactccaagctggcaagaggtattccttttcctgctccctgtgaaacatctctttcaggctcaataaacagcctaaaagaagaggaactcaagggttgccattcattcctgtaagacttttcaaataagaactatcagcttggcagcactgagccaaaagaccactccctgattccaagtggacatattgatcaattgcactgacatgtgcctcctcctttctctcccttagtaacaatcagctgcaccagggaaatccatttcccaaaacaaaaggcaactcactgctccttatctgacaatgccaagtcgtgtattttttttaaaataataataatggtgatgatgaggcctaaagacagagataggagtttaaataagcaccatacgtgtttatcgtagagtttcagaaatgagttgaggttatgaccaagcccagagatctgttttcaccacagtcgctgagggttcagctatttattcatcttgccagattctggttaaagttaaacaacaccactgccacttccagaggctctccacagggttacccttcactgcaactgccgcagaggagacttggtacaagtcagcctgcaaataactccagctattttggagactagcgagagatgaaaaaatatcaggcagtttttcaacaactataaggccatagac

SEQ ID NO: 34312 - DNA, 1384 bp, Bovine  19866880575140
ccagaagaggaatctactatatgtttaccctctccccataatattacatgactcatgtacatagattgataaaatttatgtctcaccaaactgccactcttctcactagatttaggacctttaccattatgtctacatagacattttaaagaatacgtatttcttattctttgatttccagatgccaacagaatattagattacaagcacaaaattgacatcatgttcaaaataaagagaatattcaactttctgatttgtcaagtataaacttattctcaatgacatgtcaatgtctttaaaagagggaattttcaaaaaacaaaatttagaaacagacaaaatcttcaacttcaaagaaagccaaattagaaaaataatgaagatcattttatttgtaaaagatggttattgatgataagctgttttattttttttaagctgttttattaatatttacttatttggctgcaccaggtcttatttgcagcgtgtgggatctagttccctgaccagggagcactgagtcttagccactggaccaccagggaagtcctaatgacaggttgttttgggtttctaccatattacggtgtcaacactcaactttttctttgagtcatttctctttccttattccaggaatcttggtgagattgacaatcccagttgtcctgtctccctcacccccggaatgagcacttaatacaggcctcctcaatcagagtccttcctcacaaccgatatttgaacaaatatggaaagtcatctctttccacaattttcagtgacttgggatcaacataagcctggagttgcttgttggccaacttctccagttgcatggaagaagtccattttctaggacagaagaggccaacaagtaaaggaaaacagagggaagatagtgtaagagagagagaaaagggggagggagaaagaggcctgacctaataggatcactgatgccacttagttaagctgaaagctagtttaacccttgagttccccccagtacatgaaccagtaaatgtctctctttttaaaggggtttgtttacactagtttagttttaatttgcaattaagatcaccaatatagtacctctccaattttagtgacaatatctattattatggagaaataattaggtacctataatttctatacattactgttagattttcttttggtctcatgcaacagaaatatgactacagtttcttaactaaatatggattaatttattctagtaacaagaagtccagaggaaagaatccagctggtaccaatgttcaaaaaagtcacaagctccttctagcttcctgttctaccaccttaacttgcaacatgtgtgcgtgcttagtctctcagttgggtcctg

SEQ ID NO: 34313 - DNA, 3640 bp, Bovine  19866880582087
gtgggagaattaatttaaacaatgaaccaataggatggttaatcagcttgctttgcaaagaacatttgatttctcccctgaaaactgcagtggtgacaaataagcctgatctatgaaatatcttcaggtataatgtaatatgtcccttattgcctataaaagaaatgccacctgaatcacaggtatatggtgcgtgaattatcatggatgcttctaaattaccatgcatggggtcttcgctctgggttgtctgacaatggttcttctgtttttcaaactctacaactgctatttgaattattccagaatagaggtttcaaacttaaagggctcaggcagcagcagtgggggtaaatggacaggagcagagggagaccatgatgaattggagaatactgctccatctaaggtggtcaactcttgccaagtgagtcacatcatctcattcttagacaaaacccagaactgttagtcagttttttatatcaaaggggccatacagatggctaggtaatttgcaaggtccagtgtaaaataaaaatgctgaaccccttgcccccaaaattgttgagaatttcaagctggcaagagtagagcattaaagcaagtgtggacctctctcagcacagagccctgtgttgcagcacaggttgcctgcctatgaagcctgtcctgcagctatataaaacaaactcaggaatcacctagtgtgagacccattctaaagcttctacattctctccttatttccccttgggactcaaagtaacagggctggaagagtttggagtatgccctatagtgaaagaactgagacaaacatggctggtggctgacaaggagaataaagtatcccttgttctgaccaagtcttaaaaccaactgggggattcagctgttgataggtgtgtgcttgtggataagaaatcttaggccttccgaatccaaaatacataaaagtttgttgccatagccaaagtcctataaaaagtgatactccctggaaaagctttcacactcatggcccatctatagagctgggtatgtcggaccaccatcaaagaggaacacttaatccaccaagtgacagtcacaagttagatatccttcacacatgcatgaacatgaaaaacttcatgaaaatttataaaaatacaatcaaagttttgcatacattagttaatacgattgtttagacaaatgcttcccactttaaagtgatgtttgtaaggcatactaaggtgaatgaacaggttgcttgtggctagaggtgactggcacatacctccaccagcatgctggccatttagagggctcaccagagagtttttaaagatgagaactatctttcattaaaataaaaaaacatccttaaactgatctgtcatatacatttcatatttccatacatcaggtttacatcaattgagatagacatgtaaaacaattacaattatacttttcataacagcttaataccaacaaaatgcttattgccatattggctatggtcacacccagtaagattctaatccaaactcaagaagaaaaaaatcaaagctattcttcaatgcagcaattttacctccatgtgtaggccatatctgtatgtgtgcacagataattggtgtatctctgaaacataagtaaacagaaatagtattacggtatcaaaagaataaattattccactataaatttgcctgttttatttggtctctccatccccattcctgatagaatgtagtggggaagaaatctgcatctatctcgtcccactgctatgttctccaacattgcctggcacatagtagatactcaataaaaagttgttaaattgaattgaatacataggatcaaaacaagttatcagtctctgattctaggattttttaaatagagacatgtggcagaattttttccctaaattctactggcttttctattccccaaatagaacctaattcctgtagtcactgtacccagcaattctattgctttctgtcagcctctaattcccatcgctcacagagacatgagcttgggcctccttgagacaggatgggagaaacattaacttcttctcagaacctagaaacagctaatgagctctgaggaataatatttctaagtgttcaccaaaccagaatcaatatcaatgtgctgtcagtgtgtgcattagccccacagtcaaacaaagaacagccttacagcccaataatgacactgggtgtggataactgggatgggcaagatgatgcagagatgactgtattagctctcctcaaacacaaggctcccaggatgttgcacacgactgtcattcttgtactctgtcagaaataggaagcatttagactcagccactgataatattcagcaaataactctcttttaacttcttaatccaggagatggattcaaagtacaccttcctggctataagagaagtttactcttctattccttgtctggtgttggcagggaattcaaatgccttaaagttagcagagcactacataatgcagctgataagacaggtacaacaaacttgaatcattactgactcatgtaagacctcctttcagtacagctccatcacgcccacactcattcatgtagcatttcccatacacagatcctgctagaaaggtatgtagagcaagggtactggcaaaaggtctgaatatctgttgtgcattgctttaatctataggatctgaccaagattcatgctcatccctgtagtaaaactgatcttagtgttttaaatgagatttcattctctgagtgaaatctgattttccaatcagaatgagaagggtggggtgagtatgatagagtaaaggtggctgctctcatggtatacacagttaagatgtcataaaactaagatgactgggtaagcaggtgggtatcacagtcaaagcacactgatttggaatcctggtccagtcacttattaactctatgaccttagccaaatttggtaacctggcgaagacttggtttctgcaaaatgtaaataataatatctaatcctataaaatgagattgttactctctatttcataatgtcattatacgggccaaataagttatgttcaatgtttagttcagtgccacacaataaaaactaaataaataagagcttggttgttattatgatttttatttttatcaccccaccatggcctaattatccaaagagttaacttatttgtaactttgtaattcaatgaagaaagctataaccaaaagcatagagaaggttagtttctcataaggcttccatggtctaaacttggccatacaataaatatgatcataatgatctttctcttatcactgtgaaagaaaattctctacattctagaaagtttcagtgaaacaccacaaaatgcagccatagagcaatctctcccttccccggtacacacacacaccccatctaccccttggggatatattaaaactaagacaactgaaatagccttagccaataattaagacacacagctaatcagagagcagcacgggctctgcaaagaaaccgagcactcaggataacagttcccattattagggctttgttctccggagcaaaaagagcataaaagcatcaagtggggagctgcaa

SEQ ID NO: 34314 - DNA, 1232 bp, Bovine  19866880597509
tctgttctctatgtttgtgtcttcactgctgccttgcaaataggttcatcagctcccatccttcttgattccatatattttcattaatgtatgatacttgtttttctctttctgacttacttcactctgtataattggctctaggttcattcacctcattagagctaactcaaatgtgttcctttttatgattgagtagtattccattgtgtatatgtaccacagtttctttccttttatcttcctgagcatgaattcttcatgtcttaagtgaagataaaattatgttcttcactggattgttgtgatagttaaatatgatgatgcatataaaatgtcaagtatattgtacatggaggtagtaaatatattctttctttttaaaaacagttttgtgggtttgagaaggatagctcaagaaaatttatcaattactaattagtagccaaaattcttgcaaaatcttagtgattttattcatttccattcagtcttaaggatcatgtcttaggaagaactgtcagaggtagtagaggagttgttttagcctctgggagacaaaattcagagatgtatgagagctgtctttaaatgtgtaaagggctgtcatgtggaacagacatttgttctttatgactcaggagagcagaactatgatcagagggtgaaaactacagggaaggttattttggcttattaaaatgaagacacttccaaaaattgaatgagtgctctatcattgggaactgtgtgcatagctacatcagttatccagaatgtatcagcaatggaaggttttttaaatttagtttgaatatttcttcaacctggaagcattggaacataagctagatgaaagcagatttcttgtcttagcaccgtgatatcctcaatgcctagtactgtgtcagactgtgatctgatcgtagtactatcatatgttgaatgagtgagtcagttgcgtacttcaagtatgattatctgcgttcttcactcctcttcactctccttaattaagtttagttactgatttttggttgatatttttatatgtttgtttcagttaaaaataagtgaaactgtgaattgccatttggtaagaaaacaaatgagtggaattaaaattccactaaaacaaattagtggaacgtttctcaacagcaacactattgacgctttgggccaggaagaggttatcttgtacattgtaaaatttttagcagcctcgctag

SEQ ID NO: 34315 - DNA, 2858 bp, Bovine  19866880602856
tccctcacatggaggtgataattcatgctctatatgaatttcataaaaatatttggaagagcatgtggttaattaatctttgggtgataatccagactaaatactaaggaaatgtacagataattctcaatctgaaattgttttattgtgatccttttgcctgtggcaggttcgtgatgctgtgcacgaggatgtgttaggaaaagttagcagaagtaggtctcattatctatttagtgattattcaaagccttcctgggtaggagagggtggagatggctaatgaataatctaagagtaaagagtatcacggagaaggcagtggcaacccgcaccagtactcttgcctggaaaatcccatggatggaggagcctggtaggctgcagtccatggggtcgctaagagttggacgcgactgagcgacttcactttcactttcatgcattggagaaggcaatggcaacccactccagtgttgttgcctggagaatcccagagacaggggagcctggtgggctgccgtctctggggtctcacagagtcagacacagctgaagtgacttagcagcagcagcagcagcagcaaagagtatcaaggaacgtactgtacagaacataggggctaattaatctctgttgatgctggatagagaggaaaaaggaaacttgtattaaagcaagagagatatagattagacgtaatgaagaacttgctgctaatgagcattttaagttgctgagcagggcaagtaaaactatcatcttgaccttggccagctcagaaagcaatgaggggagttccttggtggtccagtggttaggactcggcgctttcactgccaagggccggggctcagtccctgattggggaaccaagattccataagcctcaaagcacagccaaaagaagagaaaggtagtgaagcaggctagatttcctgcaaggacctaaacaagttaggtctgctttctggtatagcaggcttcatttccccacaagcagcactccaacctgtgagcttggcaattttttagggtctctagctagaaaggtgccttttggaaacaagagcctgtctcattgctgtgaaagtgaacttacagttttaggaagatggtagatttcttaactgggagagtctttttccaccctccccccctctctttcttgctatttaaaaccttcttattcagtctgttataccaccacagacacagattcttccccgggggctcttctgcctcccacttagggaaactaccaggtcgtagcacttgttttccatgaactctcagaagctttttccaattttccaagagctctcagaagctgctattaggccattaactgctttactcaatgcccgctctcccgtcttcctcctcttccctccagtctggctacttcactgctcttccttcctctcacgttctccactgccctccctgcttccctacatcttcctttgtacctctctctcttctccagagagctcctccctccttccttccttctcctctttctttggttttcttcctcccttcttccttttccttctttccccttctgaaccatgcttgctgtaccttccccagagccatgaatggaaaaaatagattgcttcttgactctacaatagaaagcgtggctgaaaagcctgtgaagtgcgggaaagccacaacatgcattcacatttgtttattcattcaacagatatttgttgagtagctactatgtgccatgtccctgagattaaagctcttgtcaatctttaaactgagagagaggtagtcttgctcatctgacacataggcttaaatcgaagattagaagctggactaaaagaccttgtgttattctccagctctgtgttcataatcagtgattattgctacagaaaagtacagccagagccttttacaaatgttgcaaacatcccaatggctatactagtttgccttggaatgtcactagggttaagtgtggtaattagtttcctttttcccagccaaagacgccttcagcatggcagtatctggccctttcaaattctttgagcacccggtttctagaccattgtaatcaattgtttcctatgggcaaacccttctagataatgagttcatcctcctatcaggggaaaatacagcagcacaattaatatttagggatgaaaatggattactgttttctgagtaatgagccctgagtcatggttcagagctgaatatacagtgcaagaacaaaatttaattcttttcatgagaaccgacagactttacttcaaaccaactacacttcattaaaactctgataagagtctgcaaagcagcctagaaatcttgcagctgtgggttctcagagagaagcaaagaatccttatattgttcaagtatgacacaatgagtttgcaatggagtcaccccatcccagatatgttcagagttcagagtcaatgcattaattctcctcgcctgccacccgggttcccttaatggtgaaagggaggcagcatcaattctcttacttgctttagactgtgagggattcaacagccaagctggggaggtggggaggtgcagaagcccaagaaggatcaacttcctctgaatctgagtctggtaccaggaacagtggtttgagccagtcacatccagtccagatatggaggaaggaaaaatgagtagagactggacaggcccctactgcattagtgagcctgcctctggcctagggcttggaggggtctgaggctcctcagagaacatctcctccaggaagccttctgtaattcctcaggctaagttaggtgacttctctgtgctcgccaggtattttgtacatattcctttatag

SEQ ID NO: 34316 - DNA, 4035 bp, Bovine  19866880602857
ctgctctttaagttagagtgaagagaaaaggtcatcatttctcttgctgcttaaactagagcatgactcagaagaacaaacagggaagagacggctcgaatccccacattattttttaataccccacgtggtcctgcaggctccactcaataagatctaggactaaagtaagtctatctttccttacgtaactgtttacctttgcaaagccttcctaatctcccaggatgtgcagatggctacagaaaagaaactacattccttcttgtatcatatgggacagacacccagcaggcaagactggtttcccctagggtcaggcaagtggacagccagccccgtgtcagaacagaaggttggagctgagagtgtgggctgagcttctcctagtcagagaagggggtggggactgaggagagagcaaaaggccacctccccagccagcacaccctcccaactcaagagcatctgtgagattctatcattagagattccttgtctttgtctcctgagagaagacaacaaatcacacactgaattataagcaaatcggtgggaatctgttcatcatgtgactccctctggaagtggggctccggggcagtgggagttcttcattcacaatgctgctcaagccctgtccaagaggacgagagctggtgctgtgtacagggacagagcaggcaagtcttctcttcttggtccagccagggttggttttgtttttggtttgtttgttttaactgaagtacagttgatttacgtggcttccctggtggctcaatggctcaaatggtaaagaatctgcctgtaatgtgcaagacctgggtttgctccctgggtcaggaagatcccatggagaagggaatggctactcactccagtgttcttgcctggagaactccatggacagaggagcctggtggtctatggtccatggggttgcagagtcactgagcaactaacacacacacatagttgatttacaatgttgtattagtttcagatgtatagcaaagtgattcaattatatatatatatatatatatatatatatatattctttttcagattcttttcccttatgagttattacaaaatattgagtaaagtttccagtgctacacacctgtccttgctggttatttatttcacatgtgcaatgtgtatatgttaatcccaaactcctaatctggggaaagaacaccccttccccttccctccttgggaaccctaagttttttttctacttctgtaggtctatttctgttttgtatacgttcacttgtatcttttttaaaaaagattctacatatgagcaatatcatacagggtttgccaatggtttttaagactccataactagtcttacatcactggcctgctgagctggtacacctcttgcacacatagaacagcactgctttcagaatggacccctcaccatcttgatctgtagccaaaggttttcagcccagggatttcctggatataatgtcaaatcaggtgaatagaatctctttggttaccttggaaattctctctgaaagtaaaaccttggttttaaaagggaaaaagggaagttgatacctgcccagctccattttgggtgaggttggtggagttgcctttgcaaagttaagtgttaccaggtcccccacccacgctgtcccaaacaggctgcgtgagctagagcttcctttactctccaactcctgacaatacagtgtcccactggcaacttccaaaacacagggtatgaactttctcttctggatttgaaggctggaatttcagaagcgatttcaaattttgattgcccagttctcattttctgtggattttggcaagccagctgtttgtgacactattctcatctgctagccccaccctttggtgggacacatttcaaactgaaatcatcccatcttgagccatgagatcttttgcttcgtttttaaaaaagcaaaagagcctagcactcagctgcaaacaaattcctaggttaaagaacacccattttttgtcagcttaagcagatattctgactttctggggacgtttaccccatgaaaatgtactctctctcctggtggaatgcctcccagaattcgctgggtggatcaagtgacatttccaactagagaggcgaagaggaatggaatgggaaacacagtcatgattcttttcttctgcaaccaaggttttcaaggaattggctacttactcttttggccttggtatgtctcaagcagctgtattcacattttgttttggggcaagctctcactgtctgaattgctatcggccgtttaggccaaatcttgtgtctgaatctcggttaatttaggaacaggctagaattttacctgtatacctatcttcactttctgttttactttggagacctggattttttaggtagaactggaatctctcaatgctctcaatgtggattccctgtgccaaagcagctgcattacgaagttgaaaagggatctgatttgactttacttccatctcagtttctatccagttttagtaaagatggaaactgcacatcttcttttatgcccattatttccacttcaggtaaaaaaggaagaagttaatgtccaaacatgttcgcttgtctctgtctcagaacatttcttataggtctatccagagaggacagaggctgtgttgattctgcctgggaagactgagacaagtgggtttaaataattcatagcttttcaatctatcaaggcggtggctgtgggggttgtttatcatacttaaacaactgagaatgggcaggaactgacattcaaatgacaccaacatgagggcatgggatgggaaggaggaacaggggtggtggtggcagagcagaatgatgacttatgtagcagttcacccctctgccagcatctgcagcaatgctactcatttcccctatgctttgtttctcaaaccagaattttcagcttcctcctcccaaggaatatgtagccatgtgctgggcactggtagcccggggattaacaaatccatcttcctagaatacaaattttgcatgaaagatttgggggttgggacatgtaaagcaacttaactagtaatttaaatagttttatgtttaaaaagcaacatattaggaatagcataatttcaaatatatattttaacctaaaagaggagagtgaaaccaactcttccaacttccatgagtcttctactaaatcccaggcttccagggattgcatgtccacactctggcaggtgggatccctgagcagaaacatctgaaaaacccatcctgctgtatctaacagaagtacccaccacaccggtgtcccgaggctggcctgcagctggcttctgttgggcagggctgccccaggcacgctgctgtgtggacttgctgcgtgatgcctgggcccaaatgagccattccacccctcttgctccaaataaatcccccactgtctgcctgtcatgattgcttctcactggatggtagttacgaggccattagtagaaaacaagaatctgctctttccccatctgcatattggacaagtcttgcactatttagcttgtgaggcctgataagaaggcagcacaatttgcccattgactgctgccctcctttccagccccgagtaccagagtctcctggcttagactctgattttgcatgtccctagctgtcccccattgaatgctttcagtcgcacctgcgtggcacttgtgagcaaagaaaaagggctccctttgagctaattcaaactcctggccctcacacttgttccactcttgtctgtccccaagatctctaatttgaggcctaaacatgttggaagaatgctgttttcatgcgtccacaatgcactgtttattttgatccatactcctaggaacatgctgggtacttcccttgtattttttttttcccccaaagaaggcaggcactgatgacacggctctctctcctcttctttttcatgaggctctgaggtcagccgtgactgtgtccaggcataatct

SEQ ID NO: 34317 - DNA, 2919 bp, Bovine  19866880619242
catccccatgaattatttattatttacctgtaaatttgtaccttttgactcccttcatggatatttccccaacacccaccctgtgcctctggcaaccatccatctattctctgtatctgagagcttctttttttcttgcagaacatatggtatttatgtttctctgaattctttaacatagcatactgcccccaaagttcatgcatgttgttgcaaatggcaagattttttatgactgaataatatgccattgtgtgtgtatcacattgtatctatccgctcatccatcactggacacttaggttgttcccacatcctggctattgtaaacaatgcttcattgaacatgagggtgtgtatagctttttgagtcgatgttttcattctcttcaggtaagtactcagaagtagaattgctggatcatatggtggttcaatttttaattttttgaggaacctccatactgttttccatagtggcagtgccagtttacattcccaccatgagtgcacaagagttccctttcctccacgtccttgcgggcgcttgttacctcttgtctttgtggtgatagccattctgacaggtgtgaggtaatcgcttctcgtggtggtgattagcattttcctgatgatcagtgacagtatcttttctgtgtacctgtgcagatttttgtcatattacttctttgtgcctcagtttcctcatctgggaaatgaagatagcagtagctgctcaaagggttgttgtatgagttaaatacattaataaattttagctctgataccctgtaagcatgatgaaatgaatgctgttttcattcactgtcatttatattacagatagagaaaacagactgggaggttaagagtctcagctaagactctcaaacccactgccaagcaggggccctcacagttcaggggcaagaggatcaaagggtgtctctgtaaatccagagagaagatgacactccatccccatcacctcttcctgtcatatcttagagttattaatactttgctcgaggctcataatgtcttttctttaaactgtgttttcatttatttcctgtcaaagctgttttcttgttccccaaattaagaatatataaagaaaatatattttaggatgaaataacatgcaactctttagttatgcctgctatctctgaaaggtatgaaatacagttgtttgccagagagagaaaaggaaaatcatacaccacatgtacacatacatattagaagacatacgggacctggaagagggcacataatttttctttcatttcagtctaaaaaccatctagcccattctgtcaagcccttctctctcatctccctccacatctctgattcccacctgttggagacttgtttgttttttttctctctctctcccctctctgcatcctcttggcttcattctaggatgtcataggtggggctcctcagaggctgctgctaagataaggggtcatgtgaaaatgacgtactaggaagcatttccaggaaaaattggtgggaaggtaggatcaggaagggaggtctaggaaagcatcaggcaaagtcccatggagttgctcttggagacagatgagttcagccttcagagttgtcctcatcaggaagggatggacaaggagctggaggagttcccacctgtgatcaagggctgtcctgcccccctccctcactaggacagaaatgcccccgtcacttccagctgtctgagtgcaggcctgagaagtgggaagcaggtgctggctttgaaaatgaaggcacagctggagctggtgtgtatgaagatagtagatctgaggaaagactccatcctgtaagaggccgcgtgaagcccctgctgcgcagggctaaggaggccttaaattcttctgagtggaaagtctgcaaaacaaacacacctttctgttgttcgtgtgcatggtctctggacaaagttttgacatgtcatgctactcagggtctgttttttcatttgttttaataaattcagagaagggaaagaaatgacatggatgaagtggggagaaaccctcatcagttctcaaacatattttagtttcatgttattggtttttaaacaaaattcagagacaccatggggtctcggcggacctttgaaggattcttgattcagtgtcaggtgcccctataatcccaggctcatcctacatctttattgtttacttcatctgccttactcttcccctttctgtacaaaattggccttggtttatttccttctccttttttctcctttgaatgctatggcttcaacagtaaggggaagatgctgagaaaggtgggttgaatacacagtctggatccttttggagatcagtgctgtatttgaggtgataagagagttgggggctagcccccagtggcaggaatgaaaggggcacagggagggatggagagagcatgctttctggactctacatgtcacaaggtgatttcagaaacaacgttcttcctaatgagggaagatgggtttctggcctgcaggtggaggggccagtgcttggtgggggcagggtgctggcagcttgcacctgtggcagggaactgggccactcaccttcactgtctcttggcagaaaggcaaggtgcttcctaatggagaatgatgaagccggaacgcagataatgaactgaaacaggattcctcactgaaatgaaagtcagggctggcgataatgaacgcagttgtctctattgagcccagaagctccactctacgtggaactttgtgaaatgaggtcttccttgtaaaacaacaggttgtgaggagtggaatctatgtttaaattgctgttaaactgagctaagcaaagtcaagaaatagccttccaactcaagagattaatcctgcaagcaaggtgctcaaaaatg

SEQ ID NO: 34318 - DNA, 1118 bp, Bovine  19866880672978
ggatttgatctatgttatttttaacagcagctgggataaaggtggtattatctctaatgctggaaaggtgaccacagataagcatttgatgggggaggggaacaggaggtcattgggttccaaaaaactggttgatcactcctctcgtacagctttagagccagagttataactgcgtaggtatccgtatatacttgaatcagtgcttcatttgcatcttcagaagttgtggtctattgacttccccccacgccccctcaaatttatctgtgactggaaaggaatcttattgcatgaacccctgtaaaagaaaaatacaaaacttagaatttgaaaggatgtatagagttgtgctgaatttcctactatttgtttgcattcaaatagagtaattaatttgatggcaaagcaagcttgagtagttgagataagggcaggaaaaatgcacatgaagattgttattgtagatctctacaatatgaggcagttttcctttaagtactaatttatcttggaaatcagatgtaattttgtgaaaatcagaaatagagggtggttatccatgggtggtacatttagttgtgaactactggaattgaaaattaaatgtttattgtaattagttcccatgaaaatgggtaattaatcaattttatgccacttcctgggcttgctctgctgttatgacacatacggtattccttccccaggggcaaagctggtatgtgagggaaagcaaatagacagaagttgaaatatacttcaagtaaagtattgctttgctttactgggttatgggaattctctttacagtttgatcaattaaatatagaaacatcccatgcaggttgaaattttttgaaaaatgttagtggctcaagtatgtccgactctttgcaaccccatggacagtagcctgccaggctttactgttcatgaaattctccaggcaggaatactggagtgagtagccatttccttctcctggggatcttcctgacccagggatcgaatctgggtctcctgcattgcaggcagattctttaacatctgagtcacagggtagatacaggaaaattttgcttttgcagcttgattataaggtttctttgcccgtt

SEQ ID NO: 34319 - DNA, 1812 bp, Bovine  19866880695506
catagcctcatgccacagtaaaaccagctctcaactgtttaaagactcaaatcattttgcagtgtctttgtgtttataggtaaaagtgtttgaagctataaatcagaccttgaactaagtacaaagtttgagtcagaccaacataagttgtctgattgcattcctgacccacacagatgccctctgtggataaaagaagttgccccatctcagtcctgtctaaattcatcatttccctgacatggcaccagccactgggctggcggcttctccacaaagtgtcccttgacagcttcagccccagggctctcccttgcccacctggcacggctctacttactaccacacagtcgagcacttaactgtttaaccatcttatgtagaacgatcgggccttccttcctgtgtctaagttcttggaagataagaaacctgtcttctgaatcttctacatacctagggggcttggcatagtgctaggcacacacctgagactacagatcttaaaccttcacttgtgtgtgtatgtatgtgtgcatatatgttttctcatttaaagctcattgtataatagactgcttggcctacttgcttttaaaaacctggttctgggtacttttaaagcgtttctttgcggatatgtgatcgtggcagttaatatcagccagaatacttttcaacaagtctgcaggcagtcgtcatgagcagggacttagagacagggtttttctgtgttggagccagaattcagaaatgctctgcttttcttggttaaaagagacccagggtttttcttttcaacacccatttgcactgacctctttttctggcttctcagtaaaaggattaaggactcaggaagcactgggggaaaatggcttgtttagctggagaagggacttaggcatgtctaacagtgtggagtggaaaagccacgaagcttcctcttcgggcagctctacaaatccaggtccctgtccagctcttggtcatcccccagtgatgtgcatggcagtatctgtttgtgtgtgtgtgtgggtgtgggtgtgtgtgtttagtcactcagtcatgtggaattctccaggcaagaatactggagtgggtatattgcatgaaactattccctcaggtcagcacatcctgggagttagcaggatagcatagggtgctaagcactggggctattcattaacccacacctaaacgaccatttatgttgtcttccagagggttcagtctcttctgagaatgtaatccaacgcaacgtgttgatccttactggaacatcttgtgggtttagctaaaacataaataccctgatatgcttaaaaagtgaaaacagattcaagcaatagatgaatgtgcctttctttcttccaaatttccccagagaaactgccttctcattctgacttttatgtgacagaaaaatcacctacaaatgcactggaaatgttgaaaataatttcactgaggccttgtagtaggtcacagcaactgggtcttatggcttgctcctaacctgagctggatttaattccagaacccaggtgggctataaagcaacaccctcttttcattatcctttttttttttttaactgtgattctacagtagtttcagcaataaacaggctgaaagaaatccttggaggcttatcatcaaagttggatatagaaaaagagatatcaggcacccagcaagaaactgtctagacaagagtcccagagcttctacttttgtatttcttccttcctctgtcattcaacaacatcattgtcttcagtgtttttcataatggtctaccctgga

SEQ ID NO: 34320 - DNA, 928 bp, Bovine  19866880707935
acctcttacacagctacaaaaggaagttcactgtgtcccattttccttttctctaaaagggtgatcataataatagcatctacttcataggattgtaatgaacataaattaaatagtatctgtgaaatgcttagaatgatgcctggccataataagtgcaatacagatgtagctattatgatgagagtcttagatttgtcagtcaataggcattgcctggctggggtttagcatccacagtgaatctttcacataactggacaggacagatctagtgggcatccagtcctaaatgccagaaggaaacactaagagcaaaaacatttactgagcattgccatgtatggagtttggggctttcatatttaatgattaagagccaacatcagtgaatgttgatgccaagaagcatctctctcacacacacacgcacacacgcacacacacacgcacacacgcatgcacacacatgcacctgaaagccaagttcctctgtgatttttatcaaatgttacaagaagacatcacactcaggtctgtgaaacaaagggatagatgttagggagctgagggtccttctgctaaacagatgactacagagttaagtaagtgacttgtgaggaggaaaattccaggctgcaaatggagtcaagatgtggagcagcagcagttaagctaatacaccatgatgacgaggattaaagatgaaccgaatatcctcagagggaaagccaaacgagacagaagacacatcagaggagacctctgccatcagcaaacacaaaaatgtagtttgatatcagaaagagataattagcatgtggaaactagatttagcctgaagtatatgtctgcccaaggtgcaggtcagaaaaagaaggtttataccaggtagttttatgggagaaaccaggacacacaaactcca

SEQ ID NO: 34321 - DNA, 1409 bp, Bovine  19866880718713
ggtccttcttttgttgactttaagaaaaacactgactttaggacatgaatagctcggtgccatagtcccatgaagttttagcacatttgaaaattattatcatgatgacagactattggatgccatgataaattaggaagttcagatgccaatttatcatgtagtgagatttaaaaagaattgctatcagaactgttgctaccagaattccttttgtgaagagaactgactgctaagttccataaggataaggactatatctcctttctcttctttgaatacccaatgccaagctcagtgaggggcacaaaataggagctcgataaaaatttattggaaaaaatgaatgcataaaaacctttaatgggccatttagacagactaaatacagcatctggaagggccagaacaaaggaaaagctaaatggctatacataagaaaatggaagaaattccctcttaagagggaagagaaagggaaagagagaacagaacatttcaggaggtaggctcagagatatttaagttcagcagtgtattaaattcaaatttaagctatgcttgaattataaaatccctcatctcctcatgtttattttatgtaaaactgctacacacacaaaggtttcaagtgaagacttttttgttgttttacttgctaagcagtgaaaggtgctgaattttctgtatggggaaagtaccacaggagtaaggaatatccacaatgatgctcagaggacctagaaactactccactggaagcgggaatcaccagcaggggttgttgcttctcctctactcaaatcccaggcaaacttgcatagtgtggggtgcagcccacccaagagggatgggactcattttggtctcctgtgacatctaatcatggtaagacatgaccactgggctacgaacttcattgtatatgacaccactcaagtccttgtttttgcattcaatccttcccattatcctcctttcccattttttttaatgccttaaaacattttcactatcatgaaatagaaagtttctgctgagaacaaaatgagaaatatgtttattcccatgaggattaccacccatgaaatctattcttgcctttataaggctcagcttagaatataggtagaaaagcatttgaaaaatgcttgtaatcttgaatctgaagtaataattaattggtgtgaatctgaagaggcttccctggtagctcagctgataaagaatctgcctacaatgcaggagaccctggtttgatccctgagttgggaagatccactggagaagggaaaggccacccattccagtattctggcctagagaattccctggactatatagtccatggggttgcaaagagttggacacgactaaggactcactttcctttacacttccactttaaa

SEQ ID NO: 34322 - DNA, 1129 bp, Bovine  19866880750305
atcatctgacaaaaatctagtgacaatctcacattccttccctaattaatgacttcattctttagcctggatgaccacaggattttttttccttcctcttcagagtccagtgatttttcactaatctgaaaaacggtcttttttaagtggattttttgctgctttggaatcctttaagaaaatgaaagcaagcttgatatatttttaactgttaaaacagctttagggtagtaaaagaagtgccatcttgaacaagttaactttttttatatatgctaacatatatttgccaagggttttcattcacactaacttgctatcaaggagggagattgaacaaaatatgactttgatcactggggaattatctgtagcaaatggatggaatccctaccttgtaaagtcaattattgtgatttgctaaaatgatgaccaggtcagccttataaagttggaaaaggaaggtttcaggaaagtgaacataaggggaacttttaaatttttctgttttgtctaacttgggtcctattatataattaaggtttacagcctctgaacagagatgaaaatgtcaacgggaacaattcagaaaatcaagtttatgatgcagacaaaacacatgtggtctagggatggggcccggtctgtgcagcttcaccagggcctgaactttatcaggatgtcagcccgagcagcacacagggaagaatttccagtgtcgtcagcacacaaatatctttctgtttggtttcgctctcaactagctctgtgttaagtcctgaagttgattctagatgaataagaagcttgggatttctaggttttgcctgccctggcctagtgctgagtacaagaaggaaggggtattctcaccatatctgctatacagataaacttctaattttgagctgcctccactctatgctggggccatttgagagctaaaatgtgaagcagataaaataaagtttggaatcctcatgacttcccctgatattactaaaaatgctcattgtcagggaagcttctggcccatcccctcctccccgatcaaaacccacatcttctatattaaatttcctcaagtcctactcagtagatgataagaccctattctgtacattaaatt

SEQ ID NO: 34323 - DNA, 1049 bp, Bovine  19866880793220
aatggcggcaaggatcagcagtagacgctatgagacgttggctttggagacaaagaagtcgtttgtcatctttaagaggctaatgtcagtgagatgtggagtttgaagccagaaaacaagatgatagtgagtgtgtcatagaaaagtagccacaatgactgtctcctcagagggcaagaaactagcactgtctctgtctctcctcaaataacctggactagggaggggaaaaggccctcctccatccagggaggccatctcttccataatatagggagaccaattctcccagtatgctcaggattctcccaggtttagcaccaaaagtcctacacgtggggaaacctctcagtcctaggtaaaccgggactgctggcacctgatgttcatatgggtgtgacactttattttggtaaagtcttgatacatgctggtaatgatcattttaaacaattttattgtggtatactttgcataccataaaagtcaccagttcaagtaatcatcgaaagcaagtctcaacccaggttgtacattaaaatcactggggagtttctaatgaataccagtgacaaaccttcagtcacagggatgcctgaggcccaggtgttgatatttgttttccaaagcaaacccagttgacctctaatgtgcatccggcattaagatccactggtttgaagtaaagagcaatacataatatcagtgctcttctaagttttcaagaaggagaaatgaagtaagaactcaagtggatatgataatataggcttcttaaaatgagtaaatatttgaaaaagtaggggaaaaaaagagtatttcaagtatttcttattttgaattctagtgccaaattctagaactcagatgggtttttcctttcattaaaatgcagtatagtaattatcttgctaggaaaattataatgtgtgtccacattttgcatgaaatcctgcttctgattacacaacggtcctacaaataagaaagtataatttttaactttatacagatgaatacatgtttcctctgaatgtgtaaaagggaat

SEQ ID NO: 34324 - DNA, 2626 bp, Bovine  19866880795980
aaaccctgaatataccttggtccatctaccattttccttgaagaacaatgtgaaataacctaaataaagttgcttaaaatttaaaatataagtactatttttggtagagaagagtttcacttgaggttgagcttgagtggtctttagagactttttttttttttttcagaaaggagctacggattgaggataaggttcatctaaagggagtggagagagtggatagtcccaatctttggatgagacagagacttcgactgagaaagccaccctttagactgggaggggaggaaccttgttctctttctgggttcttgggagaggtatacttagattcttataagtacagcaccccagtgtgtggtcaactggcttctgccacatagaagcatccagaaaaccaggcaggcgggcactagaaaggtaccctggagctatgtaaaactttgaaggtaacaaaactgctataaactgagttgtacccctcaaagttcatacgctgaagccttaaccctcaacatgactatatttggagacagagcccataaggaggtaatttaagttaaatgaagtcatatgggtgggaccctaatccaacaagaagaaaaatcagagagcacgtgtgcgctgccctctccccatctccgtctccctgtctctcccactgtctctcttcctcccccttctccctcactccttccgtctccctccttcccgctctctctcatgtacacttgcacacatttttctctttcttccatgtgagcacatagcaagaaaaacagccacctacaagtcaggaagagagctctcatcaggaactgaattgctgagcaccttgatctcatacttcccagcctctagggctgtgagaaaacaaatacgtgttgtttaagccaatctatggtatcttggtgggcttcccaggtaacacagtggtaaagaatccacctgccaatgcaggaggcataggagacaaggattcaatccctggagaaggaagatcccctggagaaggaactgacaacgtgctccagtattcttgcctggagaatcccatggacagaggaacctggcggcctacagtctgtggagtcgcagagagtcagatgcaactgggcacacacacatggtatcttgctatggcagcccccaagtcaaccaagacacatacccattaatagtaactgtttcaggatactttctgtataagtttctgtttgtttcattattccttcatcttaaatagttttatcaaacctgacagtctagcagatccctcaagttatttgaaggcctaatatgctttgtaaactgtgtgaggcaagggaaaacaatgacaaatatgacagacacagacactgcctttatgatcagtctagacaggaatatattaaatatatacatatatatgttcatgataattgtaacaagtgccatcctaccatatgagagcatacagtagtctctgccgtgctatgcagaattaagaggagatcctggtctttgtatgcaagaatcgggcaaggctagtgtggtagtgggggcagccacagcctgagggagattagagatcctataccacataaggcaatggccaggcttgatgaaaagactgggcatcaaccatctctctcttgttcactacaacaatatccccagaattttgcacaccctagcacactgcagacactccacaagtatttgtttttagatggatgggcacgaatgacagtaccgtgggggaaaatctcagaaataaatgggaggaaatccgagaggactatagccctatcctccagtatataaaaacataaagttgctgtcataagagtatgaagaaaaagtgacactttattacaattctcagggacattccagtaaaactgactgaagatttgtttcggggaccatgtcagaaatgctctgtaataaacagctgttgtttctgcccaacagccatttccaaaagttccaagagattcaaagtttttacctctgaagcctcttttcctttcggagagaagatccaaaatttcctttgggaaatcaccctctaccattctcctgtcacgtggtttccatggaattgaattcaactggagctacaggggagtccctgattggctttaaaaaaccaacatatcccatccctgtggctacactgagtacttccagaatggcacagaaatcagtcagagccaaggaagtatgcttagtctttctccggtattggtagtgggagtgtataaaaccacaaagtgaaccagtaaagctgacacccaaatgaagcaagcctagagactgaacatggtgataatacgtgagcactggaccaaaccgcactggaagctcagcctgcctgtgtactttacgtgaactgatacattcccttcttacgtaagacacttaagaatcctaatggatatgccctgcttgccctgtcctcactgtcttataggctgaagtaggccgggtcacaggagcaatctgcccacctcaagcctctctggaaggcagcttggatttctctggcagggctccacaggcatcctgccagcaaggatggtcctgagagagctccgtttgccctggattaagggctccgtcctacaacctgccctcc

SEQ ID NO: 34325 - DNA, 2560 bp, Bovine  19866880858323
gaaaaatccctgatgctgggaaagattgaagacaggaggagaaggggatgacaggggatgagatggttggatggcatcactgactcgatggacatgagtttgagcatccctgagagttggtgatggacagggaagcctggtgtgctgcagtccatggggtcacaaagagttggacacaactgagcaactgaactgaactgaactcgtgaaaggcaagaccaggagtgtgtgtggtgtggtcttaggagaggaggagagtaaacagatgctgagtactgaatctatacagatacagaacaaagcccaaatctccaacagcaatgttgtttccaaacaacaggaaagagcagaaccctgacacagcatgaaaaaatcaggaggtggtgggatgcaagtgctaatttcctaatctttcttactagggaagtatcgcatatggtacaaaatttaatcagcagttattttaaaatcacagcaacatctcaatattttttaatttttttctttttaactgtaggaggatacatcttttataaatcaaaatgtatctgaagtacaaaattccttcaattgtaccacaatttccatttcttcctttaaattcaaggaaacataatgatgccattattttcctatttttcctcctgtctgtctcttctgtcacatcctgtgtaggttcatgaagctgtgcctggaaattgtccatcaaaagtttatcgcagacgtttctgagtaacagaaatgtttattatacattctgttttgttttgtctagtatttcttgaattattttttgcagtgcatatttgccctttttacaacaaaaatctttattctttattaagatagaaagcagtgttaacagttgcgtacctatgaggtttatgttttgtgtttatttatgtcccatttgagagtccctcggacagcaaagagattaaaccagtcaaacctaaaggaaatcaaccctgaatattcattagaaggactgatgctgaagctgaagctccaataatttggccacatgatgtgaagacctgactcgttggaaaagaccctgattctggaaaagattgagggcaggaggagaaggagacgacagaggatgagatggctggatggcatcactgactcaatggacatgagtttgaacaagccccaggtgatggtgaaggacagggaatcctggtgtactgcagtccatggtggtgtaaggagtcagacatgactagatggctaaagaataacaacataaaaactaattaatgcaggttacagaaatttcaattcaccatagatgtgaagtatcagtatttttctctcatttgcaagtaagtcttgttctgtgaacacctgtatttctgagaatccatttgtaaatcaaatatcagtctcatttacatacattttaattatagaaatgaactgtatgagttccttttcaatttttagtcacttctaatattttagctccttgtcaactcattaataaattagtgaatacatacagaatgtctgtgacttaaccactcaaactactcaaggtggtttgactcaagactttttggctttaggatggtgtaaaagtggcatgtattcagtagaaactgtacttggaattttaaatttgaccttttcctaggcttaggaatatgttctcttgtgatttgggcagtggcagtagccacgcctctcagtcagccaccagatcatgagaatgaacaaccaatatcaccattctggacccgtacaaccattctgcttttcactttcagggcagcatttgaaaaattacatgagattcaacactttcctatgaaacagacattttgttagataatttctgccaactgtaggctaacacgtgttctgaacacatttaagataggttagtttaacttttgatatttagtagattgtgtgtactaaatgcattttgacttaaatattttcaacttatgataggtttactaggatgtaatcacatcctaagtcaagggagatgtgtacttaactgaattttttaaaggtacattttagctaggcaaaaatacctttagatttatgggtaataatgactgattcattagttttgaaagttcaagttttgactacaatgcatttttatcagtgttcgacactagtattttgatttcctttcaggataaataaatatataagtaaggtgacacaaaggcattgtgagacaaaattatggtaaaacgtcaattccaattgtgaagtaaggacatttgaagaactcttataattaccttttatgtcaattccaaacattagagataagtgactgtgaagacctttaatcaggcttttaaagatgtgagaatttatttggcttttaatatctttccttttttggactacattatttttcaggcagtatcaatttcacatgtaatcctgagaagcaactagtatataaaatctgattcacagagatcagtataacactgggctaaaagtgtgagacggggggggaagaacatactttcatcaagtgatgagatgtagaaggacattgaggacatgggagtcaatt

SEQ ID NO: 34326 - DNA, 988 bp, Bovine  19866880967408
atgaagaatagcgctgatagtccacaattaaatatatcaacaagaaggtgatcaaatgtgttattctctctgaaaagagaaacaggaaagagtaaagtttcctacgacatatgtaaatgaagacaaatagtgagggatataaatttgcaggtaagcattttccatgcattacatgcccttttgctgatggaaagtgtcacaaaaaataaatcataccatgttttggtaattcggtgccatcttcagaaagctaaggaaaacccagctaaatatcacacagcttattttattcactatgtctacataatacactcactacttgagctgtcttatatcatttatgttgaatgtatatatcccctaactgtaaggttttcataaatataaataaagttacatacttttataaaatgaaattttatataaataaaattatatatatttataaaaataatataaataaaattatcactcaagaaggagaagaaagaaaattgcatcatgaaaatttaaagaagggtatattctaattcggagagaatgtgaaatgtattccttctctggaacctcttaggctttccaagatatagagacatggagcaagagtatatttgcagtttgtctgtgattaacttattagaaaatcgtttgctatggactgtataaatgtctcagacattccctgtatagactacataaatgtcacagacataaaactgtaatctaactcaggatttaatgttatgctattatatgccaataacgaggctaaacacaagaagcagcacacagtagtgagcaaaacagacttgaagcttgtacgctaactggagaaacagattgaataattagtgcaaaaattgattttaaaaactagaacagtttctctagaagcaaagtacagagtattagaagactgtagagaagagaggactctactacaggagtcacagtgtgggggaaatgtttgatactacgcttgatctta

SEQ ID NO: 34327 - DNA, 1693 bp, Bovine  19866881065593
agacatcgataaacatggaccatgtagcatcagaatcccaatgtgaaagaatacataaagaggagagctctgtcttgtctgctatttcctatgtacacactcttgtgctgtaagaagtcagaatgttagagccggaggagacccaccagatgtaaaaaccgaagtctgaggaaatgtggtaacttgcccaaggtcacgccttagtttggagcagattctggactgggactcagatgtcctaactcacactagacgtttgctccctctagtccctgctcagttatgacgccttctcctcagctgtacttttgggaccatggcatgcaaacatttctccttcaattttgaagtcccctgtttcagaggtgagccagtctcactcttggagaaaggctgctgaaagtagcaattacccccccagattttagtccttctctttcttaatgacatctctgatcaattggtggaaatattggtggaaatatttcagactgctgtctgaaatatctcaaattcagcagtacctccttatttcagtggctatgctaactttaagagaggaaacacaggagaaacaatttagttagaaatgctatgattttctcttctctgcctcgtactctcttatctccctgtgtgtttatttctcttcctctcccttacacacacactgattatttcctgtactcaaagggttgcaaagcagccggagaagttattcaatttgtcccccttagacacggccacacctctacatcctagatgtaagaaaatctgactgtttgtgcagaggactcctcccttggaagtgcccttcattttctaataactctgactaagagcaaaccatgcatgagtacaccccacacacgggcacagtgtgggcagcacgggaccagaggacctcccactgctgctgctgctgccgctaagtcacttcagtcgtgtccaactctgtgcgaccccatagacggcagcccaccaggcttccctgtccctgggattctccaggcaacaacacaggaatgggttgccatttccttctccaatgtatgaaagtgaaaagtgaaagtgaagtcgctcagtcgtgtccaaccctcagcaaccccatggactgcagccttccaggctcctccgcccatgggattttccaggcaagagtactggagtgggatgccattaccttctccgtgtttaatcatagccatagtcaaaaatcaagtgtttttttcccaaaaaatgtaaataacggcacacctcctgatgcacacctcccgacctcattcactgcctgccctgcacatcccacctggacttcgtctcccaccaggtggcttcgacttcctgagagaggaccagtcgtccccggtgccagactcagggctcagctccagctccacttcatccagcatcagtctaggaggcagcagtgggaacctcccacagatgacccaggaggtagaagatgcggacgcagctgccgactcagatgagaaggcaaacaagctcattgaatttctgacgaccaggtaagggagtcaggagatgggctgctgtttgggggtcagtcttttggaagagtgccatcactttaaaaccgaagatgaaaattctaataagtctcctctcttctgaattgcatctgctggcgtctgtgtacgaggcagaccctgggaggcgctgtctacgactc

SEQ ID NO: 34328 - DNA, 634 bp, Bovine  19866881066063
gcaccattccgagatagaattttgagattctactcaggagggaagagttcaggtgttttttttttttttttttttcccccagtgaagagtagagagagaagctgaagatgaaactactttcaaggatgagaaaactatttagatgtataaaaccaaaattatcctaaagtgactttaaaaaatctgttatttcactgtttgtcaaaaataatattatgtcacattctggcctgtcacagagcagacctctgtgtttgtgaatgtgtgtgtgtgtgtgtacaaaagcacactatgtcatttcctattctactctgaaaaaagcagattaattatctttcaagggcctgtattattttctaaaatcactatagtatctgaaacttgtaatttatcagctattctgaggctgagacagaatatctgaatttgggcagttccagaaaatccggtatccttgcctggtgacagtacagtggagttttacatcatgggacatttaaaatatacagactcagccagtaacttgtggaaaggagtttaaatattgtgactcgtcctacatgctgaattaccccaaagcctaggcttgtctgtggagctcccttaggatgcgagacatgctcttgcttttcct

SEQ ID NO: 34329 - DNA, 831 bp, Bovine  19866881084041
cttctcacttgacattgtatcatgagtatttttccaggtcagtaaaaatcaaaatcctgacactaataactacagaggattttgtaattaaacatgtcccatgttttatcgtcctcttcagcagaacctcagtttggatgagggaaatgatcatgggcctagttaccagtacttccccagctcctgctaaggacagccttgtgatagctccgataaattaagagatacaagtagatcttgagcaaggatctaatacaggggaccgtgatacaagttcggatctactgtatcacatggtgactatagttgttacatgatttaaaaaaaaaggtacaagtggaaatctgcttcctatgtatctgatacaaaaggacagatttggcaagcatgaacggttatcctctctccatcctgcctggaacacaaacatgcaaccaagaagttccagagccatttgggggcatgaaaaagacagccacttgttccagctggtacactggacagactccaggagcttggatcatgatggcatgcctggaggatctgctgtaccagccttggacttactgatccatgaggataaacacctccacagttaaagttcagtcgggtttctgtgacacgcagcctaatgatacaatggtagaatgtgtgtgtatagaaacctccaagtgtatttctgatgatttccttagaatgagttgctagaaacagaattactggatcaaagtatttgaatatttccaaagctttggatgctttctttcaaattgctttctatgtagttttaccattttattcataccccctacaagaagccacatcacctca

SEQ ID NO: 34330 - DNA, 1385 bp, Bovine  19866881105088
tagccattagaataaaaagtaagcaggaccagggtacccagtgaatgggaaaggaagacattctaagtgagggtcaactgtgtcttatattagagaaagtaaaggtaggaaagaagggcaatgggtatgtaaggtttagggggagtatcccaggttatacgaaggagtttagtgggaaagaaaaggaagtcgaatcatagcggggctcaaatgagagttgtaaaagcttctgtggtttgtgggatatgggacataagaaaaagtagaacacagagtatcctaaaagagttctaaagtcaatgataagaaaaaaggaaaatgaggttcataattagagacagataattcaggtaggtctagaagggcagacatgattctgtcaggctgttccagattatatgaagtgatgaaagccatgattcaagccaggccagtaagtctttggttggtgcccttccctctaaatcctgggaactggctcaattttagtatttacttagaaatgttagctgtgaaatgaccgtggcctgaataaaactacacttcgggacctaagcctgtaagaaatatacatatacagagacaatcaccaatgcacgtgtcccctcaacatcccctcatatcctttctggtgtgtttctgatatgtcctgcttgctctgtttttctcattataaaattaagacatgttcactatagaaaatctagtcttctcactgctattaactttaacattgacataataaaccattattgtattaacaccaacagctgcaattctatactgagagccagtgtgcctggaaaccagccaaaggcccatgaccagtatgaccagccccaaagacaacactagtctgcccaagaatgatttggaggtctcctagggcttccctggtgactcagacggtaaagagtctgcctgcaacgtgggagacctgggttccatccctgggtcaggaagatcccctagagaaggaaatggctacccactccattttgcttgcctaggaaatcccacgaacagaggagcttggcaggctgcagttcatggggttgcaaagggttggacataactgagcgactaatactactttcctaaagcccaaaggagactgcttctagactgccttcaggtcttccctaggatgtataaagaggcccaaagcaatctttcaggagtcagaaacaaacaagcaaaagccttgaatgcaggagacaccaatctagaccactggttggatactcaccacatagggtgcacgggtttaggcatattcacagacaagtttatttttattagagataacctagattagaatatttacagcctaaatgggttaaaggactagaactaaacttagtaaatccatcagtcaaatattg

SEQ ID NO: 34331 - DNA, 897 bp, Bovine  19866881187083
cttaagtatataaatgtataaattaccagttttagaaaatcttactattgtcttacagttactctttatagataaggtagaagaagtaagtagtatttgcattttaattgtttaaaactttgaaatacaaatgccaggaccattgttctaactggactgtgcaggctttaggtcacttgtggcccacttgatgcttgggagctgctttttgtgttatgttgtactggggtcgtagagatggacaatgtgacaactgattctaggaattcttgcatggtgcttaaatctcactggatggaggagcctgtaggtgcttggtgctggtatcagacaccattcccaaagagaatgatgaaaatgctttctgaagatcaacctaggatggtatagatagtcttttcaaaaatgactaacaactcttagtgccaaagaagtatggcagtatcccactcaggatatcaacttttcagaagaggaaggtgtaatttttctgcagctggactgggttgctagtttgctgaaacaggaaatagagtttgaaaaacagtaattgctgctactaaatattgatttttttttttcttcagaaagttaccctccaaataacctaaaatcctttctcctctgccctgcccgcaatgttcacagcagtatcttctcactattgaatttcatcacattctgttcaactcagcagacagcgacggcagtttgtgagtcacttgatgtgtactggggagaaatatacagcaaataaatctattcttttccaggccaaagcctacctaaggattgctactgaagtggtaagaagattaccaccacctccagagtcattccccaagtgtcttggaaatttgcctggtctttgacagttaaggccttggaagtcagcag

SEQ ID NO: 34332 - DNA, 1420 bp, Bovine  19866881197183
tagagaaggattggggattttcaggagatggggcaccccccctctttggggccttttataattggcttccaaactgtcatggcacctgtgggtgtatatttagcatatgaaaatgtattacagcgagcatatagtgtggctgaaggtctactggaagctgaatcttcttccaccttgagcctagtaggttctaacccgttttggtcttgtcctcttgtttttcatggttgtgtcattcttttaacggttatgtcctgccgtcttccttcctgtctcaataccttggcttctctgtttcctttttgatacatgtaagcattagtactaaatttagtactaaatttaaattagtactaaatttagtcagtcagtagagacttgtagaggattttctattattattcttagttccatcatcttggaagcagaggaaattaacttcttgtgatctccctccctaccctctttattcttatgtgataatgtgtaccagcagctatctaggtgtgtatatatatatgcaaaatccactcctaccacagcaaattttagagcaggttttcagttttgttttaacccatgatgccaagggctcacttgtagacaagcatagttttcttctagaagacaggacagatagatgataaatagattctccctaacattttgaaggaaacttaatgatctagtgatgataaaattgagcttgcaatcttctattgcaagcacccacttcattgttttcttgtttcttgaaaacataaacttagaaaactaagttattttacttgacaggtatttttagaagattaatttgaaacctgggacctaaccctttcaagttactttaaaaccaatcttaatataaatgagagcaaggacaaagaatcttagaatgttttttgttttaattgccattattattattttatggtagcatttagttttgtaggtgtcatggaaaagatatggaaaagaggtgatagttataatattagcagacccatagataatagttaacagttatctagatttgttaggtttgaaaatctttttatccatagtgaatttactcctattttcaatttaactggattcttttgtttgtggtttaaaaaggagttaaattgggtcagaatttctcattgaatgttctacctttttaaagctactgactgacctgaatttagtaccagtgcttcagttcagttcagtcactcagtcgtgtccaactctttgcgaccccatgaatcgcagcgtgccaggcctccctgtccatcaccaactcctggagttcactcagactcatgtccgtcgagtcagtgatgacatccagccagtgctgacatacatcacaaaggtaacagaggagagaaaggtatgaagaccagtaggaagagaggaaagtgagaagggacag

SEQ ID NO: 34333 - DNA, 1239 bp, Bovine  19866881262272
tatgctgacatttgttggcaaagtaatctctctgctttgttagtatacaatctaggtatgtcatagctttccttccacggagcaagtatctttcaattccgtggctgcagtcactgtccacagtgcttttggagcccaagaaaataaaaatctgttactgtttgcacttttttcccttctatttgctgtgaagtgatgggaccctatgccatgatcttagtttttttaatgttgagttttaagccagctttttccactctcctcttttaccctcctcaagaggctctttagttcctcttcactttctgccattatcatctgcatatctaaggttgttgatatttctcctggcagtcttgattccaacttgtgattcatccaacctggcattttgcgtgatgtactctgcatacaagttatgcaaaagatgatacccagatgatttatatgtgttttttggggagagttatgctggatctttgttgctgtgtgggcttttctctagttttggtgagcgggggtactctctagttgcggtacttgggcttctcattgctatggcttctgttattgtggggcatgggctctcaggggtgcgggcttcagtagttgtggcttgttgcctctagagcacaggctcagttgttgtcgcgccctagcttcactgctctgcaggcatatgggaacatcccagactagggatggaaccgtgtctcctgcattggcaagtggattctttaccactgatccaccagggaagccctgtgttttaaaggctacttttagtgaaatgagaaagtcactgaggtaaggctggtgtgagatatttttctgcacggagccctttcacagcaactaattgctttactttgtagtagcagataacctcatattctcccgctcatattactggggagcgggggaggagggaaggggggaaaggtgaaagtctgcacaagagacttatcagtgatgagcttccttaatttccaaaaaactggctcaaaactcaccatcaaaaaactaggatcgtggcatctggtcccatcacttcatggcaaatagatggggaaaaagtgaaaacggtgacacattttattttcttgggttccaaaatcactgaggatgttgactgcagcactgacattttaaaaaattagtcactgaacagcaactacagatttacttatattcacacaatccctgtttcttctgttttcagggagaagtgtctcttgt

SEQ ID NO: 34334 - DNA, 1196 bp, Bovine  19866881287916
atgttcgcttttaaattcccagcacttcaggtgaatacctggcagatgcagctggcagttaataaatatttggaatgaatcaatgaaatctttgttaagctggtgaattattaatcttttacatttggaatattaacagtatatactgttgttgcctaatgaaagtatttaatattcagctggcattttcgtttttaatgttttcaaaggctcatgtgtgggagaattaacgtgtagcaaagcttcagaaagattttttaaaattcacaaaatgtcacattttctcttagcatttatttaaaaatatttgtattttgggtaattaatgtcacatcgtgtctaaaagctgttttccatatctggataagtagaggttaagttttgtgatatgtgtttatatgtgatataaaaatttggcaaacattccttggctcatgtgaataatagacacttacaattatatcttccatcaagagggaactgagaaataatttataggtaaatgcatagagggaatgagactgtaaaaatatgtacaaataaaaatatgtacatacatatatgaggtgtcattcaaaataattacttaaggaaattgttcattatagttgttgaataaaatgataagtttccttggtaaaataatttttatcctaatatttataagtagaaacttaaatgactggtagattttctcctccttgtgtccttaggatgcttccgctctgcagcacattctgggctccagagttgggcttgtttgctatggccaggggtggtcctctcaccatcctccagtttggcacacaggtgtcaacaaaggtgatcatggcctttccactggaaacatgatgctgtatgcttctcgccttcagtatctcctgttagggatatagtggaacttcttcagacttgactcttggtcaagacatattttattctaagtgggcttgtttgtttgctcctttgctcatttccccatttatttctttatttaatgcaagtttattgtggtttgtcatgtagaaagcactagctttgagattgtagagaataagatagaaatgaacatggcatgatacacttaccccaaggatgttgccttggataactgcactttgtggaacatctcttctggaattgcctttagaatgagtttttcgttacctatgtgcctcattcatttatagtcctat

SEQ ID NO: 34335 - DNA, 1508 bp, Bovine  19866881314084
aacagaatagaaaattaaacacaaaaataccaaccacataaaaactccaccgtaacttgaacacgacctatctacagaagacttagattaaaaaacaggagtcagcaagattctcccgacagggccaaataacagaaaatattttaagccttgtgaatcatttgatctgacagtactgagtcattgccactgtagcagcaaagcaactacagacaacagtgtgaacacaaatgagcatggctgtgtactataaaacttcatttacaaaaacagacaggatttagtccacaggtcatagtttgccaacagtgattttaaaaataaactttttcatgacaaagttattcagctgcccaacaacctaattttggtgaagccaagagcaggcaggacacagtcatctcttacggtgtcagaggagctacctcagtaaagatttacttcctcatctttaattggatagtttttaaaaataataaggagcacatgtattaggctgtttcactggaacttagtatgtcttgttttgattttataaaatgcaaataaattagtgcccattaaatagaaactccaaagcctgtattaattaaagtatattgtactttgattgtggcacagctaccaacctgataaaattaccatagctacaaaaatcagctgaaacatatcttcaagtctagaattcaataatgttcaaaagatgcaaaataaactttgtttttcaaaatttacaccattatttttcaataggctcctattttaagtgtacgaacagtttcaatttaaactttcaacagtttcacactgtaggaaaataaatgagcaaggtaaaggttacaaataaatatatgcaactgattgttcaactaagttttataatgcctttccacctcactccttctaaaataattatatttagtcaagaaaggtccaattaagatttctttcattacagccaggccccaaagaataatcactacaaaaacctcatcaaatacacaacaaagaaaatgattattagcaaaaaaaaaaaaaaaaaaccacctgtaaatgcactgttgtaaggtgggctttccaggtggttcagcggtaaagaatctgcctgccaagcaggagacgtgagctcgctccctagttcaggaagatcccctggagaaggaaatggcaactcactccagcattcttgcctgggaaacctaatggacagaggagcctgatggacgacagcccatggggtcacaaaagaattgaacacgacttagtggctaaacaacaactattgtaaagtagaactgccatgataaacttaacctaataccgttggtacctgtaattataccccttctgtgactctcctgcagtactctcactctagcagacaacaaaaacataacacatcaaaccccaagatactacttagatttttggatttgtttctttatatttcacaataccctgtgagagctagacaaggcggcagaattattcagagtgattataatggt

SEQ ID NO: 34336 - DNA, 1062 bp, Bovine  19866881376175
aaatagaaaaatgcttttaattctagccctttactttcttttcctataaaattatgagaataagatggcatgtggctagaaatattaggttaagattccctttttaatgtacatgtggtttcccaaggcaaaaaaaaaacctatcatatggcagagtgattaacattatagttgaaaaaaatctattcatttcctagttagtgaaggaggagttattacattgcttatctaattgtgttttattcacatccaaaatgtattaggatttgtcatagccatatgcctctctggtaggcttatctatactagattaggatttccttgtaaatctaaatgtagggcttggaaagctaggtttttgctaaatgcaaaaaggactgaatgtacctataaaagaaattagtatttgctgaaccacttcttgagcatacagtgtctgctgtatatcaagtgagcctgagtaattgaaattcagtatgaacagaataaatctttttttttttgcatgactacacagaataaaagataggtttgtagcaaattcccacttgtagtcgcaagtatatagacataaactatacatgataagacattataaataaatttaatggggaagaatccattttatactttgtggtaaatttttcaaattgaaaaaaactgctttattcaatgtgtcatgaatttagtctcccataacaaacctgcagtagactttggggaacggtcacgtcatattccctctgtcaataaatgggaaggatgtagagaaaagggaaccttcttacactattggtgggaatataaattgatacagccactgtgaagagcagtatggaggagggtccttaaaaaactaaaaatagagctaccatactacccagcaatcccactattgggcatatacctagagaaaaaccgtaattcaaaaagttacttgcacaccagtgttcattgcagcagtgtttacaatagtcaggacatggaagcaacctacatgcccatcaacagagaaatggataaagacgatgtgatgcatatatattatacagtggaatatta

SEQ ID NO: 34337 - DNA, 856 bp, Bovine  19866881460184
tgccctcctgtctgatgtatggaattgtgtgtgtgtgtgtgtgtgtgtgtgtgtgtgtgtgtgtgttatcatttggagaaacctcttagcatatggtggaaaaaaggctgttttgttacttttatgttttatttcttaatggcctactttgcagcagctttagtggaatggtttaagctcaatctgacttttttgagtcttttactctgtgacagtgactcagctgggttagagccaagatgtttacctgattgaggctgggggttgagggggggggggcgctgtgcctcggcctcagcttttcccacttttgcagagagcttacaaattgtaggcactcagaataaatggcatcattagtgggcgtaaaataccctaagggcatgggaatgatttagaattctaggattcggtaaagacagtgcatgctaggggctcaggtgtctgagagaaatggatccagtagtagtgctgaaatgtgaccttggttattatcagttgaccttaattctttacttttaaggtgaatgtggacattttctctttattgaaatgctgctggctatcagggcagtatttgtcaagcacaaggaaatctttttgctttaagacaattcttttaggtaatgttttgcacaagattacttaacatgggcagcttcaatctaagattctgtgaaaattgcatatgtcacagaggacatcagctcataactagagaggtcattggcaaaataagctatttcatttccctgaatagggagagatgagctgggctcttggaaatttggtgtttgaaatgaaaatgaaattgtataaatacttatcaaccagatttgagccaaggtcaaacaat

SEQ ID NO: 34338 - DNA, 1088 bp, Bovine  19866881518138
cttcctgccaacgtgctcacctcgggcccagctctctgctgggaggacagcacacagctggcagcccttggcctgtcctctcagaagccaactattaatagatggtgcataacgctgttcaccaggacaaggaaacctgtcagtagaaattggcttacggctcttcactcatctccccatggccagaggagcccaacaaatagaaatttattttgattctgaggtggctttctatctcattagcaatcccatgagtccctactcttttcactcaactgtcaacagtccttgatgttctgaataaagaagctgtccaaactgggattaaaaagaaggggggaaaaatcaccattccttttctcagactccatgtggaggtgctgagctggctcagctccctagagagctctcttttccttttctttgtagccctagtgactatgcaggattgacgtatttacatcacacagccttgattcttgctgcaattccttccagcaaaaattccacacaacagaaggacagggtacagttaaaattctggtagaatcaatgttgacttgattgggaaattctagaaaatggaattaaaagtctgaaaagagactaagttactaattagctagggttgcaaaaaaaaaaaaaaaagcaatgtatagaaatagaatacaaggaagaagacatccagtaaaatggtcatcctacattcaaccagaaatggacaccgccatctcatatgtggaaaggagatgcaagtttggagtggttgcctcctttcaagagattcacagtttgacagtgttgcagtatatccccagaggactgggtaaaattggagggtgggagggaaaggcacattggagaagaaagtatcatagaaagcgagtaggtcaaaaacagaaacgaaagcataactttaaatgaactcgtactttgacactctatagctgggggtaacgagaataagatccaacaaattaataccatgccacatggcttagaatatttggggtggtcaacaaccaggaaactcatgactcaaagtgtacttaaaaactttttaaagtcccccccccatttatacaata

SEQ ID NO: 34339 - DNA, 1135 bp, Bovine  19866881537598
tggacctgatgtttgggtttgagtccttggtatcagtagcaagagctataggagggaagtttataagcctttttagattgccacaggagacttccattggagtttcagaaatttttagtttcatgtttttatatagaattcaagaacatcaaacatttatacagatttgagttggcccaggtttactttgtaagaaagtgaagttgttacatctttatatctgatctgtagatatattttcagcatcttgcactcatcctctaaaatcttcagtacttctgttttcttttctgtctcctttatctcaacatctttagctacatattatttggaagtggacagttaaggtttgaagttaagtgttgataactaatagagtttaatttggtagtcctccaagaaccccaggaggtttttatagaataacccctaaattcagaagaccatgtttctaatggtagaacttctggcatctacaattggctggtaaagacagatttgaggttttgttttaaaaaaataacatatacaatttttatttttcagtatgtctagcacttaatcctggagaaggaaatggcaacccactccagtgttcttgcctggagaatcccagggacggcagagcctggtgggctgccatctattgggtcgcacagagtcagacacaactgaagcgacttagcagcagcagtagcagcagcagcacttaatccaagctattttctttctgtgtcctttcagataatgatctttaactattagaagaaagggcaagaaaatttaaaaagcaaaacaaaaccctgactcagtttaccatcataaactgtttaataattaagttgaaagttaaaaattttttacatgagtatgcttaatattttactatacttacattatgaaatatctacatatccatccctctatccaacccagtagcccagtttgttttttgatgcatttcaaaataaattgcagccactttcccccctaaatacttctctggcttgatttccttcttaaatagtctgcatgtcaggacaaagcaaagaattcagcaactgctgcttaaatctcattcattgctttgggaatccaggcaaagtgatatacatggatggaatgaattcagttt

SEQ ID NO: 34340 - DNA, 1096 bp, Bovine  19866881734682
tgaatgtggtatgtatctagaaattgttctttccaaacaggtatctagtgttttcttatttatcttaatattgcagatcacacattaatacacatgcccagcgccagaatataagagggtacacagaatcaccattatggagtttaaccctaactaagaaattaattccaacatcttcatgtgccaagtgttgttctagacactgagaatacagcaatgaacaaactaactgaagctcctgtgtccctgaaatggggacagaaggacaaaaaacaaaccaaatctggtatatcacttgtaatcttgatgaaagtcatcttttgagacctcagtttgttgtctataaaactggaaattaatattactaagtatcactagactcttctcaaacaaaaactacaccaaaaacctgtaatcaatagaacttgcactacaattttccctaatcgatccttgcctccagtggtagacacataacagaatccagtccagagtaggaagtgtaagccatgccatgaaacagaagaaaaataattggataatggtgaggctcaatacaagtgttagttgctcagttgtgtcgtactctttgtgaccccatggactttaacccaccaggctcttctgtccgtggaattctccagacaagactagagtggacagccattcccttttcagtcccgacctagggactgaaccctggtcttctgcattacagggagattctttaccatctgagccacaactaactctagttagtaagctatggtttctcaaataagataatcatgacatatattgctattctggaaaatattttctcttagtttcagtactattgcccagagaagtcattttcaatttaaatatcatggctgtctgtttaaaaatctttgttatcaactagactactgttttcagataatgaatttcaaggcacatttaacatgagaattcttttttctctttcagttgaaaaataatattaattattttatttagtatgatgaacacatactttttcaaattgcatcaggataggcatatagtcagagaaggcaatggcaccccactccagtacttttgcctagaaaat

SEQ ID NO: 34341 - DNA, 1662 bp, Bovine  19866881849479
tgatcacttttaaaggaggttctatataaaatgaataagaagttataatttaaactatggttaggtggttctattttgtgcatcagaatcttaaattgagatcaaaaatgttgcataaacctggataaatttctgagaagcaaaaaccgtgttttcagtatcaaggaacatttaggtatgtgtatatgatcacacaaaaccttttgggtatcccttgaagaatgtctgtgtggttttggatttggagggtaacctattggatatattggatattaaatcattaccttggtgggtaaagattttctagagatagatctgagacttaaactaaaaaataatagttgaaaagagtattatcctgctttttgtgcattatgtctatttaataaccttgcaaagctgaaatcttattgctcttctaacatttatatctattgcagtctcaggaattattagcttgaacaatatgcatttgccaatatttgataactttgggcctgtaaaaatatcagttttgtgtggcttattctaagtgatttttgaacattaactcattttaatgaaagtttagccttaaatccccaacaataataccaagagtgaaatattttcccaaaatatgagagccatctcattaaaagcatgatcatcaaggttacttcttatgaatacatttagtatgtatgtgctatatcttttgtgaattcttagttcctttgtctttctaaaaggacttactgtttctgctgagtgctgcctgtggtgtttgtcagacctggtgactgagagcaaacatcctcagtggctgagagttgatatttagcagtgtttgggatatctttgaaaaaattcacccttggtagttagtcaatgaccaaacgtatactctagttttagggtttctctacatgtactatctcagtactcttctttttctgacttcctatgatgcaatctgagatcactgatttgatacatttcttgtataggtatttaatgctataaattttctcctcagtactactttagctgcagcataagaatttttataggttgtatatttatttttattaatttaaaaatgctttctaatttactttctgatttcttctttaactcatcaattatttagaagtgtattacttatttcccaaatatttgggggatttttcagaggtacttttgttattgtttttaagtattctaatttaatttcattgtagccaaagagcataatttttaagacttgagtcttttaaattttattgagacttgttttataattatgatctatcttggtaaacattccatggacacttgaaaagaattgtattctactcttagttgagaaagatttataaaatcagttaggtcaagttggttgctaatgttgtttaaatcttctctatgtatgtatcagtattggttttttgtctatttgttctatcaattattgagagagggatattgaaatatccagttgtaactgtgaattactcctttcagtttttgctttatgaattttgaaatggtctcgttagatccattgacatttaggatcattttatccccttgatggacttagcccattatcattatgaaatgactctttatctttagtaatattctttgctctgaaatttactttttcgatattaatat

SEQ ID NO: 34342 - DNA, 1208 bp, Bovine  19866881864873
acataccatggagacaggcaacatcatctttaacaaaaggaattgcgttaagttccaccttttcatctagcaagtatcagagaaagtaaattaggaataaaaccactaagattaagaaaaaccttgcatctttggtctttataattaaagaaaaaaagtattgatgctcttagcagagtcttcaaaatcagagaaaaattaggacgccttctatcaccatggtaatacagatgcagaaaaagatacttctagatactaacctctaaaaataatggtcatcttatctgtgacatcaaccagcccctttttttgacagaatctaagcctacagaactacaaacctaaccaagtaagaaccttctttcccaaatcagataaggtactgcagcaaaagcactgaaaaccaacatcaattccttcaaaatgtccttaactaaactgcaatgcagggaagagcatttacaattctgatagcagctcttgcaaagaaaagcaatgcagcaatgcaggaatcagatgtaaacacagcacctggtccaccctccagattcaaaatcacaggagccaagcatggttttaaaacccacgtcttcatgtgtcctctgctctcctttcaccaattgtttcaacactgccctaccgaggatttagagccctccttattcctcaaagagatgagatgagggaaacaaaccactgagaagaataaaaatgagagagaaaaaaggaatcggtgagatccaaggtagggaggaaggggagaataattaagaaaaaaaagacaagactgttctgtgataaagatctggataacttcttattgtacagaatcagatcgtgaaattcaaaggatgtggaacagttttgccaccaatatgttataaactaaacgaaactaagggaaaatatattgaatgtaaaatttaggtaactgttctctttctaacccataagcaaattcagcaacttccattccattccaaagagagaaaataaatttctggcaacacgctgcactttaccaaaagaaatttataaggtaggccaaacagtgctgaggaggaaacacatagcttcttgagagctattcaaagcaaaatcgctattgcttctaatgggaaatatcaaagcaagttgtgtacaacgctttctacctaaaactataaaggggaaaagcagtttggggctttttaccttctgaaaattac

SEQ ID NO: 34343 - DNA, 1630 bp, Bovine  19866880255486
tgtgtagtattggagaaggcaatggcaccccactccagtactgttgcctggaaaatcccatggatggaggagcctggtaggctgcagtccatggggtcgcgaaaagttggacacgactgagcgacttccctttcacttttcactttcatgcattggagaaggaaatggcaacccactctggtgttcttgcctggagaatcccagggacgggggagcctggtgggctgccgtctatgggggtcgcacagaatcggacatgactgaggtgacttagcagcagcagcagtgtgtagtattacaacaaagacgtagtttctatcatcagatatagtattctgctgattgtccaacatggagcccttgagtgcatccagaaatatgtggttagtatcacaggaccaagttttagttctgtatgtaatcaatcagcagtttcaacgacagcaattctcttttgttatatatgcatatgcttccagataagattctgcccaaagggttctgagattaaaaataatttttaaatcactaattcagaatagcataaagcaattaaagaagtgttaaactgtgtaatgccagaccaaaactgagtaagtacttcagagctagtggcacagtggtaaagaatccgtctgctaaatacaagagatgcaggttcgatccctgggtcagaaagttccctggagaagaaatggcaacccactctaggattcttgcctggaaaatcctgtggacagaggagcctggcgagctacagtccatagggtcgcaaagagtcagacatgactaagcaactaaacaacaacatttactaaatatgtactatgacacacacaccctctctcacttaatgtttaagagtgagttttaatttaattatttagataatataccattttacagtaaatttcattttcatcctgctaagaattaaaggtaatcaaaacttacttctgaatcttcagataggccattgctctgttagctggaagaagggcattagcgccatctgctgctatccctcgagtatagcattcgattgctctttcatatttcccctctttgaaaaatgcatttccctatcatttcagaaagaagtatggagaagaatttaaaaaaaaaaattagtttaattcaaatttttagcaacactgctagtataccaatcattattatatcagtaattaaacctttttaattgctaaaaacccatgagatgttttagaatctgttagtttgggttgttttttttaatggtgttcttctcatttcagtaccaaaaaaaacgtatgctactatattatcttgcagcactaaccattattttaccaattaaagattagatgaagtttaaatgaaaaacacattttaataaatacaggaccaaatactgtactctttaattatatcagaatctgtgcagggaattccctgtggtccagttgttaggactccacactctcactgctgagggcactggtttgatccctggttggggaattaagatctcccaagctgcgaggcacaatcaaaaaaaaatagaatctgtacaaaagaatttcataatccaaatgatttgtggaaagaacagagtaccagactgtacagctcactattcagtaacatt

SEQ ID NO: 34344 - DNA, 1172 bp, Bovine  19866880482957
tgcacaaaatccctgtgctgagagccgggagatataactgcatacattttcctggtgggacctaaaaatgggagtttctcggccgggttgtgttttatagactaccacagccacttgttaaaggcagtgtattacttgcgggtggttggcaacaacttctcttcctttgtaggagaatgtgggtagatggtgtgcaggaccacagaaaaaatagtgaccttcagaaagcggctgagatcaagatcagtgagaagcataaacttaagaccaggaaacagaaccctggatattataaaggggatttttcaggtgtgcagaggctctgaaaatccgaattggtgtaagacctagaaggaaacggcgtctgattggttttcctttttttttttttcaaagtgagaaaggccccccctacccattgggtcggccgccctcgtaacaggacctgcctttgtgacgtggcccggcagccgcagttaataagctcatacctgggtgagtgaggttcagagccagtggccccgcgggagcgggagcggggccatggctgaaggggttgagcccatggacgaatcccaaggtactgaagttaaaacccagcagcccacggaaagaggcctcgcgggacccctgaggcagagctcgtgctccgtgctcaaggtgtcccagctgttgctccgcgccatcgcctcacacaaaaggctgaccctggcggctctcaagaaggagcttggaaatgcgggctacgaggtgcgcaggaagtgcggccgcctctcgggcgaaaggtccgggtctgaagggaagggccttcacctccgggtgaccggcagcgaagccgccggctactttaggatctggaagattccgaagccgaagagaaagccaggacgcccaaggctggaggagggtgggcgctcgccggggacccctctcggggcgcggaactcacgcaggcgctctgcgcgccgcacggtggccaggaaggtgaggagggggcgctcgagggcagactcgaggaaggtgaggtcaagggccaaggacctggtgagttccagaaccaaggaggaagggagggccaagaaggaagacatcaggcccaaatcccgaaatgcgaagaggccaagctccaaggcctgggaagaaaagaagcaggacccggggaggccggtgaa

SEQ ID NO: 34345 - DNA, 2424 bp, Bovine  19866880526863
atcaaaaatgaagacataagaattgtgaattcacaaaaaatattggggcttctaaaggttttcttttacagagaattatcttttctatcagcaccaaggggaaaatttatccaaacaattcctagagttgatcacgggttcattgaggaacaaaagagcagaaacatgcaatttcatggcaactcccaccaagcgcagcctctcattaccaacaacaagccaaatgatttacttagcaaccatgctggtggcatttagcctttgtctttctcacatctggtgctccaagtatgatgcatttaataaacatgtttataaggggtaatttatttctggcactatttttgcttctttttacaccaaacttcattcatggggaggaacattgtaattgtctcattgttaagtgaccttccttactatattgttatgagattttacaaagctcgtgaacaagaacagtcttagaaatcaagcctagtataagctgcaagttgacattttgtacaacagtcagaagtgaagcatcaagtcaaggagtcggggggtgaggagagaagctccttctcaaaatattccctggaggattcccagagtcaaaacaatgtcaggaaatcactctgatgtgtctcatgacctctagataacagtgcatagtgtttcattttactgccacatattaagatggaaaatcaaatagaactaatttgatttggtttatgaaaattttagataaaaaagcaggcatatggagatgctggatagttacacaacaaccaaagcttatttagtatgtcttcgaaaacagaggctcattttacaaagtctaaattgatctcctttgcagaacattatccatgtatccttgtgaccattgttgactccctgaaggcgtagactgcaccagaggttacttctcagaggacagaggatcacctcatcaagtcggggggtgggtagatggattcagtagtcctgtatggtagaaaattcctagactgggaataagaagcaacttgattccactcctaggtctgcctggtaccaatagcctctgtcatataacctgaatctatatatctctatctcagttagctaattgccacgtggcaacaaacccacacctcaaaacttagcagctaaggaaaaagccacttccgattctttcaaatcaatgctgatcttggacaggctccactgagctcaggtgggctgtgctcctctctctggggtcaactggtggatctcctggggacttctggttccaggatggcatctgctgtggcagattggttcagtgtcatgtagtctatctggcccttcagcaggttagctcaggattgttatgatagggggagtcgggggtgggcaggggagaaatagaggaagagaggaggggaggagcagggaggcgggatgagcagaagtaagagaaagagtgaggaagggaagggctggggcagggagagagaaagaaagaacatggcatcttgagtcttgagatccagggttggaactggccctctggttcatctctcacattctcttggtctgccctttccacacttgtcttgagaactaaatgagatgatcttgtgtggactttataagtcatcaagtgtcgtaaagcagatgtaatgtaataagacatcactgacacatcctgtctgagtgttgtccttcataagatacacaaacttataccctaattagagataaagccagagatgatactgggggcagggaatgtcatgtgagatatattatgtatttatgtcctagttccacaagctttgaggtagattgctacagaaatgcatatgcaaaaataccagcataccataaataagaacaaagaataaagactgttctgtttctgtttgtagaagcttgtgcacacaaggacccaggagaaaggagcagtgaccgaccccacaagagactgacccagacttgcccaggagtgccggagtccagctccagcagccaggaaatcagcctgaagggatgagcagtgtcggagaagaatgatgtagcctctgactcaaggtgcaggactacatgtttatttcaagcatcaggtcttcttttatactttgacaaaagcattaggtcagaggtttgacattttcagttccccctcacccagatttattgtttccagaaatcattgttgccctacaaacagagttcctgcttcagcgattctctcagaatcggctttactatctattatctacttcctcttacgtgtcctatacttaactcaagctacattcctcagtttatttcttatctttctaaatcttgttagctcctagcatcttaagatcactatttcctaaaaaggcttctagctattcttaattattcttaaaccctaagctcagcaaacttcttttgccataaacattccgctcacaa

SEQ ID NO: 34346 - DNA, 2605 bp, Bovine  19866880537334
gcttacggctgacgagaaagactctctctacttcgcaagcacttcttgttcctgctttcactttactccctgtacaggttctgacggtgcaagaaaggaacagatagggaagagctagttctgcagcaggcaggcttgaggttagatcccgagaagaacgtagtatcagaatttatcccagaaacccactcttatgtcactcaaggctctgttttcctccagaactcaacttccttcttagctcttattacacaaaacttcagacagccccccaccccgttgctcttcattcccctaacaacagaagttccatctgcctgcaccccagtttcatcagcttcctcttccctttcagcttggctctaccactgaggccctcaggctcttttcatctgggggggtgcggtgaggtggggagacctcccagaggagccggcaaaggctcaggctgggggcaagggtcagaagcccaggggctgccccaccctgcaatgcagttagaaggttcctgctgcccctgtgctgtctgggcaggatggaggagactgaggcccacagaaaatcagggaggcgagacagactaaatcacagagtcgaacagaagccgagtcaggaagagtcagggagcaagtcagatggggggtagggagctgacggtcaccaggcagaagcctggccaggccccacagaaattcctgtggcctctgatggcagggtgggctcaggcctgagggccattggggtactgtggcccagcatggtgtctctggcctgggatggcagcgggggccctgcctccatgcccagttctcccaagggagccctccactggagtcagagccagcacaggggggacactgttgtgcagactgggccttggagccctggggtgctgtggggtggcagagaatgcctcactgtctaggagagctagaagcagggccaggaaaggctgggaagtcggggggtggggggggcagacattccaggcatgaggaaggaccccagtgaagcaggaagtggtgggcctggggaccaaggatggggccatgctgctgaagaatgcggagtggcagctaggggcagaaaggaggctgtctggggttcagggaactttgcaggggtgagaataatgccagcccggaagttgggtgggcagctgtgcgcatagctctcagccctctgtggtggggaggagctgtggggaagaacaggctagttttgagtggacctacagcaacccacacctcttaggcacctctgccctcccaggcctcccctagcaaagaaaacaacactggtctaggtttataaatgaaatctctacttgttaggtcacccttgctgcacagctaaccctgacctcagagagtatgaatgggaacttatacttgctcatattattttacatttatgctgaatatgaaacttttcaaaacattttttatgaaacatctcatacatctgttaaatatatacgtatatgaacagtttaataaataattataaattaaacatccttgttcccatagcccagaattagaaccctgccaggacctcagaggtccttgtgtcctgccctgatcacagccctattctctgccctggagggagccagatcctgacacctgattgtcatttccttgtttgtcttccgaagcatttcgtctcatagatattatcatctttgagtttcacaataactttattaatcccatgttacagatgaggaaactgaggctcagatggttttaataaccttagtccaagatcacccaacgtgtaagcggcagaatcaggatcacatttggactggctgaggcccaggtgatttcttaatcaaaccgggatccaaaggaaaccctgggacaacccccagttttggagatgggtgccccagtgccccagaggagggggaggccatcttcatgaccaggccatgcactcctctcctggatttgttgactcccttgactgggcagggtcctgctgtgtgaatacctggcaggaaatgctggaggcctggggggcttgggaggggaggggagaggaggggaggcggagtaaatggaggctggggaagcaagaggatgggatccgtgcctagagagagcttcgggccctgccagacacaagccaggggagcccaggtctgtggggatgtgcctgagccaggtgtgcacccaggtttttgccagatttaccagatgtgccctccttggtgggctagatgtgcttggtgtgagcatgcacacaggagtgtgtgtgtgtgagtgcgtgcacacacctggcatgtctatgcatgtgcccaactctatctacatacttagactgctctaaaccacctctccaaccctcatctttttttttaattataaaattatacacgcttgggggcttccctggtggctctggtgggttaagtgtctgcctgcaatgcaggagacccgggtttgatccctgggttgggaagatcccctggaagagggcatggcaacccactccagtgttcttgcctggagaatcccaaggacagaggaggctctcaggctacagtaccatggggtcagaaagtgtcagacacgtctgagcaactaagcacgca

SEQ ID NO: 34347 - DNA, 886 bp, Bovine  19866880568362
cgctgcgggtggagaggcttccaggggttaagatgcatcccccgagttagtcccccttccaccacacggggtggggagagggctggcaaataggggtgagcgatatgattgattcttgatgtctgcccccgctgcgggagcgggagtcggggctcaagtgctatggaccggctgtttcttccaggtatacagtgatgtctggcaccccagagaagatcctagaacttctgttggaggccatgcggcctgactccagtgctcatgacccaacaggtaggggcgggagacacgctgcctgctttctgactcagagggtggtcagcaccacctgggagagagccaggcacctgcatctgacctcatcgggtgctcgattggcctctttggtcagctggccggaagttttcgttcctgtgttcttggcttgtgtaggaagtgctgtgacagggacggggtgtcactgctccctggcccgtggcgggattggtaaaaggggtgtcccggttgtgcatatacttgggctcaggagactcgactgctgaatccctcacctgtcccctgtccctgccttgcagagacattcctcagtgacttcctcctgacccacagtgtcttcatgcccactgcccagctctgtgctgccctcctgcaccaatatccttccagccctgggggtgaggatggtgtgtggagcggggaggagggatcccccgaagcatggctgtactgatccctccaggcccagcccattcatgggctccgggtgtcctgcccttcctgtgccggttcctgagggtggtgggtggtcctgttggacactgtggttcccttgactgggactcaccttccacgcggagcccgccgggggcagcgagcaggagcgcag

SEQ ID NO: 34348 - DNA, 1248 bp, Bovine  19866880599812
tttgggaactctgtgtgccccaccttaggtctggaacgctggggattggagaccctgggaaagctggaggcaggctcgtgccttgtccttcagccctgctcaggcttcttgccttcatcatcctcttcgcagaagcccaccctagacatccccgatgccctgatttccaaggcccaggttcccttggacagtaccttgcaagggaagatcacttcagctcatttgagcctcagttttctcatctgcaagatgagcgtgatggccaccacctcagattcttgtggtcctgttatctcgcccttccccgctaccccccccagtccagaaagggccctgaggacacgcctctgtgttgtgtattcttgtgtctcaggcacctgaagcggcacaaagcagtggatgcaaaacggccacttgctgaactgaattctatgggatatgatgatgatgaagaaatgtgcatgaaagctccaagcacggtgcctggctttcgggaggcatttagcaaatgggagttaaagctgaatttgaatgactctcccctgtggaagtagaactggagcccctggcccggactgtgagatggagccccaaggtttcagccctctcctccgggacccccatcggacccatcgcagaggacctttgtctgtgcccctcgcaggggcccctcccccagcgcggacctcccggcctctctccacgcaggcagcagcttcctcggcccctctggggcggtgggcgtccctgtgtcggcacagccggctgggcccctctccagggaaggggctgaggggtgtgaaggactggtgtgtgtgactttgtttattttctctgaaggatcctgcctgagccctgctataaaaataacctgcctggaaacctcatctccgagggggagaaagaagcttttgtatccaaagaagtggctctgagagcctccctgtaccttcgtcccagccccacacatcaaggaggagctggctgaggcaatggggggccagggcccaagtgagaggggtggggggcggctgccgatggagggcatggcagggttcgaaggaggagaggagggggcaggggaggagaatggggaggggaggcgctcggcagcctctgctagcagggctgaagcatctccgtgcctgcttaacccaggaagttctaaagaacgatagagaatgagagaggagaaagaagaaatcaacaagagatactctggataccatgagaggaacaaagaggaga

SEQ ID NO: 34349 - DNA, 552 bp, Bovine  19866880608562
agtaaactcaggaaaacatattaatgttagaatcctggattacccgatctttttccgagatagcctgttgtttattctgttgctcttcaatttgttttttctctccttcatctgacttaaccattgtatcagtttcccctggatatgagtcttctttggaagtcagagcctagaagacagagcagtcagcttaaataaaacaaataatggaagacacatacatgtttgactttaaaataacaaactattcatattagaattcctgccacacttcaaataattaaaatatttactccaattcaaaatctttctactaacaaaactaaaaagcaaataaatttaatgtacatcttattccaattaaagtaagtaatattcactaaagagctgttcatttatttattcaacaaagattcttttgaatttctacactgttctaggaacaatttttaaaaataaagaaggtaattgagaccacatcaccaaatctctcaaatttactattcatagtcattatctgaccatctaggataaacacaaaaatatacaata

SEQ ID NO: 34350 - DNA, 1160 bp, Bovine  19866880672489
agtcggtgatgccatccaaccatctcatcctctgtcatcccctctcctcctgccctcaatctttcccagcatcagggtcttttcaaatgagtcagctcttcacatcaggtggccaaagtattggagtttcagcttcaacatcagtcctaccaatgaacacccaggactgatctcctttaggatggactggttggatctccttatagtccaaaggactgtcaagagtcttctccaacaccacagttcaaaagcatcaattcttcagtgctcagttttcaaatggtaataccactcaaacaaaaacaaaacaaaacaaaacaaaaaaatgatacttcctctccattttttcattccctctcctttattaaatcaggaaatccaaattcaagtcattcactgacagcaagtaacttaagttctgtgaggctcaattttttcacttgagaattgagtattaatgttatatatattggggattggagatacctatagagcatgttggcttccccgatagctcagttggtaaagaatctgcctgcaatgcaggagacctgggtttgatccctgggttggaaagatcccctggagaagggaaaggctacccactccagtattctggcctggagaattccatgaactgtatagtccatggggtcgcaaagagttggacacgactgagctactttcatgtcacttcattgaggacataaaattggggattaatgatatatcttaaagataatatctggctggagtcatgtgacacccaaatgaaattatgtacctgaagttgctttatataccataagcactatataaatataaggaactatcatcaacaaggaaaagctcaccctgtgcaaacagtgaggcaggagtggggaagtgaggaagaagggaccatcttggcaaataacagaatgtttgccacccaaaactagggcggaaggaaagattgttgagcacctactatgtatccgcattggttctggatgcttttacccttgactgacactcatgaaatatgtttaatgaattacatttaatcataataataggactttaaagcctgagagagaaaaatagcccaacttcgtagaaatgtcaatagaaatggatcaccctgagcatctcatgtgatggtatatatattatcagag

SEQ ID NO: 34351 - DNA, 1329 bp, Bovine  19866880706695
tgcttctctctccaacctattaaaagcagggaaatattatcaaggtctggctggatagctcatccctcactctgatttctctcttgaaccatcacgaggttactgataagtattcaccttgagcatgagtgtaaggattggagagaagatgtgtaagtggtctggagactgctgagtgctcaggaaatatggctctaattatagaggaatcgctcctttgataccacagagcagatgcagtggctgggagctgaggtgtcaggttgcctctcaggcctggctccccagctcctggatgcttctctctgagactccgaagtcctaatgacttacaggccagacaagctccagcctcgcctggaactgtatctctgaaagcccccccagctaaagcactggctcacagagcagaaagcggtggaagcatggggcagggatcagactttcttcctaagtggtcatctgcagatgaccagtcttaattttcttattaacttagaggccaccgtgaggctggagccctgggtgtagaatggagggagatgctgtgttatttgtgtgtgctctgccatcctgcacatcttctagtaaatagagcctagatttagcccttttcttctgctgctcgttactcagaaaattaaggaaaaacactgacgtttctccttctgtgaaagtgtgtcggggcgggggtgtgtgggtcctggatgggcagggtccagtcaccagcccagagccgggcagaatctcagtgtgggatgggaaggaacccagctgtgtgcggaaccctggcctgagtgttgcccttctccctcagaccaaggacgtgaccagggccatggatgaaaggagattcgatgaggccttgaagctgaggggccggtgaggagatgaccaggaattcactagccacagaaatcagacatcagaatgaagccagaaatcgatgtagcacagacccaaaataggagcttctgttttcttctcttcttattgtctgtacaacagtttcttcccaaagagaactaattgtgagatggccagggggcttggttcactcccaggattctttccctggccttagcttttcacagtttgttattgctgtatgtggacccagctagatcatgagggtctctaggcaaggtgagggtggtgctcaggggtgtttggtaagtttatggcctctttatacccacctgctcccacgccccaccaatccttgctcaggctccgcttctgtccttggaggcttgccctgtggaacttcaagctgggtttatacccacccgcccccgcccccaatccctgctcaggctccactcatgt

SEQ ID NO: 34352 - DNA, 1524 bp, Bovine  19866880718864
tgaaagtgaaaagtgaaagtgaagtcactcagtcatgtttgactcttcgagaccccatgggctgcagcctaccacgctcctccgtccatgggattttccaggtgagagaagcatgcactactttagtcgaactccttatacttacctactttggcaaaaaatatctcagtactattaggaaacggccttgggtgatacataaattgggtgaaagatacccaggttatagatgcaagtccctctccctctaggatttctaaattactttacaaactcagccctttctccactctatcacttcatcctgatttcagaattgggagtgaaggattaatgtaggtttcatttaaaaggttaacatgagggacttccctggtagtccatcggctaagactccacgcacactcccaatgcagggggcccgggtttaatcgatacgttgcaacttagagtctgcatgcctcgatgaagctcaaagatcctacgtgccacaactaagacccagctcagccaaataaataaataaaatattttaaaaataaaaagataatatgagaattagattcaaggcagctggagtggacacagcagcaaactcagagttctcaacccagttctggttgagaactggggtccaacactggaattcctggtgctgaacttcactgggcagtgtctgttctctcacatcgatactgtgaaggatccatggctttccactgttggcctgccctataatgttggagaggctgtacttctcaaatacagatttctggacctcgcctagagattctgatttaggaggtctgggataggacctgaaggtgtattttgggaagcagtaggttgagaatttccaagacttctttgggctcaggataggattctgactttgtcttctggatgtcccagaagctccttacctgaaccctgggatcatcttggcaaagccgatgaccttctggatgctataactgaccaggtcagccaggtggggcagcatggagagctgggacaggtccagggtcacagaagggtcatcggagtcttcttcattcagatcctggttggagaagctggttggctccattgtgtctggggaaggaatagggaagaaaaggaattactcgagccagccttcctcctgtgaggccctcctgttctctggcagcagcgccagttgggaattcagcatgactgcctctctccaaagtcacttctgcccaggcgtccccctggggtttcccgcgtctttcttcaacagagtgatgaagcatgaaaatcaaagagcagagacattctgagatatgagacttctttaagagtgattttatatgtcattcctaatgatctcgagtcaaagatgaatttggaaccaataaacttgtggaaaacaatgttcagcctcactagtgatcaaagaacagccaagaacatccacttttcacctctaaactagaagcaaatatgtttaagggttgataccagtatttgtaaagatgcaggagacaggcaatccttgtg

SEQ ID NO: 34353 - DNA, 1299 bp, Bovine  19866880753660
tgagctggcccgccaggtccttggtgctcaccaggtccagcccctcggcagagcccacagtgggccccagctgatcggggtgtggggtctgcaggtggaagagtgctcagaggggtgcctggggagtccagggggcacggttgggggagagagtctggggccaaaagtctgtgcccagggccggaggcacgtcaggagggcaggggtgctgcaggaagtggaggcatgccccaaggaagcatgccctgacagctccccagtgctggggcccctcccacttgagagctcccaacagttttccccttgggacttcctccatcggctgaggcccactcctctctcttcctccttaggagcagccacagccaggccctgctctcctttccatgtggctctctcctagcacccacccgtaccactcccaaaacagcccttcccggggccctggcgccctgcctggccctaccagctcgtgcacttcctgtgggttgacaacaaagagccgctcgttaagccccagggatgtggccacaccacgggcatctggctgcaggccaatggcatctgcaaagagagcagagctgtgctgggtggggacagagagggaggccagggagcaaccggaggcggggtggaggctggaagaggtctcccaatagcagcactggagtctaggcaggtgttctaaatgcatgggtgcgcatgcccacacatgcacaggggcaacatggccagaggacaatgaaagaggagtcttggggagacaggctgacactgggcgacgctggagcctccctgagtcccagcttcctcctttgtcaaaagcagacaccaagatttcccgtgactactcatcagtcaaatgaagtcattgatataaatagcggctataaggatatgatacatatacaagccctttgaaaattgggaaatgccttacagaaatcttcgtgtggatttccatcagctcttgtggactgggactgggttttcagtcatgcttgagccctcagtccctagaccagtagtcttcaaagtaaggtacacaagaccattccatgcgtccaggaaaaaaatattagcacttatactgatttttcttacctgttttgtatttgctttgtgtgttgctctatgatcacatagcaacagtgtaggaatgtatgtatgtgacttgcaaggaaatatacacaaataagggagtctgtaataaaatactgattactgcatggggtgtccatcaaaacaatcagtgctctaaacactgggtttggacaactgcaacttgccacatggcca

SEQ ID NO: 34354 - DNA, 908 bp, Bovine  19866880780803
gaggaggcctggtggggaggggattctggctgaagggcgagatagctgaggccatcaccccagcactccctggtggagaccagatcctctgagggcatgcaatggagtaaagcaggggctattttaaaggaagtcttcatatttatattactgagaacaactttggaccatctcccatcccccgccccttccaaagcccttgtcacagcctccaacctgttccagcctcagatacccgctctccctggactcaccatcttctcaaagttgatgagattctccaccaatgtgtgatttccctcatggatgaaggtcatgtctacaaagagatgggctctgctcataggtccccaaactccttcccctcccagcagccaaggaaaggtaaggggccaataacagggatgctatgcggccctcttcctccctgctaacttcctggaacagtttctttatatctcttaggcctcatgtcatcagccatctgtctgcatgtgttaactctgcttctatccggtgagctcctagttcacctttgtggccccagggcgttggcacactggaatcacccagagggtcaggtggacactctggggcagcgatggatgggatgggggcagggggggcaggggctggtgcccttacctttgagaagaaggggcatgaaggggatgaggggaggggagagcttggtgagggccagacggtacactcggtggttccatgaggggtcctgagagggaagaagccgcagtgagagagggagggtcccgcacaccatgacctaccacgtgccacagcataaccaaatgcccacccgccaaggagaagccgtgcgcacagtccttggagctcagcctcctctcggccccagatctccccaaggcaggctgtgcggcaggcagagg

SEQ ID NO: 34355 - DNA, 1399 bp, Bovine  19866880783091
cgggaggcagtggacagcacaggccagcaggggtgacccaggaaaaggactgacatgacagaatcctgggtggttcctgcctcatctggctccctgtcagttcccccagagctaagacgggacatctgagcttcctttgagccctccactgtagaaagcactgggcagagcccggaaggcgacaggactagggtgtgaatggcacatcgcgggaaggtccccccaagagggcagggccagcaccagcactcacagaaacaccgggttcaccaggttcaccagggttgccttgaaatccttgaggtccctaaaaagtaaagcgaggacaccaggttggccccccagaacggacatcagagagcttgaaagcatctgtgtccccactttccaaaaggaaaaacccaatacttacgggagcaccagcagggcctgggggtccccgaggtcccatggggccctgcattggaacagaaaatgaggagctttactggaaaggcttcaccctcggcctccacggtgctgccgcctcccagccaacagtccagacaaaggacaaggagttactctgtgagcagggggccggcaggggctgctccctctcatttccctctccccttgcaacattctatttttatttataggtaccatttggacagagaagctggccttgctttcccctggacagcagccatgtttactaaagtctgagtttcatttagcatgtgccaagtgggagctgcggggctgagatttcctgctggaagtcttgtggatgctggagaacagtggctgctgtctgcattcttcagttctcattccaagagcaatagcaactggccttctgacagatcagcctatatgcctctctccatcctcattcttcttagtcactccagcgcatcattaaaactggcatccatcgccattaaaaaccaaatgctctgggctagctaaatgggaggttatataactgatggggaagggccgctccaagtaattatctctaaagtgaggttgtcagagtccctggctctgctgagggccacctcttgccattttggctgcaaagaactggtgccttttcttaccattggtccctgcattactcccatctgggcgccaccagccttctcatcaaatccaccagccatctgggcagcaaagttctgcaaataaacccaacaacattaaaagcttgagaggctacatgcttttcctacatggctaggtaagctatatctggatagaaaaaaactctgttgaagactaatctagcattgatcagaaacactaatgattcctaaaaaaaagttttggaaatggcttattagatgacagtggcataaccatttccctgggagatgaagtgttacttggaagagtatccattacttgcagt

SEQ ID NO: 34356 - DNA, 2590 bp, Bovine  19866880792584
aattcatgtccgttgagttcgtgatggtataaccatctcattctctgctgccgtcttcttttgcctttagtgtttcccagcgtcagggtcttttcttgtgagtctgctctccgcaacaggtggcccacagtttcagcaacagtccttccaatgaatattcagggttgatcttaattcactacttattttttgaggcataattctagtatcacttcctcaatataaagactgccccattcttggggatagttatttgattaccttttaaggagtgcatgctctggaagtgctgcccagttagaaaaagctaagccttttgaaatgcgcagtaaatttgagcaaattaacttttatggtcctcagttttgcttctcaaaatggaggtaatactattaaagggttttgtgaagtttaaatctgttaaaacctaagtgcttaatagtgagtgctgtctgtcattccgaagtactctggctaagggcaattgccactcacaggcccaagatccccctactgcagctcatacaaactcaccagccacttgtttgaccagcattgaattagtctccctactgcagtaggtttaaagaaagtctgtcttgcctgcttcactttgcctaggtgtagtttttctttggtaatgtaaatgtttaggttctgtgtttattgtttcttcttggtgacagtggtgtctccttgctgactgagtagtgtgtctcacatgttctctgttatctagataatcaccaattggactcaaaggaatagagctttgtggggtgaagggtagttagtatgtgatgtcaggatgtgaaaagggttgtattactatatctattcgagagcatcccaagtgaggtgctttcatctcaaggaagtagcatcagaaaacacagcacaggcctatgcccctttctttgctatctgttatgaaaggagcatgagaaggatgcagtttgcaaagaaagagaacagctgagaatattatgccctctcaagggacactgggtttcatgaagaagagaagctaagccaagagaggaagggttgcaagttaagaaagtcatcggcagtggtggaggtagtgtggagatttcatgtatagggaatgaagtggacccatttaccataaggaagaaggtggaatagtactgaattggaatgaaatgaaagatggttgagaaaaataggcagtagggaaaggggagttgtttaggagtatgggtaaaagggaaggaaaccggcagtctgagaagcttggtagaggtactcactattgagttggccaaaatgttcattcaggtctttccataatgtaaaaacttgaacaaactttttggccaaaccgatacttgaatctgaagagaaatattaaatagtcatgtacttaagaaaactaaaggactgaggaagaagagatttgacacctggcctctcctacttgcccttccctaacacacaggaagcgtaaacataacaacaaacgcagctgcatattccctctcctgggctagtggaggcaaacaaggtaaagttcaggctgatgatgcctcgtttttctttttcttttctctaacttctttggtgtcaactgctccctaataacctttttcttttttcttcctctactgtttctcatatagaagcagactggatgagggcagattcaggaagtgagaatgaagtgtgagaaagaaaaacagattaagttgaaagaaaatgtttactcctaaatgcctaggcagaactgaggctgggaagagcatataaaagtgctatgcaaagaaaatgaaatggaattaagtgtggttatgtgttatagatcctgttgtgagaacttagaagaaaattactcagaaaggtctccaagtctcctgaaaaaggtccaagagaacacagtgcttaaaggtacatcagatagatgagcattagacattaataggaacttccaggcctgatgctggtgccaaggaacctatgaatgctctttcctggagcctctcagcacaggaaagttatccaactctcaggactggaggaggaagctgcccctccaggcatcttcccactagacagactctgcctgggaaaggctgcttctcccaagggccctcgccatggcccccttcatttctttgtttcggaaactgtagatgacggggttgcacatgggggtgatgatggtgtagaggagggagaaaggcttgtctttgtcaggaccgtgtgtgctgcgggggttcatgtaagagaacatggccgaggtgtagaaaaagatgaccacggtcagatgggaggcacaagtagagaaggtcttgcctcgaccagaggaggagttcctgcccaggatggaggccaggatgcgggcataggagatgacgatgagcaccatggggctgagcagcaccacaatggcatcggcaaagatgactctcagactaaactgggggtctccacaggagagagcaatcactatgggggcctcacagaagaagttttctatgtggttgtctctgcagaagggattccagaatgacatatactcaagcaagatgccattattagcccaaaggaccaggcaatactcaccagg

SEQ ID NO: 34357 - DNA, 1267 bp, Bovine  19866880792585
aggagggagaaaggcttgtctttgtcaggaccgtgtgtgctgcgggggttcatgtaagagaacatggccgaggtgtagaaaaagatgaccacggtcagatgggaggcacaagtagagaaggtcttgcctcgaccagaggaggagttcctgcccaggatggaggccaggatgccgggcataggagatgacgatgagcaccatggggctgagcagcaccacaatggcatcggcaaagatgactctcagactaaactgggggtctccacaggagagagcaatcactatgggggcctcacagaagaagttttctatgtggttgtctctgcagaagggattccagaatgacatatactcaagcaagatgccattgattagcccaaaggaccaggcaatactcaccaggctcacgcagacctgctggcttatgatctgggcatagctaagtgggtggcagatggcaacataacggtcataggccatgaaagccaagaggatgcactcagccacacccacacagaagaccaagtacatctgggtcatgcaagagacaaaggagacaacatggttcttcactgtcaggtggaccagcatctgtgggatggtggtggtgatgaagcagacatccaggaaggacaggtggccaaggaagaagtacatggggctgttgagcctggggtctgtccaggtgatgaagatgatgaggccattcatggtcatggcaaggctgtagagggctaggaagagggcaaagagcaatgcccgagtggatggggagctctgctcaaagcccacgaggataaactcagtcacggtgctgccattccttaggtccgctggcgtggatccacttgaggacaaaggacaggaaaagtacaagagagacagctgtagagtaatgcagggtactcacttgattacagaaacccacctaatattagtggatgtaatataaaagataaatgagtggtggtaaatgttttgtaacttaagtaaacattatgtaattggcaatggtatagggcagtgaaaatgccagggtcaccataggtgcctccatggaatcataatatcaaaaattaaggcagggtggttatactttattttaatttactcaggcttaagtcaagtatctgtttccagtctgggaccgggaagggttagtctttaatcaaattggggagaaaaaacaagatagttttctagaacccatgccaaacagaggagtggagtacttcagaggagggggtggtagctgtagttcatagat

SEQ ID NO: 34358 - DNA, 1595 bp, Bovine  19866880825722
gcctgtgtggtaggggaagctgtaggagaggtggcgagctgaacacgcaggcttcatgagccgtggcaggcagagataaattggctggtgacaggctgatgggaaatggggcacaggtgtacaaggaagcgaaacttttttctggggttcagaagagcatctggtacaaacactatatataaaatgaacaaggtactactacctagcacagggcatttaatatcttgtcataaattacaatggaaaagagtttgaaaaataaaaaataaaaagagcatctggaacacaagttcattaaggaatgtgactcccattcccacttccttttttaactttttgcagtgcccaagaccaatcccagcacctgctggcagaggctgactgaccactgtcaggcccaggtccccactgtgacggagtcttctccctatgtagacccaggtaatcatcagctatctttaaccacactggggaatcagaaaacaagagtggcttgaaggtttttcttttctcactccagtcatttttatatggctgaaaaattttaaccatgtcggaaaactgttagaactcaagaatgccctgaagatgacaagggactcttttaactcaacgcagataaaactatttcttggtgggaggtggcagagagggagggaacttatgtatacctatggctgattcatgttgatgaatggcagaaacccacactacattgtaaagcaattatccttcagttaaaaataaattaaaacaaaactaaaaagaaaaaactgtttccccaggatagtggaagactttgtagatgttggtggattcttgttttattctttggagcgtgagtttaacaggtagagtagtggaagcacttcctgcaggttgggttgtgaggagaaagaggtgtgggaggggggcagtgagacaagggacactgttggcagggtgggttggaaagtcccaactggtgtgcttggctcaggagggctctcttgccaactgcacagacaggtctggttttaaaaagtgccagggagccacagatttgcatgttatttgtgtttcaggcttcaattccaggtacgtggaatgaaatgaatgaatgaacagtattcagactcctggttaaggggtggactcgggaatccagaccacactgaggatccaatcactggtccaacttggatcaggagacacacagacacagacagagacagaacaaacagtcaaagagacagagagacagtcagagagacaaacaccatcgagttctttttaccagggagtttccagtcaaagcaagaaaacgaaatctacagaacttattttcaataaatcagcccataaaaacttgggacagagtcacacatggatagtcagattaaggcaacatcatctttgacctctctccacatctgccctccatcatctacacccagcttcaaactggaccatatgcctgtgtctgccttcttgataatgtccactgcttggtacctgcctggttttctaaattaggttctaaggttcttgaggatgggtggcttttatttcctggtcaaaccatctctttactccacgcttcagggccccccaag

SEQ ID NO: 34359 - DNA, 1542 bp, Bovine  19866880858153
gggccctggacgagcaggcctcgcacatcccaggtgctctcggacgacgtgtgcgccaaccagcgagccatcgtctccatgtgccagattatgaccaccgcgccccgccagggtggcctgggcgtggtcggcaacaaggggaacttcccgggcgcccgccgagatccggagaccccttcgcctgggatcggggacagcgatttgctgggtcgcgatccagaggacgaggaggacgacgatgaagaagaaaaggagatgcccagctccgccacacccactagtcactgtgagctcccggagagcccctgtgctggcctcctagggggggacgggccacttgtggagcccctcgatctgcccgacattaccctactgcagctggaaggcgaggcctctctgtgaggggactccgagggggcactactttcccgggctgactttgggtttccgagtaaataaggggactgaacggcgcgatgcagcgtgcttcactccgaccgctgctcttgtgggtcaggcagaagagacttccttgaggaagcatttatagggtgaaggactttgggagcatcaagaattctttctgcctcaccaagcaagaagtagcaaactgcagaaaggtgaggttccgggagaggaagcgcccacctctggactcccatccaatcccctaccctgccctttcccccgccccagccaacaggagaacccctgacttgtgtaaataaaattctgctttttctattctgaaaaaggacttatctaggactatggcaaataatctctaacgatttacctagaaattaaggaattgggggtattctgttctggcaacagaaaatttacccttctgatgaaatccaagctattcagcgttctgcagaagcctctccccctcacagacctctgcggctgctgattggtaaaagaagcttgaggagggaactgcagccctaggaatctgggtgaatggggttccgagggcccctgggctgggaggagctggctctgaatgtgcatgaagacattatagctcaacctctaggattttgcatgcagagcggatcctgccttgtcactgacttcatctgggattgctttatccactcactggggcttagagaacaaagagcccagttcacaggcagagacttgaggtgggggggggattgctcagcaacagcccagatttagggggcatttgagggactcttgggggccgcagccgaaaactctctcctggctatacctgcttaacttcagttccttttcctgtcaatacttccctgcccgctgactctcggtgttgcctccataatgtcttgtgtgcattatgtgtgttgacctgtgtagtagtgtgtgagccctgaggggcagggcttgtggctctggtgttaggttcagggggcttcagaccttctatgagccccaggctctcatgacgctttcccctctcctctcctcttttcccccacaaccagggcatgaagcatgtggctgtcctggggatcctaaatgatatgcctccctcccacctcctca

SEQ ID NO: 34360 - DNA, 954 bp, Bovine  19866880862610
atttcaacattcctctcatccttggagactcacttctcctaggaaaccttcccccagcttgctctatggcttccagaatatctgttctttctggttttgtttgtttattttttaagaggaggataccatgcttgtagcttttttcacagtctttttttcttatttcccttgaagatgaaaatacagtgtcttaattctctctgtatcctcattttatacagaaatgagtgtttagtatgagacttaaactgaatttggatggtgctgggacaggacagaagagacagggttggattctcaacactgtttgcactgggactacatagtaacacatttatgctcatgaaatggaatgtacaccataaatctagaaaccctattctggacagtcctgatcctgttactctgccccaaaaatgccaaaggaaaacataaacacatcttgaaaggatgtctgaactgagtcaaccaacagaagcaggctggccccactctgcctccaccgtagctgtctgaatgaagtgtgtgcgttcaccacctgccatatttggggcaggtttacctctttggaatgtgaatccttccacactctatcactatttttaaatgggatttgtgtagagggagagaaagaggtcttttctttacagtttacctataaatatctttcccaataaggaaggctatgtccactataggtctaaatttaatattgccataaaagagagaaaaacagtgaaatggttattttgtctacacaacacaaaatgaggggttgaatccacctgcctcactgaatggatgtaatttggggcagatacactgatggtgtctgtttaatttctaactgttctaatattaggcctgccctactcaaagatgtaagtggacaatgattgccacgtgggaccttcattctagccatccatgcccttcttccactaagggaggaaa

SEQ ID NO: 34361 - DNA, 1263 bp, Bovine  19866880866407
cgccgtgactcaagattctgcatgtcacaactgaaaaagatcctgtgcgctgcaactaagacctgatgcagccaaataaataaacaaatatttttaaaatgctgaataagtgagtgtattgatgaataaatgagataatgaaggtgttatctggtgccgtggccatggggaaagaaaggaaagaaaatgtgaaactttttagacaaggttaaatgcccgatcttttttgaggcctttccttatctctctagtaagagattgagtatagtgccccatggctgaacatcctctgattttttttgtgcctcatttgtggtacgtaatgtgctctcttaaagtgattgaatgactactctttcctgtcagattttcatctatcttaaggcaaagactatattttattcatctatctcccacaatattcagcaccttacttggtgaatagtagactgaatatatgtttagaatggaaggatagggaatcatctgaacatttgcatcttcaatgatgaggagaaggtttctccataaattaggtaactgaataatttccctgtgactcatcatctttgggaaggaggttttccaatctcattacaaaagttctttgtctagggcatgagcttgccatacttcactttctgaagtagaccaaagaaagatacaaataatggattaacatttttctagtattagtaatctcaagtaaaagtttgctatttccccaatgaattataatacagagcatttcccagcatatcccagtaaggtcaacggaaattacttggaacttgcaaacttttctcctggggggcggggtagtcgggggacagaaatccggtaataatgttgaacatactaaggaggcacttggttcccagccagtctgttccctggccaagcccctcatcccctcttctttagtgtgtgtgggaataggcttaaggggaagagaaagtagaatcaatgagaccctcagggcctcattagcattttttacttagagccccagaggttccaagtgtggacatcccaacaggcagctttacttcagatcaattaaggccagattcatttagaatgaatctaaatgaatctcaggaggttagttagtaagatacctctagggactccctgagtgacatgcctaaagaggatcaggagcagctgggatttattaagggagtgatcaaggggcacgtgtccaggagaggtccctgcagatcttgttccaaacatccgagtagcctggcaactccaggg

SEQ ID NO: 34362 - DNA, 1976 bp, Bovine  19866880906385
ctctcggaagcggtccggagaagctaacgtctaggcctctttgcaaagagaagaatggattgtctgctatggtcagctcaccccaacagatccaagtccgtgtattctcacgtgtttcagtgcattttccattaggtttccttttattctgtaactgcagccatggtcagctctagccagggagctggggcaggggccgtaagtggaagctccctgtatgtagaatttctcctgacttctaccccagcttcctgtgtcacacaaggctggactcctctagtaccactgctcgatttcagttactcggttagaattttcctaaaaataagctttatttatttgtgataatagagtcatggttcctctactactattacgacagtgacacaccataactacactaataaatgccaactggtcactgtgctttggcttctcctcttaccatcttcacaagtgcattcttgtcagccccaagcaatggactctgcccagatggacacccgggaaaaggcagcccatgtgctaactccgtgtacttcgattcttgggttctcttgactctgtacgcagggtcccagaacacaggacaccatcctcaccctcatcccacaagcagtccctccctcatcctctgtagccaaggacactcccatcttccctaagcataaagttatgttctacctcttggtcatacacccattacccagctttgctttttttccagccattccctaatctctactccgacaacccagggttcttccttctcaacttttccccctgtgctcctttctggatgaaagccagactccatctcggtggggtgacatgcctggaaaacagagacattcaattctggacctagtttggtgggttggttgaaatgctgctttggaaaaccatgagttcttggtcagctcagtttgttttctgttcccacacttcctcattagcaagcacccatgtaatacagctgtaattgcatctgcatactgtgccctgaactgatgggatgctgccctgtcaatgagaggcttgagattagagtccaagaatcagatcctggctcttggcacaagcatacatatctctcccactaacacagcttcctcacttgcttgctgaagcaggaaggaggtttggggttttccaaggaacagaggaaaggactgtctgctactgctgctgctaagtcgctttagtcgtgtccgactctatgcgaccccatagacggcagcccaccaggctcccctgtccctgggattctccaggcaagaacactggagtgggtaaaggactgtctagtacttcagttttgctggctatccaaagtatataactgctaccccctagaaacagttctaaaaaatgaccgagaagtcttgtcagagtccaacattaattaaagcagccaaatgttctctgtacagttctttaaggggaagagaaattaataaatatcaagcaccattatcactgattcttcaaaacagcctatgcaggtggtgtgacagcctcagagatgacactgggactcgggacaatgatgtaacgaaaagtaggaacagtcgaaatttccaaacttgcttttagacctttttatttccttttttttccgtacatgagcaaaaaacaccaataacaaaaggacaaaagcagacatactttttcaaattagctgtgtcagcagattctgttcatttttatttatagttcccaatcagttaaaaaaaaaaaagtctttcacatttgcataaggtcatctagaatcaacaacttgatctagcttaggaacatgaagagtacctagactaagtattgttcacaaaaaaagatctcttttgggaaggtgggtcatctcagaggaagctcttaagagtgctcttcccccactccctaactccacctacaccaccaatgtctttttgtgtagatcagtaaaaagcaaagtttccaaaacaactgaaaacaaa

SEQ ID NO: 34363 - DNA, 1535 bp, Bovine  19866880928513
ctcctactatatggacagcagcaagataatctttctaaaataacattgctgaactactgtaagccttgggcacactcatggaaaaggagcaaaaactgcccttccctttagtggtaagaaggggccagtcccttttgaatgcccagggataattctagggacatctgggcccagttctgaacctgtgcaccatctgaggcggtagtatcttcatctttgggctgcagctgttagctggaattttcttaaacttcttcacagatcaattaaaatgtttctagagggattcttccgaaagttaatcatgttcccaaaggcaaaccaaacgcacatgctaaaagtactcttcatctgcccagagaaattcagcctcactgttgatttctttccctaatgagggttggggagacctcttcctttgcagggtgcaatataaaaggcccagtaagcaagaaacagaaacaaaagtgagggacatttttttgtttgtttgcttggtttggggaggggaggtgatgtgaaggttactgttgtgacatgttgccttgaaatataaaccacacaacaggaacaactgcttttcctgttttccaagacagacggtgctacagggcaaaaccttacgcagagttgccggcctgacgtctcctccaggctattctatgagtaacaggtattccttcagagaagctggcagaggcaggcccttgacggcatctggcagatactggagtcccaggctccggcgcacagcatagcgagaaagtgtttttagagtccctggggctgagcatagaacagtcagcttttcacacagctgctggtctttggccacttctcgtggcatggtgccatttttccttaattcaaagtgtccaacagctctgtggaggagctcaaagcaagagtcctctttctctgtcccaagtcccctgactagcagagccaccaggcgggagatgggcgtctggccttttaagttgatgactctgacctctgcaccataatcaagaaggatgctgacgctctcaagatttcccttcatggcagcccagctaagcggggtgtcattgttgtaatccagggcgttgacagaggccccgctctctaggagggcccgcacacactcagcattgttcttaaaggctgcccagtgaagtggggtgtctcggttaccatccagtgcattggggtttgcaccatactccaacaggacctccacacaagcctcatctttctcagctgcatagtggagggctgttcggttgtaaccatccagggcattcacctgtgaagagggagtgactatattacagtgtatggacgatgggcgggcaaagaggcttgcatgtgcctagccactgtctttgctatgtaattttctgaacatgcaggtcaacaagcaattcccagggagttgtgctcaggatggagctgaggggcaagtaggaaaacaatagtccccagacaaccaacactctttattatgtccactggttaactggcctgtatcatctaggattttgctgccacat

SEQ ID NO: 34364 - DNA, 1033 bp, Bovine  19866880943612
gcttaataggtttaacaggaatgtgactaggacaggccttaaataatggagtaggatattgatctgtggaaagagccaggatagccttccacacaagtgatgcaatgtgcacaggcacagaagtggggaggaacaaagtgatgtttagatgttaatggagcagaaaatttgcaggagccaaggttggagctccaggcaagagttaggtcatggaagctttgaatgcaacccaagaagtttgggtttatctgtcagtactgattatatgcagcatatttgtgaacctgtgtttgttaacaacactacgtatgtttgtgtatgttttcttcatgagtgtctcattgcatgtattttcttggcttgtgtatggatttatatgtggatgtgacctgtgtatttatcagcagctaccctgattgtcccagggttcacatctgaaacatgagctgtacttaaaggtcatcagcttctgatcgtgtgaatgaatcctctctccactgaggcctcagaggcctatgaccttcccttggaggtttatttggtgtctgaaatagagtggagaagggaagcacaagcagagggagaccagctattgaagaaaacaattcagatggaaagaggccatgaggacagaaaaggaggataaaggaagataataagaaggagaataatagggtttggtaactgttttgattcttgagattaaagaggagataaattttaaaaataacagcggttggttagcctggataactgggaaagtgatgattcagttggcatttttatggatgcgaaagtatgtcttgtattttcctttgagagagataagtcctaaagacaaaaatatgaaggtgttcacatgttatgtgtacatattcatgtctctgtggcagtgattttgtgttactcttcacatttggtagtgtttagtgtgaggggcaaggcctgaagataaaggatcaagagatgcataggaggcagagaccctgagagggatgggaaaagccagagaaagtccctcaccattccgaag

SEQ ID NO: 34365 - DNA, 1041 bp, Bovine  19866880964082
gggctccctagccggtcccatgggttttatttaaatggttcattgaaagctgcacgcagagaagcctggagcccagcctcagggtctgcccagggggagagtggctgtctcgatgcctcctgtgccctcctgcccctgccactcaggccaagctagaatgagagccgtgagaggaggacggggacctctagaatcaccattccaggcacagagcgggcaggacagagcagagccactgccctcacccacaaggacctgatgatccaccagtgccctccagtgtggagctccggtgactcgggaacccagcatcttttgcagcactggtgctgtagtccctcatctgacagttttctccatttcaggttcttttctttggccgtatcctgctcctggagatgatgaattcaccaaggataaggactgtggctccctttgcctctgggcccaagaacctgagccagaggagatgctcaaaaaataagaaatcatacttattgaaaaagaatagtagtggtggtcacatgtgggcagatacttcaaggtcgtagcaaggacactcccactcaccccagtgtgtagttaccctcagcccctttcacccgtaccttatgttgaagctcttctactgcacacaggagcctagttcaaacccaccctaaagacattcctggggaagagaggtgagtgttcttaggccaagacctcctcaaggtctttgctggagattccagggtcagaggtaagtgcctctcaagagggaccattaggataggtaacaaggtggaatcctgccctccagtcgatagagtcacgggggctagagagggccctgctgggccatgtagcaaagccgaactcccaagcccaccagtgggtggactgcagcatccctgcaggggccactggagcgagtaattgtgagctggccgcagagaggtattttgcaactcagacgaatttcttctcgcccatgattagggtatggcccagtggctgcctccctgaccataatctctgctggcacaggcatctccgggg

SEQ ID NO: 34366 - DNA, 1477 bp, Bovine  19866880982189
ttggattttgcacaatagcaattcttttcctcactcatatttccttggtttacgtagttataaacagaagcacaactggccaaactagtttgtggacaaacacatctacctcttggtgaacctgaaccgtgggggcagaaaaggccttgagtcctgcctcctggacataagcatttgctctgccatcacacagaatgttcaactgggagcaagcaatcagttcatccagctttgaaggtttctaatataaagctgaaactccagtactttggccacctcatgcgaagagttgactcactggaaaagactctgatgctgggagggattgggggcaggaggagaaggggacgacacaggatgagatggctggatgtcatcactgactcgatggacgtgagtctgggtgaactcctggagttgggatggacagggaggcctggcgtgctgtgattcatggggtcgcaaagagtcggacacgactgagcaactgaactgaactgaatacactgtaaatacaggaaaaaaattgtgtccaggagaatccttttgctacaagtaacagaaatccagactccagctgtttttgtttttgtttaataagatgggtttcaaggctgggggattcagagatttcgtggcgtcaagggggccccacattattgccacttccctggactgctactcacaggacgggcttcatcttgcaactctggccaggagctagggcttcaggtgccctgtctcttgctaagtgggagtgaggaacaatgggcatccatcctggaatcaggtccttcccctccatcttattggcccaacttgggccccatgcccaccctgggacttcttaataacaccatcagaggactggcctgtgctgcttggtctgaacgtcagcatccgctgctggagcagtggctgtgttcagcttcccattcccatgaatcacagcagctgagtaagcacccgaacaaaactggattctaggaaggaagagaaaagcgaaatagatgttgggagaggtgtagccgctcctacaggaggcttccctacttcacagtgtggcctcgggctggctctgtttcctgaggcgccacaaacgtacctccctgaggcatctttgcccctggtcagaagtcctcccatggcatcgtccacagttagcgattctgagcagctaaaagtgacaagatgaaagcacagaaactggcctcactggaactcatgtccgaacacctggatggctctcccagtgcccgccacctgcccacgcgccccttggtggttcaccatcccctcaacaggaagctgttcgaggcttctcaccccttgaacgccaacacctgcttcctcctctcctcatatcctgctgacaccattttctcagactgtgcaaacagcagctgccagactgctccttgctcaactgtaccctctgcctctggccagggtgctgcctggcttgtcgtcgcagtag

SEQ ID NO: 34367 - DNA, 1651 bp, Bovine  19866881051247
ctctgtacactccaagtactttacatataataattcatttaataacaacaacccactgaggtttagtaataatattaatcttactttacagctaaaaagactgaatatatacagggaatttaaaagaccttgtcacaggacttgaacctagataatctggtttcagagcacacactcctaaccactatgctatactgcctcctgatagggatatggccaaaaacaacttgaacacccactaaattacactgtagaaatcttgggggccacatgattttctacaaatcctgcctacctgaaggaaccaacagctaacctaaagagtaccttttcttttagagcaagagccttttgtgaatctacatgaatcccatcttcttctgactcggattcttgagacacagaatcatgggtactctcttctttgtcaagttcatcaagaatactatcctgaaatcaaaagtaggggaacagtgtcataattacatgaccattaaaaaaaaagatatcctgcccccccaaaaaagaacattcaacagaacttaagtttttacaacctaaggacttaaaggcctataaaaataatccaaataacctctcattattaggagttaattcagagaaaaggatattcttatttagaaaaccaagatccaaaccacttacataatctgactttgaactcatataaggtaaactaagtctacaaaccaaccctaaatcacaaactgttagcagtgaactattattgttttacataaaagaagtttgcaattaacccaagtctatgtaactgcatccaaaagcagggaaagggttttatctaaaacccttttttctttctgacttttaaaacaacaaaaactgcttgcagagtacaattaactcctgattctcatagcaacctaggagggtagatataattatccatgtttttcacttgaagaaactgagaaataaaagttagcaaactcactcaaggtcactcagctaggaagtggccagatgaggatctgaacccaagccatctgcctcctccaaggagctctcaatcactatgttatactgtttatcaatgtactctgaaatatagctgactatcaaagaaaatacacaacatgctcgtccagcaatttccaatctcttttgactgagacattcctttcatggtaataaatcatttcacggattgcatcagtatttttttaaactattttttttagtatgcatgcatgcaggctcagttgctttagttgtgtccaactctttgcaacctcatagattgcagcccacctggcctctcggttgacggggattctccaggcaagaatactggagtgtgttgccatgccctcctccaggggatcttcctgacccagagacagaacccatgtctcatgtttcctgcactggcaggcaggttctttaccactagcgtcaccatatataataaaagaatgatttttagtaagattttttttttgccatgccatgtggcttgcagaaactcagttccccagcaggaattgaacctgggccacagcagtggaagctcagaatcccagtccaccagggaatgcctgagtaagaagttttaaaccagtaagaattaaagagttcattaaagctcatataaacaaaaactttatat

SEQ ID NO: 34368 - DNA, 1184 bp, Bovine  19866881077254
aggataagaaagatcaagagactgagaatactcacattgttgtggattttgtctgtcacatagactaaattttctcagcatgagagagtcgtttgcctggtgttacagccaacgtgctttcctcatctcctccacacttgtacagaggaaatgggcatgatcatttgcaagaatcctaaaccatatgagcctctgactgaagggagaggggtccaactgtgatgtccctactgtcacagacatcgtcatgaggtgacatacacagatacacacagtcacactaaaggcctgagctagactttcagttgcttgctttgtgccttcaacctaattttaggaatcccaaaagtcacccctccccatttctttctcacccatattaactttactcagagcaaaaattccaggggaactttctaaattctcacacagtttgcagtaccactgaaaataacttgtcatttcagttaaaccctgcttggctggttttcttcattgtccactgcaacagcttctcttgtatcaacacttgcaaaggctttttcacctttcggtgcatgtttagttatttatcctgtaccaggctagacctgactagttctagtccaggtttcaccaggcaattggccatagatacagacattccaagatgacctctggtgcagggtctcatgtaccctcttcatgcatcctctccatgtatcttctacccccagaaagttgcccatagcttagggcctggtttgtccccaagtcagtatccttatcaggcatgaatagcgttgcatcacctgagaacacccacagtttctggtaccatggtgcaatttttcttggcaaattgcctctcccagaatatcagtcaaatttagaggaacttatgtccaagtgtttggacagggtatggactatggtatgtctacttctgacttcttttccatttaaagaattcttagaaattgacttatgcaaacttccagttcccttctcacctgtcatatctttctacctctgacttctcttccatttaaagaattcttagaaattgacttatgcaaacttccagttcccttctcacctgtcatatctttctacctctgacttctcttccatttaaagaattcttataaattgacttatgcaaacttccaggtcccttcttacctctcatatcttgagaaagt

SEQ ID NO: 34369 - DNA, 1571 bp, Bovine  19866881101456
gaattttatgctaaagactgaggtccttcttcttcttggtcgaagtaggtagcagtaaaagtggcgcctttgttactccactaaaccactccctgggtgggtcttccccatatcatgtgttgtgagcacatgcaaaccactgcttttaaggaaaggactgcctgggactttggggtccacccagggctcacatgtggtgcctcaggaggggaagaagctacagataaaacagccttgtacagaagcagatggacttcacaaggggcatgtaaaaaggacaagtcctggaggacagccttatgcaggtgccccaaagtccagtttacagtctactatcctggtgacacattttgaaaatcctgtgtgtatgtacgtgtgcgtgtatatgctggtggttttcatccctacgtttttacccacatccattcctacctcttagtaaggcctaacaacaagagtttatacgaaaccaagagtccttccaagcttctctcaggcccctaattaagagactgagtgaggctggagccctttgaaaacaagatggcagaactgaagaagtaaaaagcagtctctctcttcagattagggatgtccctcacccctttcacagcaccaaagtttctttgcaaaaatagtatctgagatacaaaaggaaaggcagatgtgcttgtgagtgcatctctccagggcctggtccaggatcaaggactttacaagaagagagggttgggagcagctgtctccaaggtctctggctgtagacaacaaagagctggtccccaacaagtccatgtctgctaactgagatggtcttcacaagagctttcggtggaggatttcccagaccatccgcttccggaagtagggcatgtgttgctgtagggacacagagatacctttattttcatttcttgcatgcagacctaacactcctttccttcttgaggttttcacctaaaatagtctcagctgcatttttggtctttcaaattgctcattcttcattacgtgtgattttttttttcctaatgctttttccgattactattgctattgctacttttcattgttgtaaacctaggagtttaattaggcatcaccaggaatccccaggctatcctcaaatgtctccaagaattttaagaatggtgtctaaaaaagtcctctgtgttgaacttttaagaggatatgagatctgaggcttgaagatcaaaactcattttgcccccaaattaaatgaacttcaagagtcagctcaacccaagggctgcggtggaaaatctagtataaagtcattactttaaacagaagcaaagggttaagtggaggacaccaaataaactataatctctagcctcaattcactttggtttccaaaggaccacgtggacagaaattaacaatcacaaactctaaggaagactgatcagctgcataaagcgaggggaagagggcagcataacaaactacactagatcaaggtgtggcctgttccaaaacttcattgctaccaaaaaaagggaaactgaggaaacctgctctggtcccagttttctgcttcttacagg

SEQ ID NO: 34370 - DNA, 1848 bp, Bovine  19866881159744
gtttatattccccattttacagctaacgaaataggcccagaacgactgctacttgttcaaatctccaggtagtagcagcagagccaaaacaaacccagatctgttgaagtcgaaagcccagctcttaaccatgatactacactgctgtttttaataacaaccataggaatttggcagaaaataacaaaattctgtaaagcaattatacttcaattaaaataaataaaattaaaaattatagccatagggatcttttcacatcttccagggggtccctaagtggttcctcccctccattcccaaccttcaccacccctgcttccatcactaccacctccgccttccttccaagcactcacaagggagacacccctggatttctttgaattatatttatgctaaatttcacaaaggctccctgggcttctcaacccaccagccaataaatcaagccaagacaacgagctcaggtgagcatataaaaggcctccaaagtaatatatatgctcatcgcacagctgtctctctctctcatagctcacctcctttatgagtgtctcctaatcccttacattccttcccagtagaacaacttgtctgtctcttatgccccagagaggttttactcaaacaactatactttattatgagtatttattttcatatctgcttctccaccagattgcgaggtagaagctgtatcttattcatctctgagtctctggtatttagcatttttcagtacttattggtgagtacttactaagttcttgatcagtgaatgaatgaatgaattctctaccctacactttaagatactttccctacccagccaaatgatgcataaaattgtaataccaggtattataatatgagcttttggcataagaacttgtgccttactagaggattaaagccctttggtcgcttaagcctcagtgaaaatgatatccttagggggaggtatatagggacgttaggagagatgattgcatggggtgcctaataaggggcgaaggaagggaaagatacagaaagatagatcaaaagaccagaggagccttttgtctttaacagcttttctgaggagcagcactggttgccatagcaacagcagcaatttgtggtagttccttccagcgtcctacctgcctgtgaggaggacctgaaagctacaacctcttatcccagcaggacattctcctggcatctcttgagagtgggagccagcataggactcagggagatggcagcctgggctgaactagcttgaagaaaagaagctgagaggggcgggcaggaccatactgctgccaggaggtgaaggctaacgcgtgggcgcaagtgacacaggaataaaggagtaagctgccacagtcggcaaataaccgcagctggggcaacagttttcagagttgattacctagcgatcctcttacttaattgattttatacaacctcctgactgcgaaattgggggcctcaaacaataaaggcaattttcaaaggacagctgcttgctcaaatggacaccccacacagagttgtttcttggagttctgatgacttattctcctcaactaagccagaaaatatttttataaacaagaaatgggaagaatgccagatctatgaagagaagattgtgcatgaagggtgttgctacagtatgtaattagtagtcttcctaatcaaatcagcagctttgttgtaagatttgcccatttctgcagtagaaatgatttggaaatactaacaaaacagaatagtctttctaggttcttctttattctcagtctaagccttgagcataacttcagatcaacggtatttttttgcaaattatga

SEQ ID NO: 34371 - DNA, 1114 bp, Bovine  19866881166517
tctgtggccggagagggtgggttctatgaggtggattaattgatttggattgaatttttatacaaaagaatcaagactataaataaatatatacctcagcattgctagagaaacattttccttccattagattgaattctaaaggaccatataaaccaaggaaaagatcaaaactcgttcctcagtggggacagtaggaagaaggaccctgggtattgaaggcagaggtcttgcttctctggagctgacagagtgggcatgaattgtgggagttctaaagattccttgtccagcaatatatactgttttccttagacatggcagaagaaaattcttcctgaggattgtcagccccatttttgcagtggcagctccccaagctcatctcattctctcccaataccttaggcaatatctgaagcaagaaagcattgacaagaaaagaaaagagtttgacgccaatggctggcagctcttcagcaagaaaagccaggtacatttcatcttggtgagatggaaatcctgagattagagtattggttagaaaaggagtatactgcttgggccctggcatccttctaagtgtctggcctgacctcagccagggaagatagagtagagtaagctatctgtgggaaaatcaataatacattttttatgaagaactaggttttctaaatgcccagctattttgctaaactttcatctatgggagaaaatgtttgcagactggttggcccttgtgggagggaccagcttttacacccttgggtatcatagaaatctcagatagtctcctgtgtgataaacatgaagtacacaggctggactgagatgctgaatttttttgctctctgagcctatgttgttctgagtgggggaccaggaccatctctttagaattcagggaaacctggaaaatttatatcctttggttcttatttataattgaataagaaggaaggaagcttggaaagatgtcacctttttgttattttttgccttttaggaaattccacagcagatgaatggaagcgactgtggcatgtttgcctgcaaatatgctgactgtattaccaaagacagaccaatcaacttcacacaggtacgccaa

SEQ ID NO: 34372 - DNA, 4650 bp, Bovine  19866881240915
ttctgtgggttattgtgagtaaaaagtatttaatgctagatattttactcatttttctgccagggctgttggattgggcccaaactgtgaccattagctttgattacatggctaatgagataggaagagacgaataatgaaagaatgtaggtctggaattctatgtcagtgtgcatctgacttgtatgcttttacagggcaataaatacttcaaacaaggaaaatacgatgaagcaattgagtgctacaccaaaggcatggatgctgatccatataatccggtgttgccaacaaacagagcatcagcttacttcagactgaaaaagtaaggcgtttccataatgtgtgtgaatattttatgtgcatatggagactggttttttttttttttaatctttcttaatgaaatgtgtgggaatgcttgagaaaattttctatttcttttcaactataaattcttattcactcccttttagtgaattctttaacttaagccattttaaacattcaggtgctcaaaccatgctccttgtagttcactttattgaggtgttcctcctataaaaattgagtaagatgccctttccctaatttacagaagaaaaaaagttaggtgggtaaaaattctttataaattaattttccttcattattttgaaaaattatgtatttactatttaatacagataacttttattatggtaagcttaaaatgtattccaacatttaagtcatactaatccttaaaatacatacttagtgttgaagaacataaatgtatatggtgttaatcctaagcagagaaatgacctagcataaaaatatttaaaaaaccaaatactgtcaaggaggatgttcttactgttttaattactatttggaaatataaattatattggtgtctgaatttttactacttttaataacattttaaaatctttgaaacttacgttattaatatcctgaaaaattaggggatatttaccttttataatatttgatagctacagtatgtgtaaatgatgaagaataattttaaataaatctgcatgaagatgcttccaagcttaagaatcagacattatttttcaaagctacctttgatattcttttccatatcctgacccttgtccctcccagctaactactgtcttgagttgtatatcattcttttgattaaaaaaaatttattatatatgtgtatatctctaatacattgtataacattgctttatttttgagctttaaaagtatatcattggatatggttttctgtggcttgcctatttatttgaatactatatttcatatttcaattcatctcataacatttgttcatgttttgcatatatcaatagctgtagatctctcattttcactgttgaatgcatatgcagttccttgttaggaatataccatcatgtatccattctctaattgctggattgctggttggttcctttattcctcaccttccttgtcttctttcttttcctgccttccaccctccttcccttaattatttaacaacagtgatactgtgagcacttctgtacatgtttcttggtgctagatcttaggatgtgcacatgttcaacttttaatgatggtgaccagttgttacaatgatagttgtacatgcttacattcccattagcagtgtataagaatacacgttacatatccttaccaacgctggtataatggggtttctgaattgttttcaatctaggggtgtaaagtggtaattcattgtggccttaatttgcatttccccagtttctcatgtggttgaacatcttcttatgtgtttattcaccacttatcttttttattttcctgtgatatgtttgttttgtctttggtccttttttttgttaggctgttttttctgttgatttttaagcattctttttttggggatactaattctttagtgtttataatatttatcttctctcagtttgtagctgatctttttttaaatgaagaaacagaaattcttattttaatgtgtttcatttattaatttttataaaatgttggcactttgaaaagtatgatttgtgaaaatagtccccttctttgagttcgtaacaatctcctctattttctcctaaaagttatgttttacttttcacgcttaagtctctttgtgtatgctgaaggtacaagtccagtttcatatcctgattgtttcagccctatttattgaatatccttgctttccacatggatctgcaattctaccattgtcatatgtcaagtttgcatggatctgtttctcatttctttcttctcttcattgatctgttgccctttactaatagccattccatactatttttaatttttatagcattatagtaaatcttggtatttggtatagggccttattattctttaggaatgttgggtattcttggacttttaccaatcagtataaattttagaatcatcctgtccgattccttgaaaaattttgattacaattgcattggacttacagatcagtttggagagaattatattgttgtatttttgtgtcttttagatgaatgaaattgctgtagttttctttcatgtctttgaagacaacctcataattttctgcatctggatcttgtacatcttttgttagatttattagtttatttttgttgttgatatttagtagagtagccactttgcttaactttctttatttttaacagtctgtctagcttgttttgaattttcttggtagaccattatatcatctgagaatgtcagttttattccttcctttccagtctttttagttctgtttctttcttatggaacttcattggtcaggacctctagtagagtactgagtaaaagcagtggtagtgggcattcttttctttgctttaaagaaactgcttacatcagaaattactgattttactagcttaactaaaagaagatggtagcacagggaactctgcatagtactctgtaatggcctctgtgggaaaagaatctaaaaaagagtggagataaataggtatacacacacacgtatacatatatgtatagctgattcactttgttgtatgcctaagactaacacaatactataaatctactacaataaaaattaaaaagaaaatagaaaaaaaaaagaaacatgccttcaaatgagaaataaatccccttttcagagatttcagaaacaaattttttgaagtttttaacagatgatttttattaacttcactttatttttttttttttaaattgcagatttgctgttgctgagtctgattgtaacttagcaattgccttgaatagaagttatacaaaggcttatgcaagacgaggtgcagctcgatttgctttgcaaaaattagaggatgccaaaaaaggtattaatgttttccaggtcatcattatctaaaaagttatttaatagtttaactgattctatacaaagaatactagataatcacagttactatcttcagagatctttctatattgaataaaactggtttttgccatttaaaaggtattttgatattttgggaaaagaccttgttatttgccactgattaaactttggttcatattctcattcaaccatgagttcactctgttaccaggggaaagttatgtatcttctctgattttcagtttcttatatgtgagacagattaaaatatcttgttggcttttgtgaggctagaggtaatgcatgaacctaacacatttttatttattttaaaattttaatccttttattatttcataaaataggcttgtgtagtataaatcagaaaatcggaatgaagtttatgtctgaaagattgtgctcctttgttttatgagatgtaacttatgatagcaagtgttcttcctgaggctcaaagaaggaggtgatctgacacaaggattaagggttttatctgtgctgggagaacggaggaaatccagtggaataatgtcagtatttcttagttcctcttaatttaaactgtcccctgtaagcaaatgactgatcttttatacaggtttttgaataccatctatctttttttgattgttgttggttacattgagtctttgttgctgtgcgcaggctttctgtagttgtggctcgtcggggcgactcgtcattgtgacttttcttgttgtggagcccaggctctagggtgtgtgggtttcagtggttggggctcacgagctcagtccttgtgacttgtgggctgtagagcatgggtacaatagttgtggtgcacaggcttagttgctctgagacatgtggaatcttcctggaccagagatggaacgcatgtcccctgcatcggcaggcagattcttattccactgtaccaccaggaaagtcccatatatcttttttttttaattatatttttaattgaaagataattgctttacagaattttgttattttctgtcaaacctcaacgtgaatcagccgtaggtaccatatatcttttaaatattctgttatcttctgttttactcagattatgaaaaagtattagaactggaaccaaataactttgaagctacaaatgaactcaggaaaattaatcaggtaaactgcagttatttaaattaagtgtgttacttattacctttattgacaaagtaaatgttttt

SEQ ID NO: 34373 - DNA, 1336 bp, Bovine  19866881247192
ctctctgtctaccctcaccatggctttcatctcccctctctctctatccccacctttaataatttttccattctctttcagcatgaatagcagaaagggcactgtccccaggaccaggaagtttcttttggttttcatacactaatgataaatggccttgatccacaggggttttgaggatactaaatggccacaattagagtcttacctctctacctttctagatacttgacaagtcaggtcacttcctctttcccgaggttctgtttccgttttaaagtcttgttagtggcaccttttcgcatgaagttcctcacagattgttgtgaggcatatgtgagagaatctaaaccatggagagtcttggatggaagggatggtcccagttatgttttcacaatctagtcttactttatttctaattttcactttattccccgatttgactttatcttccattttcttcccatccaccttttttccttttatcttcctcatgatgtgtttctcttcctcctttcccagttgtgcttttctctcacttcattttcctgtgaatagttttcctgtttatctgtgcatttttctttcctgttcctttgagaaaagatggctgaggaagtctcaaataggtttgtgaatatattacaaaacaagcaaataacatgaaaattcagtttttctcattttctctaaggaatacaaaataaataaatttaaaaggaggtagggcaaggagttgagatgagacaagagtttaacctgatatacaaaagaatttcctgatccagaagagtgattttttaaaaaccaccagtttctacccaggaattttccatgtaagtggaacattggatcaagattttaaaagatctcttccaacatacagagtgcaaagaagaaaagaagggagaaaagaagtaaaggagaaggtaatgaatgtgtactaaacaactactgttggtcagtcacattgaatataggtttttccttatcaattaatatttacaccagtcaacaaaatgttattagtaagtttatctacttccaaaccctaagctttttctatacatctgccatatatatgtatatttcacatgtagatgtcaattttcaaaatagtatctccatcacctctaaatattaatacaatgtatgtcattgacctgataatgctttagttctttccaagactttcagatggtctgtcttctctccctatctttgtatttctgattctttttacaatctgtacagtttttctagacaacataaatggcatttgtagttcacactaactgtagcccttagacttctaaaacaagcctatcttctg

SEQ ID NO: 34374 - DNA, 1230 bp, Bovine  19866881253092
catatttggtatacccatgagtacattaattaaacagcattttcctttgcattgataaatgatcaaaggaagctcaccaaaatgttaaaagtggttccttgtactttcatatattgatatatatacatttttatggtataaagtaatagtatgtgtaataatattattttggtatgatttataaaatgcaccaaagataaacacactctcacttactcatgacatcttcttactctttgtgtttaaaatacccttgttaaactgagtaaatattgtgtataattagtttgtttaataaagctatatgtatatgtaattaaaacatattaggtatattaaaaagaaatagatcaacttaataaatacgtaatttattcattcactcaacagatattcataaagaacttattatgagccaggccctgttttagacatttgggaaagagcaattgatcaagaccctgatgctggggaaaactgaaggcaggaggagaagcgggtgacagaggatgagatggttgggtggtgtcactgactcaatgcacatgagtttgagcaaactctgggagatagggaaggacagagaagccctgtttactgcagtccatgtggtcacagagtcagaaacaactgagcggctgaacaataaagactgtcctcacgatgcttccattctattggaattaagaaaataaaatagaaatggctttggctaaaagaatgttgaagtggctaaaaatatacatctcgaaggactgaaaaagatttagaagggttaaactcatggtattattaagcaaagtccatcaaatttaataattcttagacatatgcatttcagacagtcatattctgagatgatttccttggacgttaaaattaagagaaatacagacagaccccaaagcagatgcaaaaatagaaaactcttaaagagttgaaatcatccaactatcgatacacataagctgttatgaatttgttaaatgtgaattttaggtgaatctgtcattgtgaaaattaatcattaggctcacaggaggattagttttaggatacttagttcactccctttaggctacggtggaattaatatctaaatagcttttgtgatttttatgggaattaaaagaaatattgttatcaaatacctagctaagtctaaccttcatctattatagagcaatttatattgtcatagccttagcaaaaataagacttatgttcaat

SEQ ID NO: 34375 - DNA, 1399 bp, Bovine  19866881281283
ccacagacgttttagaaagagaaacaggtggaatgtaaaccagatttgcattctggttcctagttgagccattaactagtaggacctgagcaaatcaaagtcatctctgtgggtcttggttcctttatctgaaaaattaggaggttgggataaatgacttctaagtagtttctgtatctatatgtctatatccactctttattttcatgcactgggacagtaattatgcccatcaggatgtatttttggtattattatattattattaaactttacttagatggaaaatatccatcttaatcaatatgaacatttcctttattaaccactccattgaaggtatcagagaattgagttcaacagctagaaaaacatatatccaacaccaaactcttcgtcttcaactccctacttacatgaggattctgcaggcttcattgtttatcccacccatagagtcgtaataggtaatattcttctttctaaagtccacaacctgggaataaaaaaaattctctgtgtttatgaactgaagaaaatctcagcttttcccttccctggaacttggaaccttctgccagatttcctatgaaatcatgacaagtttgatggatacttagcattataccatgcttcatctgcagaggaaagaagaacagggtgattatttactcagaactatgctgggggctgactgactaagtggcccagtaattgccctgaaacctttttctagtttttagggtctccatttgcaatggaggcaacagtgaagacacgacgtgctcttcagagaatgtaaactaagtgagatcatttccacacattttcagaaagatggtaaaagattctaggttttgtttcttggagaatttccttttgacttaatacttttcaaatataattcaagacaggctttaacttgtatacttttattaatatattaagctaatgtatccatgttctcagagtcatgtttgtgttagttgctcagtcatgtctgactctttgcagccccacagactgtagcctgccaggctctgctgtccatggaattctccaggcaagaatactggagtgtgtagccattcccttctctaggggatcttccttacccagggatcaaacctgggtctcccgcattacaggcagattccttactgtctgagctaccagggaagccataataaattatcaagtatgcaaggcaaatcatgattaggcagaaaataatggtcacagaatctgagttggcagcatcattaagaaatcactttttctccccatgtgttccttgcctttaggttgctttgactataactccatttttaagtatttccagaaaagaaaatttcagagcttttttcaaagtctaagtatctcccactctgacagggag

SEQ ID NO: 34376 - DNA, 1027 bp, Bovine  19866881298164
ttttgaggttttggatttgatcgggctagtcaacctgtatgtaatattggttcttcaacaaacagctttcatttcctttacatagttcttttcatctagggtgagagggtaataagtccctctgggaaatgtcatgtccactttcaccatacaaatctgaatcaatcggtcctctttatcccttaaaataccccacttccatcaaagatacattgaatttcatcatccaagtgtagatgttcttgataagttatcttaatccttgtcttaaagcttctgtttcttgggcagccatttctctgtgcctagaagaatatttgcttcatactttggcagtttatatttgcacatggttattatgtcaatccaggcatgttttctctcttttcagatatttttcctaattttggatcattctcatatttgtcacattcagttttcactaaaagacaccatgtcaactcagttgctccagactgactgtgcatctggctttcattaaagagtttcctctagtccgagtaattggtcatatactgtgactccatgtttacgtgaaataggcaggctgtttcccctacagaaattcctgctaacagtatcataaaaatatactcaatcaaaaaaaaaaaaagaaaaacaggttgaagctgaacatatatactaacagaagtctcctgaacacaattcttgatttgtggcaagaaatcaaggtggcatggctcaagcctctgtcttaaatatcattcttttttcatttttaacctatttgtcattatatttgaagtggttcttataagcagcatattagttgactcttgctttctcgggcggcctgacaatcgctgtcttaaattgtgatatttacaccacttacctggtggctcagatggtaaagaatctgcctacaatgcaggagacccatctttgattcaaggttcgggaagattccttggagaagggagtggctacccattccagtattcttgcctggagaattctatggatggaggagcctggcaggtta

SEQ ID NO: 34377 - DNA, 1095 bp, Bovine  19866881335499
gcaaagatgctttatgactctccacctttttttcattcaacaataatttgattggaaccaccagcagcacatcaaaaaccctatttccagagaattctctttctgcaattttttcctccccagcatgctcatccagtcatgttcataaacatctctagaacggaagaatctcaggcttcacagtacactgaagctggtccgaccaaacgtggttaagttggaaataagcatttggtcaaatctgtatttaaaacaagtgttttttgccaatatacatgggaaaatattcaacatcattttaaccagagaaatacactttaaaatgagatacaatataggccaattaagatggcaagggaaattaagtattgtatgaagagtaaaaggtttggagagtgtaactgatacggtctttgtgtcagataatttatcaatattgataaaagccttttgaaaacctcatgcctctgacccagtaattacatttatagggatttttctgagggcgagattagaaatgtgaataagagatttaactacaagagagttcattgcagcactgcagcaagaagatgaaacccacctaaacatccaataacaggggatgtattgggtacattgtgccacaatgaaacaccgtgtggccgttacagaaacatgatcaaactgtctctaaccacttggggggacgtgtatgctatactgtgaatgcagaaaccaattcatggaggattcacagcaaattaagtatggtaagatcataaatatgaaagctatactataaaatagatacagtgataatatatctgagaagtgggattatggctgctttttaatgtattttggtttatttgattacattatttccctacaatgaatatgaatcccaagtgtaataaaagttattcaaaaccaaatgtattatgttgcagctcacatgccctggaatatcccaataagccaaagagattcacagcctctgaaatccgataatgactgaggacatcccacaaatccccttatgttaaggatgatgacattatctggaacaattatggaaaccctgtgagtgagttctgcccggtagttaccaaa

SEQ ID NO: 34378 - DNA, 1258 bp, Bovine  19866881335629
ctccgactgtgcagacccagcctgaggatctgtgacgggcacactcagagtgaatcctcacaggaggatgatactgtctacacatcgtggggttgctttgagggtcaggtgaaataaccctgaatacaagtgcctcgtgaactccaaagagctgggcaaatggtagctctgggtcttgtcagttactcactgcagcgccggcagggccagtccgtcctctctcaccaggcaagccgcggggaccctggaacacacaccaagaggcacaagcatgagttggtttaaggaccgctcggccccatcacttaacctgcaggcccttcatggacactggaagggagggagccagtagcccccaggaggcaaaggtgtggacgcccctggtcccgccttcctgattcaggaccctcctatcacaccaaaggtttctctgccgtggcaggatacacaggtgctcccattgttacctattaggagccctgttataggcacatcttgttccttgcaatagacgaactcccccaaatgttgaaaataaacagaatttgtaaaaattgaagcacaccttcagtgtgttaccagggttatttcaaagaaatgctggtgagcccttgcacaaaccatccagttgacacactttactttttgctcataatcgaatcaatctacaaaactgagtatctactttgcccaaagggagcggtggcatctacagtggcgccatctgctgggctttagaaggtgtctcaagagtgtctggaggccctccagggggtggtgctcatactcaccattgggcctggagaaccgttctcacctggggaaccactctcaccctggaaaaaagatgcggagggtcagcgagcagggccccctctgccagcccgcaagacaattcccatggaggaagccggacgctctggtcatctcagctagcgccgacacctccaagctttagttccatgagggacaattcccggagctctccagacctgctgctcattcattaagttgtagtgctgggtgttcctaacccaagctgttcagacgtcctaactccactgagctcagcagcatctcctcatcgtccgtcccccatgcccacgtgctgcttggtccttaccttcacacctggagcaccagcttctcccttagcaccatctagacctgggtaaccctacggaacaagagaagactttcaatcacacttctggggaagccgaagaggacgattcatgtccgccccaccaagagtttt

SEQ ID NO: 34379 - DNA, 1741 bp, Bovine  19866881361512
tctactcttactaatgcctctacttatgctctctccagatttctcagaagccctaaaagtacaattgaaagtggttcctaccacttccctcttgctttgaggtggtatgctgagggccaacaaggcactgccagctgcactagtagagcacccactgagagggtgcgctatggttctattcaacacgcataactacactagtatttgtgattgtgtcatgaacagggtcccctaaatgtaatccacatcttcaaaggaccacaatggtgctgcaccttaggcagaagtgaggagaagggccctttctccaactttttcactgaggccctgaagcctctggtttaagaagtcttacaggaaaccagctctatcttctgtggtcagccacacactcagtttatagatgcagtgcctgttttgtttgtttcaaggcacaaggatccccttcattctagaactctctagtccctctgctttatacgtctccacagccattaacatccgtgatactgtatttttatttgtttgtttatttatatatttatttattgtctttcacctcccactaggtgtgaagtgaaagatccctaaagagccattagggcagaggtttggttttgctcacggcctggtacctggggaggtgctcaataaatatgtgttgaatagatgaatgaatgaatccatacctagaaaaataaacatctcccttaaggacacctagcctgcagagctccaactctgccttatcttagagagcaggttatctatgatttcagccatctacttctatgatctatggcttatgttcacacaattcaatggctcttttagtggctttccttgaataaaggaatacttactataagacacatggaagtccccacctcttgcaaaacagaaaaagacttgtaactttgaaataagaattaccatatagccagccacccactggaatccccagtggcatattctgccaccatccccatcagagtctcaaaggttggggccaagttttagtccaatgtcaaggtcagaggattgcatgctctcccctcccctcaaatgtttgagaatggaatgatgccaagcctgcatcctgtatgtcacagagaagtcctgatttatacttttattctattagagacagccttcaaaaaagtaccctgccaatggttataagattggtagctaactgagaaaggatattattactatgctgtaaagattactatgctgtaaagttagggtttctcttccctttgagttcctgagctgatagactagtaatttagtgtaatgttagcccagggtactttatactataaaaaaaaaattgaggcctttttgtcctctccttatcccatccttacttatgttataaaaacaaaacaagcaaaaactctccacattgaccaaatatataagacatataaagatcagtttttccaggatagtaaaatcaaattaaaaaccaaacatcaaacatagatcagaaaagcaatattccaggaattgaggttagtcttcaatcaatattagtaggacaatttcaataacaacttgctgttctcaacagtgttatctaggtctctaagaagcagagggcagtttcactggtaattgcccagatcaaatgcattaatctggaactcagttcccctcagagggcgatcctgagtcacatatctaatctcccgttcatcacatctcatctatcaccatatcacacacacttcca

SEQ ID NO: 34380 - DNA, 674 bp, Bovine  19866881378522
catggcatgggcatggagaaggccctaaatcaatggatagctggaggccagcttccttttcccacacctccctccactgcctgttaccttgagccattgttccccaagctgggcagaaaatagctcactcaagagaattatttttgtctctgttaaacttcaatcctaggctcctgatgagcctggctgcagaattgtttttcaggccagggggagttctggggaaagtgaggggtcagggcataaaggggaagcagtggttggaggggtgccacctcttcccccaaaggaccatgatgaccacaaagcaccggccctcttccctaggacgctgcccagtgggcggcctgactagtggccaacagtgtgcagcctgcccagcttcactcagggctcctttcaccaagtgcaggccctgagcaggtccagggctgtttgcctctgcccagagtgttgagtgaaggtagtggaaactctgttacatggcgtggaggtccaggtgggcagctggggggctgcagacggctgactgccaaggagggaaagaggtttttgcattggagagccgggctcagctcctcccgtgccctgaggcagcaccaaatggcacagttcagttcagtcgctcagtcatgtccaactcattgcgaccccatggactgcagcacgccagg

SEQ ID NO: 34381 - DNA, 901 bp, Bovine  19866881444140
tgggtgacttctctggaggtccagcggttaagaatccaccttgcaatggtaaagacaatggaagggttccttccctgatcggaaaactaagaccccacttgcctgggtacagctaagtaagcctggagccacagctagagagtccctatgccacaactgaaagatcctccatgatgcaatggagatcccacatggtgcaactaaaactctatgcagccaaataaatagataaaatttttaaataaataaaaatgatgaaatactgcacatcggtattatgctcactgcagaagttctgcttggtgtcatccactcaggtgtccccacttttctctgctccctccatctttcctgtttctgcttccaggaaaactaccagactccactgtccatttccttctttaacccttttctatttttttgtctatgtcacacaattagaccatttcatccactaagcatgttagaatgctttgcaaacaaaggcaaaatctttgtactcaaggagtttacagcccaatggagttcaataggacaaggatacaggtaaatgtaacacaaggcagaagaaaaacattgcatcttaaatataaattaaatactatattctttcaaagcatgaggaaaacagactttgtggtgaatctctgtccgcctttggcagatgttgaagtggaggcccccagggaggaagtgattcccttaggtgccaggatctggttcttatatgtatatatataagatcaggcactttctccgtgtgtctttggcagcatgaccctgagtggaccagggttccattgtaaagtctgaaatccctaagcaaatggaggcggtctgcttttttgtgggtcaagttttggggaaatactacatagcatatcctcttttttggagttca

SEQ ID NO: 34382 - DNA, 778 bp, Bovine  19866881954999
tggtgtcagacatcagtcattgttacttcaaatattgcctctgttcctttctttctttctcttctggtatttccattgtgcatgttacatctttcataattgttccacagtccttggatattctgttctttttttagggataagaatggcactcttgttattgtttagtggctaagtcatcatacggctcttctgtgaccccatggactgcagctggccaggctgctctgtccatgggcttttccaggcaggaataccggagtgggttgccatttccttctccatgggatcttcccaaccctgaagggatcaaacacgtgtctcctgcttggcaggtgaattctttaccactgagtcaccagggaagcccaagaaggtcattacataataataaatgggtcaatactctaagaatatataacaatccttaatatgtatgtatttaacaaaaaagcttaaaattcaacattcaaaaaattaatatcaaggcacccagtcccatcacttcatggcaaatagatggagaaacaatggaaacagtgacagagttaatttttctggacttcaaaatctctgcagatggtgactgcagccatgaatttaaaagacacttgctccttggaagaaaagctatgaccaacctagacaacatattaaaaagcagaggtgttactttgtcgacaaaaggtccgtctagtcaaagctatggtttttccagtagtcatgtatggatgtgagagttggaccataaagaaagctgagtgccgaggaattgatg

SEQ ID NO: 34383 - DNA, 3460 bp, Bovine  19866880122513
tcatcttttaggatttgaaatagttccactggaattccttcatctccactagctttgttcatagggatgcttcctaaggcccacttgactttgcattccaggatgtctggctctaggtgagtgatcataccattgtgattatctgggttgtgaagatcttttttgtatagttcttctgtgtattcttgccacctcttcttaatatcttctgcttctgttaggtccataccatttctgtctttattgcccatcattacatgaaatgttcccttggtagctctaattttcttgaagagatctctaatctttcccattctattgttttcctctatttctttgcattgatcacaataggtatttcttgacataggaaaaataagcataatgtaaaagaccttaaaaattttccagtaattaataaatactgttgagtgataaatagctcttggtttatcccaattttacagtccccaggtgattgtcttcatagttaggataaacaaaggagggaaatatgtgatatcctttgctgtaatatatttcattggccattaacagtacttttttgctttaaaaataggtgtctgcatggcattgtcatataatttaagattattacattaaattatttaaattaattgattgttatttaaccaatattaatcaggacagtgtgctgcagtccatagggtcacaaagagtcagacatgacttggtgactaaataacatttaatttttaaattataataaaatgtggcatttttataatattaatgctcattgatgaaacttcaaaatccacattagtctaaattcttaacattgtatatgttttttctaataaaacagagctgggaagcattacctactaaaaagtacacagtgtagccattataatttatgccctaccttatttcttcccaactagaagaaccctgaaacattcatcatagagaacaaatgagaaagaaaactattctgtttcttctagaaaattcttatttggccccatctaccaccacctctcgcctatcactctggcccaaaagaccaaagaaaaattagggtgtagtgagacagtagttaaatgagattaccagaagtttcctgagatgacataatcaggggaaagaatttctaaaacggcactccccagtaatatcccgtgcaaacataaccgcaggtattaagaggttggtagtcacttgtgagttttagtttgagtcagtgaccaagagtccagtcacctctgaaacagaagacacagcatttgaccttgattgtcacctctgcaacactgcaacctcatcacatatccttcttcaaaagtctactgtgtcatttagattgtccagggtcttccacttaaaatgtcaggtagttttatgcgctaagccaaatgactgtgttttcctcctcttttactcattctcccccaaacaacttggattttttttaaaagctcttaatcagaatcgagaagcttaccaacagatatttattatcagaactcttaacatacaaaaccagttttctttccctgctttccccaatatgtgaattcagaatttaggaataaatgccaagggaaaatttttaaggtcttttactttatgtttattgttcctatgtcaagaatacctattgtgatagtttcattcaaataggtttacttcccttctctgagctccttgtgaaaggagttcccatggctaggaagaaacaatacacaatgccagtacttccctgaaggatagaccctggaaacttaagtacattttgtatatagtgtgtttatttaacttaccctgattaccatatcaaatctagcatccctaatccctgtctattctcttgccctggtttatattcttcataacgtgagtcatgttgttattactgttatgttatccgtgttatattaccttacttatggtagtatcagtctcccacactagcacggaagccccacggtcttaaactccactgaatcctcagagctttgaacaggattagcacatagtaggtgctcagtaaacatgagctgagtacaatggacagctttggttgtccttcctgatcatatccttttgctcccatattgtttctgggaatccctttgtgtgcctttgattctggtagccccacccctccaactcttcttcagagcactgctctggggttacccgagctattttgccacctcatgcagaggacctaagtgcctgggtgcttacatctcccctgggcacccacggccagtgactgactgatacagcaggatgacagcccagcttacttgcccgaaagtccttagctcagcatctgtttctaaggaaccaaacctaaaacactgagtaattgaacatgtgcactctaagatttcacacaaaccgaatcattccttaaaatgtttgcaataataacaaaaatgtcgaccacatttcacttaattccacagtaaaggattgatatttaccacatgaatctatggtacaatgaattatgtggggcattttctttttggccatgctgcatggcatgtgggatcttagttccctaaccaggaatcaaaccagtgtcccctgcattggaagcacagtcttaaccactgaactgccagggaagtccaatctggggcattttagaaagggtttggcttcaaaagtaatttcacaaacaataactataagcattggaaaaaagaattggctgagtcagcccccattaactatgcagaattatacttctcttgattaatgctgtgatttgaaaagcactgctctttaaaaaaaaacagaattataacaaagaaaaattaaaaatgcatttgcttttaatgttgcctgcttctcataacttctgcaaatgtcttcatttctcagtcgaaatgtgggtaaaagaagtttactctgcattctccagaatatcattagcaaaaatgagagcatatctgcatgactaattttgattaaattgtgcttcatctaaatatctaaacaccaggtttgcctctgcaaatgtcctttacttagcttgcctgtctctcaggatatattttcttctactagtgtggtaaaaaaagacaccaggtcaaaggtcaaaccccaagcataactgacagatttagaaatagataatggcccacattttggagtagaggtcaatataattttctgaaatcaattctaataaaaaagacaagcacttacgtttccattttcctgccctatgaattttgcagcaatgcaggcagcaggcagtttccagtaacgcttttagaagtatgactaacactcaaggaaataaaagatgacagtttttataagcagtagctggaattagtaagaaaatctgaatgcctccatttttatactttctgttttcaggtatgtagtctccacagcttcaggcatcttgttactttagcaaaatctttatgtcactactgacaccaaa

SEQ ID NO: 34384 - DNA, 5005 bp, Bovine  19866880642216
attctttaccactgcatctcctggtctgcttacagagctctaattcacttactattccaagtctaagatatgtgggctgaaggaaaatctggaggaagcacctgcaggacttggtgaataattatacatgggatatgcagattaccagttctgaagttccggaagaatgacgacaatattgatataaaacgagagaaataaaggaaaaggggagaagtattcaattttactttacttttaatgagatgttgcaaaagtattgtttttcattctttcaatttaatttttattgaagtatggttgatttataatgaagaatagttgatttataatgtgccaatctctgctgtacagcaaagtgactaatttagacacataagggcattttaaagctattcttttctgttgtgttttatcataggatattgaatagagctctttgtgctacacagtaggcccttgttgtttatccattgtatatatgagtttacatctgctaatcccaaactcctggttgatttgcatccctgaagaccaagcaaggagatcaaaccagtcaatcctaaaggaaatccaaccctgaatgtttacagaaggactaatgctgaagctccaatactttggccacctgatgcaaagagccatctcattggaaaagaccctgatgctgggaaagattgagggcacgaggagaagggggtgacagaggataagatggttggatggtatcaccaactccatggacatgaatttgcgtaaactctgggagatagtgaaggacagggaagcctggcatgctgcagtccatgggatcacaaagaatcagacacaactgagtgactgaacaacgatgacaaaaagacttcaggtttagatacacaaggagatttcagttcagttcagtgctcagttgtgtccgactctttgcgacccccatggactgcagcacgccaggcctcctcgtctgtcaccaactcctggagtttactcaaactcatgtccattgagtcggtgatgccatccaaccgtctctttataggagttttattaaggttgtttttaatggtacatagagatgactggaagatcagtaagctcagtgcctcttaatctttcaacttgtccatatctggtagtgccaaacccaaaggcttccaaaatatttaaatacttataaaaggtttgagctaatccaaagaagatatctgaaacacttgtgacatcactgtttctgaaatccaactttgtacacataaggcatttgagaaaaatacaagttcaggctcttgtgttggcattaaaaatatttttgccaagcacacacagtaaaagtaaaagataaccctcccctttcaatcaacaaccttaggttcttatatttcaagtgctaatatacctgaattttctacgaagatcttgggtgacataagagagtgaagcaaccttttaaagaacatactacttattgattattctagtttctagtactcagtcagtttatagaaagccacatgcctggattctcttacctatctttagaaagaaatattaaaaaacatcacgctccaggatattatggatagctgacatcaaggcttcccatctggcatgcttcagtcacaagttgtaactattgttgatccccttggctctcagcgttagtcatctttttgtacatatacattttctatgtgtgccatgatgtgaaaagtttggcaagtctggcttactgaataaacagccatatgcacaacatctttttattttctaaaatctgatacttaagacctagacattaagctattcaatggtccttaaaatttgagttggtaaaaggtctacctaagtattcagcactgaaaaggattttcctgttaaattgatacattcttagatcatgggtttgaattaactcatttttctttttgaatttatttctaggaagctcaatcccgaattttgtgctcaattgcattagccatggttaccttaaagtatctactacatttacagtcattctctgcatttcaacactaaactcggttcttcaaatgctctatctaatagtttgtttttgtttttttaatggcatgcaacctatgacctttttagaagtagactgggttggaaatgataaatgaaccaataacattttcagaaaaagatgtctatatagttatgaactgcctggtattattcaatatatttctgtaagaatggagaatttaaaaaattcccctaggaagagcataataaaaaatttaacagctcaatcttgtgaactgcaactgaactgcaacacacacacacacacaaattattgaatataacattataaatttctggtttggataactttcaagatgaaccatatgaaaatgccattgtttgttgtataccacaaaatggttgaataatggcaatttcgtgtagatcaacatgactaggaaaggatttatctgctaatagggtatggttatattaacagtgataacagaactatgcctcacctgaatgacctcagcattcgataggactttcccaaatcagatactcttctgcagaatggacccacagccaactccatctgaaatattaaaagatatcccatagctttttatatcagaatcttgaagtgaactggggacccacttggatcacagaaagttgtagcttgaagtaaacttaattggatctgcactgtaaggcagttttgaatgtcaagtttattaaaaggcaagaacttagatagcttttgcatttatttactaaaaaggtcataagataattccttcaagaatagaaaagcagcttttgttgtgtatgaggagaaggtttagattttttttctccattgaaaaatcagaaaaagaaatgttttcaagactgcctgtgtgtctgtactttaagtgaacatcacaagtctttttctattaaacagaaatgatgacagttttcactgggctggtgaaaaatgattaaaagcactgactctggaggcagcgcacgtgtgtcagtttctgatctacagtgactagttgtgtggctctgggcttaacctctttacgtttcaagttcctcatctgtcaaacacagataatacccgtcataaaattatgcaaacaaaatagataatttcacaaagcactatgtgcacggcatacagtaagtgcttattaagtgtcagcaattactatcattaaaaaaaaaaaatttccccttttaaattgttagtggattaatttgcttcctgactgaagaattcagcaactactacttctctttattttcctcctttgactggaaatgttgtcattaattggagttttaggttacctgttctttacctaccaagtgcatacgcaaagtttttgcatatatggcagatggtaagccatttcactatacttgctatgaacagagctctggtaaagaatagtttagaaaatttctgagaaaagcctgcgccctggtaaatcaacatctttcttcaagaaaaacatatgaatgaaaaatggggtatctgtcttgctggccatctttctgaaaaactgttcatatcttcttgccattagaagaccatggagacgtactcactcatttgagaaacattttttactccctactaattatcaggcaccaaactagacatggagataagaagatgaattagacggtcttacctctgaggagttctcaaatttattgaagaggataaatatttatttaaataatataatcttcactcatctagcttatgagagatctgtgtgtgtaaacacagatgcacatgcagattgattattattaagagaaacaacaaacaagtgtgaaatcagctgtgtgaactgagtgtcaggggagaattacaaagcagcttcctttcttcagatggtcttgagggtgactcgtgactggtggatttctctctcagcatacagaagacagagtgtactgtatgtcctagagggaaaccttacgtggtcagcaaactttctaaaacacaaaaggataagtaaataaaaggagaaatctgatgaagaaaagtcagattctttccaatattacaagagagagcagtttcaagccaatgttcttgaagacagtgggcgatgggatgctccttgggacctatttagtttattcactagataggagtttctggtttcctatagaacgtggtatttattttacagtgagtacaaagtaaaaatgtggttaacatgtacctatgcccgtctgtttctctgtggaggtgcatttataatggttttttacacactgaaatttgtcaattttttttgttaccccagtgggatttatcattttcaaagattacagcaaacaacctttgctttagcacttgagcaggactgaatgttaaataaaacagctaggagaaaattacagtatgagaatatgacctcgaatggctgtgtcatctctgatgactgcaggagacttctatgccatatgacaatttcaaaatgttatatgtttaacataaatttttcatccatcagggacccctagggtactaaagaccatcttcttctgccagagttccactagacaataaaggccatgcttctgaagggcaggagtgctccttttagaggcgtgactctgccattagctgtggatacaaacggcacctgcagctgcccctctccagctctcctgtttggaggcaacaaacagtgagcagcaggcatggttaactaattacagagctgctccatgcccaccgcagacatctggctaaccacagggcatcttcagatactcctggcattcctgccctgacactgttcagaagaaaaggcaacaggaattagaatcttgattatttggggatttttccccaaatttataattttcaggcaaaaagcaagagagatataaatatatatttaaagggaaccagaaataaacagaaactgctcagagtgccactgagtaaataatttaatgccaacgtcaaaagtcatccttctctagggat

SEQ ID NO: 34385 - DNA, 1104 bp, Bovine  19866880694324
cctcatttcttgagatagttagaaacaaaaccaagaaaaaacaacagagctgagttgagtgtgggaagtgggccaagggtgggcttaccagtagagcagtacactcccacacccagcctgaaattgtagcctcctgcagacagatttgcatgtcatggacttttgggttgaacacaaaaattgtcaatactacaaatattaaatctgagaatatcaacaatatactatctttacctaataatgatatcagcatatgtgaacattagttttgtttccagattttttcactgtgaaagtgatgctgttaaatagctttttccttttctagtaatatttctttgagataactctcttaaaagttgaattaatttttttaaaggagataaaccttttatgatacttcatgtaattgccaaattgtttataaaactattatatagatttgtactgtactatgtaagtagtttcagccacacatagctagggattttcatttaaagagttttggaggcactatttaacagatgaaatattggttttaatttatatttccttgtctagtattaaatttaaacatttaattttcatatatttatatatttcttctagcactcgttattcattcagatcttcctcctatttaacttatgggatcattagcagtttagttccttttcagggttttggataaattagaattttatctaagcatattatcccacttttctctttcagctccagtaataaaccgatttacaaggcgtgcctcaggtaagtctccttatggattttgcttactaatggtgacattttaaaaatggattggataagaaggtatgaaaagaataattgctatagagtaataacttatttatcagtcattttcccagaaaacagccatatgataaaatcaagaactaggaagtaaatggaaatatcctctgagtggctgaatttaaaatcccagtgtggctaatgtatggaaactcttacccaaatttgtttatttctgcgcttgataaattactaattacaggttatctggtttgccagccacagtttagaagaaggatttagaacttgggtaaaagtaaatcactcagt

SEQ ID NO: 34386 - DNA, 1542 bp, Bovine  19866880708197
attttgtgtcctaagaaatatttgcttcatccgtgattttcaaccaggggtgaacccccacctcctccaccaaaggatgtttggtaatgtctggagacatttttgattgttccaactgggaccatgctaccagcatccagtgggcagagaccagagatgctgctaaatatcctacaatacacaggacagcctccccctacccgccacaaacaaaaaattatccagtccaaaattttagtagtgccaaagtggagaaacatctcctaattcagtatgccaagttttttccctaaagttttaattctcatatttaagtctttaatccatgtttaattttataacaattagcagtaagctggctctttagcaaaagcatacactacctactgtccttttgaagttagaaatgggttcatgctcagtcacttcagtcctatctgagtctttgccaggctcctctgtccatgggcttttcctggcaagaataggggagtgggttgccatgccctcctccaagggatcttccccacccagggatcaaatctgcatctcttgcattgcaggtgaattctttactgctgagccactggggaagccctagaacttggtaggaataatgatatagtaatacagcttcatatcatttggttttttttaagatcacgtttttgatccataatgaattcactgttggctaaaactcctaagactttctatttggaaagagtggctgctaaatcacctttctcccaccttgaattcatttggaggttatgtaggctttttggaggggaaaagcattgtataatatctgagtgcaagagttccatttattgctgttaaatttcatcttgttagatttggcctagaattagattgcatctaattttgcaacaaccatgtttagacactacggtagcaacagaactcttttttcaaattaattcttagaatgaggccaaatatataagcaaataacggcaaaattgccctgtgttagagggaacattaaagtacaagagtcctgtgagaatggaatatcagaagataggatatgccatgtctcttaggcactccacagatgcttgggtttcctgggaacacactttgagaaccactggtttaagcgttgtgaattgctttcactagcatttttggatttggtgaaaatgccatgcacatttttacccaaatcactaaaatccttcaactgaaaactttttcctaggtgtttatagtgatgctttgcaggaagatgtatgtctccacaatgtgttttcaattgtgtgtaggaaacacgtggctgttttcttacagattgaaaaatgtaaagtgatggcctctaagaaaaaacctctgtggcttgagtttaaatgtgctgaccctacagctctatcaaatgaaacaattggaattatctttaaacacggtgatgatctgcgccaagacatgcttattctacaggtatactgctgttaaggatttttttttcagttgttcaaaacaagaagtctgtactagttgtttaaaaaaaaatacctt

SEQ ID NO: 34387 - DNA, 1511 bp, Bovine  19866880719104
atatagaaagtgttcctgactgctgaatggtgggtgaaaggaaagggtgacaggaattaaaaggcacagagtttaatgataatttaaaaattaccccactactactgggaaaccatgcatgtttccagaattctcattaagagatcatggtgttcccaggaaactgcctagaaggaaattgcaacctactcaattacactgcaacttgccaggaattaagtaatggtgttcttggaattggagagtacagtgtgggcagtgtttatctaatgctgtgctgaagagtctgaccttagcttctgaggaccagcaggattatctggttggtaatatctctagaatggagagcagttcatcagctcattcagggggcccagcttttggtagagttgatgaattccatgtgaaagacagggccctagcagttctcaacttttaagagtcatttagaaagaacattttaaaatgtggattgctagaaacaacatccagataatgtaaattcataggtcttgtaagactcaggaatttatgttttaacaggcttcttctggaccacattttgataagatgagatgcataattgaagtggctagaataaaaattaaataatcagtgacagtatcacccttaggcccagaccaaagggattctgctttggggtcttaggtttagaggagcctgctctgcccctgtgatgaggaatcagtcgacttaaggggatatacgaccgagagtctaggccaaactttctagaccatgttctgggtaccgggcccctgaaattttctgcccagctggcactgagctgcctcccaggttctgcatgaagttcttccctggtctgagctccggagggcacatgctgctgcaggcatccttcagcctcagtgttggcaaggggcagctgtttgtggggttgtggagcatggctgtgtcagctgatgcgcccaccagtggggggaagaagcatctcatgaaaggctggctgtggtccacaggagtgtggctgtgggcctggagctggctctccctgtactgctgcattcctgtgcctggtgttctgggtccttttgaaggtacatttatcatgaagaacagaacatgcgtcattcagcaacttgctgctgctgctgctgctgctgctaagtcgcttcagtcatgtccaactctgtgtgaccccatagacggcagtccaccaggctcccccgtccctgggtttctccaggcaagaacactggagtggcttgccattttcttctccaatgcatgaaggtgaaaagtgaaagtgaagtcgctcagtcgtgtcccactcttctcgaccccatggactgcagcctaccaggctcctccatccatgggattttccaggcaagagtactggagtagggtgccatcgccttctccgagcaacttgttagtatggattataacttctaaatatgcagaagtttaaggtttgtgggcctttatggattcttgccttaggtcccacgaacactaagggcaga

SEQ ID NO: 34388 - DNA, 1061 bp, Bovine  19866880720368
tatgtgtatatatggtgtgtatgtatatatatatatatatatatatatacacacacacacatatatatctttttaaaaatattcttttccattatggctcatcataagatattgaatatagttctatgtacagtagaccttgttgtttatccatcctatgtataaaagctttcatctgctaatcccatcccgcattcaagccatcccccaacctctccttcctgacaaccatgagtctgttctctatgtccatgaatctgttgttctgtcatagataggttcttttgtgtcatattttagatttctttgggagatgattttaaaagattctgtttggtcctgaaattttaaataaaaatgacttaagtttgtagaaaagagatggcattattttaaattaatgacagaacttaggatggacacacagcttttcacattcaaaacactcccaaagtcatcttcataatcatgttccttccagatggcctcctccagatgcccttgttcacattacgaaacacaagcatgttgaaagagcgtctcagcgttttgaattaaagggtgttaaaggctccactttggcctggagagctctgaaatgtacgtagccaggcagacatttcataggtgggatgatccctgaaaaggacatttgcccatgagcatagaaaagtgttaaggcatgaaaaagaagtttggtgtcactattcattatcaagtttggatcagcttcttgattaaaaataaactctctgctagccagctcattctgtcatgaccccagacttcttaggaaagtataatgttggaactgttttttcaaagacatagcagattgagagagcttcatgccaaacaggggataaaagatcagatgctcagaaaaggacttcaaaccatttaaaaattataaaaacagcctttaatttgaaaaataaattacggatagttacaagtttcttttaacacttgattttatttattttaagaagaacactgttttagaaggcaagagattctagaactgtgtctccagagattcttgaaaagataaaaataaa

SEQ ID NO: 34389 - DNA, 714 bp, Bovine  19866880753146
cacaccagcacatccacacccacattgcaagcagcatgatagaaaatggaagaaagatgggcctattcttacattaagacacattccagagttgaacataccctcccatcatatgcaattggccagctcttagtaacatgaccatgcttaatggtacaggaggttgaacaatgccatctttatactgaactttatattggacatcccatgtaatgtccaccaatcaagggttccatcactataagagaaggggagaaaagatactggaggacaaccagtattgaagcaatctctctcttgacaaatagcaggttgaaattttagtgaataagattaggtaagaatataatagaattttctgtgaaggttgctgaacacagttaatttaaaatgtgagaaatgcttccaaatgtctaaaaatgggatagtgtttcatttgtaaatgagatgggttgagaaaagggatagttcatgctcagtctcagacttaatgtttatattcagaaatgacaaaggttaaaagactggactaaatgaaagtttaagggtctttcttgaggcagattgctatagtcaggattgtatgcttggcagaatgtagtgtgccaatgcaaatgcccctctgggtctttgtagaacatgcagcagcccctaaggaggtcaaagagaccttggggttagaggaaatggagaaaatacgggaaaaattcacag

SEQ ID NO: 34390 - DNA, 1957 bp, Bovine  19866880870000
taaaaggtttatttcagtcattaattgaggtaatgaggctcttcaacagacccagcagagaatgcttggctaaagaagctcaaaacttccttggaatttcaaccaacgtctttcatcctctcctatccaatgtcatctcgatttgacaactatcagcccctgaaactgttctctccacatcagaaccaaacacgtcctgaccaaattcagtgatcccttcattcccactggctgcttctcagctgttagctaccatctgcctttaccctctcccagaaagctcttttcctttggtttctctgataccaggttttcctgtttcactacgtagtttttctttatttgtttgagtggctggatttgcctttttcttctgttcctaactgtagtcttctcctaaaatccagtcttcagtcttcatcctcttaaactcatctttgtctcctctacttctctattctcctatagtcttctaacaggtcttacagttacagattctttcaatgatgttgttatacagaacatgagcatatataacatatatgctatatacaatatggcatatacacaacatattagtaaggatgctaatacggtttaagtggtcagtggtcaacttagagaattcctttgtattgaatttaaagatgttctgaccttggatatatatatataaacaaagcactttgaaaaagactatttaagaagtatctaaggatgaaattgggcagagtttaatccagattgagcataagaccagttcattaataaaatacatattctattacgattatattacattaagatcaaattttattaaaatcaaattgttaattgaagggcactgtggtatgtgctggggcttccctggtggctcaaatggtaaagaatccgcctgcagtgcaggagacccaggttcaatccctggctagggaagatcccctggagaagggaatggctacacactccagtattcttgcctggagatttccatggacagaggagcctggtgggctacaatccatggggtcgcaaagagtcagacatggctgagcaactaacactttcacactttcacgcatggtaggtgcgaatagacataacagcataaaggcagtcacaccgaagctaattaaagctatttctacaattcatcacagaggttaaatgcacattatttatttcacacacttttctttaacaagaatttaagttatttaatattacataggcttatcttctacatatttaaagtttttcatttatctgtaagcattaagactttaaggtctttagataaatcttttagaatctaaagtgtaagtgtactttgcacactgataatataacattttctgtcgttcccatcaaatactagattttgcctggcacctgctgtcaacaaatccttagagacaaagacattaatttgtttcatggaatggatgaagtcagttaagcctagtcaaaaataaacgtgcagcccaaatacagtaagtgatatgaaagaagttggcccttcaatggaattcttttcgagttttccaatttttgccacaagtatcattttcttactggtcctcaggcttaataccttggagattcctttgcctctgcctacccctttgttactatctctggcctgtctccaattaccactcctgctctttctttattttcagagccactacctggtctagactgtgagtactccaacatggagagtgagatggtttcttcatagccgtcctgctcccaatctctcactgcttcagttatttcttgcctgattaaccttacatatgatggatggctttccatgtttaagagtcatcagaggttttcttacaatatattccagcaatcccactcctggacatatatccagagaagactctaattcaaaaggatacatgcaccccaatgttcatagcagcagtacttacaatagccagga

SEQ ID NO: 34391 - DNA, 1625 bp, Bovine  19866880914039
catgaggcctgtgattctgcatttctcacacgcttccaggaggcaccaggggctgctggtgcccagaacacactttaagtagccttgatttaagggaatgtggatactacttgtgttttcttttgaaattgttgataacatcccaccctatggttctgacatgagtttatttggttatttctctcaaatccttttgtggaaggaggcaaggttgaagtaacaggaaggttgttaaaacctccttttcaagatctgtagtctcacggaagttacgcatggttcagtcaccactgagcctttgactccgaggtgaattcagccaataaaaatatctcttgatcagagaaacaagacttgtgcatttcttcttctgagacccaggcagctactgtttacttcttaaaaatgtcatgagtcactttttaagtggtgcaagcaaaattggaattgtttcaggtggaagggagcttgtcctctgaagtgtcttaaggataatcagagatttgaatacccaaagccggcaaaataaacactcaaaaccagtagacttggcccttaggaagtgtttacgcactgtcacaagggtgggttgtgatctgtttccttaaaggaggtaccatttaaaatttaatcatcctggtgggcttgccaggcagggtcagattgtcacatgatcaggaaggctcctcatgcacatccttggaacaaggtcacatatttagcgggttggcccttcgagtactgatagttctcagccctggaaggaaccttaaactagggacagaggtccagccatttccaggtatatgtgatatttatgttctcaggaagggtgaaggattcttcagtttttttttttttttttttactaatctgtacctgtttgaagatctcttggaggagggcatggcaccccactccagtattcttgcctggagaatccccatggacagatgagcctggtaggctacagtccatggggttgcaaagagtcggacatgactgaagcaacttagcatgcatgcatgcaataccacataattagataacaccgtcttatttaaacaaatgaaataaaattattcaaaaaaaggaaaatggcagcttcttaaagattgaaggaaagaagggtgagaaagcagctttctgtctcctttgtcatctgagttttcttgctctgagtgtaccaggcaacagtgagattcatagaaaaaacacacatttttatgactaaaaacgaaagggtaatgaagagtacactatgtctgatgaaaagaaggagtaaaaagggatagaaattctttcctaggaagagctggtagttgtgaagacaaaaatcataataaaatcattcatgttatttttataaatatggagcatttatttcatggcagatttggtgcaaaaagctttgcaaacattgtttcagtttaccctcacaaaaaccctaggaggtcttatcaatgtcatccctcattttatggataagaaaatggaatctttgagagcttaaatagcttgctagcaagtagtgttgggattattaagcaggccatttaaatgatccaaagatcttccaaggtgttagtttccaaggtttacctgcaagagttatacccacagtt

SEQ ID NO: 34392 - DNA, 1550 bp, Bovine  19866881018285
ataggagttgcagcaaagcttcggagttgtggtctgaatgcaagtttggtccaggttccccttcctccacctgtgcatcagaaccctagagccaggaaacagggatgtaagggggttgagaggtgatcttgtcacatgttgctctgtttcttttcaatgagaaacctgcttcatgaaatgcattcttacttcagggaaaatgggattcctgtgggttgaatataaatggagtctgggacttagcagatttgaaggaaaaattagtatctactgttcaaggaaaaccccccaagctagtaacttctctgggaatttccaccatcaaagggggttctggggagaattctaactggagaggggggtgccctgcaccgtgcaatgtgacgaatatgcagatgtcatggctgtttctttatttttctccataagaaaggctggattagagacaggtggaggggaagcgggagctgaaggttcccagcagcctcaagtactgctcagttccaagtaactggtgggtatcaaccctaccttgcaactctccgtacttcaggatgtagtttccatttcaccttctgattgttggctagttgaccctccagtcatgccttgtcttttctggactatgagtggatgaggacaggctctgtctaaagcagttatattccccagtggctaatagtaggagctcggtatcctcttgtggaatgagtgaatgaataaacaaatgggtttattctgtcccttactgtagtctactctaatggcccattttcttgtctgtcttccatcccaaaactggatgctgggttagggcaggaactgtctgctttgctcaccagaactgtgtatcccaaagtcaacgatagtgccaaaccatagtatttaaaatatgaaagggaagaaaggatgaggagacctgagcctcttagagtctttcttccacttggagaggacagatcagcacatggaatgaccatcagttaaactgatagctgtggcagttcagaaggtgtgagatgcccacagaaggggagatgatgtgaactggagatgggttgcctgggactgagaggaccggaaagctgtgccccaggaaagattgatcagggaactgatgatgtgagcagttttgtgggacagtattggagagctcagagacttctgaaaggaagagttagaaaaagcatctaactgatctgtgttacttgggctcaggttataggcagggaacaatgggacgtgagagttctaggtccctttctcccaacctctctgcctggagctgggctgccatgaaagcagatgcaatctggcttcccagacaagcctgtactcggctggcaaagcaaccctagtgacacctttgttggtcagcttgctttcgtctttacactttacaagtgctttgcatgaaaggttcactcaaaacagatgtaatagcattttagtggcagaagaatccacttgagttgtattgatagttgggtcagcagacagaatgttctgggtgatgtttataacccaaagagaaactagattacagaaaa

SEQ ID NO: 34393 - DNA, 1194 bp, Bovine  19866881256552
atgaggacttggttattttccccctttaacccttttaaaataagcgagattctggtctgattgaaggtagaatgtaactagcagtgttactgaccagagtgaaaccgtttttttacattctacatgtatcagttagctatttctggagctgctgttctaggatggcctcacacatctggcagttggctggctgtcagctgagtcaatgtgtgaccaggccacgtgtctttcattatctaacaggcgtgcctgggtttgtttacatagtggtggccggattccgagagagagtgtggaaatgtacaaagtctctagaggcctgagcttggaaccagcacaccattgcttccattcacattctgtgccagagcaagtcccgaggccagtccagagtcaaggggtcggggaaatagactgcactccttaacggtaggggccttagagttacatttcaacagctctagatacaggaaggggtgaagaattgtagccatttttgtaatttaatggaagacattaaattttttgcataaaacctcctcagctgtgctgatcaaacagaacagggcactcccaagaaagcatattactttcctcatggattgtcttagtccattcaggctgctgtaagagaatcccagagattggatggcttatatacaaattgatcacaattctggaggctagaagtccaagatcaaggccctgcaaattcaagtgtcaggtgagagtccatttcctggctcatagatgaagtcatttcactgtgacctcatttgaatggaagaaaccaagggggctctctggaggtttttgtttttttttaataaggacactacctcagccatgaaggcagagcccttctaatcctaattaacttctaaaagccccacttcctaataccattacgttgagggcttaggatctcaacataggaatttgggaggaatgtaaacattcagaccacattagtattgtggttgggatttcttccttgagaatcaagggattatagctttagttcctaggttttcaaccaaatcactgtaatcatttagtaatagtttctaatctcttacttcaaaccacaccagccaggtcataacaaaaggtctgtgaatcagtgaaatagtaattaaagttacctttgcagctaaacctcactgttcatttaaataaaatttacaaagttct

SEQ ID NO: 34394 - DNA, 696 bp, Bovine  19866881306389
tggtaatattagctacaataaataaacatcaatcttttatatttgaataggaatttgtagtttataggcactttcaaaaagatgtttattttttcttaaaaccctcttgcattaaggagggcagatgttactttgcatattttttaagttgagaatttagctcaaagttacatgattcatccatggtttcctggaaggctatggggctggcagtggagcccacgcctcctgaccctagttggtgcccagtggtgcgtccttcttcaccttccccctgctcctcttccctgtacttgggttcctgagagagaaaacaccaggcacaccctgcccagatacacattgctttacttccagtgaggcctccaccctgaatctcaacgttcttccctaggtttggctgctggactgaaaaaaaaaaaaaaaaaaaacaagaaaaatggtgaaggttactgttggtttgccaagagctgatgcaggaaacatttgtgttttatccctgcaagtggatatgaagggatatgattatgagggattggatggaattttggtaattttgtcaaaacccagtgtttaccttgacaactgcatagcatatgcttggtgcccccatctttttaactacccagtcctgtgccccgtttactatgggagacagaagtcattgtcatagaacctctctacccacaatttaaa

SEQ ID NO: 34395 - DNA, 774 bp, Bovine  19866881317286
tctattttaggcatgataaacattttatatatcaagcaaaatcacgaaacaggcaacctttcggactatactaatggctatattgaggaaagaatgtgagataatatttcataactctggttcatcaaccacaaatctgatgggattaaatgagtgcaatgagaatgagcaatgataacattaaatgtggaaaaggaagggcaggtcctgactagttatttcttgaatccgctgctttggctaacatacaatataacccaaggagaactttgatcgccatttctatagaaactgtgtaacaaaataaaagtatatttagcccccaaatctcacttcaaatgaagaactttatgataagcaaaaatgaccacattggtaagaagttcgttaatgagaaaaagaaaattgcccttttacattcttttggacagaatttaggtaaagataagctcacttggtggagaaggaaatggtaacccactccagtattcttgcctggagaatcccagggacagaagagcctggcagactatagtccacagggttgtaaaaagtcagacatgtctgaagcaacttagcatgcacacaagctcccttggaggcctggtcatattttagataagtacaggctttctcggattagctagattttttgtgtttgaaaaattggttctgatcattagagggattaaatttatccaatgttgcacagaggtcataataggatccaaagttttaataacaaaagaactgggccaattaagctgcctcaca

SEQ ID NO: 34396 - DNA, 886 bp, Bovine  19866881320943
tggaaggtggctctctgcagcagatccgatttaagctgtcctctctcaggcagaccctaaaggaaatgagagctggggcaacaaacctttccttgaagggagatcttggaggcttatatctgtgttccctacagattcataaccaagagaagtcttggcataaacttaaagttacagatagggttataacaaaggaactccagcaactccacactttgctgcttagtgatggactcgtgttggtactgcaaatgaataagttaacaacaaagcccttttcagttaactgtgaaagcagtgaggctgagaatatatccatggaatagacatctgaactgaggagctcagaacagggccaactttatggatgtgtgactactgcagtcgcccagggccccatgctcaggaagaccctgcatttggtttcttgcttagaagtttctgtcttacaattcttagtcattttatctttgatcttttgttagtgaaatctgatgggacaatggagtgtgcctgtgagcagaggacatgcatacacagtatgactgtctgccattccttatgtcctcattcatgaataagtttgagatacaccatgagcacagaattcaggtggattaactctacctgggagttcaatgagactcaaagtgaacagaaggtacatagactacatctatgactgatgagcccccaaaggacatatttctacttgaattagaattttgacttcagaaagaacacatttatattctaagaaatacaaatgatcaaggagctctaccatatcctttcttactcacgttatttccctgtattagctaaccacttatgctgaaaatgatgacatagaaaaggaaagatggagcagcccacagtgtttttt

SEQ ID NO: 34397 - DNA, 620 bp, Bovine  19866881342959
tatggaagtacaaagcctcacatgagcacaactgcaggacatgtggctgcagaaggataacaagcaggctggaagaggctactattcatcagagcaaagagtagagagaatgacccccaaatccaagagtgatcagcacattgaaatgagtctcttagaaaccttgggaagggaggagctggggtaatttggaaggagaagagaagactgtaaatgctaaaccattttgtttgtttcttaagttgttgattatcccacaaggttggtgtgacttggaaaaacaaaaggaaatctagaacaatgacttcttatagaagtgtccattgtatcatagatgtggttcagaagaacagaacattttaaagtcttggcaagtgccatgggctttaattaaattggattactttaattaaataacataaagagacatgctgctcagttttcagagtagcacccctgttcattcttactgagtctagatgaatttgaagaacagatcaatttccttttatgcaactgagagtatgaaatatctgtggggaattcagtccatacacccaattcagaattttaggttttagagcagatcacaatgaaaaatggggacagactctttggga

SEQ ID NO: 34398 - DNA, 1802 bp, Bovine  19866881394828
tgacttagcagcagcagcagcagcatgacaagataaaactgccactctaccattcccatgggataaggcccagagaagtgggaggacctggattcattcaggcattaattttacaacgatgataagaaagaagccatgccaacaattttaatggggagctttgaatttaaccttcacggcatgacatgaaggatcaagttctcattttggaggaagagggacataattgctaaatacttgagtatgctgtctttaagtattatcattattagtaatctcctgattcactgaccttgggctagacaatctcccttctttaaaaaattttttttttcttttagatgtgccgcatgacttgtgggatcttagttccctgatcagggattgaaccttgccccctgcagtggaagcacaaaatcttaatcactgaactgccaggggattcctggacagttctcccttcttatggaagacaaatggaatccatgctggcattacaggaaaaaagcaaaacaaaacattgctctctttactgaatacttaaataactctgcagcttctatcattaacattagttactctaggccagaggtcagcaaactatttcccatggggccaatccaacctacacctgtatttgtaaataaaatattacaggaacaagctgtgtccattttttaaaatgtattgtttttactttcatgctacaacagcagaaacttcctaagatggaagcttagattattactttcagaatttttttctaatacaaatatttaaagctataaatttccctcaaacagctgatttagctatagaccttgaataattaaatgttacaatttagcaactctgtaatctgctatgttcttctgaggacggatttcatagttgttagtctgcctagattcaaactatatccccttacgttgtgcagcagctgctatctctgtttagttctttctgctttaagtcattgatttttagcctgcttcccagggatcttccgtcagtctgtgtaggttagcagtcagtgaagaatctgggtagagtttgtactagatttttcagttcctttgctggtctttctgacttgagctctctccactgatatagaagagtataggagaaggtgctaaatctaaaaagcagcagtttcacaaactgcctcagtgcagttttgtctttattagaatattattataatagtataattattttttaggagtccctgaggtttcccctgttcttgtgtgatttagcagtcgctaaggatgtgggcagaatttacactcagattttgggtctccctacttgtgtggctcatcactttcaggatttctctccctttcaccctaaatttgttctgtcaaccctgaacttttctgtggcacttcaagccagtaagactgtggttttctgccactggaactgtggatattgggtagtgacttcagaccaaaaacaaacaaacaaacaaaaaacccccaaaaccttacaattctatttttatctgttgcgcttgtgatctttcaagacagcatctcctggttcccatttgctttgaccactttccagtgcctttaaatagggcttttaaaaatactttgttcagattttatagttttatctgcaggaagttttgctcagcaaattcaattaattcaccattaccagaagccagacccctaaatagttgttttaaaggggttttggggcagttttcaactttgttgtatgctcagtatgaaagaatctatgaccattcattaatgatctttgattccagtaccaatcccaga

SEQ ID NO: 34399 - DNA, 1852 bp, Bovine  19866881584048
aatttacttgaccagacagttcagcaaacaaaagatactattaccctgaagcagggtaaagggtgaacttttcttcaaacaaagtacacattagctctaagaggactgaaagcaaaagtggaacattcgatcccagaagtatgttaattagcaagagaattccccacctgggaatcttggttctagaatttcccaagtgacaatggattaactaaattggagacagaacatgaggaagaagcaaaggacataatgaaagtagaacaagatgttataaaacaaagggaaatttcataaacatttaacttggtgacacaataaataggatatttagagaatgaataccttgaaggtctttccctgtttaaaaaaaaaatagctacctgtcttaggagcaactgatttctaaaattcataggacctgatgcaggcttgggatttctcacagaatgttcagcccactaaataaagactggaaagtcatagctatatggttcccctgactcagagaaaaagaaagagttccatgaaatgtggggatccctataacttagcacctgccatagaaattcatatgtgtaggtcactcctagttcccagaaacatccgcttgcagttaaatttaagctcttttgttagataatgacatatttctaaataatatatatgttactatttcgtgattctccaattaaatatttgtagtgactccctgttatgaaatgtcaggatttagtgcttttattctttcctccaacaatacagacacagacatacacacacactctttccttttctttttctggctgatatagtcataccacactttttgattgaatgaattctcattgttctcattgttactgctgctgctaagtcgcttcagtcatgttcgactctgtgcgatcccatagacggcagcccaccaggctcccccgtccctgggattctccaggcaagaacactggagtgggttgccatttccttctccaatgcatgaaagtgaaaagtgaaagtgaagtcgctcagtcgtgtccgactctgagcgaccccatggattgcagcctaacaggctcctccgtccatgggattttccaggcaagagtactggagtggggtgccattgccttctccgttaagagtgtatagggttctaaaatgaaaaggtttgagaattgccccactagaccatgagttatccacaaagtatcttcaagtattctgaacctggtgcacaaaaaattcacctggcaaatgtttatcaagtgccaactctatgcctgatgctatgctacagtggggattcagaactgaaacagagtcccttctctggagggttcacagacaggtggagaagcaaacaggtacaagaacagtacccttatacttaagggggactatgatgagaaagttaggagcctgcaggaaaaacacgcacctatgaggtggagagggtgggagggaggagtcgatagagaaggcttctcagaaaagctgacacctggtctgtctttacagccaccaggaatcagccaagggaaggcagggagaacagaatgcataaaaggtggaagctttaagaaaagaatggtgatgtcctgctcctgcactgagctcagtatgagtgctacaccagtacaagtctgtgcactgggggtgagtttggaagtgaaagaaggtagcttagagctgaagcgggcaggagccaaagcaaagggccttgtataccatattaagagatgtggattcttaacatcaaaagagggagggctaaaggaggcattggcaaggattttagggtcccacttgcatcaactttaaaaaagacttttctgtcaaggagagttgggga

SEQ ID NO: 34400 - DNA, 1176 bp, Bovine  19866881589406
caaaaccctttcttcaataaaatattttgtcaaagccaaaggtatggaataaaatatggccctaaaaaacatagcttgaaaatcattgacttactcttatgtcaatttgactatgaaatattataattcccattgatgtattcatggttcatcctgagaaatattcactgaatatctgcagatattaagctctgcagtgatctactgtaacttatgcaagctaggccatgacctgtttctcctagcacattatttttcagagggagaacactaattccataaataaaataaaaagttatgatacaagtacaaaaggatacacaaaataggggagtggttactgctggctgggggattgaagaatttttcatgtggggtggcatttgaacaagaggtaggatatttaactggggaagatatgtaagggtttccaggttgagcaaacatgataagtgaaggtgtagaggcaggaatttgaaaagcagtttaagagaaaggcacaaccattggttgtgatgtaaatggcataatagggacttaaagccaaagctaagaaattaggttggaatcagattatcaaagtccttgaatttcataataatgaggtttgcttttattctccaggaaacaaaaagccattgggggaaaaaattattttttagcagaaggtgatatatatagaaatgtatctagaaaatatttttccaaataaggtataataagaaatgaaaaaaactagagacaggagtgttaattagaagacaattgtctggcaagaagtgatggagacccagcctgggcacagtgctatgaaccaaaatatgtcaccccaaattatctattaatatgatgatgctctaactcccagagtgacagtatttggagacaggacttttaggaggtcattaagggcttttcaggtagcactagtggtaaagaacccacctcccagtgcaggagacgtaagagacctgggttcaatccctgtgtagggaagatcccctgggagaagaaaatggaaacccactccagtatttcttgcctggagaaccccatggacagaagagcctgatgggtaacagtccataaggtcacaaacagtcagacccaactgaagcgactcagcagcagcaagggtaaaagaagtcatgaagatgggactcaatccaattggag

SEQ ID NO: 34401 - DNA, 889 bp, Bovine  19866882158885
agtattaactcctcaaagggcagttatagttaagattatttaagaacaaagactttggcaagccttcagtggaagggagctgtgttcttttttgggcatttgcattttaacagactgagaaataaatccactttttaaagggaagaactatttgccatctgcagttagttaatgtctgaggcagggaaaatctgtcgttcacacacatttgggatgcagttggcatattttcctcttccggagggtttcatcagcagtgactgagatcgaaacaccctgcctggtgtgttatagtgagccagccacttggcttttgcttggggcaaaaccttagtatcttgagagtagtatctgctcatttttcccttgtgacaaaagtctgaatatgattgatggaagaattggtatggtcatagataaaatagtaaagaatatagtcaccatatttccagatactggtaaagcagcccaagtgcgatcaggctacattattcaaatggccttttgcagcagggcaggccatatgtaaggtgtacagggtgtacagggaagggacaagacaggaaaagaaaaggaactcaaaaagccacctcatagaaaggactgtgtggggacagagaaaggaaattttgaccactgacatgaatgaaaaattctaaatgaggtaaagatggttaaagaggacatgtagaaaggttcagatgatgtacaccaaacaaatgttttgagctacctttcaaagaaacttagcacaaatatttatattagttctcagattgtttggattggtgttcttaaaaatgaaaccttaagtagcaacaaaatctagcagaatctaagaagtgatttggtatattttgagtagtaagcaggggtgatgggcttccca

SEQ ID NO: 34402 - DNA, 939 bp, Bovine  19866880140543
ttgtattagttttgccaaacataaaaatgaatccgccacaggtatacccatgctccccatcctgaaccctcctccctcctccctccccataccctccctctgggtcgtgccagtgcaccagccccaagcatccagtatcgtgcatcgaacctggactggcgactcatttcatacatgatattatacatgtttcaatgccattctcccaaatctccccaccctctccttctccctctccctctcccacagagtccataagactgatctatacatccgtgtctcttttgctgtctcgtacaccgggttattgttaccatctttctaaattccacatatatgtgttagtatactgtattggtgtttttctttctggcttacttcactctgtataataggttccagtttcatcgacctcattagaactgattcaaatgtattctttttaatggctgagtaatactccattgtgtatatgtaccacagagacacgtgtaccccaatgttcatcacagcactgtttataatagctaggacatggaagcaacctagatgcccatcagcagatgaatggataggtaggctattttttatttgccatcttattttgatctttggctcaaactctactataccatccagacacgaaaatatacgcacctccagtaacctcgccaagacgctccctgcaaatcctcttggcatctgtatgttggatcaaggtttttccccaactttgagtttcagaaatgctgaaagtaatctaaagtgtttgtataaaagggcaaaaaaaaaaatggtgatagcacaagagctaattaaagttcaacctaaaattagatgggttcccttgattaattgcatagcaactgcctgatgagtggaagggtgaaggaagacatccatagtctatactagtctagatgcagtaactttaagaat

SEQ ID NO: 34403 - DNA, 1336 bp, Bovine  19866880424916
cccaacctgggatcaaaccggagtctcctgcattgcaggcagattctataccatctgagccagcagggaagcccctatacatatacataatatgccctgttttttggatttccatcccattcagctctttaccacagagcattgagaccacacagttttgaatgtcttaaaaatgcaggtttcgcttgtggctcagatgattaaagaatctgcctgcattgcaggagtccaggttcggtcgctggatcgggaagatctggagaaggaaatggcaacccactccagtattcttgcctgggaaatccccatggacggaggagcctggcaggttatagttcatggggtcgaaaagggtcagacatgacttagcaactaaacaagaacagcaacaaaatgcaggtcatcctgtatttgtccttctgtagcaagtagagagtcccagggacgggggagcctggtgggctgccgtctgtggggtcgcacagagtcatctatggggtcacacagagttggacacaacttcgcagcagcagcagcaagtagagaataagagagtctttgtgagcctgttatcctgaggagttttgtgatgtgcttggttttaatgcaaataaccagggacaataggagcaactcagaaaaagcaaagaattggaaatctactcaactcacttccatttcatgctgagacagattctctgctcttgtagagaactttctctcttgcctgaagaaattgggagtggctgtttgaggcacgtttcttagattcttctttcttttttaggatctaggttttgaaatagggctgatgcataaaaagcatgactccaaatctttagctgactgtaaatacctccctacgagcaaagattcctccgcagtggttcatgctgttaaaaatggtatgcacgtgtccgatcatatttttggcatatatttattattagaatgtgttggctgactttccctgtggtgatatttaagtcaagtagcattcacttattttatttacttatttttaaatttccagaataattcttattgtactcaggatatttacacagttctgtttagaattttggcagataaggagatgagaaaagtacacatggagaatttgaaacgtcaggagcagctgagagtgaaaagggaaggccaagggccggccgggaaggatgggcttgacttgctaacagggttgggtatttgcacatactggttttctgtgcgtgtggatgctcagactttgtctgactctttgcgaccctatggactatagcccaccaggctcctctgtccatgggattctccacgcaagaataccggagtgggt

SEQ ID NO: 34404 - DNA, 2512 bp, Bovine  19866880472574
tggtgctgtggcaagaacacgcctgccatgcaggagacataagagactctggtttgatccctgggtcacgaagatcccctggaagagagcatggcaacccactccagtattcttgcctggagcatcccttggacagaggagcctggtgggctacattccaaagggttgcaaagagtcagacactactgaagtgtgaatattcacaaccctgaatattcattggaaggactgatgctgaagctgaagctccaatactttggccacctgatgtgaagagccgactcgtgggaaaagaccctgatgctgggaaagattgagggcaggagaagaaggggatgacagagatgattgtatggcatcaccgactcaatggactcgagattgagcaaactctgggagatggtggaggacagggaaacctggtgtgctgcagtccacggggtcgcaaagagtgggacacaactgagtgactgaacaataactgtgttgggcattgagaatagaaagataaatgtgaccttgttcctgtcctgtagggagtttctgtttcgcagagaaacagactgagacagttggaatcacagagtcatgatccaagtgtgataatattccatagacgaggagtgagtgtagtgaggggccagaagggggaagtcggagcagtgcatctggagaccaccatgagcccgtgggagctttaaactgggatgtgacatactcggtggatattttgggatgagattcagcaacttagtaatgtgatgtgatgggacctaaactagggcagaggctgtgggaatagactggaaagagcacatctgagagaggtttcagaggcagaggccgtgatcctgcagacaggatgcaggaaggattgaaggaagaagaagagagtccaggaaaatcagagggctttgggtttgcatgagaggttgatggcgatgatattattagataagaaagaaaaggggggagaatttcagaaaaaaaaaagattgacatttctttgcaacagagttttgggtgatggtgatccttgcgtagtaagaaataaaagatttgaagagtgtcatcaactgtataatacattttattcaaggccttaggcctggaagaaattaccaaagaacaagtaagtcttgttcagtgaggacaagcgggggaaagaccctaaaacaaaaattatgggtagtgccactttttcttggccttcttggctaagatgaagtgtagtacaggggcttccctggaggctcagtggtaaagaatctgcctgctaatgcaggagatacgagagacacaggttcaatccctgggtgaggaagatcccctggagaagggcatggcaacccactccagtattcttgcctggagaatcccatgggcagaggagccttggtggactacagtccatggggttgcaaagaatcagacacgactgaaccacagagtgtgcgcacacgtgtgcgcatgcacacacacacacacacacacacacacacaccactttttaagggaggggttggcagaagaggaccagaggccgatgaagaaaagcatccagagaagaaaagactagccagaaacagtcatggctgataaataatgatgatgagatgcagtgactctggttcaccagcagtaccaaatggggcagaggagcctctcagatgggaacagagaagagtgggttgaacttcataggcaggtcctgtcgtgacagtaagagctcagaaaggagtgaagactgggcaggtggcagccaggtgagaaatgggctacagaggcttctcctcctgcccctcagccctgaccccggctctgcagaaacaagctcagagaacgtcctaccctgccctcactttttacaaccatgtttataggctgagcagaaagggtgagaaggaattactggtgacacaaaggctccaaagaagttgaaagaagcgaatccaaagcccagagaaagataagcattcagaaagtgccggccctctctcatccttgtgctgaggagactcttcctgtaaaacccccgccctcagcatcacagtgtgtggtccttcagcagagcgtgtggtccgtgtgagatgcaggatgaacacgtggaagatggtttagtcggggtccctggtcctctggtctgtcggttgactgggtccactaggtggggtgagttcccatgaccaccgcatgaccatcagagggagggagaatttggggaaagcaactgcatttacagtcgcccatgatgttctccccatctcccctgcccagtccctctcaatgaacaaggaagagaggtccagcatattgaaagctcacatgccttgcacaggacccctcccttggttctttgccacgtaatttccttttgctgctgattataccggtagtctggtgggtttgagctctttgggaaaggctttactgtttaagatgattgccctctggtggcctgatggatcctgtcttcagaaaattttttaaaaattattgagtatctgccata

SEQ ID NO: 34405 - DNA, 1152 bp, Bovine  19866880535371
aatctgttacatatacattgcttctgttttatgttttttttttttttttttggccctgaggattgtgggatctcagctccccagccaggctcgaaatctgcagccctttcattgcaagatgaagtcaaaactcctggaccagcagggaagtcccctgtctggttcaagtgttccaagaaacaggggtcaggcattccttagaggaaatgtaacgttattgtccttaccactttgtgtaactgaaattctaatgtacaaaggacagcaaagagccaaattaaagaaataaagggacaacgggcatcggacaggagggagaacaagaatcaatcacagtgaatgacactatttctccatggaccgtccctggggcattccatggcctcatctttgctgctttcagtagtgccctgccttgacggcagttagaaactaatactgggaatgtttctctgtggagagtctctcctgaacctttttgaaggagacccattacgcaaccacaatttaaacatgcttgctccttggaaggaaagctaagacaaacctaatcaacatgttaaaaagcagagacatccctttgccgacaaaggtccatctagtcaaagttatggtttttccagtagtcacatatagatgtcagaattggaccataaagaaggctgagcactgaagaattgatgcttttgaatgatagatctggagaagactcttgagagtcccttggactgcaaggagatcaaaccagtcaatcctaaaggaaatcaaccttgaatattcactggaagggccgattctgaagctgaagctccaatgctttcgccatctgatgagaagagctgactcactagaaaagaccctgatgctggaaaagattgaagacagaaggaaaagggggtgacagaaggttaaacggcagcattaccgactcaacggacgtcagtttgagcaaactccaggagacagtgaaggatagggaagcctagcgtgctgtagtccatagggtggcaaagagtcagacacgacttagcgaccgagcaacaacaataacgctcaaccacaatcactgctgtaacgttcccacggggttgagcacatccagttcctaagcgaggggtacggcccgaagagactgggcctgggtgtacagga

SEQ ID NO: 34406 - DNA, 1366 bp, Bovine  19866880616293
tttcactttcatgcattggagaagtagcaaccccactcccagtgtcttgcctggagaatcccaagggacgggggagcctggtgggctgccgtctctggggtcacacagaagtcggacacgactgaagtgacttagcagcagcagaagagtcatgggatatcactgtttttcacttgcttgaagttggtagttttaatggatcagtgaatagtattcaggagtcacaaatacttaagctgagtatatcaagatctactagcctctcttctgtacatttatatttgaaagatcaaagggagaaaaggcttgttttcttaaaaatcattagtcttacaatcccccaggcaggtaaatggtgtgaaggggtttctttatgaaatgttttgttactccacaggaatcctgttgtatatgtaaggacagagatttatatgaaacattctcctgcaggaaaaatcctaggtttgtgtcttttaataaaatgtcactgaattttcttatctgcaagagatgtaggtaaatttgaatgcagaagctactgtggcagtcaggagatggagaagttagagatgctacttctataagtggaaaaaaatgaggataaactgacttttttcttctgtagagtaaaaaattagagctgaaaaggaacgaagcctcaaatgaatgccagggaccattttttaaaggggaaatgaatcaggaattgggaaggatttcattcacacctgcgccatgcctctttggaagctaattaccatttcttttggtagtcatggagtaaatacagccttgaaaagaggcatcatggaatacagtttatgtttcttgaaaagataaagaaggcttctcttgccatcatcccagtgcatgtagcaaaagtccttataccagttttgaggatttagagtttgtaggattccaaacttttttaagctgaagcagaacacagttaacaaggtaaatttaatatagagaaaaggcccagtttagccaaagctgagcataagcgttttgtgtcactttctgtttgtgatcacaggtgatgctgttccttccagtcactgaatgattgctgattttaggtcatacaaaattaatctatcagaagagaagggagcattggaaaatagtcatctttagtgagttggcaaggataatgtgcaattttaaatggcgggggtcatccaggaaagcaaagaattgagtataagaaaaagaaaaaccaaagcactgtaaaaatcatgcaaatctaatactaaagaatgtttcggcacttgggtttaagattgggagatgtacattatagaattattaaactaatgacataaagtaagaaggaccatattaagaagctttgatttta

SEQ ID NO: 34407 - DNA, 2009 bp, Bovine  19866880634014
ccgctcgtaaggactgctggtggccccaagtagtgtgagaccatcgtgagcctttgatggatatcattgctctgggatagtatggaatgaaaagcacttgttggtcttcgatcaaatggaaaattttaactaacccctaacctcaaaaaaatctttagggacttccgctggcaattcagcggttaagatttcatgcttccacacagcaggcatggattctatccctaatcagggaactaagttcccacatgacacatggcatgggcaaaaaaaaaggtgcctttgtgagtctgatgtctgctgtgccgtgcttagtcgctcagtcgtgtccgactctttgcgaccccagggactgtagtccaccagactccactgtccatggggattctccaggccaggatactggagtgggttgccattcccatctccaggggaatcttcccaacccaggcatcaaacccaggtctcccacattgcaggcggattctttaccacctgagccaccagggaagccatggtaggtttatgtaaaatcacacaaaagaatggtacttggagaatgaggcagctttcataagttggcaccctgaatttggagaaggatgctcttattcttcagtataggaatcacatacttttacatcatttgcttctctcaccagcagatcttaaatgattatcaggtttattttagatcatttggttcagaaagaaaactgcattaaatgtatctcttgttcctttagaaatgtcagcagtgaaatgtgacttttatctgtcagtgaataatagcttataggaaggatgacattcaaataacagtgaagggctccaagtgacctcctcctggtttatattaatcactccagcagatgggctgggagggtggctgtaaacattctccacctttaagtcaggtgtgagtatgatggggagagaatcactcaatcacttaagtaacatttttaaggcataaaagggagtattcagcaagtttctgcgtcatggggcagttttctgtggccatgtagagttacacactggtgtgcttttctgctctaagacattgcagctaaagtcagaatatctgtatcctcagaagtgagatccacagagcagaggccgaatataatcgctgtgccacatacagcgttttgtgtcagggagttgagcatccagtttttggttgtcctcggaggtcctggaaccatcccctccagactccatgggatgactgtgaggcttgacttaggccccaggcctctgtctcctaacccagagctcctgaacatgagatgtgttatagggaccttgtcctggacatacaaagtgatgtttctagcatgagtatatgattttaataataagcaaaagcataaatagaatcaaaagttattattacagatgcctgggatcacctcccccttgaccttctctgccttcagctcactgtagcgtctcagtccttccttccctttcaccaagccctgatgtgactgttggggtgacatactccccaaatttcttgacttaaaaggctatattgcattgatgttgttagaaatcctgattctgactgcagaaggagataacaaatatgaatgaggtgagataaagaatcctataatgctttatctgaatatatctgtccatggaattctccaggccagaatactagagtgggtagcctttcccttctccaggggatcatcccaacttagggatcaaacccaggtctcctgcattgcaggtggattctttaccagctgagccataagggaagcccaagaatactggagtgggtagcctatcccttctccagcggatcttcccaacccaggaatcgaaccagggtctcctgcattgcaggcagattctttaccaactgagctatcaggaagcccaacaacatgaagtcataatttataactcttgattcttggctccagccgctgaaggggctaagaagccgtgatatccaacagtactgagcacactgagtgcctaca

SEQ ID NO: 34408 - DNA, 1426 bp, Bovine  19866880652643
tatttgtttgtttggctgtgctggggtgtcagttgctgcatgaggatttttgatctttgttggggtatgtgggatccttagtggcggcttgtgaactccactagttttcatcacaggatcgctgtatgaggtaggatgtgggatctagtttcctgaccaaggattgaacccaggcctggagcaagagagtgcgggagtgcagagtctgagcctctggaccaccagggaagaccccctatgatgtacttcccctgggaagtgtacaaaaatgaaatggaaatattaacatccagttaacctaagtagaaaaattggaaggaggttctaacttttgaataagtgcaggagcaccatttttctggatgtcaaaactcaatatggtaaagatgccaattattcccttgtgtgctcagtcgctcagtcatgtccaactctgtgaccctttggactgtagcccaggctcctccgtccatggaatttcccaggcaagaatactggagcgggttaccatttccttcttcaggggatcttcttgacccagggatcaaacctgcgtcttctgcattgcaggcagattctctacctggtgagccatctgggaagccagttattcccttagctgaatgcaattccaataagaatctgacttttctttttaatatatcaacattactctaggggtctactcaagaaacatgaaaacacatttgcacataaaacttggacatgaatgttcatggcagcattattcataacagctcaaaagtggaaacgtctcacacacgcatcaagttgtaaacgggcaaccaaagtgtggtgcatccataccatgaaataccactcagcaataaagaggaaatatacatgctgcaacagggatgagctcaaaattgttatgttcagtggaagaaaccacgtgtaaaagatcatacagtggacactatcactatgtttaatattaaaagtctggaaaagcaaatctatagagattgaaaataaatttgtggttgcttcaccctgggaattgaggagtgattggaaataagtacaaaatttctttgagggggttgggaatattccaaaatgagactgaggtgatggttgtacaactctgcaaataacactgaaaaccattgaactgaatacccaaaatagactgattttttattatgtaaattatgtatccataaagcaaaggtttttctgcgtttttctgtgtttatataagaatggagagagaggtatgcagagccaaagcacttttagggaaaaaagaaagctgtgacaggacattaattattttctttgggaaaagccttagaaggagaatttctggattaaaggatatacacaaagtgaataataacagtagttgaagaccatacatgcatattgataataaacaacccagggtcaaacttcacac

SEQ ID NO: 34409 - DNA, 3445 bp, Bovine  19866880703923
tgctgggttatccttgctgtgtgggctcttgtctagttgcggggagcgggggctactctctagctgcagtgcatgggcttcttgtggtggcttctcataggctctggggcccccgggcttcagtagttgtggttaccagcttctagagcacaggttcaatggttgtgctgcatgggctcggtgcatttgctctgtggtaagtggggtcttccggcaccagggatcgaaattgtgtctcctgcattggcaggaggattctttaacactgagccaccagggaagccccaagagtgctttcttactctgttctgaaaggtaaaaagtgctctgtgcaccagaggtttaatagccaacttgcaattcaatgaatctgattttgtaagaaaaaaagtcaattcacacagtgtgtatcaacaagggatgctgtagacatgctatgggggtagagttgggattaggtgaacttgaccatcccatggaactggagggtctgtggttctacaaatccagtgaacaactaagtaggtggtatcagtgaatggtgataatttgttattttgtagacacaaatctgacaactttactgtgtgtgaacagaggagttgagggtattaaaaagttatttaaatagcaaggaatggactggccatctgaaatagacaccctataaaaatagggaaagccactaaagataataaagggagtgataagacaggtaactataagacagttgaaggaaaacccttcaaatttagtcagaagatctttaggatttatcaaggcatctgacggcaacaaacttgaaggatagaaagaattttgctgccatattctttctaaccacctttttcagtaaggtgattccaatcaccctacttccttaggacaaaaccaaagtgatttccacccacctgaaaaatgtatggtgttctacacatactttccataaacgcttggcggctcgatggtttggcagcttaaacccgatggtgctttcaaattgttcaaactaaattaaaaaaaaatgttggagagcagagtgaagtttggagtcataaataacatgaaagcaaatgacatacaaaataaaaataccacccataaatttttctctactccctacatcaattgctatataccgatttcatgctacacacattcattcattaaaaaaaaacttcttatatcaatctcaaaacactgcaggtacagacaaccacattacgcatgtagtaaatgttgcatgtacaaggattaatcttatgaaaactaaacgcagaaaaggacagaatctgtattccttccagagaccaatttgtcctgatcttttaaacctaatgttcatggtttctctctgacatcatgacatcagctggaacacagaaatgaataaaacatttagagtctacagcagcctcaggatgacattctctccttgtatctggtctacaaatatgcatatattctatgtatccgatgacttggtatcagatattgctgattttatttgttcattggaaggactgatgctgaagctgaagctccaatactctggctacctgatgcgaggagatgactcattggaaaggatcctgatgctgggaaagattgagggcaggaggagcagggggtgacagaggctgagatggttggatggtatcaccgactcaatggacatgagtttgagcaagctctgggagacagtgaaggaaaggaaagcctggcatgtggcagttcatgaggtctcagagtcggcacaactgagcaactgacagcaacagcaagctggacataataaagaactgcgtctatcacttcattgactgagataatacattcttgacaagctggatctaacccctgccaacctctccaagctcattctacctttattctcaacattctggctgtacagtcattcagttccggcacacatcatgtccttgtctcagaatttttggtttgcagttatctctacctggacagcccttaccatttttctggatatggttaatccatacttattcttcagttctttgcttaaatgtaatttccttagtttttttcctgaccctactcattatctaaactaccttcccttttatatttctcactcatagcctttatatgtcagactttatatttactcaaataattatttgctcagggtctattttctctgaccacaaattctgcatataagaacagcagtgtgtttattttgtttaccattatacactgagagccttgcagagaacctgacctataatagttacttaataaatatttgtttaatgaatatgttaagtgcctagcacatagtatgtgtttcattgatattagtttccttctctcctgactcaaaaccatcagctcactggtttatatgatggtaaatgcatcttagtttagcctctctcttgttcttccattttataattctagtccataagtggggcactacttgtgaattagtaccatgtctctttaatcactgtggaaaaattttaagcttcttcaaatacagtttttttaaaaatttaactttacttatcagcttggcctgaaataaatagtgctaccctcaaatggaaaatcatagagagcgtagctaatcttctcatagaaatcaaaatgactgaacccaggccttacatcttttatgttctttcttccaactgtgttcacttaacagaaactacacgacaattccattttgtgtgttttgttctaatttagatcattttgttcttcagaaagctagtagagcacttatgtctttcacatatctttctgtgtcaggatctctgagtaggtttgccacctactggatgcgtgacctggggtaagttacttaaccacttctagactgagcttcctcctctgttaaatgggcatgatggtaggactcatctcaaaggttgttgttattgttcagcttcactcagtcatgtctgactctttgcgaccccatggactgcagcataccaggctgtagtcctttactctctcccagaacttgctcaaactcatgtccattgagtcggtgatgccatccaaccatctcatcctctgtagccctcttctccccctaccctcaatctttcccagaatcagggtctttccccatgagtttgctctttgcaccaggtggccaaagtgttggagcttcaacttcagcatcagaccttccaatgaatattcagggttgatttcctttgggactgactggtttgatccccttgccatccaagggactcttaagagtcttttccagcaccacaattcaaaagcatcaattcttctttatgaaggttaaatgacataatttgtgctatgcatggtatatagtttctggcagagttcagtaaatgatagctaatgcttttggttctgttccacagttgtccatcaactcttttagtagtgtactgaacataagtta

SEQ ID NO: 34410 - DNA, 1078 bp, Bovine  19866880719459
aatcttaaagacaaatatgcttaatgtccaagatgtgaaatgttgctactatgcaaacaaaaagtagtttagctaaattgctgacgattaatccatctcagactccaaggccaagttgaaagagctttaaagtcttacatggaaacatgatagatactgtgtatcaccataaattaagctgatggatttttttcccccagatgattgccttttttccagacaagaatactggagtgggttgccatttactactccatgtgatcttcccaacccaggaatcgaatcctcatctcttgcatctcctgcaatggcaccccactgaactgatcacacccactcatcatttactgaacagttacaacaagcaacattttaaagtgtacccgttttaatggtggcaattgaagaacttttttggtaacttgtttttctgttttgttcttcacagaaacgctccagaggccaagtgctgtttgataaagtctgtgaacatctgaatttgctagagaaagactattttgggcttacatatcgagatgctgaaaaccagaaggtgagtggttcaaagctatagagaatcttctggcttcagctgcccttcactgcaagaaagtgaactgacactgaatcggtagatcgtcttctccacctacccctcgcacccctacacctcacatgtactgtctgaggccctaaatgctgtttatcaccttatttcttcatgagggaaattatcgacaacttccttcaatcttgagtcttttggaaacagtaagtcagtgtttctgctcttcatgcttgagttctttatgcttccagaaaagcattttatatagtgttttggggagggtatgataataccgtcagtggatttgagccactgagaatcaaatacattgatacacgggaaacatgtccactggatgccatcttactgttaattcatctcattatgctttcatattctggctgcgtcacaatatgagaggggtcttgtcttaggtatccagtctgcctctgtagactctcacagctgatgcagccctcgttaggccttttcctcacttatcctctcaac

SEQ ID NO: 34411 - DNA, 1619 bp, Bovine  19866880739118
catgtgggatcctcccagaccgggatcaaacctgtgtctactgcgtcggcaggcgaactgttttaccactgagccaccagggaagccctctcttttgcttggaagagattttttttttttccatgcccttaggtcatacaaatagtaacagaattgaacttcaaacctaggttgataaattctaaagcccatactgttttcattgtctgaaagaaaatgcaacattcagccaaagggtatgtttgtccaatgcaactggtgaaaggagtggaagaaactacaggaactacagacatcaaatgaaaattagaggattgtggtattttaacagaactaaactaaaggttacatttgcttgtccatcccagcaacaaggtccttttgtccattgtcagacacatcgcctctacttcctaatttcatttgttttatttggtttgttgaagggagtacagagaaggcggtgtggtcagggagtcaggattctagcatcctcagtgctgcttggtacctttatcatcttagatgagtcatttagcttcccagcctcagttattccatttctaaaatatcagctctaccaacccaatgccctcccaatagcatgctgtacatacaggggacccacgagaaatatacatgtgaatgttaatttcatagcactgtacagaaatcatagtgaccacctcaactaaaggctatggagatgaatatttgtttttctaagaccagaaagtgtggcagaaaaaaaaaaaaagacttgagatgcatgacagattttaaagatcatttggattccaggtctgtctggctgctgtggtgactataatgattctgggtatactcgattactgtcctttgtactcggcaggggaataaatctttttatgattctcaattgcatttaacaccttgacgataaaaatgagaaattttgcatgaagcgttgatttactcatgattagagctatagcagttcagaccaagttactgaatttgacggctgaagaaatataagcatccaacagtgggttgttccaagagaaaaccactgtgctgctttcagaaacgtttggcgagagatttgtgtggggacaaaataatagcaaaggccaaaaatgaacaaatgacaaactggttatccatggatgctctatggagtcatagaagctgaaagagagatttctggctgtgatttcagggtcataattccttcttgggactgcatgcaaattaaggaagagttggcatgatgtggccatatcaaggaatttatgagtcagcataaataaataaaaatgctgactaggagactaagtaattgcctctatttcctgtctaactgcctattcttaaagttatatgagaatcataaataatgaaatctgaacagtaggaatgcatgcccacgagctggaagttcaaaataaagtcagccttctgcatgaagatttttaaagataagttatcagatataacccattccatggacttttatctattaaagaagatatcataagctccctcttgtcagcagataaaaatgaaagaattatttttagcttaaatctcaggcactaaaatattttcagcttccggagaccggcaggatgttgtaa

SEQ ID NO: 34412 - DNA, 1135 bp, Bovine  19866880804451
ctcctgttctggcgtcttttcccccatcctaaaatcgctcaggatcgctgagctaattagaagtggccagcgagcatttagtcaataagcagcttggctcagcagacagttagtgcaatgccagatcaataggaactgaaattatttcttcatttccttctatggccagtagacattcatgaaggacagaatgtcagccttcagtcaaggaagcctgaaatgtttcatttattctgactcgagacatggagagggagcaaccgtaaaccgttccaaggtccttacggatgtgatgtcagattttcattttcaaatggaataggctcagaggaggtttggcaaaaaaaaaaaaaaagggctcagctttctcaaccaaagtccttttgtttttttccttttcctggagggagccttaaaaatgagaaccgtgctgccatttagaactattagctgaatacgcagcttttaggaaatgataggtagttatctttcatcatcttacatactcaaagaaaaatgaaaagaatattagaaaacaggaggaaacattttggaggaaagatattaacaacgatattaacatttttcttcatgtgaccttctgataattcatatggatggctatttggtttcaagttcaggactgaatcaggatgaaatgaaactcttttcagtacagtgtgacctacaagaagcctttcagccccgctgttcaccaccacctggctgcaagggcttctagcctcgagaaagcgacagagcagtactaaatggagaataatccacttcctaaaactaataactcctccagccagttggggatccaggtagatggatgatggctgtcttgacttttgagaagtgagggggcctagctttatagagtattggatttctttcatttctatgattaacctcaaactgatcaccgaagccaatgtctggccctcatgggccaagagctctgtttctgaaagtcacttgtagaaagatgtctctacctcaggagcggttcatgctctacttattttcttggaacctcctgcctcctggccgcctggcaacatctcccgagggagaagcaatctggaaccagagagcggtttattttttttgttatttttttttaaaggaa

SEQ ID NO: 34413 - DNA, 1796 bp, Bovine  19866880829295
aactctcctggtttgtctgagaaaatatctgggccctgaaacaagttattaccctcagttgctttggaagatgcatcagattcactctatccaaatttataattggaaaatggcaggagattaattatggaaatgcttttcaatttcaatagtcaattaacaggcaactgtatgaagaccacaataattacattgttctataagcattgctccagaagtcttattttagtttacttagacttgtagaagagaatctgattagcactatttgtttaatgaatttgacattcaaggggtgcatgaatttcctttggatattggattataaattaatgcttatcaaattaacattgattttctttatctaggtccctcatcatagggacatttttctgcatgaatacctgccatagttgtcattatgttcaggtggaagatttcagaaggaatgtgaattcccgtggaccctattaaacctattttcttgatatcaatgggacctataggtcttatagatctttccttttcccttcaatgtggatattgtttttctctgttctgaccaacagggaatatttagtgcaggctcctggacatgttcaatttcagtaaaccttaggacttatttcgatattataattgtatgctctcagaaacacagatgctaagtgcatagttggataagttaggacagatgtacaagcaatgttgaatcaagacataacattcccatcattttacaacagtatcttgataagcgctctccctctacacagacctattgtcgcctaaactgccagggaatttgcagttattttgcttccttcttcttagaagtgtggaagaatgggaaagatagagactattatgggattatccttgaggaaatcaaccctgaatattcactggaaggactgatgctgaagctccaatactttggccacctgatgtgaagagccaactcactggaaaagaccctgatgctggtaaagattgagggcaggaggaaaaggaggcagaggatgagatggttggagggcatcaccgactcaatggacatgagtttgagcaaactccgggagatggtgaaggacggggaagccctcctttgaacatggtgtgttgcagtccatggggtggcaaagagtcagacatgacttatcggctgaataacaattgtgggttggtactcatcagtaccctcccttcttttagactttggtggagcactgactcaggaatgtaagacctaggtctcacctcttagctctttccctacttagagtcattcaggatgtctgaattttagtttccttatttgtaagccaaggatgctaaaacctatctcataaagttgttgtaaagataaaaatatgtaagcacctgacatgggacttcccaggtagtccagtggctgggactctgcgttcccaatgcagggggcccgagtttgatccctaaccagggaactagaccccacacgccacaaccaagaccccgtgcagccaaatcaatactgttttaaagcacctgacattaggaacacactcggctgatatgccgttcatccttctctggttaaaatcctgggcgctaggcattttctcaccccttcccccactccaaacaaccagtcaaaaaagtatactctagtcttttagggtaatgcatttgaaggaggtacttttctaatcagaaacactaatcattgctgatgtattaataaacttgaataacttagagcgattcccattccaagtaatatgtttgcattttaatttaagcctttaagaagt

SEQ ID NO: 34414 - DNA, 1758 bp, Bovine  19866880940604
aagtatgtactgtcttccccggggctcagcagtaaaaaatccacctgaaatgcaggagacgtgtttgatccctgggttgggaagatcctctgggggagggcatggcaacccattccagtatttttgcctgggaaaccccatggacagaggagtctggtgggctacagttcatgaagtcaaaaacagttgtctaagactgagcacagaacacagaagttatgtacgagggaaaaagaaaaatgtatcaaatataggtttctgggtacaaaataataaaattctaatgacagatcttgggaaattccacgagtcttcatttaagtgagaaagtgatcaggttgctttaatatctgaccacttagcttttctcccaaacggccaaactcatgctgaactcaacgagtttagtatttcatgtcttgttttcacaactgctttatgtaaaaaaacccgcattaggaaaataacaacagaccagttatctagacatgctcagcagctggaaattttgttgaaatgtaattgactccccattcttctgtcaacagatgtaaagcaggaagacagtgtacaaaaatcattggctaaagattacgaagagcctcaaagaatccaaataataaaactcctcctataacataaggatctttccaccatgcttttgtcccagtctttctcagtcccacagaaaggaataaaaaatgtagtgtccaccactgtgggtgccccagttacaatttttgcaatgaaagatcatgaactgtgtcataaaatagaggccttaattatagtcatttaacacattgtaactcaccagtgatttttgcattcagtgtgtttcaaacagctgagctttaagtatgtggagatttgttcaccacttccttattatccatgggtctctgcagctgtgcggcctcctaactatggttttcctaccgagtttaatgactccttggaaggaagatggaaccaaggaaaccgcagtgaaggaaaacacccaactggagagaaagttaacccaggtgtgaaagtgggtgggactgtgaataacgatgaaagaaagcaggcatcgagcctcatggaaggtggggtccagcctggctgaacgtcctgtgagctcttgtctcttattttgggctcctggagtgtatgcaggttggggaactcagagggtactttccacagataaaccccgcccacccccagcaggggtgtgaattgcagggtgagacaaccctctcgcctcctctcggacttaacttgatcatccccgtgttgaggccactccactagcagcagtgggacagggaagcccattgtcccccagaggagaacaatgttacccaagagggacataagctcttcctgaatttccctctattttttttctttttaaaaaatatttatttattttggctgtgccgggtctcagttctggcctgtggggtctttgatcttgtcgaggcatgagatctcagttgcagcatgtgtgatctaattctctgatcaggaattgaacctgggctccgtgcaacgggagttggcatcttagccactggaccaccagggaagccctccctctttttctgaaatatatttccctccttgttacagaaatgaagaaagttctctcggccatttaaaaatagataagcaaaaaaggaggagaaggagaaaaggagagaaggaagagaaggagaaaaagagagaaaaggtacgagaaattgcattaatgccacacttcagacaaaagca

SEQ ID NO: 34415 - DNA, 979 bp, Bovine  19866880969820
gagcgcacacattatgtctgttcacagtgttgggctaaggccctggcgatgctatttcctggggcaggagtccgctgccagttcacatcagaacacgcagagagcacgacggggcgatgacctttctgactctccaagattcttccttcctctcctcccctcccttttctcctcccactggctgacaaaattacacccacatcttcagctgaaactccaaaggagcacagacagtttagcaaagaggttcttgtccaagaatcactgaccctccaatatcagaaatttccaagacagaaaagaacaggccttttcagtaggaactagaatggtctgtagcatttcctaggcgctagaataagcaatccattcgatgtcctcataataagaagtgcccttctctcactcccctcagatatgaattattaaagtctcttattgttcctctgtaagtcctgtgtataatgcagaactcatctggataaaaaggggagaaagaagctggaagcagcaaaaacaataataataatgcatctggagcttacaactcccaccaacagtaaaatcatttcttgcactttcatatgaaaatgcttttccccatttcatttccatcttgggcacaaggtaattacccttcagagacacctcgggagcggctatgagaatgtctgataatttttagtgtatttgcctctacatattctttcccatgctttctcatgcacacctgccatgaatccttagccgaggatgacttcatcaaatattaaatacaattttccgccttcaccaaatgttggtcctacacaaaaccctcaaatgccccgggcgtccaggagggcagcctgactctttctgagccacaaaggactccttgggaaagtcaccctgtcggtgttctgccggtccccctgtgaggtttgcctgcagcctgtccaatctgaacaattgctacaatagcatctctaataagggt

SEQ ID NO: 34416 - DNA, 1306 bp, Bovine  19866881018251
tgacaagattttccttgaaaatcaatattttaaattcctgcaatgctagcctcagctacccataactggagaacctgtttcatcagactggtacactaattactgtgtttgtctactggtcttgaaaactaactaattgacttttaataatatcaagcataaacaacctactacattattaaaacatgacctgctagcctttgtaggacatggattcaagatcttgaatttaaaagcaaaaatcaaatagtcaactgccaaaggatggcagaagaacatgaagcctgggtgctctgtagattaatcctaaaggtaaagtagaagcattgttgaaaattactgtttatttaatatttcatttggaagagatgctcccaaacgttcaattctactctgtatttaagtttaaaatatgcttgaaatgactgaggatggcactgaatcacagtagtagtgtcatagcaaaatatcttaggtttaccagctgaactgccccatgctttacatgtgttaaagtattagttccgaggcaaaatgaggcaatattatgtttaactgtttgtttggaaacttgttttattaaaaaaaagatttttttcatggtaatgctattttcagtacaggtgtgataatactccataaagtattgtgtacttgatatagtgaattgaggaaggtaacggtcccactcgatgctggcctctagtctccatgagataccctagtagcaaaatgtaaatacccttttcaaaaataaagaggcctttgtgtggtgggatgagcagacaggggtggggcagggaactgtgatctcttcaaactcatgcttttggctttgacttcactgagtaaaatcagttctcagagaactgagacaaacccttctatgctccccaaaagcacagaaggaagaaagcttgtcattcacgagcagctagggacaaaaccagcggcagagtacaggtcagggggattagagatttaaaaaaaaaaaaaaaagttggagtaaagtgcacagttactgtcaaaaatatattattttgatcctaagaaaattaagagaattttatctaaggaactagattgctgaccttttaatacatttggttttcagagaacatacaatcaccatcggacctataagactagtttgctttgaaaaaaaaattgcttggaattatctacaggaatctcgtgaacgcaattcaaggctaacattctgcagctctttgggtagtgggcgatttccgcggataaaccccctgcttcctgcgggcatttctcctatcttctctctctcttccta

SEQ ID NO: 34417 - DNA, 761 bp, Bovine  19866881053994
cacaatacagtgatctcttcccccaattttcctgatcaattgccagttcatttcataattacagcattttccccatgaaagacaggttataattttcaagattatagctcgtctccttttcgttagcatttaaattgatgccttacttcttccggccatagtcttggctctgcgggaagtctagggagaatgctactggcatcaaccacacaatgagaaaagtcttttcaaagttagttcacaacctgggaaaatgtctacatggtggatcatctcttgaatgtgataccactttttttgttgttgttaccttcaatgtcagaggcaggtgtctttgaccttgtcccttcttggacagcagagctcaagtcttgtagaatagcaggttcttagggtcagaggacagtgtaaactctagttcagtcctgcactcacattccaacaaagtgcagaggtaggttctggaagcttggaggacagtgattttaaagtccttgtcttagggacacagtaaaatagtcacagaaaaccagcttgcacacaatttcgtggtgtccgtccacataccagctgatctggtcttagagggaagtgcacacagtcaggcagcagttagtgtcaggaattgactgccatgtatgccttacagtccagcgtccaactggcacaggaagagagctgaatatgaggatcgtagtttgaaaacccagagaaggcaatggcaccccactccagtactcttgcctgggagatcccatgga

SEQ ID NO: 34418 - DNA, 1819 bp, Bovine  19866881065798
ctttcttggcatgactttggggcctggtgggtttttttttttttaaagagggaatatttctcacaccatatgcttccaacaagaaggtgggatttcctaggtccgagaatccatcagtgtaggcagggcacagctgcacccagaatattctgacatgccaaattacaggtctagaacattgatttcctacactatgttttaatcaccaagacacggaagagtcaaaatgtctcaaacacacaattttgaacaatcaagggaagggatgtgttctcttgcccacagggtttgagccagaaccactacagtgacggaccacggatgcatttttgctaacaccaaggagggtaattatcacaagtgtctaaggccaacatctgctggacaggacactgtgtttttcttctctctgcactgtgttccctggtgccccaggcaaacagctgtcatctacatgccggccttctgctaacactctgtaattcctcaggggcttcccagcctataattagactccccagctgcctcagtggaggctgctaggggagctgagagggctgtgctttatatcagcccctaaaatgtcctcttcaagacggagctgctggaagaacacggattggaatttggcctgggaggcaaacgggaattcttccaccactagctatgaacagatctaagagcagtgtctgctttcagatgcactgagccagtcacgtgggtggggacttgagactcagcatgaaaaatggggaagtgcaaaaccataggagagatcttccgattcaaagctgcagagagcatcagcactggagccgataccacagctcccacggccttttacataattttcctttccaggcaccatcgtccagatgaaccaacacagcacagcaaggaggaactaagagaaggcagatgaaaatcccatcctatttcaaaatcatccgggttccctgtctcagaaacgagagtattaagtcaaaaagtcaaagagggagcaagctttacattggactgaatctttgaaacaaaaagcagcccaattcttaagaaaatgagtaactttttccaaacacagaggaccacccaccaactctctgacctggtccaatattcataggaaacaaaggcacagaagcagattttcccaaaggagaagaacctgctgtcctggcagagggaagcctgtggctagggtcatcctcagactcctgaaaaccattatttccttgcctagagaaaggactgttataatggactgaaactcaagtgcccataaaaagtgagatgcccccaaagctgatagctggtacaggcagggtcctcagggcaacgagatgtccccgactaacaaacatattggatgctacagatgcctctggtctgtggaccacattggagccccacttatggggtggatattcacacagtctatggatgctctcctgggcaactgatacctggccacagctgagaactggacttgccaccagcttcttcaaattgaaagctcaagaccacagctaagaccaaaggttcagccacactgtgggcttctgaaatgccaaagacaaaattaagaggatgctttaaggagatacttaaagaatggacatgaggaccagcccttccatgcaatcaaggaccctgctgactaccaatgttctaggaagggcaggggactcctgttctcacttttatgaccggaagtcacgcggtcaaggaggcactaggaagtccgtgctggttcctgacactatcagctgcttcccacatgaatgtttctataaactgaggctctttctttccagtcccc

SEQ ID NO: 34419 - DNA, 1263 bp, Bovine  19866881068297
tggtaggctgcagaccatggggtcgctagagtcggacatgactgagagacttcactttcacttttcattttcatgcattggagaaggaaatggcaaccccactcccagtgttattgcctgcagaatcccagggatgggggagcccggtgggctgctgtctatggggtcacacagagtcggacacgactgaagtaacttagcagcagcagcagcagcagcagactagatcacagattttaaattgtgggattctcgttggaatgtatcacagttctatcaagaacgttagcttctcataacctggtatgatatcccttgttggatttctagtgtggatgttttatctctagataaatggaatttgggtcttccttttgcttgtcctgccaagactcgtctcttttgttcgtgttgtctagtgactgtttcctgtggtttggttccaggatgtgtctacaaatggcaaatttaaatggccagattagatgctaattcatgaaaggttttgatcagtgggggtttcttctccatgacaaacaaggcatctttgctgcatcagaatgtgtatgtcctgtgtgacagacagctgtgtgtaactggtatgcacatttggggtcactttccaataagggtgaaagaaattccaatctcgaagtcatatttgcacttaggaatgcactttattcatcccacggctgcttgtaggcatgagtgatggtatgcggacgtacagtgagcacaaggaatttgttcttaggatggtgttcggaaggaataaagagacttgttatttcttatggaatgccatggtgacaacaaataaagtcactaaagagccgccacgttctttagggaagtgcccctagactggacttgtcaaacacacgggatgcttttcaaggattacctgaagcaaaatgcttcagttcatgtctccagttattcctttaaaaaaaaaaccactgtccaaaatatcatggtttgacaaccttccttaataataccaggtcaagaattcatcctcataggggaaaaaaaacccacccaaattctaaagataatttgtttcaaaaatacattttattttaagttagggtttctatgatgtgtactcagtcatgttcttaaggtattttacagacatacatgtaggctgcccacgtggctcagtggtaaagaatctgcctgccaatgcaggagactcggattcaatttctgggtggaaagatccccggagaaagaaaggcagcacactccagtatt

SEQ ID NO: 34420 - DNA, 959 bp, Bovine  19866881089937
tggaactctgctcaatgttatgtggcagcctggatgggaggggagtttgggggaaaatgggttcttgtatatgtatggctgagtcccttcgctgttcacctgaaaccacaacattgttaatcagctataccccagtacaaaatgtttttgatgttaaaaaaaagatggagttggctgaatgaaaggatccttcccctataggcttgaacttggtggggaatctggtctaccctgggtagaccttccacaccaagacagactttgtcttcctcctcttgagcatccagaggatgctctcatggttctcttgggttaacattagaggaagctgggtgaaaggtttataggaacactttatatttttgatcacttctgcatatatattattatgtcaaaacaaaaagattctctgtgtaggtaattatttttctctggtttctttcaagactttttccttgttttagttttcagcattttaattatgatatttctggggatgcattttattaagattattttatttgggatttactgagcttcttgaatctgcaggtttatatatttctctaactgggagaatttttcagccattatttcttcacatttttttttcagcatcacattctttctcttctgagattctaatggtagagacattggattaaaatttttttttctcttaggattataaggcttctcatttttaaaaatatttgttgccctcttgctcagactgaataatttctattgctctctcaagttaactgatttgccctttttcacctccaatctgctagttagccgactcagtgagatttttcatttcagttgtctatttcagtctaaaatttacgtttttttcttttagtcttctatttcttttctgagactttctagttttgtatttaagagtgttcctaattgtttgttggagaattttaataaaactgcttctaagt

SEQ ID NO: 34421 - DNA, 1644 bp, Bovine  19866881122385
attgtgccaggtgtagtctgttcgcctggtaccacaggtaaacccaggcacacacaacaccacacacagtatgtgtgtatttaatttaattctcacaacagtctaacaagacagttattaccagtttgagaaaagtgatgtttagagattatgcaaatcatccaaagtcaccaatcaggaagccttcctggtctgccctcttcctctgactttttagatgtgcctgcctagtacccaaaaaaggtcattgtcattgtgcttagccatcacaaatttaaacattctgaaatgtatgtatatttctagaccgtgtgcttctgggaaccattccatttttatctgtgtgtgcctaatgcctaactcaatatttggcacaggatttagaactcattaaataaataattgcttacacaagggaaagccaggatttgaacccagatttttctaaccacaaagctcatgcctttccattgtatcacattgtgctacattctctctcctcgctgctccatctccccccacgcccctccataaattagggtttgcctttctctctcgattaccatctatcccataaaagctaagtcccaactgacaattattttcctctctctctgggaagactggcgattaaaccaaaaagcacagccacatctttttcaaaaccaaataaatgccttttggaaaaagccctcattgctttcagatgcagttgcagaacacatgtgagcatcaaaataaactttttgttagaaatattaactacattatggacagagacttaagattccatctgttcaatggggttttcacttaattagaatcttttgaaaccagagccacaaatcactgttcctattggccacacgtggaaatatctcgcttcaacagaaccctatgtccagtgacacctgctatgaccctgcagtttgtctacacagaactgcagaaggcagcacagataagctatggcctggacttgactcatcagcagtcagtcaaaactcctgccagttcacaggagctcaaaactcaggtgaaaatagcagttggacctggtgctggaatgaagacactgctgtctcctcccattctttgccaggtcctttttttttttttttttggccagggttttaaatgcctgcttttggaggcagaatcacagagacacagacctggattctggggacacagagggctaatatgcttggctgtgcatttgcaaactggaaccttggcaagtatgaagcatctgaatcctaaatctatttccttgtctgtgaaataagacagtgctgcgaagagtaaataaggaatgcatgtaaaacagtagtgccctttggccagacagtggtctggcaaagactcttcattcctcttaaaaggagataaaggatcacacatggaaataccatgtgtgtgtgcatgcttagtcgtgtctgactctctgcaaccccatggactgtagcccaccaggctcctctgtccatgggatttcccaggcaaggatactggaatggcttgccatttccttctccagatgagcttggactttgtaacaagttcaaggtgcattaagcaatatcactctccattttaaaaacatttcacagcagttatatctattctttctatatccttggt

SEQ ID NO: 34422 - DNA, 1273 bp, Bovine  19866881132515
tcctacatatattttgaataaacaacaaggtacaataacttgaaatggttaaataatgcagtgagccactcatggcagtctctgtcttctggatatttattaaagaaaaatgattctctgttctgatggctccagacaactatttccccgagggccagaatgagccacatgactcttagaatcttctagcattgaaactagaaggaatttaagagatcagctaagctaacggctcaaaaactgtagaatgcacaaaatcatttggagaacatgtcagaactgatttctgagtcctgctcctatggttttgcttcagaaagtctgggaggggcctctcttctaactgagtagaaatacagcaacctatttctaaccagttccaagcaatgttgatgctgtcagtccatagaccacactttgagaaccaatgatctagtttttatttcctgctgtatacatgatggagatcttcagaagctgggtgtgacctacccaaagacgcactgccaagttggagacccaggttctaaccacactctgatgcccgggtcctctgattagtagaccacatctgggtcacagatgtggtgatatctgggtctccaaaacttgtagatgaccagcacaggcacaaaaaaatgtgtctgactagttggcaatgctagtttcacatgaaatgatagaggatatgaagagaaaataatttcttattctgctcattccaatcagaggatgaaaaagttttgttgattttttcccttcctctcaatgacagatttctgtggcagttttattgttgtggctaaaatgttcttttgaaacaaaaacattatgtcatgcttctgaaaatgcaatgagaagattcttttcatggggtcactttcatagggttctaataatgacatgtttttctataaatctttagctaagctttttctttttcaaattatttttaaggaatatattttccagctggaaatatcttttcccagacaccctccctataactaaataagaccatagataatagcaagatctacaagacttggctttgaccagcgtttcacctgtcttctcccactgtagactgccaggggtctagcttcagtctactttgttcctaacccctctccctgcccccaatgccatcagcctctcctcaagccagttttggttttcatgcattggtcttcatctttctaggatctttgatccacactctagatctgtcatataacctcttttctgacttgggacctgcgaattcatctcc

SEQ ID NO: 34423 - DNA, 1685 bp, Bovine  19866881203521
ctaggtgattatcagagaacagagtgactgggcacatgatccacacccagacttatgcagaacattgacaataactttattcatcatagccagaaactaaaacatcctcgaagtccatcaatgctattgagctacacaaattgtggcagatagaggtacaacgttggtaaatttcaacaatgtatggaacaacagaaaccagacaccacagagcacgcactgtaggaattcattgatgtgaaattctagaaaaagctggaaaagctatagtgacagaaagcagatcagggacttggggacatgcagaggtggattgggactgactgaaaagggacatgggcttgaacagatgaggcctgcctcagcatcaacaagaggcaagtcagctgatgggcaggatgaagggtgtgtttctaaatattttaaaagatgtgctaaaagtaatttctttttaaatgctaatacatcaacatcttgctactcaaaatgtagcccacggaccagcagcacctacagcaaggacatcactagggagcttgttagaaatgcagatctcagacccacctgcagtctcatgagtcatcatctgcattttgacaagatctccatggcattcacgtgcacagtcaggttggagaattacaggttaggagaatatctaacatatttagttttcattcctgtagggtgttccccctcatagctcagctggtaaagaatccacctgcaatgcaggagaccccggtttgatccctgggttggaaagatcccctggaaaagggaaaggctacccactccagtattcttgcctggagaattccatggactgtatagtccatggggtcgaaaagagtcagacacaactgagcgactttcactttcactttcagggtgtcctccactcccagaaatttcctggaatgtgtttaatacttgaggcggactgattaccaagcctttttcttttcctacactccattattttttcctggagacagaaatagcaacccactccagtattcttgcctgaaaaatcccatggacagaggagcctggcgggctacagtcctggggtcgttggacacgacttagtgactaaaccaccagtgctcttaataaatccattaatccattatcacatttaatcttcacaacaaacattcaagataccataatccttctattgcagataatacagttaagtcacttatctgaggtcacacagctagtaaatagtgaagatgttctatttgagtcggactaattcccaagccttttttatcttcctacactccattgctttttcttgaacttaataaagagtaaattgtttatgcactaagggaataaactcattaaaatttaagcttatgagagatcttttgagcatgttaaatgaggtctttcagttgtttaaagagtatttcaaatagtgtcttgcacttctgtcagtaataaagcagagagagtgacgcatcattggtttcccatttctggtgtaacccaagaagtgggaagacgacatcctgaatatacacacccttcatcctgcccatcagatgacttgcgtacttgttgctgctgaggcaagccccatctgttcaaggctgtgttgagccaggtgctaagagcagtactgattgttttctgctcagactgcccatatgcctccatgcaaactgtag

SEQ ID NO: 34424 - DNA, 1155 bp, Bovine  19866881336019
cacacccctgtgtgactgtggcttctgaaagcgacagtggggtcactgagagacgacagtgtcttctgtaaattgactcaagctggcacatctaaaacatagagtctcctgagtctggtggtttttcccacaaaatggccctgccgcttactgctttctgacttggctgaaatcaagaaagggacatgatatctttattttccaggcagaaaggtaaaaccaggcaatgacaaatcaatcctcaaggcacacaggtctattcctgaaagtggaaaacgtgattctgagagtccagcatggctggccttaaaagtcaaaattcgctgactcattcccaagtgtcaggaattttaaaatctcagatgtactgttttccaaatggaaactggtggctactgtctgacacatccactgggtatgacaaggccttgggacagagaggaggtggtgctgagggttggcgggtacatcctgaaaagcgctattagccccaggttgggatcgatgtgaaacttaatactttaatgactgggctgctcgtgggctcttgtttttaattctctggtcccgagagaatgattttcttctctcaatcgaatcttcttgagagaggaggagaaagcaaggagataagtgtgggtcaggcagtgcttagggcagagcttcctaagggaagggaccgctcctgatacacggagcaggcagccaagggtggccagtgagcaccatgcatctggactcaaacctcttctccatcccctacctatcccctgagctgagtcactgacatgatttgagtctcatctcctcctctgtttccctgccccaggatggttagtatgaaatgagatcatcacataaaaaaacattgtgtctgatgtctggcacatagtggatatttaatactgatagggaatttcaattattttatttcaatgtttaacaacttgcctagagagcaccagagggtcagtatatttggtgtgagtggatgataaatgaatgacgcactgaactcatcacaggtggaaccagctcgtgactgtcatcaacatcagaagttcctaataggcggagaccatctgagatcacaggcaagcatcagtctttatgcgtatcagctaatttagccttccaaacaatcctatcaagtca

SEQ ID NO: 34425 - DNA, 1019 bp, Bovine  19866881369758
cttgggagtaattaggtcctgatggtggagcccacataaatgggattagaggccttacaagaaaagactggagagcctgcttcctctctcttccaggtgaagatgaggaaaagaaagaaagaaagtgaagtcgctcagtcgtgtccaagtcagacaccagtgagccactaacactttactttggagacagaaattgcggactatacggataaatagatgtggggggcaagggggaggtttcttcctctctacccggtcaggaatattgcaggccctatttccatttttctgcatcccctttgtttctctccaagaaggaaggagggaataaagattgggcagagctcactagtcttctgacatctctttccttgtggatgggtctgaggacacttgtagccccaccgtttgctcaggcagagctggtcctctgcttcttactgtcgctttgcagtttgtcactatgacaacagattcctaactacattccttcttactcccctccagcccactgtctacacaggtcatggttacttttttttgtttaatttcctcaatagttatttgatttacctgatgagacttggaagtctatttttggcctgcaacaatgtggatgttagtaagaagcatttccagtcaattttcttcttcttgatgcagaaataatgccattttaatgaaatagtattattcacactttccatttttctcactggcctctactgcttggcatcacccctttgtcaggagagcgtaaatatctgcatcaaaaactaaagccacacagaatctcctgctgttttaaaaatgagaaatgaataggttgatagagatattttccatgtttgaaaggcttattaaaaataaaaccccaagaatccattacaagttatgaaaaatgcattgactgacatttgatgttcaagcaggctccaaaagagcaggataattaaagaagataagtaaaaaatccaagaaaatatatgaagctgactaagagcatgtttaaaataaat

SEQ ID NO: 34426 - DNA, 2762 bp, Bovine  19866880210862
catgacccaggaaaaacctagccttgactagacaaacctttgttggcaaagtaatgtctctgcttttgaatatgctatctaggttggtcataacttttcttccaaggagtaagcgtcttttaatttcatggctgcagtcaccatctgcagtgattttggagcccagaaaaagaaagtctgacactgtttccactgtttccccatctatttcccataaagtgatgggatcagatgccatgatcttcattttctgaatgttgagctttaagccaactttttcactctcctctttcactctcatcaagaggctctttagttcctcttcactttctgccataagggtggtgtcatctgcatatctgaggttattgatacttctcccggcaatcttgattccagcttgtgcttcttccagcccagcatttctcacgctgtactctgcatataagtttaataagcagggtgacaatatacagccttgacgtactccttttcctattttaaaccagtctatggtttaaaatggttccatgtccagttctaactgttgcttcctgacctcaaaaaacaaacaaaagaaaaatcaccagagttgcagaatttcttttgcaaaaaagaggattaaaaaaaatcaagaggcaaagtagaaataacagcttgcaatcaacatgaataagccatttaaattctgtgcaaatgcatcagtttggtgtaaaatacaaggtgtggaccagataactgcctgcctcattactagctctaaaattctttagttctgatgttaaaaacatcaaaggtaatttataacatttttaaaatcctcaaacaatgacaaagattaaaaatggaggtcttagctaacttagtaccgatgatagaattggaccaactggtccagaatctgctttatcaactagttatcaagtttgcattgatgaaaaattgtcactagttctcagatttgtgaagtgatttgtgaagtatcagatttggcccaggctgtgtagatgctaaaaatacatagaaatgttgtataaggacacaagaaagcaaaattcaatctgtatcacttttatttctcatggtttttaatttgaaattactactcaagatccagctcatatttattttccttttaaagtctagtttatttttcctttcacatcagtggtccactttatcatgaatattttctctattgtgatttagtacaataagtatatatagagtaatgattacaaaatatttttgacaagtatggaaaatagtagttaatgttttccatctgtttgctgcatgctatgtcatgaaaagaaccattgatcctatagaatcaggaaacacctatgcaaggacatgacagaaatacaaatacttaatgaattaattttaatcagttacacatttttgtaaatgttaccacatgttgtttaaattacccattatcaaaactagtatccaaatgctatcacttcccagagcttcactctggaaagttttaaaccttgtaatttaaatttatttgtggaaaatgagatgtcatttctttctcaatatctgatttctaaagctgaagttcaagttctgaaatctttcttctaagagctttcatggagctgtcacaaaggattttgtttgatagacttaaattctgcaaaaagtcaaaaccaagaactctatctaacgatttcaaattcaaactacagattgcaaaggggaatgcagaatgtgtcacaatttcgatctgcaggcttggaaggcactccagacagtccatgttctaggaagtcaggtgatgctagtggtgaagaatcctgtcaatgcaggagacgcagtacatgcaagtttgatccctgggttagagagattcccctggagaaagaaatggcaacccactccagtattcttgcctgggaaatgccatggacagagaagcatggtgggctactcttctctttcaccctcatcaagaggctctagtttctactcactttctgccattagagtggtatcattttctacattcacctttatggcagaatgtgaagcagaactaaagagcctcttgatgaaagtgaaggaggagagtgaaaaagctagcttaaaactcaacattaaaaaaactaacatcatggcatctggtcccatcacttcatggcaaatagatagtgaaacaatggagacagtgagagactttattttcttgggctcccaaaatcactgcagatggagactgtagccatgaaattaaaagacacttgctccttggaagaaagttatgatcaacctagacaacattttaagaaacagagatattacttttctgacaaaggttcatctaaggtgaatctaatgaatctgaaggttcatctgtcaaagctatggtttttccagtagtcatgtatgaatgtgacacttggaccataaagaaagctgaccaccagagaactgatggttttgaactgcagtgttggagaagactcttcagagtcccttggattgcaacgagatcaaacctgtcaatcttaaaggaaatcagtcctgaatattcattggaaggactgctgctgaagccgcagctccaacactttagccacttgatgggaagtactgggtcattagaaaaaaccctgatgctgggaaaggttgaaggcaagaggagaaggggcaacagagggtgagatggttggaaggcattactgactccatggacatgagtttgagtaagctccgggagatggtgaaggacagggaagcctgga

SEQ ID NO: 34427 - DNA, 3874 bp, Bovine  19866880391789
gaaatctgtatgcggacagatgcaatagttggaaccggacatggaacaacagactggttccaaattgagaaaggactacatcaaggctgtatactgtcaccctgcttattgagcttatatgcagagtacaccatgcaaaatgatggcctggatgaagcataagctggaatcaagattgccaggggaaatatcaataacctctgatatgcagatgacaccacccttatggtagaaggtgaagaggaactaaatagcctcttgatgaaagtgaaagaggagagtggaaaagctggcttaaaactcaacattcaaaaaacgaagatcatggcatctggtcccatcacttcatggcaaatatatggggaaacaatagaaacagtgagagactttattttggggggctccaaaatcactgcagatggtgactgcagccatgaaattaaagattcttgctccttggaagaaaagctatgaccaacctagacagcatagtaaaaaccagagacattacttggctgacaaaggtccgactagtcaaagctatggtttttccagtagtcatgtatggatgcgagagttggaccataaagaaggctaagcaccaaagaactgatgcttttgaactgtggtgttgcagaagactcttgagagtcccttggattgcaaagagatcaaaccagtccattctaaaggaaatcagtcctgaatattcattggaagaaatgatgctgaagctccaatactttggccacctgatgtgaagaactgactcatttgaaaagaccctgatgctgggaaggattgaaggcaggaggagaaggggatgaccgaggatgagatgtttgggtggcatctctgactcaatggacatgggtttgggtaaacttcaggagttggtgatggacagggagacctggcgtgttgtggttcatggagtcgcaaagagtcagtcacaactgagcaactgaaatgactgaagtgactacactgaacctcttccatcttggagggagcagagacttgtcctcactggagtagatacattctgggtgtagatctgcctttcctgacccacagtgcttcttctaggaactctaggggaagacagaggatgagatggttggatggcatcaccaactcaatggactatgagtaaactctgggagttctgatggacagtgaagcatggtgtcctgcagtccatggggtcgcaaagagtcggacacaactgagcgactgaactcaactgaactcccatatagtaaatatcaatagacagaaacaaaagttccttggaattctcaataatttttagaagtataaaaggatcctaaagccaacaactttcagaatcactgtttcaaaagattatgtctatcaaatagtcattaaagtatggttacttcccctacttctaataatcaaagacaccacaaactcacacacacacacacacacacacacacacacacacacacacacacacagtctgcacatcaaaacctctgagtggcctacattcatctgtgtaacaacactataatgaaataattataagctgaaatacaactgacatatccgcaagtaaagttttactctagggaaagtttagagttcaaacaagtattggacattggaaaaaacttaagagtccagaatttaatctctgagatttcctgagaagtatagagattccaaactgagaacttcagaagtgtcaaagcatatacagaaacatcttgagttaaagcttacaatttaaaattttcttgttcttatgtttataaataacttgtttcaaaacacaggtatcaacaataacatctgccttgcagctaagtctcttcagtcattgtccgactctatgcgagcccatagatggcagcccaccaggctcccccatccctgggattctccaggcaagaacagtggagtggattgccatttccttctccaatgcatgaaagtgaaaagtgaaactgaagtcgctcagtcgtgtccaactcttagcgaccacatggactgcagcctaccaggctcctccatccatgggattttccaggcaagagtactggagtggggtgccattgccgtctccgaacatttgccttatgtatgtccaattcttcaattaaatttgcaaagaaaatgttagaagtatgaagactaagcatttcaaatatttcagtgtcctctttccagagttaactgtgtactgcaaaatttacctgaactggatgtttggaaatctttcattctgactgttttattaggaacagaatctttcattctgactgctggctgaatggggtttggaaacaagttgattactaaataatgtacataggagacaatccacagttcagaattcaagataaaatcataaacgtttttaccttcatgttaggatatttcccaggagactctaagagggaaaagggacacagagttaattacatgtaaatatgaaagccagaggtacattcatgcagagttagtacggagcagaatccttgcgctcagccttggcatggaatacattgttttagtgtcttgtttttaggggatcttaggacactggtaagacagacacaggaatccactaaagatagtgaagaaaaaacaggaatacaggctcaccaaaacgtgcagttaagatttcaaaagtaacattacgttttcaacggctttataaaacattaaagtgcacacagaccaatgtgaacgtgctgactgatgaggagaaagtggatctgaatcagaggagcaagtcatgaacccaagaagataaacgtgaaagctgatggtaaaatgcaacagcacatcttgaatgcaacacagcagttatcatttccaccattatgcgataagtatttatcatgttcttcaatctgtccagtcctttaagaagtgcacagctgggatgacagttcaccagaatgtataattcatttctcatcaaagacagagtaatgaactgattagcctggatatacacttgtagaaaaatggctcataaaaatattcattatttttccatatccgtgtgggctactggaatgcctacttgtcttggctcctctagtctagccatcttaaagtttctcaatccactcatgcaggaaggtatataagacacatctaggaaataatgtataataaattctcaatattgaaatacaattatcaaaaaggaaataatatatttaattgccaaagaattattagaaattaaaaatcttgcatgtttcaaaatcagtgtagtatttattaaaagtatttctacatttagggaatgaatcttattaatctgtttggcttcaaaatttagtttggtttggtatatcatgttaatgcttcagaggatttctatgaaacaactttcaaagaatcagctatctttataaaaaaaagtcaatgcctccttttacaaattaatctgatttgaataacaaataccagtacaacatatatctttgatgcctaagagttactcagaggggctgcagtttcccccacttctagcaccccctcccagctccaggattctctggagcaataatgatcttatcttttttcagggtaaatacactgaagtcatctagaaggagctctctcaagtgtcctcatcaactccaaactcccctccctacggccttcctttcctccctttgtcctttcactagattctctcctctctaaatggtaatctctagatctgtggacttaaatcttcccccttgacatcctttctatggatcatccctacctgtggtcttctttacagactggggcctggtggaccgaagtcaacgaaaagaaagcaaaagagagagactaatattccctggggtaatggaaaaccaataaagcc

SEQ ID NO: 34428 - DNA, 2371 bp, Bovine  19866880413687
attaaaatcagaggataatattagtttaatggaacattccagaaaattatcatttctcatctttccttttgtaaattgctgtagagttctgtatacatttatttcatggatttcagaataacgtgtgcagaaagggtcttatacaaaccagttgaagtttaggcattgccttctttccttttcattttaagtatattgtaaaagcatggatgtactcagatggtgtagaatacgtacatccaaactagagaattaaaaagattatctggatcctgccattggattttttttaaagctattgagatataattgacatatcatagaattcacctactcaacatgtgtatttcagtatctcttagtctagagatgtgtaaccggtgactacagtcaattttagagcattcccatcaccccctaaaagaaaccctgcatcccttagccaccacccatggcctcccatctccctcagccccaggtaacccccagtataatatctgtctctgtagacatgcatgtcctcagtattttatataaatggaatcatgctgtattctcctttgggattaactttgctcatttgatgtcatgttttcacagttcatccatgtgataacacgtatcagttcttccatttctgtgtgttgtcaacagtaagctaagccatgtatccatcatcacttgatggagctttgggttgtttccgctttgggtttattaataatgctattgtgaacattgatttccatgattctgtgtgcacatgcttttatttccctgtggttggatcttatcctcaaagttagctgactttttcaccttttcttggcccttgctcagactgtcctttctgtctttacagtttcttttcctcttgggtagtccttcattatttcagacctggcacccagtctctcctccttcatggagctttcgtgactgtccagctctttgagccttttcacatcagcacttgttacctagtctctgaggaagagtttagcccctagttttacattgtcgacatttcttccatgagggggaatcttggctaagtatacactggtgtaacagggaatatttattgatatgcacagcacttgtcttgcataaatggacagtaacaaaggattacaagaatgaggcattttttgttgttgctgttcagaaaaaaatgtgcggatcatctctgtaaactgttaggaaatgggatttctttaactttgcaaataattctctttggaatgcaattcaaattagcaaaaagtctttgtacttcagaaaaaggcttatgggattagaatccatatttataagatttattaattagagtcttattctcacagtcttcttttgggagggacttattaacttagccctagataactcaatacagtatccctcaaacttctttaaaatcctggaacattaagatgggaggaggagtaagagacattctattaagaggtgacttgtagtcattttatgaagaaagatagaaaaacattattgtagaacaataaaacagtataaaatcaagtgcaattgttgtgtgacaaagatgacagtgaagaacatactttgtgactcttggtggtttgaatttctttcttgattctctgagtaatctctggtcctacagtctacaatacaaataccatcatatttatttgatcctgggtttgagttaggctgtgctcagtccactgtagtcactagcaaacagtatctttttattcttgaagactgatgattttccagcagacctggaaactgcatcttcaaaatgtctgtacctggatgcaaaaaatcaagttttttgacaggtgttattatctatgaaactaatgcaaaagaaatgtaaaaaactagagaagaagaaaaagaagttggagcaagaagtagtgtacctcagaagtcatatagaaatgaatatgataggacacagttaagtagagcaatatcaacaggtgattgaagaaagagcaagacaggatctcgtagagaaatgaaaagaagtcaacctatttttgcaggtaaatttgttgatctgtcatatgcttgaattcactttcactgtacagtacattttggatctatacagcttacgtgtttcctctacctcccttagagcagttagttttgtagacttctgtagttttgtagatttcacagttgtcactaaatttatctttcagaatgattctcactagagaatccttttacttataagaccaattggtaaaaagcaagatcattaggaagaaaagaaaatattgtggtttaaaactggtaccatcctcttgaattattctcaagtcgtcttgttcaggtttaaaattgtaagttgaccctcttattctttgaatta

SEQ ID NO: 34429 - DNA, 1870 bp, Bovine  19866880438718
gttaactgtgtacattagaaatggttttccctgtttacaggatgatctgacaccactgttacttgctatacatgaaagaagagggcaaatggtggaggttttagtgaagaaagaagcaaatatacatcgggttgataagatgaaaaggtaccgttgttcttttttttttaaaaacccttagtgctgttctaggatcatgaaaatatcaagattaaatgaataagaggattcatttgtgatcaacacatcatcacttaggtagaaagtcagttattctgactgggaatcaggaacaatatatagcaagaatgtatagcaggattcatattcctttataatattgactgatctcatatgcaacctgtttggttgatcttgtaatcgctgagggagttgaaattagttttattggtttaatgaaatatggagtctgctttttagtttacctcatgacagtattgagtttcttaattcttttaaaagaattctttaacctctactttatatgtatgtatttttaaaagatgcatagtaaacctaaaagacttgattttgtcttttggataactcttggctttaaattactttgtttaaagaatgctgatgttattaggtttcaaaagagtcatatataacatagcgactaaataacaacagccacaaaaaggtgattatgactcacggtcaccagatcctgtggactcatcaggttttatcctttctcattttagtacattttgatattttcatttttaatgcaggtagaaggaagaaagatagctttgattggataaaagctttaacaaagacaagtcagaggtggacaatacagatgaaaatgatgggctttagattcaaactaggttcaattcctaggtttcttaccaattagggttatttatcattagcaaataagtttcctaatatgaaaggcaaatagtaatgcatctttcaaaggtgcctgtgtgtaagaaagattttatatatagtatttcattttcagtgcctagcacatgcttgtccacatcatgaactgccaccatgactatttatattcccattattatcaatatttttgaatgaatcgtgcaagtagcctttcctagtcaacctctagctgactttgaagctgaatatatcagactaaggaggaaatggggaattcatcccttaaatattcacctgcctcagataagtgacctcagcatggtttcttgtccatcaaggactttattattatttttaaaaaacatttatttatttggctgcgtggggtcctagttgtgggaactcttagttgcagcctatgggatccatttccatgaccagggatggaacctgggccctctgcattgggagcctggagtcttaccccctggcccaccagggaagtccccatcagggacttatgaaataggaagtgctgctgcctggcatcccagtgggacaggaggcttcttttctgtcccttcattttagccttggaggtaatttacaaagatgaacacttgagcctgtaaatggtcagtccttcatgaaagggcaaggcgttcacttggtaaagcatatcaaattaactgtttaagtaagttaactcaacttcctaaggctgaagtcatctctctgttgttttagaacagccctcatgcttgctgtcaagtatgaatcagcaaatgttgtcagacttcttctgcagcaaggtgttgacatcttttctcaagatgtttttggatggactgcggaagaatatgctgttattagtgggtttgatatgtaagtgttcacattaaaataccagttctcactaaactgcagccaaaaataattttaactgttacttgctacgtgaccagtgagagttccagttttg

SEQ ID NO: 34430 - DNA, 2537 bp, Bovine  19866880453990
gaaactccctgctctgtagatgtaccttacttacatttccaagatttctctgattcaaaggcttagtatcaaatgatttttaaatattcttggtatgtgtgatgttggctttagcatcatgtgttcagagtgtttttgataagagagaaagtaatctgtccctagtatagagggtggttctttgtttacctgaagaaaaagaatatgatttgcttttctgaagactgttttttcccttgattttttcttacatgtaacttggtgtttttttaaaaatttttaatcccatcttgattaaaatgtgtctgtctaaatggatctactgattatttgcttttaaaaagctgtcctctatttatttaggggaaaaaaatgaagccagtaactgaattatatgtaacaataaaatttaaacctgtggatctggaattattctaaaaaattagccctctatctggtatcagaaaatggtggctttcctcttagtatataaggaaataagatgcagagtaagaatgtaagcagttgtgattcgtgacaagcagttggaggtaactagctcctagggataaccaattgtatcctattccaaagtcttattttatagtttgaaaagcactttgcacactgttcttgtatatacaagtaaagatgtaattacatgacatagtgttactgctttgtttaacaagaatctcatttaagattgacagctatggtatttttttaatgataatacttttctgtttctttactgtaaaattaagttaaaaataaaaggttaatgagaattgttatggtttttatttcttgttactgttagaagtgcgttgattatatactaaggcttaaataagaataaatagtagggattcagagaaagtaattgttcctctttcaaaataaagccatgctattacacatcattaaaaagaaacggggggtggtggttaactcatttagttgaaagtgttgttgatcatgtgaaaatcttttcaatttttattccaactcagtcgcttcccacagcctctcagtgcagccttcatcagccatcttaaatgcatacgattggtcttaggtagaaaatggtgtttttaatacaaatgtataacttgtaacttctctgctgctgctgctaagtcacttcagtcgtgtccgactctgtgcaaccccatagacggcagcccaccaggctcccccgtccctgggattctccaggcaagaacactggagtgggttgccatttcctcctccagtgcatgaaagtgaaggcgctgagttgtgtccgactcttagcgaccccatggactacagcctaccaggctcctctgtccatgggactttcaggcaagaggactggagtggggtgccattgccttctccgtaacttctccaggtagtgataaaagtgatgacagctgtttgtaatccttaagatatcagtgttctgttgcctgtaataggaacctaactgcagcagcttgagttgttttcctcatctacaaggagttaggaagtccagggctagtgatgtgctcctgcagtgccctcagggacacaggttccgtctgttgttctgtcctgtcatcattagggcgtgggtcttctctttgtgtttgccaaatgactgctgtacatctcggtccaatgtctacagtaccagcaggcaaagatccttatctaataaagaaacttgtaacttgcctggaagtctcacaggacatcccttcaccatcttcttggctagaactgggtctcatatctttgtctgagaataaaattgttctagtttatagagatactaattctataagtttgcccatacacaggaaaggccatgtcttttggcctttaatactgtcctaaattctcttcattttcttttctacttcttagtccttgttttctctccttgttttcaccctgatcttgtctttctctccattaatcctccttttcaatggaaccatgtttttcaagctgaaaaatgataagtgttctttcctttttcaaaagaaacaaacaacttttaaacttatccataatacaggtgaggtgtagccactgtcatttttcctgcccagcacaaattccccccgctgataaaacatcactctcctcttcctccctgcaattctgctccaccccaagccacagtaatgggcatgtccctcagatctggcccccgtctatctccttctcctcttgaccacagtgacaatcccagggagggctgtatgaccatcagtgaagcaataagagttattctccggatctatttcacagagcttggagagaaaggcttttccagaatcttacatagtttgagtcataacagtatgtagccctttcagactggcttctttcactttgcaatctacatttcctccatgtaatatcatagcttcatagctcatttttgtttttatggctgtgtttcaataaaattttatttacgaaacaagtaaggggccctatttgtcccatgggctgtagtttactgccttcgatttaggtaattcatctctttttag

SEQ ID NO: 34431 - DNA, 1477 bp, Bovine  19866880511174
cttatttagcctttgccattccttggcagtgtcgtgattttactgtttccttagtatctcctcagtcagtgctcagtggtgtctgattctttgtaaccccctggactgttgcccaccaggctcctctgtccatgggattctccaggcaagaataccagagtgggttgccatgccctcttccaggggatcttcccaacccagggatcaaacccaggtctcctgcattgcaggcagattctttaccatctgagccaccagggaagcccagtacctcttcaacttcagcctaaaccatagtaatttgttccccttctccaggatgtgatttccatgagaatctacagttatttaaaaatgaaaaccataaaacactcttcatctgcccccttcaggtaaagatgacatttcacaacaattgcaaaagtaactgctttctaaaatgcatgtgattaaaaatgtccccttcgtggtgtgattttattcctggaaatgactgtattgccaacagaaactcatcacattttaaaaacttggaaacagaattttcaaatctattttaaaacctctcaaaaagtttcagcaaattattaaagtcaattttttgaaaataaaaatgtaacactttacgacaaattgataagaactgacagatctcaaagaacacttataagcatgacttcagccaaaccatttatataatttgtggataggactgaaaacaggtagcaaatacagtcagaaattcacctcttctgcatgaacctagcttgtcttgaagtatctctgttaaagatggcattaaaaacaagtctctaattaacctgaacttgagtcccaatctttaaatcattattaaatctagatttttaaaaatatatataaagcaattcaaactatatagttttcactaaaaatagcctatttatcatatcaataattatttatccattaacagtgacattttgatgggaacaaaaagtatttttgtatcatcaagagataaaacaaaactatttcaaaatattgtttatatcatttttgccttttagaaaattttgtatgttttactatttacatgatatattagcataatgtccatatatatagtgtgtaaataattgactatatatcagatccacttgctcaaaatattttaatgatagggtgtataattaaaaagtgtaaggttcattaatctagatgaatttttctcaaaacctggtttgaaaagcatctgtgtcagtatcactctagaccctaagctcagaaaacctcacttgggcatgtatagttgagatctagaaactgcctttttaacaagcacccctacgaaaggtggttcatgggctatatatatatatatatatatataagggactgaaggaaataaaaaaagcctcctatggagaccacaagtgcctgtgtgtggcagccatgtgccataggcaatgaccatcatcagctgtctccttgctag

SEQ ID NO: 34432 - DNA, 728 bp, Bovine  19866880660493
tgtttccatagaaattgggaatgggaaatcttaggtttccattgcttggggatccagacagcatttgaccaaggagatagagaagtttagagatgacctaatgactccttgagtatcttggtccatacaaaaacactagagtaaaccaaatcttgacaacctacctgaagtcctggtgtgtagttctgatctccttgcagcttggtagtggctttgaccctcattccaggctgcttcaggaagtgtcaggagtctttttcagataccactatagtttttactggtctcataggtcaccctggagaatactgtgaaggcagaagacaaaagataattttttggttgggctattgtaggaagcaaatgcttggtgatcaagaattgataccagtcacatacaccaaaaccatttggtgtggctaagctggatagccctgagaaatatttttttgttttcatttttgttcattgctctttaatcagtgaaaacactattctggaacatcacttcaacagggacccagcctcttttcagagttctttggtgcattccagcagcaatttctgctgaaggtctgaacacttggcttctgagtcactaatcccaaaaacttgttgtcaattcattcagtctacaaagaacaaaatggcattaaatggcctctgaagaataagtacgtaaattaatttgttttgctgtaaaataaggctgccatacattcagattt

SEQ ID NO: 34433 - DNA, 1345 bp, Bovine  19866880719675
acggctgcccaccaggcttccccatccctgggattctccaggcaagaacaccagagtgggttgccattgccttctccaatgcatgaaagtgaaaagtgaaagtgaagtcgctcagtcgtgtccgactggtagcgaccccatggactgcagcctaccaggctcctctgccgtgggattttccaggcaagagtactggagtgggtgccatggccttctccgaggagaggcttgcacctacacaaagctcaagtacacccagtgcttcaatcactgggtttgcccaacctcttcatgcactaccagcagtgtgttcagaaagcaataaaggagaagaagattcctattgaaggactggagttcatgggccatggcaaagaaaagcctgaaagctcttcttgaccttgacagtcaccttgagagtggactcctcaaatcaagaaattgaggtctccggatcgtgtcaattaaaactgaagatagcattgatttgatgaattcaggagggaggagtttcctttcctccttgctatttttctctcattttaaaaagatgatgaaccatcactttgctttcagatttctggctttgacatctcagcaggaactccatgttctaaataatgggattatttgggattagggttgcaatacttggtctgggatcagtttttaaatatatcttgtaggaaaacatgcataagcttgtcaggatgactaaggttgcctgaccttgagtcattctttgaaggacattacatacactctaggggttatttgttcatggaagcaactggttaagatctcttttctctgaggaagctaattctccagaaagagtccccagcacaacagttccagtcaatgcttgggaacacagttttatttttatatagtcattttactatgattgctggtggactgggttagccaagaggaagatggctttcaacggttccctaccttaacaagtggtgtcagatttcctattaagacatgaaagcttcatgaatgctgctgctgctgccgctaagtcgcttcagtcgggtccgactgtgtgcgaccccatagatggcagcccaccaggctcccccgtccctgggattctccaggcaagaacaccggagtgggttgccatttccttctcctatgcatgaaagtgaaaagtgaaagtgaattcacttggtcatgtccaactcttagccaccccatggactgcagcctatcagactcctccatccatgggattctccaggcaagagtactggagtggggtgccattgccttctcccatgaatgttgcagtgaacaccatttcagaatgcaggtgtacttcaggaattaaaat

SEQ ID NO: 34434 - DNA, 1132 bp, Bovine  19866880919008
catggatggggtggggatggtttcaggatgagtcaaacacattagggttccagaccctgtgagaatctcatgccagcgctgatctaacaggagacagagctcaggtggtaattcgagtgatggggagcggctgcaaatacaaatgaagcttcacttgcttgcccaccacccacctcctgtgaggtgcccagttgggcaccgctggcttcactgcaccccctcctctggggtgaacccctatttttcctgcaatccttgagacctaggctgactccaagtccaacagctattgctccagccctcagatcaacctctcttcttgctaacttttgaagaaaagccatgacctgtgcattcacagaagaaaaacagaggcctgcctcatcctatgttggcttagaagcattgttcatgaagtctgcatgcatcttcctattttgcaaaaccatcacactcccaggcaaaccagccatcagtggttgtctttttaaaatttcaaattgttaagtattcttgttttcctgaaatgtcttgaaaaagttatttccacactgacactctgcttgccagcttttatttagaagcacatttttaatatattcgattctctgaaagagaaaaaggccaggagagtaaataaagcagaagctgaggttactacccatcagtcaatccctgagcccagattaagcccaagccaggaaaacacacgtttgaaggcagtggcaccagccagaccttctttcaaaagggacccttgttgcccttgagggtttagaactgaaaagaaaagcttttcaaagccatcagaaagtgaaaattaatctaagtgcatccatgtagcacaggagtgtcagaattcataattaggggtcataaatctttttgcaatggaacaaaaataaataagcacgcaagagcacagatcgaaaggcagcgggcgtccacacactcccagtgtcagctttaatttatttctctacttggaaaggggaaacattgaaacctggctgccagtctgaagggagcctcctcaaactcttcttctggcccagacaaaggtttgaatgttgtggggagacatgcaaagaataacacagggaagtgtttgactttttacattgaaaaagag

SEQ ID NO: 34435 - DNA, 3125 bp, Bovine  19866880962946
tggggtcctttccatgagtcgttctttgcatcaggtggccaaagcattggaacttcagtcttgctcagctctaaacgataaaaacatgagaatttcatgagagagtcctgcatctgattaaataccatttatatttacctttgccatcatgaaatttctaggattttttttggtgacttaaaaactatttcatatataatgtatttatatagcctgactttacaggtttagattaatgtttgtattcttgtttccctcctccccctctccctccatgtgtggcagcttctcctggacatggttgggtcacctgatgaggaactccaggaagctgctgcaggttgtatatccaacattcgcaggttggctcttgctattgagaaggcgagatacagctgaacctgaatgggcatgacagctaccaaattttacatgaccctgtatgtgtcactcccagagccgtgaagcctaaattgggaaacacttcatagcagatcctttagaaacaaatgtctgactgaaaaccaggaagttagaaatgtagagaatgtggttcactccaaaattgtatgggtatttttgttctaatttagggatatgccatgtggtgacacataaacccaatatattggtgataattttttcaggaatttgagaatatatatacatgtatacagctgtatatatgtatacagatatatatatatatatatatatatatgtacatatatatatatatatttcagcgatgcttttgtatttgtggtgattttaataaaagatgtggtcttcccgttgtgtgtatttatagtcatccatgagtgtctttagaaatccctttctgttaaaccagtctaactgtcccgtcactatagttttgtttgatctcttgcaaccctcaggagagctctgagatgtgctgacttgacaaatggttatggaacagaattcagagttcagcagctgggttgagagagaacatcctgaggtcattccaagtttctcctaaagctgtcaaacatctgaaaagacaacgtataactgtcactgtcccagataacacaaatcacaaaaacataagcactgagtgagattttcacttttgcatttcccaggcataaacagtgaaatgttttatttccctcacaggatacaccaacattttattgaaagaattaatttatgccgatgtacgcacacctcacaacacaaggataatattactttcacgtaaacttgcttggagtttctgaacttgttttcagcatacaaagtactttttaaaaagtggctacaaaggattaatagcattttatcaagttatagaaacatgagaagccacttaaaagaatcacagatgtaaccttggtgtgctacaatgtttgggaactgaccgtccccccatctagaactagctaggaaaacagcttcttgtatatccactcagtaaaccgacagtctcactctttaaagagcaggcaaggttttattgaaaaatatgaagtactgtgtatgtttgtcataatttggagaagactgtaaacttaattgaattaaatgtaaataatttgtatgaaatgaaaaccccatacaggattaaaattatcctgatgattctgagaattttaagattttgtaaaacaccaattcatctttattgcttttcaaaggaggttataaaagaggataatagaaacaaggaaatggtatcaatgctaacaaagaattgaatttaaataatagtggaaatcctcaaatgcacgtcggactctttgtgaccccatggactatagccggccaggctcctctgtccatggggattctccaggcaggaatactggagtgggttgccatgccctactccgggggaccttcctgacccgggaatcgaacctagatctcctgcatagcaggcagattttttatcatcaaagccactagggaagctctttaaataatagtgtaaatcctaaaattctcaacagtaggtattattaaagacactggttaggtgtgtttcactaatattaaaaacacatctagaaatcatggattatgacagttatagaaaatgaataaatatattattgttacattattattaaaggaagctttctccatcattttaagattgttcatattcttggaattagagggtcttaagagcttgcctgaagaatcccacgaacagaggagcctggagggctacagtccatagggtggcaaagagtcaggcttgactgaagtgacttagcatgcatggatgagaggggaaggaagcaatagaaaacaaacaatcaaacatctgcagcagcacaaagagaactggatgtagttgagaaggataagttcctttaccatgtgcaagtgtgggactttcatttctatgattattaaagacataaaatgagagcaacagtaccattttaaaggaaactgaacttgtgggaacagatacagtaagctaacatgaaaatcattttgggtatttctaagagttgtgtccttttaattggtaagcaccctggatgtagtggtcttcccacaggtggctcagtggtaaagaatcagcctgcctaagcaggagacacaggagatgtgggtttgatccctgggtcaggaagatccccctggaggagaaaacggcaacccactccaatattcttgcctggaaaattctatggacagaggagcctgacgggctacagtccacggggtcataaagactcagacaggactgagcatgcatgtaccagggatgtagtacctttaaacaaaagagaaactgaatttaaaggtcagttttggctgtgtgtgtatgtgtgtgtataacagtataacagaaaactctgaccttattagaaaaatgtcagaggcagtgagtgaaagtatccagagataacagaacaaacaagcccaggatcacaccatttctttgctgctccaagccaaaggaccatttcttggcactctccatggaagaacaccttgggttgttttttttttttttttggcctaggtttctggataagatttttgtgcgttattttctgctttaaagctggtgacattcattctgagttttcagtggcaagttcttttttaggttttattcttccccagga

SEQ ID NO: 34436 - DNA, 778 bp, Bovine  19866881022829
tgccctctttttatattcttttattaacaacacttctttcttagctgtaagtttctcttaattcatttctccactacactgtgaaaattttgaatacgaggattttgtcttcattttaatccccagtgtccatcattgtgaacaacatgtgcctaacatttactgaatgtacaagtggatggatatttgcaggaaagacaccttcacagtattgaaatctttatgtcaaagtacgcactaaacattttcaagtgttacctgagcaggcaaccatgagatcatatcatttccatcagtacatgtgaattcctgcactagcacaaataagacattttggaattcagtcaggcaataaacatgatcagtattcacagtggaggacttgtgtttagacaagcatgactaagagaagttagtggactgtcagctgtaccggtcaaaatgttttcaaaaatgagagaaaaagcagctttacaaaaatacagagatgattattttgttacaaaagccaatgagagtactgagttactattttaaaagatattacaaaattctttaacagcaataaagattttgaacagctatattaaatatataacaaaggtgtataataaaactataatattagttcattttatcttaaacagaagaaaatatacataaataataactactaactttgcaaattaaaccatggattcagaattgtagacattttaatgtgattattctcaagggataataacaggcacatgttctaataaagtaaacattaaaa

SEQ ID NO: 34437 - DNA, 1240 bp, Bovine  19866881025733
cccctcagatgtcaatccccacatctaggttgtcatctgtgcttctgcctattggctataaattggagattctcagaatccctccttaggtttaatttggtagagcagctcatagaactcaggaaaccaggttaggtactatcggcttattatgaaaggatataccctagaacagccagaaggaagagggaggtaggcaagggatacaggaaggggtacaggccctccacgtcctctctgaaaatgctacgctcctcacacctctgtgtgttcactaactaaaaactcctccaaactccaacctgttgggactttaatgggagtgtactcacataggcataatcaattattaactcctttccagcccctctcccctctctggagaacagagagtagacgtggaagttccaagattctaaccacagcttgatctttctggtgaccagtccccctccaggagcccactcagagccacctcattagaacaaaagacactgtgggacttccttggcggtccaatggataggactccatgtatccacagctgtgggcccaggttcaattcctcattgggaagctaagatcccataaggtacaagctgtgtagtcaacgggacaaggaaagaaaagaacagaagacactgccatcacccaggacattccaagggactcagaagccctgtgtcaggacctggtgtcaaagaccaaacagtagaacaaaagatactcccagtgctcttatcccctgggaaattacaagggttttaagagctctgtgccaagaactggaggcacagaccatacatgtattttctattatttcaacctttctaataaaaaatacaataatgtttgaagagaccaaggtaaactttttaacttactcctttaacatgttcaaaggtaacatttttcatctgtacaggatctacagcagaatcaagccctgttgttgtccggaagcggactaaagggacaaaaaaaaatgcttacatatttgatagattcataaaattttaactaccttatttttcagatgcaagaaagtccagaaaaattaaatgtctaagatgacaatgcgaggagtaggaattaggtcttctggattttgagacaatgttcaaggaatgaatgattctcattaaaatgacatctttgcctttccagttaaaactaagaattttcctcttctccttatatctaataataaaaatgtaaaccaaggttctcaagctccatt

SEQ ID NO: 34438 - DNA, 1118 bp, Bovine  19866881094370
agggacgcgctagccctaagcaaaagtcctttcattgtccatttgtactattccctacagtcagcaaacaatgtctacttggtgagtaaatgacatgtttttcttcattcaggaaccactaaacccagtgacttaagaattactgtctttgggttcagagtacctaggtttgaattccagctgttgaacttactagctttatgaccttggccaagttaccttaccagttctatttgttaaggttcttcagggaaaaagaacaatagggtgtctgtgtctgtgtgtataacgggggatttactttagggaattgtccttcatggttgtggcaatggcaagtccaaaatctctggggcaggctgacaggctgtagacccagagaaaatttgatgttgcagcacaagcgcaaaggcagtgaagaggcagaattccctcctctttggaggagaaagacaggatccctcaaacttttttctctccaggccttcagctgattggataaggctctcccacatgatggaggataatcagcttttacgcagagtctaatggttgagatgtttatctcatgtaaaaaataccttaacagcaacatttagattggtgtttgaccaaatatctgggtgtcatggcttagccaatttgatgcataaaatgaaccatcatgcctcagttttcccctctgcaaggtggggataacaatagtacctacctcaaaggttgttatgaagttccaataggttgatataaaccttgtagaacagtgtgtggcacatagtgctaaaaatatttcctaagtaaaggatgcataatagaaatactgtataaagtttgatgggtaataaggaaatgatattaggaagtggtggatttgggatctatgtacttagcaagttgcttgcttttcactgaacatgacagcttacactcttaattctaatgaggaatttgggtagggggcaggaagaggtgaggatggcaggtattttgacttccaagttctagaggttcatgaggaaataatcagatgttgtggaagaccattctgtgccccactcccagtcccacccactctccagcaaataaaaagaagaaaaattattccaaattaaaggaga

SEQ ID NO: 34439 - DNA, 1790 bp, Bovine  19866881203949
ctgtcatgctgaacttttaaagtgcaactcacttttggtctgtgacgctggaaaaaaaagcagctgaatcatcaacagataaatgttacaggttgttggataggtttttttcccttcctttttgggcaaaatcactcaggatgatttatctttactcattcaaaagctctcactacccttaaagagaggataaccacaaacatttcctctaaaagtgatgcagtaacagctgtctggcagttacttagcagttattccctcctggtgatgcaagggggatcatagaacagaggcccccggggccaaaggctggtccagtccctggcctgtggaggtgaagggcggggcaagtgagcaaagcttcttctgtatttacagccactccccatggtttggcattacctgagctctgcttccagtcagatcaggagtggcattagagtctcctaggaacgcaaaccctactgtgaattacacatgcgagggagctagatggttgttgttgttcagttcctcagtcatgtctgattctttgcaaccccatggactgcagcatgccaagcttccctgtccttcactgtctcctggagtttgcttaaactcatgtccattgagtcggtaatgctatccaaccagtgatgctatctgctccctcttctcttcctgtcctcaatccttcgccagcatcagagtctttttcaatgagttggctctttgaaaatcaggtggccaaagtattggagcttcagcttcagcatcagtccttccagtgaatagtcagcattgatttttttttagaatcgactgctttgatctctcgcagcccaagggactctcaagagtcttctccaacattgcagttcaaaagcatcaattctttggcactcagccttctttatggtccaactctcacatccatacataactactggaaaaaccatagctttgactagacggagctttgtcagcaaagtgattgcatgttccttatgagaatcatcctgaaaccatccccctcacacaccagtccgtggaaaaaattgttatccatgaaaccattccctggagccaaaaaggttggggaccactgttgctagggagtgtaactctaacttaaagtgcaaagatggggcttcctggtagctcaatgataaagaatcttcctgccaatgcaggaaacatggcaggagcttccacatgccttagggcaactgaacccccttcaccactcccaaggccatgtgccctagagcccgtgctttgccactagagaagccaccgcagcgaggagcgggagcacttctactggagagtagtcccccttgttgcaactggagtaaaccctatgcagcaatgaagacccagcccagccaataaataaatgaataaaattattcaagtgcaaggatgagctcaacagagctttaggtttcctattccgtgatttggatcattttttttaaatattacagattaaataataaggaaggagataagcctttttgaggtcttccctgtagctcaaatggtaaagagtttgcctgcaattcaggagacctgggtttgaaccctgggtcaggaagatcctctggagaaggaaatgtcaactcactccagtagtcttgcctagagaatcccatggacagaggagactggtggactacagtccatgggatggcaacaagtcagacatgactgagcaactaacgctacaccaagtgttgttgtttttttttttttggcgggggatatctttaggtctaaaatactaggaaaaagtacagaaaaga

SEQ ID NO: 34440 - DNA, 1697 bp, Bovine  19866881304911
tatggtgaataataaacagtaggtaaaactctatagatagtcctattaaaattgtttagttgcaaagtcgtgtccaactgtttgtgaccacatggactgtaggctgccacactcctctgtccatgggatttctcaagcaagaatactggagtgcattgccaattccttcttcaggggatctttccaacctagggatcaaacctgagtgtcctgcattggcaggcagattctttacccacttgaccaaccaggaaagccccctatcaaaatgaggaactagaaaaagtaacccacattattatcattattattttttttctgaaatgctactcagtgcattaagcacatataaaaagtatcatagatagaaggtgggagaatttttatagcaataaaagaccaaaactaacaaaagggaacatattcagtccagtttatcaacaaggagaacctgatctaaaggacaaggatacaagcttgctttggcacgaggacagtgggagtacagatacagagtcaggttgttctcagaattatctcagaactagagaggaagaacaaccagactcagtctcctggaaatggggttggcggggatgaagcaggaagcaggtccagccagctggctagatagccagaagacactaacaccctagcattgacagtaggaaaagcctgagccctcaggcctttcaggtcaaagagagtcaggttggggcctagtcctgccacgttctctgtgtgtcaatgactctggtgtactagaactgtagatacacctaacataagcatgctcaagtgaaagcaaagggcaagaggttttgatgtggtgctgggctggcagcctactcctaaatggacgctcctttgacaatataactggactgagaagttttcttctcgtgagacgagtttggacaatgtcctccatgtgtatcaaaaatgtgaattacatattataaactcaatctatttatgaaagacattctgttgaagtttgagcttttgacaaaggtggtcctcctcttactcaatagtgctagccctgtgaatagagagccagagattccaaactccaaaggtcaagggatccagtttcaggtaagagggaataagtatattctaccgtttccctcccactgaatgaagttataaaacttggaatgtatatttggagcagctatttgaggactctgaaaagtaaatagttcccaggtgctgcagtggtaaagaatccacctgtcggtgcaggagatgcaagagacccaggttcgatccctgggttgggaagatcccgtggagtaggaaatggcaacctgctccagtatgcatgcctagagaatcccatggacagaggaggagcctggcgggctgcagttcgagggtcacagagccggacacgactgagcacgtgacacacacggcatatggcttggggaagacctcaggtcaaagggccatgaagtaaatatgtcagctcttgcaccactgaggtaaaggtgagttccttctctggacttcatttcttccccttctccctggataggaagcaacagcaacagaaatggatccagaattggaaaccgtaacttggtattggtcaatcaaccctacagcttgggtctgacttgctatctggaatacagccatctgcccccacccctacacccctattacccaggtctctttgaactatt

SEQ ID NO: 34441 - DNA, 1127 bp, Bovine  19866881355735
tctgttctttgtctgggctttcttatctgtgacataatacggctgaactccatgcttcctgaagttaattcacagggtaacatttctaaatcttactgcctggcattttcaggacatggactctacccgtaccagatgtaggacacacacaatcctttgtcctgaagcaaacttgctcaaacactctttacatgcaaagctttgggggaattgaagtcaagacagaaaattttaccaagcttgccactccatctgaaagctgaggacaggtagaaattgattcattttttctgaactaaaagtaaagatttcaaagctatttatcagccctacttgtgcttttcagaaataaaagtaagatttccaaagcaatttaagccacttttccttcacaaacatctcgccacccatgctagtttatattctttttccatcaatataagcaatcaaagaatttaagagaaaagatagaatataaaatatttgcatggctaattatgatctgggacattcctccattataatttattcttaaagccaacatttatctcctctaagtaggtttattgctaagattgaagatcttcattgaggatgaaaacttccctgtagaccatcatctgctaacaagcgtatctgctaatgaagaacaaaatgaaaggtttcaaatcgaattatgggccacatgtgcaaatctgatgcgcaggctataaaaattctgtcttgacatctgtagaaagaaggccctctgctgcagccttcattctgtttaaacaaggttatcacgaaaagcacagacttacctgtgcggtagacaaagttgccttccgtttctgatgacgagggagataccaactcctcctcaaactcattggaactaaaagatcccgaatggtttctttgccttgtctttcccatcatggccgcatttgtgaccatgacgtgtctcaaagagtcgttaaggtaacgattcaacaagctgctcttgtatttggggggcgatacgtagtcctcactggctcgtgactctggccgtactccagcctttatgactgagctctcacttttaattacgggatggtgaactggattattatagcctccgtcattcatgtggtttcgtggga

SEQ ID NO: 34442 - DNA, 1338 bp, Bovine  19866881504937
tctgttctcttttataagggaattctcttgcactgttggtgggaatgtaaattgatacagccactgtggagaccagtatggaaattcctttaaaaactagaaataaaactacccatatgacgcagtgatcccactactggccatataccctgagaaaaccataattcaaaaagacatgtgttaccccagtgatccttgcagcaccatttacaatatttgtccttttgtgtctggtttatttcattcagcacagtgtcttcaaggtttttccctgctgtagcgagtgtcagaatgcccttctattttatgggtcaataatatttcactgtatgccctgcgatgttttgcttgcccatctgtccatgggtggtcacttgtgctgctcccatcatgaggctgttgtgaataacattgccatatgcatgagtgtacaaacgtctggtcaagtccttgtttccaattatcttgtgtgtacacccaagagtggaatagctggattgaataaaattatttttttcaagcctaactagtcaaatctataatgatttaaaaaagttggttcggggtatccttaccagcagaatcagtggacatgagatgcactccacagagtctctagcaggcactctgtttattaagcatcccaacagtcacacagtcactgactcatagacaaagaatcccctcatgttacctcagtcagttcagtatatttttaattctgaatgagccaagttctcccagtgtgtgattcagtgggtgcaaattaggcatttaagaagacatagtcacacttttggaaaaatagtaaggtcttaccactgtgccactaatagtatcaaaatggcctaaaaatgatcataactctcataaattccattgggtgatgtttaggttgtgctaaaaggcaaatgtgagttttctgcaactcctgtgaacaattcagcacttttagagagaaaaagaggctggaggcctttgaaaagtgagtgctggagttgtgagaactatgcgcagggtgggagctgccatgggaatttgctcagtttgcatcatgggtgtgatccaggccccatgaagatggtgtgcctggttccctgacggcttgcagatgcctctgtctgtgtctgtactgccgtcccttccgcgacagagagatgttggccccaagcaaatctcgcttgtatgttgtgcacatgtggggaggatgtcacagttagacccctgttttgctttgaagggaatgtgttgcctttttcagcgtcaatggttgttcctaatcttcatttgcaaggtataaagcagaagggatcaccttaagatcatcttctgtttaag

SEQ ID NO: 34443 - DNA, 893 bp, Bovine  19866881746564
actgaaattgaagaaagagggaaaaccctaggccattcaggtatgacctaaatcaaatccttagttctatcaacttttgctttatatcttttgtaactattaggtacaaccaaggtttaaattattatgtcttcttgataaattgactctttatggattttcctctgtctcttttaacatctcttgccttaaatcttatcatttgctattaatacaactatatcagctaccttttggttagtgtttatatggaatatcatttttctcttcctatttttctatcttcctgtgtcctcataaataaagtaagtctcttgtaaatggtcttctgtttaaaacgtgtctcttgtaaacagcatagtgtccatttctttttagaaaaccaaattgacaattggttttagaaagaaaatcgctggtaattcccagaagaccttaaacctggaattccaattcatctagttctgtttccacaactctcctatgtctttggtatgtaattttggaaattttcaggacttttctagataatatagtgagaacattgagtgactatgacctaccgtattctgccataaagtgcaagtctcttgagtccttgtcatttaatggcacatttaactactcacatagctattttatttgctttaacttcttgtatttcctttaatgctttgtggctatttttcattttactttttgatagatttatcttttcaactctaatactgtagacactatgtatacagatatcacatggcttcttgagatttcaaaacaaaaccactgacccttgctaccacattcaatgagaaatctaccatcctttccatgatctgggcaaatttatagggacttgtattttcatggcaaatttgcttcgattgtctgtg

SEQ ID NO: 34444 - DNA, 290 bp, Bovine  19866881790157
gcgaagccaggctgtggcagcctagattcttaccaccacccccacactgccttcccaggcatctgacttaagtggtgcagacagaagcgcctgggcagcttgcttttattctctgtgtttatttgcctgatgttatgcctttgagctggatgagttttaaagcagaccatggctgttgccactgtttgttaaacatcgctacttggagtgagcagagagtacagacagcagtttgagttcttggtcatcttgaacaggatcaagcaggacaaacagaggggaaagcaatt

SEQ ID NO: 34445 - DNA, 733 bp, Bovine  19866882078375
tcccttctagcataactcaaatgaactgtgtaatcaacctgatgcaaagaaagaggaaggaagaaatgatcattttagtgtccgccctgaagacagtgggtttgcagaagagtctctcatttgacttgtctaatagggatgataataaacttaactaaggaggatgaatataatgattttagcttccacttacattataaaaataatatattcttgttatattttaaattgatttcttctcatgggtatttaaaaatccacaaatatttttacagatcatctgctacaataaagagcgattctgcacatggttgcattaaggaaaacccatcttagtttcctttgacttcatcctaggatcacaaatgttggcactcataaccgaacaaaggatagacttccttaagcatgtttcatgataatagctttcattttattttggttggctagatgtatattgcctctccaagacctcaattatataacctgggatttccacattgtttttgacagaaaagtagaacaaaaataagttatgcagactaaatttgaaacacatgatatggaattgaaaggacttagtgatgaaaaagttgtctgagttagtggtaatcaaatcttgaaatagacttcttcttaaataagcaaacagttctaagtatttggctatgcatcactgtttgttcaagcttgaaaagattatattgctccatctctcagctatagtatattt

SEQ ID NO: 34446 - DNA, 1111 bp, Bovine  19866882121148
tgcttttcaatatgctattaaaagtattttatttaggtggttagtattttggagattcaaagagctaacagaagttaaggggtattttccatttgatgctagtacagaaaaattgaaaaacagatttcccagactttaacatgcaggcaaattcacatgaggggtcttattaaaatcctttccaatacaaggtagtccaggctctatgctactaacaagctcctagatggtgctgatcctccaagaactacattttgaacatcaagattgtaaagaatgtacctacagcctaattagcctttctcttctcaacctagaaaaacaaatagcacccagtgagatgatatcattatcgagataggtggggacatgggtagggatgagaaaaaaaaaaacctttatgctattattggtatagcaaaatacttgaatttctaattaaaactattcataagctcagagaaggcaatggcaccccactccagtactcttgcctggaaaatcccatggatggaggagcctggtgggctgcagtccatggggtcactaagactcggacacgactgagtgacttcactttcacttttcactttcatgcattggagaaggaaatggcaacccactccagtgttcttgcctggagaatcccagggacaggagcctgatgggctgccgtctatgggatcgcacagaatcggacacgactgaagtgacttagcagcagcagcagcataattagtttaataagtccactgataaactcatgaacaaaacttgtaaaattaagaaagctatttctgtagcacagtgactagaatgtggctataaatctgaatgctatatataatggcagctgtaattgcttgatgttttattaatagtttgaatttttaatgcacactttgcagctagagttacacttattttacttccctttaatgaaatttatttttctctattttgtatcaggaaaataccaaataactttctacagagaaacttcatatacagaaatttggtattacaaataccataaaccaattaaaattttatattttatacccaaagttcacatttagatattttgagccatgtctcaatagccttattt

SEQ ID NO: 34447 - DNA, 817 bp, Bovine  19866882218915
ctacgtgtctaggctgtgatctattgcttgcataactagagataggtttttatttaaaaatagaatttggcaaatgaatagtccataacccgaaccaagtgcatctggaatgctttaataaaaataaatggccaggctatttcactttgaaaagcatcgcctgtacaggatgttagtccctctctgattttaaattttgtcactttttaaaagagcttgcattttcagaagacccacacacgctgggggaatttcacaggcacatgaccttatttttactgggcaacataaatttatgagaaaaagaaaaaaaatttttaaagaacagatctcaattaccccacctcattcaactgtaatttttattgtttttatctttcttgtcttgtccatacacacttgtcatattcagggcatcctcaattaaaaattttccacttaacaatagatgattatcaatatttcccacattgtttcatagtcagtagcagtaccacaaataaaaattttgactttatgctgtcttcatctggtttgaggttaggaaaacatttacatttttaaaaattgagatacttcccatgtttttatatgttccagaaacatatacaaagcataggaattaattatttctttaaagtttgaaaaagaaatccaatggctttatcaagcatttgggaactgagtttactaaaaaccataatttttcctgcattagcagtcatttaaaagttttcttactatgaaataacaatttgtgtggataatagcaattcacttcatccatacatttgcatacacctatactgtcaagcgg

SEQ ID NO: 34448 - DNA, 1269 bp, Bovine  19866880130197
aatggtatggacctaccagaagcagtagatattaagaagaggtggcaagaatacacataagaactgtacaaaaaagatcttcatgacccagataatcatgatggtgtgatcactcacctagagccagacatcctggaatgtgaagataagtgggccttagaaagcatcactacgaacaaagctggtggaggtgatggaattccagttgagctattccaaatcctgaaagatgatgctgtgaaagtgctgcactccatatgccagcaaatttggaaaactcagtagtggccacaggactggaaaaggtcagttatcattccaatcccaaagaaaggcaatgccaaagaatgctcaaactactgcacagttgcactcatctcacatgctagtaaagtaatgctcaaaattctccaagccaggcttcagcaatatgtgaaccatgaacttcctgatgttcaagctggttttagaaaaggcagaggaaccagagatcaaattgccaacatccactggatcatggaaaaagcaagagagttccagaaaaacacctatttctgctttattgactatgccaaagcctttcactgtgtggatcacaataaactgtggaaaattcttcaagatatttattagaaatatttattaagaacattgttgtcattacattatctcacttaatccctgaaataatcctactagggaaatataattatagctacttattttagagatgttttatgtaccttacaacctcactttctcaactcctccaacatttcactgagtttgggacaaattagaatttatattcccattttactgttggaaaaaaaaaacaataatttagacaaaatcacagagtatgttgttgagaatagcaaacattcattctttagaatgaatatatggaatgacacagtgtacattaggtggaacacaacagtcagtggtaatatttttgaaagtcattgtcaaatagagacaaatgccagattgcgataaaagtgattttaaggcgagaaagggaagagcaaatgaaaaggtaaagggatttttcctgaagtttatcacgaaagtgagaagaattttgagcagaaacttggcaggaagtagcattcaaagattttctttctcagcacaactattatgagccttcccctcacactgtttaagcccacacatttccctcttggtagatcactcactttcgatgaaggaactctttaagttcctgcaactccccctcgcccatcatctcaggacaagcag

SEQ ID NO: 34449 - DNA, 840 bp, Bovine  19866880245231
tggaatttactctgcgtttaaatgttcttttgatgaatttgtgggggagaaagtgttctccctgtcctactcctccgccatcttagctcctcctcccctgcaagtggtttctttaccagctgagttaccagggaagttacccaatctgttttttactccttaccaattaagaatagtttttacattttatttatttattattggccacaccatgctgctgagtgtgttctactgaacctttgtcccctgacatggaagggtggagttgtaaccactggaccaccagggaagtcctggtttttacattttttaagttgtttaaaattaaaaaaagaatatgtgacagaaactacatgtggcccacaaaacctgaaatgtttactatctgaccagttacagaaaaagtttgccaacccctgctctaaagcacagggcccagggtagaggttcttcttgtccagatccagaacagtagcctccactctttctttcccacatcacttccaagtgtctgagagtgagcacaaacccagagtcgtagctgtggtattttagctccatctgctggtccagggcttttcaccagtgctgtaaacatgggaaagtttttgcaagtttcaacttcctttcactgatcaatgggttggtttaattcactgagctagcctattggatggagaaggcaatggcaccccactccagtactcttgcctggaaaatcccatggacagaggagcctggtaggctgtagtccatggggtcgccaagagtcggacacgactgagcaacttcactttcacttttcactttcatgcatggagaaggaaatagcaacccact

SEQ ID NO: 34450 - DNA, 1693 bp, Bovine  19866880371024
cctgcacaacttcctgagtgtcctgtttcagtgcatgcatatcctatcagtggccggggggctggcagcccagcctgaggccaaccgaccacgagatcagcggctgctgcccttaatgcagtcatttcttctaccaaacgcccaaagatcatcatgttgtcacgtgatggggctgggcagactgtggttattttgatctgggagggtgggagttgtaattcttagttctgctgctgaatagttgacatgggtgggtggggagactgtcctcgcagtagggggataggagccctcaagtagggcggggcctctcccagcaagcacagcgaaaccgaccggcctccagagcaccctctgcgcatgctccatgcccccgccccaggatttcactgggctttgttggggttaggtagggggtgaaaacacttctagggctggaacatcgtttctgtgttagtgcctgggtcactgtcttcacagggacctcagggtccctcaacttgtcagaggacagggcagctttaagaatatgtggagagatttaggagagagaaaggacataaataatttccaagcctaccttatgtacccttttgttgtggaaagctggggacatcctcgctcacttgtgctctctggcaggaactccccaggaggagaagggggtctggtttaaatggggctgcctggtgagtcactgataagctgggcgttgtggaggcccacccatcattgccttttggtctctgggaagaccatcttctggtggaggtaggaagggagtatctccttttgtgctggggtgagtgtgaattacccacgttggccctttttctccccctgctgccactcttcatcctgagggctttcagacaaaacttgcagggggcccagcccagaggtggtcagggcttgaccccgtgggccctccagggaagctcgctgcctgactgaggccctgccagcatagtgctcttctggactgaagctgtatgaggtggttgggaaagactgacactgtgacctcatatgtggatcctcctaggtggctcctagtctgcagaaagcttgcttctcagcctgaacctttgccagggagaggctcaccctgaggaggggaaaggcgagcagccagtccttccatgcagctggtagagcagctggccatgtgcccacagatccactgggctggcttttcgctgaatgttgctaaagcttagactgagtgtgaagccctcaagataaactctttactgctggcatttgggagaaagcatcaggtctggatgtatgtcctctgtgggctagccaggcaggttgtcaggtgtccatgagtctgtctgaacgaagtcaggccagacccagggtcaagggagagactggtcataaagctgtgagaagcccacagcacattcaagggtgttgctgcagtgtctagagtgtttggaatggcttttaatcgttttgcaggcaggctttttcttttaaaacatgtttattgaattgtgttattgcagagtttgtgatagaatatatattttaattggcattttttccccagctttgttggaatataattgacaatgagacattgtgtatatatatgtatataaggtgtaaaacttgaggatttggtgtatgtatgcattgtgtcatgaccaccgcagtcaagttgattaaaaggcaggcttat

SEQ ID NO: 34451 - DNA, 1960 bp, Bovine  19866880392949
actgaacactggggcctttgagggctaagcttgcccgtgttagtagtggaacaagtacaagcggaaccatgagcttcatccattcatctctatttggtcgctaataactatggtgacatggctgcaaagcaaggaatgtgaaggtattcagaggtttgctggctgcaagggccaaaaaagaattcctttatacccatacaaaaaaacacacatcaagctaacgtcatcgagctctctccacagagagatgaggaatcagttaagtccatgccctgtgaccctatgaccaaagctactctttgcttaagtaagggctttttctggtggggggcggaaatgccaaggccacactagcccatgaagtgtgcttcactcattcaacacatctttacatctttaatgtttactctgtgccaagccctgggagtaccaagtatgaaataaaaccccagtgttcggataaatgccagcactggtggggttggtaggaggccctggggagccccgtgaggtcagaggttggacctggggaggtgggcgtgctgtgaggctaccccccaccccaaacccctccctgccttccaggctgctgctctgcttcatgtgctgcaccacgctgctgtccatgtggctctccaacacatctaccactgccatggtcatgcccatcgtggaggccgtgctgcaggagctggtcagtgccgaggaggagcagctcgtggctggcaactccagcgccgaagaggccgagcccatcagtacagtttgctggagttcatctcccccttgctcctccacccctcctccagtgacaccgcccagctcggcacccactccctccaccccccctcacctgcttccctcccctcgtcttctgatgtccccctcacctgccctttatcccctaacctccagccctgctcatccagaggctccctgtgactcccattcccagctgttccttcttgccccgcttccagcaccctctgctgctccctgccccctgatgctccaggattagcccaggaccccaggcttttgtctgtgtccctgagtctcaccacatcctcagaggggagggaaggggagttgccaggcaccaggcccagtgggagcctgcatgctcctgggtccccctagtccagccccagcccggagtccctgcccttcagggtcaagtccggactccatgtctcactttctgctttcctttgctgctgtagatctcgatgtaaacaacagccaacctcccctggaactcatcttcgtcaatgaagagtgagtatgactgccctcctcccagacagagccccgccaggtccatcccagaggtcaggaaagagcctggggaacagccctttcagctgggtgggccacactcacagcttagcacaccaccagccccgcccgccctgatttcctctctgcccaagatcctgagggcaactcccttcaaaacggtactgcagggctcagagaagagggggagagactatgctgaacctgatgggacatacagactgtacatacatctcccaagtagaatttcatctaaattgatgtccctcttgggagaatgatattttttaaatctatcaatgaagaaagtcttgcatattagatatcgatggagactcttagagaaccacaaagtattttataggtattagatatggtcttgctaggtttggtcttgttacatacggcaaggaaaaattaagtggcatgtaggggataacaggacagttggtgagagcaccacgtgatgatgaaaacaagctcttttagaaaaggagaaatctggtctcactcatgtgaggcagattcatgaacagctgatttcttctggacatctgatatcaatatatggtcttcaaggaagactgtgatgaatagggcattttaaaagttggatttgtactagagctccgttgtgcaatttgctcttttcataaaaaaa

SEQ ID NO: 34452 - DNA, 4482 bp, Bovine  19866880441628
cttgggctccaaaatcactgcagatggtggctgcagccatgaaattaaaagatgcttgctccttggaagaaaatctatgaccaacctagacagcatattaaaaagcagagacagaacttcaccaacaaaggtctgtctagtcaaagctatggtttttccagtagtcacgtatggatgtgagatttggactaaagaaagctgagcgctgaagaattgatgcttttgaactgtggtgttggagaagactcttgagagtcccttggacggcaaggagatccaaccagtcaatcttaaaagaaatcagtcctgaatcttcactggaaggactgatactgaagctgaaactccaatattttggccagctgatgggaagaaccgactcattggaaaagaccccaatgttgggaaagattgaaggcaggaggagaaggcgatgacagtggatgagatgtgtggatggcatcacctactcaatggacatcacagactcgatggacatgagtttgagtaaactcttggagttggtgatggacagggaggcctggcgtgctgcagtccatggggtcacaaagattcggacacaactgagcaactggactgaactgaactgtagtccacggggtcacaatgggtaggatacaactgagcaactgaacaactcgatttgcagcctgctcatgtacctttcttcccccctccttccttctactccaaacagccttaatttagaaattatacatcaaaaaaatttttgtcccatttattgagtataattttctgttctgcatgatatttgcttcctttagcaggaaaaatagttgctgccttttacttatgtagcccattcctgttatatttctgtgtgggtcagtggtcatcacatggaaaaacattcctttcacttgcactaagggtttggaaactttgggaaaatacccaagcgttcatggtgtcaattgctccagggctgggtgctggctgtgctgttgctcacacgtctttagctcccactgtgggcccaaggtcatgcagatacagaggtggataggtctgagggtgcgatcagaaaatgcagcgaggggaaatgaatagcgggctctgtattctccaaagctgacttcacttgttctgggaaacaccacacctctgcactgaagcagacaggaaagcaacatcgtaataatattcttttctaagccttcttagaaagcaccatcttgaagagttcgtgctgaacttatggggctttcctgtggaaaatgggagcccagaagagattttaagtaggaactaatttaattgggttctagaaagatccttgggcagccaggtggcagctagatgagagatgggcaagatcctgggaagagatagttagggatgctgccatgttcaggtgagagatgattgatcaagctgtggtcctgcttggagaaaagaggacaggagggccacaggcacacagagaagacagaatccactgtgaggggtgcaggtcagagacaataaggatgccctgggtgaatctacaggacaaggtttacaatgaggagaggtaagacgggggcatgggctgaacatcacagaggccatgctgagtgagaggcacccttgggacacacaggcacaggtgaccgcagccaagaaggtcagaacagtagcagaataatggctcctcagagatgtccacatcctgatcccaaactcacatggcaaaggggacttaaggattttgagatggagagagtatcctgaattacccaggtggcccaatctaattacacatacccacataagcagatagtctttcccaggtgtagtcaaagggagacatgacaagggaagaaaggtcagagagatgcaatgttgctggctttaagatgggggaaagaggccatagccaaggatgtggggagcctctagatgatggaaaaagcaaggcgatggattctcccctggagcctccaggcaggaacgtagccccgctaataactttactgtagtcctgtgagacctgtgttggagttctgacctccagataggtaagataatacatttgggttattgaaagccattatgtttgtggtaatttgttgcagcgacaataagagactaagacatggatgacagatccaggtacttagcctgcatacccaccacccacccctgccacacacacatacccgtggaccactgtcttcagccttaccctggtgatgcccagtgcgcccacattctcgctgtaggaggtggtgccattccctgtcccccaggcccctgccagcaggcagcccaggccctcgatgccgatgcctcggttgatggcatgctttggagggggtggtgccccaaccaggcgggcacaggcatgataatcgcctattgactccaccattgaggagattaccgctgcgatgatcccaaagaccccagccgggctgacggtggggaggccccactgtcctgaaaatgcaatgcagagggaatattaacccagaagacaacaggttactggaccccaaataatttctttccgagaggattctccggaaggctttaaaagatgggcaacacgtcttccagccccacaactgtcctgagactttgtcttgaacccctgcctcacccgtgcctccctgggggtgggtcccatgccctgaccttgaagtcacagtgcgcacaaagaaccagcaacccggccttttcccaggaaggccctgaagcattctgaagtccagatacttactcagggaggccgtagctccctagcccccgacgccacccctgcccatcaccactgaaacgtgcttattcacacaacctgagccaagaactgcagggaaaggagaccagaagaggcctaagggatggccttgacctccaacccagaaatgttctcattcagtcccgagcctcccttgtgtgggacccaccgagtccaggaggagccccagatgctggctagaggtcggggttcctctgtgcttttccccatcacaggctgttgtcagatcccttggacaagattctccccccaccccctggctctattcaccacccgctctggtgccctgagccccatggacagacctaggaagcgtgtgtcccaggcaacaagggcccagtctgctcattacctgggtaagggaagcgaaaccacggagcctggctcaggacgctgcctttggtgtcagtgcgggccaggtacccataggctgtgggtgctgaagggagggcgtcagtgactgtgagcacaaagcagagcagccacgagatgcagagccccagcagtacctgcggaagggaggtgcccttcacacctggtcccactccctgcccctgtccacacctcccagcaaggttgggcaaaagagagaattcaggaaagctcttcaaaatgaggaagtgttggattaggaaccctcccagtgacaacagaaatctgtgtgtcaggggataagtaacacagtaaaggaacacagacagtaaaccaaagggagaccttatgccaggtaaaggccgaaatgtccaggaaagtagacaaggcctgggtcagaaggactgcaagctgactccctttctactgttttctggtcacataacttgcttcaaactccttgagcctgagtttgctcatctgtacaatggaatttcagccattgctctgcagagcctgaagcaggatttcttaaagtggggtcctcagatgtattggtttataatctctggtggtagaactccagacatctgtatttttagcaatgttcccaagtgaatcttatgcacactgaacttctgaaccactggcctacagggttgtggaaggatcaatgagatcattacatggaagtatcatttttataatgcagaatgtaggtcataggtgaaccaaacctgaaaacacctttatggggttggcaactgcgcctgcttgacagattggaacaaattcaacagagaaggctctgaaaaaggaggcaccatctgaatcatccaggaaccaacgagaaagaacctaagcatcttggcccttcgttttgcacccatagtggtgattctggctacctcccccagggccatgctctgaggacatcccgggaaacatgaggaagctgtcccacactgctgaccactgtggcaacctggggcaagctctctgctcccgcaggagagaagcattgagggaggagctgtagggcattaagccaatgctcccaccacccatgggcagggtggggaggagcagttaggggaggccgaggaggaaaggccactgcaggtagagagcatttgacttgaggcccatcagggtgagcaagaggctgcccctcactctccaagtgagtcagctaagaatggcagtgggtggggagtgcttcttacagggaagatctgaaacaggtagaacttagaggtgtgagacttcttctctcgtccataaacgggcacgggcactgcgatgtttttcaggtactgagaaaa

SEQ ID NO: 34453 - DNA, 901 bp, Bovine  19866880545840
ttttttaaaacgcaatttgctgtttacccagtctatctacttgtggtgacatgtatttgagacaatctgcttcacattcttcaaagattgttaaaaaaactttttggtatcaaattgaagtacagattaaaggtaagaaggccaatcaacctgaaaaaaccagaacgtaaaatctcaaaagatctacttaattcatcccacaaagatctgcttaatggaggtagctggaaatataccaactccagctttggacttctgaatgtaacccaaatcacgcagatttctagcaacctcatcctcatcattggtcagtggtgtgactctccctcttaggtcctccctagaacagttggtcacgaaagacatctctgtgggtttcctgcatcggtgtttccgatctctttcctctttcccatcgtagcacgcacacgtgctgctacttggatggcaccctgcctgctggtcctgccaggtctccccaagaccaccaccatctcagcacgacacagcctatgtgctcctttgctgcacgagaggcttctcagttgggaaggtgtggcccacacaatgcaacagcacaaagaagcatcttctactgaaagccactggaagaggaactcttgaagatgggctggtcatcacacatggcaacgcctgacaataagattaattttttttctagtttcttcttttaacccgtcttccctattgttgaagatgtaaaaacccatggatacacccgatgactgttaccacaaaatatttcaaattcacatgcaacaaaatggaaaaacaaaaacaagaacaacccaagggtcatcatcaagttttctgttttatttaagattttagttttaattctgaagaaagaggtacatttcctttttttttttagttttag

SEQ ID NO: 34454 - DNA, 1881 bp, Bovine  19866880691157
ttgctattctttggaactctgtattcaaatgggtgtatctttccttttctcctttgcctttccccgtcttttcctttctcagctacttgtaaggcctcctcggacaaccattttgcctttttgcatttctttttcttggggatggtcttgatcactgcctcctgtacaatgtcatgaacctgtgtccatagttcttcactctgtctatgagatctaatccctcgaatctatttgtcacttccagtgtataatcgtaaggatttgatttaggtcatatctcaatggtctagtggttttcctactttcttcaatttaaaatttggcaataaggagttcatgatctgagccacagtcagctcctggtcttgtttttgctgagtgtatagagcttctccacctttggctgcaaagaatataatcaatctgatttcagtgttgaccatctggtgaagtccatgagtagagttttcccttgcattgttggaagaaagtgtttgctatgaccagtatgctctctcggcaaaactctgttacccttgacctgcttcattttgatgttaattaaatggctcttaatgttagtgttaaagtaatagctagctatggtgtaaaaaaagtttttcctaaattttccgtatgcaaacataagttttactaatttagattgaaggacagtccgaattagcagagtacttctttgtatacacattgtatcaaacacatcagattgcttttgatattactaacttataaattatagaagatgatatggaagacggattggccactaaagcaaattcttaataagtctggcttattttctaggttgctgttctctggttttagtaaactaatttttttaaaaaggacatgacttggttaaataagcaggagtgctctaagtgtagaaatgttcctaaaactctaaagtgcagtaagactcctaaaactcacttaaggcaggcaactgtaattttaaacgttttttttttttaagtgtgtatatttgtgcatatgtttaaaatctcagaagtataaatgccaaattgactagaagagttaactaagtgatatggatgggcaaagggcagtggggttcaattaaaagggagttttgctctatttgtacagcttgaattttcctaaaacttcattacttgtgtgactatagttaaattttttaagaacaatgcttttaagaaaaatatactcaaagaaagtcatattagtacaacacaatgatcactagttggagcagggttacatgctatatttaaagtgtctaaaaaaaagagtaaacaagaaataaactcacattttaaaaaacttatagactagatatttaggtcaaattcttactcctccataaaatacatttccatttctaggactgagtatttttagcagtgttcactttatatttcaccatctgcgaattttccagggaactgaagtgcatcactttaaagcagcaaatcctatgttcctactatgtgtcagatatagtgttaggcactgaagatggtgagttggtgatcataatgaagttactgctgttgttgttggggggcggggagaaaaattaaggactaatgaatttattatacactcaatgacctttactctatttagacaggcaaatttcaggttcttccagatttaaaaataagtcagctatgttctaaacatagctgtgcaaactactgtgcaattctgtctactccatgctgttgcaactttccccatcatcactatgagccaaccttttttcattaacagtctatgatgtaaagaggtaaaatttacagaaaacttgaatgtcttgaggaaaatatagggtagaatgataaggatagtcaagagcaaagagaaaatataaat

SEQ ID NO: 34455 - DNA, 2027 bp, Bovine  19866880719782
tgcagtcatcaaattcttattttcagcactgtgaagtcaaaatgaattcactttgggatctttaacacatctgaagaagataagtgctttgatattttgataggaaatagagagctgagatttcaaaatatttttgtatggtttattgcagcttcctaattttatgggttttttgttgggagggggagatagtttgaaatactttctgctgggttcagtagttgaattcttcaattaatagattatttctaaaggagggtttttgaatgtgaattacttaaggtaaacttgttataaaatttgtttatataaagttctgtagacaaaccttttatgagggataagactataaccacatggcaaagtgcagaaaaattgttttgtaatgcccttcaacttcagtctgaatggagcactagtgataacttgcagtttattactttgtaaaagaaagagagcattgcttaaggatgagcatcttgcattaggggaggtttatttttaagatgatgttttatatatatatattaagttaatgaaaaaataccttctcagtttaagcactatgattttagaaatcttccctttctctccttcactactcctgtcttaaggttaagccacactgttgatgaaaacatttttttttctttttggtgcctgcaaatagcacttgattgaatctgtttcaactcagtgttactatttttatataccattcaagtgaagtagaaagttttaatttgtaaaaacttaaacatttgctgaaaattcagttagttttttgtcattagatatactactgtcttctgactttttgtgaaggaagttacattcatctcagctggttctaaagaaaaacagtagggaaataggttatagagatttttggtgctctagaaatagtataactagaaatgtactacatacttttctcaaaggatttcttaatctaagtgaaacttgtaaatggttttcatcccactggagtagcatgtattggataaaatttgttaacacattttgagattaaaaaaaatctgtgtttaactcagatattaggaaaaatgtgcaaatggcccattctttgtggtaatacccatgatattttaaaaagtaatgttttttctcaaaagtcaagagtatacaaatgataaagatgggcattatttactcagtgatgtgatgaaaaaagataagtgggacctttaatcctatatttagtggttttatgaaaatgtttttgatatttatgtggtcttctttattagaaaagattgtgtggtaaatgtcaactttttcaggtgtaataatattaattcaataggttttgtctcatttctttttcatagcatgattcttgtatttttttaatgagaaagtagtttatagaagagaaaatttcaacactcttttggccccttagattagctttcctatctagcagtttttcttttactggaagagggaaattacatgctactaaaaagaagatcattacctttacttgctaggaaaatgaaactttaaagatagggcaagtacaaggcaatttaaatatgtttatttttcttctaagaagtttatttgtgagtatggtttcattctttctaaactctgtttatataagaaagttgtcttgttttaagctttaattgtattgggtgatggacagatgatgtattgctattaggataaagcttgctgtttatttgttgtgtagttgctcaatcgtgtcagactttgcaacccatggactgcagcacaccaggcttccctgtccttcaccatctcctggagtttccttaaactcatgtccattgagtcagtgacgccatccagccatctcatcctctgtcccgcccctctcctcctgccctcaatctttcccagcatcagggtatatgagatatctgttcacagtcactgggtttttagttatggtatctaaaacctaccctcttgaatatttagagaaattgtggagaaggggaaatcaaaataatcagattagtgtgtatatatgc

SEQ ID NO: 34456 - DNA, 1475 bp, Bovine  19866880738037
cagcaacaaagacccagcacagtcaaatctaaataaataaatattaagaaaaaaaaccatgttattatctcagcccatgagcaaggtcaagggcaaaacaccagcagtctgcacctccttccttcctgttctccactcccccatcctgagaggacaactcctcagcacttttctgcctgccacatctactgcctggaggtagatacacacatatcctcctgatctaatctgcaacagttaactttatttagtttagttagcacttagcgaagcaacagttatgaggcagatcaggccctatgctggtgttatatttaaaagcaacaatgtgtttcagcaataggaaaaaaaattacgcaaaatataatcacccctctacaggggaaaaagacacacaataccctctcttgttttgggccaagggcatgactaagccagtcaatgttaacaaatattgaggtatttggaaatgattactgggcaaccataaagtcttttaacagaaatagttggaaactcaaggactttggggcagaataaactggacaagagagaaactggcatcttctggctccttttgatagcaatgagataaagtcaaccaacgttacagcaaatgaactcagttaattcccaccccaggctttcctggtgactcagacagtaaggaatctgcctgcaatgcaggagactcgggttggatccttaggtcaggaagatcccctggagaagggaatggctacccactccagtattcttgcctggagaattccagtccatgggatggcaaagagtcagacacaactgagcaactaactggggcttcccaagtggcacttagtggtaaagaagctgcctgccaatacaagagacacaagagacatgggttccatccctgggtcaggaagatgccctggaggagggcatggcaacccactccagtattcttgcctggagaaccccatggacagaggagtctggcgagctgcagtcatgagaccacaaagagttggacacaactgagtatataatccccaccccactcccatagagactgaagatttctaatctagagctttttaaaaaggagctgccacctaatcacctttccagatgatctgcctgggttctctttttctaatctaattcccacaaattatgatgctcacactcctaccccctctccttttttttttttttttttttttacactcttagcaaagggatatagataccaatagccactcagtttgagaccaacatactcacaaatcatttgtacacaagtcctaagcaaagagaataaattcaaccaaagtctacaggtggccttttagttcttctacttgttatattttatgttaacaccaaacaactttaaatgattgacatagattccctgggaccctgaggtcacatgaacagttaagaaaggaaattttaaaggctattaggagcctaactgtggctgacat

SEQ ID NO: 34457 - DNA, 973 bp, Bovine  19866880808281
actacttgggtttgcatcctgactcaccaatcactgatcctgggaccggtggtgcctgcggtctctttcactgctattatcatcatcatctgggtctttggctttcaatggctgttttttaaggctgctcaaatacctctctcccaacctgcctaccactctgaaccctgagacaagagcatgcttctatggagaaatgcgtgggcaatcttgacatccacgaggcgctcctttcagagcacagaaacttcccagggcttcacgacaacggctgcgtgtattaacccaggctgcacacacctggatgtgcaagctcctggcagagcctgtagttcccctgcctctggtcaggcccagagacacagaaaactcagactagaacagtgggagcccaggaggttcctagcaatttggaggcatcaccaggaggaagggagaacgctggggacagagcgaggaggggcacggcacacactcacagttctgagtcccccaggcggtccatgttggagacataaggaggcaatttgtgctggaccaaggcctcttcctcctctggctgttgctcctctttcttcagtcggtggatttcggcttgcagtgcaaacagctacatagaggtgggggtgagtgagatggggatgtcagctagccttccctccctggggaagatcagacacatcacgtccaaaaaccaaccgcattgactcaaaggccactcgccctcagccttggggagcccgtctcactctccgcaggcaggaaagataggtgaggctggtgtgacttgatgacaaggaggtgagaaaactaaagaccattagataatatggaacctacttctttttgctttttatcatttgacttgcttcccttttaccatttgacttgcttcttcccgaattcactgagaaaactagctccacccactcctgctttcctattgggcatctacagaaccagacgtttggaa

SEQ ID NO: 34458 - DNA, 1300 bp, Bovine  19866880808739
ctgagtgccagagaattgatgcttttgaactgtggtgttggagaagactcttgagagtctcttgggctgcaaggagatccagccagcccatcctaaaggaaatcagtcctgagtatttttggaaggactgatgctgaagctgaaacgccaatactttggccacctaatgggaagaactgagtcatttgaaaagatcctgatgctgggaaagattgaaggtgggaggtgaaggggatgacagaggatgagatggttggatggcatcactgactcaatgaacatgagtttgattaagctccaggagttggtgatggacagggaggcctgccgtgttgcagtccagggggtcacagagtcagacacgattgagcgactgaactgaactgtacacggcctaatcttattagcagccccatgcttcaactgtttctataaaacttctcatgaaatccctctgggtggagacacacagttttcgagggcaggagccactgtgttcccctttgcctggcaaagcaataagctattcttttctatttcatccaaaactctgtctccaagatttgatttgacactgtatatagaagtgtcaaatcaaatggcatcaaaatgcacttgattcctcttgaaatgctcaaacgtgtttttctctttttcccagcagaggggtgatggtgtgctcagctcccatgaaggtgaccaaggcagcaagaaggatggccagctcaagagttccagcagcagccacctggcttatggtatcctggatatcccaccatggtatctctgcatcttcttggggatccaggtaatgggacacagaagcattgggtgcaaggaggctctgtctcaaaaggcacatcgacacacacgggtcaaattagtcaagatctaacttcagttgctcatgttcttggcttccatgctgttgacctttaggggactcaaggttctcttttctcttttttttctattttctcccaaggagtttgaggatgggggcagggttttaggggaagattgttccctgtgctaagctactaggtcacatcaaggacaccacctgggccattgtgagtttttgtttgtttgtttgtttcaagttatcaattataatttgtttggaaacaactgatatgtttgataaccagtgcttggggaatattggaaaacacgcattgtcaaatacttgttggaatgttatctggtgcaacttttctattaactggtaaaacacatgttatttaacccaggccctaatgcttaagaatttctctgtagagaattccccaggggtcca

SEQ ID NO: 34459 - DNA, 3119 bp, Bovine  19866880893795
actgggcttttgtttagagagcttattgggcagcttcctgataatgcctttctgaggacattttagcagaatcagtaaactggaagaatggcttagagacctttttttcagacagtgatgccactgttactgtgatgataaaatgaagtgattctgcttctcttggaaaacacggatctttcatacatggagatgagttttgtccctgttgagttgtactggtgtgtgagacagattaggatcatattatggactgacttgtcccttgaagtgtgatcggggcaagcagcttatttttctgaaactgttgcattctctgtacctacctcagagggcttccgtgagaaacagctgaaataatgtgtgatgtgtagcacagcgctttgaaaatcagccaataaatagtagatactcgtccaaacatgttgctttgggtctgaatactttttttttccaccccctgcactcacttttggagcaaaagtctatgaactgtgcaaaatttgttgttattctttggtcactcgctttgttgatgaaaatctgtagtatccacattgaccaaagcacctggcttgcaaggtttgctcttggatgactgaattgttagcagagtgaactgcagccttgaaggagagagatttaccatccttcagaatattcaaaatgccacaaacttagaaaactgttttcaaagacagattctttttatcacctacggagcattgttatttgtggatgtgttctcctagactggctgctctgggggtgagggtcacttagatgttgtaatattaggtttctataatcatacgttgtaattgaaactcatttggacttagagcttctatcagaagtgacacttaacctcgatgagggggatcatttcttccagtgggagccatccaggaaatgcccttcaccatgtaaactgctcccacagtgaacacaggccgacttcctggtcaccttcagagcccctctcctaattttaggtccttgcggagtgaaaaggagctctgagttctcaggcagggttatcttcactgagatagtgttggaggaacccagagccaccacggattttaggggatgtggtgaaggtaataagggcactgactggtgcactccctgggtgttttgtcgagagctttgcctcacaaagcaggggagggatgggaagaaccactgagggacatgccttttaaaaagtgaaaatcactgttgtcatttaaggagactttctgctactcctgactttaaaaggagggttacataaaacactactaaagttactcgtgtgaaaagtaagacttcagggttgatgttgggaacctaaaaaatacattgaactagaaaccttatccttaaactgtaacctccaaacaaaatacccaaagaaagagaaaaagccaaaagaaccttacttggcactgtattttatgaattgaagttaccagttgatgtctttagacctctcttctgataattaagcagtttttggtttaaagggacagttttgttttcttctttctaactcatttactcaattttcatttctgtgactctagagaaaagttaggatgtgtgggttttccagttgtccatacttggccatggagcatgtgtgacatgcatagtgttttcatttccactgagtggttcactccctagatactgtgctggtgtttgcttttctgctaagctctcccacattttaaatactttctctgttactcctcctgacggaacactgtatactgtactgaagcaaaggagacttttcttcagctccccagcctgaactttgcacatagcatttcccagccttactcagatgagtgagttcttttttcccccactgtctgttaacgccttgcctcgtggaaaggagcaggacagtgaaggggaaatacttggagatgttgcctggtcttaatagggagtctgtgaaacttggattttcacatgttctatttatacctttcctaaatctggatgccacatagtcaagcactgaagacctagcagatggcatgggagagaaacaggccaacagtgaagttttgtggaaagtgcctggggtgtggtgggacattgcaaaacccgagtcctgcgcccgcgtgtgaaaagtgccactcttacatgcacagctgtaccaggctgggctgagcggaaggcaccctgtaaatagagtagacggtgtgctcagatctgttcagtgagggcggccccaggacagctgcctgagctcttgggtgctctcagctccctgtcttaatggtggttcagttttctcgctcgcctgagagtgatcctagtgttgagatgcacttttcaaacaggtggctaaacatgaagccacctactttatttgggttcagctaaataagagatctactctgacagtggaggaaaaaactagccattttttacttactaaaatggcacacgagtctttgtttcatgtgaattctaacataaaaggttgtatactgtgtacttcatgggtgacttaaaggaatttccgagacaactttaagcaaaatttgatgtataatcaagaataacaggcaactctacttgggtttttgtttctcagtttcatcagctataaaatgagctggtatcaggtgatcatttacagcttttccacccatatagagttgtgatatgagaagagaagaatcagatttaatgtatttgcaaaagacagcactaccaagcagagctgttaggtcctgtccagcagcagagcgattctagaagacaaggagttgtgagtcacagctgatgcttgttagtcacatctggaatgagcaggctgctttggactgaatctatggtctggggacagaacagtgctgttcggtctgctgaccagaccaaaataaacaccctttctgaactgactgctcgagagtgttagccgcctgatggacgtggcagcagcttcgtggagctgctctgctctctgtttcagaacgagtcagggtctcaaatagctcaataggggccaatcattctaagtcaactgaattcttttttttttttaatttatttttggctgcactgggtcttcgttgctgcgtgcgcgctttctctctagttgctatgtg

SEQ ID NO: 34460 - DNA, 1392 bp, Bovine  19866880963219
acaggcaatccaaggacagagctgaagtctctcttttcacttcctccttctctgaaatgggcataatgatgggatgcatgcatgtgtgcttgctaagtcatttcagtcgtgtctgactctgcaaccccatggactgtagaccaccaggctcttcagttcatgggattctccaggcaggaatactggaatgggttgccatgccctcctccaggggatctccctgatccagagatcgaacctgaatctcttatgtctcttgcattgacagcgggttttttttaacccactatctgggaagccccataatgatgggataccaaggcatagaaggttgagaacatgtgttttgccagttgtttcagaaggctcagaatcaaccccatgcctccctcctatgtgagtcttgcagaagtgctcctgatggctacttcccttcttaaatcagtgttggagtcacatgtccaggaagtcttccctgaagaagcaggctgggttagggtgccctccctctctgcgttctgctatcagagtatatcaccagtgcatttattaccagtttccttgtcagtctcctcctaggctccttgggagcctggcatgtagcaagtacatttcctggcatgtatacagcacatacttcagcaagtttgttgatctgaacttgagctttgagtcgaagaaaagatcaataaccatttcaaaagttttgttgttgttttacatttgttgttaatacccggtgattccgccctttaggcagagctattcctccaaattttaggcatctttgggagtttctatgccttattcagatctctgggtcatgacttagtgttccggggaattcagaggggaagaaaaatcatttgcttctgcaaaccctcatgtccgccgttctgataaaggatcccagctgtgacaaggagattatttacttgaaactaatgaccaaagctaattactgcagttgatttgggcagggacagagtgttccggagcaggctgttggcaaatgtccccaagtctccaattcggcaactgagccaacgagcccactcgatgtgccagtgctttttggtccttgaatctcctgttcaatagcaaatagactttagggttgtggtttggggctcagttgcctgagaggagccaagattgagtttctgtggcttgttctcattctgtctggttccagtttttgtaaaagatacaataaaataattaaagtctgacctttgtgagggtgtgggattggaggtctacccctcacttccacaacttcctccttcacaactcctccacaggacagctcccctcctccagaacaggaaacagacttcttggggctcacaaatgccaggttcccaggctcaggcgatttgtttccttctc

SEQ ID NO: 34461 - DNA, 1226 bp, Bovine  19866881003783
caactaaacaatgaacaacagcaatatgtatatggatgactgattcattttgctgtacagtagaaaccaacacaacactgtaaagcaactccactccaataaaaattaatacatatgtaaaaaaagaaaactacaccaaaactctgagcttgtctcccaagtactccttcatctgcttctcagctactactggagaactaagtcaggatgggatccagcaaccacctctggacccagaaccattacccctttgtctccagcctaactcggatggacccatcagatctctctctctctctctcactttgagaatccggttgcccacccctgcaactggctgtgattagagcctcatggtgccaaacacagtggatctccctaattctgcagtcaagtgctctgccttgagctatacccctttctccctaattctgaatttcaggaggaaggcacaaatatatacaacagattgtattaatgtttaccaaacattccattcttccatcctatgggagaattacacattcttgccctgctgaactcaggaatttccccatgacttgttttagccactgaaatatgggaggaattgaaatgtgggacgtgtgtccctttggagcagaaactgtaagaaccagagtgtggtttgcctgaaccttttttcctctgctatgatggccaaggagtgcttcatatagaagctgctccactagtcaggatccccagacatcaagaagtcaagccatggccaactcaggatatataggtcacatgaatgagaaataaatttgtattattgttgttgggagtcactggaagtttggggttatttgttaaagcagcataaccttgcaaattctaactaatatccagttcttctctccctgagtacccagggatccttgtgcaaatgagaccaccttctccccagagcatttcacaccaaaagagacttctccaagaattcattttgcatctcctctccaagtctcctgcctgctttacatctgtttagtaaatgaggagtctcaacatgtgccttgaggtacccttcagcttcaacttctacagaaagtgtttggtggtaaaatttgctaaaaatgggggaaaaataatctctcataaggcagagccactgcttctgttttccccagagtggcttatacacagtggacaccaatgaatgcttgtcatctgggataattctgagaagaattcacagcatt

SEQ ID NO: 34462 - DNA, 2297 bp, Bovine  19866881139320
tggcttccctgaagattcttttcctgctgtttcctggaccaaggggagaagcctaccaataggactgtaatcaggcctggacagcttgtggtgctttgacctcacttcctgctggaatgaggcctcacagtcaccttgggaaccctggtagcaatcctctgcctttcctagggaaagattaaaaaaaaaaaaaattttttttttccccctgataggttgttttctgttccaccagcagggtgaggagttaacaaaattatttgccaagtacattttggccacttttcacagaaattgtttacatagcgaagcccaacaaagagatagcaatctctttctccagccagtttccgcaaaatcaaactttatacagctgggaagagtcaccacggaaaatcgctttgagatttttggcaagtctggctgggctgggttgggggagggaggtggcagttgagttgctgacctctgatctgccttcaggcccccagggctctgggctggagccacaggcctcagaaagaatggagatgttctttgggatcatgagaacatgaatgtcacctcactcccaaggcagaaagctacatgttcttgcttcttaacgaaaaaaaaaagtgttatttatttggctgtgtgggtcttactagcagcacgcaggatgtagttccctgaccagggatcgatcccggccccctgctttgagaatgtggagtcttaaccactggtcgcctctttttaaccaagtatctgagggtgctgtgcctttaggctgtaagaccacagcttttcaaagtagcaaggacattttagtcctaaactctctctttctgagaaaacacaactgttttttatgtgtgtgtgtgtgttcaaaaaaaccaagctgcttcttgttttaaaatctccccagatgctcttctgacttcagggggtcatccctccttctacatccttcccatcagcactgtgaaaacaacttctccccttgtgcagctcagagactctgtcactcaccccaaggctcaggcatggggcctgtttccatgttggcccagactctctctgtccacctcttaaaccagactgactgttgtaacccacccacggccacctcaccccaggagacagtgcaaatcactagagttgacaactcactgatgtatctcagccctgggtcacaacagaagaattgtctctgctgaagaagccccagagaagatcctccccagggcaatggcacaatcctaggaccagccttttctgaatcacaggaaaaagtggatttccaagaacttccactgaattatgctcccctctgagaggctgcaagggagagggtcctaaacaccccaacagggacacccacacacagtctcatacccctcctcacctggggctagatgtgcctggagcttcacttttgtccaggaaacttgccacatcgaaggcttcttcaaaaaggatctgaaagaaaccacaaaacttcacgtgtcagaaatcgccacactctgatgtttgctctgggctgccgagggatagaaaggctccctaccttttgtccccaaaggggtgcatgttaaagctgagtcccaaacccagggtctctgcttggtgacctttacaggggatgaatattaagttcttgaccacccagaaaaaactgccaacctcagagagtggctgagagatggggaagcactggggaccatggtcttctctttctaaagagggtgggagcttaggagggagaggtaacagccagaggtgagcctctgtttacacaggaaagggctcatctacaccgcccaagggacagactgagcccagcatccacaatctagcagtttcattctaggggaacagaggttcaggggctcgggggttaggttgcagagagcccactcccagggtggatatgccacagtcaacccgctccctcccacgtccctgccccaacctcactccaccttgggagtcccttgcagtcacaccagtcacttggggtgcttgttaaaaacagattctgagccatcccctcaaagactcagattcagtgggtctagagtattagccaagcacctgcctttcaactaaactccacttaagtagtctggagggtcaacaataactagagaccaaagggccgagatttgggaaaaaaaaaaaaatctgtgataaaggatgcaatccttagagcaggaactaggcatcctggataggtcctcccacacactgggctcgtctgtgtattggaaggactggatgaggcgacagtagttttccatgcctgggtcctg

SEQ ID NO: 34463 - DNA, 1655 bp, Bovine  19866881202284
tagcaagatttttttttcccccagtgagaagatggttgttctttgaatcagagagcccagaggtgcaagggactgtgagaaggaggagctttcaaggaggttccagcccacatgaggtaatctgatccattctccttcctggcttttccagcccaaactgtcaaaagctctccatgagtgcaatcctggagataaacctgtgggtggtgtacatttttggagtagggaagattcccagggatttatatcatttactccaggcaagtgcagggctgagccttgaacagggctggtcttaactagaagagggaaaagaagtgactgccaggggcaaggattatttattcaccacattcacataacaacccagctgtgggaaatggacatttcatttatttgttgtggtggcaactctgtagactcccaaatgtttatgagtatgaatcatttttatttcatctctgtggacttagtctctagcaagataaggaggcatcttgccgaatctagaagtgctgtttaagtgatggaataaatttaaattttttgagggtcaagttatttttacttttgaccccagacaagctctctcttccaaagaaacaatctgaaaggtttatataaggtattcaaggttctttggatcttatgcaaacctgagtcagtcttactcaggtgagtctgtaggtatagtagagctttgagaattaaattttctataaactagcaagaaatgagagaaaacagtacttgatatgcacttgggactctcacagtccagaaacttagaagtcagtgttgttttatgggcaatatttcaagctccatataaacaattgtgttcttttcctacttctttcttgttagagatttctttcaagacttgaaattgaaatttatacattatttaccagaattaagctttctaaagtgctcatggggctttcctgatggctcagtggtaaagaatctgcctgccaatgcaggagacctgggttcaatccctaggtcaggaagatcccctagagaaggaaatggcaatccactccagtattcttgtctgggaaatcccatggacagaagaacctggaaggctacagtccatggattcgcaaagaatgggacatgacttagtgactgagcatgcacgcatgaagtgcttatgactcaaataaaccagacaatacgtcacgtaaaatcacataaaatcaaacatatggatgtcgttacagttaaaattcccacttgacatttctgctatccccaatcctataaatagtaccaacaatactgaaaaattaaatatattttgcaagtagcagaaattcttcctaataaatttttatggtgatttactaatggaaattgagaatacataagggtaaagcaacagatgcatgaaatcaatattcctcataatgaaagctcttagcaagccaggaatagaaaggaacttctacctacctaataaaaacctgtatattcctctactaaaaagcctatacttaattgataaaagaccaaatgctttctccttaagataaggaaccaggctgatgtctgtctgctctcaccatttctgtttaataacctactagaggtcctagtggagaaggcaatggcacctcactccagtactctgccggaaaatccca

SEQ ID NO: 34464 - DNA, 1757 bp, Bovine  19866881258851
ggaagtgcctcagtgtcttctcttgcctgtccctggtcccctctgtctttctactgctcccctttgggagtccaaactcctccagtctctcctttgctgtgtctggacagacagacgagaccccgaagctggtgcctctcagtcatcagtcttgcttccgtctgtgaaccttcctgacttgccctgggcccatcactactgtatcttgggcttgtttcacatgccagttccctctcacccaccccggcatcacctggaatcttccagcctgtgaccccgtgttaccttcagcaaagggccctgcagggttcctgtgccagctgtttttttcctcttctagaggaattgattctttgtgatcctctgagctgtaacctcatcaggctgaaataacttgacactcccatttgtctgacacagaagtcatttgtctcccaaaactcagggtcagggtggttgtgaattcctccccctggcctcctcttggagggttgtgaccacttcatcaaatgctcttgccttgcctctgagaggttccacgaccagcagggaaggagagatatcccgggtagagagtgagaaagctataggccaggtggggctggaaatcaatccaggactgttcttgctgagagctccttgccaccttcagggaatccagactcacccaatctggctcaaaaggcaagacagagttctgcagcggtctgctaacccagaggggtcaggactggccagcaaggatcctggctcttgggtaactggcttcatcatagcagcactgccattgtcatcaggtatgaccacactaccgcaacgctgtccacagagcagcaagtgaggcataaggaaaactggggccaagtccaaccctgcccctcagtagccctttgggcctcagtggcttgactccattatggggataatcatagctatttcagggggcaggtcagccaataaaatgagttcatcatcatgaaaatggaattctccaggcaagagtactagagtgggttaccattcccttctccaggggatcttcctgacccatggattgaacctgggtctcctgagttgcaggcagattctttactgtccaagccaccatggaagccccaaaagtgtgttctgttagtcattcagttgtgtctgactctttgtgaccccatggactgtagcccaccaggctcctctgcccatgggattctccaggcaagaatattggagtcagtagccaattcccttctccaggggatcttcctgacccaaggatcgaacctaggtctctggcattgcaggtggattcttaattgtctgagcaaccagggaactaaacagacctttctcggcaaagtaatgtctcttctttttaatactctgtctaggtttgtcatagctttttacatcaaggagtaagtgtcttttaacttcatggctgcagtcaccatctgcagtgattttggagcccaagaaaacagaccctctataggctgagtgatggggcaggggaagcatggtgacccagaacagcatggaggcggggtggtgctgtcccaagatggacaagagagtactcaacagaaaaaggattgcaccaacatctcttccagactcacccttgagcatacggaagaggacaaggggatcccaggccatcctgcttaaagaggaggcacagtacatagtggtcccatgaagcaaaagatgagcacattccaggggacacatgagagcatataaacatgcagagcatgtgg

SEQ ID NO: 34465 - DNA, 563 bp, Bovine  19866881305748
ctgttctcatacttagaaacccactgttgagatggttgtttagatcattgttcctgaagacggggaaacttgccaagggggcttgtgatataataattactggtttagacaaaactatagtgtttatctctgctatccctgacttctcttcctatcccttttctagtttttaggtactaatatcaaccctgtgtgaccagcgcttcaattgctattatagaaagtaaaacatctgacagtcattcattctgaatattatcttagaccagagggagaaactcagttaaagcaatgatgactgcatagaaataaatgtctagctgcagatgttaggcatccactgggatagtttaaggacactgaactctcagaagccttcaaaatgcatcacaggggctctcctgtgcagtcctagacgctatgtcacagatactatgtagactgtacggacacgactagaaactgtcatcaaaaagtcgcttttacctgttactttaattcaaaatcaaaatctgttaagatggaggaaagggaatgaggtaatctggtagaagaaatctggt

SEQ ID NO: 34466 - DNA, 985 bp, Bovine  19866881316246
tatcaggtgttttgtttatactctgttttgcaacttaggccttcctgctaagaaaaaaaaatgtttaacttatcatcaaaggtggataaacttattgatgttttaggtaataaaagaggcactcatttcaacacgaaagacttggagtcaatgggatatcacttttgtgactctctcttggactactgtgatccagaccgaaccaaggtaagtaaagtccgtttgctcatacatcagactccagacgcccagataacatcacctgcctttgggcctgcagcagtttgttccttctaacatcctgactgttcattcagtgttttgttgtacttgatgttccaggtgtctataaatattcagttactttaattaggaaataagttatttataattaacttacctatcattttcccctagtactatcaatgcctgaaagaattagacgaaatggagaaacatataaacttggaaaaagtcattgatgattcagatacttctctgaaagaaattacattggatctagagactaggtaggtcaagatagtgaaagtaatgtaatttgctgtgttattctacatgctctctagtggttaggattcgactctcaccaccacgaccagttttccattcctggttagggaaggcctgttataacaattcaaggatgtaattgtcagtctgtactgaaaatcctggctagagatggaggaaaattttccccatgcacgttacttcagccagaacttatcaagacttcatttattcaaatgatattgagtacccactatgtactatatgtgaaagacatctcaaattgtttttaatgctgtcattacccacagagaatcgacacatttatagagacaccatataaataatctaagttagtgaatgataagtgcaaaatttaatgccaagggaatgttactggaagaaggaaggtactaattttagtgcagttcctataggaaaatcagaacaaatg

SEQ ID NO: 34467 - DNA, 1335 bp, Bovine  19866881319442
attcatctgtgagcttccgagcaaatataagtggtattttgattatatgcaggttatatgtgggttagggattccttccaaattgagaattgattattgactcagtgttactgatgttcagcttaattgatgacattttatttatagtttgagtggaaatttcctctctggctaataccagattgacttaatatttttggatttggtaagttctttcttttaacatttctagaatggtaggtatcagaatacattatcttcttttgaaaaccattaggtatataagcaaaagaaaaatcggtttttttctagaacgaaatccctcattttttttcataggaaaaaatggggctgggaaaagaaatgacaaagctgtgcacataaatgcatttggtaacactcactgtcattattgtttacattaagaaacagaaagctagaagccaagggtggcttatgatgtctgttttggtgaaagcaaaattaaaatgtcctgagtaatggcataaagtgaagaaggagcttttgctataatcagactactgtaaagtaaagaattaccagaaaaccagacaggattacatagattagatacatacatctcaaatttaaacatgaataatacattgtattcataagatatatataaaaatgttaaaagtcatagtagcaatctcatgcagcaatatacctcttacttgcaaaagtaataatacctcaaatgtaaatataaatacatacagctggcctttaaatcacttttggagattactgcattaattgttgatttttacagattttatctgtagtacttgaggaatcttatatttgacattactttcacttgattgtgataaatggtctgtttcatcaaatgtaaaccaaggttaggaaaagatacttataaagctttgtttttcctttcagccagttaagccacaatttggggaaactgaattaatccctactcttttgagatttagaagcaattcatgtagcaaaccttgggttgagttataacctgagctttttttttttttttttttacaagtattacttttagtttatattagtaggaaaatatttaatacaattgatcttcaactctaagcaaaaaatacatttcatttttctttgtaatacactggtggagaagctttctactatgaacaatctgaatgggtttagaaacctttggcagtcatgctttgctgaattgtaagctgtgtattctaggagaggacagtctggcagaagaaggtaaatgattttaatatatcttttcttttgtaaagctattttgcttcaataaaaaatgttctcaagtagttttct

SEQ ID NO: 34468 - DNA, 1123 bp, Bovine  19866881325697
tacgctgcactaaaagaacatgcaaaggcagtctaaagaatgacctgcgcctatgtttagggaggcgctaaggtcctcttgaccccaccaagctcagcaactaggaccaaagagaaatgttcaacttcatgtttttaaaaccttcctctctctgcttttcaaagctatgtaaacaaaagaggccctttctgcaaaaagacaggtatcatcttgtgggccaaaatcaggtgctggcttttattagcctccacctgcatctccaagtttagttaaatcatctcaattggccatctcacagaatgccttctatagacttttgcccacagggttgggctacatgtaaattatagcttcatggtcctctccagaaacacctgtggtttccttctgtgttaacataaccactgaagctggtctccaaagatgtaaagatcttctggtccctgactgagatgggtagcttcataattttgggtgtccagcactctccggcaaagctaagtcagattcgaagactttgcctgacctgtactatctgcattccacgactcatgccatgggataggtatgagcaaggtctgatagttaagagactaaggagaggttctaagagttgtggatattaaatcaacaggaagaaaaaaaatatactcctggtctacttatgataaatgactcatctcatatttctttattatggattttttttctctttttctataaatgttggaaagcataatctttcatcttttccactgaccctctcttgtgatttcactcagggtcattaatttacaaaaacattctatatattgataacttccaaagttataactccatatccaaaccaacttgaataaattcacctgtctattcactatctccatttagatctctaataggaatctcaaacctaacatgtttaaaaccaagttcctgatattctcaaaaaacctattcctattacagtcttccccgtctcagttaacagccattctctacttctagttgttcagttcaaaatcttgctgtcatcctcaactcttctacctgtattgttataaaacatatttatatatatagttttgtaactacgtaattaacacttaaatagatctcacct

SEQ ID NO: 34469 - DNA, 1820 bp, Bovine  19866881365283
ttgaatgctctgacttcactggtaaactttccattcctggaatatggccaaattcattcccacattgggatcttaacacaggccattttttaaatgggtagcagcgttaattgctcagtcgtgtacttttcggaccccatggactatagcctgccaggttcctccatccaggcaagaatactggaatgggttgccatttcattcttctctcttctttaaatgggtgattccttccaatcctttaaatttcagattaagtcatctctttagagaggctgtccaatttaaagtaaatcctctcatgatgtatctatttctctgttctttttccttcttaatactttgacaacaaataagtagagttttacttgctttttaacttattttctgtctttctttttaaactctaagatctttgagggagcttagtgctttgctcacttcgacataactcaatatttagcactcaaataccaaatcattaaaactagaaaagataaataagaacaataaaattccaagcaaatggatttttgggagaaaaaagcctccatgtaaaatggcattaatattcactgatacaaaagcaatctggccataacaagggtcataaagctgaccatttcctttgaccctgtagatctatatttgagactataagaatataacttgaatttttaaaaaaatatccatatattaattattagttaaggttaaaaaatatgggaaataacccataatgttttctgttttcattctccttctccagcctagataaacccaactgtatgttgtttctttggcagaacccaagcagataagcattattagagataaaccactaagttaggcaaaatacattcggcaggacttttaagatcacccaactcagatgggcaatcatttccctgaaatactgttgtgttatggatgaagctgttcttctccctacagatgttatttcaatattcaccattctcctgggatcaaaggagccactgtctacaaagccaaataaatcagaaaacctgagagttactcatgggactgcctcctggtccattatatcactaagtcctattgtttccacctcaggaagcagatcttgaactcatcacgtctatgctatcttcactgccaccactatcagaaccacgatacggataactgaaatgttctcttaattagttgctccatttcattctatagcttttatcctatccattgtccacacagcagattgatctgttttttaaatgtataagactaattcatacacataatagatccatatagcaatttataaagacaaagttgtatactccctctacccctttccaactgaaactccccaaagtaaccagctgcccattcttttctctgtgctctgcataaatatagattctttcttatttctaaaaaatgggtaacattatacacaatatatcatgttataatttatttattttttacataataacatgtcatggacattccttcaggttgatatacagttctttccctttctattttttatatagctgtatattattccagagaatagaagtacagaaattaaattggcaacttcctcagtgacaaacattccatagcatggccttttaaaaatgtaagtgagatcatgcctctttccttcaaaactttccttttcctgtggagtaagatccacattacctacaatggcctgcaaggctctggtatgataaggcccttgcttcttttaaattcaccttatacccccacctcgccttgctcaccataatccatgctgctgctgctgctggtaagtcacttcagtt

SEQ ID NO: 34470 - DNA, 2759 bp, Bovine  19866881402617
agagtgaaagttgctagtcgtgtccactctttgtgaccccatggactacaaagtccatgggaattctccaggccagaatactggagtgggtagcctttccctttattcccttgaccaggggatcttcccaacccagggattgaacccaggtgtcctgcattgcaggcggtttctttacaatctgagccaccaggggatccctgagagtatccactctaaattgtccccagacctttcaggtattttcatggggcaattgggccaccaagaagccatttgaaaagggtatgaaaccaaaaattaatatttaaagtggaactttgctttttctttggaactccctattccagacttgtcaccctggggagacaggtggggtgggtccctggcactattgcactgagtgtaggcacatcatcagcgtgtgattttctctaaagaaatcagaatcttcaaactgaacacagtgaagtgtgttctagggattcttcaaagcattgccactcataagggcaactctttaaagatagtggaaataaaggaaaggacacaggtttcctcaataaggatcaaagctttttgattgcaatcctgttaaactctccggtgctaattactgcctggatgtattcagccgcgaagccccctcaagtttgccagcttgagcgtgaggtactccattttaatatttcaaaacctcttaaataaccacaaaagcaactgtttatctcaatcttcccttcaaacacctgcttactgatacttgattgtgtgttttgaggcttgtgattgagtctaacacctggctgatgaggctgacgttgggtcatgttttgaaacgcaatcttactatttcgtgcgccattccagactgcagtgcatacctccaaactcttgttgtttttaaaagataactgttagcgagtaatagcttgttttcactgaagaggtaatgaactttaaaacgcttacagtctgatgcggctttgttctttaaaacagtgggtttcaaagtgtggtgctggtgatgggggtgggtgaagtggacaggggacctaccttgaattcctacaagacttactgaatcagaatctctgttgtggggccctggattgacattttgaactcattccctatgttgagaaatgctgctttaagagaaggaagctttcaattgcgtcctcagtaggagctttctgggcagaaacttctggttctttacctgtgaaatgtctctgaactagagccaagaggtttctggttgttcccttggagagcgccaagcgtgcatgggagccctcgccttgctgcttgatgggcagtggccctgtgctcaagggtctgagagaggaggagatgtgcccttgggcctgtgatgggcacctgcttctccgtttcatttacaaatgagataactgaggccaaggaaagtaagagggctgactgaaggtcactcagggcagagatgaggctagagcctgggatcacaatccctgccccttgttcccaggccatggagtgaggcctctgtaagaggctgggccccgccaggacccctccccatcctttcccccagctcagtgcccaggaggctgacctgcttagcccaccgctggagcatcctactgtctgtcttctggctgggtttgggagacagaaaggagcctgtggatgaatgtgtggtgggctggcctgagagcaccagtcagtctggagaagggaagagcctgtccagccctcccagtttgcccaaactgaagggtttcccaggacttgggactttcagtgctaaaagctggacagttccaggcaaaccagagtggaggaacacctttaaaatttaactagagaaatgcttgagtaggctcagggctgtggttaataatcatggaggtgtaatttttgttaccatttaaaaaatagccacatacttaatttttttattaaaaaatgagagtctgacctccccttgatcatcagggatggggcacagttctcgaggtgctagccgactgtgttctgcctttgcctgggaaagtagtaaagtcattctttcctcctcctccataaaaaagagagagtctgtaatggaaaattaaaacattttaaaggggtatgttgctaagttagtctttcccactcttgacctctgtcagttttcttttcagaggcagttgtggccagtttctttgtgtatactttcaaaggtattttatgcacatttaagggcataaatgtatcatgtgaaacatccaaatggtagcatattgtgttctttaccttgcttttcttacttaacagatttgagattgttcttcaataggtaacagctgccacactcttttaggggttgtatagtattccttcatctggatttattgtcttttataaatgtatcaagccacctattaataggctttcagtttgcttctaattaagtgccattattaatacaaataatgctgcaatgaatatcctcaaatgtctgggtcaaagggaatgtgcatttaaaacaatgaagtgttggttgctcagtcacgtctgactctttgtgaccccatggactgtggtcctccatgctcctcccctcacagaattctccaggcaagaatactggagtaggtagccatttacttctccaggggatcttcctgacccagggatcaaacttgcatcttctgtgtctcctgcattataggcagattctttacccactgagccatcagggaagccaaggctgaaccaatttacactgctcc

SEQ ID NO: 34471 - DNA, 1287 bp, Bovine  19866881404891
catattaaagatatacatagaaatgtgacatcccagagatattgtagagcaggggcttcccagatggaggtggaaaaagccccacctcagggcatatccagatgggggaagtgactttatcccaggggaatccctggtcagtaaaattctgtaactctcagacttccctggtggcccagttaagattctgaactcccaatgcagggggtccaggttcaacctttggtcagggaactagatcccacatgcctcaaccaggagttcacatgctgcaattaagacctggcatggccaaataaataatttgttttttaagtctatgactcttatagtggcagaagaatgcctacaagcccctttttgaaggaagaataaactcttagtgaagcttccgcatgagtcagcactggtatgagaagacgggccacaagcttttcttctgattggaagagtctatcagctcaatgcatgggctgtaatttcaccaaaacacttgctcaaagaggcattctgttgaggtgtggcattttatagcgctttacagtttgcaaagagcttccagtgcatcctctcatttgattctcacaacccagtttccagagaggagatggaggctcagtgagattacatgacttgtcccaggtccccttgtaaatgggagaatgaaactctcctctcctggtcgagggcagttgctggcaggtgcattcctgtgtgtacagggacagcgtgtcatctctctggagcagagcagcagagcaggaggaggctggcacagagggaacagcagtaggaaggaggattcctggggggaaatgaatcccttggccttctgactccatccacccccaacacagcctcctgctccccaacttgccccctaggtttgcttcctaacacttccagtcaactgactctagcctttgggattgtccaggtctctccaaacatggctggggaatctgtcttccccatgtttatatccctagaagttgctaacaaagcaatatgcacatgaaaaccaaaacatctcagaaaagtggccttttaatctgggtgctgagaccgaggctttgaggaaaatgacaagacagttcactgaataaagacagatatgtgcccagaccctacctactggcttcaggtgtgctaaagatgtgggaaaaaatcacagctttcagaaatagagtcttcaacttatttcccaagttgttgttgttgcggttttttttttgcttctatgagatggtgaccgccaccgccaagtcacctcagtcgtgtccgact

SEQ ID NO: 34472 - DNA, 675 bp, Bovine  19866881450639
ctcttgggaggtccctttttatcattctgagacagttagcccgctcaggaatataacctgcagttacaaaatagaatgcatttcactgacttgatgaaaattaatctcttgcttagttcttacgagtaccacgtcctcaccaagaactctaaaatttcttttacacagccttcttgctatatatttggtatttatagaatatttgccaatttactgtaaaactatgaaataaccttttctaaaaactcagtctttttcttcatggtatcccttaaactatctttccaagtgtaactttgcagatttgtttttcaaagaactttctgccaggatgtttttattctatagagctaaaaattatttgggaaacaaataatagtctaagtctgtgagcattgttgtttcaaaatatacctagaaaaatatttgaaactgttcaggattagatttttgttcgtgtttttgtttattcaaattttacttaagagagggcatttaaagaaaattctttgtttctgaattcactgttttaacagtgacttgattgaaatttgagtcatttgtgaaacaagtcacttgtagtcattatcaattataattgggagaactgatctcatttcatgtatagttctttgacctagaagtagtcatcttactttcagtcaattggatcat

SEQ ID NO: 34473 - DNA, 677 bp, Bovine  19866881461825
gctggtttaaaatgacctcctcctaggtctctctggctccagtaaattacgcacaggttgccgaggcatgacttctaggcttctactttcttatggtgctgcttgtgttaaaccatctaatgtctatttcctattttactgtaaaagttgaggccatgatattttcttaatctcatttacttatctggctccccctttcctttcttgagtcctctccaccttttcacctctcttcagtcagagaacaaaatggccctctttctatcagaggtcaatgctcccacctgtgtcctagatcctcccctctaaccctccccttccttctctaggctcttgctccatcacttagctcacttctcctatattcaagcttcctgtcttttctgaatttttacccatagcacataaacataatgtgttcaagtctttcccatcattaaaaacatgctcaagcaaaactttcctgtgacctctttagctgctgttctttctccttctggtctctttcaaacttcttgaaagacttatttctttaatgatctcctctccagttcgatcttcattacactgcaatttgacttctacccacacattctattgaatgttaggagccttcgagtacctaattgacaaatccagtgggtactttccattcatcatcttccttgacctctctg

SEQ ID NO: 34474 - DNA, 1073 bp, Bovine  19866881894949
cttccctgggttgatggacgaggggaccaggattgccgtgagcacagtcgcttaccaaacagccggatgacgccgtcagctgcccccgtgaccagcaggttcccattgtgattgaaggctgtgcagttgatggcaatgggctccggatccagggagaactggagctaaaaaaggataaaccacatttaaaatgtgagacaataggaaaccaattccaaggcaggttctgtctgaaagggggaaggagaccaagattgaggaaagacacggcagagcataaaaaggatcagtagcgtcccactgttaaaccctgacaagacaggtactcattttacagttttctctttattccaaacacctgtgattttaatattctcttctatgtattcaatattcaatgaaaacattggaaaacacaagtaaacataaaattaaaaatcctgagaaaggccctcagcagaaaatgtgcttagtcactcagtcatgtctgactctttgcgacccgttggactgcagccctccaggctcctctgtgcatggggattctccaggcaaggatactggagtgagttgccatgccctcctccaggggatcttcccgacccaggaatcgaaccagggtctcctgcactgcaggcggaaataataagattaaaaaggacctgatcagactgggtgggataaggtagaacggagacgccagaggacagatgtacagatgtctgctggatggaatggggcaggagggcacatgtcattacccatctgtccaagcccaaagaacacacaacactaagactgaaccttgatgtcaactgtgcacccggggtgattacaatgtgtccgtgtaggtgcatcgattgtaacgagtgtgctgctccggtgagggaaactgatagcaggggaggctgggcacgtgtggggacagcgtgcatggggaaatctttgaaatttcctctccattttactgtgagcctaaaactactcatagcaccccttctatggccacaccaccctgaacgcgcccgatctcatcgatctcagaagctaagcagggtcacaactgcttagta

SEQ ID NO: 34475 - DNA, 1792 bp, Bovine  19866880120993
ataaagcagaaatagatatttttctggaactctcttcctttttcaatgatccagcggatgttggcaatttgatctctggttcctctgccttttcaaaaaccagcttgaacatcaggaagttcatggttcacatattgctgaagcctggcttggagaattttgagcattactttactagtgtgtgaggtgagtgcaattgtgcggtagtttgagcattcgttggcattgcctttctttgggattggaatgaaaactgaccttttccagtcctgtggccactgctgagttttccaaatttgctggcatattgagtgcagcactttcatagcatcatctttcaggatttgaaatagctcaactgggattccatcacctccactagctttgtttgtagtgatgctttctaaggctcacttgacttcacattccaggatgtctggctctaggtgagtgatcacaccatcgtggttatctgggtcatgaagatcttttttgtacagttcagagaactgccctagtacaatctaaataaactcttatgcatcatgagaggcattgctgtgatgagggatgcaggtctttcaagttctttcaattgaattttatgcatggtttcttttttagtccagctttatttctcgtggcttgaggtcattaggtcatgtgcttatatctgagcaggactgccatggtcagattaacattagtttgggcatgagttaaatgtttgacttagaggatttaggactaaatataaattgggagtctaagaagtgcttggatttggattgattggattggatttggaatacttgtagctcatcctcttatcctgacacagggactaggatggatggaatagatggtgaacttctagagagcattttcttcgtgggaagaaggttaaattgtcacctctgggagtggtacagatcctgataccaggcatgaggtctgaaggagggtgaccatggggcagttgtccctgggaaggcatgacaattaagaagagaaggggttaatatactgactgatgtttcagtttataagcactggcccttctctttgttctgttttatcatacacattcatcacgttcaacctggcaacccaaccaaatagctatttaagttgtaaaaatgaatcatagcacaatttcatgaactgtgtgatataactgaatctaatcccattgtacaatggggcctttgccagcccagtgtacctggttctagacgtctttggaataagtaaataaataaacaggctgcatgcacagtaacagtaaggtggctgggccttttgggttgcgggtccagaagaagaagcatctggccgtatcacattggaccgtggtgacttcccaagctagctcacccatcagaagcgtacaaatcatgttggctgtcttctgtcctctgaacacagccagccaattccctggtttattaagtaaatggccgaagaagtcctggggtaggaatagaagcctcacaaatgggagctgcaaaggagggctccaccccagttcagtttcacaggattccagggttcactgactttgaactaactgaaagatgagtagacacaaagtctctaccctaaggacccctgttaatgatggtgcctgctgatgcatcaagcattgtaggtgttttttttttgtctatttgactgtgtaagatagatcttgagctgtgagtaataccatcgggagaggtgaaataacttaaggtcatccagctaataaatgttagggcagagaactgaactatctgagtggtagaaaagg

SEQ ID NO: 34476 - DNA, 983 bp, Bovine  19866880418609
cacacacacatttgatgataccaagctgctaagccagtcatgttatctttaattctgaagagctccttatgccaattaataggtctcccccttttctgtccatatattttcaaccatttggctggacattcagtgttcttcatagataattggattctatagatgcagtttatcctcctaggcacattctattttcaccaagggtgtgttagttgctcagttgtgtctgactctttgcgaccccgtgggctgtagcttgtcaggctcctctgctcacagaattctctagggaagaatactggagtgggttgccatgcccttctccagggggtcttcctgacgtagggattgaacctgtgtctctgatgtcttctgtattggcgggcaggttatttacaactagtgacatcttttgggacccccacttactggtgaataaaactcctttgcagacactcacatacctgatgtgtaaactagtggagattctctagtgctgtttgcataatgttatgcattccagccccacctttagtgcttggtgattgtgaggattaaagatgacttctcttacatcataggctgcctgttagagtctgacaccattctatgtcttttgcagcgaaatgctgcttctatccatagattatcggggaattccagccaggttccaacttccctgtgataatgcagtactttgtttccctagcaggttaggaactgatatccccattatgtagcatatcatgaaatgaatgctattgttaagtataaggacagaacatattagtggtatcttttattacacagttcattataaaagaacagctattgctagagtagtccccatttgataggtagcttgacattgttcttgtgctgttagctctgattaaggctgggataatgcactgttcctgcctgttacgtccatcaggaaacaaggcagacccgaggtaaaatagatgagcatatgttggcaa

SEQ ID NO: 34477 - DNA, 1205 bp, Bovine  19866880437875
tttgtgtggaattacacttccttcgcatgcatccaacttttgcagggaggtgttagaatttgttttctgaaatcggttggacagaaacatcttgttgttgttgtgccggatttcttcaacttcacctgtatcatccaattctacttctccttccttccttctcttcccgtttactttccaggcctttgagaggatagattgtggcctacatatatttagaggttttcctctacctctgtgtagagtctaagccgctgatcttaaaccctcagcctcttttaccaccagggaaaaaaatagggagccctgtcttttgtaacctcattttcccagtctactaaatgaggagagtaatgccttcttgccagggttggtccaagtaaaagcattttgtgaattctgaaaaccactctaccgtaattatgaatgttgttttatgatcaattgaacaatgagttctccttgtagagttttcacttaggggtagtctttatacacttaagttcttggggccattggcatcaagcttccccgttagtgccagagctgttgggcctttgaagttatatgtattgttgctatgcgtgtatatggtgtccacatgtatctatttatctgtttattcattttcagagcagattagatatgtttaaaaaaaaacaatagaaaacaataaaagtctaatgcagatctagggacaatatactgctttattttgctactaatgaactatgaagaataaaataactttacagttcccccattctttgtacaaattatgcattattaagaccttgactaccttcaggcaggagtgaggaactctatattaagtcactttagagcagaaaatacctgctggtgtctcatacatgtgcaacttggtatatttactgtttgaccattgttggtggtcggcatctgcattgatctggtgtggcaagtttaagtgtgtttgtgtgtgcttttgttaaagacttgtatctgtactattagaggaacctgtctgtgttttaaatgctcatgttgccagggctttgtgatgatgcccacatattcaatagctctgggtactgtgttcaacagaattcatcaacagcactgctggagatggagcttgaagtcgagaagcattactttagctaacattgggtccatgttctttctagagggttttttcttggttctttaagccttaccatcat

SEQ ID NO: 34478 - DNA, 1929 bp, Bovine  19866880447411
actgtagcagagcttgattgaaggggtggggtgggggcaggcaggagagacctgcgtgcaacccactgtcttcccttggcaggaagtaagaaaggctcggactaaagcgccagacagtgaaacagatgaggctgagctggaggaatttttctgggttgcactgagccctttataaggcagcattcgctttcctgccttcccaatactgacagcaacttgtgtttattctctctgtctcctttcttcccattttccctgcctctccccttttccattcatcactttccctctttctttgtctctctcagtctccttttcattcttggcttttgttcccttgctcatttttcttccctgtcttcactgccctggtgttctctttactccatctctgcttctacacgttctgtagtccaccccatcccctttcctttatgatcccttccacctccccccaaaaccttttctatggaatatataaataaatatatgtatctatattttttgtctgtgtctctgttggttgtgtcagcatattttagactgctgggctttgcatgttttgcagctggttttgaagcagttgtcagacagtgatggatgactatcatcatttaaagtgtaaaagaaaaagccttggcacagacaggcgtgatggactgccgtctgccagcccggataggcacggccaccattttcttctcctccctctctgctcacactgcccttgccagaatctacaaaagtcatcgtgagctgtgcagcaccaggctcttgccttctataatatcactttggtagttgtcagatcatatgaaacgtcaaaattcatgtggcctctgtgaagagatatatttagtacagctgctgcatacctacacgctccccctgacactgacatattagttatgctgtcttttgcaatctgatatctttaaatttgccaccttgttaagttttgattaatgtgattccatttcactaaagtaattggcttggcctgttgtaaaaaataatcagccccctctccggaacaaatgctagcacatgctaatgagggagtgagttcgttacattgatggcgtggactgacagttattaatgattgttatgataaacagacgagtgcgaattgggatgagttgggcaaaagtgacagtttaaaaataacgtatattggaaagtactaacgaagtaatatactgttaggaaaacaatcatgcaagttgtcaaggaaagaagtgtaattatacagccgcatgggctgcctaggaggacagggaccggcctgataatggacacattttttgttggcaagagggaaatatgttatggcagaaagaggtgcagattgataaattaattggtccttctcgcagctccgagagcaaacttggctggcagtcaccatgcagatgagggagatggaggttgcccagcgcttcttctctccagagtctccctggtccttgttgccaggcttttctgaagcctctcttgtgtcctctcctcacttttcttcatgagctgcaacaagttatagaaagtgcatcctgaggtgcaatggacccaatacaacttcgagcaggaattcttgcagctgtgtccagtatttttttttttttttaatttaaagacccccccaaacgtaaacatcctcttgttgctaaagtcttgggctgtgatggaggtaattatgggtggtttccagctccatgaagaccaggaggggctcacacaggctgggaatcattctgaagggcaaggccaactctgtgcttccaaggccagtgagttgctttaggttgtttgcatcgtgagccaaggcagcagtggggtgtgtgtgtgtgtctgtgtatagcgggtaagacttgtctgaagaaccaggctgagatgactgtgggcagtgggaggggtgagggaggcatg

SEQ ID NO: 34479 - DNA, 906 bp, Bovine  19866880473990
tcagcgccaagcctatttgttttacctggccagtcggtaatgagctcgctctgtggatggatttgtattttattattataattacgccaccattataaacatacctcgagcaacctcagcataaaaggcagggaatgctattaaaacatacatataaacacacagggaaacaagacaggattgtaaaagggctgcaacagaaactaattgggtttgcttttttcgttaatcccagcctattaatatggtaagcagtgtggtctaaggagcctcatgctgggaacctgaagatgaccgctgcataccagagttagcctctaattgactgtgtgaccagaagaaaatgctttacctctctgtgtgtgcctcactgttcttaggggttaacaaagataatggagataactgtgagcactttagacatgtgaaaatattgataatttgggggaaaaaactatcaaacaaacagcatcatcattctctagctatagagaagacagacccaaaaagcagacagcggataaccctcatgtatgcatatatttaatgcaatgaccacattaagtatcagcaatttacttcctattttctcctttgatatgtgaagtaggctagacaaatattatcatcaccatttgaaagagaggctcattctgggattaaaagtgagattcagaacattgaagatgaggctcttctgacctcactatgctgcctcccagcactctccctttgggtaaaggctggagaatgtatgaggagataaaaaaaaaaaagaaactttggctagtgggacctcaatgacacagtgaccatctctcccagccctgtcctgatcagactgatggctcagctgaatgtcttaagtctgggaaagggaaacagacaccacttcacacaggcaaa

SEQ ID NO: 34480 - DNA, 1310 bp, Bovine  19866880536233
attgttcttttctttctgatttctccctgacatttttggctggttctgggccaattattagaattccttgggaggtggttagttcctccataaaatgggtatcatcataaaatttttacttcagaaaatgaggactctattctgtggcctggggtgaagtccatgtgttatagtcctgttaaattaaagactcagtcttgcctgagaatgccaggactggatccttattatcctgtgcttctcaatagtgcagacttttctgcagaatagtgcaccccgataatgaaggcctggcggagtggtagggctgaagagggggatcagctcttagggcattagtgctgtatggaccctctcttaatgctagaacagagctctagagccaagagaaagctgattcttgcataattcctaacaggtcgataattagaaggaaaatcttcaactttgaaaagttttaaggaaatggaaatactcctttttagacatttgcttgggcttaactatttaataatttttgataggtcacgatactgcatttcaaggttagagcaactaaaatacttagagaatgggttctgattaattttctacttaacttaggggggaactatagattcttcttgattcaacttagggaaatctgatttccatgacttgggttctcactactgagtcattgttcttgggaagatgactgggtgcactgatccccaaataatccctggcattccatgacgcacacttaaaagatgcatgctgaaaaaattcattaccttgactcttttgtattcccattaattgaggctttgctcattggaggtggttgtgaagaggaagaggacataatgaatcacagagtctggccccttgttagcaaatggttgtaaattatggatgttattatatgaatgcgtttttatttttaagcaaagattgctataaaatatgatggtacctgtctaggctgaccttgaaagaaaatactaacagaactttgtgaaaccaaaatgtgcatggaaaaggagcatccgttcctcaccgtgagtaggtttcaaatctcttatttggaagatttaaatgtaagtttgaagaagtaggaccgaggtcacatcttcccctgtcggacattctttctgatgaataagtattaaaactgctttgaatttggtttccccctcagataaggatttattttttccatacggtcttttctttgcacctgaaggagcattgagggtgaaaaatagaggcctgtttcctgttcctaactggagccctcagaaggttgtcaaaccagaacaacaact

SEQ ID NO: 34481 - DNA, 846 bp, Bovine  19866880574070
ggacttccttgatggtcccgtggttaagaatcccctgccaatgcaggggacatgggtttgattccttctccagggagattccacatgctacagggcaattaagtccacatgccgcgactactgaagcccgtgcaccctggagcccatgcctggcaacaaggggggccacggcaatgagaagctggtgtgctgcaacaaagagcagcccccactcaacgcaactagagaaagcccgggtacagcaacagagatccagcacagtcaaaaataaaaataaattcattttttaactataaaaaagagctttaataatcaagtaaaaaccctcccacccagtcaaacaagaagggtaggtcaagtccttagaaatagctactaagattatcatcctatttctttttctagtcatgtctgattctttgctaccccgtggactgtagcccaccaggctcctcggtccacggaattctccaggcaagaatactggagtgggtcaccatttccttctccaggggatcttcccaacccagggatcgaacccaggtctcctgcattataggcagacgctttaccatctgagctaccagggaagcccaagatcaagttaaaaaaccaaaaagatggtttatctcttagattctaacaggaagggctgaattcaaactgacccttaggaaaagccatcacgtcctctgggagcagcaggtatgaggcctaatggcctgtcataatgaagggccagtccctgatgcggaaactaacaccaccatgtgacacagagggattcataccaccccttctcaaaaatggtgggcaaagtttgatggttcttaaaatcataaatca

SEQ ID NO: 34482 - DNA, 1821 bp, Bovine  19866880578630
ttaaattcaagaccctccatgagagtagaaccccttaccccctcaccccacacacaagtatctagcaaagtggtaagcacagagaaggcacgtggtgaacatttatggactggaatgcttaaaaatatttaggggtaactttaaacttgggcacttatttatgagcgttgagtgacaatggcaagccaaagctaaatgacccctatgcaaacccagatgatgagtaagatgaagaacatcctgagtggaggaagccagggtgttgcagaaacaagcagtaaaaagttccccagccttgcaaatacgttcagacttttactgctttataccagccccatgagcataactactgcctaatagcccctgaaagattttctggaaggtgaggatctcccagagagggaaaggtagcgagtgtgtgttggcaagagcagaacaattttacaaaggtttgaaaagacatgctcgttaaatttacctcactgagcaggccccaccagcaatgaagtgctctaaactcaggcaggactgggctttcttgagaaaatggagctgggctggagggctagaagaaaaccagaataaatgcttactggcccccagtagggatgttcagcttaatacaggtcaagggtagtatctgagaagactgaaaaatgggggtggcgggcagagtggagaaggaggaggtaagggatggacaattattgactcccatgagtggggacggggctgggggcaatggcttgtatttcttcaaacattcctctgtctgcagacaggctgtttcctagtccaatcttgtcagggtaggagagaaagccaggatcactaaggaaattggcagctgtttgagttacatacatatgaacgcctgcaggcaagtcttacctgcagaccagagggacttgccctgcaggactgtcctcccttggctatccccagaaagcacatcaacacggtggatgacgggacagagagctggtctctgaggacccagggtgggggtgaagctaagagaaaggaaaacgccaccacctctgtggggtaagagtcttggggcagtaaagaggccccagcctccgccctcacctcggcaaggccatttttcaggcgtgcatgcgtggggcgagcagacttgttcttggctagagaaagaggctttctcctcccagttgctccaggggactgtagaaaatacagtgcaagattgcattaccaatttctgttggcctaacacaatgaaaacccatatctaatttgctgtccactatcccccaggtccccttcagcatttactgctttccaaatatcttcctcccattgaatatctgtgtttcagattatttgtccccagatgtattaggatgcatttactgcagctgagtctcatctagtgatttcctgtccatatgcctgacagctccaggtcccctttatgtcatgtctctgtcattggtgggccttgtaatacctctcccatttagggcaatacacagatttaattagcatatactttataacctttcctaagttattaacaaggaggcagaacataattgacacaataatcctggtggcgccccgcggcctctgaatcacattacatgtctctccccaatgccacaatgaagtggtccattcagcacaccagaagagctttaccaatttcctttaatcatgaaacaggcaaaaggatccttggtccagcattatgaaaattgcactgaaccaggacttaggaggagcagattccagttccagctcagctaacggctatgagctatatgaccttgaataagcctcttcaatgctcattta

SEQ ID NO: 34483 - DNA, 1318 bp, Bovine  19866880629862
tttattaatttaggagtctgtaaccaaaaccattgtgctttatcttatggtttctttaccttaccatgttgaagctgtgtttggccacagaatctgagaccttagccacacacagactgcacaatttaacaacaaaacacaggctcacaaagttgccttagctgtgattctgaaaactgggagattctgaaccatctcaataaccaatcattagaaattgtaccaagaatgggcttctttgaattagcatgtccaagcgtgattatgtttgtgcatctgggatgtcttttgttctttctctgtgactatacttgcctgtaaacctggaacactagtgaatatggatgctcatttgccaaatgattttgatataaagcattctaagttctgcatgacctgaaagatcaagctgtacaacagcagataacgagtctcggcttctctttccagttggttgtaatagaaaggatgaccagaaaacatcaatagggactcagtagggaccgatatggtctaagcaactagcctgagtaaactatctgcccaaccacaacccttaagaattcatgttgtttattccaaaggatagtcattattttctcttgcctatattagatacagtactttttgtgaattttttggtagtgacaagaagttacatgtgggtgtctagaatggattataattgtgaagagtgttaaggatagtatcaagatccttggcacaatatactgaaaatggtatatgtgaaagttacttgaccaaaatctttatcaagaatcagcattaattctatggaattatccggacatagactccttttcaaatgactcaagatgcttgcagatactttacttctagcccattctgaaataatcacaggtgctttcaacacatggctttccagacagtatcatttctgacagtgggtctgaattgaaggaagttgtggacgggaaccttatcttagctgtcaccatcccgcctcatcaccttcaaacaaagtgatcaggctcaaaggatagtcaggctactggaatgtcttaggagaattctagaggagatgggtcaatgagattcaccaggctcttcatccctcaacttctcactccatgttcgaccatggaaatcagttctgatgcatcactagtagggaatttgctcaagacttgctttgaatacctacagtcgtacttgaatgaggactttgagagcaagaacatattccaaaaacaatgatggctggggttgtaatatgcatgaaaacaaaataagacaatctttgttaagagaagtggagccagcccgtggctgtttc

SEQ ID NO: 34484 - DNA, 772 bp, Bovine  19866880701044
ataaagcctaaggcttagcaaaggtaatgagacactttacaagttctttgggaagggaaaagatggataccgagatgaattcaccagtataaaagcaaacacttagatgagcaatgctctccacaccccccccaaaaaaaagctatgtggattaggtctggagcaattaacaaaccaaagcatttccagtgtgaactctttcaacctaatcaagaaatttaaaaagagaaactgaggactacaaagttggcctatagctcttaggaagatgaatacaaaagaaacagagttcacctgggtctttggcccaagaacttgacaccaggtttagaataagtttcttgcccaagagagtgctatgtggatttatgaacaaacatctgaacaatgacactagaacacccactcattcttgtcaactctcctagactaaggtctatttcctgtagaagagaaaggaagcatgagaacaaacaccagggcaatgttatagcttgagtgtagcactccagctgaaggatggctgccatgtcttataacagagaacgtgaacgtgaactgtctaagactgatggacacgaaactaaatattacactgctacaacaaagcagacagtaaatagatttaaaggtcccaagttacttctcagaaatgaatgtcaggaatagatggttgaccattttcacaccccagctggaatcatatatatgaaaaataaggtaacatggggaacctctaatgtctgcagaaatcatagatgatcctgcgaca

SEQ ID NO: 34485 - DNA, 2286 bp, Bovine  19866880720505
ctggatcttaagggctctgagtcctagagaaggaagttcttcactttttgggcctgcacaagtgacgcagatggttcgcacacgtaggactaaggctacagaaggatccgttcaaaggaggacacaatgcaaattcaagaacatcagtgcttcccaatagtgacaaacggcttaattatctacactgggggccgcgtgttacaatgttcaccaaagtattcacggcaatgaaaatctggcatttccatcgatcagagctttctctaggacaatacagagaggtgacattttgatcatgccttcaactcaattgttggaacaagcacatggtgatcagtgaaaagtaacaagtacacaaccttgtcttccaatcaagagttttcaacagaggattcatgatgagggtaccacagacatctgaaattacatgcaaatttatgtccatgagacatcaaggacaagcaaaaggacacatgtacacttgccccctgaccagcacaaacactaggggtgcagaccctcctctcagttgaaaaaccctgtgtaacttctagcgggccactcatttatgcagttcttccatatccgtgattccctagccacatgttcaacccaacgtcagatcatgcagtactgtagtatttactactgaagaaaatccacctagaagtgggcccttgtggttcaatcccaagtcactcaagggtcaaccgtactgtgtgttttcttaagaacgtcagtctctcaaacagccttgttgaataaaacatctctatctcagatccactcaaagaatatcactctctctaaatatgaatcctgaatcttttggaaaaagctaaaaggagatctgagcttgttctagcttggcaaacatccttacatctggagcaatggttctaaagctttactggtatgcatggaacttatttggagagcttttcaaaacatagactcagcttcttcacgaaagagtctcattaaagtcccaagtaactgagatgtaagcagtctatggactactcctcaacaaactctggtctaatggtttcaccccatgcgtcaggtgccacagacaactctgagtagacctctcttaaaagagaacctcataaaagcagaggccccactgccttctgctggggctctagccggctctgttgtcatctccctggtgtgctgcacaccctgttcccccagatcacctggcctcagagctgcgtaggcctcagcctctcgcctgttcctgctctgctaacgtgacccgtgttacccaggccatctgtaacacacgtgacatgctcaccagtctgaagctgttctggggaagctggctcttgttccaagggccacagtggctctcatcttgggcactgtggattctccccaggacacagccataacctgtgaacacaagctcactccagttatttattgccaatcagatctgttcctactgggtcacctgttcacctagaagagagccaaagagatggaataatcatataacataattacagtctaaaaatggcgaggtatgagggaatagttatggggacaaggtgtcccacttgctgactaacacacaaagcctatggccctgaattgccaagtctcctattcacctctcaactaaactagcaaaacagacttacagagataatcaggccccagaagaaagtgtgtgtgaatactggaaacaaaaatatatatatagagattctagaagctctgtcaataatcactggctggattcccacttcaccatttaactataaatccatactcactaaggattgtaccacagatcataaatacctgtttatatcatgtcaccacattcagaatcgcccccagaaaatcattacctggcaaagaaagtttgcagtttggaacatggtagtaatgaaatactcttctgcatttcctactcacggttgaaagagcagaaagaaacctctaaatatatatatactttagcatacaatcataaatatctactgcccttcccaaagacacaatgcatgtactaatttataccaggctgctaactttttgtttcatgctatattgatggacttgacaggttttcgaagagtttataactgcagcaggtgttgatcttatttaaagagaatattaaatcaaatcccttgtcatcggcataaaatctcctttagcatcaacaaaaggcggcagtttttattgattccctgatacaaaagatgtatgaagtggacggatgctgctctgccaaaaaaaaaaaaaaaaagtcacaattaaagc

SEQ ID NO: 34486 - DNA, 1006 bp, Bovine  19866880765511
atagacaagactttggacttcttgggtccacagccaaggagaaaagatgtacataattgaaaactgctgtgtaagaaaaagcactattgaggccacccaatcagcccaggaatgtttgtgaccagaggagctatctgtaaatatccaattggtaacttcagtattctctccctacttgttgtagaggataatggtttagagaggtaaggaaggatttggagctttctcccagccaaagggaccaactaggacgtctcctgtcgctaagacacagcattagagagcatgccagccacagcggccacttcagtgttcaatataagggtatgagtttctgaaacctgtggacagcttcatgctctacagaatccattcacattcaccatttcctttgctcttcgctgcaaagcaagcatcataatgcccattcccttgataagaaggctgaggttctatacattttgagcaccattcctaaagggacacaagtcactaagcaaggactcccaacttcaatcttcagtagtcacaatgagtaaccagccacttcttcagaccagcaagccagccccacaagttcaatttcacgtggcgtctgtgaaaagcttttggttcactccaggaagtagctgtgtttccacagcagataaagggactcttagtgatccaggctagtccataaagactgctccaggctgtggcatttttctagttcctttcattcaaggatcctagtcatcatcattattattgttgttgttattaataatgataatgaaataaactatgcaaatgtggggaatggctttagccctgaaacgcagacagtaatgtggtaatttatccaataatggaatcacaaagtgattttatttgcttttatggctcctttctttcagaggagctgggcatcaataatggcgatagtaatgaaatcaactatgcaaatgtggaaatcgtttttaccctaatgtaccaatttagccagcaaagggaattcaacaca

SEQ ID NO: 34487 - DNA, 623 bp, Bovine  19866880766504
ttctgtgtatgagcttgaattgaaagggcttgaatcgtagagataaagggaaattttttgtaaactgctctttgctgttcaagtgcccatgtactaagtgtctctccctctctcttaaataccgtagtttgctagatttttctcttcagtgttaacataattataaaaccacacctaaaaaacctaagcctaaatattcaactctagttcttattttgtaataaagattccgtgatgaaataatgtgttaggctgttgatccctgaagtgtttcggtaaaggtttaccttgacatagtttgaatgctttagtaagaaaagtggtcaagggaggtggggtgatggaccctgaagggcctttgtcttggagaaaacctggggtgtgcttggacctcagcctcccagcccctcgtctgtcaaaccgccttgctctggcagcgggactggacccaggtgagcggggaggagcctgggaggcagagcccctgcaatctgggatattgtttaaataccgtaaaaaaaccctcgctcatttactcctcctgagcaccggagagaaaaacggtgtggtaatcctggcatagcaggcggtgttactttcatatcagtataaaatgaaattgt

SEQ ID NO: 34488 - DNA, 2615 bp, Bovine  19866880803343
agagaataggaagttgctagcccagtagccttacattcacttagctgtgaagttcagagactgaaaagtgagtactgtaaaatgggcggaggactgggttttgagtccgacagatgtggtgtgagtttcagtcttctcgttaacaactttgtgagcttgggcagctcacataaccactgcatctgtggtctcatgtgtacattaaagatgataaaagcttcgctcttgttggcatgttgcaaagattgagctaatggatacaaagcacgtgtgaagtacataatgtgttccaccaataccagccattattaccattacaattctcattcttatagtaattcataggcattggaatgaaataatgatagcactatttggaaggaatactttggcactaatggatacaaacattagtgctgctaggaggagctgctaggattctagttctggttccatcacctgttagctgtatgatttggggtaattcactttacctgtttctcagtttctccatctgaaaatagtgtccactaccttgtgggtttatgataatgattatgtaagataatatgtgtaacacacttagaatagtgcctagtgcactcagctgtttattaatagtttttttcttttcattgtggcttcttcctcttcactgtctgttgcctctgaaacccttagaccttcttgttttccctggcatgtgctagggaccggtggccccaaagtgtcctcctggctgaatcctatttgagtgttgagaatgtgcccccagtcatagattcttcactgaacagagtgaccatgacttctttgatattaaatgagggtgatgactgcacacaaaggactgagcccatggttttaggagtcaggctggctgcaggtttctgaactctctgaacatttatccagccctcttgtcccttattggtactgcactgaggcatgaaccctgctacccaggaagaaacctgctgactctgggggcatgcagtgtgtgcaagcctgcacacacacgtgtgtgtgtttgtgagtgtgagtgagagagagagagaatatttgtagcctaaaggtacatttgtagcctaaaggtatggtgcattgctttgtttcatttttgggggggttgtaaagttgaatgaaaggcacttagtccaaaactttaaaaaattgctaccgggcaaagtaattttgtgtcaggcttctgttcagggcagatttacactggttataaatctctgaaattaaggtcttactgtagaaaagctgaaatgtattcaacattagcagacacccaggcttgctctgaaccaggggctgttctccccccatgtataataagaatatctagctatgtgtttgggataataatgagtttaaatatgcctcttaggatgggtaatggcggtccgatgagtagcaggattctctaccaacaattctttccctagaaccaaaggttaagttgaagagtttgatttaatgacaaatttaattaggcctttaacattatagggttctttccttttgttttctaatcaagatcatggtctagggtcaacacccttgtagaagtgggggaactcatgcttctgtacactgttttgatgtctggagagggttggagtaagactagaggtgattacaaatctgagttgacaaagagctggaaaatgcttcctggtcttaaagtacttttgcctcaccttcaccaaaccttagatttataatatccttgatctgttaggtacttgaagagtcatctggtcagttctttcactttacagctcagcttgggaaactgagactaagggattgaggaatttatcagtagttgcctaggtcattcggagcaggataatggatcatttaaggtcagcctgtctcctccttctggtcaaaatgatctgtctgccaagactcacactcagggaaaagcaaagcctctttttggcttatgggatgtatggcccagtttgctagagcacttctttcctgctacttttcaaggcagatgtgccctatttggtatttactggtacctcatccatagggtaccaataaaatctcttggttgcaaacaaaagaaattgcctcttgctctcttaatctccactcctttcccagacagacagacaaataagaaaataccaaaaaaaaaagaaaaaaaaaggacatcccattacatacaaggctctcagagtggactgtaggctggagggcctcgtgaagagaagaaacatcacagcatgttcagtgttgcaaaaaataccgtggtggtcagaatctgagcccccagcacttggcaccactccgacacagtgagtggtcatccccctgtgtctttgtctcatatgttttcatgattcggatcatagcaggtaggagatgtccaagaactgagctgaggggcttgttgatgctttgactgccaagaaggcagggaggggggagatataaactcattggcttctattgagacgtggagtggccactgcccactctaaggcctcacacaataggaaattacacaaaaacaaggggaaaaaatgaatgtcaggttttggatagtctgaagctcttagtgtccaagataaaggcttcatttgtcc

SEQ ID NO: 34489 - DNA, 949 bp, Bovine  19866880835426
ccaagaagtccaaagtcttgtctattaactctgaggtcctattgcgaaaggaaggtccattggtggccgtctctggttcactggagaattttccctctggttttgtttttattattttattttatttctgctgcaccaggggctccaaaaaaatgaatgtgtcagtaaaggatttgacagtatgttacgacagtcatcaatccaccaagccctgtagccataaataagcttcatacgctgccacactaaagaggacagtttttcttctccaggacattgaaaatgtcacagcgagggaattgtttgtccccgtctccacggcaacgccaccagcacttatcattaactttcacaccaagattttaatcagcgctctttgcggcctgagaccaagtcaacatcagcccaaattttcaaagccgttattctaattatgacgagaaagctatagattgatgagctgagttttctgcaaggactggtggcagttaattctcatgacctgcgtggctcggggagtctctcttagagatggagtcttgaaagttcgattattagtgacagcttgtaagtgagaggagccttatctctccagagagtgttgataacttgagacaaggtttaactaggaagtagtgagacagaggaaggaggggagagcgggggagaaaaggaaaaagaaagtgcacactctatctgcagcctgcacccagcgtaatgagaaaatacggacaggcacaatttcacaagttgtaaattctggtagccttcagttgtaaattctggtagaggctgttttactcggctatctgataatgtgtgaaaatatttgtccctttgcttcataggcacgggcaagcactgtgttccagaaaatgcattcaaattcccagctctccctgccttgcattgcttttcagtttccttggtcggagacctcggaaacaaa

SEQ ID NO: 34490 - DNA, 3238 bp, Bovine  19866880869062
accatggtgacaacagacagcatgttgtcatttcgccccactttggatcacagccctgaaatcaaaggagagagagagaagcgctagcttttaagctagttaaaaaattttagatgacaaagagctactgttttcagagcagtcttctttcaacaccaaagaaacatccacgaaacaggctgccagctcccctgaaactaggggtgcccagactcccacccagttggtcagcctggatttccaggtggctgatgcctaaagatgtctgagagatactaggaaggctcgttccaaatagttcagtatgagactcagctcaggactccggtatgtcccttaggagatgtcttctttcatttatttacacattcacccacccagcaaatacttagagactaccacccgccaagaactgagcctggtgctaagaatgggtgatgcacaaaacagacaaggtccctactctcaacgaacttacattctagctcagtgggtcccagacttgaggaggtgacagaatcccccagaggccttgttgaaacccaagtcacagggtccctccctagagtttctgattcactgcatctggaatgaagtttcaaatttacattctagtaagttcccaggtgaggctgatatgctgctaggcctgctgagaatcactgtccaagtacaaaaacaccacaaggattaacagttttggaattatgaagttgataaggtggccaagtgtatccttcccagttcagctagtggtctgtcctgcccccaatgtctacggtccccagtgcccagacagaagccatatccaccagaccttctttcttgccccttggtggtttggaaccagctctaaaccagctctgccaatgcttagtcagtgagctttctgcctgcccgtcccattctggtcttggggagatctatttccctttgttctaggtcatgtcagggtgtcaaaagctgcagcttcaatcctgagtataatacaagtttgccataaaaatacaagagaggattcccgaagccacagaatgaaggcttttacaatatcaattcaacccttgtaaatttaatccagggttatttgttgcaccaaaatctctttactgtgatgtattacttagttaccagggttatcacagccgtatcctaaagttgcatagtacataaaacatttcagttaacaatgcgggaaggttaactcccccagataacctgcaatcaccagggctagtccagatgacatgcctctgtcagcttccacgagctattgatggttcaatcagtttgttttgaaggtaaagtacaacaaaagggcagtaaacttattcagactgtcaacaggggctatcgggaatggggcttgcaggtaagtaattctgggtgttttaaagctattatcaaacagcaatggttgaaggaagagacagctactaataacacagaaggcagccatcataaaccactttatggcagaaacccccgtccataaatcctgcggcacccggagacagcttcagatttataaaactgcttgttaagccagggcactgcttaatgaaaagagatccgtctaagttctcaggctcacatccccagccccagagggcaatgccaattttcctgaccttcccaaggtggttgggagaaagcctcagggccgggaggggtgtggcgcgaagtcagaggccctcctggctgtgacatggagggtgaggttacccagaggagaccagggaccctgggaaggtgttcaaagaaccacctgtctctgcatacagattcttaaaaagtgagacccacacacagcttttcaggttctctctcttttcatagaggaagtgccatttcctgaaagaaatcctctaaagagatgcttacaactggtagagggacaaaaacaacagcagaaagcctttttggtttgtttggtttttgctcccaagtcagttttctctaccaaaagctctggcacttttcatccagacttcaaagggaagggaggatgctgtctcctgcccacatctgctcccccgggggatctggctgctccccaggccctctgcacaactacaggcacatcaagacggatctcctacatctgctcctggggctggctgccatgtttcttcttctgagactctacccaagaaacaccgcatttccagatcccaagggaactgcatgtggagtcacggggacttttcccacctcccccctttacagcattctatgcttcttcctattgcttcttggtgccttcttgctctcatgcatgggaaatggggagacaagctgggggtcacccccccccactgggggcccctgaaggcagcaacaggtgatccatgaactgttctcatcctttcacaaagcttaacaggaaagcgtgaacacgccagcagaacaccaagcttctttgctctggatggcatcaaccccatttggtaacactgcttacctcatgctgatcaaaaactctgatcagcaactaaacgtctctgactaattttgaaaagttagcagtggcttaaatgaagcttactgaagagaccaaagctttcaagtatatgtgttggagggaaaaacaagaggggagtcttcccagcaaaaagcgtgtggactcacagggtagaggaaagagcccagactctgggctgagctttctgtgtgaccctggcacagtctctgccgccttcctgagcttcagtttctccatctgtgccatgaagggagtgggctaatcctaccccgcctcttaagcttcagtttgctcgcttgatttctatgtgcctccaagttaatccacaataaatacatccatattctcctctttcgtattgctccaatttgcttgtctcactacccactcacaccttcaggtaagggaggacggtgaggaaaagtcaataaagaccacagagtaatgaacaaagaccgcgagtgaagagatgacaacgctctccctctaatgagccgaggtgagctcacctacagcattaatgaacgcctgacaaccagccaaggccagctgatttccctcacagttcaccggcagcacgtttgaagtctcggtgcaaataatacacccacaggatagaccaaggccctctacagaggggaaccagcaattactctgtgggtttctgtcactttgatctctaggtcgtgacctttgctttcctgtgatcttcaaagcccagattgcagattagctggagaatgctcactgggt

SEQ ID NO: 34491 - DNA, 2397 bp, Bovine  19866880935243
ggcccaacttggtattccgcttgagcaaaaagaacatacaagggccacacattaagtagctgtgagaccgaggtatcagcattcatttgtcgtgggattctctgtttctacattttttataatgggggcaccaaatgagcacatcacctcaaatgttgatgacagcatgagcattttgtttccacaaaatttgctcagtgcctccctgtctgcatggctttagtttgccatttctcggtaagttggctctgattttttgagtacctgtggcttgctaaaccttgtgctgaactctgcataggagagaagctaagatgtggttctaatcctcagggagcttacattttcattccagggagaggacagagatctgaaataggactagttcgaagcatggtgagtagctagcagaatgaacactgtggaccattggaaactacaacattctggagtggagtttgttttgtttagcaaggaacagctggagggtaaggggtaaatggtctgtaaatgtaaataaatcaggagttcttattgtgtttgctggtggggatctcagaattgcctcttgtttgtcctcattctgggcatttaatgagctgatgttaggtgtgaaacacgtaaggaccttgaaggcagctcttttcctctctgggcttcattcagaggcatctgaaggtcatgatggaaattgtggatgtctgagtcccctttctttcttcacacaggtctcaactgagccatcagggcctgggtcactgccttagccagtttagggtcgtctagtacgcccggtctttctgctccctaagcctgggaggacccagggctctcccctttctggttgctctgccattctttcactcgtccttgtcttcatggccaaagctgactcaccggcaacgtggacatgctccattccatgggaggaagggaggcagcatgaatatggccagcttcctcttacaggacgtgccgtcacctttgcctgccccacctgactgatgggcggtcggcatagtctgagtcgcacagcagcactgagcttgaagggtctctgggagatgtagtctccagctggactgctgtgtatcctggtgaattcagggggcatggggaaaagagaggaagtgctggggacagttagctttttttggcttccctttcactcagcagtgagctctttgtagccagcatttacacttttaacctctatgaccccaatgtttatactagaacttagtacataataggtgcttaaaaaatgtttgctaaaggaaagggcacatcagtgagtgagtgaagaaagggatcagggacagcacccacagtccgggggccttctttcttttgtgcccccaggccatgttctttgtatttgagcacttttagctgacccatgagtgggctgtgctgagttcagtctgtgagaggccgcgtggcttacacccgccacgcagtctttgaacccaggactggggagatagaagaatatttcattaatccttgcaccattttggcttcttatcgaatggcccagacctcttctttgttacggacaacaatgaagggtgcctttaagaaatctccagtgagtcccgaggcattgcagattaggtcagtagcaccgctgctaggttgaacatgatggatgagcaggagaatgagtttctgctgcacggtattgtgaaatcttttcattgtcaccaacgggcctatgaggagctgatgaatgagggagcaagtgtcaggaacgcccttccttgccccagtacagttttaatatctccctgagctacaggatgagtattgataaaagtaaagtttaaaaatagccacggagtgatgggtagccatgatttaaggagaacagcagtggggttagagagggttcattttcctgaaagcacatgagaggaaagagagcaagaaggagagagaggaggaggaggaagagagaagtggcagagccggcatgcgaggggaaagagcaggaggcttttataagaagctaatgtgatgaggatgacgagggctttgatggatgagttagatccatctggtcgcagtatatgtaataaatagctgtgctcgggtttgacctctcccacttaccagacacatctttctcttttgggatatccaggagggagcttccattagaggaaagaacccgtcatgagccggagccagggatgtttatggccttgtgcagagggcaaaaaggagatgggatccgagttacaggtttataaactgaaaactggagcctgcgcgccttgcctaagatggtgctggcgccggaaatgcattttcagcgctgctgatgagaggagagcacgggaaggaaaagggcagggggtgggcagcagtccacagggccgtgtgagggacagc

SEQ ID NO: 34492 - DNA, 1356 bp, Bovine  19866880976721
aatgaatagcacatataccaacagaaaatatagtacaattgttctgctgtgacccaaaaggaacaatataaaaagaagaaaatgagattttattatcctttccacactttccactctcacacttagcatcttaacattcttcaagttcttctcaggaatataaagctcaaatcacagaccagtatctgttatgttgtgctgtctttgcctgggaattttacaaattaaaaactataaaggctaagaagttacaactatatgcacttggatcctgccctgggaggggaaaaatgtacctgagtagtaatgagagtagggaaatacacagattaaaaaaattggaaagatgtataagaaaatgtgtaactgcagttaacttagaggagtctgattatgggtgatattatcttctttgtgctttggtgtattttccaagcattaacaatgcccatctttccactgaagaacatttacagagggccagggactaaccaagcactgcataggatgctggaaaaacagcaatcaagacagacaaggtccctgccctcttgatggaaacaacctaatagggaagacagaatcaaacaagcattgacaacacaatgattcgtgctttttttgtttgtttgtttgtttaatgaggatttactactacttagattctacacatatttcctgggtcttgagcgagtttgaaaccttccaacttagagtgtttctatcttcctaaaatggaaagcaaacccatcacatgtgcctgaggcttgaggaatcactacattttctacttttccatggtgaaggtgcaagacttcttggacccaagacctaagcacctaggtaaaccatgtttgtggttagctgagctgaggccctgaactcttctcctgactctcgtgctaactaagctttagcaagtatttccccaagacaactatacctgaggctctccacgttttcagtttcactgacttctacactgactgcctgtaaccagccagactcaacaaccccacctgcggcccaaactttctccacctgtgactgcacatgctcactcagacatgtccaaccctttgcgaccccatcaggcttcctctgtccatgggattttccaggcatgaatactgggagtgggttgccattttcctcctccagggaatcttcgtgacacagagattgaaccgcatctcctgtgtgctcctgcattggcaggcagattctttaccactgggctacttgggaagccctaaactctccatcagtcccaaatatcaagcaaaaattgccctcaattattctctttaatggagaaggcaatggcaacccactccaggattcttgcctggagaa

SEQ ID NO: 34493 - DNA, 1661 bp, Bovine  19866880981637
tgaaaagtgaaagtgaagtcgctcagtcgtgtccaaccctcagcgaccccatggacagcagccttccaggctcctccatccatgggattttccgggcaagagtactagagtggggtgccatcgccctctccaagcagtggtcctagagatgtgaaattggttatgttggcggtatcttggaaaaggatctcaaggatcctttgtaggagaaaaactgtcaaagaatcaaagtgaaggccatgggcatgttgtaggaacaccaagtggtctagcttcaccatttatcaacaatcgcttgtgggtagagagcagtgatattcttagataggctagggcttttacttgaaaggaccttgactgtctacctttgggctggataatggccccagtggaagtcataatcctatgttcagtgggtggctgggctaggagctaaatcaccgttaaagggaacatctcatgtcccccaaatccatatgctttattctcccctggagaactacctgcacccatggattttcttcagttttgaggcatggttagagaggaattatgaagggccctctgctggcctcattttcctgttttaaatgcataataactcgaaggggaagctgtgttagtctgtctcacctgatggagccttaaattctcccaatgctgcctccactgtgctgcattggagtgtgccgagtgccttactgcctcaaagaaagaaagcatcctgattttgggggtgtgggagttgggggacagtgataaacaggtctttgcctgtattgtcttctccccatgataatgaacccatcaccagcacaggaatttaatgcactgatttttccaagagccatccaggtcccattgcaatgctgcctgaaaatataaatacacttcctgtggacagatttgcattttttggtgaaagaaattcatatatatggcaaagatgcctctgtaattatagaaagtttatttctgtccccagatgtcagcaatcaaattccacataaatatattttgtgtaaatctgtcggcagctggtctccattcaggtttctggagatattagcctgtctttgagtttatgacaaagttaaaaattattcattaaactgacctgcagtatattcagtaactggaaaattgccttgcagttctatttggtttgtagatgtgatcacaagtaaatttttaacttaattaattggccgtttctgttgacaagaaatttatgtggtaataatttgctcgaaatagatgccgactgtaggaaatgagatatccatcataggcttgtgttccaccagctgcacagtggctattatgaaagtatttcagcctgcaccgaccccagtgtttgtgcagtcaagattatatatacccacgatccatagcctgccagagaggcgctggtggaggtctatgataacaaagactttgtgatttatggcttgctgtgaaagcagagcttgatgagattaaacaatttcatagcacaagtgtttctcaagacctgatttgtagttgcaagctgatggtaaatcacatttatatatctgcaagcgtgctcagcagaggactgcaattacagtttaagacagctactttttatttaatttttatcctgggtttgtctcttttatatccccttcgtctgcaaa

SEQ ID NO: 34494 - DNA, 2018 bp, Bovine  19866880986990
aaaacccgcagctttgactgtacagacctttgttggcaaagtgatggctctgcttttgaatatgctgtctaggtttgtcgtagctgttcttccaagaagtaagcatcttttaatttcatggctgcagtcagtgcccacagtggttttggaggccaagaaaacaaaatctgtcattgcttccactttttccccttctatctgccatgagtgatgggactggttgacatgatcttaatttttataaatgttcagtttcaagccagatttttcactttcctctttcaccttcatcaagtggctcttcacacatccaatataatgggattcaactccgtggaacttaggctggtgtagtttttggcttacatcagtttatgttcacaagctcacacttactgtgataattttcgatgtttacttttttatccttggtacctttcatcaacttctacacctttagaagcatatgcccagtgctttaattttctcttcctaagagaaggatgattccttattagcatcttaaactatgtgtctaatagatcttcctgggatagccttaggaaccactcaccattgataatactatttttagaggaaatgaaactctgagtccccagaaacaacttttaaatgtatgccttccaaaagttagctggtacatggaggtgatggtacctggtgaggggcgggggttgttgcctcctgcatgtggaaatcttgttctagggctgatgccctgggaagtatttggcatgtgtatctgccaggtttatcaaggactccgtacaaatggaattgtctgagatagaactcaagggccatacctatagcagtgggactcaggtggagggctaatgtcagccttggccctgtggcccgtttgccctttgatatttgaggattctatggatctctggttacttgtgtttccaattctctgttcagacatacatccttcctgagccatttagtgggtagtgtggtctgtggaaaaagcatggactgggtatgggaagaatgaagcctgctctggccaagaactaacttggggctgtggtccagcgttttctcctgtgttagccttgttcttcttttctggaaaaggaagaggtgaaatgctcatgggtttccagacttttcctttgtccaccttacaggtgaggggaagctgggatgtagaatgtgaacccttcacctcagccccagcccttctaccctgatctacttaaatattagactttggcagaagatgcgtctggggagaaagtgttgctattcaaacagctttaaaaactacctctgcattcacccatctaattggggtttttccttcttgggtcccaatatgcctcacagtactttttagcatgtccattttatgtggccagcttatggggttttattctattgattgagctgtcgtcctcctctctcagtcacccctggggaccaaaagtcagggcaaaaccagagaacttgttaagggaaagctttggagatgagcaaagagagagcttggaagggagatggcatagaagaccatatctttcatgcttgtgtcagctcatcccctttagtcctaatcacagctctggacaagcggacaagcaaaggaaccatggagttgaaacttacatagtatctaaaccagtaataatgccttagatttgttcagtgttttaacatcttgaaagcagtttgtttgccattgttacattggctattttgaataatcccaaatgtaggaaaggcagaagttattgtcctgggttgagcgttgagggcatgaataatgcctgttatgcagacataagggcccaaaccaggacccggtctccctattcttgctcctctcatgttgccattcctctttcccacagtcagggcttctcaatgacccaagtgtcagtactgggaccatgcggatgctagtggggagagaagaaatttacagtggtctgttttcttcttcctgtggatcttttcttctcttgctctccccatccaagaagcat

SEQ ID NO: 34495 - DNA, 1789 bp, Bovine  19866881034125
agtgaacttgcaccccctgcagtggaagcccagagtcttagccatggaccactagagaaatcccacccgtacttgtttagtctgcatgtagtttattaaacacctctcacgaaccttgtttggttctccatcaaaaacaggacagaagtccacttcactcttatccaaaacttctgtcttagatgaccaaatgagattttacagtaaaagtagagtgggtatttagtaaaagtataccaagaattagaagtagaatttagaaatacgagactgatcagtattgttgggactgatgggatccgtcccatcattgtgtgttctttattactgcagccggattaacagtcatgtttatgataggtggttgctgacaaaaaggataaatatttcaaagaggacagatacctccatcagtaaacatttgctcctatcctgggtcttggttgttaattttggttatgtgactgacttgagcttgtggaataaagtgaagcaggctaacaaatcatcagaaagagcccaaagagaataaaaagagaaatagaggagggtaaattttcatttggcattcatttccccaaagatgtagtcatacagcaaacattacaagattgacagttgggtaatagatgcataacatgtccaaacagttaagctattcttcaattaacacccagccctgtaatgccatctggtctattggggtttaagaagaatgtaggaaatttggctcaagtctagaggaactgtagagataacaataatttatgaattgatctatctgaagagctttgtggggttggccttatttacctaaataagagcagctagaagaatattcttctgatgtatgtgaaagtgaaagttattcagtcctgtctgactctttgtgaccctgtgggcggtagcccacccagatcctctgtccatggaattctccaagcaaggatactggagtgggttactgtttccttctccaggacatattcccgccccagggatagaacccaggtcttctgcattgcaggcagattctttaccatttgagccaccagtgtatagggttggttttacctgagaaggtaactggtgcctttgcattttaaccaggaagtgaaaaaaaggaaaaggttgacatttaggtgtgtttaaattaagttagatctgcaagagaatttcgctaacttctcaggttttgtagtggtgacccagaattgtttccaagttgtggagtacatctccgaaagagatttaatttttaactttttaagtggaagagaaactagttctcttacaggaggtcatgtattattctccctggaggcagggagtctgaacctttctgggaatctgtttctgcatgttgaaggagaacgtaggctctcacacagcattttcagatcactggatgaggtaatgaaggtgatgataccctctggtctggttccatctccttgctatcctgggaaggccatgatctactcagtctgaatgggtagcacatgggttctatcacagagagctgtaaagagtgtttgagaacttgactttcccagggaaatggaaggtccactttcccaattaatttgtaagctggatatggtagagatcatttgagggttcttaaggggttcctttctctgtgtattttaatgttggggggttaatgtaaaggcctcttaaattaagctgaagctcagaattcctctgcacatctcaaatatacatgtacaatatctttcttctctatttaaaataagattcaaaattaacaaggaaagggcaaatt

SEQ ID NO: 34496 - DNA, 1761 bp, Bovine  19866881037016
aatttgagcttgcagcaaagggaagtaacctgtggcttataaataatggcaacagctttatggaaacacctaaaaatcaccagaggctcataataagaaagttctccatctccaggtgcaaaaacatgctggtgattacttgttgagcaagaccttgtcagcttttttattacaatacattacttgggtaatagttttaaaattatttatagaaagaaatggagctatgtagagaattccatcatttaatatgttgtctgtgaatctcattagcctttttagcctagggttaggaagaaaaatagagagttggctgtattttgaagatggagctctatatacactttttgtctgggggcttgttgaccttctgttaagttgcttctttgtgaatctttctgtgttacagctctggtttccatggtatttacataaacctagcaatagtttgctatttagaagtggtggcaggagctatgatctcctcatccaaggactcggagcaggataggatgccggctctgcaggccatacgtagaaaatgtctcttccaggtaacttatgagcatataaggattgtgggggagcagcggggacgccagcgccacaaggcgtgtgggtggcctctcccctgtctcccagtgacagaggcaggcccagtgttctgtgttttggaaacccatcctgagtgttctcccatacagcagcacagcagagtctggatgtcagcagcactggggttctggcttcattgttgccctggccatgttctgtagttcttggcagaatcccatcctgggagtgggttactgtggagaatacagctctgtcctttccatggtctgtgctacatgctgaccccacagctggctgcctgagcaggccttgaactcagcttcagctgacacatcccaaatcctcctactaaatggagggctagcttcctgtatccaaggatgttagtgaagtcagatcaaggttgaaattggaatccagggagggaatcatatatcaattatcattgtccagtgtaacatgtctactagccccaggccaggtactaagagaaagccctgctgtggaggcaactggacctgagatcaaatacgggccctggaatgctgtgtttagtcctttgtagttcacaacaaggcataaaactggggggaaatctactttaaaaggattcattagaagcaaacacagtagaaggcagaaagaggtaacttggagcacagtgactgtgggtaaagaagcctctgtaagcctcagtgactttgcctgtagactgggaataatggtatgcacctcctaggtttctgaaagggtttactgagttaatggaactaaagtgctcagagctgtgcctggcacctgggtagctagtggtgggtaaatgtggaggctcactagggcccagtgagtggaagagccagggtctgaacccagggaatctggttgcagaactgctgccttacttctgtgatatgatgctgcccagggcctggtagacccagatgtcttgaactggagttgtgaacaatggctcaaatcatgccagacagagaagagggacctttgatctgggggggtgacagcatagtgtaggggagcatgactgtaggcgccttccttgggagcagcctcattcttgtctttgcacacccatttaatttacagacattgacagacacctgtatattttcagtgcaggcactgggcataaagggaacagacatggataagacagttcctccctca

SEQ ID NO: 34497 - DNA, 1455 bp, Bovine  19866881085196
atctcctgctgtaatttgttacttctttgtttttattggtgtgtatatatatatatatatatgaatgaattggtgtgtgtatatatatatatatatatatatatatatataaatgaagtatggttgattgttagttaatctttctatgcatagaaaataacacaagtatctgctcactctcctatctgtaaaagacttcaatagttcctcttctctaatcccatcttcacctgaattttccaactttaagaaaaaccttatggaggaaatttagagtttaaactcctgtgctttgtttttttattagtacagtatgtacttttaatttatgtggacaacttaaagaggagatgatactctattttagcctcttaccacctgcctacatgcccagacacagacaaacctcaactgtgcttaaatagtgccagtggcgagagaaccaattgactttcacgtctatggggttgcacagagtcggatatgactgaagcgacttagcagcagcagcagcagtcccatgtgataacagtcccacaatcactctcctttgacaagctaaaggttttcttgctgcctttacccttgagtgatttcttaggccaatgaggccaaagaacagctctcaggaagagaatggggtgggtgaagaccaagtagagggagagtcacgtcagagactacggactgaagaaagaaagaagatttgctgtctttgactcgaggctgggctgggcttcttgctaagttgctaaaaaggaaggaccccttgaaaaaggcttaaggaatggggtgagtaggctccataaaagttgtagacatttttactgtaacttcaactgcttggcaggttgcagcacagatggggaaatggggcagagagccttctactgtccatggctttccctggatatccatagggtacccatagctaggtgaaggggagacatgcacaattgtttatgccatggcaaaggaatcagcatttgacctgtgtgtcctggcggttgctggactgtgctaactgatggggaagaggatgggctgaggttgcagggatcactcctctgtattggctgcaaaagtcccatccacttttctgcagtcctatcttgggtcgatgccctacttactgttccaattattggactttgtccctaacttcctgccactgatactgttccttgaattgaggtggttttctcatggctggactcttcactcactgatctcaagacctcctggaaggttcatgccatagtggtcaaagaccgtgttgacattgggtctgacaggcggtcagtgctaacttacccttgcttaacagtctctccttacccctaaagggtgagcatgtattttatatatttcacctctcaatgagattttaacgtttatctttagagtcatttacacatattaatctttatacccgcaaatattctttccatatta

SEQ ID NO: 34498 - DNA, 1005 bp, Bovine  19866881101846
cttgaagtaaaatccttattttgaaaatacctttgaaatcctaaagaaatagcaaaccacagtattgtggtattccaaagtaatatctcttgtttataaccatataaatttagcccctggcactacagggcttatataatagaatagagttattttaacagcgccctgttaaagaagaagcaaaatgttcagctcattttctccggtgggagggacacatggcctcatgcgagagagcgaacatgcctaagtcattaccgcgggaaagccatccgtcaaagccgggtcgctctggcatggccaacaccactggcgagatcacagaggcagcctctgcttgcaattaccagggaaggaccttggctctaggcagcctgctatcaattactaccctggcctcgccgcttggacttgtcaatttcccagtgtcttctgttttgtagcagtaagaaaaagggctcctcctgactgattcttggaagtttctcatgtgttgtgtcactcctcggtgtcattaacaattcaattaaaatttcacagcacacaggcaggcagcgccggacagggggcgggaaggagccctggcttcggagatttccgaagggcctgcaacagggccacgtcggatcaggcgaatccaatcttgaaatgtctttgacttcacaagtcaggcttgcatgtgtctcccatctgatgcgatgctggctgtcatgttggcaagatgacatgtttgatgttctcaccccgctgggggtgcagggatgggaaggaatttcaggctggctggaaacaaaaatctcacatattacttcactgaaagttttggctctgtaatggataattataaatattcataatcagctctattaatctacagtgagttctagaaagttctttttctccatttttttttccactggggcctcctattctcttgctttccagagtagagctgtctctaagaatttagagacagtataaatcacaattaaattcttcaggaag

SEQ ID NO: 34499 - DNA, 720 bp, Bovine  19866881119072
tgatgccctgcctttgatatatgacacatcacccacagcagcttttcatcaagtgaattaacctggaaaaatgcaaacccacctgccagttgcttccaaactttgcacaattcctttgtgtacttcctctctagcgtgcatcaggcaggaaagcagcaagggcaagctcaagaaatatggaaaattaagagaatctaaaccgggggctctgggaaatagttcactggctggagtcggctgcttttgcataagcactttcagaagaggtttaagtgaaaagcgccagcttaagccacactttagaatgctttgcacctgagctggaaattgccatttttccccagtcattttccccctgtgtggctggaataatgaccagagccttggcagtcgctgatgacatggttacagaaactatttggtgatttctaatcaataatcaagatgggctgaggaggagcctagagcaggaaggagtaagcagactgaagaaagagaggaagaaaatgagaggttaaaccaggcaggagcgaaactgaagaagaggagggaaagcaaggctgaaatgaatctggattcttctgccagcccctcgcacaacaactctatgaagccagattcattaacatttggtttcagaaggctccaaattactatgaaagagtaaaggtagagagcaactttgatacctcacagtaattctcagtctacatgttcaag

SEQ ID NO: 34500 - DNA, 1344 bp, Bovine  19866881162290
ttaaaactcccttggagaagatgagtttgttttcttatgcccattctattattgaaaatcctctcaaagtaggagtctgtattcagcttaattgactggtcctcaggttagttaaggatagtgtgttgacttccgagttcagagtcattagttatcagcatttggaccatctctctcactcctgtgctgtcagtccatgtggctaattaattatggcatcttttcctgttgagccaaagctgtgcctctgaatccttctcattacagcctgccatgaccaggggggtagagttggttcctcagataaaaacctatttactcaccctggcttattgtttgaagaccttggaagatgaagacagtgtaatctaggagaaataggtgcccacctgaaagaccttccagtctagagaaatggtccaaggagcatgagcaaccatggtggtggggggcagtcactgtgggcaggaattagtttggattttcatcaagatgtttcaaattatgggcctgttttaactgtgctgtctcatattgtgggtacagagaatgctgtggaagataggttgaagtgatttaagatgtttgacttttcaacaaatacgtgtttgaaagtccatagtattttgcataatcacttcgtgtgggctctgatatgaggctgtttgtaatttacagcatgcgtgacattagtcttcaaacttaatagtttcaaagccatccaagatttgggaatttcatttaatgccatggataactctgctctgagcatctttttttttttttttaatatcatagagggcatttattcatttacacagaatgtttctttagttctgatcatttctacaaatgtgcacacagaaataagtcaaatatgtgtctcaaactgaatcctccagaaatttaggttcatatttgactctataattatatctctaaaactcccatcaactcctcaggtcaacatatccttctgcagtcctgcaccatggctgagtcacctttgcttttctcatcacactaagctgatatctgaaaccaggtgtgtgttttcccatcataatgtgcttatgtcctagatttcagttttcaagtgtccagaataaagcttttgatagaagcaaccaactaggcagggtattacaatattatgtattgggactcaggtgctctgagcatctttgaagaccaggcttagagtgggtagagatgggaataattttgtatttggtggcacagagacagaaacagtttttatatgggtatatacatattagaaacatagcgtatgtgtaatttctgtgtattttaggaggaatttattactctacatgtgcccta

SEQ ID NO: 34501 - DNA, 649 bp, Bovine  19866881224067
taactaaatcacctggcagccaatttctgagagttaaaccacaaacccggaaaatggtggagtgtgttgaaataatgtaaaggaaacccataaattcaaactttatgttctgtaaagaacaaatatgaaaaaggcatcaaaataatgaaagattgtttatgtattctggcatgaaatgggaacgtgttatgagagagagcagtggtggagacagatcgacggagctgacagtgtggtattcatcctgcgccgcgcagcagacgtcccgctagtggcaggagacagcgcaataaatcaagggctctcgaagctgtacctacagcttattacatccaagatgacaaataaataataatccctgtcagagcggccctttgctcaaggattgagcctgaaacctttggctcatcactcctcatcttaagtgaaaacactagaactagggaattggaggccacgctttgctaagctcatgaaacacaaagcgagcgggacctgggaactaagactgaacaagaaaggtcaagaaagagggaaggataaacatttaaataatcctgaccaagagggggcaaagcgtctgaatgaatgtggtaggttaacacatcctaatcatcggggcaaggaaaaaaaaaatccagaaaatgat

SEQ ID NO: 34502 - DNA, 1454 bp, Bovine  19866881288956
tctattctgtctcccaaggttgaatcctgttttagggacattttaaggctgtggctctcccctggtcacacacagaattaatcaggcaaacataataacagtttgtaggtaaaagtagcttctacaattctgctgactcgtcttagacattcctttggatttcccagtatccatgtggttgagtatacatccacaactaagtgatgtcccaggcctattttatgttcactgagcctatagttctggccaaaatgagaccacagactgacctacaggaaaacgatacagatgattgataaagctgaaagagaaaatgcatgtttaatcacttaacattggcaacattcctttgccaccaggtgaatgttagaaagttaaaaacttatgcttcaactggaaagtgtagcaatttttataagaagaaaatgcttgattgcatggaggtctgcatggagactgctcaagaagtcggtcttgatttggccctgatagcctagacttaaagacaaggggaaaagaaacagccattcttcgtgattatttccactgcacttatcaaagcaataaaataatgattactattgatgatggtcttatcactgattaaacaggccaatcaaacaggctaatttaactgcttctgtgaagacacacaattcttaagtgtatgtcatggtgtcagtaaagagtgtgaggcgtccccaagccttatggacaggatgtgcaatggcattgatttagagcttttagattgcaaccttccctctctccggagccatactccactggagacttcctctgttctttttaaatgcggccctgagctggaacaaagcaagaagcccagcaagaatcacaggggttgcctcacagagaggattaaaatgtcctttatgagctaagattcaagtcaagaagaaggaaaagaagacagaccataaaaagaaaacaggctgcaggcaggaaaatattgattcaaagaaactgtaaacaccacagcatccaaactccttgccctgctctgtatggtctgagtctggccaacctcctgactttgtaatctaccctttctccacggctgttagtgcttcacccacatgttggctttctgatataagacactggtcctgcagtgggtgttcacatctgcctttcttctacccgaccctcatcctcaccaagccacttatcttttaggcctcagctcaaatgttctctcctcagagagcccttctgtgacatcctagctaaagtacccctctccctgtctggacacttgtcatcacattgctgcaacacattttgtctgaggtactacccaatactagcttgatctgctcgcatgtttttgcccgactgtacctattaagagtaaccacacaagaccaggaactgccctcctcaatgctgtatccccagcatccagaataagcactccacagagtagatgctct

SEQ ID NO: 34503 - DNA, 940 bp, Bovine  19866881294994
aatccttaaatgaccgaaatattttcttcctcactattcagtgaatatgggtcagcctaataaggttggtttatatccaggagaggaaacagcactccttggtccaatatacagttttaataaactttattaaattttcattgatccatatgcaaaaataattcatttacaatttgaactcagccttctaaatggtgcctaactcaataaaggaagaggctgagaaacagcagctgtatggctattaacacattatgccattaaaaacattaaacagttgggtttggtgaaggaatcaaagttaaccccttgaatatctctaaactggagattaatcttggaagacattttgtagcgaagggaaaccagagtcttggggaaaagattctatcatctgaatgaaccctagtggaaacccagcctatggctttgctgtacaatcttctaggagcctcctttaaatgggcagtctgagattcctgcagggaggatgaggggctggtagagttaagaaggatatcatcataaaagtaaactagtagcttatttgacacattaacatgatttatatggcacagtatacttctggtatataaataaattgcttagttttgaccttgtactaatgaagccagggtcagggtacactcctttttagctcctgggttctcttttgtgattatatctgcagtacaatcagtaagccaataacaagtattaatagagtactaagtaaggctaagaccctaattccaaattatatataattcagagacatgaaaatttgaaaattattaagcactatactatgcaattccaaagatatgtatgggcctgaagaaaagagatgagtgaaggttaacaaagataggaatttaggaacaaagtgggactgagctgtgtttttggaagaaggtggggggtcaataagtaaaaggag

SEQ ID NO: 34504 - DNA, 848 bp, Bovine  19866881314240
aataaggcttttaaaaaatgacaataaaactcaagttcccactgcagcctgggcagcctcagcattaccaatggttaatctagccgtataaccctgggatttgagcatctacatcatgttagtattcaaatatcccagcacccttcagcttagttcaataaacaagtacgtttgcactgaaataaccagagttcccttgtttctcattttaaagtcattttaatatgttctagacacaagataatggatcacatttaaacatgagaaaattaagtcccatcagcaagtaataatacccaatcatattcaatcatgttgaacaacaacctctactaaaatcatcttctcctaggtgaggttaagaaaataacaacaacaattaaaaaaaaagctattacgttactttcagaaagatccaactttaaaatacttctgtgttatttcccataaggcaatacagtttcttgtgttcatgcctcccagacctctgcatactgtgaccagatgtcctctctcttgatgcttagtgaattccctcatttttcaaatttcaacttatcaagtctatctagatacccctttctctgctctccaaccccctgaacttccctggttctagtcctaaacgactttattcctctagaggattacaagcttcatgagagcaggaactgataggtttcttagatgctaaaccccaggacccaagtctctggtgcataaatattgttgaatatgttattcctttgactttaatgttttctgtatcactcaactcctggaagaaaagctatgacaaacctagacagtgtattagaaagcagatacattacttgccaacaaacatc

SEQ ID NO: 34505 - DNA, 1173 bp, Bovine  19866881406483
tgcctggaaatatcgacgccttccttttgattcagatgctccattcacatctatccttatatgtctcactgtgatacattttctttttaaaagatcctgtagtcctgtatgaaatacagactgtgcatcttaggtaaaccatacttctttctgaccaaccatgacctcatcagtgaattcatccaagaatgactcagattaatacctgtactttctccaacccctacttcaagcccctagctcactaagcctctgtacctgactgctaaatgggctccctggttcaatttacagataagaaaactgaggtccatacgggctaaataataagacccttggcctcatagaaaatgtccttcaaccagcactggaggaaataggttcttaagtccctgaagggcatttgtgaagagcatcaccagaaaggcagtgcaagaggaggggagtgtgttttacacccagagttctctccttaccacaagccagcgttacctcctgtcagcctcctacactcccccagccttcctgtctgcagctggcaagaccctccatccactcccctcagagcatgctatccacacacagggaccattcaactcaggcatggagaagatggccttctcaacccttactccaaacccaagaaactcaaactagccaaaacaaaggacaagatttttttttttcttaaaccatatatccttcctactcatgatgggtttctacctgcctcaattcgatgaatcatctcctcctaaaacacacacatcccaacagtaagcccctcccagagctagccccagggctacagtcctggggagcaagagcgggcacatcctggggcttcgaacatgaggagacgggaagtcagagtggagggatcctcagctggggctgagaggaaaataatcgaacccttgcaaattgcaaagcacaagatgccagaagagatccctcactgtcacagctgcttaccatagaaatctctcctcctttggggatgacatcagcagacctgcttttttgtcaccagtcactccgcacttgctttaattatgcagcacaccaacagaaattttctttctgatcacataaatcacatcgccctgacactgggctcaataggcacggctggaacaatgtggggagagctatcgactccatcgctcaagt

SEQ ID NO: 34506 - DNA, 1197 bp, Bovine  19866881423782
aattgtatagatgagaaaactgaggcttagaaagattaagagactggtccaaagggcttacaaggtatttgttgtacagctggtgtattagcttcctaggggtgttacaccaaataaccatgaacctggtgtcttaaacaacagaaatgtattctctcatagttctgcagggcagaagtctgaaatcaaggtgtcagcaagcctgagttccttccagatgctcacaaggagatttcttgcttccatctcccagcttctggtgacttcaggtggtcttggcttgtagctgcctaacttcaatctctggccctgtcttcacctgaactcctcttgtccatctatctttcctctatttgtctatattcataacacaccaggatagtccaggatgatttaatttcaggatcctttattatatctgcaaaaactttttttcccaattaggtcacgttcatagtttccctcggttagaatgaggatatacctttgtttgcttggtttggtagggggaccactactcagcctcctacatctgaatttgaaagtcaagcctttctcacttacagcccatttcctcatggcactgccatgctatttcctgtcttttcttttatctgttttgtcaaggatagctttggccaagataaagatgctgcagtcacagtcacagtatagcaagaacatagcctttcaactgcccagagttatacagcaagttagtgacagtgttgaaaggtaagctcccctcaatcctgccactattctaggaaccaagaagagagctgctcctggaaagatacctttccattgcctctaaacatcaaaacaattgactcttttataaagttctgctctcctttgcaggagtaaaagagctatcaggtgtcaacttaacctatagccaccccctaataagtttaagataaaaggccaatacattcaaataagattcagacataatgtgatagtatttgttaccaaaccccatctaattatatcagtcaatcttttattaccagacccacaagtgcagggaactctattataatctctctttataatgatctcctctctagctgactcctggaactctataataaattaatcatctgctcacaatcatgagtaaacatcaactcaattaagaattgataaataaacagtttgctccaacgcttgtcctgatacggaggggga

SEQ ID NO: 34507 - DNA, 930 bp, Bovine  19866881431758
acttccttttcctctctggaaattgtatttcatgcggtgtatttctgatccaagtgttacatcaatcagcagttcagtgtaggtttgtggttctcctggagcgttttacaagcagggatggagtttcttatgctggtctgcttgactctcttggttggactcttggaaaaatactcaaagtgcagtttccttccatctattatgatttctttttagttgctattggaattattgctttttctaaggcattatcctaatagaggcattcctttctgggctgtatttgacctgtgggtgagattgggaatctgtttattctcatggttattgtaaagttaaggctttcagaaaactgagaaaaataggagcctttgaaatgtgatccccttggccaatgacttccctgttgctgaatggatgctggatgcaggcttagcttgtgcctttccttctaaggtggtttgtttttgagagaagtcccccaacccctgcctcctacagtggtcagttcttcatgttttggatgtcaaagaaagaaagaagacattttaagttacgaatagtggtgtaaatattgatgacgaagaaggagaagggagaccttggacttgggcatcgtgccaggctgttgtctgttgtctgaatgtgtaacaagcatgtgactgtgatgtgccagatcacagaagccagggctggcaatcgcagtgactaatatggtatttgttgaccgaaagtccacctaagagttagaatctgaggtcatgagctaatctcgctgaaagaaaggagactttggagtctgggatttgcaattttttttaacaaattttttttttaaaggaagataaaattgcttccattctccaaataataatattgagctgatactttcttatattgggtccaaagaaggaaattaaaatttttttt

SEQ ID NO: 34508 - DNA, 1784 bp, Bovine  19866881509453
cagctgcttctgtctttgctcatggttcactgatttacatatactcagttaaattatgtttacaaatactcacgagaaaagctggcataaagcagttgagagtaaacacaattgcttcttggtgagagcaaaaatatatggacacagtaggtggaagtggcctcctcactggagtgtggacaccagttagtatatctcatggagggaaggaagaagatggggaaggtgaaaaaaatggaggaagttggataggttttggggggaggagtaaagacagcttcttctactaaacatgaaataacttgcatgtctctagaaggagtaacatacattcttgacattgttttttaagtgattactccatcccccaaccaaaaataaatacataaactaataaaggcatgacatggttctcaatccataggacagagttaaggcaaaatggcagacccatcccctgtagcaacacctaagcttgccaaacttggaggcagttgccctcaaacttggaaacaaagtaccctaaagactgatttgagcttgagaaagttaaaattgaccaggtggaggaatctactatggtcacttgtaattattctgttcctgctggcaaagtgcatctgaaacagtacaccattcagggtaagtgttttgatcaattactttcgctggtaggttagcaccttcataggttactctggctgattcattaccctcattgtggcagagagaagcatttcaaagcaccaattaataagtcagacaagcttgagtttgaatcccagctctgcctgactgccttgctttgagcaaattatttaactgctgtgagctgtggttttctcaagatgaaatggaaatgacagaacctatgtttacagaagtgtggtggggactaaatgtggtcacacatataaagcacttattagagagcatttggcacatagtaagccctgcagaaatggtagctggcccttaaggacataaggacgttctgatttggtaggagtggaaattggtgacctgggatgttgtccagaccccaaggcatggaataaatgagagtctggggtgatcgggggcatcataaagatgctgcgtatgaaaggagaaagtaggtacacagagaccctaggatggtcttggcccacctgatgattctgctcaatattgatccaggaggcttaggtagtctgatacttgttaccaaaacagtccaagtgtctacctggaggaatgtgaaattcccagaataccccagaggtcattcttcatgagatcacctgtattttcatttagttataaaagtatgggttgagtgcctattttgtatcatgtgctgaggacatagggttgcaaacaaggacttgaagatcctcaggagtttatggtcaacaaaagcacatggatatttacattttcttattctactgtaatttatcaggaagtcaatacacagaagatagggtctctaatcataccagggggaaaggcagacttttccccaggaaagatgaaatgtgaacaagattgcaaagggtgagtttgataattgaggagagaaagacaagcatttcaggcagtgggaagagcacatgcaaatacagagagccctgaaaggttctaacaagtcagtcagggagcagtgagaaagtcagggtgactgggatgggtggtatccagcaggtgagaccgaaggggtaatctgaggtgtcccactactaagtccagttcctagagattaaatactttcttctagactatcaacaataaaatcaagaaaa

SEQ ID NO: 34509 - DNA, 2297 bp, Bovine  19866881520696
cagattggcatgtctttggattagtggaggcactgaagcaaaatgctcaatccttagtgacctttggcaagtggaggggggtgtgtaaccattgtgggttatctttatgtttgctctatagacactcaacctctgccaggccaagacagaagctgtcagggcagataaacctagtagggagtgggctgttttccttactgcatcacagtgcctggcagagctattttgtctgataacctgcttcttctttaaacttgcctgtgaatagttccatgaaacattaaaccttccttcttaggttctgagccttctaggttctgttgtaatcttgggcctaggactttctttttcatacaatgtgcattcagttgtcctctgttagagtattctgacaaatacttggaaatccatgggagaagccgtatctggctgttgcaggcacatgtcctgtgtgtgtgtgtgtgtgtgtgtgtgtgtgtgtgtgtgtgtgtatgtatgtatgttccttttgtttgtccaggaagcattctgtggaagtggggtcccctttgatcatttctttctgagctcattatcgcttgtctctagttggcacttacttcgtatgttgatttagaatttcacaagcactcagagaaaaaaatttgggcaaatatccttaatatttggagtagagctcatatttcatttttctctttttgtcaagcagcagtgactccagcccagggatgttggttcaggagactggctttgtgactttgggcaagttgcttcacttgtctgagctcagatttgctcctctttaaaatcagatagtcacatcagacgattgcttagacctgttccagctttaatggactccagggtttcttagccaagaataggactgaagcagagtgtattttaggggaagtgggtgaagtgttgggctcttctttcattcctattccaggtgaagataaaagactttgctctctattgagctgacatgaattcagaattcattagtgttcagactttcttttaagcttcagacaggattgtgaaggaaaaagcctgccctcgattcctttgccttattagttcttctcatataatgtatggcagaaaaaactgctaattgtcacttgaggtgatgagtgagggtctggtttcttgaaggaagttttgaatttatcagttcctgtctcctcttacttaggtagaggtctagtcaggtctaataggagaggactctaaattaaatctaaactaaaattaattcacatgtccctctttgccgaagaagaaatggggagtccaggagaattgtagggtaagtatatatatggagttgtgtacagatccaaatgtaataatgaaaataaaaatttgggggtgttagagtgtctgtgggttccccttgcacgagctgtgactgggagaatgtaaatatacacaagcacatatacttcactaaggagccatttagacataatttcaatttattacagactctcattgctgaccttttaaaggctagttttatttagttttagtttataacctaagtacttgatacttgtgtgtgaaaattcactccttgtatcttgagcccaggatcttatattggtgcatcaacctcacagtgcattaggcttaaaatataaatggtgttttataaaatgccattagcattcatttccagagaaggcaatggcaacctactctagtactcttgcctggaaaatcccatggacggaggagcctggtaggctgcagtccatggggccgctatgagtcagacatgactgagcgacttcactttcacttttcactttcacgcattggagaaggcaatggcaacccactccagtgttcttgcctggagaatcctagggacggggaagcctggtgggctgctgattattggaaaagactctgttgctgggagggattgggggcaggaggagaaggggacgacagaggataagatggctggatggcatcactgactcgatggacatgagtctgaatgaactctgggacttggtgatggacagggaggcctggcgtgctgcgattcatggggtcgcaaagagtcggacacaactgagcaactgaactgaactgaactgaactgaagcgacttagtagcagcagcaacagcgttcttttctgaatccttggtgtctgctgatcttaccgttctgtcctacctctctccgactcagccttctctctgtctgctgagcagtttgtagttgttgagcatttgccttttcaagtccccaggcgggtcctcagaggaacatttg

SEQ ID NO: 34510 - DNA, 1632 bp, Bovine  19866881577341
aacattcttaccagcaactctttggatttaagtttagacagaaaaacatgattctctttcattttaagccattaaagtctgggaaactttacttcacattactgaacttgggatcaaacaaaacggcctggggtgcatgatgggatttgtttaaagaattgaatctacctcaaaacccaggatatatctttatctgaaaagagacaagagacgcactcccactgacctgccttctcaccccaagatttacatgaaatatgctctcccagctttaacaactcctttccaaaagctcctatggaaggacatcacagctctccagggaagttcccacgaggagctggcttttcttctcttgttagccttctcttgggtgctaaggtcagttggaagttcaaagacattagggttgctatgggcctgtctctcctttcttaagtcctatggaaaccactatctatcatgtgagatcacatttgtcaatgcatcactttcaaggatatctacagcatgttagactctgccagtaaactgcagaagatagtgcctgcatgcaaagtcacttcagctatgtctgattctttgagatcctacagattgtagcccatcaggctcctctgtccatagggattctctaggcaagaatactggagtggattgcagtaccctccttcaggggaatcttcccaattcagggatcacatgtctcttttgtctccgcattggcagggaaggttccactagcaccatgtgggaagatcttcctgacccagggatcgaaccagggtctcccacattgtgggcagattttttaccatctgagccaccagggaagcccccccaaatttcttcaccaagtttggagtaaaacttcttttatataggcattatgtgtatgtgttactcagtcgtgtctgattctttgtgaccccatggactgtagcccactaggctcctctgtccatggagttctccaggtaagaatactggagtgggtagccaggccttcttcaggggatcttcttgacctagggattgaacctgcattggcagatggattctttactgtctgagctaccagggaagcctacagaagatgggatctttcccagtttttctgaatcccccacaatgttcagcactcttctagccaaaggttgctcaaaaacatctatcatattgagaatggcagctcaaggaagatttctatggaaagtaaaagactccttttttttttttttcttgaaaattaatccctagaaatgaccttaagctactccaaccttaggaaacaaataccaggtactgggtttcctaggtggttttaaagatatacaaaagggatagagcctaatggtgaaagagcctgtgtctagagtttgggattagtcctagtttttctgcattccagctgaataatattggatgtgtgacatagtttttatggcctaaccttcctcatctattaaatatctatttgaaaattacatttgatttcctcacaggggctagaaagttcaaagaaggtaaacacaaagaacttgcaacactaatgtctggaaccaatgaaggaaataagagtgggagagacgggtggatggtccatggatggattggtggacaggaatatgg

SEQ ID NO: 34511 - DNA, 780 bp, Bovine  19866881794159
tgtgtctacaaggtggagttaatgactttctatcctgtgtgcttctccacaccttcaataggaaactaaattgacactgaccaaagggaagcagatcaattggatgcaactctgtttcctaagtaagatcttctcaggtttgcctgtggttggcaacagtgtatttctacggccaaagtcaacctcctaggttagataatttaatggaaagaagcatgagtgaaagcccctaggaactccaagctaacttgggtaccactgtaaaaatcattccatcacccatattagcaatggctaataaataaccacacactgaaacctcaccatactggatatttgaaatctgatgctgccaaagaaaccattttatactgagctacttttgccatttccaagagggactgtctctaaaacagatccactgtatactcaacactgccctccaatataaagttgggtttgtggttccagttggcttgatttggcttctcggggtgatataagagaaggggaccccattcagagaggttatccctgtccttgggcacccatgttaattcagtagcctcactgggtagtagaaagtaactttatttataaccccaaaagcaataataaacacagaactatgatttactctgaaccttcctattattaaaacactttgtcttatagttttattgatttacaatctgtcctacttacttttttagcatctgaaaacaatcaaggcacaaagctgcaaaatgtttggacattaattgttaggaggcagcattt

SEQ ID NO: 34512 - DNA, 753 bp, Bovine  19866881824628
taaagcactcaaatacagttggtccatgtaaaatgctcagaacaatgcttatgtatggcaagagctcaacacgccactaaccgccatcagcatgagtatcactaccatcttggaaaggtctttcccactcaagctttactccatgtaccaatgataccaccatcactattgaggtcccagtgtttgcatagcttccagcactgagagtaactatatcatccttacacaggcttatcctgaccaaacctataaatgagtaaacctccatgaatgagatcacttgaaagcaattttgagggcttggtccttcaactctttacataaccagtatataataatggagctttttttgtggtctacaagtcttcaggattattagtgctgctttggttaggaagctgcagtctgatcccctgactagaaatactggcataatttattgcattattactcctctgaactgaaagcaattaattacctggagcaggatgcacaagtgaaaatttatcagaggaaagtgatgaaaaatgtgcccattgctttaaaataataggtgcttaatgggtttttttgtttgctggctaatctcaggcatcttataaacaactccagccctgttatcagctgtgaatccagcccccactccttcttgcccccctctattattctatcatcccatatctctcttgagtacaagaaatgtctaaaacattcacctaaaagcagaagagagactccatgcctcttctgcat

SEQ ID NO: 34513 - DNA, 1304 bp, Bovine  19866880449724
cttatgttttgtattcattcaggtgttgaaatttttctcttgtcattgcagtaccatcttttatgatgctgtcaatctttgggaatgagtgcattgcaaccaaagccaggttctattaggcagaaaagggatggagggtactgagaaactgtgatgtgtttctctggctagaagtggtgcataatgttgtatgcccatttcgtcagcaaaaacagtctcactgtcacatatcactgcaaaggaaattgtgagtcattatgtggcttggctgccatgtgcctggccatagttaacctctgtggaagagggtgagacagcctctaggggacagcctgtttgtccagtcttccagtttacccttcttgggatatgtactaagttcagggaaacaaactttagtttcatagaattgagagtttgagtataggtattctttcactgcttggctatgtcaggattgatgctttaatagtctatcagaggatatctagggctgaatgattttggtattgtttctaacaagtaggaggaagctgggagattaatcacaatgtagatctttaatgaaaacctatacagatggtccctgacttgtgatggttcaatttacaatttttcaactttacaatgttgtgaaagtcatacacatttagtacaaactatactttgaattgtaaattttgatcttttcccaggctagtgatatatagtactatactctcatgatgccaggctcccagtcagccacatgatcataaggggaatcaaccaatacacttactacccttctgtacccagataaccactctttttttcactttcagtacagaattcgataaattgcatgagatattcaacactttattataaaataggtcttttgttagctgctttggcccaaccttaggctaacataagtcttctaagcacatttaaagtaggctgggttaagctttgtttagtaggttaggtgtattcaactcatttctgatttatgatattttaaacttatcatggacatatcaggacataacctcattgtaagttgagaaaactctgcactctgaacccctccttcaagctttggctgtgcacagatgctgccctatgacactcttgtctcttttatcctgtagtcattgcactaggtctgggtatctagatcacctgcatgagtggggtcaggttgcctttgttaaagtcttaactttccccacggctgggcaaagtgattttggttaattatttaaccattgtacttcctttgtttcatgtggaaaaccaggataataaatagttacttc

SEQ ID NO: 34514 - DNA, 2495 bp, Bovine  19866880720552
atggtgatggacagggaggcctggtgtgctgcgattcatgggatcacaaagagtcagacacgactgagcgactgaactgaacctgatatatatatatatatatatatatatatatatatatatttaagtacattatatatttacagaaggaaaatagagttaaaaatctgctatgaacagattattagctttcaataccagataaggttaaaatgtcagataaatcttaaatgaagagagcataaatgtgtattgaaaatacacgatgtctgataaagttaccaactaggttagggaagggaagatgaaaatctcaaatctgaagttttgccttgattcttatccagacctctaaagacagaatgatttgccacacacctgaaaatattctaaaaactgttcctctaattaccaatgggctaattaagagacaggttattggaaaagcttcaactgtaactcaccttcaagaccacaatttacttgcaccatacagccaacattctagagaacttaatgtaatcatagccattaagatagtgggatttacataaaaagtagagccaagttggaaatgattgacttggggtgataaaaaacttaattgaagggcattgcccatttgtcatttcaaacagaacttctggaactctaaaactgaatatgcagaactgactggaggaaattcacaactctcatactagacttgtaggaaagagaggtgtcctttgatatctctacttcccttccttctcttatttaactctttttaaccaacttatttacacaattatgttttatgatagtatctattgaatccctccaaagtaaatttaaatagtcagttttatattttagtctcttctacatgcctcagcaaaaacataaacattttgctttcctctgttcttcccacataaccttatgagcttttttttattatatcaatctttatgattttattgtaattttaaatgcattgtttactaccaagccaagtgaagtaatattatgcttgttttttttatacaatgattgttttgtagtgaatcatgccctatgtggtcatgtacactatatatacttatttctaatttatctctaattatttgatagaattttgaagaaacagatattctattttttgtcttttcttcttgactatgatgcttttctgttgttttcataggttgatttctatgcttttaatattttttctaaatcattccttcatttctctttcagattatattgactttttactggatatcatgtcttcttcttgcctgctattatttttccctattttgtgtaccatataagtacatggaaagtgaagatttttgagaacattcaagtctaaaggcaaaatatttaaaatgactgaacatagaaactaaaatttttcacattatggaatctctataaacaattttgattgacagtcattcaattggcaagttattctaaatcattttacccacatcattagtttactcttctccttaatgagaaataagtcatcctctgtttatagcttaaacctagtttaaattttcctggaggctttaagaacagatggtagtatctgtttaaagttgatatggttattaaagtacagaaatacctaagcactaaacttttaattcagttgacatcaaccctttatgcatctaaaaaaagtctacaaagacttgaaagttatatctacgctaggaaaatgtaaatatcacaaaagtacaaaaaagaaggaaagacaaaagttgatagtgcatactttatctaagaccaaaaattgttgactcagtttgattcactgaaatgagcagaggtgcacagctggctgcagtccatggggtcgcaaaatcagacatgagttagtgactgagcctgcagcatgcacctctcatattccagcaattcttcctttctagtaatttcctttcttttttttttttttctttctttttcgtctcctttacatcagacatgtttgccatcagtggcttccgttgttctttgacttacttttagcatatacaaccaaaagcgccatcaacactaactgggttatgtgtaggcttatgaatctccattaaactctgcatagtaaaggtacagaaaagaaaatcaggaatgcactggtctactttattattagatacatttgatagttaattgtatgggtcaacttggctgggccatggtaaccaaaacatttggttgaataccagattggatattattgtgaaggaatttttaagatgatattaacattacatcagtcaactttgaataaagccaagtaccctccattatgtgagtaggtctcctccaaatagttgaaggccttaagagaaaacagactgagatccttcaaggaagagggaattctgtcttcagattgccattggactcaggatataacatcaaatcttgcctgtgtctccagcctgttggtctcccggcagatttggaagagatagctttcacag

SEQ ID NO: 34515 - DNA, 1460 bp, Bovine  19866881001652
taccccatggattgtagcccgccaggttcctctgtctatgggatttttcaggcaaggatactggaatgggttgccatttcctcctccagggaatcttactaattcaacaagtgaacccacatctcctatgtctcctgcattacaggtgaattctttaccactgatccatcagggaagccctcatatcaatacatgtgggtcaatataaatgttgaaggctttgaggaagtacatgtcaccatttttgagtggaattattaatttgatactcaaaatgtgtataaagtatatacatttttgacccacaaatgtaataatagcatcttataacatatgacttcgaatgaaaaccaattcatatatgcttagtatttctttaatattcctggggactagtaaaaggtacctaaaaccacttaaactttgaagttttatttactgtttaccatcagactcttctttggacctcagtctagcctctaacttttttggtgtcctagccatttgcttcaataacatcattatccattactgcctatcttcttccttaatcttatccaggtatatctttgtaacctccattatattaacattggtttttttcatcataagttttctgctacttataaattttacctcagatgtactttaatagaaggaaagttggaaaacacagctgggaaacaggaagccatgtgttgctggccaatttttttctataggtgattagagctaacagcatggcataaatgtcttctctataagataattggatagaaacattttttgatcctcaactgaaggaactggagcagaaaagatgaagtggttccttttcatgccaaatcaagatgatctatagctgagtcaataacagaattgctggtatataacctatgtgcccaaggcaacttctgacccataagaaaagtttcagcttggtctctgactcttacaataaagctagacataaggtttgttgaaattatacaattgacctgtttaaaataggaagtgatcttataaatcagtcattttaatctatgtatgtggtacataaatttaataaatttattctagataatcattgaacattaactaagaggagcttaaatcaaagaaaaaaagcagctattaatatttgattcttaatgtagggttctttcaattttcaaatattttgctgcataaaatgtataattaatattatcatgtaaacagagattgtttcctctgtaaacttgcccctttagtaaagtgaaagtgaaagtcattcagttgtgcccgactctttgctacccaatggactgtatagtctgtattcctcaggccagaatcctggagagggtagcctttcctttcttcagggggtcatcccaaccgagagactgaacccaggtctcccgcattgaaggggatttttaaccagcgatccacaaaggaagccgaagaatccagag

SEQ ID NO: 34516 - DNA, 550 bp, Bovine  19866881184249
ggtgagggttcaatccctggtcagggaactgagattccacatgctgtgaggcacagccaaaaagtagaaaaatgaaataaaaaaggtttgttatttctctaaaacaggcccactcatagcttactaacagtaaacactactactgcttttcttcctcagatgtgattttatctatttaaaaatacatataaactacatgaaatatatgagaaatgtagtttcttctagggaaaattctaaaacttgtttcttgcattggaactttaaatgggtaccaagtgatattcaatattctgtgatattattataaatgataatctaaaagatacagtgaaattgaattttgacctcttattcacctctggataaaaatgataaaagactatggggaccagggaatttaaactgaaggaaaaatcaataaaattaagtagattttcctcagtagcctggagtgtatctttatgccagtgctaaactgcatttaagatctttttttttttctttatgctttcacaaaaagcttttaaccttattatagaaattaaaa

SEQ ID NO: 34517 - DNA, 885 bp, Bovine  19866881473465
aaaaataaaaaaataaaatgttaaaattcgggaattgtcaaaatataatagggcattgaattcagaattgttttcactttggtatcactcataatagaaaagtaatatctaagttttcatctgagctttctttctataggtattttgactcagagtatttaaaaggttagcaatttacagatcttatggaataattcagatatttttctgcattttaaatggtagatctgccttaagtcagatggataatgactgattcaagccatatttctccatgaacatcataggtatgaaatcataatgttcactgtattttagaggaaaagcctcaagacagaaggaaatcatttaatactttaaaatatatgttaaagaaacaagataattttattcttcattaacttactcttttaagctatccttcagttacaagtaacaaattaaatcagtataagttaatgacaaatgttggtgtttgtaacaacatatttgagtcaaactataacactatgtacctgcggaaggggctttactcctttgagcatcagttatcatgtttgagagaaagagcgagagagagcaagagaaagagcctttatactgtttttgaaggttatatgagataatgaatataacgacctgtaataaatatacagttaagttgtagatggctttaaaaagtgcataatagatgataatatttggacatttgcctactcttgctattaattactggcataggacttaagtgtttattcaaacaaggcaaaaagccaaaccttctcaaatgacttttttctcagccttagattggcatattgctgcacactaacaccttgaaatcttcacctcttggtaattagatttaaaattttaggtaaggaa

SEQ ID NO: 34518 - DNA, 1161 bp, Bovine  19866881574770
tatagcagaaccgcactgctttctgtatgcattggtttgagttgaaataaaaatatttctgttaacattgcttaagagccagtttaattctgaagctttaaagtgaatcaatcaccaaatgcaagaaaatatccatgacagctcagaaatacattgagtgctattttgagagaactttaaaataacaaagaaggatggcttttacgataaagggaagcataaatagttctgataaaacatatctgtattcagaggttaaacataaaacaagatcaacaaaatccgacaaacaaaattatagaaaaagaattcatcacagggatgcggacatttggaaatggattactataagaagcaatgaattttaaagcaatcattgtgcataaagtggttaaaaacacgggccctactcagatgggctaggttaagtcaactctacaatttcagagtattatgacctcagacaatttacttaatctcctggcaccatctatgaaataaatacacatatcatatggttgcacagattaaatgagcctttgctcagcataatgtctggcaaatggtaatttctaaataaacatttagtactatcaacagatcagatgatgtatctataaaacaggagctaaaaaatcaaagaagataaatggctaaactatttttataaaaaagatcaagtgaagaggaagatgagtaagattaaacaagagttaaaataaactcgtagcttttggaatattaaagagtagaattaaaattaaggcaacttgcctttgtgatgttttctcaagacagaaaaaagtagggggggtaaaaaggatgagaattgtaagtattacagataataataggagaagtgaaaattagcctgcctaatactacaagatcatagctcgcagtgtttatctgggtgattccagtatacttttcttcccatcaactccatgccaagggcattttttctcttttcaaatgaacaccaaagcaataaaaaattccagaatctgcaagctcaggttctggtaagctttgctataccagaactggagagtaaccagaactagccaacaggggaataaaaaaagccctttgcttagttgctcagtcatgtctgactctttgtgaacacatagactgcagcccaccaggctcctctgt

SEQ ID NO: 34519 - DNA, 698 bp, Bovine  19866881824283
ataattatttgaatgtatttatttactcataagtatttcaataatttaaaatatcagaggtatgtgaggaatctggaaatataaagtgttttaatttgaatatatacatgaactaaactagtcttagtatttgttcattcattttatgctcctttttgtttacaaaattattttgtaaaattttaaaaatcagtatgttttatatataaaaatatttttatattcacaaactaaatttcatattttaaatattaaaatgtataattttttcattttagataagatacaaattttatgtttataacctcacaaaatatttacataatagtgtttcctctgttcacatgaatgacccaattcagtggttccataatttaacattttgtaatagtagccttaatattgtttttctataaattctgagtttgatatttacactctataaagtcaaaaaattttctcaggaggaaactaaagtcaatttgacccttaaatctcattttattcttaaaactctagagattctagttcattatttcttcaattctaatactaatagtattttcctgagtatataaactctccattaatacataaacttgatttgcatttttataatatctttcggccttggccaatctaccattaatatatgcagtaaatctaaatgacagcgatttaaaaattgcaatccctta

SEQ ID NO: 34520 - DNA, 1181 bp, Bovine  19866880496687
acgtggcatttggtctaaaacttgttttctcccctaaatgagatgattactttcaaccataccttgtgctcaggccaaattcctagggcctttgtgtggaaaccttgctgacattgacagatggtattagattcccatagtgttgggctaactggaaaatgttaaggagccatttgaactccaaaagcaaaagtaattaagacaaacattggcgccttcatggtgtgactataggcaggtgccccaaggctgctgctgctgctgctaagttgcttcagtcgtgtccaattctgtgcgatcccatagacggcagcccaccaggctcctccgcccatgggattttccaggcaagagtactagagtgggttgccattgccttctccggccccaaagttaggaggatgtgaatggctgaggtaatcaccagccaatccttccactctccccagggtttcctgtttcttgctgtcctctttccctcttccaccttctcttctgcctctccttagtaagaggggctctcaggatccctaccaagagtcattagtggcagttaacctttttaccatacttgctgaatgcctttcctgagggacatagaggtgagccatccagacatcggtgaacaaaatccttgttgtatcatacctgtggttatgaattgggaagtacatgatgtattgctgccccggacttcgctgaaggaatataccgtgatgttgtacttggtgtcacactctagagcagaaagcgtgcaagctggagccgtgtcattacactcaaccacattgaacccatccacagcctttgtttcataaagttcggcacctcggacgggagaccagacaatctcgactctgtcactggacaccagcacagggttaatgtcactaggacaacagggagctgcaagcaggagtagagagaaggacgtcagtacaggagccatgctgtcagaggggcattgagtcccggcgtctccgtgcccaggagtctctgcagtcactgtaagagtctcctacaggtctgcccaacagtgatcctggcctgacacccactacatagaggatagcttctctctgcatgacattcaaggttataataagcgctaccctgtcgacacatccagctgctccccacaccccctgcctcacctgactccttattctccacccaacgtg

SEQ ID NO: 34521 - DNA, 1878 bp, Bovine  19866880579452
gtccatggttagacattgttttgctaaatcagttagggagctacttgcaagtgaagctgggtttcattatatctttctcactgaccactttagaatagaacattttgattcagaagatctggcgaagtttcctgaagttgtctttgggtacatgtgtccagccatgattgtcatcagcacaccaaactctgaattcaattccctgtttccatgtgcagtctttagagattcagatcacaaatttgagtggagcagaatgcagtttcagacctggtgagttcttaagtgtcttttttgtatgtgactacactggagttttaaaccatatgaaatcttagtatctacggttaccataataagttatttcttactttactccaacaaaattgattcccagaatgcaacttggcatataatcattaaggaactaccatatttgggcatttattttctctgtcgagtgtcgaaagtgtgtgtgggcactgctacctttcatgtgaaggtatcaggagttatctcccagaatggcgtgacagatggtcatgttctggcaaaactgcaaacccaaataggagctgggattatagcccttctggtttctttgtccctgcacgctgttccatattcttatggttactgggaaactcacactgtcattgccttaatgcgctttgcagaaataagcaaagccagtgatatggcctcatgtgatgttgtaggaattgcagtttattttaacttgtaatttttatgttctgtcctaactagaaatggttgttttagtttagaaaatcatcttttctctttgttttgttttttagggctttagatgtggccagtcgctacaattactcggtggagtttactggtgtgggggaaccacccacaggagctgaggatgttggctattgtacccagataggggtcttccggagaaaagcagaagcagctgaactggctgttttggagcatcatggtgaacatgtttatgaagttgtgagtgttctttgtattctcagagcaagttcatttactgggatggtgagataagtccccattagagagaggtgtgaatgacattcttttgaggagaatcccatgccccatgatctcccaaagcatgttacagagatgatctgctggtgtcttggaaatacttccccagcagctgtgcactccacccccatctttatagtctgttaggaaagaggaaaagcagcagcagtttctgtgtagcttgatttaggacatgacttgaaattgagtcttgaagcttgtcagacccattttgtttgaggagatgtgtatggtaaagaatatgttgaagaatgtgtctatatgccaggaatttttgaccctcataactgggacattcacaataggtaaggtttgacatgttcatgtgcttaattatatatacagtttaattctaatgtgctaaaaagttactagtggttttgaaaatttttcttctattccagatcttttttttttttttgctccttcaggtttatacaacctcgtacccaagtttacagcaaataaattaccgtagacgtgtggtgatttatctagtgtaccgagaagtgagcagattgaaacagaaataccaagtgagtttgagacagcatgaattggagcctgagttcatagcccctggcaaccagacaggaaaattcacctcagaccttccagttccagtactcactgaagatgacaaagccatggagatagctccccaacctttctgtattgaagataagttttacgtacccctgcaaagaatcattgcttatcccaggctggggcacttatgcggtaatgtaaagaagctgaaagagttccttggtgacgtgattgaactgaactgtgatggtt

SEQ ID NO: 34522 - DNA, 1367 bp, Bovine  19866880594069
atgaaggcactgtccacaacaaacgttctggtttggttgtcagttgtccaggaaatcaggccattgcaatgagcaggactggctaacaggagataagatgaataatggggtcaaaggaagaagcagaggttgagagataccacaaaagtcagaagaaagaaggccaaggactagccaaggacaagtaactggggcacagaaaagggatgagtgtgaggagaaatgaatgtgagacccctggggggctttctgtcctgcaggggggcggggacataggcgcttcctgcagagtcagcttctgctggcaaatggctaagatgaatccctgcaacttttccccaggatatataagccatcagagttttcttttgatggtgaaggagacagtcctgggtgatgttcaaggaatgtctggccagtgcacagtggactctttgtccattcttgcagcatggttatttctgagatgctgccaaagccagctctcttggccttggggacagaaagagaaggttgtctgtgtcatgcacaaggcgatttggcaggtgggggtctgctggagggagttgatactggcaaatcacacattcacactgtatttactccttctcctctttgccctcgagttttgttttgccctttagttttgaatttggcatacagtgatcttacccagcaaatgcagttgttgttgttgtttagttgctaagttgtgttggattcttttgcgaccccatggacggtagcccgccagcctcctctgtccgtaggatttcccaggcatgaatactgaagtgagttgccatttccttctccagggaattttcctggatcagggatcgaacctgcatctcctgcactggcaagcagattctttaccagggaagcccacaattgcagttcattaaacataaaacccagcaatttcggtttgaccttttcttccacttggacctcctacacctagagcatttttgtgtccgcggagttttgcagagtaatcaatctgattgccatgttgtatctcctaccccattcccaaagtataggaatgcctagtgtaaattcataacataagcattcatcgcctcctggcaaaccatggccaggtccaggtgaggagggaccacagcaactcattcttattctggggcagatattttgatagagaaggagagaataatgtttaatttttaatattttatatagaagaatcttaaaattgttacattctgatagtactaaaacagtacaatggagcaattatgaaacaacccaattctccctccttttccattaggtgaaataccacttgggaagtgtgcaaagtgcatgaaaggaagtcaaagctgtggcaggatggggga

SEQ ID NO: 34523 - DNA, 1059 bp, Bovine  19866880596935
atcactgtactatgtttcccttaaaagatagattgagtaggacgtgtaagtctccataaattagcagtggttcttcactcttccttagttctatatttggcccacttactgcattgatgaaagagaaaaatttattccctagatttgcaatcaaccaaaagtgaaaccctttgagtctcagcatttgtgcattctaccaactcagagatctaaattatctcagctggccccagtgatcagacacagataagtagctgatgccaagagcccagagaaaatcaaaatacacacacaccaaatgaaatctcctatgcagtatcaataaaacactttgcatctgttgaaaagacaggatgaatcagttgacagcatcatcagtatctcagcctgtcccattccttctctcaaatagtgtggagagtggggttgaaaaggggcccattttgagggctcactgtgtctgggtgttctgggaggaccctctaagagacagcagagctagatttcatccatttaaaggccacttattattttaaaaattacttcgtgtatatggccaaatagttcttctcacagcttcctagtcagcactgaaggtgtcttaacaataagtaagaataaagcatggcataataattttaaaaaacctattttataagcacagatttttatggctcagtcataaatctctatcacatattttaattgctttatttatacttccttttctgtggaatgaacaaaataataaataaaaactgttcttatttgtactgaattgctaagagagtttatttgtgatataattgatataatatggtttcttcagataatctaaatctctgaacataaatttccattctagggacttaaatttctagaatgtatgagccaggagaagcccgtagagaaataatccttgccttcagtcatttattcaagaaaaatggtgataaaatcttctaaaagaaagaatttttctagctctgggttatcattatctatattttatggatgcaatattagaggtataaaatcttttttactaaagtagagaat

SEQ ID NO: 34524 - DNA, 2650 bp, Bovine  19866880719334
cttctaaaagaggaactttccttcatggtattagtctacggacactacaaaatatgaacgtgcaaatgtaaataaatatatgactgttatactttcagacaaataactcatttactgagcaccaacttacgttttgaaacatgggtcaccagacatcagttgcatactaatccaaacctaaacatgagaaaaagaaacagcataattataaaaatctcaagaggaaaagccacattctgttaatctatgcaccttccacagtacctaatccactactgcctgttttagaaagtattaaatacaatgattactgaattgggttatatccaatattgaattgctgctttatacagacatgggttaaaactaatttttagcattcaaaactttgtaactgcaaaaataagagtggaaaagatagaaatgaaaagcatagacttcacggaacttccctagaggtccagtggctaagacttcaccttccaatacaaggagtgagggttcaatccctagttggggagctaggatcccacagactttgcggccaaaaaaccaaaacaaaacagaaatgatactgtatcaaattcaataaagatttcaaaaatgatccatgtaaaaaaaaattcttagaaaaaaaaggcaagggtttcaccagtaattatcctctgtgctgttctggtctgttttatatgtctttcctcccagattcctgtgttgtttaagtgtctagaatgttttcctccaacacatttgccatatgatgcttctaggggtgcctgttggtagcctgctaagagaagaatgcttctggcctttgctctagctttgcaccagaatgaatgcattaatgtactttaaaaaaaattttattcagcagcaattattttataaagcttgtacattatgtgaggcttagaaatatctgacttcccgacactccaagctattcaatgcttttcaccaagagtaaaggcatttcctctggaggatctctgtacaagtttatcctgaagactaaatgcttaatgcaagtctccacatgcctattagcagcatctgaaatatgaaatgcacagggtcatctatgaagttccccattctaagaagctaaagaataaaagggctcaatatttggagaaatctggactcccatatactctgctgatgggaatgtaaaatgtttcagccacttgaaaaagtcaggtagttctgcaaaaagttaaaagcagagttaccatgtgacccaagaattctgttccaagcatatatactcttgaatgtatgcccaagagaaaagaaaacatatgcctacactaaaacttgtatatgaatgcccatagcagcactgttcataacagctaaaaaagtgaaggaccattaaccgataaacaaaatgtggtatagccatacaatggagtattacttagctataaaaaggagcacagtactgatacatactacagcatggctgaactttgaaaaacattatgttaagttcaaagaagccagacacaaaatactacctattctataatcccatttatatgaaatgttcagaataggcaaatccagagagagagtaggctagtgattgctgagggctgtggggaagggcagagagttggggtaaagtgggaagtgactgctactgagcacatatgaggtttcttttttggggtaatgaagatgttctaaaactgattatggcaatagttggacacacctttgaatacactaaaaaccattcaattgtgtactttaactgggtgaaatgtatggcaagtgaatcatagctcaataaagctataaaaatttaaaagtattcaaagtccctgtctactaccagctggatcagcttctctttcaaggtactaagtgacttaaactaatgttcttgccactttctggaaaggaggagttagcatcttgttgaacatccatcctgtcctgaagcgtaccatgaggctactattgcaaacacattttgggaaacgtaccaggccaagacctttcagacaaggtctctaaaaatagcctcctccacgtcccatattttgctgacatcatagcaagccaacgccacttagcagctgacattcttaggaaggcagggaggctgtgagtaagcacaggaagctggtctgcagacagaaattataatgcagagagccaagaacagtccctagaaaggtccttcagttcctggaagttcaggtctggttgtaacttcccatcctagggctctgtgaaatgtccctgcatttgacctaaagctctcttttataggagctaacctaagggatttctatttcatacaactagagagtgttggcaaaatcacatacagtaactctttcagacctcaggatcagcccccctggggcaactattgaaattccccttttatagaggaggaaacagtggggcagagctgaagtgcttacacagggctccagaggtctaagaacaaacacagagccctgatgtcataatccaccctcctgctacgtggctgtaattatgttccctaagctccctaagcctgtggctactcaaattctggctgaaagctaaaacaatgaaggaatgaatacctagagtactattattggaaatagtgtttttgtgttttgtggaccagaacttaaag

SEQ ID NO: 34525 - DNA, 1733 bp, Bovine  19866880720558
tatggatgtccgctttgcctggccggatctgctacagccctgactttgtgagtcctctgtcttggggggacagggtgtgagacgcttgtcatgatctcatctactggtcttttagatttttacttccttagagctacttatccaccaagacattttcttggaaactctgattcagttcccaccaatcttaagaagagtccagcttctcctggatggaaattcactttctagacaggatattttcctccttaccccagcacctcctctccacatctaaggcctaaacacatgtgtccagtgggcagcccagggttagactttcttcctctccctccttcctttcagcttccagttctctccagctgtccagaaactgctcagacgtccacaccattcctgtctcccacactggaatgtaggacttctttcctaatcattttagtgttgatcagcctgaggtctgaggaccaagctccgccaggtctcacagcactgctggtctgacccagggcaggtgtctggagctgagtggtgacaggtccgggaacagtgcgttttgccctttgccttcccacagtctctcacagatgggagatggttcccataggagtctagtgaacacaggtgggttgaattggccctggaccctgactcacgtacagtcaagggacatgactgctcacctgacggctgggatcagacacagccctgggaggactgctctctgccgggaggactgctctgtgccgggaagtctgtgtgtgagggtggtgacagctgttttgtgtctcaggagaaactgaagcctggtttcttgaaggagatccctgaaaaaatcaagctgttctcagagtttctggggaagaggccttggtttgcaggggacaaggtgagttggacggctttgggggcaggataactgtcattttccccaggttcagagttcagtccgcattcatgttttgtcttcctgcagctcagctatgtggatttcctggtttatgacgtccttgacatgcaccgcatatttgagcccaagtgcctggacgcattcccaaacctgaaagacttcatttctcgttttgaggtgattctcctgaaccccttgtatttacgtctttcttctctctcttattctccctgatttcctagttgggactacaatgaagactatcatttatggagaattttgtttaccagaatctctcctcagttactgacgtgtattgtgtcacatttaatctttataacattcctacatgtggaacaattatcctctccattttacagataaggaattaagctgaaaggataagtaatttctgaaggtcacacaaccagtacaggctgtgctgggtcagcactcctagtcagactgtctggcttctatgggcagcagtcagtggctgtccatctcctgtactgaaatgaaaagctcaggtccttttattgtctgggttcacagttctggaaagtgtgtaggaagcagaatattcaggagatggtatgcagctggcattagtagaatgagacacagtaggaatgatatcaagtactaaaaacacagacaatatattctcctgatctccaaagggctctgcagcaattgagccccgccctgtttttctgagattgtcacatctgtagttggtgctgggatttgggtgcatacagaggtgtcctgtgcaaggatttcatcttgacacctcttacggtgggcagttccttcactc

SEQ ID NO: 34526 - DNA, 1569 bp, Bovine  19866880730952
atttgttcattcagtattcaatattgaggacctccaatagtgacctgggagcacgggtggagcataacttggggaaccccctgctgcagaatggtcagtggggtgagggagatcaaacgtgttcacataggaaggagatagatttcctaagcaattttttaaccctggctgcacaatggaactcccaggagagcttttaaaaagtatcatgcctagctcctctgccagcccaatgctatcagaatctctgacagcatcatcagcagggcagcaacagcagcaatttttaaaggacccccagggatttccatcgtgcagtcaggcgaatcactgatgagcagggagtcctcgagaatcaagaggttcagtgctgaagctgacgggggcctctgggagatggaggtgggtgtagggggtagatgccgagtggtatctgcatttgggactcattaggcaggatgtataatggggccctcggatctggagagctcggattgtctgcagctgaagcccttggctgggggacaggaagcgaagcggggaccaggtgcagagcatcttatctctgcctgcagctgggtgctggtgctggagggagggcaggaagagaggcgggccccagccatatgtcccactgggaggctacttctagtaagttctgtcatcagtcctcactactacatttgaaaagtaccatgagaaagtggggcctgtcttgagagggcaaacaggaaggagacagttctggaagtcatgtcacattaggaatgaaagaagaaactgggacctgggagaaggaaaaagctttgagtggctctgacaactatcatcaaggagttaaaaggctatcctgtagaagggtgattagacgctgtgcttagctccagaaggcacaccaaagagtagaaattcaaagaaagaagatttcatctccatttaaaggatgacatttctaacaactagcttccacccacttgaaagggtcaccatgtgaagtggaactttcttctagactttaccaagaggttaggtagccaaatcttgaaatggtttaagaacattacagcactactttgagcaggagacttgataccatgatctttatgatctcctcctaatcctagattctagaaaattctttgatgtgaacattaaaaaaaaaacagacaaacacaaaaaacctgaaaaaattcttggtgtgtattggccattgtcttggggaaaacaaaatgttttctttttcttttaatctagcattgcacttggcaaatacaggtaactattaaactattcaagctggcaggtcctttttttgaaattaaaaagcaaatgcttccttcattatatatatctataatttaacacattaataacaatatttacaggccctggcattttcagaacaatttcttagttaatcctcgcagtgtttctatttaagtagggtcagtatttttacaggagaaacttgaaaaagagagaaatctatgtgacttgaggaaggtcatagcttaagtcagcactgtagccaaaaataaccaattgccataatttgacaggtatacagct

SEQ ID NO: 34527 - DNA, 1956 bp, Bovine  19866880797856
tgaatgcggactgaactctgaacctggggaaatgacagttatcccgcccccaaagccgtccaactcaccttgtcccctgcaaaccaaggcctcttccccagaaactctgagaacagcttgattttttcagggatctccttcaagaaaccaggcttcagtttctcctgagacacaaaacagttgtcaccaccctcacacacagactgagagagagagcagtcctcagggctgtgtctgatcccagccgtcaggtgagcagtcatgtcccttgactgtacgtgagtcagggtccagggccagttcaacccacctgtgttcactagactcctatgggaaccatctcccatctgtgagagactgtgggaaggcaaagggcaaaacgcactgttcccggacctgtcaccactcagctccagacacctgggctgggtcagaccagcagtgctgtgagacctggcggagcttggtcctcagacctcaggctgatcaacactaaaatgactaggaaagatgtcctacattccagtgtgggagacaggaatggtgtggacgcctgagcagtttctgaatagctggagagaactggaagctgaaaggaaggagggagaggaagaaaggctaaccctgggctgcccaatggacacatgtcctgatccctgagatgccaagaaggaggctatgtggtaaggagaaaaacattccgtttacgaattgaatttctatccaggggaagctggactcctcttaagattagagggaactgagttagagtttcaaaggaaatgtcctggtggatcactagctccaagatcaaaatctaaaagaccagttgatgagatcctgacaagcacctcacaccctctccaactcagtgggaaggactcacaaagtcagggctgtagcagatcctagccatggccaagcggacatccataacctggttctccaaaatgtccacacgaatcatctcctcctctgtctccccacctgtggccacacaacagagattcaccctcagcctcccattacagcccaacccagggcatggccactggtgtccctgaccccagctccagacccactcacacaggttgtgcttgcgagcgatgtaccgaaggatggcgttgctctgggtgagcttgtgagtcccatcgattaagtagggcagctggaagaacaacagggtctggttatttgggccaccagactcccctgtaccccctctattgaccaagggcagatatgaaatctggcactcacagagcctaaatactgtggtgggcactaaataatatgctgcaaaatggagggatgagctgggacagagtatcatggaagggcaagggagagaaccaggaagctgagagacagagcagaaggcacctgttcctgaaacctctaagccaggaaaggagatggatggagatattgtccactccccctcccagcaccccagcccctgcacctacattggggaagtccaggcccagcttgaatttttcattcagccactggcttctgtcatagtcgggagctgagaaaaagaagatgcagtgaaacaacctcccaggaatccagccctccttcccggggggaccgaccaaggaatcagaggcaagaccccctgaactggtggatacggattctgaattggattctaatctcacatggagctttgggggaaagcacacgtagaaggatttggaacctccctgagctgaggcttacagagagctaatgcaagcactaagcagagcccaaggggctctcatgtcctgctttggaggacagctgcaccctcaaagggtttgggaaggggcaagtcccttttccagctggtggagtttaagggatgggagcaacaaggccaggacatgggctgcttggcaacaaatcaatatgagttgagcagaagttagaatagaagaaggattccattaccatctcctaccgagt

SEQ ID NO: 34528 - DNA, 2306 bp, Bovine  19866880834940
catgcgaagagttgactccactggaaaggactctgatgctgggagggattgggggcaagaggagaaggggacgacagaggatgagatggctggatggcatcactgacttgatggacgtgagtttgagtgaactccgggagttggtgatggacagggaggcctggcttgctgcgattcatggggtcgcaaagagtcggacacgactgagcaactgatctgatctgataggtatataatatacaaacaatactatgcagctctttactataattaagcaataatccagagaaattagaacagtgtacagagcacgctgcacaaacatgtccttgtttgggtgtatctctttctggaggaatacttcagaagccaattgtagtggttgcttggaggaggagtcacagagaattagagaatgacctagaaggcagacatgcttggtatatttggattatttaagatgtgcttacaatgcttattttcaaaaaagaataatttaacatattttttaaaaaatatgtccataggaaccatacagtttgttccatctctttggaacaaatacttaaagataattttaagaaataaatttcactctgtgaaaagagtgccaatgttcagagaaagctatatttagataatgctaaatatccatttagtctctcaaatacagaaaacttttggactcttaaaattatctttgcggaatatttttagtcgcgtctgcctactacgctaaaaagttcttgggcagggaggcagggattcattttgaggggcttgaaaaataggaacatggagttggaggggactctggggggcatgaaatgcaaaccccaaagcaagacttctgtaacatgcagtcctctattcttcagatgaggcaacccagcctgtctgtgggtagctcaagttaccacaaaagcccttcagacattaggtagaaacctgctgtcaccaactgagttataactggcctgtccaccctctctggcgccacctctcagaaatctgccagtttttctagatgcaaacccaatgtcacagtctgccttaggcttacattacatgcttagcacatgagagctcagttgttcggtcagtactctttgtgaccccatgaactgtagcccgccaggctcctctgtccagggaattttccagaaaagaatactggaatgggttgccatttcctcctccaggggatcttcctgacccaggaacggaacctgcatctcctgtggttcctgcattagcaggcagattctttaccaactgtgccaccaaggaatcccacacaccttaggcttatcactgacaaccatgcaggccagaccccaggtccctgggggcagatatgcactttctcctttgaagtgccttatgctaggagcacacagtaggtgcccaagttatattgcactgaatcaagagctctctatgtcctatttgccctctggacttttaagcaaatagctcagcagtgcagaaaaaggacaccctgaggcagtgggaccatcccaactacaaggatgaagagggtgtaacagacgagaaaacagatacttttcagtctccttgtgtagcagggccactcacagggcatcctcagcaggcctggcaaatggaagactttcctgcagtgtccacaccaggtgtcgtagttaatgctcctcagctgtgcgacagaacccacaagcatgatctgccttcatccttatctaatcactttacggggcattaagctgcctttggctgaaccggttgccagctgcaacaacactccaggaaaggacaccatcccctctcatgataaagcgcatcacactaacagaacccatctatatgtagctctgctcaagagcttatataatttatcttaggctcatcctccctctcctctctggggcgtggaattacacccactcagctggaggcaattgctttttgatggtgcctgtgctaaagcatttttaggataaagttagtgaatcttttccccgtggcaatgtagctctctcaaggtgaaatacagacagcgagttatagatagaactttaaggcaacagtttcccagtttgtaaaagctaataagcccagtttacatacaaacagtcgttaccttgttggcgggatcaacctccatccgtggaaagacgcagagccttctggtaaccaaaggcatctcagacgtgtttttgcttgaagcggtaattgcggtgtgcctctcctcatcctcaccctcttatccacttgctctgctttgctgccggtacatgttcattctgcaattcctggcagctgct

SEQ ID NO: 34529 - DNA, 4768 bp, Bovine  19866880888329
aagaaaaatctaattagctcagttcctggcatgcttgaaggcagtcaaatattggttgaaatagtgaatgccataatgatgccaatatacataaatgaaccaataaaacaatacttagtcaacaaacattaattcatgtggaagggactatcagtgctttcgatttaaaagagggcaattattgctgattcacaaaggagatgatctgagctcagacttagagaaagtttaggcagagatctgtttcttgagacggtcattttgagacttgaaatcaaggtaatcaatcataggggaattccttggaggttcagtgcttaggattccagcactttcactgatgagtgggtgggttcaatcactcatccgcggaactaaaatcccacaagccctgagaccaacaacaaacaagttatcaatcatgaattaaagcagtttagtttctgagaccctcaactgtaacataaacagcatatacactagcaaaaagcagactttctcacaactgatttgcaaagaacaaatggtcttatttcgagttggtcacatagggaagtggaaatggttagttactacaagtaataatattggctaacatttactgtggatgtagtatatgctaggcagcatgctaaatgaattatctcactgatcctcaaagcagtcctcacagtcaaggaacctgaggcttagtgaaactaaataacttgccaaggatgcacaggagtggtgtagtgggaaggagaataaggtttgagttacacagataagacaggctgtgagatgacttgcaatttttgctctttaggagaaggaaaatgaagaataaaaacaaccataaaatgggttcaagtaaaaacctatggcatgaatgactttccattatagacttgattgggctctggggctctggcctctttcaaatctactttaaatagacttagctgctcaaaattttaaacaaatgcatatattatatttctctaccttttcaattttaaatcagattctgctctgtatagcagggttgagcccccagccataaaaaaaaaaaaaagacatgttacagactcacacttctaaaatgaagctccttgtcctcaagggtcaaaccgagacagaggaatgaggtgggtgaaagtgtcttgagaagaatgaccacgtgccaagggtaacacagaaaggaccttctgggttggaagtttgacttgggtcacatggggtatagctgtgattcatgctcctgaaggccagattccaaggtggcaatgcgtggagcaaatgtgggcgttaggagcatgtagacatgtgtccacaaaccctggattggcctcttattagtagcatgacttaaaacaattcagtgtcattgcatttatatattgaaggtgagtatagtatctcaaacctcacaacaacccaacaagatgataatctttatagcaattttacagatgtgaaaactgagattcagagggagacattaaattacgttaagatctcaagacggctcccaaaccactggcttttccatcatactacgttgcctaacctcacttgccctcctagtttcgcataacctctttgagctgtctctctagtctcctctagttggtttacctaaacagattgaacgaaaaatttgaattccctgaacaggatatagcagagtggaagacagaatccaccaatgctaatcagagatgaaaaatctgcattgcataatttgtagagcagatacacagttgaaataattgagactgaatgtaaaagctcttgagttaaggcagatcactcactcaccatcctatatccaggtcttcttttctaataatttatcaattaatcatgataacccagatagatattttccataaaaatatcatagattagcaggtctgatcaatgctacatacatacttggccccctgataatctgtgtttcaactggttagctgtgaaaacatggatgaattccttgacttttctgggtctcatttttgttatatatatataaaggaatattatcatttagctcagaaagttgttatgagaatgagtataggaaaagcacttaaaagcatgtagtatgtgtgacatccatgttttggttttacattcacccaatatggatcacattgtcttctgtggaattctgaccaaagcagcccagaattagatgcctagctaagtagacagccatttcattttttctgtattctggtatttgtagggtatgagtgcactggtcccagcagccccctagtgtcctggaccagggatcctggccttccatttggcttttgccctcggctctttgcctgttccagtcagccatggacacaactcttatcagagggcacacataagacaaccactatagctacatagctattggttttatagccagtcaaataatatccttgctttgcttccacctcttttcagtaaaagtctccccctcccaccaacccctgccccctgctcctgtcagtagagtattcctaatcatctcagttttggtgctgctgaattcaaatcaatttttgctcaaataaactcttaaaatttttaacatgcctcagtttatcttttaacatgtttcagcttcccatcgctgaaattttgcttcaaggaagaaatggggccaacgcaagtcttttaaggttcccaaacttggccaccaggcagaaacactttgtgagtttgttagaagtatagattcccaggtctggtcccaaacctgcggagttagaatctccaggggatgataccaggaagtttgtattaaataatgagctccccagctgatgtcaatgcacctagtccgactcctgttcacccactagtgcttaggaacaaaagtgaactaaattcggtcctcttctgtgtgtactgtctgactcagtgatttctatttttctggaatctaagttctttgacttgccttcttttcaagtgcaaatgctcttgagtatctcatcagtggcacatttgtatctcagtctcacacagaaagggaaagcagacacagaaaaggaagtttgctgttccctcccagtgtacctcaagcctaattccatgctccaattccctctgggcagagttccatggttgttcctaactacagacagtcttagttccacagctaggcttctggggagcaaacactttagttacatgtgttacacaagtccagcttgcactatcttttaataaggtttctggcactcaaagcacaattttttttttaggtacaacagagttatcattgtcttttctctcggaaaaaaaaaaaaaattacagtgtgagtgagcaatagagccaacaagatcaatggtccttccctccaaagatgcatgtatgtcagtctgccacagtttggggctctggctctgagtatccctccatctgaagtctttgctcattcaaaagcatgactacagtcattccagtaacaggctagcaactctgctttcccagacactcacacagaggtgtcaacacatgatgctttctctcgcttgggaaagcctgcaagtggctcggcttcctcctaactttagatgagggtgttatttcctacaggtggccctggcagctgctgctatccaacctcagccgaagtccttgttgggttttgttctggatgagtgcaatcaatgtgtggtggcttgattttgacttctctgggagtggatgcttccaactcttgaatagcgagagagctgcatggcaagtgctgggtcgttgaaacacttatgaagtgggtgtgttgtagtatgtactatgtctgggtgtaagaaatctccaagaatttctgctatgcagatctttcatatctccaggactttccctgtgtgctggctcattctggcagccttccacaagactttctggattaatttctcccctgagtcttctctgcagcagatcttgaactccttgccattgaggacacacctgaccttgaactcaggaagtggagtcagagcagttcttctaaaggccaaaggagcttgtcctagcctagaggaattttgtattctaatagactttttccagctctaatcacactaacaattaaggaacctctgcaaaagatatgggaagaaatttttaaagcaaaaaaaaaaaaaaacactttgcctttgaattataacatttccaatttaaattactcactagacaagtctctgtttttaaccgtggtttactgtgtcattccacatttctcttccctctgtaaatcactaaaaaggcaaggaagggaggaagccacaaaaatgcattagtatgcagacgttttcttaagttaaaaagccctcagatgtcactgaggttcagattagcgtttcgatttgaaatgctatttttgcagcacttcccagcaagtaagcagaaaagtaagataaactgaaccgttcaaagggcaagaagaaactgaccatcagggtctaactaaccaggatgttctctctgctgctttgtgatatgaatcctacccaagagtctcttggagctcagactactgacccaagacaaaggactttcctctccacccccaagacttttatttactgagcctactttgagcctgtcattgggtctaacaatttatatctcctttaagcttcataacatcttatgagaagtttgttccaattttcagatgaggaaacctgtacttagaattgaagcaccttacctaagggaaagggacagtggcaggatttgaacccagatctgtctcttaaaaaatccatt

SEQ ID NO: 34530 - DNA, 1493 bp, Bovine  19866880924915
tctgatgttcagcagaagttcgtgttatgttggttactcttgtcatccatgcttctaattttctatttctaatatgttattgtgcctacatatacacagacatgtgcatatgcaactatacctttttggaagagatgggacacaattaaatgttttcagttaattgctgcataacagaagatgcccgagacttgagctaaagagagctgaccacaaggttcatcttgccagatgtcagctgagtgactttgggcagttcacttaccttctctagcttcctcatctacaaaatagctacctagtctctccctcatgaagctttgaggattaaattagatgacacatgtgaaaataagtagcagatagtgctacttctccccatgtacctctcttcctactgcagccattcacctgccctggttacaccctggggccagatttcagcagatcccactccagatctactgtaccagaacccaagggtcatggattaggtatgtggatgtttcacgtagtctaccaatacaagcaccagaacacagtgtgttcaggaaatggggccacctagaagcctcctgatacacgtgcgatagcccccaaccctacaagtccatgaataatggctgctccttggctctctccaggacttctggaaaaacccatatcttctgcttctgtctccctcctcggtgaacaagagtcctatgagctgtggcccaacccaggtgtgaggggcaggcctcgccactaggtaccgttactccaaagaaggctcccagtgccacccaccttgatgccctatgcactgtaaattaggtgcccagctaagtgctcatctgccccctatgcaagtttctgctgccatagtcttcaaatctcacattatttccctctaaatctcccttctgagaatgagctccttcagattggagtatgtatcttaactcagaatccctaatacatctatcacatatgttcagtgcatgataaaaagtcattccttttccttcatcttttcatctcttattaccttgtcttggaatataggttatattcttcctgctcttttgagagtagggatagaagatgctccaaaaaaggagggtaagatcattttgctgagaatttggggacatggtaattaggaaggaagccagacgaggggtggacactaatatttactaagtgcactctgtatgtcaggaaatgttagggtcacccttatctgcgtgtctcatttaattcttccaacccctcattcctaaatgcttgtgttctcatttaaagcactcacccattaacccacacaatgacttcaagtcaaaagcttgactgaacttgaacaaattacatgagcaaattaattatatgttacaggaatactgaaacaggttttcataatagaatgacacccattcaacttatccccaatcccaaaagagcacatccaacatcagaagtcaggagcccattatttgtgtcggatcatctac

SEQ ID NO: 34531 - DNA, 709 bp, Bovine  19866880942303
atggaaatggtacataatgcattgtgcatcttggtttatgaaggataagaagataactccattcagcaaacacatgtacagagtatatactgtgtgataagcagtgtctcagcattttaaatcttgtatctgtgtgatgtcccaaattgagggatttggcaaattaatgtagtttatatattttaaagtaaagtgttaagacatgtatatatatttttattatttttcacttttgccagttttgttcacattagataagagttagacaaggaagtttctactgtattaccatgggacaatgttatatgttttaggtgggaaaaagtaaggtatatgtattatgttaaggtatatgtattatgtatatgtattatgttagtataatacatataccttactttatctgagtaaaaggggaataaatatatatacacacacatacacatatacacatctaaaaattgctaacagtggttgtctctagggtggggatctccactcttgttgaaatctttgtgcagtgtattattaatatgcttaattaagtaaataatttaacctttctttggtgattcaggttattgcaatgtgtccagaacacttttcggcagtttcttcttcagcaaatagattaaatgttagtttgtcttctcaccatttgtctccttcaaatttaagttaaattctaaataaaaactctggttacttg

SEQ ID NO: 34532 - DNA, 2523 bp, Bovine  19866881171401
atctctaataatgacagctttgatgaagctattattaaaaatattattgtgtggcacgttaagaattcttggccaacagaacaatcctcagaactcactgacctactcaactccaaaagtgatgatgaaaatagcaataagcccagttgttttctgactatgacggaagaaaacacctctgattcagatgagtcaatggcttctggagaaagcaaccatgaggaaaattcaaattttctatctaaaatcaagagtctatgtgataaacaaaaaagttgcctatggcagacacctcagaaacaggctgaaaaagaaagctctggcaacaagttcaaatatggccatagtcaggtttattactggttctctaatttctctaaggttgcttccaaagtgaaaattcctaaaaattacacgattgacaaaccacttataacagatccacaagccagcttttctcctaaattgagagataagtcagctgttgggcaagatatttcagaaagcacatctagatcaaattatgttgaaaaacaagagcagaagtgggaaactactcaaccttcacagccagtagaggtgagtgaaagcagccttcaggaaacaccccccaggaccgctgctcatccatatgcgtgtgggtcctcagaagctgcatagaactaagttgtagttctgaggttctgaattctagttccagtccggtaccctgacctctcagagctcagtgggtgtcctcatgagaagaatctggaactgaactaacaataacacagaataaaatccaaattcttcaaccaggaatttgcatctccccatgtttcctgtcatcctagccttctgaactcagctcccctcccccaggagtcatcctgttagtgggctggccccaccttctctgagctcctgccttaccaggaacatcccacctctgcttatcaaacccccgctcattttcatggtctccttcaactccacactggctgtaggacttttcagaatcccacagccagtcttttgcatccgtatttcttaaatattctgtcagagcttatctcagcctccttgcatcattacgatttccaaacatctgttccttcgactagatttcaaggctctggaggcagctgcctcgtcttcatctttccatcgcccaattcccccagaggcctggccaggtgtttgcatatattatgcccttggttatgaatgctaacttgaattgtgatctttgataacacatttcaagatgttatactggtaactatttaacacaacattttgtttacatttaatttatactttttcccctttccccatctttccatccttccacccaccttcccaaatgctgaggctgaggatctcattgactatttgaggttccgtagttaaataagtttacattaatgatcaaagtaaacactttagttctccggcacttttccaggactgtatgatttttcttttaagcagtctatgaagggcaccctgcctgaacacactctgcctgtctctatttccaccccttcatccaccttttcttttaactgaaacttctggggaatttgaatagaacctcccttatgccttgcaactacacacacacatacacacacctggagtcagcagcccactcagccttgaccgggatgcttctctcagtcttagagaaatctgtacccccatgacactgggaagtctccacattcctcattctgcttggagaagaacactcttgggtgggcacagttctcagggccctgtgggcagtaggggcagaaccaatatcaagttcatctgtctctggtaacgggagtctgaagtggggcatcttcttttctcttgtcctgtccattcaggttggagaactgggctctgtggtttccatagcgatcatatacccgagatattcctaataaccacagtctagtttgaccacaacattggctgtctgtctctagtgtgtttgtgagctgtgtgtgttgggaacaatgggaagacaatcaaggtgaatcactctggaatttgaagtcttatccagttagcctctggtgattagaaaagggaatgtcctgtgtgaagtcactgtcttgctcccagactctagccaccttgtatctggtgttagtgagagcgctagcgatagagtcagtgacgagaccaacagaggtccctgccctcgtggagcttgtggtcgacctgtaggagaagggtttgagtattccatataatagtatcaaacacgataacaggaatagctaacatatattgaatgtttaccatgtgccagatactatggtaacatttaattctcatcatgacactatgaagtaggttctgttactatccccgttttattgctgaagaatttgaggtttatagcaatgacgtaattgctctgggtcacccggcagataagtgtcagagtggaattcaaccttggcatcagggcctcagctcttgacataaccctgggtggcctccatgatgaccagaacacattgggtcatcctgcataat

SEQ ID NO: 34533 - DNA, 827 bp, Bovine  19866881191717
ttactcagccccctcagagccctgaacaaaccccaatattccccaacctggaattctcccacattgctgcctcaaaatcctggcgaatatttgatgagggacggacatttagaagtttgagaaactgctactttatcaaggttgtgtctcttactcaagcttgctgttttgactggagtgaaaagtatatgatttataagattcagtcataaaactgagacagttgatctggaagggacattaccctgaaggttggcctccatgaacagcccaagctgagtgggtcacaaagtgtgaccagccagaaagaaagcaaagatcagaggccagggaaaatgtggtggcatgatttggggtatgtgtacttgacagggcatactgtgaagacaaggttggtaactacagtgaacagtggtaactgtaattgtagtttttgtctgtccaatgagctttgctgtctttattctgtttcctctggtgaactcctcctctcctccacatagtctcagaaaagctgttaatcagagtgtatctcttccctaccctatccccactattcaaaacccacagagatgggcagatgtcttaggctgggcaaatttgttggttcaggaagaaccaactggttctaaatcaggccagtatattccttgttgtatctctaggggaactggcagaggagcctgggagagcataaataacatcagagacaaggagaggaaagggcagagatgggggagagagacagaaaatgaataagagttggcattgttaagcaggatccagccatgttagatctacctcttgatttcccagtcaagccaata

SEQ ID NO: 34534 - DNA, 2972 bp, Bovine  19866881246667
tgatgtactctgcatagaagttaaataagcagggtgacaatatacagccttgatgtattcgtttcccagtttggaaccagtccgttgttccaggtccaacagttctaactgttgcttcttgacctgcatacagatttctcaggaggcaggtaaggcaggtttggtatttccatctctttaagaattttctagtttgttgtgatccacatagtcaaaggttttagcgtagtcagtgaagcagatatttttctggaattctcttgctttttctatgatccagcgaaagttggcaatttgatctctggttcctctgccttttctatatctagctgtacatctggaaggtctcagtacacatactgttgaaacatagcttgaaggattttgagcattaccttgttagcatttgaaatgagtgcaatagtatggttgtctgagcattctttggcattgcctttctttgggattggaaggaaaactgaccttttccagtcctgtggccatggccaagttttccaaatttgctggcatattgagtgcagcattttcacagcatcatcttttaggatttgaaatagctcagctggaattccatcacctccagtagctttgttcatagtgatgctttgtagagaccatggtggtgttcattttaccgatgctaagccaccacatcagaaaagatgtgctatggtagtcatactgggacacttcccccagccattctgtagcttcagtttccctccttcacagaaactctaactccttgaaagggattttagttgataaaaattcttaagaaagttctagctcagcccctaggatactgtaataagcccctagggaacgttgctcattcttagtgtggagggcaccgtgcccaagatatcctggacatagccagtgagtcaggaatgagtgtgattcccggaaatggggtttgagcctcaggccttgcttgcaaattcaggctcatccaactgtgcctgggcctgctgccggtggactccaaaccctacttggagtctgtgaggctaggggctgagaagccaggcactttccctgcttcttggaaaaacatgctctcctcctgagtcacatattttctcacaccttattttctgcctccaccctcctcctctggggcatgtgaacatctgctctccaaagtggaaaacttggattgcgctcaagtgagctcagtctaatacacgactttctttttccgcctctttgaaacttctttgtgcactaaaatcttcttgccaaacagctaggggaagctctacttgagaagacagtttttcagcaagacaaagtttttcagcaatccaaaatctcttaaatccaaaattctgcatcagacataaagggataaacattttacatgtagcataattgttatttatctgcatgtatataaatatccttcaaacagtatgtgcatcagtaggctaaatagataatacattccatctgagagaactctaatcttctaaaagagtaaagagtctatacagtcttctgtttaattaattcctcaaggatgatgtagtttaccaagatttcaaatgataaaccatgcctattgccagcaatagatttactgttagatctgattttacacttggctgtgttttacctcctaacttgtttgttataaaagagaaaatgtagtctggaacattggtccctgtattggtacttaagttgttctgtgaggtctagactataaatttggtagagaaatatctagtaccttgaatgcttaatcagaatgtttttaaaatgtcagactatttgttattatacttgtttttattactgttgtttagttgctaagtcatgtccgactctttggagaaggcaatggcaccccactccagtattcttgcctgggaaattccatggataggagcctggtaggctgcagtccatgtgatcgagaagagttggacatgactgagcgacttcactttcacttttcacttttcactttaatgcattggagaaggaaatggcaacccagtccagtgttcttgcctggagaatcccagggacagaggagcctggtgggctgccatctatggggttgcacagagtcggacacgactgaagccgacttagcagcagtagcagcagtcagctaagattaaattaaacacataccaaaaaagcagataattaaaagaacaaagactaagagagagactagatctttgattaatgaaaaattatatagtggtctactataatagggagaaggcaatggcgacccactccagtattcttgcctggaaaatcccatggatggaggagcctggtgggctgctgtctatagggtcgcacagagtcagacatgactgagtgacttcactttcacttttcactttcatgcattggagaaggaaatggcaacccactccagtgttcttgcctagagaatcccagggatggaggagcctggtgggctgccatctatggggtctcacagagtcggacacaactgaagcgacttagcagcagcagcagctactataatagaaagtgaatattgaatttttcaggatgtgaactggttccaatgctgtgactacacttactgccaataaaagtgggcagtcatgtctacctcataatgaacatttcaaaaaatgctagaaggctttttttcttaacttgagtactttaagaaaataggaacaacttggagattcaaggttgagatgaaagggcttttaaacatttagtatttagttgggtagatattcagggaaaagcagatgctctgaaataattttcttttaagtcataatctggtgggtgtgagcaggtgtatggattgacccttgttctccttttccaccctggaagccggcatcccatgttcttattacctggagtcccaacttcatgaaaaacaccaaatctctcttctcaatcccctcaattccttgaaatccaatttttca

SEQ ID NO: 34535 - DNA, 892 bp, Bovine  19866881251943
gaaaatccaaaagaaagtgacctgtgaaggactaaaacaactctgggcggggccctaatccctgctttattggctgaaacactccatctttgaggtctggttctctcaaagttgagaaacaatgccccaaataaatagtgcctagaccccaaaaatcatccttacaggaacttccacccaggtctctgctgaaaatttctacattcccaatagcaaatggttctccacaccatgaccaaggtgaaggctgacaattaagaacccattcagcttctagcttccctatggtagccctggaatagaggagcaacagaggaggcccgcagaagccgacgataagaactcaccagaccaacagatttgctcatacattctctaaggataatgtaaacccagctgtttagtctccggctgggtggccaagcctctctctcctgcccacaattgttccaactgtcaattatggcccgtgagtcacctccgcagagataagcattgtgctacagagacaatcccctagggtcatcctgggaatgcttatcgtttttttctcataccacaaatgttccacttggcttcttccatctggcatttcaacacctgaaaaacttcagacttggagtgcaatacacagtgagcttctgagggctttgaatctctttggaggcttctgaatcttgtgatgttgcagggcactcatcacaaagaccagtgatcgctgtacattagtcagtgccctactgtgggtaaagccctgcattatggtggctttacaaacagtctggaacccggcattggtaatgtagcagggagagatgtagaaagctgatagaattacatagcaaatgagtatgaaatgaacaataaatatcttacatggctataaaaacgt

SEQ ID NO: 34536 - DNA, 794 bp, Bovine  19866881297518
aaatgtgtattgtgtattgaatgaatggtgaagcatcattctatattgattgaattgataagtaaattcactatttttcagttgcctgtgaataattaaaactttctgaagattttcagattacacgattaggaatttgttttcttcatatttcatagtttccaaatatttacattatggacttgcgtgaaatagtgtgtgtgtgttttaacatgtcatccatgctatcatagttaattaactggttcttttttttcccccctcagggaggtggtgcaagcaaactgtgttcactggagaaagaagttctcatttatgtgcaaaatgagcgccagtgccaccacgggtgtcctggacccttgtatctacagagtctctgtgaggaaggtataagaacagcctgttccttctctcctttcagaaaccgtggttggttccatcgtcactgactcactttagctctgctttactgttagaactgttataaatttcacttcatacctgcagcataatttacatttctatgataagtatgatgaggaatctaaagaaataaaatattatcaagatccttcatctcattatcattatgcatataattaataatcttatttctgttagtttaggggccataataggtctttgtcctgccattcattgtttctctgatttattaggcactgtttttttagggactttacatattttgtgtctaataacagccctgaaaatgtgttatcttttccgttttcaggaaaaccaaggctcaaagaggttgttactgcacaaactca

SEQ ID NO: 34537 - DNA, 838 bp, Bovine  19866881395443
aaaccctaacatgaatacatttatgcaattggctaaatggtcttttaaaaataaactttaaatgtagcaagacagataatattgctaagtgttgaggctgagtaatgggtacaggaaagtttattttctctactttgtgtatgttagaaacttctcaaatggaaagttaaaaagataaaaaattttacacaaactttaaaattcacatttgtcataaccttgaaagttatattaacactcttacctttccttctgttgctttctttgttgatgaaatttccttcataagcttgggaatttccctgtcaaattattagaaagttctttaaatttctaaagtttaattcacaaaagtatcttaagattaaaaaatgtactattagtactctgtaattagtatttaaatatggaacaaaaattaaacaggttcacatactctaatacaactgcaatatggcgatgccgaattttgacccagaggtcatcatcttcttcaaggattgcctccttttccttcccatctgtcttatatctacaagagaagtatgaaacttttggattatttcgtgccagataaagtaaaagaaaagtttttataaataacaattttaagacacagctcaagaaactgaagatttttaggaggataatgaatacctatccaaaactaaggcatattgctatccatacaacaaaaatcaagcgccatgcccaccatgacctttttactttcaatgttattttttgctgtcattattacagacttttatctcagtatcttagaaacaaaaattcagtgttccacagtcaactttaacaagaggaatttattaacaat

SEQ ID NO: 34538 - DNA, 1102 bp, Bovine  19866881432013
agaagagcctgagggatgagaaaagaggtcaggttttgccgtttcctcttgaagcacataaatagaacaaaaggaagcagtgagacgaagacaatggtaaagaacatgaaatcaacccaggacatgttaaatgttgatggaaagcccaagcaccgaggatttgtggtacccctgaaaatagagtaattaattcagcatgtttttattgatgtctgtgctagtctaccagggactatgctaggcattagacatgcgtgaaaacaaataatgtgtagcttttgttcttagagctcacagtctattgaaaaggctgacatgaaaaaacaatttcaatttaaagtgataagtgctgtaacgagtttgtacagtgtacagtgggaacaacagatggggtgttgacaaggcatcttaggggagatgacatttttgttcagtctttgaaagatgaagagaattttgccacacagagaagataagtaggggtgtttcagagagaaggggggagagctagtataaagacatataagtatgaagtggtgtgtttgggaaattgtgagttgttctatgtgactggagtgtttgctggagataatagctagacagattaaaaccagctagcatgtgtcattctgaggagctgtgtttaaaaagagagccactggaggaattccatcagaagggagtaatggaacctaccaaatctttgcagaaggtggatgggtaggaggggagtgaattggtagcaggtacagactgaaggcttagtggctcagtggtaaagaatccgcctgccaaggcagaagatgtgggtttgacccctgggttgggaagatcccctggagaaggaaatggcaacccactccagtattcttgcctggagaattccatggacagaagagcctggtgggctacatacagtccatagggtcgcaaagagtcggacacgactgagcaactaacactgtctcactcacaaactgaaggcagagagactacactctcatctttcatgtctgcatccccagggtcaagaacattatttgctatatggttggtgctcgacagatgttaaatggagaatacatgaaggaaggcaaggcag

SEQ ID NO: 34539 - DNA, 1840 bp, Bovine  19866881657652
tatacaatggaatagtcatcttaaaaatgacattcagacccaggctacacatagatgacactgatcactgcgccttgctcttcaaccaatgttctaatgttctccgtcagtcatttcaagcattaggcacctactgtgtgccaggcaataggaaatacaaaagaaataaaaacactgctctagagaacatgttactaaacactggaaatctgggcacaatagtaggcaaactgaccctagaataagatacttaactactactaaaggtcatttagagacatattttggtttgtgaataccatttcccattaaaaggaaccagaaatggcagatgaggaaggaaaggtagacaaccagtctggtacatcttgttataacaggaagtaagtgctcaaaaaaacaaaaaccagacatatcacaaggacacagatgccagcttgaaaggatccctccactgctgttgaccaatcatgggaagatatgagtaacaaaataaagtcagtcacaatccattaaaaaaaaaaacacaggaattcatgagttcacactgatgatggttaactgaggtgggagggctcctgactagtaaatacaaagaactgctgaaaccacaaaaaaacatttaccaccatataatataggcaagttaaggggggaaatatggatgagtaacaagatatgtgcatggtgtgcagtctccatgctgcttatttggggctggaaggcagtaattatacagctaagcaagcacaaacacaccttgactggagagagcaaaattaacctccccaggaacaaacagacattagtgcctccagattgaacgacctgaggacccaaatatagagctctactgtattccaggaatctaatcattaagagccaaaactgaaaaaatactcctattaaaaataaagagaaccatggaactgcctggtggtccagtggttaggactcggtgcttgcactcctattgcctgggttcagtccctggtcaggaaactaaaatcctgcaagccatgaggcaccaccaataacaaaaagggaactggctgtttaatactgaatttattaggggcaaagagtaaaacctacatttacacggttcagaaaaaaaaatgtgtggagggaaagggagactgagggaaacaagagagcacatgtacataagataaaggaaatatggaaaatgttcacctgtgaatcaggataaaggagatgggtgtttgtggtactatatacattttctatcttaacctataaacttgaaatcatctccaaacaaaaagctggaaaaagccagtgaaaacccagtcccaactgacaagcaattttctccacaaataactcagattatgacaaatatttagcatactaactttactgagactgattaattcatattttccaaatgaatgtgtatagtaagaaccagtttcatacttacaattcaatacatgctgccaagtcaaatccaagcaaacgacagtctttctctaaaacagagccatgatacaaggtaatcgctaaatccagctctcggggatccagatgatcccctacacatggggacagccttgacctgcaaagcattattgcagaaggaacacttgcacccatataatctatttagagtatcttaccagctacagaaactctgaccctctgataaattatctcctgcctacactggttaagtctgacatacgcccatttccatgaattgccgtattaagcacaaggtcccagggtaacttcctctctcatgaggcattaaatggccgacgagaacaagatttttatatttgatattgctctcattattaatactttggtctct

SEQ ID NO: 34540 - DNA, 1287 bp, Bovine  19866881848223
ctttaaaaataatagtttttcccttattttgccaacatggaaatactagaccaaagtaactctaacacactatatttcttggacctggtttgaaagttaaggactgggaattactggttccataggagcaacattctttttcagtgactaattgagtccaagaaaactgagatctttccacacagaaactgtcatgtaagaccagaaaaactcttgaggtttatctgctgtgctatttaactggatccagatcagatattcttacttctacttgatgtatgttgtattctattcttgcctcaaaataactgatttctgatgcagcaaagaagaaaacaaaacaacgggtccatgtcagtaaggtcaagtggctatcccttgttctttatccattacctccttggaataattttcagtttcatgtaagcttgaatcttcagagaaaaggcagttttgtttctgactgcatctcaattttcctcctgttgttctaatatttgactcctaaacccagcagatattattgttagttaacagagctcttacgttagggcatcttatggaagcttaacatactgaatcttatacttctcttagtctttcatatagcactaatgggaattctgcagctcatctaatattaacaagtaatgacacatactgcataataatagcattatactcattcatgtatctcagacttaaataacacacacttgtttttgaatttatgactgattcgtttagaattaagcattttacatatttaaactgtagtataacactttcccaaagcacaagcacccacattttatataaattattgcatcaagaagagtgaataaatttagtacaatactgtagggagtataatatggaagatttccttcccaggaattatacctattcttggcagaatttatagtttaaattattgtcacttcttgtctcgcaaacacaaaatttaaaagctagagccaaatctgtcgaacattgtctgtcacaggtttgacacttaaacactaaaactatactcagatgtatagtgttttttcccactggatggttttacagaaaaagcaggcttttcattattatgtgcagtgaccacagaggctgtgttcctataaccacacgtggcacactgctctggtactgccattccgatgttccctgttggtaggtgagaaagagtggtgggcaccttcagagaagaaatcagtgttggctttcctcttgatagacgaacatgcttcattttttaaataggttcatttgctctaagtg

SEQ ID NO: 34541 - DNA, 2098 bp, Bovine  19866880395427
ggcctgacatagaagcagtgctcagaaacacttccaaaataaattagtaaatacttgaacaaagtaatcgtcagttcctgggcccttttgttttctatgcactcacttccctgtctactggacgcaggggtctctatgtatgtgtgttgaccctggacccactggggtatggctccaaatcctgggtctaggtcccagtaggtctaagacacactgtacagggtcaaagtcccttgaccttatgactgaatttgagtttacagaatgcccaaatagggaaggacattagagacttctgggttcaactgctcccgtgaaggaataagcaatgtcttactcctctttaatattcaatgccaagcacaggacctggtataaagtgggtgcttggtaaatatttgattttgcatgaatccctctaatacttttataaataagaaaatgaaagcccagagagggaaaacaaactctctcagtcacatagtaattttctggtagtctagtttccagcttggctcctgacttccaagaagccagaatccagtgaacttttcctaaggtcttgtttctcatcacagatcaaaggttatatgaagtatgatgttaattacttgttccgaatttatctcagatcattggtggatccaacgtggatgagttcatgttgctttaaatccatgaaggcaaaaggcaactgatgcggcagcaatagagctgacttttgaaactgacagttttgagcctaagagtctgcagaggcacctgccaaatgcatgaccttgggcagatctcctaattgccctgagcatcagtctcctcccccacctcttgctccaaacagggaccataacgcctatctttcagggttgcagtaaagatccccactaacgtgtgccgtttgcctggaacatcttactcttagatggccagtcgcttgatgacgttgtattttcagtctgtgcttcaaagctgtcccgaggctccagccatcatcacctttggcgattgtttgcccttacaaaggcacccagtctccgcgccccgccatcctgctattttagtttccacagtgccactgctcactgaggaacagccactgaccataaagtttgacattttcaagattaaagtgctttgaattagtcatgcacatgtgaagtcattgttcctgtttgtcctgctccagaatctaaaaatgactttcagcagagcccagtaactttcctccacagtcaccttctggtgagggatggaggagtttaagccaagggaaaactctcagttgctcagaagaaaaccagagaagaggaatggcatgaatcagcattattaggagagaggggtctgctctgccaaggcttggtggtcctctgcctctacaaggagaagtgggggcccagagctctggggagaatgggatgaggcaaagaaatctcacctagtcttgttgtaagcacaggagcagagcaggtgctgggcagtcacagggttctgggttcagaacctgcctttatgagctgcgtgacctcaggtacgcccatatcttgagtcaatattgttctcatgtgcaagacagaaatagtgcctctttcataaggctgctgtgggaattgaatatgctaacaaggcccttagcatagtgcctggcaagtggctggcaatcagtaaatattttttgtctctcaaaagcttcccaactttccatgactcagattatcttcagagtcttttaaatgctgtgcatttccagaatcccagagaaggccacttgcaaatattactaaaatgcttagccaaacggaagtgaacttgggatttctcagtctgcccttaatgcacgtaagtagggcggaccacagcccgcagttttcttgcggagaactcaaaagaggactcctctttgctttatacctagttgtctggctgcacatctctggggggatgtgggatggttctccatccaggcaagaagtctggtcctcaaccagctggcctcctgaccacctactcagccgatccccacgaagtgatcacatagaatcgtaatgtgtaataatagctaccattccttactgggagtcagtcagggtgttaagta

SEQ ID NO: 34542 - DNA, 2768 bp, Bovine  19866880436044
attccttataccacagcacagactagtggatcctctcacagtatcatcaaagagatcctcctggagctgcacatttgagtctctgattttcaagatgtgttacatacgtagccagtaataaggcctgccaatatatttccatcagtgcaggcaacacttcctattacaaatgcaggagattaagatttagatatagttgatcatccattattgattgcattctttaaaacagattatgtaagtcatttatcctgcctaatagtttatactttgtgtaaacacataaaattataactttgtaaggacaaactagaagctagaaggttttaagcaaactattagcattttaataactcattcctttataatgaatccttttgcaatgcgggagaccctggttagattcctgggtcgggaagatctactggagaagggataggctacccactccagtattcttgggcttcccttgtggttcagctggtaaagaatctgcctgcaatgcaggagaccctgggtttgatccctgggttgggaagatcccctggagaagggaacagctacccactccagtattctggcctggagaattccatggtctgtatagtccatggtgtcgcaaagagtcggacccgactgagtgattttcacgtacttcctttataaaggaattatcaagaatatgtcatgtagatacattataatcagatggatgtagaaattttcgttatcacttagataaagcaagatatcttaattatactagtgccagctttgtgtttgggaaatgcatgagaaagagaaatgatgggctgctttagttcttctttggcatgtttaattccaagaatggaaaataattttaaaggtactatatgtggaattattgctctagtataaaaatttatatctttgtttagagataaagctctaaagaattatatatggacattgttaaaatggttaggtatatagatttgctgtccccaaagcatgtccaactttgttagactatgaattgaacatattgtgaggacctaatactatagttgaggttgagtatttgattttatatctgtctctcatcctcaaagaaagaaaatatgttattctaatccttatatgttatcacaaagggataagaaaaaataactatgtgtctggcatttggtgatttatttttctctccctctggaatgcaatcatctttgttttttatgcctacaggttccattctgattggtgttcaccttccaactgtgatgagatccatgaccgggtaaagaatgtcttgaaatcacatcaggctcatcaaagacatttatatgttagtttctaaatttttctcttgaaggctttttttaaaattaggcatgaaaaccacccaagatgtttaatgctcacaatatttaatccctgggaaggaaaagaaaagatacaacttccatttaatggaagtcagtggtttagctaaagggaacatatctaacttcctgcctgacctgagtcattatgcaaaatgtttgacacagatcatgttaactataaaaaaaatattagtgatacctatctcataaagagtcagtaagtagtgatttcacgataatttttcacagccttcaaaatacgggaactcttattttatgacccggaataaattccatttcctgcaaatagatttgattgaatggtagaatgagaggagggatgagacatgtgttttggagaagtttcccagctgatttttatgctatttaaatacttaaaagaggacaagaagaggtcaggtttatcagtttagtactaaataacatcagtatgaaaatctgacataaggcaaatgaacatataaataaatgacaggtgggaaataattacagtatattattctttttatgtttggtatcttgtttcagtcatttatttaaaaacaattgtttatcaggagtcatgttggacaccaagcttggtcctgggaatgtaactggattatgtgacattggcatcattttatatagttgaaagcttctattatgcataattttaaattaaacttgttttcaaagtataattacagatagtcccagtgactgcctctcccaaggttaacattatcctaacttctaataacaagattagaagtgttagaagattagaagtaaaagtattgcatgtttttatgtttatagcagtgacatcctaccatgtcttttcccttttttttccttacttatttcattttgtttttccagttcggatatttttgcaatgcagacatcttgttacctagttcttcactcttgctgctgcatggtatttcattgtgtgaaaatactaccattggttaatgcattcatctatcgatgggcctttgggttgtttctggtttgagctattttagaactgttatgaacagtatgtatcctcagataacattgtatacattttatttgggtatgttgccaccactgtattgctcagtcataaactgtataaacattaagcttttccaagtgattttaattatttacactcccactaccagtgtgaatgagttcagtttgtttcgtatgctcacttctgcttgataggttgtgtgcatgtatatgtgtgtgtgcatacatgcattttaattttggcattttgactgtgagaagtagttttatcacataatggtttcaatttgctgtttcctggtgactagtttattgactgtttgggtattctcttttgtgagtatttgttcaagttacttgcccatttttata

SEQ ID NO: 34543 - DNA, 2665 bp, Bovine  19866880465649
ctgcacaaataagagagactgatctagttggttttgatagattatatgtaccttttaacctttgctatatatatggtttacccaagggtcataatatgtataaaatatattctcctggccaaactaatttttattttttatgtttaggataaatttgtttaccatacggctccagttgaaaaaccacacggcagactacaaaacagaacatcaaggtcacaaaagaaaaaatccaagtcacctgagaggaataagtattgcataaatgcaaaaaactacgaacagcctacaatttcttcaaaatcacactctccatctccttacacaaaaagacgcatgtgtgagctatcggaagacaccaggcggcggctggcccatttaaatctcggcccttatgaattcaaaaaagaaacagataaacctccatttgtgattagacatgtatgtgttctttgaaacatttccgtttgaaattgatctaatttgtaattgcactaaaatattactcaaacttctttcaacttctagcttatatgaataatttttcttcatgaactgtatgttagcctagcaatctaaaatggaaaattaacttaataaaaacattcttttgcagcctttaaacctgacagagatcaagctccattatgaatcccataagtcctctaagtagccatttcctttcttcttataagtggacagcgtaataactttacaaattgaactgatatataattgacattagtactaaaatggcagagtaggattttaaaataggaactagttttctttgtgaaaaggaagacacccaccccccagccctttaaaaaattgtaatggaatagtttcccttgtaattatgtcccttgggtaaaccttatataatggagtttgaagcaaatcatcatttgatgggaacagaaaggcctttcaaagagaagacttaactttaagggtaatagagtttctaatctttctgtatggaagcctgttatgatgtgttttgtgtttaaagcttgtatccatatgatagtcaaaaagattttggctaatttttaagggtctatagtccatcctaaaggagaccagtcctaggtgttcattgaaaggactaatgctgaggctgaaactccaatagtttggccacctcatatgaagagttgattcattggaaaagaccctgatgctgggagggattgggggcaggaggagaaggggacgacagaggatgagatggctggatggcatcaccgacttgatgcacaaaagtttgggagaactccgggagttggtgatggacagggaggcctggcatgctgtgattcatggggtcgcaaagagttggacacaactgagtgactgaactgaactgaagtgaactgatgcccttcatgggcttccctggtggccagtcggtaaggaatctgcctgcaatgcaggagacccaggtttgacccctggatcaggaagatcccttggagaagggaatggcaacccactctagtattcttgcctggagaattccatggacaaaggagcctggtgggttacagtccatgaggttgcaaacagttggacacaactgagtgactaacacacgtacacatgacctttatgtgtcctagctttggccagttaaacaaatcccactaaccataaaggccttcctaagaaagccagggatcttcctgcttaagctttgttatgatctttttacctagcccaaggcttcaagtcaggcacaacacaactctagctagtaagttgaagctgacacaatgccttttagggctgaggcagtgtcagggtacacatgtcaaaattacaattccagaggttacatgtagtacctctggagacagagtttacattgttagggcaccccaagcagaacatatatcagctaggtagtactggttgacagcctccaagatggcctccaaccatggtacctcctactctgggattctcagttcagtccaataattcagttcagtttttggtttcaaaggggcttcccaaggcagtcatttccaaacagatttgcttggacactatatcagtttatccacctcatgtgtgtggacagcatctggaagtgttctgcatcgaaagtgcaggagctggagccattctctgctgcttcatagtcggcactgtcaggtgtgattgagggctcagcagtccagctgaattatatgtgttcacagcagcttggtaggcagcatggggagttttccttcaagaagagagggaagcttccaggaacagttctgaaaaacaaaaaccattaatgtactccccactctctgtgcctctccagaatgtgttttcttcattgtcaaaaaatcaagtgtatcccatttagcaactataactttttattttttagttatcccctactccaacccagagctcttgtttggaaaggctgtgtgcaagagacaaaagcagtttcacagaaaagatttttgatgtaatttaaccacaaagtcgtatcatgttaaggagttggtcatgaagatattctgaattttcaaaggttttcaaaatgatttatagagatcaatctatttctggggatagttgtatttaacagtcaaattgccttaataagatgtgtctactaggaaaaaggtgagggaaataaagttcacactattag

SEQ ID NO: 34544 - DNA, 3171 bp, Bovine  19866880487860
ccagtttgaatctgaaagcaaattatagtggtgtcattttgatattgatgggtccagactaaagatctttggcaaacatttccttccggcagtcggtgtggttcatattgttctctctcagtccgtgtggcaaacactggctccagccttctcatgtgccaagaacagtgagcgtcactggtggtgaacagaacgggggaggtgatgatggcccaggaggacagcagtgatgctggggactgtctatgagccagggacacccagggtcctctggccagagagattggggtgaggggcttagtgaaggagggattcatgacctgggctttggagatgctgggcagccacaaagctaccttactgagtgccatcaccatgtgcctggctttagtcctcacgccggcctctgcagtgagaggcagaagggctcagtgtttaatggccctgaaactcagggattaaatcctgatgggtcatctctggagtctacagcaagtgattcaaactgcttcttagtctcttgtttggtgaaatgggaatgcaggaaccaccccatagggtggttgtgaacaccagaagaaattgcgcacaccggtgaatgcagagatgaggtgggagggaggagagagcagatgggcagggtcaggtcccgcagctgtgatcacccagtgaggtcacctcttctgtgggccagttgcattgtgcagacccacagaggcacccagaaaaggctcgaaagctgttagttatggttagtgccacacagctggaggtgtcagagctgggatctgaacccaggcccatctagctcaaagccacttgatcttaattcaacctattgccacgatgactaaaagtaatggaaagggccatgtctcagcacaggttttctgactcactctttgcaggaatattcctttggaatagaaaaccctcctctgagaggcctgaccccacccccaggcagtgcctgagtctcctctgggttcccatgccctgtgcatccctcggtccacacagcagtcactcgaaatcctccttctccacttacagctccgtctgcccctgctgagttcctgagagcagggaaccgagcacagaatttcaacacaggttggaacatcaccccatgttggaatgtttctcacatagaaagtttccctttaacagtagcaggtaggaaatgtaagtgtgttaataaaccatggggctggcagttgtaaaatattaatgatttctagaattgaaaatgcaaatagctgtctggaactcctccacttggcattaaagagaagggctttgaaaggacatgtgggaaactcggggattggagaatatggccttgctggaagatgaggagacaaatagccatttactgccctgtcactgccacattagcagcattacaaagcaagcaccagttcctccgaaggcaagtcagtcacatgtgctgtctgacggcagggctttaaagtgagtgactggcttgtccatccactccaacgttcacacgcggagcacttactatgagccagggaggagagggcgcaacccctgcaacataagaccttcacttcaccctcaaaccagagagaaatgtgggctgggggagacaggagatcccagtccagccctgatcagttcagtccacagctgggctgtgacccaagtgaggggagggggctggtctgggggaagcactcacccccacagcactggctcgtctgtgaactctgcagacaaccaagcatactctccccagcccttgggtctcgaatacaaaacatgcttcccatttttcaaatcgtgtgtggttgcgtgcatgcgtgctaagtcacttcagttgtgtccagctctttgagaccctatggactgtagcctgccaggctcctctgtccatgatattctctgggcaagaatactggagtgggttgtcatgccctcctccagaggatctccccaacccaggaactgaagccatgtctcttacgtctcctgcattagctggtgagttccttaccactcgtaccacaagggaagtccagggcgtggttactagatggtaagtttctggaaggcagcctcatgactgcatcttctcaccatctccagcgctcagcactggcactatgtggcagggcccaggagaactggcaggggcagcttgccgagtgccaaagtggggtgagagagtggggtgccaaggatggatagtcaccccgtgcggtcaccccattgtggcactggctgccttgagggggccccacatctcagtgccgtcagctaccctctccctgccagagacaggctgggctgcactgccctgtggagctccagaggcacccagcctcctgccaactgacgccagcttcttttcgatgtactcatggtgttaggcagtcaggaacacgtcctgggaaggcccctgtctctctatgcgggcctcgccagtcctatcctgtttccctctgtgctcagagactagctttcaaaaggtacactttgttcctgattctcagaaatcgagagcaacaagctgtcctgtcactggtgtccccgacaagttctgaggcctaacaggatctttattgtggggtctgtgcatctggatttggatggttttagccgcttcctgcttccctctggctctttgctgtggtatggatgtgtgaggttatgagtacggggaagctctggataagtgaggcaccgagctggaggggaaggagcaccaggttctggagtcagtgacctgggctttatccaagcacagcttgtgtaaagactctcaccacctgtggggtctgagggtggggattagagccctgccctctgggagccgcctgaacagaaggagattatatgataacatgccccagtgcccacacagatcagctgctcggccctcaggatctccctttctctcccctgtcctcccaggatcctggttttcctatctcctggttgtgcatacattcgaacccctctatgtctctaattgcaagcatattaatcctcctccttcatcctttgaaaatgcctttcctccttctcctcttgcacacggcttgcgtttatgttataaatccaatctgtttgctctaagctttttgagttcccagagaggctgcatcggtattatcttagtacttcttgtcctgttccaggaag

SEQ ID NO: 34545 - DNA, 1482 bp, Bovine  19866880488347
ctgagtagagttccatatgctatacagtaggtccttgttggttatctgttttgaatatagcagtatgtatatgacttgcccaacccccctaactatccctttccctctggtaaccagaagtttcttttctaactctgtgagtctcttctgttttgtaagttcatttgtgtagtttatttttagattccacatataaggaatacatatggaatattactcagccattaaaaagaatggaaaatgccatttgcggcaacatggattgacctacagagtgtcatactgagtgaagttaagtcagacagagaaggggagatatcagatgacatcccttatacaaggaagaattcttaaaggatgcagtatttgaactggtctggttcaagaagtcagctttgcttaacaggaaaattacctttactctatgtggccagttttctcatccttcaagacctcagtcaatgccctctcctccaggaagtcttccctactaactccatgctggaataggactctctaggctctcatagctccactccttcaccccctccaaacctgtgcttccctagacaccttacctatttcactccagtacagatgaccagtttatacacctgcctctttggctagctcatgtgctctctaaagacaggtctatgccttattcctgtcttcattcttggtggcccacagagggcctggataagacaggtgttcaaaagtgattgaagaatgaacgaacacccccagagtgagcaacttgaaagaagacttgattgtgcttagggaacacaaggatgaatatttatccatgggccaaaaagttaaattgggatttgatcagaaaggccctaaatgacaagccaagggaagggtttgagcttttacagatggatctggctgctctaaagaagatggctgggagtggaagatgggggtgggagggaaggagctgtaagccaggcagaaagagcagtcagaaagctgtaaccatgatccaagccaaaggtcagagtggcctggaccagataacagccatgggaatggagagaggggaagagctggatgggagctttgaagccccagccaccctggtggcagcaacactgggtcaccagccagctattccaattattcatagaaaatcaatcccattccatggagactcagataaaactcatgcacagtaatggatggagagcttagagtgaggagataagaggaggccccgggtgtggggtgatcaggtggggctttgcaggagggggaggaatggtaagaggttatcaaaacagccctcaaatagcaaaggctcagagccggtctgcccagctgtggctgcagagggacacacaggctcaccccaggcctgggagagtcagacctagtggtccttgggcattagtcccagcagcaggggagactgattgaatcttgctaccctgagatgacatggaggtcctataccctctattaggagac

SEQ ID NO: 34546 - DNA, 1158 bp, Bovine  19866880647598
acctggggctcgatttagacccttggcacacatacacaaaaatgtaataaagttctatttgcaattccatggtaagttagttatgttacagaatcagctgtttccataggtctctttttcccttaggcatgctattttcctagcattagataccactttttaaagagagtggtgaagtgtgggatcactgggcttggaatccaatgaactcggcacaaattttggttccatttactggctggaagctcttggccgagtcacttaatcttgctgagcttcagttttctcacctgaaaaagtgggataataattgatagctcttcctcaaataatggcgatccaaatttaaacgagatcatagacaccagagaaaacacgctgagcacactgtttggcacgtgaatttgctgaactaaaagacttattttcctgcaaagtcctctcactgctcgtaggttctgtgaggttacactgtgcgacatttcagttctttactctcagtctagagcctagccctcaatagttgcttagattagtttagattagttctgccactggcctgctgctgctgctgctaagtcacttcagttgtgtccgactctgtgcgaccccacagacggcagcccaccaggctcccccgtccctgggattctccaggcaagaacactggagtgggttgccatttccttctccaatgcatgaaagtgaaactacattcacccaaaactttctccagatctgggtccttctcttgctttctcttggctggtaagtctctaagtctgcatagttcagcatatatatatatatatacatatatatatatacatatatatatatatatttacttaagtctctgagtctgcatagttcaacatacttccaatccatcctttatatatatatatatataaattttatttacttatttattggtagtgctgcatttctgtcgctatgcacaggctttctctagttgcagtgagcaggggctacgctctagttgctgtgcccaggcttctcatcgtggtggcctctcttgttgagaagcgcaggctctagggtgtacaggcttcagtggttgcagtgcatgggctcagtagttggggtgcaggggcttagttgccctgtggcatgtagaatcttcccagaccaggg

SEQ ID NO: 34547 - DNA, 1331 bp, Bovine  19866880655395
taactgaagtcactagactaagcaacactagggttatgactttgcctgtctttttcacaagttgttttcccagggccttgcacacagaaggtactcaataaatcctcgtggactagttgtagagcactggtttgccctttggtggtgtgagtgcatcaggcaagaactgagtgcccaggtttttcctaacgcatgctctacctttcatctgtcccagcctccagaaatctctcaccaggttcagtttcaggcttattagcaaatgcaaattgaattacgagttgccctttcacaacaaggacaacaaaaacagtttccccaggaaaagagggtgagaagaggtgaaagctaggatgaaagtcgaagacaatacattctaatcaaacttgataaatatgtaaattaaagcagctaaacagttggctttgacaaatgacttctcggtaatggatttttccacactgaaaggcgagagttcagccaacctgctagttgcaatcagaatcctctcctgctttcccggtgatgcgggctgacggggcaggtgctgggatgctcagaggcggagcagagaactgatccttcttttaatggatgccatttattgagcatctgctagctgctaggcgagcctcccttggccctttgagggcagagaatccctgtctcgtggaggaggaagccagggaaaaggcgaggaagggcttgactcaccagactcccaagtctggagttgctcaggggccaaagcaaccagtccattctgaaggagatcagtcctgggatttctttggaaggaatgatgctaaagctgaaactccagtactttggccacctcatgcgaagagttgactcattggaaaagattctgatgctgggagggactgggggcaggaggagaagaggacgacagaggatgagatggctggatggcatcactgactcgatggacgtgagtctgagtgaactccgggagttggtgatggacagggaggcctggcatgctgcgattcatggggtcgcaaagagtcggacatgactgagcggctgaactgaactgaaagcaaccagatgttgagaatgtaaatttaacccctccagtggatttactgcggtctggggtggggtgggggagctcaccaactcaacagttactgccttttttttttttctacccctcacaggacctggcacagtggtggtcttcagaaaagagctttccttaacttgctacatagctttagaaggaccccttccctctggcccctcccatctctgtttttccatctgtaaaattagctgtgggggtcgccctgcgaaggctcagacag

SEQ ID NO: 34548 - DNA, 1345 bp, Bovine  19866880671646
attcagctgtgtgacgttgggcaagtgacacaccctttctgacgttttctttattgctaaaatgaggatactatgtaaagctctggcttatgtaaaaattaaatgagatgatgcatgtaaaacatagcaccatgcctgacagtcttattaaaagaagatttctgggttagaaaagctagccataacattggcagggccagacactgttttcagaagtactttatttttgtattatctctaatagttctcaccactgaaagatgggtgttattattattatcctcattctatgagtgaagaaatgaattaaagtaattgcctgtgcaatcctgcagacggtactggcccccgagagtgtgagcagaatgtgtattcttagtccctacagctttccaccctcgtgatgagacaggcattggctgaggccaggaccctccctgactaccctcccctcatctcctgctctctcttgctgtctgtgcaccccttgcctttggaagtcaggctacctgacatgagaatcccttctctcccagcctttgctgtagccccaagccctggacctctgtcggggagcctcagcctgcttctaaacaacctgtcaggctgccagagggctgggcggcctgtctgcttttatcagggcagctgacagagctgggcaggcttggcaacagcttcagctatgaacagaatctcaatgaaggctttcacccaacctacagtatgtgtttatgacctgggagccttgccctggcagctggggaggagagtaaatattgcaggcttggggcccagctgtcaacccctaccccccacctgcaatgattagatggcttcctgtcctcagctatggtgaaagccattcagctgtgtgtgtgtgtgagtgtgtgtgtgtgtgtgtgtgtgtgtgtgtgtaatagggaaagagggacgcctcattcaccaagaagctggttccctggggtcaagaagggtccagcaaacagggagtatgggaagagaaggggagaagaaggaggaggagacaaagaatctgaatccactgagaaataaaaatcagagggaagtgaaggcccactggaaaataaagtatgtagactatctcagatgacctaatctgacactgttccacctaaatggtttactgacttaagaattctagagatttggaggtggaaggacaaaatagccccttacaaaattgatttaaacattatcttttatgttcaaaaggcacacaacctaaatctgtaacataagtcccaaataggtttcagtcaatcagttcttattctcaccatcaggatgtacctctgctctactgctctagccgccctcccca

SEQ ID NO: 34549 - DNA, 1631 bp, Bovine  19866880720620
aaaaattgtaaatgtttcctcattggcttattaatttctaaaactccatcaggggaatggcagcgtaattacttattggctgaaccagtatatcttacatagggaggcaagattaataaaacaaaatattcttttgggtacatattattatagttgcataatgcatatcaagacaaagtacatttttccaaggggtaaaattcatactgttctatataagaaaattttaccacagggcaactcctgctttatcttttcatttcaaactctatctgaaaatttaaaagtcttgtttctcataaaccttccacaccatggtcagtgataagcctacagtctagtgttaggggtttagaaatagttctattttaaaatacacagaatcattctgagaatcaagtggtagaaacatactttcagaaataaattcatattcagatgaaagatcataataacatatgtaacagattctattaatataacagctactgctgtcatcatgattatctggttgtattgcatcctaaactaattggcatgtttgcttttgatattgtaaagctaatatgtaatgagaggcagcattttataacaaaaagaaggctgcttttggaataggggagactaaggtgtacattcctgtcgtgccaggtactatctgtgtgagcacgggtaagtctttagtctgagttttttcttcatttcttaagtgaggattcaagtacttaccttgtagagatgtgtgaggtatataattattcatataaaataccccgtgcaatgcctgtttataatgcaccatcactgaatggttactatggctatttgtttggcttataactaatgaagacactgactttgttattactaaatcaatccctttaggagactgaacacaaatgaaagataatagaggtctttaaaaatgtctctgacattctggccatttggccagggagtcagttaccatcctcccttcataaatgcaaagtcgactacataaaagaaaaaaaataattgattccctccaagtattcatcaaatgagataagatctctgagaaagattaagggcttacattttttattagacctgcttcccataaaatttcatagaggataaaaggagggggaagtgtagaagcagcactgtttctgttttatctgctaccctgcagttataaatcttcctgagatatcattaattatagtggtgccattcacaacgctgctattccaggcctgctagaatttttactaaaaattctaggactgggacttagaaatttgcagctgaatttttgtatgaggttgaaacttgaagactgtgacagaagtaacacgttcaaactatcactatggactgaacgtctgtgtcctctccccagtacacatgctgaaaccctaacccccaatgcaatggatccgtgggttcagttcagttcagttcagttcagtcactcagtcgtgtctgactctttgcgaccccatgaattgcagcacgccaggcctccctgtccatcaccaactcccggagtccacccaaacccatgtccattgagtcggtgatgccatccagccatctcatcctctgtcgtccccttctcctcctgccctcaatccctcccagca

SEQ ID NO: 34550 - DNA, 932 bp, Bovine  19866880744830
cctggtggaagttatagaacatggccaaatgcatcacatatgccctgataagggaactcaaagattctggatgcagagtcttcggaattcagcacatgcaaaagatttctcttcctttcctcctctttttctctctctctctctcacatacacatacaccaaaaccacaggaaaattaaatggaataaccaaatgaaaaaaaatcaagaaagctcagacttaaagttgttttcaatttaaagccatgccctggctgccctgcctccctgccacccaggtgcctacagcataacgttcagaggctgtgcgcttggctagaggtgtcctagactagaaatctgcccattaagacactagatggagccagatgggaaagtttctgctctcgctgcagaggaaccattttctctgctctttccttttcaggagcagtagcatgatatggctggtctcacagaaaacctatttctctaatagtcttcatttgagctgtcctcaatcagtcattcttagaacattcaccaagcccttgctctgagtcagctttcagacacaaagctgagtcaaatacagtcctcgcctcctttctctggaggggtgtatgggctggtgggagaggccgcttagttaacaggctgatcttactttacttttcttcgctctttctagactccaggcaacagggcccaacacattgcctgatcttgcactggaattctctagcttcttgacttccttcttgcaattttctctctcagaaaagaggtttccttctatttctttgtatctaaatcttaatctctatcaggcccaatccaaatgcgtcttccgctgggaagcctttcctgatttttcccacacagaattcctctttgattcctttaaccctttgtttagtgcaccagttatcaagatttactatgtatcagaat

SEQ ID NO: 34551 - DNA, 959 bp, Bovine  19866880776174
cagatgaggaaacaggatcagagaagtaaagtaagttacccaagaccaccttgtaagtaaggagtctagctcaaagggtacttcttctccaaagcctgccatggtttgtcctggccaaagtgattgatctcccttgcccccaaggtcctgtagcagctactgtccccttattcaaactcagtatttgaggtcttctctcagtcgtatcagagagtttttcttttttgtgggtttttgtctagtgtccctaacaatgttcattcccagtggcccaaggccccagctaggtcctgcaagtgtacttctgagtaaacattaatctgaggtataggagggaaagtgctgaactctggctacctggtctgagttctcacgctgttcaagttctgatcctcatttccgtgaccttgtgtaagcatgaactgtccagaatgggaaccctgcctgtcctactcctcctgcatccctgggcctgctggtttagtggacagatgcatggatttaccatttggaacctcatctccatcttgaaagggttgagtgaaatgatctgaggactgctctcagttcaaatattgcccagttttgtgagtctgaaggattgcttctctccataccaacatgattctgagcttcagagtttcagctcagggaggctgagcatagcttgtcatttctaggttggtggctatatctcaaatttttgcccttgaacttgtcaaactgaagactaacccaggagctttgcctcaacacattcagaagtcctgataccaccctctcatcccctgcatctctctcagtttctttgtttcttcacttgcaaaaacacccacccatcccatttcaggataacttcatttgaagcactttcactgagttttacttttaacagctttttaatttagaaagaaagaacaaggtttaataggagggtagctgctgttcttcagaaagac

SEQ ID NO: 34552 - DNA, 1701 bp, Bovine  19866880776244
ctgtgttggtgcagcagtcagctagccctcaaatagctgcaacctgtgactgccctcaggtctccccaggggatgccgtgaacggcaacctcctgacactggtgctggcatctgccgaaggaaggcttaagaggccacaggccagttctcccaacgtgggtctcggggtgagagctttcctgtagagttcagtgctgggaaatgctccatgtggctttagcatggcctgggcttttgttggaattagcacacatggtaaataaatgagcagtctcattagaataagtggcccacggacatacacaccagggtgtcatgtggggactcaggagatgactcctcctcacaacccaggacactctgggaagagggactctcctgacagccttacaccctctgcttgtcccttagttcggttcacaggcccagatcgcacacttggtcagaaaatctgctcttctcatttggggaaaaggcagatggtgatccttgaaagacatttccttcaaggtgaaggtcaagttcccacttttgcaaagagctcaatcaatggtatgtgaatgtgaatctgtactgagctgtgaggagaggggaaagaggaagagggagggagggccagtgggggatgagaggagagaggaagaacagacacatggggctggaggtgggaagggcagggagtgctgaggccgcccgtagttccctcctgccccgggcagcaccagctcctttaatcttcatcaccagggcagttaagtgtcgggttctgcacacctgaacaggatagtgcaaacggaggacactagagtccagtgcagattttggtgcaaaacatttccactcaagagaggaaaggagctaaggaaaaagaaggagagagaaaggatgagtggaggagaggggaagggagatgggaggctgggggaaggagaagacagcaggtgggattgagcgagggcatgctagacacatgggcacgctagacacatgtgtgagtgagtgtgtatgtgtacaagggacagagtcctgcagacctacagacaagaagagaagtgggggatcagaggtggggaggtgggaagaaacaggcaggagggtggatgaccacacgggagggaaacctgggagaggtgagcggactgcccctcccttctctgccccccaaaggtggctcaggcccccagagctcagatcctggctcagacaaaggacttggcagcctcccaacctctgcaggatgaagacagactttccaaggcagccatgcaccctgggggccaggagagggcacttcagcctcagacaacagcaatgagcctcagcctgtggtccctgccagccaggcagagagagacagagatgagggagggaagggagaggccagcctccggttcaggtcagggggttactaccaggacctcttggtggagccaggttactctgtgcatccatgcagacacaggatgggcactgagctggtttgggtcccctaggggcctctgcgccagcctagtgtctcctctagccctgccctgccctgcccctaactgatggcagatttctgtcctgaagggcagggtgcctccagcttctccctatgctccctctcttccccttcaccaaaagccatccctttcttgagtacagggaagattagatttcagaaccatttcttctaccctccgccatcgattgcacaac

SEQ ID NO: 34553 - DNA, 3353 bp, Bovine  19866880805946
ctggtactggatctgaggggtgttcctgactcccttcttagttgggggcgacaatattcagaggaggtgtcaggtgtgtcctgggaccatagccctgtttctcttcctccctcctcatttcaatggctatcgtctcctatactgccaggctgctttggtaagctttcactccagggtgtgcgtaggttcctgtcctgcttggttggtgacctaacacatgacattgaatagaagtcttccactcactcggtttccacatttgtgcaagtgatgcttaccctcttggatccactgtctcctctttgtaaagtagatgaaggagtacccatcttgaggggtagatggcaccgtgctggcaatgctctcagcaacctgccaggcacatagagagcactcagtaaacaggagtttggggcaatgcctgggggcgagacactccaggctgactcagaacagacaggggcagcttgctgtactctgtactcttctgctcaagggtgctccagctgggttctgtggatcctgacacacttccggggaaaacccttgagtttcatggaccccttgcagtggtaatttagacagttattggtgagctggggtatcctgctagaatcctgagcgaggcttcgggaattttgtgactctcagatatgctcacatcttaagtgggcgaggctagttgctgtgaagctagttcctcttattgtatccttgttctaccccattctaccctgttctcaggagcacatgttctcaagtgaaaatcatggtcccccttggggtgtgaaaggggccagtgctgccatctacagacagaagagtgattagactcacttcttggaaagcctggtgaagagcaactgaaaaaagaggaaagaaattggttgctaatccccactgcctctatgttttaaaatctgtcattgtttaccactgttgtcgtcagatgtctcaccttaatggacatttctgcttgcaaaccagggtacgtgtggtgtcacttccatttgggactgccactggagccctggcaccatcctggtgccttgtgtagaatacaaagggtttaggagtctgcttaattatatattgtgtcattgctttggtattggatcaacatttgtgaaggtcctgtgcaaacctttggttttagcaggtcccaatgggatggagaagtgaagtagctcagtcgtgtctgactctttgcgaccccgtggactgtagcctaccaggctcttccctccatgggattctccaggcaagaatactggagtgggttgtcatttccttctccaggggatcttcccaacccagggatagaacccgggtctcccgcattgcaggcagacgctttaacctctgagccaccagggaagcccaatgggataggatgatccaaaaggagatacctggaattggccaaatggggaattttggttcttgtgcattactgggttccaaagaactctctccagatataacttggccagtgcctggagagcaaagaggacatgttctggggtcagagatctgcctggctggtgtggggagcaaagaaaagagtgtgagtctatgcaccccaggtctcatggtggagttgtgatttgccaccaactttccttggctgtgtagatgcgaacagttaagaccctgatgctgggaaagattgaaggcaggaggataaggagacgacagaggatgagatggttggatggcatcaccaactcgatggacatgagtttgagtaagctctgggagttggtgatggacagggaggcctggcgtgctgcagcccatggggtcgtaaacagttggacacaactgagcacctgaactgaactgaactagtttcagcacctgtgctggggaaacaaggcgaggttccatttcctgcacccagttgctcatttatttaacaaatattttgtaaatctttgtaactgagtggagaagcaggacttgggcagggaggtgtttaaagaaaagggatggtcaggaagagtgtggggccagaaggtgggttgtatggggtctctataagggtaaagtgagagatagaactgacccagaatgcctgctgtgtacaatcaaaaggccttcatttgatgatcccactgaggacatttccagagcaaggattcattgcttttgcaattctagttactaatggagaagccagccacatgtctgaaactgtaaataggatatcaattcgcctcaagaaagaaggcctcctgaacattcaaaacggatggacagaagctgtagggcatcacaaggagtggaagggtccacaggggtgtgggcagttagatgaggatgcagggaaagagcttgtccccacttggagatgatggtgagggtgaacctttccttctccaggaaatcctaagccctagggaactatcgggttctgttaggaagcacccagctgtaccagcatacccagcacacctgggacgtgtctgtgacttggattatcacacacccagacttcaagaagttatatccctttgggattgacattgccatattgcagctgctctttcctgtgaacttcacctcctacatcatccctgcctgcctcccagtccctagcatgaaggtctccaataactcatcctgctggataactggctgggggatgctcaatgaagaaagtgcaaggttatgggggacttgggggggatgagaggaggaggaggaaggggagaaggacagaggagcaaagaagggaggtatgtctctacctgaggggtctccaggcaaaggtcctcttggcccagtatacttcatttccagaggactggaccattctagttctagttcttaaagtgtgtgattctaaggctttggtgttccctaagtgtaaagctctgaagtttgtgaatctgactttcgagtcaagaatctgagttcttgaagtctttctggttcttgattccaaggtttaaatcaaccatagatctgagatgacttgatctaactcaaaggtcatgttgaggcatgactccttccaggtcactgataaactctctgatttcccagtgccataggaggtgcttgggaaaagtggaaagaaaactcaaatatgatctctgacctctgagtctgcctgatcaatttagaatgattactacttaagagggtttcactctccagacctcactttgattttctcccagctcaggtcatctatctaatttgtagacttgttaggcaaactgagtaacaggaaaaaattgtattttttaagattgaaagaggagaaatctaggccaaaagttatgaataacttataagcaagagtcttcattaaggaaaggagtgtttaagacttggtgaaatga

SEQ ID NO: 34554 - DNA, 1634 bp, Bovine  19866880868957
tagcagtctcttttatcaatctggggtaaaaatttcacctggataggagaaaaatatttgctcatattgcctcccttctattgaagaggttataatagaataaaccttcaaaaagtaaggaaaaaactatagttggtcttctgggccaaatgagtaaataagttcatgctgcaataaacccattcattcccattaaatggtaattttgaataatacatgaaaaaagaaatgaaaatatatagctgggctccattgcaagagacatatctccatgaaactgaaaagcacaaatgcaaattgctatacatgctcctgaggctacttgcttattgagatctggatctagaagcaggcagtagctgctgaaatttggactcctgtgagactcattaaagtgttctataggagatgaggaccagagataaggtcttccacttagaacaaggaccacgggtggggcttcccagttatggaaggagcctagaaaaataaaagcctggtgcagattctgggagatagcccctatgtgctatataggcctagagaagtgagggatatagacatagcaatcagaagcaaagccaagctatcctgctgactttttgtcactggatctgacatatccccaatatctgtaaggttctgtactgaaattatggatagagtcaactgtaaaaaccaacatatagggatatgtgagcatagtgggagatttttttttggggggggtcagggatgggaacaaagagtaacagaaaacttccttctcaaagtgatattacaaattaaaatttcaaaatgcatgaagaaattaaatgctaaaagcgatactaaacaaaatcaacagttataacttgaattcactccagatgaaacttattttataaaacagtcaaagcttttaaaataagcatattgaggatgtttgaagaaacaaatgaagacagaataagaaattatgaaacagaataggcagaaataaaatgagagcaggtggatatgaacaaaattagaaatctcaaaattaaaaatagatagtcattgaaatattgaaaaagacaggaaaaaatctagactagatatggtcaaagagtgaatatgaattcaagttactttggataactcagaatcagtgcattaaaataaaattataaaaaattatgaaaagtcagtaaagaaccatggagggcaacttgagaaaatccaacattcatctaaagaaattattaaagaagaggattgaagggaaagcaacatttgaagaggtaatttgctgataatttctcgaaattaaagaaagacattgattctcaggcagaaagtgtactcagactaccaagaagggtaaatagaaataaattcacatctagacttattaaaatgaaaaagtagagcatgaagatcaaaaggaaaaattttttagcctacccaataaaagataagttactgcaaacaaataatggcagacttctcactagcaactatggatgtcaggaaaaaaagaaaaaaaatcctcaaagtacaaagggaaatcttccttaagctataatttatacctagccaaactattattccaaagagaagtcagaataaggacaaatacagatccagatagcttcccaggactctcacta

SEQ ID NO: 34555 - DNA, 1296 bp, Bovine  19866880877816
gaagattccttggagaagggaacgggctacccactccagtattctggcctagagaattccatggattgcatagtccatggaattgcaaagagtcggacacaactgagtgacttcccaccttcacctgtagaatggatacctacagtatggcagattcatacaatgaaatgctattcaaaaatcataatagtgtcactcacaaagtatggatgaatcttaatatcaagacaaaaaagtacatagtgtgtgatcatattcacataaagtcacaaaacagagaaaactaaattaaatcatttaggcatatacacttaggtggtaaaagtataaaacaaagcaagaaagtaatttcacaaaagtcaggatagtggttacctctaaagagagaagaattttggaaggaaggatcacaagggtaggaggtattgaaggctaatcctgagaggctggaagtgttctatttctttatcaggaagtgttacattttatatcaaaaaatgagatttaaaaagggtagtcactaaaagatttctggaaaactctgtgggcatgggcaaagctccatgacggtgaactttaggatgaccccattttgtacccttcttttacttgaagcagatgttcagtaaatatttgttaaatgattgaatgttttcagctttgtcttgcttggataagaaccacctgtgcctccttccccagaccttggtatgtagaagtctggaatagttcttaggtttaccagacctgaagggctctagatttgcagatagagttaagagtccagtctgctggtaaatgggtctctgagctagctagggaactgtagtaaaataaatcttgttatgcttcgtacccttatccctgatgctaaagaatatttctgcttgcttctgctcatgtgttaaggttgatcatttgattgcaaaatactaaaccttctttatagcaagtattgtcatacccactcagttgatgaggatggtagacatgatttggttttttccacccattttacttgtcttcagctgtgtagcagccaggctaattaataaatgagatttatcttttactttcgaatgcaggggtgggctctgattaatctcaaatagggtcagcaaactttttttctgagagagccagttagtaaatattgtagattttgcaggccgtaagatctctgtcccagttactcaattctgccaatgcagtatggaagtaactatagacaatccatacacagatgaacatgggctgtgttccaaaacaactttatttgcaaaagcacatggtagg

SEQ ID NO: 34556 - DNA, 2218 bp, Bovine  19866880903959
accatgttgttcaagtcaggaaactgggcatcttccttaatttcttcccttacccaggcaatcaatagaaattctaccagctagatattggaacatgctattaagatggaactgtactagtcttgattttagctgagatctcaagtctgtagataccactttttttttttttttgcagattcttttttataaatttttattggggtatagctgttttatagtgttgtgttagggtctactgtacagctacacttaacatatatattctgctatacgtcacatataccccccttttttcagatttccttccactgagtagagttccatgtgctttacatgtacttacacatgtgcttagacactccatcatgtccaactctttgtgaccgcatggactgtacaccaggctcctctgtccttggggattctccagacaagaatactggagtgggttgccatgccctcctccaggggatcttcccaacccaggtattgaacccatgtttcctgcattgcaggcgaattctttactgtctgggccgccagggaagcccaatagttatctatcttatacatagtatcaatagtgtatatatgtcaatctcaatctcccagttcatcccatccttgccatcccctttggtacccatgtttttttcctacatctgtgtctctatttatggcttgtaaataagatcatctataccaattttttcagatcccacatatatgtgaaattaccaggcaggacttggacaacgaaaccaggaaaccagatttataaactttagctctcctttagacaagagggccactagagggcatagtctccgaatggaggtgaaccagcagaccaccagagactgaggtgggatccatgaacaagggaacccttgcccctatcagcagctctctagctctggggctgatgtatctgaggaagctcataggcattgcccaggtcttctctgggagcactcgtccccgaagaccttcccttctctttccccttttccctgatcctgctcaacctcagaggggtaaacatctggggttagccagatggggtaaagggctggaagtcaagccagggaaacaggagtcaccttgagcacctgtctgaggcctgagctagaggatgggaaggttttagctttgaaaaggctcaatgactttgattggaccagacatagtcattgctgaactgagactgtcttgtgaccagaattaattagaaaacttttaatttcctgagagtggctgggaagtcacgggatctgcaagagctgttatatctctagatctagatgtagaatacatatgcatctatctgcggggtcaaccgggagataaaacatatttcataattgtaccttgtgtgtacagcttgtttaatattcctgttatacagttcacaaatcttttcccttctattcatggtctggttctgcccatatttatttatcacttcctgtttctagcccaaaccaacttcctaccttccaatactttggatatacattctctctctggaatctgggctctctcctttatgtctccctctgccaggaaggcgccttcaccctcttctcctgcctgcatcacagccattctggaggtctgagacctagtttctcttcctccaggaagtctttcttccctcttcttccccagcactcctgcatggttacagagctcccatgggagtcacgagctagcagagcttccctctggctgatcatttacccctctctgctgcttcctctcctctcaaaactgtctcctttttgaaggcagggaccatgccttattcatctccctatttttagtgtctagtgagtttcacgtgatggatgagtaaataaatggtatctccaatgtctgccatatgcttcagaggacctgtgcaaggcacagagtgggctgtgaattgagaccaagacaactaactgaattctaaatctctgcattttctcttggctacacagccatttccttctcctagagccagcattttctgatttcaaagtgcccacagttataagtgtgtgtggaaaacagtctactaaggaccctcagtctctgttcccaatgtttttctcatccatatgtcaaagagctatttccttttggcttgaaaccagaccataaacaaaggccagagaaactctgggttattttatgattccagtttaaccctttctttctctctttttaa

SEQ ID NO: 34557 - DNA, 660 bp, Bovine  19866880908245
tccctggactgggaactagatcctgcagccatgtggtgtagctgacaaaaaggaaaaatgggatggcattcctgccccctgccatgaaaagagcagatctcagacagagctgaaggttcagcttggacctagataataagatacgtgtgcagagctgcaggtgactcgctcacagccctcatagaacatgctgctgctgctgctaagtcgcttcagtcatgtccaactctgtgcgaccccaggtgcggcagcccaccaggctccccgtccctgggattctccaggcaagaacagtggagtgggttgccataacatgagcatgaaataaatatttgctgttatcagctaccgagctatcagggtcattttttaccatagcaatgccaaataacacagcacattttcttgcagaaatgtgttgtttttctcatgctcaaagttgcctttagttatacaataattatgaattcaggccatgaggataatcggttgtgtgcattttaagtactaaatacataagaaataattagacaaagagttgaaaagtacaagggtacaggaggaaatgccaggtgtcagaggtctggctttacgaggtcaccttctgatgaaaagaaaattgtggggaaagcccactctgtaggcagagaccacagtgaa

SEQ ID NO: 34558 - DNA, 1729 bp, Bovine  19866880917980
caaatatggtccttatattacttgcattagaatcatgtccaatatttttaaaaatgctaatttctaggtctcactcctatatataaggaaccagaatctatggaagtagaaagtagaaatctgtatttttagaagcaatatcatgcatataaaattttgaaaatcagactgtttaccaaccccttatcaaccctactcacttcttatccaaagtagaattaattatgtggatacagaacacaaaattggaatgctaatccatatgactataatttagggaacagaagtctaagtaacaatagtaaatggtaaaaattcttcccaaggtatgtactttcttgcaccttccttttcctgtttgaattacttcttcttcaaactcacttaaaatacagggaaagtagagtattcctttaagattgggaagcagtaactttggacaggagtttacatttatactctgtgtaatgaacacaaggaaaaggcctcacatgttcgtgaaacgtttacacgagcctaccacggtaaagatcagagatttcagtccatatccctggttagcaataaaacatattccattatctggaacttttttccttacacttgttcagaaaactcaggaaggcggaagacatagtaatcagtggtatagcatcaatcagtcatacagactcagagaaattttagttatataaactcaaaatttacacattcagtttttaacaccacacttaatggcaattaacacagttttcaaaagtcttcatgagatatgttagtataattttgcaaaaattttattattactacaatatttctgaaattttaggctagaagagctgaatttctcctatactattgaaaaataatttttaaattataataaattaaaataatttagcttacttatggacaaaaattatgaaacctgttgtttggatgagagttaatacatcctgaaataaattaggactatgtggatttgcaaggcagccaaatacactgtaaattttaagtagaaagaaaggcaacaccattaactgaccatatctgttttcattgaaaattttcagtaatgcaaacattaaaacattttactaggattttatatagctaaaataaaatataaataagtaaataaataaatataaaaatttgtcacaaatcctgcagattaaaaacaaggttatttggacactaactatgagaagatctctgtacactgcattagtcaagctcatacctatactctgggtcactgtcataggcagagtctctatataaaagacctcttttcagttccagttcatcttctttctctgggtctcgctcatcctgaaaaatttaaagatttccattaatttattttataattaaaattacacccatgtttctttggtaattgtgatccccctctcccaatacaagagattgaattaaatgctgaatttcttaaggaaagaaacaaaaaggtaaacgagaatttattattctgttaaataaaactaatatagctttttttctgttacagtatcacttacactgtttatcagagactagcacacagatgtttcttgcatcagtgaatgattaggaatggatactgtctcaagatacataataaaatgtgcagaagtgatagttcacatacttttccctggtggctcagatagtaaagcatttgcctacaatgcgggagacctaggttcgatctccaggttgggaagat

SEQ ID NO: 34559 - DNA, 720 bp, Bovine  19866880924829
atgggattgcaggaatgatgtggaatggggtaatgaagtcctgggaagcacaggcgggtggggagagcatttgagctaggaaattgaaaccttgaatgcagaaaaagatgtaaatgttgtttcccagattttatagctcccagatgcctcctctaattgcatagctaacctcgagtttattaagttattttccagagtcaaactcatttgtatacatgtcagaatataaactgaatttaaaaagtaaggtccttggattaaaattcagggatgataaacaaactcatttagaatgtaagatttgcatgtcatttgcatgtgcccaaatgcaattacatgtgctctgtaaatatgcatttcacttttatttgtcatgatagaacagtatggaagaaattaattgccacagaattttttttaatatttaaagaaaaaaaatgatggctcttaaaatagactctgctagtgtatgattcaatgtgcagaaactggcaagaagagataaggatccttcaaaaatcataaattccctctgcaacatctgtagtagttcaaatcgcatggtttatagaggccccttttgccttttccatgggtattaccatagtgttctgtagatttattactggctcagtgcaaggacagttttactagcaaagctttaaaaaagggagtttttttttttcctctttgaaagttcaggattgaattgaaatgaaa

SEQ ID NO: 34560 - DNA, 3388 bp, Bovine  19866880994051
tccccagttgatgcttgggacaagtacttgctgagtgagcatttgagcatggggcaagggagataatcagggacagggaagcctggcatgctgcaatacagggggtcacaaagagtccactgagccactgaacatcaacaagggagacagtgggaggtgaggctgaggaagagcttcctgaatgctgtgcccaccttgaagacaaggctgacgagtataggttccttctgacggtatatagggcgcccccaaagtattgtacatggaactgacgctattccatcagtggtttcggaactaagactgggagccatgaagttcttgattccatcacaatgttttgctcctccggactccccagcccctaattctgggtaactgtcccacagaggcctgtcttcactgtagaatcaattattaaaatcaactcactatcaactctaactttgaaaggctacttgaagggacagagatggggagcagtctccacagacatctagccatctggccttttctgcggaacctggctgggaagctcatttgaataattggttttggcggtgtgtactcatgggttagacacctgattacgctgccagccccggtgtcctttcagcctctgtggaaacatcactccggttatataaaaagggagagagtctctgggaggtaaggcttggtctggcccctgtgtcacttgcacttcatcttgaaaaactacgtgactcacatactgtgtgaccttgagcaagatacttagcctctctgtggcttggtttcctctttgctcaaaggagcagggtgatttctgcccagtctatgctttcttgtaaggttctcagagaaggaagggtgggagggtggttggagtgtggggcttgtgacttagcagggatgcaagtggaaggattgaggttgacaagaggtcaatgtcagatagcgataggcaagtaggctgtaccaggagaagtatgtccccagaactaggcttgtgatgattccttccttctcctgtgccactagctagctctatgaacttaagggagttacctaatctacctatgcctcagtctcctcatctgtgaaatgagaataacaatagggttgttttaagaattaaataaaacaatacatgcaaaatacctagaataaggccagatccaggaggttcaatagtctatttatcatcaccattatcatggtcatcagcactaccatcatcaccaacactcatcattataacttttccatcctggacaccatgtctcaaatatagaccatgacgaacatctggagcatgttcagaagacagcaggaaggatggggagaggactggatttcagctcacatgtggaaaatcgtaaagctctgggagtgttcggccaggagaacaggagctgacagaggttggagtgagtgaggagttggggaggtgtggggacacacaatcctcaaacagctgaaacgctaccacgtagaagatgggtcgaacctgactaatccttcaggggcagaaagcagaaatgatggctgacagatttagtgtggatatgctgctgctgctaagttacttcagtcgtgtccgactctgtgcaaccctagacagcagcccaccaggccccaccatccctgggattctccagcaagaacactgaagtgggttgccatttccttctccattagcgtggatataaacagcctctaatagtcagagctggcatcagtgtggcgcttcttaaggttcccctgccctaggtggggccatgcacaagctatctctgaggccccatcccactccaaggctgacgaggctgagagaggcaacaagctggcggggggcggggggggggggtgggcaggtggcctgtgtggggaaggaggcatagtgagaaggggctggcagataccagttggtgaggcaacttgcagcggatctttgtgctcacttccagttgatgaaaaacacgcagttttatgcttgtcgaagaacaaatataatactgacgcatattttttacatagctaattttgttttccattctattttggacagttaagaatgtttccttctttggctattgaggtgagtggggttggtcggttacagcgtctgtgcatgcatgtgtatgtgtccctatgtgtgtatctatatgtgtgttatgtttgtgtttgtaagtgtgtgtatgtgtgtgcaggaaatacctcccctggtgttttaccatctgccatatgtaatgatgattgctgtaaaaatttctccttatatcccttctatgtctggtggactgtatacattcttcaaaaaccttccctcatcacccatagtcagaaggaatcactccctgcgtttacgatacagtgtagccacggatttaatttgtagcaggctaggcctggccagcttggattcataaacctgatctgacccttcctgctaggggacccggggcaagttctttggtatctctgagcctcaatttgcttctctaattaaaaaggggccataatactacctccacctcagggttgttttgagtgttagcagggatgatatctataatgtgtggttagtaggcacttagacactagctctgatgatgtccaggcttccacagcatgacacacacccttctagtacaaatactgggcctcttattgccaaaggctgcctctgatctccatctgcttccctaaggcgcagcacagggcttgacactcagcaggccctcgacaaaccttagttaaattggatttactgcgctggagcattctttgctacgtaaagctcaccagggccaacagacagaatgtgttgcaagtctgcgggttgtagcagcatccgtttccactgcggggtctgcagcgccgtgcaataaagctgaatcatttctgcaccacccgtggaggtctgttcctctcccccatctccagactctcaagaagcactgaggcttcccaaagatgagaaatttcacagcatcctgatatcttttgggtaactgcgtattttatgatgactaataggcaattactatggtaatattgcaattcagcatgtgtgaggtttgggaaatgagaaattatgggtaactacgttgggctcatttctatggtaacaaaaagtaattgtcattaaatatcagttatacggaggctgtacctggtaattatagatttttatgcccagaaacataaataaaaccaataaatttactcaaaggtctacgactgtttacttatatgtgactctatggaacacacaatgacaagcacctaattaagaaatgcaaacctaatgcagagattcgtattgtcatgtagagatggagagtctgtttctcagctgcaaggaaaactgcacatcacccgggcccagtggggtacagcg

SEQ ID NO: 34561 - DNA, 2231 bp, Bovine  19866881042639
tggggttgtcatgaggagtcagtgagttgctaaatttagaatagaacctggcacttggcaatgctgcttgtgtacggaccgctatgactgtcatcattatctgtctaacagcatggcctcggagtagctggctgcctccaggagaaaaattaactcagaggctggcccatcctgtgcttaactcccgtggctcctcccctggagtctgcaggaaagcggtggcagagggcctcccccatctctctcatgggggactctccttttccctttagccttcttctctccagaggcccttaggcccatggccccagagcagagcttcatggtccttaatggatcttgctttccatgtcttttcttctttcccacttggcctctcaaatctctgggtgtcctggaggtggtgacttcatttctccaaacattaactcctggaaagattagtaccatccctccaaatacttttggagatttaagtatattagtgcatataaaatgcccagcacagtgctcaacatacagtaagtgcctaatatgtgtctattctgttcagcctcctcattgctccccagtttcctctcctccctctgatctcacatttatgagttcaggttctgctttctctgcctccatttcagatcctgaagctcatagtcctgactccaaattgattcagatgaaaactgacccctgaccctcgaccccacttgtgccttgcagatcggagcatctctgatgtccagcaacgtgggcagcggcttgttcatcggcctggctgggacgggggctgctggaggtcttgctgtgggtggctttgagtggaatgtaaggaagctggctggaagattctcagggatagaggggtcttagcccactccaccctaccctgtccctgaccttagtgctgagagaaacctcaaaggtgcttggggaggctgcacggtaaatggagaacccattttatagataaggaaaccaagtcctgatggacctcatcaggtcacacaggactgaaatcaggcctccggtcccttacttccccgcccagggctctcctctgcatggaccactccccctccatctgcattaggaacatgaatcccttttcctccccattctcccaggcaacctggctgcttctggcccttggctggatcttcgtccccgtgtacattgctgccggtgtggtcacaatgccgcagtacctgaagaagcgattcgggggccagaggatccaggtgtacatgtctgtcctttctctcatcctctacatcttcaccaagatttcagtgagtaccgttcccatgtggccatatcatgttgctctgaaaatgcttagtagaggacacagcacgttgttgctatatgtatgtacggatggataaattgatagctggatagatggatggatggatggataaatgaatagatggatggatggatggctagatggaagagcaaggataacagaagtggaggatgaattcacaccccttcatcacacactccccgtccacccccactaacagcagggtaattagagatggacgataaatgtttgttgagtgaataacagtccctctatccaaagaactcacaatttcaagttcattcactcatttatcttcccattaaattagtcttcattccgcaccaagaatgttaccattaaaaaggatgtattcctcctctattgaggcaaacttggaagacaaactcaggtcaaacgatttgccaaggtccacacagagcactagctctggggctggaactaatgtttggttcccgtggcccattccaggcctcctgcggctctgccatgttgaagcccctgtcatgggtcacaaaatactcagggaaagggaccaggaagcatgccctgagttcagggctggaaaaactatagcctcttttccaccaatgcttgtaagcaaccctaaatcagctcaggccaaggctgtgaccccaagtcctccaataaagcccagcacgtgggtatccaggatctgtgtcatctgcggctcctgctctgtcaggtcacctggggcccacatcaggtctgagtgggctggtgctctttcagggagcagttgaaggccctctgggttcccaccctctcccccaggggcctcttcttcctgacccccactcctgcctcatttcctcagcatgctactccatcctctcaccgccagcacatgccccgggagtgcagcggatcacagggccct

SEQ ID NO: 34562 - DNA, 1673 bp, Bovine  19866881097650
acggatagaaggccggatcacagatgcaaagattacagaaatttattttcgtaaaatcccagaacattagaattatagaacccaaataaaactcaagaatttaaaaattagatcccttgaagggggtgtatggaccacctgctttcagaaagaaatccatacctttctcctttatacacctcagtaaagggcctctgttgaaaaactgttcttgggtgtgttgggtgcaatagtgaatattgccaggagatggcgcccaatccccactgattgctgtaaaacttggcaggtgggcagagagaaaaggattctgtcctctcctcacctttccctcccattctctctttctggccccagtagagcagcagttacctaatggccttcctgccattcactcccctctcatgctccacccatttgtaaaaatctgtcctgcactcaggtccttcaatggtcagcccctgggcgtagagctgggggtgcacagatgagtgggcattagggggtcccttaggcagccgtgggcaggaggcatcgtgatggaagaaacagtgagggcaaaggtaaggagagggacaagagtaagttacctaaactcaagtaccatctaccagaagggagaaggaacattcagaaacttgagttatagaaccttaaattatgaagcaaagatttcggaaaggtcctcttaactttatgtaaactataaatccccaatctagggagaaaaagtaaaaatagccaccaagttatgtcttgaaaaccataaaatgaatacctatgagataaggttcaaaattttcagctgagctctgcatcctttggagacaaactttctatgaacatctccatccacccatgcccctcactgcattacctgtgtttctgcctttctcttaaactgtgtgcatccttggggcaggaccatataaatcatccctgcatccccagcacaaaagtatgatgcaggatgcctgctgagactgagtcttttctggtatcctggggtgacagccagagctggtctgggagacactgggggtgagctgcttgctaactccttcccatcaatacagtgcatctttgactgattaaatgctttgtcagctgctctcatttacccttttggatcagttccaagataaagttgaacaggcaggcagggaagagactttttttctccttatctggagggaggtaaatggtccagagttggggaagaacttacccatgtcagagagaaaggtggccctaggttccaggtgctctggctgccggggcagggtctagacccagccacatctccttggggtaacccggggcagggggcagggggaaagacctctgcctacagggagaggacccaggaaggatgggcctgcgcacctgcccaccaccatcagctcctgttctgttgcgttcttgcggaagcgctgccacacgtcaatggcgaacagggtgctgctgctgttgaagatggaggtgagtgagctcatgagggcggccatgatcacccgcgatcatcaggccccgcagacctggggagagacgagggtgtctgtggaccgctggccggtgaaagccgatctgccaggagctatagaggctaccagcgtccagcagagtcaggagctcagaggagaagggatggcagaggtattgaatgaggtgcc

SEQ ID NO: 34563 - DNA, 1379 bp, Bovine  19866881110924
ttgggctggggtccaagtttatttaagaagaggaaaatgttattatggaaattacaacagctttacgaaacagcgtcgctgtatcaatccaggaccacaagaatgctcatcaacttaatagcttcctgttgggagcctttcaagttacgactgaaactggcaggcatcggggcatgggagtggggccaagcaactgggtgacaccgcactccgccccctgccctcgggatgagtggcagagtcccagcaggagaccacaggggaccctccctgcctgctcctgcctgcatccctgaacaagactgcagcttgggcttcccattctcaaaggtggagccacagtggtgatggtggtggtggtgatgtgtgtgtctccaggtagcaagcagggaggagaagcctggggctcctccttctacccaccccattccacacccacagcctgactcaagtacaaacacagttgtgatccttagaccttcttccaaagccagtgtggagggtctgtggctaggtccctgataaggacaggctttaggaaagggactgctttctttaactcctaagcccaaaaagagagaaagccaggacttaactctttttatctttaaaaaaaaaaaaaaaggagaagaaaagaaaaccattaaagtgaaattcctggggctgagagcagccaggagtctggcacgtgtctcctcctcggtaattatctggcatttagcacctctcttcccagcacttgtaattagcagggaaattaagatgctgtcattctacctcccagcttctctctgttatgcccagaggcccagagaggggagggtatcagtacaccaagaattgagactaaaactcaggggggactgagaggggacatttgacaggagagcagtggtgggtcctggagggagcacttcctgccgcctgcagccacagccatgccttttgtctgaatttctggagtgtatgcaagggtactacgctgtctcccatgggatgctgttatggcgctgatgaaaagactaggctccagtggagtctcattgccttcaccaagattttcacagaggctctttggtgcccacctcggtgctagaccctgagatcagggatgaatcagatacacccggagttgtagatggtccccagggaaaggatatggcatttggttggggagggggtacaaccataacacaaggctgaatgtgacaagagttgaaggaggcaggatcagttatagaatttggagggacttactgaagatgtgaattactggaattctaaataatttcagacagcaacagcagaagattaaaccaagcatatgggctcttctaagggactctgtgagctgcatactcatgaggccagccctggat

SEQ ID NO: 34564 - DNA, 1066 bp, Bovine  19866881164131
tcgccgaaaggaattgcatactctggcccctgaagttttcaatttatagtacttgctctttcagatgaaatgtccatttacatttcaaggaacaagccagcaccatttgcactgtggctctggtgtctgactcttcagacccaaacctgtatcccttccccttggcggtatggcagtttttcctctagaactcagaatacagagtctcattctccccatttctcaggctatttgctatccctccaatagtactcagcccatttctgttcctgcctattctgtgctctcagtttctcttaatatacaattatggttatataataattatacccctggcaaaacatcgtagcagacacctaccataaatgaatcaaggaggaggcagattttaacttaagagagaacttttaaaatctagacctctataatgtctgcctcaagaggtagtgagtgcctcctccagaaatacttaaaagaggccctttgagcattcccgcagaccagtaccccaacaggcatacatgacagggacacctgccatctggatgccgtggcccagagaggacaaatccccagtcccccaaatgtattctactatcacagtctccccctcttttgtcgaaactaatgagtcacgattcgagtaatgtttttctgtggctccaaaaccattttgcttaatgaggtactaagtctttataattaggcccagaaggaaatcaggacatggcccttaagagcaataattatttcagttatttatggtaataaaaaactgaaaataggaattcttcctcagaatgcgactatttattcttttacatattgcctaacaggcaattaccctattaaggctgcgttttgttgctaaagacattaattgaaatgtaaattaaatgtaaatcagctaattaaattgatatgtaatgaacttgtcagactggcctctctgatcagatgcatttcactaataaacaagcattgcagccggcctgacacgcagctggggtgcaggatgcctgtgctgtcccccaccagacattctggtgatgaaggggagggtctg

SEQ ID NO: 34565 - DNA, 774 bp, Bovine  19866881176837
agctcagagatgaaggtggctatgtggggcttccttcctgtgataagggcgactgccttactgaactgaaactcctgtaagcatggccggatggcggctgtgggcttgtaaccagagcctgggtttgagtctctgcccctttctgctgcattactctggacaagttacttaaactccctgagcttttgttccctcctctgtacaaagagaagagtaagctgctatccctcctcaacttgccctcatcttcgtctaagcttcagtttctttctcatctccaaatctaagataaatccctctgcccttcctgggttgcatttcccttccttcatcagactgaatatgtggtaagccctgaagtgttgccctaaggtagaggagacagccccacagcacagcaccaggctcagactttggcttgcgccagcctaggtgaagcagctcagaatatagaataaaggaaaaattcatttcctccctggtgtctaggaggaagcaaactccacactaaattatgttccaaatatgccctaaggtagttttaattttattggcactgattttaattcactctttaggcccctgttgcagaatgagccgttggctgctggcaaggggacagccctttatcacttggttttgattaaggtttgtaagtttggaaggaaagaacaaagatgctgtcccctcgttctattctcagtcccaaaattgtaattaagggccctgcattagcagcacaccccctgctctgacatagccacacaaaaaaag

SEQ ID NO: 34566 - DNA, 725 bp, Bovine  19866881181776
gtgacagggtcttctttatcaaagcaggtggtcgttcatccacctccttccttcatcaaagaagggggcattcattcacctccagcatccttctctcctctcattataataccatcagtcttccttccttctttcctttctttctctctctccctctttcttttgtcttccctccattcctcctttccttctttccttccttccttccattcataatgcctgccatggtatcttagtttgggttttttcaaaagcagggactggaacaagaaactcagagcaagcagcttaatctccaagtgatacctggaagcagagataagggagaggcaaaagtgacacaggacagggagaaaacccagtaaatggtgtgttaatgagctaattatcactgaggggaaaggtcaatccctccagaaactttcttggaactggcgcaaaaactctccccagagttgtctccccagaagacagggagacagctgagggttgcctccttgggtataaattccccttcacttgctgtcttgctctgcaaggctgattcccgacatagccccagtccagttccaaatgcctgaaactgtccaccatagctgtgctgaaatcagaggagttgaggagatgcaaggcaggcagcgcaagcacatgctagacctgggcacaggaggctcaagtgaggcatgagtgccttgtctttgctatcccatgactgtcaagtttgg

SEQ ID NO: 34567 - DNA, 1299 bp, Bovine  19866881198485
ttgaagtcttagtgatttaaattaaatcatcaagtatactacacattcacaattttaaagcattctaatatctattatctagttgatgctgaaaacaatctgggactaggcaagacaggtattattcttcccagtttcagctgaagaaacaggtgcaaaatgcagcagcaaccttcctgtggccacacaaggtcacaggcaggacagagagccagcctccaccctcacaaaggcgcactctctgcccacccagctgcctcctcccaggtctgcttgtgcagatgagaagggaagtgagagaggtctgaggggccagagaaggcttcctggagggctggggctggctcttgaagatgaagagggacaatagaaaggacagctgtagcaaaggatgggcatggccagacggtcatgtggagatgggccaaagcctctttccaatctctcctgtgcccgaggtgaatgcaggttgcagaattctcccaaaatgctcaaagtgcacttcagccaagattcctgatctcagtgtaaccctgagccgccggtcagtcactgacactctacctccattgtggtgggaggtggggaggcagggaagaacagagagagtggagtcagacaaacctgagtttgaaggctgactcctccacgtatgcaagacctgccagggactcggtttcctcccttgaacaggacacaataatgctggacttgctgagttctgtgaagattagatgagacaaggtatgtgaggtctgtggcacatggtagatgacagaaacctcgtagctcctttccttcccttcctggttcttttgggggcaggtaagagctgacccctgtgctctggaccctctgagaagtttggaacacagaggagcgattgcagacaggacggcagcaggctgagcccgggctgccctcttccctgtggggccacaggctacacgtctcagggtggggtttatcgcacccttcctgcctctgaacagcctctgaacacggaggctaatttcctcctaagtgaagcccttggcagctgagctcccgcatatggcgggctcccctgtttgctgtcagaacaaagccctgtgctccctgtaaatgccatgcattttaattgtctgagcagccttcttgctcgccatccagggagacaagatgcatcttgaataaggtactgtcagaggaagcctgggtgtgctgggtaactcgctccagcttcagggatggcccttgaggccaaacagctggactcctgggggccaaaacgagggactccatccacagtgtgcaggc

SEQ ID NO: 34568 - DNA, 1315 bp, Bovine  19866881259464
ccctatcttcgttccccagcgtagccttcaaggaccggatcatcagcgcctcctttctgaagccgcccccgggcccctgagggagaatgaatcactggctccactcggctcccacagctctgaacttactctgctttgtgctgtgggtccagctccaatgatctgccccccagcacactgtgagctcctgcaggacagcactgggatccccgtctcctcataaaatgcctgccagctgtcagatctgtgctcggaaaatgttatgtaatcgattagctaattaatgaaagagaatgtcccaggacaggagcatctcagagctggagaagactttcatcccagggcctcattatctaaatgaagcagcatggatgtggaggaggctgagatctggggtgggaaggacaggccctgggacccacagtgagataagagcaggataggcactaagaggctgctctccacacctgaccaagggcagggcggtcagttccggttcacagttagacagacatggacctgtaggtggctctccactgccccttgaggaagttcgtttctcatcgtggccttctaagtccctttgtgaggtcgtccccatcgagtgctcacttctgcttgtgagcctgacttgctgttctcagtgctgggaacacctgcccctctgcctggccaaagcctagaatccttcaggtgtccgcgtagatgtcacttctgcagaagatgctcccttgtcccctgtgtccctctttggccccctgtgatcccatctgtcatacgaggctctgattgtttccgtgcctctcgtctagtcagagattgttcatcttgtacccctagtgcccagcctggaaggaatgtatgtgagtaaatggatgaatgaatgaagtataaggactggatatttggggggctccacaggtggctcagtggtaaagaatctgcctataatgcagaagatatgagttcgatccctgtgtggggaagatcccctggcgaaggaaatggcaaccaactccagtattcttgcctgggaaatcccatagatagaggagtctagcaggccacagttcatggggtcgcaaaagagtcagacacaacttagcaaccaaacaacataaagattggaactctggaccacaggcagccattttactgaaggcaagttaaccccagggcttcgcgggggttcaggggtggggaaagcactgacttgggaggagacagagagcagggtatgctctaggacaccccgcaggggcagaactgagagtgcggccatggagggagtcgtgttccccagaacccagagaac

SEQ ID NO: 34569 - DNA, 1031 bp, Bovine  19866881406538
tcacccttgctttttcctcagatgcagtagacccctgacaggcagtggcccccatccccattgtatggacatggaatggaagcacagggaaaccaagtgacctgcccatgaccagacagtatgtcaggggcttccataagtgaaagtgttggtgctctaaggcactcatttccaaaactgtctgatcataaaaagcattcagggcacgagtctaaaaatatccaccccaaaccttttgctgcagatcctaatttagtgagtctggagaaggacccaggaacctattgttgtaaaagcacaccaggcaatggtctctcatacaagtttaggggtcagtgggttagaaacatcaccccatttttcattaccctcagcagctgtggcggcaactcctagaaacctctgccgcaggctgcatcttgccttctgttgagatgttccctttcctagcttggagttgctttcgttgcccccttttggctcagtgaggtccctgtgtcactcaccattgtctccgtgtgagtgtttcagagctttagctgccaacaccctagagctacctcgccagactctaagttaagcgctccagggggctgtctacccttagcctcccaaaaacacagcctcacctttcagctagtgcttctgaaattccacccagtgcttctgacatgctggggttgagctacttccctctgggctggggagggtgagtgattgtgttgaaggttgttttgttgtggtctcttttgtacaaggtcagcttctagcaattattttttttttctaatcacctgggatcactctcatctaaggacctataccgcaagaaacacaatacatcccagaaaagaaaaacgaaccgatgaacaaaaagctctctcctgagctctgctccgttagcaaggtaacggacaccatcttccggatcccctgcagcccttagaatcaggctgcacgttaattagaaatccagagccctggaacaaggaaaatgagtgtgtgtttcaatttaatttgttcttattttt

SEQ ID NO: 34570 - DNA, 942 bp, Bovine  19866881421141
tcgcagggagttaataagcagtctgggaggactgcctgaggaggtccacgaacctgatcgttaactgcaaggcctaatcagcatgtgcttcccacccagagtcccctacagctacacagggcccggtcccccagtaatggatggaaaatcggcgatttcctgacagttagcaaccaattttccaccaattagaagagagactgtggtccctggaggaagctggatgggtccaccgcacagagctgggaccggaagacagatgatcctaggagcatcagggaaccaaaggccctgggggcaggggacccctccccctccgcatctctttccggatcagctttggcttatatcaggggaaggccacttcggggacaggggctgcctgcttgggcacttcccctctgagctcgtctcacttagcaaccctgttttgtgataaaccacccccttctcttctcctgggccagcagacatgggtttctgctgggtgtctcctcagtgcccaggacaactgagaaattcctccaaggcagttgatgtggaggcttaagaaagcataagctctggagttgaacagttacgcctcgaaattctgaatttgttttttttttccattgtgtgtgaccttgagccaaatacctaaattccctgggcctcagtttcctcatctgtaaaatggggctagccatatcacttaccagataggacagttatgaggattaaatgaaataatgtgggtaaagtcctttacatcacagtaaatagtgttcaatatagaggggctattattattcttcctattactacgttgataatatacgtactattactaaatgatatcagcgagtgtgtgttgagcattgtgctaagcactatgagatcactgcccaagacatccttagacatttctccagtttgtggccctgcccccatcatcttcca

SEQ ID NO: 34571 - DNA, 1768 bp, Bovine  19866881472158
cagacacacatctctgctcacgctggtcccttcgcatgaaggctcgttccccttcctactcccacctctcctccaggcctcacctctctgctccttcagggccttacaagaattcccaggccccgtactgggtcatggcctccttgagagcaaagagtctgtttctcttttttctttctctgtggtgccttagcactgaatctgaccagcgtgatgtgacaagaatctgagttgggtcattgttctcccacagtttataatgttggtgggcagtggggttcaaaatactccttcctcaaccctcactgtgttgccaaagaggatgctaccctgatttcatacaatactcgccaagagcgaatcaactgcaggccatgacttccaggaaacctccccccaaactgccaaattcttctccccatgctgttgcctggctctcgagcagacctgagggagggggacccagagcaagagatttcgcttgttcctttgaggtcaacacctaatcactgtccctcttcaaatgaaaaatggggaaaacactagctaactattgtttagtgaccccaacccccacccctttaaaataaacactcttttcaattaggaagatttgtcaccggggacagtaattccgtgtcctaccaaaacaaacacagttgtaattagttttatccaggaagaaaattaactctgtttatcttagcataattaatcattgaccctttctgtccgggcagcttgggggagggcgcgggagtggggggttatgatctacagcaatggggcattccaggacccatctatctctcctcttggttactcagctgtctgcatgagttatttgaaataatattcctggccaagagttatggagctgcctcagagctcgatttgaagaaacactaaataaggctatgatctttatggtttcagtctgctgagaattttagatgagtatgcatcagatgggcatgaaggcctgctggggccccaggatttactggacttctgttgtgcctttcatagtgacctctgcaagtcctgagggtgagaaaggagctgcgggcaaagggtttggttcttgatgatgggggtgaggctcttgcttcagtgagaagggcataagctttgaggttagaagaatttgagttctactcctaacacatcttctagctgtgtgacttgaggcaagataccttatcttttgaagatagtcacctccaaaattaaaaaaaaaaaaaaaaaggttatggagagatcaagtttagtaactgatacccttggggatttggtaagattagaagtgaggtatgccaagccactagcccgttgcctggtactaagaagttgttcaataaacactggtaaagtttgttattcttgtatgaactgaggattcaggggtggaagaacatatggaaagtcttctctctatattttaaaagtccctgcaactcaaggagaccctactgtgtgctggactttgcgttaggccctgaaaatagaaagagggtctaatcacaacccaccttatggagttcacagcccactggggagagacagacacacccaaacattctcaatctgttaaccaaatgctaatccagagatgtggagtgatatcatcgtggtgaaagagaagcagagactaactgaatttgatttcacagtcagttaacatgtaatacctcaattaaccctcatgataattctaaaaatagacacaatggaggggacctagggacagcatattcaggctcacaga

SEQ ID NO: 34572 - DNA, 1279 bp, Bovine  19866881576658
cttgtgcttggtggtaatgttgtgacccttgaatcgactatgaaacagacattgccaggtatctactgtataagaggaaggagaaagaatctcacatcggaagattcccttagagacccaaaaaaatcaataataaaagatcagtgtcagatggggaaacatcttggatgatgataatgatgatgatactcacgataatttcttaacttcatttagtgtcttaatatgccttatctcatttgacacaactttatgaggtacaccagttcatagaaatgagtagaatgagatcaagaaagaagcaatgccagtgcctaaagatactttagctattcatttatttgacaaatatgtatcaaatctctgctgctgctatgtcacttcagtcgtgtccgactctgtgcgaccccagagaaggcagcccaccaggctccgcagtctctgggattctccaggcaagaacactggagtgggttgccatttccttctccaatgcatgaaagtgaaaagtgaaaatgaagtcgctcagttgtgtccaactcttcatgaccccatggactgcagcctacaaggctcctccatccatgggatcttccaggcaagattatggagtgggttgccactgccttctccaacctctaccaggtaccaagataaatctgtaataggcaatgtttctcttctcattggggttaaaaggtaataaaatgtttaataataaaatatatgatagtatagagaaataaattatgtaatgatatataatacatgtaataagataaaataattattgtttataataatttttatgaaggaaaactggcagggtggtgagtcagcaggtaaacagagaacgcaattttcaatagaatagtcagaagacattctgggaaaggtggcattacagacaaaaagaacaataatcataggggccagttatgagaaaaggcttgatttatctgtgaagcaaagtggacaacagtttggctggagcatagcgagtgagaaagccagagtgatatgagaggaggtgggagaggtacaagtacccaaaccacaagagctctgtgaaccatggtaagaatttaggattttgagtgatgggaagccattaaaaaattttaatcaggagtatgatacctgattttacatcttaaaaggtcactgactgacctgtgggtaatagaccatatgatggcaaagggtaaaatcggcagaccaagtagaagactattaaagttgtccagacaagagaggggttagggctaaaagagaaaca

SEQ ID NO: 34573 - DNA, 890 bp, Bovine  19866881599361
aagagtaatttaataaccgcaaatgccttaacacagtggggaggtaaaaagaaggtgtgcatgtcccttattgctacaggtaaaataaatggcatttttaataaagtgtccccatacagcgtatagaatatggcctcatgatgaaataaatatcagctgaaattatgcattgcaaagcatactttttctggtctttcggttattaaatttaatcacttttgagctgtggccctacgcttcttcctagaggcaggtacacttttgattaaaatgtgggccccagagcactttcacgggggaaggctgagctacgtccccagaggagctgcagtggagcacgcgaatggaatgacagggccaaggcaagcgccacgatttgcttctctcctgatggacgtgtttatccccagacagagtgcatgcagtcacggtgtatggaaatctcacaattaaggcaaagtctaattagagactgcatattcaaaatacaaagggacctctgaatggcagccactctagtgggctctgaaacgtgattatctcattctaccccctgcttcagccactattcgactgaattacaggagggggaggcgggtgcaacttgctgccctaatggattttctggggatgactctgctttcacagcccatagaaatgcctaggtccttggagaagagcacaggtttgggatctaccagactggaattggaaattgactctgcccatgatcgggcttcgctggaggctcagatggtaaagaatctgcctgcaatgcaggagacccggattcagtccctgggttgggaagatgcggtggagaagggaatggctacccactccttattcttgcttggagaattccatggacagaggagactggtgagcta

SEQ ID NO: 34574 - DNA, 843 bp, Bovine  19866881726187
ggtattgatgaggaatggatttctgcttcagataatggcaacttacataaagcacaccaatcatcttactaagaagactaagaaaatctggtcaagttattttttaatatctgcttgaaggcacagagaagctaatatggcagtgaagaattacagggccaagttctaggaaaacaaagagtcagggagatgagccaaacattggaactgctttctccccaagggcatctgctaattccagaaatggcaaactaaggattaataaacttagctgagattttgatggtctcaatagacctagaagaaaaatatcactacaggagacctcccccagtggtccagtggttaagaattttccagccaaagcaggggacatgggtttgatccctggtctgggaagattctacacgctgcagggcaacttagctcacgtaccacagagcatgtgctctagagcctgtgagtcacaactacagagcccaaatgccacaactactgaagcctgtgtacctagaacctgtctctgcaacaacacaagccatcacaacgagaagcacacacaccgcaactagagagtagcccccacttgcaacaactagagaaagttcactctcagcaacaaaagcccagggcagacaaaaattaattttaaaaaatcactatagggcctacaccaagaaggagaggtctccataaattctccacagtttagataagagtgtctaaaagacaacatcacagcagcaaggataaattgcaaatatcctcccctagtccttgcactcagaaagaaacccagcttctaatcaccttaatctctgacatcagactgacataatagag

SEQ ID NO: 34575 - DNA, 1041 bp, Bovine  19866882006890
atgagatgggcggtgagcctagggagcctaacacagataatatcagctcctgaggctggcaagggaaaagtcacttcagagggagcgagccggtacgttcagaggaatcggtgctgggccagagaatgcacaggatttttccctgcggagaaggagtcaggcgtagtcagaaccctgcggggcgtgactaactgccccaatattcctgccaccgggccctctgggtaaggactccacaattatgggagagccagcaggagaaccgacaaacccgcctttcatttggccggcaaatcaatctggcttcttacctccctggggacaatattgcatttcccctggaaaaacaaaaagccagagatctctgaagggggatcagtttctgctcctgtttccctggtgaagagcttgcagcatctcaggagcacaagcaggtctggttccagcagtagagcttctagtccagccaatttaccgggctggctcctttctggaaaagcatgtcttggggaccatgcctcacttggggcatgggcccatgctccttgcaggagccaccaacccctgactcggagcgcctgttctgggattgacagcccgtctcaaggcgcagatgtgaactcattgttcccagggcctcagagttgagtttggggccagtgagttgtgagtgacctctgcccatggagacaaggcttttaacaacactttgctggataagctccgccctcctccctgcccccatgcctgaggttcagaaatcagaactgtcaaccttgaagcgaacacatctctctgaaattatgaacccccaaactatacttgctgactttctctcagcctagggaggcggtccaaggggcacatggagttctgtagaggctccgggaaatttggcagctcttaacctcaacctgcaagccagggccaccagacaccaggtctattgcacctctcctgcctcccaaccccaggaagcatatctccctctgtgcgtcctctgtacaggtacacacacacactcacacacacacatacaca

SEQ ID NO: 34576 - DNA, 1186 bp, Bovine  19866880342226
ccctccccctgctttggggtgacccagcaggatagtgctccccttaggggccaagccctgaaatgggggctccagcaagaggcagcggctcctcctgaggaaccccttcaacaagggcttcaagaactcagtgggaaggccttagatgtgggcgccttccactctataactgatagccccaagggatgaccctcagcacagggtgacacccccttcccaagagggctggtgtccggctcactgtggatggaaggagtcctgctggtagggctccagggcggtggtcacctcaggggcccatatcagcctccctcttggcttgactcagctgtgacacaggctatcagcacgggaacctcttcatgtccttccgaagcctcttccaggatgtgatggatgccttggattatgtccaccttttggtgaatgtcccaggaccccaggccacacccaggtccccagactccataaggtttcactctgcttccggttgaggatggtggtctgtgttcctccatcttggatgtatgcgtgtgcacgcatgcctgtgtgcacatacacacatacacatatgagcacgtgaactcacagctctgctccctcctgcagggctgtctcaaggagaagaccttggaggacttagagaaattctggagaaggatgtgagtggccttagactagggtcatgactaaaccttgtccccccctctcccagggcggtggggctgctcctcctttccctggctctttcttcaagatgtagacagagctctgcaccctggccttgttccttgccttcctgcctgacctggggccccctgcccagccatggggctgaaacctgagaacaggctcccagggcagctccggggaggccccactgctggaggtggctcctctctctgccccaggcatgaatcctcgtccttctggacaagatgaaggaggtgggaaaagtgttcctggccaccaacagcagctacaactacacagatgtgagtgtgtaaatggaggtgggtggaggggcggagctcagcctctgggccagagaactttcttttctggctctggggaaactgaggctctgcagaaacagtggggatgaaaccctcactgcctggttggtatcttgggttccatttcttgaccttttaaggtctcagtgaaatgttagtcactgtctgtg

SEQ ID NO: 34577 - DNA, 1572 bp, Bovine  19866880482636
gattttccgtcttctaccctgccctaactgggagcttgtcttcccacactcagagtgatttatggctactcaagcaaacgtccctcttcagaaaagatggataggcttccctcaagacccactccttagctgccaggggctgtcaagtcatactcagccccggggtgcaataaacgaattaagccgaaacacaagcttctaagcacccctccaactctaaccatctacaattctgctttgaggacttttccctccctcccccaccaaatacttttagaaatttaaatttcttgctctttcccccttttctaagaccacacgtttaaaactgttaacagcaaaagcaataaataaatgaatcaagtcagaaactcctggaatctctaggaatttttcctggaaacactatattcaagtatataatttgtcattatttggaccggtataggttgaatgaactgacatacaaaacagaattcttgtaaattcccagtgacgcaatcgcaatcgtggccacgcccactccggagcagacaaaaggcgaagtagcctgactcagttcaagcctccacgcgaagacgagggagccagtcatctcattgttgctagctcggttcagcaaaggtatcgtccttatcacatgtttggctcttatagtattttttgcttttcctccttggctgtgatctctcaaattgccctctctgaagttgaagcctcttccttcctttgccgtcccactctggtttggcgggtgaattagaatcatagtcagatttcagaaaatgattctctctctgctggtgggaaattgagcaacagaggaactggtttcctatgagagcatgagattacagccaagccttcctttgggggtactctctgctatcaaaaactattcagagaaaactgggaatttctaactctttctctctcttgcaactgtataaattaaatatttcatgcttgttgaggtttttcagttttgattttttacttattcaaattttcatcaaatgcctaccaaatgcaatgcattgggttggatgcctaagagataccgagattctaacagaagtttacagtctagcagaggaggcaaatacatatgcagatcattcaaagggagtgaaaagaagaatgctgggtgtgagctcagtcattcattaagtgtcttagaagggaggtggttccccttgcaggtgtcttattcacacaatggccagactgacagctactggtgttttctgttgcagaagtgaagatggccaaagtccctgacctctttgaagacctgaagaactgttacaggtagaaaagagattctgtctcttgtgacttaatgagggaagcaaggcacattagaatccagctaggagggatttgccagggagtccagtgggtaagactgtgtgctcccaatgcaggggacccagggttccatccctggtcagggaactagatcccacatgctgcaattaagacctggctgagccaagtaaataaaataaatattttttaaaaagaaagaaagaattcagctaggattacagtaactatcaatggggcaag

SEQ ID NO: 34578 - DNA, 1455 bp, Bovine  19866880541691
aggaggacttggttccgttgccaaatatttaagaagtggagcgggctgatcaagagatcaatagttgaaagttacaaagagaggtataccatggtctaacaatcaaagaactgggcttttgtttgttttggtgggttttcatctaacaaagttgctaatgacatattgtattatcagcaaagaggggacctgatgctggcccccaacttctaggctgagagatatctgagggtaaaggcttgagttctttctcttgtgaaagcttcagggtaactgtgacaccccaaggacagccaggtttcagcccagaggaaaattgaaagaacacttagaaaaaagggactttcctagtggtccagtggctaaggctccaaactcctaaagcaagaggcctgggttcgattcctgattgggaaactgaatcccatgtgttgcaagtatcccacatgctgagggaagccaaataaacaaataaatatttaaaaggtatttagtaaagagaatgaaaagatagagtcatccatttaaaaaataactgtggagcatttgctttgtgtatgaacctgttttaagtattgggatgtattaaggaataaattccagtggcaagaaatggagaataaacataaagcaaatatacactgactgtaatttcattagacacaaaatctgagataaaaagtagggctgttagatggagaataaatggtgtgaagaggaaatggggatttattgtcacaaattgttcctccaaaggaaaggagggtacagtggtcgttgtgtcaaactgggtaaacccagatcaattttattggattaatgcttgctagaataagctttagaattagctttgctgaatagcagatggagaaaagcatgttaggacttgcaaaccatcactgtgggatatgggattttgcaaaataactgccagggttttcatagaaattatttcccatattgttgttttagtcactaagttgtatctgactctttcacaatcccgtggactgtagccccatcgggctcctctgtccatggacttttccaggcaagaatattggagtgagttgccatttccttctccaggatatcgtcccaacctagggatcaaacctgcattggcaggtggattctttaccactgagccaccagggaagctatatggccccctggagaacttctgatcggtgtatgacctctcctacttgcttgacctcaaggtcaatgacaaacacttgtaattgctgtctacgggtcccttggttcactgaactgtgtgaggcttggaggcagcttctaggatatctcggtttggatgcagctcaggaagtgatgaagtaaagggaagtggacagcacttcagacgtgacactcgttgaaacttagatgagacatttttagaacaaagaaaaggaagttttactttaccaggggttagtaaatataggagat

SEQ ID NO: 34579 - DNA, 869 bp, Bovine  19866880708873
atgtggcgttctttgagggggccattattctggtcaccctcagtaggatgagcttggtttgggagcaccaggccagaacccagcttcctgcctccctaccgactctgttcaaagtagaattcagtgcgggctgagggctcactctccttggtaagtctcaggggctgctggggttcagaggagccagagaggaaccagccaggccaggcagcagcctcaagcctgaaagcagggcctgagcttctctggaagaaggtgaagcgggtggcctcttctccgcccttgtacaggtcctcgatgttcacatcctgtgggggcaaggcagaggaggctggatgggacagctgactgtcagccctagaggcttctggggcttggccaaagagggaaccaaaaggtgagtctttcgctagggaaattccctctgcaggttctagagggagggatctgggcactgggtgcagagggagatggtagaaatccaaacaagagggacgtgtggaacttgctggaccacaggcaggcagagagatgccagaccaccctggaggtctgtaggggcccccagcacagggtgcgattgctcacctccagctgcagggaaggcccctcccctgtctccacacatgccaggcaacggctacctccctggactcccaagaagatggggaacttggtgcgttccaggcctctgttggggagtatgcagatggtctctgggagggaataagagaagagagccaggtgttgaggggaacccagattgcaagctcttaagcgagcttaagagctcaggtaggaagcttgggtaggaagcttgggtaggaaggaactgggccagggcacagctaccagcccctgcatgcagg

SEQ ID NO: 34580 - DNA, 1448 bp, Bovine  19866880721726
ttatgacacgaagacgttcccctaagggcaagtctggcctgagtgaatcacactttactcccaggaagcccagcgccctaagggcagagctttcccagaagtggttctcaccaggccagtccagcagccaaaacgtccatctgggtcctggctctgaggaggaagctggactgagaggaagaaagttcaggacccattcaaccaccttgtctatgatcctcactagaaatgtaagttgactgagtctctgtctctctctcccactctctttccctctccccacccacagcaccccggcaccttctattgcttctcactgaatgaagggacagaatgacctgaggggtgaggtcacttcttatgaccaacatggcagtcccaccaatcacctgggagagagcaacctgaccgagcagggatagagagtcaagggtcaaaggtggagaccagtctctgtttcctggaggtaagatggcacctcttaggcagaggtgggccaggaactggggagcagagcccaggtctcatgcatctagaattttcttggtttattcccgcccccacccttggtatttagtgttacctcttttaaaatggctcaggtatcttaatcagaacaaaggagggagaaagtgtccaacacgggtctcttcgctgggttccgtcacctttgaaaggagcggcccttcatgtctctaagcaccatgatgggtcaggaagcttaaggaaaacttctgggagaagtggggtggctctttggaatccaagaaaatgctctgagtccagaagccagtgaggggaaggattggggagggagcggaggatgggggagggatgggagagaaagggtgctccactgggcggcccgcagggctcctgtccagagcggagtgaccactgctgggctgagcctgtattagctgattggaggtaaaggacacagaacccgacagctgggggaccaaggggtcataagtcccttctactctcacctaacctctccccccagcttcaaggcaaggttttttccatcttggggaaagaaggagcccagatgtcacctggatcatcctattgagagtgggttctcttttcaccccctgtttgggcacagagcctgtgccctgaggtgttgaaggccacgggaggccaggggagagcctgtccaagggggacagggacagcacgagtgtcacacattcagcccctactcaccataatctggaggctcacagcctagtctcaaatcctaactaccactgaccagccacataactctggtccaaaacttcacctggctccttgcctatgaaagaaggaaataagacggataagttttctcaggaagtttgctagaaaatgggagcaggggcttccccggggctcagggaataacaatccaccgtgcaatgcagaggacaccggttgtttcccggtcccagaagatc

SEQ ID NO: 34581 - DNA, 1138 bp, Bovine  19866880803692
gaagatcccctggagaagggaatggcaacccactccagtattcttgtctggagaactccatggacagaggatcctggcaggctacagtccacagggttgcaaagagtcagacacgactgaagcaacttaacacacacatatattaacaaaaatcccaagaaaggtattgggattttttaaatatttattcatttatttttggctgtattagttcttggttgtcacatgtgggctctccagttgtggtgtgcaggctcactagctgcaaggcatgtggaatcttagctcccagaccaaggatcaaacccacatatcctacattagaaggcagattcttaaccactggaccaccagggaagtcccagggatattgggactagtactagcatataactttctgcctgtgcacatcatcaattaaccttgatcatttctagaaccaccatgtcaaacatcactctctataaaaacctaatttgaaaaacgggttctctgtgacagttccactgatgctttaaagggagatgttgaaagattttctagccttctaatattagggtgagaaagaaactccacatcagaggttggtgaattctgtaatatctatccactgtattgaagtttgggcagaattgttgtaacacctttatacaatcagacatcctcgttcagtaattaggggagataatcacccggagtttgggtactagacttaagcagtacaaccaataaatcctgagtgaccttgctgagaacttcctctcccagaaaatagaaaactcagttctagccaattcggagaaaatgagtcaagaagtgaaattaagtaagccatagaaggaagtggccaaatcacctttgattatgtaacaaccagcgggtagaatacacaacagaaagtttaggagagatgcattttatcacagattttaggagagaagtattttttagcatcattttttttttaaggcataagattccgggggtagaaaccctaaagggattgttttgacagtgctatagcaaagtcttaaggaaaaaggctaggacagaggaaatcaggcaacacagcagccagagcaggtgagaaagtgaagaggaataaggaagatactcagaaaagagaagagagaactga

SEQ ID NO: 34582 - DNA, 922 bp, Bovine  19866880943152
ttatttactgaccaagaaggttactgagaaccttacaaagagctccagaatcagggtgtagttttctgcagctgctgtaccatccactatcatttccacatccttttagatcttgaagatgctacttagtctactcaggctgtttaaatcctctaatttgtcagtttgaaaactacacattattagattccaataattcatcctgcattgtcagaacccagaatggtaccgagacatcctgctaagaattggcaacggtaaagttgctcttttgagaactaggagggatgtgcttgactcttgttgtctgctgattttgaatatttgatttctcccagtcccattttcagtttctgttccttctaagcattatttggcctcacagatcaagtgagtctgtctatgaggggaggaaagggctggctgcagggattcctgcattttcgttgtggtgatagtctatttctcattgagagttagtctatcagctgcagggttttatagctcagttttatgaatcttgtttttataaatcttagagatggctgcttgcctcacagtgggaacatccacatcctgggtgaagctgggggtcagatcaaggtgagttctccagggtaatgggtgttccctgtgagggctactggtgtttcccagttgatgttgtttagtcactaagttgcgtctgaccgtttgggtccccatggactgtagcctgccaggctccattgtccatgggatttcccaggcaagaatactggagtgagttgccatttcttcctccaggggatcttcttgactcagggatcaaacccaagtctcctacttgtcaggcagattctttaccactgagctacttgggaaaccagtgtttccacagacacacccctaattctctaggccaagctaccatcacagtttt

SEQ ID NO: 34583 - DNA, 743 bp, Bovine  19866880982154
aagacagattaggtaaccgtggatgtagatgtccatcctgtgacctcgaggcgatgggggactgccatttcagacccagaggagctgcttataaagaaaagagtcgctcacccagccgggctgcgggcgcctgtcccacgaaaacgaacggaaacgcctgcacatttccaaaacgagaaaccttgctgttgtcactttcaactctgccgagtgtcgcaatgggatgtcgtaacccattccctccccttttcctctgtgcaatttccccaaaatcgagatttctatttccccttcacccagttcctgggaagaagggcacaatgaaaactcaagcccctcatctgcccgacaggtatcctgaagctttgaaaaactggatgtgagtagaaatgtccccctcttgtaagaagccaagtggcaggattcccagtgcacgtccgagactcaggccactttgtgttctttgaaagaggggcagccttgttggaccttggaccaggggctggcaaatactctgtcagacaaagactagatggcaaacattttaggatttctggggccatacatcattattactcgcctgtcatagttgacaagcaatcttagacaatctgtaatgtgtgcatgtgtgcaggcactaagtcgtgtctgactctttatgaccacacggtctgcagccaaccatgctcctctgtccgggggattctctaggcaagcatactggagcgggttgccatttcttc

SEQ ID NO: 34584 - DNA, 617 bp, Bovine  19866880996285
caccccctccctcacccgcttctgccccatccagcccgtccccaaatatctagtcacttttccaaggtctctccacccctccaggctcctcccatagcctggctgaagtcaccagtctccacccactggggaagttccagcacccactggggaggttccgacgggcccactcaggtgaaacgatccttcccatacccttggttcctcctggaggagagaactggacatgggagggacctgcagcaaggtggcctggtctccctgccctagacacagcctccaccagccaggcccatggcactcacctcaccagcacctaacaggtaggtcatgatggcctggcaaggacaaggcaggagttagggcacctagctgggtcggaccaggggcagccaaggccctcagcccacaggacacaccgggcaccacaggagcaagatggaggggaaatggataatttcacagagaccctaggcttccctggtggctcggggtaaagaatctgcctgcagtgcaggagaggcaggtttgatctctgggtcaggaagatcccctggagaaggaaatggcaacccactccagtgttcttgcctggaaatcctgggacagagaagcct

SEQ ID NO: 34585 - DNA, 1023 bp, Bovine  19866881003607
aacaaggtggggaaggcatgaatatttaaaataaaataaacaaaatgttggcatgtgtgtgtgtcttaggctggaaattccttaagggcagggaccatgtctgtttatatagcacccgggcacagtgtcaaattgaggcttaacaaatgaattttgatgaagacgagaaagaagccgcttgcaagaagatacagaggttttagacctcatcctcctagccaaacctcacccaaatcccctttttccagggagtagccttcttcaggctccacccaaatcctcaccccgtttctgatcatccaggctccttcttgtcacccctacctgtccacaccccgcccccgtcaccaaccctgtgtgtgcatgtgtgctgaatcacttcagtcatgtcctactctttgcgaccctatagactgtagccctccaggctcctctgtccttgggattttccaggcatgaatactagagtgggttgccacgccctcctccaggggatcttccagacccggggggctcaaacccacgtcttatatgtttcctgcgttggcaggaggactctttaccactagtgccacctgggaagccctgttctcacccacaaattctccccttcctcacacagagaacctcaacctcacctcactcagggtggcttcaccccaaacacccaggccaccctttcacccagtgtcccagccccgcaggcccatccacggctgggcggcagcacgtggtgctgggaaacaccacctccgaccaagtgtttgaggtgctgtcccctcgcgtgtcttggccccttgggggcctccagccaggcagggacccgacagagggaggggaggggataagctgcttcaaaactccagatgcagcagttaaaaagaggacagaggcaatgatccttcaaattgccacatctgtataatctgccttttattttctgcttcatgaagttttatttcctattatttattcacctccccgccctcccctcccctgcctccgctcttccttagcaggcga

SEQ ID NO: 34586 - DNA, 1579 bp, Bovine  19866881209115
gaacttgtctgtcttgttaactagatccttaatgtctgaaatagtgtctcacttattttgggaaatagtaaaatttattaaataaacaaaggaatgaatggaatattctatgaataagaggaagactgggaagagagaaagggagagagctgccttggaggggcatctgttgagatgagaggcaagttcctgccccctcatggagaagagtcaggggttgctatcccatagcagaaatagactaccccaagaggatctctcaaacagtagagggagactaggaacttcaccttcagctggatgactgatatacctggagatcctcgggctcaccctggctcctcagccaagacagtgtagggagggagttcttgggaagccttgtatgggttccagccttgaacccaagacactgtacaccccagttggtccaagagcatccagtttatgcccattttcccagggtgatactcgtttgggttttattattttgggtttgggggtgtttttttgcagggggatatttttgttttgttctgggtggggattgttttttgttttgtttgttgtttgttttgttttgactctgctgcatggcttgtgggatcttagttcccctagaccaggagtcaaacccaggctctggcagtgaaagcgctaatcattggacaaccaggggattcctcctgtgtaattcttaatagagctcctttcactctcttaagagttctggccacctcacagctctagggaaattacctacatagggaaaggcagaggagaaataggtctacctttctgtagaaaccatgagaaatgaaagctcagggatttctgtgttgtctatcaccaggaagaaattgaatctctgacatcaacatggccactctaatgctgaaaggcagaagatattaggatgaggtgaggaggtcaaggcaatgcttgtggggcccagaaattcatcaatgtgcttggaaaaatattgtctccataatctttctccaaatctcaggacaagtaaaatcataacagaaagttaaaaaaaaatcacaagatgatatgggttagaaatcaccatattgggcttccttggtggctcagtggataagaatccacctgccagtgcaggggacatgggttcaatccctggtatgggaagatcccacaagccatggagcaactaagcccatgcaccacaactattgagcttgtgctttagggcttggaagatgcaactactgaagcttgtatgccctagagcctgtgctcggcaacaagagaagccactgcaatgagcagtccatgcactgcaactagagaaaagcccacacagctacgaagacccagtgcagccaagattaaataaataaatacatattttaagaaagaaatatccctgtatttacagaggatgctgtttactgacatgatgtgggaagaaatgttatttcataaagggtagaagaaaagataagtctttgttgccactatgctctagatgagtggatgccatgtcagatcatggcctgtgagttgatgggaaaagagcctaagaagctctttccgggataggataggg

SEQ ID NO: 34587 - DNA, 1124 bp, Bovine  19866881284543
tgatggctgctatggcctatttgttatggtctctggggaggaagagccacagtccttttttaccagtttttttcagctcctaaacttttttcctctgcccccaatctcacactcccacttcaggagggggtgacccttcccaagagtctttttgtgggctgacaaaaacattttaacttttcacattcctgtttttccactgaatgcccagatgcattttattttcccccaatatagggaacccctggctaaagaggttggaatgcagtgatggtccgagacagattgttagatgcaaggtctcacctctgccacttgttctgagccagcttggtcttgtgtgctctgagccatggttcatgatctgcataaagtagaaaggaatagcacccactaggcagggtgatttttctcaggattgagaaaaatcaagtacatcgtacctgagaaggtaattgtgaccatcattgcctcaacctcagtccccctccaccgactataataacatctaccgtgtggcttgcacttcacaactgtccagggactttcatggggactccattcagccccccagtttgcatgatgcttacatatgtgtagctgcgttgaggtcttgtaatacctgtgtgtttggttgctgtagtcctcagtcatgccctaccctttgccacctcatgaactgtagcctgccaggtttgtctgtctatggaattctccagacaaggtcatttgctagttacaggattaactgtctaccagagatggtcaaaggttcattgaatgtagcaactgtgtggactggggtcacatgttaagacatattctgaggccagtgctttgggaaagtgctttgggatccaagagggaaagagacaggtgtttggtatcctggcttttccgtcttgaaggctgcattgcagcatccttcaggtccgctgatcagaaggattcttcagctgttcattgtctcctaagaacacattcatgctgaggttcaggcacttttttcagcggtgaagacctgaggtggagagaggaatgtgtgatctgagcaaagtgctggcacccagactgtctgccacttccttccctgggcaaggagccagaaaagggagcaagttcta

SEQ ID NO: 34588 - DNA, 1301 bp, Bovine  19866881452903
ggttcttttgttaaaaattctttatgaagtacccccgggggttttcattttagacttcactgagcctcccctgacatgagtgggccatcttctccaatgcttcttccaagaagaacttgttcaattaaaggcaagggtacatcacccctcatcatgataccctcccatgaggccacgaaacagcacacacctctgctccccacatgtggatcacacatgtcactaatatgctctgtgaaccggtgtgcaaaaaccaaaatcaaggcttgtgctccgtggttatataacagctctctaaaggcaatcgctttcaacgatttgagctgggttctccaaggagccacagcagtttctggttgcatgccaggcacttatggaagttgcagtcaactctggagaccacaagggcaccattatcctgtagcagcaattactgactaaatggcactctggttctacaccttctgagggagcttcctgcttctagtcagggtagagttacttagagcctggtttcatgaaatttaacaaaatgcctgatttctaggaaatgtaagaaaagtttaaaatgttttgtggacatgttgatctgatataaaacacctcctcaaaatcctggtggtgttagtcatgtccaacattctgcgaccctatggactgtagctcaccaggctctctcagcacggaattctccaggcaagaatactgcagttggttgcccttcccttctccaggggctcttcctgacctagggattgaacccaagtctcctgtattgcagacagattctttgtcatctgagccaccagggaggtgaaagttgcttagttgtgtctgactgtttgtgaccctccaggccagagtactggagtgggtagttgctgctcccttctccaggggatcttcccaacccagggattgaacccaggtctcccgcattgcaggcagattctttaccagctgagccacaagggaagcaagccaccagggaagccccacctcaaaatcctatagctctccaaaatctaacaattcagtgaaaaacaaacaaacctataaatcagacatttcagtaatgttaccccaaatgccttaaacatctcaaggatgattggatttcttattggggtgggatttgaattggggtgcagaggacacaattcctcaggacttggacaagtttgagctcttgttctgcaatcaccagcttagtagctttagtctccttgacctctctgagccttggttttctcacctgtgtaacaggcataatagatcttctttacaaggctgatgcaagg

SEQ ID NO: 34589 - DNA, 794 bp, Bovine  19866882008118
tttgggggctatgctacatgacatgtgggatcttagttccctgaccagggatcaaacctatgccccctgcagtggaagcatggagtcttcaccactgaatcatcagggaagtcccaggaagagaaatttaagagcgtatagtttctgaggtggcaggaactcagctgatgaggagcagcctgaaggcctggacttttttggtgacgaggtagaaagttccttcctcatacagaaagaccaagtggctgatgagtgggtgggtgtggagggacaggtttgggaaataggttcaggtagagactgcagagttcgtctagatgagtttttgttatcctaatcttagtaaatggaatctaaggcttcctgagagtggagagtggctgggaggaggaagggtctctggggtttaggccctgagaaactagggatcccctgcccaggtgtctctcaggggctctgctagggtcactccaaaggtaagagtctcttagccctgccagacagtatcggctgagagaatcttattatagcatttacttccttttctttcgatgaaagtttaaaggtcaccatttgctcttgcaaaggaagttccacaaatattccatgtgcagctttagaaataaacagcaggacatcaagttcattgcaaactccctgttctgggggaattcccaaggaagtggaggcagagttctgggagagacaagacgaattcagagtgattactcagtagctgcagcagggaccagaatttccctgcacgtttcccaggttctcatttgccaactcag

SEQ ID NO: 34590 - DNA, 1908 bp, Bovine  19866880411335
tatatatgcacaagcagaaagaacatcaagtctcttactctttgtgaatgctcgtgtctcatattttaataaaatttattttaataaaatgcacacatgtgtacccaagaaaaacagagcagcactctggctttgatagtggaagaggatcgggaatgaagaagcagggggacaagaagccagcagagaactgtcattctctcactccgaggcgccctgaataccacctttagcaaataaacacatgcaggaggtcctaaagtcttggaagaaagaaaacctatgtcggaatttaaatccaacacctactgtatctcaggctctgtgacagtaaaagaaccttacagaaaatatatatactccacccagtaaactaccgtaagatttaattctctgctcttcctatattgaactacattcaaacatgtagaagagatactatgatacatgcataaccatatgtttcatgagtctgattttagctgatgattcactgatataagttccatttttaaaggaattcttaaagggacttttaaacatttttaaagcaatgttttctttctatcctctgatctcatggcaacttatatatctagatgtgatgagagcatctgtgaagcccttttgctattcaaaaacaatggactcactggaattctcattctctcaatttcaagcaaatacagtcctagttatgtctcaatttggttcagatctgaatatgccaaaaaggcctattaattaaggaaactgataatttcatgtttttgtatgtgtcatatacacaaagctgacatgaccagagagttttcctaatcaaaagttatacattttaatgtatgatggggaggggtggggtagaatctttatctttgcaattatagagattattctaaatacaccagaatgatcaaaattaaaaatacaaataagaagttaaaaaaaaaaagacatggttcactttttactagtcaacagatagtgacgctgaaagtactgaagagtttctagtttttaaagcccagagtaagaaaaagaagcaaaggggaaatgtgggtggggtgggggatggtatctccccaatatatgtaaatgcaactcctaaaagaagataaaagtaactcatgaaggatcagccataaatttgactgattttaagtttgtcagctggagggaactattataacaccaataaatagagctgtagacagctggccatgtgtaataccatgcccctttgcctaaatgtttaaaccattgatttacttgggattaaaaaaaaaatgaaatctcaaattcagctatccccaacacacaaagcaaattccagaatcttgaagactttcattgtctctgaaagtcattgtcaccaccctaatcccctcattaaagctaaagaaaggccgagatggcattaaaatgaatgcagaccatttgcagcaatctcctgctcacaccacctccaaatgaaggcaggcacattgcataatccaggcagcaagagctcctgacaggtggatgatttatgctcatagtcagaagaatcggagggcctgcggaggagacagcatgagttaggcggtggcgagacagatgctctcagtgggcttgcgggggctggcaggctccagctagttcaggtgcaacctggacactttaagtgctgaactcctattgcctagattccaacactctgatgtgccatttgcaatatgatacgcaatgtacactgtgaataaactgtcaactgcaggcaagcactgtatacaccgcacgtaccccttccgagcatagatgttatgggacacgtgccccagcacataaaagaacggaaacccatttttttttttttctggtggtattggcaaatgattcttctagtacagatgtacacgttatgaagtg

SEQ ID NO: 34591 - DNA, 1865 bp, Bovine  19866880703366
cactgaaaatatagtcatgaataaaaaataagcttttctgcccttagaaacttttacattctagtttatattagttgacattctagtgaatggttttagaaaattattaaatttctttcctattcctcagttttctcagctgtaataaaagagaggcaattgcaactactgcttccgggctagttggagagattcagtcagcttatacatatgaagcacttgggcctgacaccataaggtttaactgttcttagtacacagagagcattgcctagataaccacatctgtggacattttactgttgaggttcgaaagggaactaattttgtctcacttttttttttttgctagagcaagtagtgaatgaaaggaattccctgatagagatgagctctttttgtatcagctgttcacagatttattcactcattcatacattaatttgtttattcattctctcacctaagatacatttattgaacaaaatttcaggcgttatgctgagactcactagatagtaaaatctgattcctgcttaaggaagctcagaatctagcaaggacaacagagaagtatatgcactattgtaatattctatgataattgcagtgattttaagaatatagacaagattctattttctctgcaagtgcttatcgaaataaggctgtacccatagttgttctttgcacttctaatactttagcctgtatagtatgtactagagtacttttttttttaaagaaagatttgtttcatttatttaccataattggagaattaactgcttcttgtaaattttccagatgtgatcttttaaaatgaacatgaaaagaagttttcatctgttttttgaagccattctaaaataaaacaaatcacttactttgttctgtcactgacgacaagttgattttggtaacttgtggtcatcataatgaactttagctttcaaagggcattgaatctgttggacttttggatctgttgaactcttccatgagtaacttttgagaagatctcatcccctctcccaccttcccatgccctttatgtatctttgattaagaggacattttctcttccttccttcaaagatacatagtggtcatttgatattgctggataattggctgaagaaatatatagtttgtatagttagatttttgaaaaatgtgactatatgtatcttgtattttttctgtaaattaggatcagatttgaaatactggaaataagacatcaagcttgagactgacaacagtagagttgataaaggtacttttggacctgtggaagatttttgaaagattgtctttgctagtctataatagtaacaaaaaaacactattctagtttaatgatcaagaagagagaaatgtcattgtgtaatattaatacgtaatgtagtaaaataaatttcatcactgttttctatatccaatgatgattctatgatttgtctacctgaatatgtcaatgaacttgactgcaacttagtggaattaactagtagcctttaagaagctatcaaaatgaaagcagttaaatgaatcagttgataaaggtcctcatcctgataagccattgtctaatcttataatttgtacatccagggacatatcagggggaatccagttgttacagaacaaactgaaacataattgaaagtgacaaatgatcagctgcagattgggacattaaatagaaaaccacttggttcagaacctgcgtaaaatatggtatacacctatttctagattttaaatgaaacttcaaaagtcattgatagcaaagatagaagtaatttgaaaattcaaacctttattcataatgcacttaattagtatttcttccatttttt

SEQ ID NO: 34592 - DNA, 2520 bp, Bovine  19866881024733
tgagtgaatttatctttgatttaattaacagaagtttggaatggttttggataaaatcattattcctgaaatttagaaagtatctggaaatgtagagaaaaagatttgtgctgttgggataaccaaattactaacagaatgtcccccaatgatggacacagagtacaccaaactgtggtaagtactccattctggagtttggggaaattagtttccttcccctgtgatggcaaaattaaccaagcttattctcttgggggccaagagaatgggttttgaccttagcctcctctgtagctaccatcaaatccaagacatgacttgtggattcttcggggcctagaaagattttgtttcctgattatttttatttcttttggccatgcttagcagcatgtaagatcctagttcccccaaccagtgatcaaaattgtgccccctgcggtggaagcacagttgtaaccactggaccgccagggaagtttgtgggggattcatggaccccttagagagactgctgagagtgcctggtctacacagtcactccgttaaactggcctaagtctttagaaggagacactgagtaggcagaagatcctacgtgtgtgcttgatgttggcctccatgacgacctagctttcttgacctcttgcttctcccttacggtttcagtcatgatctgacaactggaagcttatttcttctaacttaaaaccattgaatctcaatttgacttcacacacatggcctcctaagtagcctgggtcacacagccagcacagagttctgggcaaaggacatcagcatgctgtggcccaaagaattgaggaatgctttccagttagacaaaatcactggtgtccatcttaatctcaaggatcccttcctcctcctgagaccacgcgtctatagttttgtgtctctgaagacattgctcctttattaataatttaaatcttctaagagcttacttaaatcttgtcattttccaatccaggactcctttattacagtctctgattggcctattcgagttacccgaggatgataccattcctgacgaagaacattttattgatatagaagataccccaggataccagactgccttctcacagttggcatttgctgggaaaaaggagcacgaccctgttggtcagatggtgaacaaccccaaaatccacctggctcagtcactgcacaagctgtccactgcctgtccaggaagggtaccgtgtgtctgttacctcggagaactctagtcttctctgaatcactctggcttggttcccaggcccccatgggacggcgctgagggtagctgctctggtgcctgtcttccttgctcagcacagtcaccctcaggcagttgcattcaaggtctctttaagtgataagactctttttttcctttatgatgatgttcaagtaactttaggagtaaagacaaaatggaggataaaacccttgactagaaatgtatttatttcccagaatgaaataatcctgccatttttaaaatggaggtattaatgtttttaagtgcaacatattcagaaataacgaaccatagagtaaatctaataataatggctttatattgggttagccagaaacagtcttagaaattttgtcagaaaatctatatttttgattgttttattatggaaaatttagaacataacttagaaactgtaataaatacttatatttattacagacctttactaagtaattggagagcaagccttaggcatcatgtattcaccatgagtacttcattaggtttcggtaaccaacgggacatgatttaagcaaccataacaccactaccacactgaacaatagaacagtaattcctgtgggcccacgttttagacctgtcatctgtttcccatctgtaggtcccctcaatggtgagcaccagcctcaatgcagaagcgctccagtatctccaggggtaccttcaggcggctagtgtgacgctgctttgaactgccttttttgaattgtcttagtccagaatggtttctgaggacatcatgtagacatctgagcacagctgcattaaaacaaaaggtgttcgttttgaacttgtctattaaatgttgttttaagctgaaccttgagcagattagtttgtgtgatcataaatataagtgagtgactttttcagtttgcagctacaaagacaagtattactactagcttagtgtatgacattgattggagcatttgcactgttttggcaattctaaagttttgacggacactgactgtggagacattttttctgttaccaagtccttttgtttcgaggctgctgccgttcgtgtttgtcctgtcctttgtggttttgtccgtttccttaagcttttactggaaatgtgaataagcaaagaaatcacttgtgtaacttgccaagaaatgcacatttcatagttttaaatctgtaatgagcaataaaaaagaaaaagccctaaaatatgtatctaagaacatcttaaggacaggtttttg

SEQ ID NO: 34593 - DNA, 1484 bp, Bovine  19866881106284
ttgggtgggtttgcagggtgtgtatggaaggttagatgatgacagaattatttttaagaaaagatatttctactttctaacctgggttaaataaacataacccttaagctggaggggggaggtggcaggcaaagtgatgagcacaaattccccatccataaaaaacatctggcacaaggaaaacagtagcaagtccagatggtacccggctctgacacaagccaggggatgctctacggacagagacaccatagagattgtgtgtgtgaggaagcacaaaatacagtcttacagaattaaaaccggaaaccttcatggctggtagcaggagagaatgagagcttagtcaatattctaacaatgacgactttgtaaaaccttttcttaatactttatgtctacacctctgctttacactgtactataaggtacatggcagttttacactgggcaatcacactgggagggggcaaatgctgcccagtattgaaaaaaccaattggaaagcgaacatgcatggcacccagttggtgtggatgccgtctaatatggtctcaggtcagcaattggcctcttgttgttatcattccgcatgtatttggtgcacagctttgttaagatcagctgaaccggctatagaaaacaaacatgtttatcaaaggggaaatggtagaggggataaattaggaagttgggatgaacagatatactactgtttataaaatagataaccaacgaggacctattaacatagcagagggaactatatgcactattttgtaataacctataagggaaaagaattctaaaaagagcactgtactgtccaactgaaactaacaacacattataaatcaactatacttcagcagaataaaacaaaatttaagaaaagagatctctgaagcaattgattcctacttgcttcactctctcctcagaaaagctaaaggttattttctcagttcaaatatttctcattccgggaggcatcttcaagtgagagtctggttaagggctctcattccaccctccttagcagccaggactttctgtaagaactcatcgcagtagtggtcattggctcaaagcaggttcctcctctaagcctgaattacacaaatgctgggaatacaaccatttttcccatttagccagttcatgactgactccacatcttcacgtcttgtgtctgtgtaacagtccctgttctaagcacccacacagtgatgaacaaaacagacaaaacccctgtttattggagttcatttctatgaggggagacaagcaacatgcatgaaataaattagcaagactctcaaaagaaaaatgtttgatggtgctgacagctctggaggaaaatccaggaggcaaagagagaaggggagagtgagataggagagggctttttcagttttaaataaagtgactggaaaagcctcactgagactttgagatctaaagaaggtgagggagcaaaagca

SEQ ID NO: 34594 - DNA, 1570 bp, Bovine  19866881187807
tactgcaggcagattctagagtgggtatcctatcccttctccgggggtcttcctgacccaggaattgaaccagggttgcttgcattgcaggcagattctttaccagctgagctatcagggaagcactttatacatttgtttaaatgttctgtttgaagttgtttctgatacttatgaaaccgctatatctgccttgtaaaattgctttgccgaatttgtaagtactagagaatgtagaacaaaggaactgagtacttgtattgatgtatagaaaaatctcaagagactggactactagacttcgagacaaaaagagtaagtaatttgaagtattgttgtatatttctgtttccagtgaataaaacattgtgtggacttggactatatttattgaagtatttcttcatcttgagaataggtaggaaatctttcttaggtgttttttaaggcatgcatatttccattctcctcagaaagttcaaggaaaattcagcctgagatatcctctgaagtttgtttcctgagttatgatttgatgatataatattacatcattttatgaatacgttgatcttattcacttgcagaagaagaatgtttattcatttttcttcaagggaaatgtacattagtatggtgaatttccaatgacagaactagttcttgtaaatttgagaggcattgctcttgagatgaagcgatgatcttatgtccattaacaatatacgcattcttttagttagtctatatgatccagagatgcctgaatataggatgctgtaacactgaaacactttcttggggagatttatggccactagtctgacaatcatttagatcacttttgtctaaaattctgaaaagcagcattgctaataaagatttcctcagataaacatttcactggacggtcactgctggccctatgccacacatgatgtcaagtgaaaagtatgaatgagatttaaagaagaaggcatgccattctgtgttttaagtgagtgaaaaaggtgcccgcctcctccatttgcccttagaggggtctgagagaagtctgatctctcaacttagacctggtttactctctacttacacctggcttgctgatgttggcctatctgaaatgtctggaaaggcattatgtgggagaatgcttataaatagaatgactgattttgctctgtatcagtatattgcccttaatggaaaaattaaatatatctgcctgaaattggcattcttctttgactcttggcagtggccatatgatctgaagccattgaagcattttagggtgccagaatctgtactggtgagtcacaggaaaccattgacaaatgggtttggccccagtcccttctcctaaaacagcagcagataaaatgattttcttaattctttccatggatgaacgggagaccctatctataactcattgttttcaatacattattgttcactcatagtgatgtcagcttaacaatcttaatgttaatcttaaagttaatgttgcctttcttttaatcaaaaataggcacaataaagtattatattttaacaaatatcttga

SEQ ID NO: 34595 - DNA, 1552 bp, Bovine  19866881206757
cccaagttcttttggtgaagatttgggggagaagaatccttttatgattccagaagtagatgaggaaatgtaactattttgaaatgcaccagggcatgtcatacttctaacaagaccttccctcaaaagaaactgttttgccagaacctattggagttttattaaagtctagctgaacatggagaaaaagaattacgtctcctctaaacaatcctgtcccacctaatgatggagttggagaagaaaggggcaagtcagggaataaacagagagtacttgtgaagttcacatccccatggtagagactcactgaaagactaaaatctgagcataggaatatatggcgattcctttcccctacacctgaacactgtaactaaaggtctatttactgatttccttttactgagtgcatcatgtctggctttcaacaaaaaattacaaagcacactaaaaggcaaaaatcaaagattaaagagacagtgaaaacattagaaccaaactcagatataacaagtattttaaaattatcagactaaaaatttaaaacaactgttattaatgtgctaaccgtgttctttccatttcttttctaatgggaaagaataaccaacatgcaagaacaaatgggcaacataagcagaaaggcggaaatcctaagaatcaaatagggatgctacagattaaagagaaaagaatacaacaagggttttatataatattgtagtcttaggaatcattaaaacagtgttttttgtaaagcaagttaaaacagcatttcaaagatacattgataagctatgtttgaggacaaagtaccatagatactaattaaacagtttaaataagtgtcaaattaccagattctgagagctatgactgaaacatgcttgaaaatgatggaaagagtagtaatttatgaagttgaaattgctaatacaataacaaatattgaacagtttcaaagtagttgtaaactatgtcataatttttcatttatatatttatcctttcaagattatagatcgtattttcagagtgaatgctaatatgtcagaatatatcagtctttcatatgcagaatttacaacttaaggaaaatataaggttttgtagataaaatagaaggaacaaaaacatgagaacagcatgaaaaacatgaagcaaaaaatatgtaaaagtttgatcaaaattgtttcagtaaaagattttacttcatagaacagaatgtgaggcatgaaataaactcatctctaaaacaataatgatgaagtttctgcccagtgtcattataaggattcctactttaatctaaattaatcttcaccatcacattatgagtaatggctaatggggtgcctactgtaattcattttattttacaaatgagtaaacagaggtttagagagttgatatcctgtctgctgctgctgctaagtcacttcagtagtgtccgactctgtgcgaccccatagacggcagcccaccaggctcccctgtcccggaattctccaggcaagaacacggaatgggtgccatttccttctccaag

SEQ ID NO: 34596 - DNA, 1106 bp, Bovine  19866881299339
agtagaggaaaaagaaggacaagtaaaagaaaaggcgttttcaaaagatacgcctgtgtatatgtacaaaaatctactttaaaaatgcataaaagggaagatttttttaaattttgttttaattttttcttattatttttctctaattagctttgttgataatttttatactcaggaaaaaaatagaatattcatgaaagatgacatgcagccagagaactacgttataggtgtctgaaggtacatagtgatagaatgctttaatgaatttagaagctccacattgtccatctctaaatcactttcacattttacctaatttttattttgttttctcatgttccgagtacagacacaacgtgtatggattattattacttgtggaaatgcagtgtcgagtacacatttgcctaaatcatcttatgaaagatttctaaaaatgtttaccatcattttcaatgggataaaaaaggatacacactaaaaaaagctgtcaacaatgtcagaattataaactgtaaaattaaattcaaggacgtttttaaaacattcatgcaatttcaatccttaataatattagggagcatacaaggaaattaggcagtagttcaagtctcattttataacttaggaaccaagccagccccaaatggcctgagtgactgtgttgtgtgctttgagttctggaagggaattttttcctttggcagttgtcatttgaaactcaatccaatcttgtaagatatggcatatttgctttattcttccataagaaatgttgtaattcttcctcttgtggatgccaagatcttgaaaatggcatgaagtaatgctctgagtcactagatcctaaaactactgatgctaaaattaagacatatagaccatctaaatgacattgataatattaccattattaggaaaaatggaggagtcattataattgaagaatccttaatatagagtcctgggatccctaagcctactgtagatgatagatgagttttaggacatccatataaagctttcaattgtatatagaaatgtgtctgtgtatttttgtttatgtatcatgaagggggagacgtttcagtacccaaaaagta

SEQ ID NO: 34597 - DNA, 1517 bp, Bovine  19866881340079
aaaaagagcagttctaatctaatacagaggaagggaaaaaaatgcatgggtaaataaagtttcagggatcaatagatgaagaataggagtttcataatcatagtttgttcatgaaatatattcttttgatttatgtattcaatctgaaaaagggaaactattgatggttctggagaaaaataaaatgcaatttaaccaacatttgttagaatagataaaccaactctctcaattaatctctggagtgtatgcccatgtgcacactttataaaggtatttccatgtctctattgattgagggaacataaactgtccttgcaacctcatggaagcttcttcattcatttcaggaagctctgtgtactgggattctcctgggagcaccacctcaactcctaccacaagagaatttcaatccatatggttcctttaatactttttattgctttaaactgtaattatttacatgtatatgaaagccttctgtttgtgtctagtcagtcaaatatcacccaagttaggggaatagtttgtcacttgaaatgaattaaagatcaatagaatttaacaaagcttttcagaatattcagttaaaaatgatgataataaaagctgtgattattgagcctagttagttgtactggattaaaaatgcagccttgccaaggttaaatttcctgcctgaatttaaaatctcaagtttccctgacctttacctaaaaaataataaattgctatgaccctagatcactgtaaagatacaagaagtacttgtatcagaagtacgaggagtatcagaattctctaaatgtccccttgacaaaaaccaagaactgaaaaggcatatttgcaaagtaaatataaattaattttcatacatgtttgtacatatttgtaatgtcagtgtttataatgcttcacatatttacatgatttgcacaaataattaaaatcaatatatttttatgattatactctcagtgatacaggtggcttaatgcataacataaatcattttatgttatgttctcaatatctctatggtttataacagtcaggaaagaccatggtgggcgaaagaaagaatattctacttaaccttccctggttacctgatccatgacatacagaaccaagcccagtaacaatatagtaaaaataagaaggaagaatttttaccacttgattagaaaaaggtaaaacaatccaagtaaaaattaatttttctctttgcatgggactttaaaatatcatatttagtaaaaaggcaaagttcaattcttgatatcttacttaaaaattgtgcaaccctaggaaagtgatgtagctccttgaaatgttagatacccacgacaattgggaacaaagataaacccagcctatttgacttctaccgtaaatgtgacatgtaaagaaaaaaatgtctgatgaagtagtgatactttacagtctgctgtgatggagcttacagtttattagaaagaaaagacaaataatcacgccaatgaaagccaagt

SEQ ID NO: 34598 - DNA, 1532 bp, Bovine  19866881430329
caaagactataatttggcatcctgagggccattgattagctaaaaattggtgtgaacatgtaatcattgggtaattttatgtaaagatccagattgctggctgcttttggaattggaaactgataatgctggccttccattcggatgcgcctgcatccccacaaggcaacatcatagaggtgctggcagggactgtgtacatggtgggaccagaggtctctgggtcaccacagcacgtcctccttattttttttaaacacacaatccattttgcttcttcactttacatcaggagtccctgtagttgtttgaatttgcaactcctgatataaacatcaatattaactcatgtaacatgggttttctttgaatggaaaaatcttgcaaataaataaatgccacagtcattagacctgccagatcattatcaagaaggtaaagaaattgaactgtatattattgatttagaatttgtgtatatttacctatttctaggtaggggttcccaggtggctcagtggtaaagaatctgcctgcaatgcaggagatgcaagagacgcaggtttgatccctgggtcgggaagatcccctggaaaaggaaatggcaactcattccatactcttgcctgggaaatcccatggagagaggaggctggtgggctacattccatgaagtcgcaaagaatcagattccactgagcaagcacacacacatctatttctttatgtatttatgtatatatgtagatatccatgatatataactataatttctgtgtatatatgtgtgtgtgtgtgtgtgtgttactcgttcagttgtgtccagttctttgcgaccgcacagattgtagcctgccaggctcctctgttcttggaattttccaggcaagaatactagagtggattaccattcccttctccaagggatcttctcaacccagggatcaaacctgggtctcctgcatcgcaggcaaggtttttactgactgagtcaccagggaagccctaaaaggatgactatagatgtttagatgaaacattactcattgtagcatatttactgaaacctgatcctatttagccaaatgcctttttattttgaaactccagatgaaattcacttaagtaccagaataggtattagctgctcattggtcgttttcttaatctccattattaggtcatattgtcctctccttagcataatctagtctctgtgtagtacagtgctcacaaatctgaagctgtttctaattttccatccttcagtctgcacaggcatatgcaacaggcattgatcttttcctaatgcagtaataagctaggagcgcttttcaaacatgggcacattatttgctgtattattgtcaagaacaaaaggaaatgcatttggccaaggtcagtgaaaggggaaggctgaggcctgtgccagaaaaccttctgctcttctggttcattaatgctatccatttggctctggtcttccgatttaagatagaaggatgttgatgtttcccactgccaaggcagtt

SEQ ID NO: 34599 - DNA, 3905 bp, Bovine  19866880233801
gagaacaagcatatttgttggtgatgtaggcgggcgtgaaggggagcgttctttgacctccccagcatcttgtgtaggggggaggttgggggcaacagaagaggcagtaggtggggcgcaagcccccgttttttccctcagagaagactctgacctgataccctccgtcacggcccttgtgctcgtttgttaaataggatgaaaatttacatttcttactgctcccgaggttgaaacgcttttgcatgtttgttggccactgtgtttcttcacccataacttgctggcccatatgcattgtccggttgcccactgtggattttgtattctcattacttgaacaagcatttattatattcaagataataaccatgcaagtcacctaatctccctagagcttcaatcccttatcaattaaatgagaaagtgagactagctcatctctaattctgcctccactcttaagattaggttgcacttagatttgaacatctataaatcacattttcataaagtcaggcatgagtaccttgatggttgagtgtagagaaaaaaggcgccctggagaaaggttttttgtgttttgagactatgttaatggataggtttttatgagtcaaacaatacatctaagttgggaaaggtcggtgttttatcgtgaaagaaagtgaagtgctagtcactcagtcgtgtccgactctttgtgaccccatggactgtagcccaccaggctcctctgtctatggaattctccaggcaagaatactggagtgggttgccatccccttctccaggggatcttcctgacccagggatcgaacctgggtctcctgcatggcagacagattctttacccactgagttacgagggaagcctttctttccctatgctgcctgccaagttgcttcagtcgtgtccgactctgtgcaaccccatggactgcagcctaccaggcttctccgtccatgggattctccaggcaagagcactggagtgggttgccatttccttctccaatgcatgaaagtggaaagtgatagtgaagtcactcagtcgtgtctaactcttagcgaccccatggactgcagcctaccaggctcctccatccatgggattttctgggcaacagtactggagtggggtgccattgccttctcccttctttccctataacactgtccatatctgtagcccaaaatgctcagtgtaggatccagcagacaaagttcctatttactgagtgcttgttggagcagcattgtaaccactttacatgcattaactcatctatattcacacctgaatgaggtagggacagtttttattcccattttaaagctaggtagtgaaacagaggtgctgagaaattgacacactttgaaaggtcacacccttggtaaaggctggagctggcactggaaccctgcgtttggatctggaccccagatccttaactattgaactatgtgctaaatgaccgctttaacaagctctgtggggagtggaggaggctcctggctgtagtgacagtcccagtccatttctcccacgagtggtgaagaattgaatggcttcttcatccactgcatcccctggggggcccagtggcattccaggggtccactgtttactctgcttcatgtccgcagttcttagaattcttctaagacctatgactgtctgtttagccagccagcctttaatgagtaattgtgtgtgtgtgtactaagtcacttcaatcggatctgactctgtgaccccatggactatagcccaccaggctcctctgtccatgggattttccaggcaagaatcttggagtgagttgccatgtcctcctccaagggatcttcccaagctagtaatcaaactcccatcttttctgtctcctgtactggtaggcaggtttaccactagctccatgtgggaagtccttgtgctgtgctgtgcttagacgctcagtcgtgtctgactgtttgcaaccccatggactgtacccttccagatcctctttcctggggattctcttccaagcaagaatactggagtgtgtcaccatgccgtcctccagggaaccttcccacccttaccatccaccaaaaaagtaatgctgctgctgcttctgctaagtcgcttcagtcatgtctgactctgtgggaccccatagaaggcagcccaccatgatcccccatccctgggattcttcaggcaagaacactggagtgggttgccatttccttctccaaaaaagtaatccggaaggttgcaaataagaaaagagttaatgggacttccctggcagtccaggggttaagactctgaccagagaacatggatttgaaccctgattgagaaagtaagatcccacatgcctcacagcaaaatattaaaacaaaaaagagagagagagagtttatttggagtcctaagaattgcaatgcaggagacataaaagttgccatgtggttgttaaaagtttcctggtggaatcattatagactccaaagcgactcagaaaatactttttcttaaggaatcacaagttgtttcagcctaaggagtccaaaaagcatcttgaatctctgacaggagttctggatgacttcatcaggtcaaaaggtcaaattcccatccaagctgaaatgtgcatgtcacattattttttttattggcgtagacttatttacaatgttggattagtttcaggtgtacagcaaagtgaaccagttatacatatatccttttttttagactgttttcccatatacgtcattatagagtagtgttccctgtcctatacagtaggtcttcattagttatctgtttcatagacggtgtgtatttgtcaaccccaatctcccagtttatccccccaccctccctttccccctggaaggtcatgctttcttaaaggcctcctgcccagctcccctttggaaagctcacttagtaatactgatgttgcttagttgctaagtcgtgtcctgctctttgtgacaccgtgaactgtagcccactggggtccttggtccatgggtttttccaggcaagaatactggtgtgggttgccatttccttctccagggaatattctcagggccagggatcaaacccacatctcctgcgatggcaggtgattctttaccactgagccacctgggaagccctcgcttggcaacactgactcccttttgattttcctttcacgctgggaaatgccaaacacaaactatggaaacacagtgcctgcctgcaaagagttctcgtcttgtggggaagatcatatgcaaatgcaagcaaaaacaaaactgtagagaattctgtgagtgactaattagcatgtgaatggcaccaaatttttgtctagtcagggaagacttcctggaggaggagagtcttccacttgagccttcaagggtgagtaagacttggagtggggaagaggtcagcgtatagtcttggcctgagtggggagccttaatgggaatagggaggtcggctagactggttgaaagctcctggaagggaacaaaagggaataaagctggaagagtgggttggggacaagttgtggaggtttctgaggacccagaggagagcctttaagtgtactttatgcactggtgtcttatgaaggctcagagctagggtaggggggcaggaaaggagtggcgagacaaagacagctcttagggaagattaacatgaggcagcctgttaagctgcagaaagagtgagagtgaatcgaagggtgccggggaccagccctggctgatccagggtattcgaaggagagatggcataagcgacctatttatttaaatatttatcaaagatataaagagtaatagaatgaggatagctcagtgaggaagttcagggagaaaagaggctaaataaggat

SEQ ID NO: 34600 - DNA, 1685 bp, Bovine  19866880411857
tgcagcttcccccacccctcttccaatggatagcctgttttctgccacccaggcctggatgtgacctgacaagcagaagagcaggcatggaaaaacccatatgtcaatccatgcccagcctgtcttgcacaatcctaggagcatctttctaaattctgtgccttaggtgactcattcacctctccctagttccagccttgcagtatgagagcacctattagggcatcagctctgtaatagatattggggtacaaaaatcaataaaatgaggccttccttccgtggacagacagctagagagaccaacaggaaacacagtgattttagttggccatgaaattgtttcagtggggacaagggaagtcccctggggcaacaggggaggcatctgatctacctggggaaactggtaagccttccctgaggagaggtggccttggagttgagacttaaaaggttaggggagggagaagtttgaagaggaaaagagaggggaggaaggggcattccatgcagaagagaccgcatggacgcagatacagaggctagagagaatgagtgtttaaaaatccactcatagctcagtaggagcgagatgaaaattacatgggctgggtgctagtggggagggaatgggaagtgaccagagagccaaagcatgacagagcctgtattccatgcaaagtggtaagaatttctgtcctgaaaaccgtggggacctgctgaagaattttgagcaggaaagtgacatgatcagaattgcattgttagaaatagcactctgatagaaatgtggggagtggactgaagggttgggagagcaaggactgagtgagtggctaggagggggttgccagggttcaggtgtgcgtgctgagggcccgcgatgaaaggagtcctgcctcgctgtgctcacttcttcccctggcccctgggaggaaaaatggcttcctgccctccccgcgtctgggcgggcagccagggcgactgcactgattgaggcgagagcgagcgtctccaggagcacaggggtgggaaccagaggggctctaacccgggaccctctggcagaagcagagtctccctgggctgagaacagatccctccttctgagctgggtctggagcggaggaggaacacttggtccacaggaggaggagccccgaggctacactgggaactttttcccagcactgagcccctgtactcacaggtgagaggtaccagatggaaggggtgtgtggggatggctccctttccccctggttccagagccccttctccacatttctgtgacaatatctttacattgctttcttcatccttgcttcccagcacctccaggggggctagagaaggtagctaattaccttgctataaataccagccaggaggagctctgagggccccagacctggcttctctttctcagtgccttgctggtgggttgggcagtcctggatggggacactctacacagtaatccaccatatatttctaggatatgcccaccttcccctaatgaatggaaacaggcagagtgggaagaagttagcaaccacatcacagacatccacaaagtaccaggcacagtgctaggctccaggaatttgggggtgtatcagagcctgtctctgctttcaaggaactcccctgtttagagggaaagataggcctgcaacaaa

SEQ ID NO: 34601 - DNA, 850 bp, Bovine  19866880424291
taaaatccctaatgtatgtgtttatttgaacagagaaagccaatgactgcttgatacagatggaatacataagagacaggatgactggggtatgtgatagaaccagcacattcttctcatatgcttggcagtagattctagaggatggtgagcatttggaaagcctgggtatcagtcaactcagaggtttgatactctggacaatttcctttctcttgccaacatgtgccccttttcactactctcttactacccctaattgtgccgggcagaatccaactcaaattcttttctctgcatggcacaaaggcgtgggccatagcagcaccaggaagctgctcctggggactatcaaagtgtgggaagagtaaatatgaggatctggaggactccctgactggggaattgggagactggttattcatatggttaagattgagcctggaggatgcaattggcagaatacagagaggagcaaggagggaacacttcataagtcctcactctcccctgggacctgggcaaaaccggcgtgttgcaaactgaagaagatttcaatacgtggatctaaacctggaggagtgttaagtgttcattgtgaaggaatctaatcccactcattgctgcttgatgctataaactttacatttgggactcttctaaaaaaccaagtgctgagggtggtggaagtgggctgatgacattctaatacggagctatggagatgtatgttacagaaaccagagtgtcagactgggaggagaaggtaagatgattgaagaatacaacagacaattatcgtttgggcaaaggagatggaactgagaaaagctgagaaagctctgggcaa

SEQ ID NO: 34602 - DNA, 1348 bp, Bovine  19866880447689
tctgatggagcgagcccagtcgtgtttctggagagcaggtaatcaggctttgcaacaggaaaaccagaaagggcacagcccaaaaagccatcagagagaatgctgtcttgctatttacagagggtttaatttgagtgggcagaggtgacagcagatggggccgaggcagtgggagagggctttctaacaagacaaccttcggtatgccagtgactcatagctcccggggagggggtgtgggtggatcatctccatccatagagctgaggttcaaaggggagctctttcagtgtatggctaagcacgtgggtggagaacctaggcactcctgttttatgctgtttccggaacatcagttctgatgccttttcttaggaaataaacagacccacaggtcatctagctgctcagtgacaccctggggaccagatgtgaccacttcaccagggtctcctgcacgtaacagggtaaatgatgagtggtgtcgtccgtctctcttatttcagaaactagctgcctctgtgcttccctctccctacatacagcaacaaatgacatcacacacaagtctcttccattataaaagagaccaagagaatctaaccaatagagcaaagtaggaagaaaaagcgttccactacctaagcattaatttttgggtacattcgcttccattgttttacctgtatgtgattcttttttttttttttcttttcacatagttgagttcatattgactagaccatttcatgccctgatttcattcacactattataaggattttccatggtattacatacacttcataaatgtcattttgaaggtagcaagcttactggaccgacttctgattgctgggtgtttaaactgtttccaatctttcactgttacgcacagtgcctcaaagagcagcttcattgtaggatcactttgaatgtttgggatgattttcttgggctggaattttagggagaattctgcacacaggtgctcccatggtttgctctcccatgggtgacccagccttgggggtcccagacagaaggctaacaggtctcctctcctctctctacagtctttctgaagcctgcattgatttctttttctcattttctcactcaggacctataacttctttcctgagacccctccattaaaacccatcacattcaccaggattctctctctctgttgaagtgagggggtggggggaatcacaccctaaacaatatcatcaaaaatagaacatattgtttcaataaactgaaaagttctggctttaggaatagctggatccaggcactgaggtaatatgatcagagcctgatttttcactgactctaagcc

SEQ ID NO: 34603 - DNA, 1358 bp, Bovine  19866880569599
cttgcagagaagaaagtgaaaggaagggatcatgtttattgagcaggaattatgccttacctcatttcatccttaatgaggtaaggattttttcatccttagaaaaaatcaagaatataggtaccacaatctccatgtcaaagatgagagcagagctaagccatcctcagagcctctcctcccagctggcaggtggcagaatcagaatgctaatgccatgaccccacactgctgtccccaagtccctctgatggcatgtaaggaacatatgtaagaaaaaacaccccccacgttatccttggtttacatcatccctctctttgccaactctgatttttggatttgctgatttccaacccttaccttcttactcactctgccttcgtgaggccttttcctagcagccccagttaatggggaccttgtctacacttaagattgtacactgctcccagtgtgactgggtgagtcacttaacctcttgacttaacttcagttgagaaagtgacacccccacctcttttctgacctatctgccttccatcctcccctttcccatcactgattcctttctttccctctttctttcaacacatctttgctgaatgcctaccaagcacttaacactgggccagatggtactgggctgcagacagaactaggaattaaagccacggtttctagacgtggagaacctcctttgtacctttttgatctggagcaagtcattcaccatgattacttcttttcaaaaaaaattttggctgccccacacagcgtgcacgatcttagttcccagatcaggatcgaaccagcgcctcctgcagtggaaacgtggagtcttaaccactggaccaccaaggaagtcctgaccattattacttcttgtattgaggtgaaattcacataaatagcacactattatttttctttgtttcttatctcatgctttttaaaactgttagggggatttaagcatgtgggggatttaagcatgtggaggatttaagcattagggggatttaagccagccacctaaaacctggcacaatgaatgacccataatacacactctgtgaatgctaattccatgaatgaataggttttattctcccaaggacagtttcagttcctggacagtctgggccatgtcagtatcggagctggaagggacctcgatgaatttctcagtcagttcattcatgtggctgaacaggggctcaaagatcacgcagtcagtgacaggactggtctccctacagccacagtgtgcacccccttccttgtgtccagcatggggcaagtggttgccacgaccttcaacaacctgtatatgctgttctagaaattaggaccca

SEQ ID NO: 34604 - DNA, 1176 bp, Bovine  19866880580634
ctgggattgaacctgcgtctctaatgtctcctgcatgggcaggtgggttctttaccactagcgccacctgggaagcccagcagggcagggatgcaaactccagaccgaagacagggctggcagggagcgctctaattttcaattactgtgctcacaccaaatggagctcggcggctctccctccactccggggtgtatttgactttacatcacacgacttcctgaacatatagacacagagcgacggttcagccctgctcactcatctgaccaggccgccacggggcgtgagccacagcccagcgtttacacacgggcttactgaaagcaaataggatttggcctcggttgcagacaggccctccttcgggtaagtgcatgtgctgtgatcatgggggcatttcctacagagcccgtgccaccaagatagggccctttgggctgcactgaacttcagcaatagcttgcccgcttccagttcccagagatctacgaatgttcgcttaagacaagggacattttctgtgcaccctcctgccacccggtccagggaaggaaagttctgatttttttccccatcatctcctgcagagactgtgctgcctattaccaagatctgctcactgctctctcaatctccttcctgccttcagttccccatctggaaagtgggcagatttgatccaatgttctcaaaagctcctcctccttagacaccctgtgttccttgaggagcacagggaagcagggagcattctgggttgggagtcaggaaccctgcaatccagtcccaaactttcctcagtcagtgaccttgagcaattcctttccaattcttgagtctcagtatctccaacaacaaaataaagaagaaaatattacttgctcagtcatgtccaactctttgcgaccctatgaatcttagcctaccaggctcctctgtccatgggattctccaggcaagaatactggagtgggtagccattcccttctccagggatgatcgaacctgggtctctcacactgcaggcaaattctttactgtgtgagccaccagaggcttccaactaagccagggggcaaattcaatgatctctgagctttctcgttttgcatgattttctgtgtgtgtatattcgtgtgtgtggagggggtatgtgtaggtgcatataggtg

SEQ ID NO: 34605 - DNA, 1272 bp, Bovine  19866880581634
gaaatggcaacccactccagggttcttgcctggagaatcccagggacggggagcctggtgggctgccgtctgtggggtcgcacagagtcggacacgacctgaatccgcttagcagcagcggcagtgtgtgggacttccctggtggtccagtggttaagaatccaccttacagtgaaggggatgcagctcagtccctggtcagggaactaagatcccacatgccatggagtagctaagcccaggagccgcaactactgaagcccacgcagcacaactcgagtccacgtgctgcaacgaaagagctcacatgacgcaatgaagaccctgcgtgctgcagctaagactcaacacagccacatagataaatacatttcatttttttaaaaaagaatatattaaaaaaagagtaaacttcatttgatttctctgtggctgggaacagatctcgacgagcccacatcctgggactgagcctgtaggtcccagacaggcacgttctgggctcctggagcagaagatgggctcaggcaagcctctgcttcggtttagctcagccagagccatgagtccattggattgtttccttttccttgccctggccctgaacccttgatgagatgtgggaatctgtttccataaaaccaatttatttttccatttatatgattaattgaaatcactaatactctagcctccaggtcataaacactgggtaataaaatcctctctacatctgtccagtgctttagtgttcgctaagcacttttaccaccattatctgatgtgaccctttagaacggtcctgtgagatacacaggaagggattacaatggtcagtttagagcccgagtgttgccaatggttacaggtagccgggagcagagcgggaactgaagctagttcttatattcttaagtttagttctcttgtcaggtaaacagatgagcaggttgacccaggactcaggggcttcacaggatctgggacttttagctttaaaactgagaatgtccaggcaaagctgagaagaattggccaccccatttgaggaccccagggtgtctctcgtgatggaggcctgtcactcccaccaggttcaactgaggaaaatgtcctatcacctggcacaggtgaggcaaacgctgtgcctggaccatgtaccatgatgtggctggagaagagccacctgcggctgacaggtgatctatccgaggcagacctggctgggggtgtgtatgggcaggtggaagagcctgggcatatgagtgatcc

SEQ ID NO: 34606 - DNA, 1489 bp, Bovine  19866880600292
tatactgttgaattttttacagtacgtattactttttacacacagaagaaggtgcttctattgtgaaagatgaagaaagcggagccctaattctgccaggttgctgggttggtcagcccaggggaaacggagcagaatgagacttataattcatgtaactgaagctacctacctcctgcagctcctgaccacagcctgctgtcaatgcgcgttctccaacctggggcatcaacatctttaacacatcaccccaggtcccccaactttattcctgttcatcttctcagttgctaggcaatatgtaattaaattttggaaagcctcttccaccctggatatattatcctggaaattggactttgcatctggcagtcttagaaagcaaaattccactcccctcagcacccccaccctctggcttgcaattgactcacaatttaattaaaaagattccagggacatctggtctccttttctaggagtgcatttgcagttggctttcctggcatgtttttgtttgcaagccgtggatttatttacagaggcagagactcattttcctctcttaggtgtatctttgtggtctttattaacgctgtgttttgtaagctgtgatcattcctctgcgttcctctcctaatggtctgttttcccctgtgtttcgctcagtcactgagagacctgatgccactcagatgcctgccaccctgctgaccctgcccagaggacagggtgcctgttcactgctggggggatccagaacatagcccctacccaccacaccccactacccatccccagcccccatgccccttgccatcaaaagatcaacatcaacatctttggttggcattttctttcctaggcacaaaataaatacagaaagaacttttagagagagagatgcatggcagaggagagtggggaagactgaaccagaagctggctgggtgatttctggcaaccacttcccctttctgagcatctgtaaaataggtagttggacttaactagcacagagtcggacacgactgaagcaacttagcagcagcagcatttccaaaaatcaacttcttttatacgtgcatgatttgctctgtatctgcatacctcctatactattattcatacaatatttttctttaaattgactctcttttttccccttcatgtgtgtatttataatgggaaccttaaatcactatataaaaggtaaaatattatcgttcaccatgaatagaaggtaactgtaaaaatgagtataatgaaaacaaaacagcgcttctagcttgtagctcggtgttgttttcttccaaggctctgtgcccgacacttgttctctcttcgttaaaaaggaaaattggcaaatgtttacttgtaagaggcatgttaataccactttgagactttacctgtagataataccggaaggacgaaagagagcgagaaggaaatcagtgcctgattacaggataataaaaaaagaaca

SEQ ID NO: 34607 - DNA, 1224 bp, Bovine  19866880603618
tgtgagctcgtttctgttttgtagatgttcgtttgtgtcatatttaggtcccacagataagtaacgtcacatggcatctgtccttctctttctgttggaaaagttttcaattagcaatgatcctgcctcagagagaccccactggctatgagactgccactccacaaaacttgcctttctctttctgacttactccacttagtttgaccatctctagttccatccatgttgctgcaaatggcgtttttcattctttttcatggctgagtagtattccactgtgtatacgtaccacatctgctttacccatgcattcagcaatggacatttaggttgttgccatggcatggttcagagctgattttcagtcctacttgttaccctttcagaaccataagcataaaaataaaataaaataaggtgcccaaaatagtaaaaccaagtgcttgtgaaacagtactttcctacatgctagcagtaacataagttgttctgaccctgttgaaaaggaattttccagaaggtaccaaactcacaaaagcatatgtactctgacattctacccatggggttttccaaggagaaaagtggggctaaaaccagttacatacctggcatgggctaggcatgcttacagtcactgtgctactatttctgcacatcaatgttttgacacatacccttactcccatcttatagaagaggaagctagtaaagggctaatgacttatctaaagctgcagcattattacaagggagaaactgcattcaaactccatctgcctgagtccaatcccctgtttcttcctcggtaaaatattgccttgtgaggaggtctatgcatgaacatcttcactgcagcattactcatagtagcaaaatgtgagaaaagaaaaagtggctgataacaggaaaatgtttgggtaaattatgggaaattaaccccatggattattttgcctttttataaatgataattttaaaggttatttagcagtgtcaggaaaagcatatcataaagacgagaattgaacacaaaagtattcctaggtaaccattataactatattaaaatgcatatccatatggaaaaattgttcctgggaacttggaaaatagacgagtttttaaagatattagtaactaaatataatttctcaaaatacccattattgttgtcaagttgtatttcaagacagacacttgtttgggtgggaagaataa

SEQ ID NO: 34608 - DNA, 1971 bp, Bovine  19866880605684
cccaagctgcttgagtgcttaccctcgaactttggtgtgttcagtgctgtgggcttcacaatattctggcagtgttcaggaagcagccagaggaagtggaaacttgagtatttctaagacagtcagtcctcagcccttggtaatttctcctactgagattgtccttggctctgatgcaaagccccagctgaaactggacaggcactgacctgaagcttgagtcctgaggcttagagctgaatatgggcatagttgtgatgaactggctcccttctttcatactggaaggaagtttgtggtcagggtgtaaaatgaaactccatttgaaagatggacagccaggtgcccacccaaaggaacttgttttctaggtggagagacgccaaagaagcagagaaacagtgcccataacagttctaatataggactgtctattgcatggtaagaaatagggacattcttgcccaaatggacttagacagggtaagtgacaatctcatcaataatttgggagcaaggttttgctgtggacaatttgcaatgcaaagcatctgtccttgtataattaagactagactgtccccagttctggtttgtgagttatggaatttgaggcctgtgaacccaataaagaaaaacaacgacatagcctctcctcccagttcagctaatcaacgagaccatcaaaacaatagctttgcctgggacaggtcaagccagtgctgccctgggccttttcagttagccttgcaaatcagccatgtccccatcctctctctgtctgggaagcagggtgagagccagacaaccttccctccacctctctcatgagtttgtctgctgatgactttgaaaagccagccgtagtgagaaggaagggaatttgcttaaagttaagtgtccaatgttttttaaagtaatagaaggctttcttttatatttatttattatttaactatgctgggtcttagttgtggcaaatgggatcatcaatcttcaatgcagcaggcaggatctttacttgcggcctggggactctagttacctgaccagcaaacaaactcagacccctgcattgggtgagcagagactttgccactggatcaccagggaagtgacagaagttttaaaattgaagactatttttaaggttcacgtcttcattttacaggcttccccggtggctcagtggtagaggatacacctgccagtgcaggtgatacagattcgatccctggattgggaagatcccctggaggaggaaagggcaaccccctccagtattcttgcctggagaattccatggacagaggagcctggtgggctatagtccatggggtcgcaatagagtcagacacgacttagccatgaaacaacaacttcatttctacaaagaagaaaaacaaggcttggagtgtgtatgagggatgcagggcagcgggggcagagctggggtggtggagaagaaacacactgtggagaaaacaaagatgaatttcaaaggatcgtgactctgtctctgtaccaattcaatattcgttgaatatttataatagacaagcttgctatgtattcccttttttaaccccgtgacaatatatgaggctattactctgattatcttcattttgcagataggaaaatcaaggcccagagaggttaagtaacttgcccaaggtcacacagctggcagactaagctgagattagaccccaacttgcttgctcttatgcattcacttagctctccagcctcttggttgtgcacatcctggaacctgtagctttttgaaagttacttgttcatagacggagtctggatcctttgttcattttttaaaaatgcgtccattaattcatttgtctataaatattttttgagcatctactatctaccaggttctgtggactccaaataagtaacacccagtttctgccttccaggagctcaggatcagttgataaccctact

SEQ ID NO: 34609 - DNA, 901 bp, Bovine  19866880645483
tgtctggcatggggtcaatacccatcgacttgtgaatgaatgactaaattggtatccaacttatcataaaatctcagcaagcattaaactcgaagggaacgctatccagtccatagtctactctttggcaatatccaggaagatatttgaggtgcaagctcatgacgaccatggatatttcatagaaacatttccagaacctaccgtgcccccacatccatcattcacggtggcatcatcttatcccactggtaacccattttgctttgtttggtcaggcccctcttctttgactttatcacaggcaataccactgcagatgtgtttttgtttctttggggccaataccacgaactctgttaccagagaaaggattgccgtgttggagaatataaacagctctcactctgattgcctgattgcttatgtaaattggtccagtctttctcgaaagcgatgctgaaagatgtgttttcacgggctgcccatcttgggtttcatcacattttttttttttggcgactttaatagtcaagtaatgggacctgaaaggtgctcggttctaaattttatttcctagctggcgggatggtacctgtttctacatggtgatttactgtctccatttcttggtgcaattctgttcatctcctttgaccgcttatcagggggagtcacgtcgtggcccgtccattattttttggggcagtaagcaggcttgggaaggggatatgacaaacataatggatgccactgttgtccttttgatatttatttttattacatggtggtgcaaaaatttccattcttatgtgtctgaacccatccatcagagccctgatgttatctgtttcttcaggagctgggaatttatctcctcatcggccacagggatgcttgt

SEQ ID NO: 34610 - DNA, 962 bp, Bovine  19866880648775
ttttaatggccgagtaatatatatgtatcatatcttctttatccattcctctgattttggacatttaggttgcttccatgcctaggctattgtaaacagcctacatttcttagaaccagcagtagacaggagaaacatacccagctcaagccccactcctgagctgagagtccagctttctggccaagtctcatccaccagcagcaggtgtttgggaaattggaatctcacctcatgcccaacctcggctgtagaattcaactgtgttccgaaatgctgtcatttacccaaactggtacctgtagaacactgttgcatagaatcttaatagctgggaagcaaatacaaatctcttccgggtttaaataaactaagaaatcctgggcaaaccaaagtataaatttgcatggttttcttgcccatagaatttatcagaccctttaatatacaaatatttattccaaaatctaaagcagatagtgcttcccaaacttgttttactacaaaatacttgatgtggggggacacctaataacatttcatagacccagtgagctgtaaaacccattctggaaaatgctactttagatttatttctacagacttgagataagcataggatagattagtatggagatctctagttagaattttctatcagcatgcaagaaaggagagccctccatggaccatcataaattgttcatgtgtctgcaaccatgagagagagagacagagccgaagaaaaagatggtcaaaggtgctaatctgccatgattttgagaaataagggggataatttttatggctactggaaaggaataaattgttgctgctgtgtttacggcactgaggagaaaggttgaagctaaaatattcttgcaaagtcaaaggtcttgggagatgggccaagggaagggaggcttccttgtcaaggatatagtttcctctctccctattta

SEQ ID NO: 34611 - DNA, 1553 bp, Bovine  19866880650542
tgctcaccaaaggttagggctttttaaagtgtgaatcagacagctgggattgggtcttggggctggcctcagagctgatattgtagatgtggaaagctctggactagaagagatggccaaaggacagtggcgatcaggacatcctggtggtccagcagttaaaactgtgctgccagtgcagggggctcaggttcaatccctgatcagagaactaagatcctacatgctgcaaaggaaagccaacttaaaaaaaaaaagttgagatcaattaccttttggataaaaatgtcctatcaaaaatcaacaagtactgaagataaattttaagttagttagctacttccattttcccctgaagaacacaactcaatttagttctataaagtttatgagccaggcacagtggaaaggggagccctgagatggataagactcagttcctgctctggaaggattcacatgttcttggaaggagcagatatataggaaaccaaataaagtgtagtgtgagaagagttatgtgagaggcctgaatcgagagtattgggtataccaaggagggagcaatcgattttatctacaggatttgagaggaaataattggtacactaagatccttcctgaaggattaaatacacatcatcatttttcaaataaattagtgatgaataatgctattcactcccttgtgtctcagatggtaaagaatctgtccacaatgcgggagacccaggtttgatcccttcctgggtcaggaagattccctggagaagggaatgacaactcactccagtattcttgcctggagaattccatggatagaggagcctagtgggctacagtccatggggtcgcaaacagttggacacaactgaatgagtaacacacacacataattatcagttcaaagaccaaaatcctaaccccaaatttctaggtcattatggtaaaaagagtagggaatgaaaaatgtcgttctggaagtctggcattctctagattccaaggcaaacagcttctaagccccatgggtgatctgtgatgtagttaactagggttgaccattataacagaaacgttcttctgtgtttttataagttcacaaagtaaagctagatgttgacataggagaagaaatacattttcatattataataattgaatctcaagtggccactgcaaaaaccagaaagatggagctggcaggaacctcacaggttctgctaatttaagcccctcttctgctttcttgacaaagacatcagaaaggggaaatgattcacaaaaggttgcctagcttggaagagccaggacagggcctcagagttcatcgtgaatcagcaactctagatcctccagtccatacaccaggaactgcatgtatgtacacatttcttgttcagttgctcagctgtgtccaactctttgagaccccatggactgcaacagccaggctacctgcccttcaccatctcctggagtttactcaaactcatgtccatgattaagtgatgctgttcaaccatctcatcttctctcatccccttctcctc

SEQ ID NO: 34612 - DNA, 1877 bp, Bovine  19866880662754
gacttgctgtcctgtctaaggatggcccttagtcctcccgctggacctcaccaactccctcaaagtgactgacttacttattcagcaaacactcatataaagcttattacacgccaggtaggcatgtaggcatttgttgttctttagtcactaagtcatgtccgactctttgcaaccccatggactgtagcccaccaggctcctctgtccatgggatttcccaggcaagaatactggagtgggttgccatttccttcttaagggaatcttcccaatccagggatcaaacccgcatctcctgaatcggcaggtgggttctttaccactgagccatcagggaagccctagtgtgggcatttgacaaatataaactcattgagtctccatggtttctctaagaagtaatagtcgttgttatcctcattttacagatgtggaaactagatacagtgactcagaagtcaagtgactctttcaagtcacactagtaagggcagtcagtgtgggcacctagggagcctggctccaaagtctaagctcataaacactaagctgtgccccatttttgtggtggctttgtggatgtgggtgggtcctaaactgggagattctactaatcctcgactctccgaacccgccttcactcctggactctgcatcagacttcctgtacagcaactcatacctccaatccttttcttgtttagaaggtggggacaaagaccagatctcatgaacccagacaagatggggctgagatgggaaactggggtgacccgaaagcctacacaggatagactccttttcctggagcaagtccagcggtagtcactgctgacagctggtggtaacacagactccacggggccaggacctgctaatgcattttgtcactttgaagagtgcctccaattacatgtactggtcaagggccacggtttgaaatgtgttgcagtgtaccctgctgatctcttttgtaaactcaggtagtgcatgctggtgaaatgtcagagccaaaagggatccctgagagcctggtctgtgaccctctgcccccttcagcccctggaatcctggatgcgggatgggctgcgtgacttggccaggatgcccccagggagcagcaacagtccaggactattcatttaccaggataaactatgtgctgctagtctccttgttactttaaaggcatccttcttagtccctggaaatctatgaaggctcacctagatctttctgatgattttcagaagtggggataagtgtgtactgatcactatataccctttctcacccaccctgtctctttcttaaccacagcttttggaaactcacttgaatgttcacgttctttggacttttagaaccaagactttagctagtaagcagtgagattcccttgagttaacctcagaagcttccatcttcaaaggtttatcatttagtgtcctggttttagcttcaccttgatgtctacaattcgctgtttttcttctgaaattttttttcctctttaaaaggtcaattgaatcttccattcagggtgagagtggaggagaagcttagtagatttttaaaatagtgacatccagcttcagtgtaagagccaggaaataagcattctcatatactgctgacaccaatgcacatcgtcacaatctatatggaaaaatttatctatgctcatcaaaagctttgaaattacctatattactagatgtatgattcccatggctacaaatggtcaaaaagtttcatgtacaagattgcttattacaatattacttctgacaaaaaagctgcaaaaaaaaaaaaaaaccaatcccgaacattcaacagaagaggatttagataaatgaataatggtacattca

SEQ ID NO: 34613 - DNA, 1665 bp, Bovine  19866880693268
acttccaacccttctccctgccctgctgtttttttttcttcccccaagcacttatcactttctaactttgtatccacctttcatggtgtattttgcatatgaccagtttctctcaggagtagggaagctccctgttttgttcattgaggcatcccaaggaccagagcttcagaatacggaggcccttgatatgtattcttgcagagaaagcagaagcttggagggcactgaatgtttataagctgtcttcccatgtctgtgctccatcgcccccaccccatccatgcactttgtcaggagcgcagccagagccaaaggcaccaaaccagctcatccatctgagtcccagaggccaagcgcaaacccacttgcttttaccccacgccattcaccatccttgaaatactacagagtgggtgaagagagctggagagggcatatgagggttgcctgagaaggagggagggtggaggaggagggagcaggtggcaagtattacaggcagcccagccagaatctagagtctgagccactttcgtcatccacagaacctcactggaccctaaacatgaacgggacgaggttcacccagtcggtacccactccgagcagttctagaacctggcattgtccacaggctgtgccattgatcctcctgactacatggggatagtaaaagggctgaaccccagttgccaagtaagctgatggagatggctcagctagtaagagaaaggctggaattcagatctgagccaccaggctccagagcctggctctctccctctatcattgctatttagcacatgcacagcttagaaagagctgagtacttttccaggggacagggaggaagccaaggaatccactggatgacactttgctttctctgcctcgaccctctcctggagccacacgacccaagtctgcagtcgggggaccttgggccccgggcatctctcctgtgatccagccctggagggaaacagcttgcgctcgcgttccctgtgctcaagtcacccccagagccaagaggaatgtttgcccacgtcatacccttccccttaggcgcccacggaggctgtgaagcctgtgatgcgatgttttgtctggctaagctttcggactgattgaaagtcttcagaacctgcgctcctcttggcatcgctcttcctggaaacggttgccatggaacacacagagatgcagccttcactgtcagaactaatgaaagtcggagagctattaggggaaggattttttttttttttctgtgcataattccactcttccagtgaggtgtttgcatttcgcttctgtttgtgagatgttaattgtgtcttcattgtaattccttgcccattgccatcacctcttatgagctccagcccctgaaggctgcctttttgagataatgaagctaagtgaccaggggggagggcatctcagcctctctctggagtgatcttccctaagcacacatctgaccaggccacctggctgcccaaaagccttccgtggttcccaacggcgacccaaggagaccggactcaaggactcacagagccagatcccagctgcattttggaacccaaatccttcctccctccaggaagtcctgggccagtggtacagagggccagctcgcttcctcaggacacattc

SEQ ID NO: 34614 - DNA, 1811 bp, Bovine  19866880721418
ggcacaataaatgaaacatgcttgaatcatcctgcaaccatccccctcccccacccccagtctgcagaaaaattgtcttccgtgagaaaccagtccctggtgtcaaaaaggttggggaccgctgtcttaaagcactgaaccagacaatgtgacccaaatttccccagaaagcaatgctgtaatgcagagagatggaccagaaatgagacagggaggcagtgaggcgtggagaggcgatctttggaagcgtggtggggagcagaggtttggcgtcaattcaatccccacttagtagcaaccttaggctagtagtcactggaccatccccgccccccgccccaccccaaccccacaccccaggcatcagctttcttatccgtaaaactgagctcttattacagctgctgcagggaacctgggagggtggagagggctcagacatgcaggctcagtgagcagggtaatgcctggcaccacagtccagacgtgggaacaagtgaagccgaaaggcatttgggagggagggggaggggggttgcagttgaggaaggcttcctgtagggggtggcttaaggtcagcctcaaggaatatattagtttgggttggaagatgtgaaatgacactagtcattttttaccccaaattgttctctcctctttggcccccatccgtgcctctttggaatggagcgtgaatattaagcacatttttcatacactttgaagaaagccagacagggctggcagtgccccggtgaatctcttacatatttaaagagcatcctgttggtttgagggggaggtggctgcgtctcagtttttctctctcagtagcccccagaacaagctgacatgaacgctttattcctgacccaaaaatgatagcagaggatacaccctgtgatctatgcaccctgcaaaatgttgtatggtttacaaggcattaggaaagctaccgaattcactgtggctctgggatcaagaacaaactgagccagcctttgcccctccctagaacatatcccacgcctcacccccaccccatccagctttccatttgaccctttgttcatgggtatttgaacatctactgtgtaccagggggcttcccaggtggcgctaatggtaaaggacctgcctgctaatgcaggagacacaggctcaatccctgggtcgggaagatcccctggaggaaggcatggcaacccactccagtactcttgcctccagaatcctgtggacagaggagactggcggcctaagtccatggggtcacaaacagtcggacacaactgaagtgacttaacacacatgcgctgtacaccaggcactacactccttcaagacgctacttggatgtcacctcctccaggcagccttccttgatatccacccttgtttcttctgggctcaaagtccctccctcatattccccaaacacctcatgtttgttacatatcttgcctgttgtgtttctctccccggtttcttatttgactgccgactcctcgatttctttcaccaacaaacagtaggagcttaataggtgtttgaaaagcacacagaactggttctgtttcccaagttggcttccccttgcctgattctgaccccttctcgggtgtggaggcgggaaagcagatgtggggacagactctgggcctgaggttctgtgactcctccctgtatgaaagggcagcagggggctccccagctccctttgactgaggtttgtcctccctcccaggtatgtcccacaggatcgggagggtgggctttgtgaaattctgctaaggtctgagcactcatca

SEQ ID NO: 34615 - DNA, 1327 bp, Bovine  19866880722134
acacatggcaggcatagcaagggagccacggtcgaaccctgtgaagcttctccaggtctgtctaggtctccctgaaagtttagcaacaagaagttctctgatcggactcaggctccctgtgaaaaacaaattgatttgccatccagcgatctgctttctttcagcttgggcctcaggcctgaagagcaagcagggagggaaaccctaaagcgggccctggagggtggaattcacgccccacagactgcaaatctcaaagataacaagacaaggagattagaacataaagatccataattagattctaacagggtaatcccactcgtggtacctggaatgcatcccctagcagtgatgatgaaagtcggagatcatcagaccttagcctatgacatgctaccaggcacgggaatcattaactgtgattaaagtgctacctactaagtggtgagtgggaggaaggggccagagcctattactggtgccctcagtctctgcaggtcacagccaggtggatgctcccacctgagctcgtgcacacagacctgtgagattacatagactctcttactgcagacagtcagagggctgctgatgttgccgtctgtctgtctttcgacagaatcttctcttgtcatctcaccatgggtgggagatgatggaacatggggaacgcaaggctggagagaggtcacaggttattcgaagttcaaagtgctccctgccatagtagagatgataaggaatttcccagtagtctattggttaggaccccgcgctttctctacggggtccaatccctggtcggggaacagagatcctgcaagccacacaatgcagccataagtaagtataaaatttaaaaataaatgaaagcttacataaaaatgctaagtagtggtttagtcattaagtcatgtccaactcttgtgaccccatggactgtagcctgccaggctcctctgcccataggattctccaggcaagaatattggagtgggttgccagaagccccaaaatgctaagagatgctagtatttctttgaattctaacaggaacaggaaaccgattcacctggtcttgcatctgacctcttctaaatagatctggacttattacaagcgtgttcaccaacacatactcatttaatcatcggtgtgtctgatatgtgacaggcacagtgctcaatgctatctatgaagtcatataaaagtggacaagatacactcactgacctctaggaaacaacagtctagtggggtcactagcaaggaagtgagtgagaagagctggagaaggaccacccctccggtgagtgtaaatgaa

SEQ ID NO: 34616 - DNA, 1981 bp, Bovine  19866880747568
tttccctatcccttctccaggggatcttccctgacccaggaattgaaccagggtctcctgcattgcaggcggattctttagcagctgagctaccagggaagtccaccatggtttgaagcagaatttcctggctgaactgagtccagctaagtttccactgacctgaatatctttgagaatagatattcattatcatataccactgagatttttgtggttgtttgttacgcctcataactaactgatagacaaggtatcaacaccatgtgcttggacaactctagttcctatttaaaaatctcttttccccctcaatttattaaaaataaaaatcattaagcactcacaacatgtccattctcaaatttggtgtgatgtgtttataagtttgggttactgtttttgaggagctcggcatgggggaggtaaaaagatgatcacaaaatatgatgtcaaggaacgcttcctttgggtagggagtaatgatctctgagtgaagtcttgggggaggaaaaagaagggaaggatgctcaatgcagaaaggagcgaagcaagcttgttcgttggtggaacacaagccctctttgtgctggggctgttacccttagcatagacaggcagcccgagtgcaggtttgattgtggcattttacaagtccctgaccaaatgtttatacgaaaaaaaaaaaaaaaagacatcaatgacagcaatttattaccagatgatgaagttcagggaaactctattaaataaaaaagtggcacaagagatgataaaactcaaagaaactcaaaggggataaaagactcagggtagcgttgcggatgcaataaacaacagcataatctaggaaagccagcggcgcagaggtaattacacgctgacacctgctcctgggaagtcgggctggggtccaggcggctgctgacacgggagtgcccagcactgccctcaccccaccttacccaaagcttgcctttcccctgggcttctcccggtgtccctttccctaggatttttctcagtggcgcttgcttcctgccggggcgggaggtggctggggtcggcggggagggaaggtgggcagcctttcggaccccacgcaataaacacggcctctccctcgagcccatcccctgcttccaatgctccccctccctccagcccaagtgtgtgtgatttccgagttaatctgtctgcactaattaaatattgacggctgttaaatattcatggggcgttttagctggcaggtttgatgtctccaggccctgctggctgcagctccgctgacgggccattttgactgggcactttgcgctcctgaccgcccctctgtcatccagctgttcccagcttctctgggcgaccccacctgctagggatggctcagaccccacacagacacgcccatgagcctgctcctgtgggaggtggtgccggcagctttggccctgggggcttgtcccgtgtcacagaaggactctggcctggggtgtgtgtgtgtggacagggaaggggtggaacccaggggtcgctgagaggccaggtggtctgtcctccagtggggactcctggaagtccttccttccattgactcttgctggcagctctggttctgggctgcatggggtgtgctggggagagcggtggccaaggacagcctttcggatccctgcgggaggtcagactgagtggcgtggtcctgcaaagggcggttgtgatccccagggagagtgtcgtggagctgaggagtctcaggagacgccagtcagactggggagggggaggtcagggcaggctttgaaggctgagaccacagacagaattctgggagacaagcaggaaccagaccagctgggaggagagggttattgtggaaggtctcccatcaggggaagggcacagacagtgagggcccgggcaagtgcgagagagaggagccctgtgagtgggcatggaggcgttctggaggctgggt

SEQ ID NO: 34617 - DNA, 3365 bp, Bovine  19866880776003
cattatgtcttttgggtaagactttaatcaaatcgcttatgattatacagtagaaatgacaaacggattcaagggattagatctgatagacagagtgcctgaaaaactatggatggaggttagtggcattgtacaggatggacattgtaccatccccaagggaaaaaaatgcaggaaagcaaaatagttgtttgaggaggctttacatactactgagaaaaggagggaagcaaaaaggcaaaggagaaaaggaaagatatacccacctgaatgcaaagttccaaagaataacaaggagagataagaaagccttcctcagtgatcagtgcaaagaaatagaagaaaacaatagaatgggaaagactagagatctcttcaagaaaattagagataccaaaggaacattccatgcaaagatgagctcaataaaggacagaaatggtatggacctaacagaagcagaagacattaagaagaggtggcaagaatacacagaagaactgtataaaaaagactttaatgacccagataaccacaatggtgtgatcactcacctagagccagacattctggaatgtgaagtcaagtgggcctcaggagatatcactatcaatgaaactagtggaggtgatagaatttcagctgagctatttataaaactaaaagatgatgctgtgaaagtgctgcactcaatatgccagaaaatttggaaaactcagcagtggccacaggacaggaaaaggtcagttttcattccaattctaaggaaaggcgatgtcaaagactgttcaaattattgcacaattgcactcatttcatatgctaacaaaataacgctcaaaattctccaagtcaggtttcaacagtacatgagctgagaactttcagatgttcaagctggatttagaaaaggcagaagaaccagaaatcaaattgcccacattgctgaatcataggcaaagcaatagaattccagtaatacatctacttctgcttcattgactatgctaaagcctttgactgtgtggatcacagtaaactgtggaaaattcttaaagagatgggaatacaagccaccttacctgccttctgaaaaatctgtatgccagacaagaagcaacacttagaactggacatggaacaatggactgttttcaaattgggaaaggaatattgttgactgcttgtttaacttaaatgcagagtagatcatgtgaaatgccaggctggatgaagcacaagctggaatcaagactgcatggaaaactatcagtaacctcagatatgcagatgacaccattcttgtgaaagaaagtgaagaggaacaaaagagcctcttgatgaaggttaaagaggagagtgaaaaagctggtttagaactcaatattcaaaaaactaagatcatggcatctggtcccatcacttcatggcagatacatggggaaacaatggaaacagagacagacttaattttcttgggcaccaaaatcactgcagatggtgactgcagccatgtagttaaaagatgcttggtccttggaagaaaagctatgataaaccttgacagtctgttaaggagagacattactttgccaacaaagttctgtctagtcagtgctatggtttttccattagtcatgtatggatgtgagagttggaccataaagaaggctgagcactgaagaattgatgcttttgaactgtggtgttgaaggagactcttgagagtcccttgaactgcaaagagatccaaccagtcaatcctaaaggaaatcagtcctgaatatgcattggaaggactgatgctgaagctgaagctccagtagtctggccacctgatgcaaagaactcactcattggaaaagaccctgatgctgggaaagattgaaggcaggaggagaaggggatgacagaggatgagatggttggatggcatcactgactcaatcaatggacatgagtttgagcaagctctggaagatgttgaaggacagggaggcctggcgtgctgcagtccatggggtcacaaagagtgggacacgactgagcgactgaacaacaatgggataactcaggagcttgaacctatgcaaaaccaagagtttgtccaaacaagccttctgggagctgatgtaccaatattagcaagacccgtggcctcctcctcagacagcttctgggttgtcaatggagacagataaagcctcttctgattggatttccaaagcagcctgtccgttccagtgacctcattagtttattcatcagtttgggattttttttgtgtgtgtgatgacccagggacttccattatgcaagcgttttgatcaagatactattttgccttcaccaagtttcttgcctgctcagtggctgcagggtcagatgtgagagtgattcttcacctgctatctgtccacatcctcagcggtccctgccctcctccagtaccctgcgtgtttgccgggaggttgagtggttcccatacgctggctgggtcagaggccgcctcctgggagacgcatgcaggatcagtgcctctcattcagcccgcggatatttagctcattaaacagcaatagattcaaacagaaaaatgaaacggcgcacatccttagcgctaaagacgtttcgtccctttgtcttagttcaatttttctgaagggaaatgtgaggagctccgcataccgagaggctgaaggcatccaggcagagagatgagaggagattggctccaagcaatatcctgcctagcaggaagtgagtggtgatgaatccatatttctccataataagctgagccatgggggcagagcaccccttccccagtgcagggagagagtgtcaggcagggctggctgtgcctgtgggggatgtggtcacagtccctgctcgtctcaggggcagcagctgtcctgccaacttggttcctccaagccgtttcccttcatgtcttccagccttgggagggcacctgtgggttgccacctcaaagtggcctaagagctgggaagtgaccttcccatggtgaatggagcgtttcatcttttttttaaagatttttttgtttaatgtggaccatgttttaaagtctttattgaatttgttacaatattgcttctgttttatgctctggttttttcacctcctggcatgtggggtcttagctcctccaccagggatgaaacctgcgccccccgcggtggaaggcgagtcttaatcccttggctgccagggaagtatcaagcctctattctttagagcagtaaggatgttagatggcaccgagttcatttaggccttggtttgtggttagattccttttggattaatttttattggtgcagagtgctttccaatattac

SEQ ID NO: 34618 - DNA, 828 bp, Bovine  19866880778584
caggcaaaaatactggagtgggttgccatgccctcctcctccagagggtcttcccccacccagggatccaacctgcgtctcttgtgtctcctgcattggcaggcagcttctttaccactagcgccacttgggaagccccatttgtaagcttgtttataaatgtagaaaccaattcttagtgaagtggattaacttctggaaggccactaggctggcaaggagaagagctggggtggaaaattcagcaggtctgattctaatgcctacttcccagaaactgacagctctgtgccccgaagagaacctcataatggtcctggaacctgaatatttaatgttgtcgctctggcttttcttccttttaattgaggcctttaccaaaatgacattttccctctcctccacatatggtcccgggctccctaatgatgtgtttgttccaggcagggcacggaatctttttgttctgaccaccgtcccccgtgaaggcagctgggccccccatgtgggaggatgtggggagcagagatcatcaacccaaagccgaaagcagaggcatgggggagcaggaggaaggccctgtgtgtgccaaacccggcgaccccaggacagaggaaagacccagaagggatgctgtgacaagcacagagtgccagttcgccttcaaatctcagccatgttttccaggcccagcagctgatacgttcagtccagaaaaaaaaaaaaaaaaaatgagagtgagggtgattatggctgaaacagatcaaaggcacctttaagactccacttcttccttctgtaggaagaaagcaaagggggaggagtgtg

SEQ ID NO: 34619 - DNA, 3156 bp, Bovine  19866880825508
gggagggggagaaagacgagggggcattacccccagcctctctccttgaacctgatggtgtgagatagtggaaggaactggagctttagcgggtacccttaggagaaacaaaagcagagaggccatgggagggagaagagtaccctggcacccagaaaagggcagaaagtcagagcgaagtacggaagaaggtgatgacaagccagcaggagctgtgctgataggatgacaatgacgggagcagtgggcagagcaggtaagtggggtggcagggtcggagaaggctccttgtggacttgttaggagccttggaagatggggggaggtgtgacacccaggcagcagaggatcagtgttcccgggggagagctctgcttgaaaatggcgctgaggatggagcccacggcccctgaaccgtggctttagccggctggtgtggaggagggctgccttgaatggcagacggagatgaggtggaaaaaaaaacccataaaaagtacctgcctggggtggccacaaccccggcaacctctgctttcacatcagcaacatggggagaacaatccctgctccgtggtgatgccgggagtattggaagatatatacaaagtaggtcaagggccaggcccgctgctcggcatcaaagaaacgctctgtgaagggccactgcgtgtgctattcacccaaaggggcagaaagtgaatagccctcatgtatactaagtggggattaagaggagcttcagggcccctctcagatgcctcttctttccggagagtcaggcagggattctccgggcaacacacgtggcttgggcttccctccttgccatagcttgtagcctagacgagcctggggcctggaatggggggcaggccagctgggggcgggcctcctgcctgtccctgtgtgtgtggtttgtgttgcacacacgccacggggaccacctgtgcttgtgtattcatgctcgtgtgtatcagtgtgtaccctctaaagcctggaagacgacaaacagagaagaggtgaaattaaagcagaggtgtaattgtcgttgatcgatctgcttaatggcctggaaatgcccaattagagccgtgtgtgtggctggctgctgacccggagggctgaggggacgcctcactcttatccaggcgccccatggccagccagggtgtgttgccatggacccccttcctgattctgcccctgctggatttctggcgccggggccaggcgtgcccctgccacatcctgcagccagtagagcccttgcagtttcacctctgggctcgacgagacatcactcaccacagcggatcatgaagtgctctacttctgactgccccgccggcgcctttttgcccacgactgaaggtggggcggggtataatgttaccaggatgagcctggggcgagtggctccctctagtggcagccacatgcaggggcgggaaccagacttgagaatccgacccatcgctgcttgtttcccctgctctcccagctgtgtgactttgtgcagttcactcagtctctctgagcagaggctgcgctatgaaaagatctaaccacttcctgcctgctccactgctttattttggccagagccagcatcatcgccagcctgcgttgaaagatggctataccattgttcactgcggtatccccattgcctccaggagtccctagtgcataggagaagctcagtactatcaatatatactgaataaagaagtgaatagcatgagacagggcactcagggcctgtgcactgggacgaccctgaggcatggtatggggagggaggtgggagggggattcaggatgggggacacatgtatactcatggctgattcatgtcaatgtatggcaaaaaccactacaatattgtaaagtaattagcttccaattaaaatgcataaattcattttataaaaagtgaatagcaagccaggtgacttcttggggtctcaaatctgcaaaagccttatgggaatgagggattttctacaccaggtttgcccagtgaacccaaagtgaacatcctaccatatgggcagcctgcattgcacagctccaggggtcctatttacgagaatacaatgggccctgtgcctctgagactgcaatgtgggggactaaccagacgtctgcagaatggagaattctccatttctacgcgtaagtgtattcttgattcgtttacacaactgtgatctgtgtcaactattcagtacagatgtgcacttttaggggaaggcgtgtttgaaggaatttcatctttagacactgtgaaactgtatcattgaatttcttttaagaacacattcacgataaaaactcccataaaaatagaaatagagggaagtttccttaacatgataaagagcatgtaatataaaatctgcatctaacatgcttattggtaaaagactgaatgcttccccgtaacatctagaacaaagcaaggacgtccacggtcactacccttatgcaacatgtgctataagtcgccagtgttacaaggcaaggcaaggaaacaaaaggcacacagatgaggaaggaagaagtataattgcccttatttgcaactgacatgaatgtttacatatttccaaggaatctacaaaaaacctcctaggactaaaaagtgagtacagcaatgttgcaggatacaagatcaatatacaaaaaatcaactgtatttctatagagtagcaataaatctgtggacactgaaattaaacataaagtacatttacaattgttcagaaatgaagtattatattcaaaatatgtatagggcttgtatgtttaaaactacctgtgctgaagaaagaaatcaaagaagatctaagtaaatggagagacatagtatgcccaggaattagaagattcaatatatcagttcttcccaaactaacatacaatttctatccaaattaaaacaagatgttttttgaaagtatagatatgatcatccgtaaatgaaaaggcaaggggacagttttgaaaagaagaataaagtggcagagatcaatctacttgatttcaagacattatatgtgtgtgtgctcagccatgtccaactctttgcaaccccatggactgctgtccctcaggctcctctgtccatgggatttcccaggcaagaat

SEQ ID NO: 34620 - DNA, 1184 bp, Bovine  19866880870776
ttgtgtctgactatgacctattgacagtaccccgccgggctcctttgtccatgggattctccaggcaagaatattagagtgggttgccatgccctcctccagggtatcttcctgccccagggatcgaacctgggtctcctgtgtttcctgcatcggcaggcgggtttctttaccactagcgcctgtgaccatcatcctttgcttccaagtcagtctgacctcccgccttgtccatcccctccatcagtcttttcacagtcaaacagaatccaaatggctgtcaggggagccctaaagttaaagactcacttcagtaggctttctattagcatgtcttggttcaggcgggtgttatgaactgttcccactggcttgtgccaaattggtcaatcaatcaccactcaggtaccgagcaccctctataataagccctagtatttgtaaaactttgtagctaacaaagcacttttatatagcctctcgtgggactgtgcaaccaacctctgaattgacagggcaggtctccagatattaaattcccatttcatttcaacttctggaactttgtaaccaaaggtcttcactaagacggctccctcttgctcttctttttggcctgggaaacttccacctgagcttccagaatcatctttaaataacaataccttccccaaccctcaggcggaggtaatcaatccactcttcttcctctgtgttccttgggtcatgtgccttttttttagttgttttgctgtaatgtgtagctgtacaccacatgaaatgtatagggtacttataagcatctatctccctaatagataatattctccttgagggaaaggaatgtatctcatttgtcttagggtcccaatgcctgatatatcctcccacatataataagcagtcaataaatgaagggccatatggatattttgaaagctggaggtcacaaagtgggggactgcgcctattttgctaaggaatatggacctcagactgtaggcataacggatccaagggagtcttgatttatatcacaaaaggcagatggcaggctcatttcatagaatttatttccctgaaagttgatgaggtctgatttatgtcttcccttgaaggtcaggttatggactgttcaactcactccttctctctaacaagggctttcatggggatggtgggga

SEQ ID NO: 34621 - DNA, 1494 bp, Bovine  19866880888088
gttctgccctgaacgtgctgtgccacttgaaggtctccttgttcctctcctcctgtctcatctagacctgggcaggatcgccaccaatccttggacattatgccaaggtcaccccatggttttctgaggattgttctttgagatacgcctcccatgggttccctgtcctcttgggttaaactcccaagggctgtcccattggtatgaatttccttatagtgaatatctattaaagactgctaatgaattaggagctgtatagtcattgaagttaataccatcgtacccaagacaaactgaatttgccagattatcagatggctggcttggctggaaggaaccatggaggtatccagcccagggatggtgcaggtggcggactctcttggcttcccacccaacacccggtttctacttgtcttcaacacagttctaatgtttttgcagagaagtaatggatccaggcaaaatgcttactcttccaagctcccactcagctagtgtctccatgtcacacaattttgtttaatgagatgtcaacagaggtctgcaaggtattcctggaaaatgttctgctttaccaatatgggtatgctccctgcccctattctttttccttcttcttcttcttttttttttccttgcttaaaaataaaggtgggatgtgtgagaaggagcagtcatcttgcaatgagctatggagacaaaaaaataacaatcacagcactttggtgaaacattcccagccatccacagatgtgcccgaggcagacatcacaaatcaatcacagcactgttcctaatgagcccagacagggctgcctcagaatctcattcgaccagagcatcaaggagccactaccaattgatcacagttggcctctgtgtgaaatccattagccatatctaacctaacttaaactttccttttacccatcattttgaataaaaatgagcctgcagagaaaaaaagagagcttctgagagagatgctccctgagagcactgcttcaaggaggtaaggggggacctcggatatgtaggagttttgcagcaaagggcaggaagtccaggacataaaaataattagtgttgaccaaagaaagccaggtgagtcaagttaaagaatttagcacttttctgtgtatgggaagacgcaagagtctgggctcactgaaatcattcctctgatacacacctcagccatcaggaccagaatcctgtgttttcacatcctgagtcccctcagggctcaccatggggagtggctgcagtctgatagctgctagatggcaggtattctttccttcctgagttccctcagggctcaccagctcaccatctacggtggctgcaactgctgatgactctgacacctttgtttacggatatggcaggaagcattccatttctcacaagtgtcatggccagaactggagccagttccctcactcctgataggcctgatgcagtggcaggaatgtgagtttgggg

SEQ ID NO: 34622 - DNA, 732 bp, Bovine  19866880938378
cttcccatgtgatgtttaattgctctagcaatctgttccgtttctcccttgcagtgaatggaggagcagcagccacagcctgtggtgaaaggctgcgtttagagatgggaacagcttttaagacggggaaggaggcttctgtagggctctgaacacagtgcagccagggctttatttttagaggtctgcttggagcctctgccccctgttcagtgcctgcctgttgctggaacaggctctgaaatgacaggaccaccctttttattctgaacgacacagtaggaagggccctgggcttgaagtcaggcagacttagagtgcaatcctggctctgtcacttaaatactttgtgattacaagaaagtcaggaagcgccacatgctactgtaaggggtgggggggggcagggtgaagatgaagtgagaggacttgaatgcatgacacacgataagcacttagtgtgggccggtcacatagtaggtcctcaatacaaagggtctgttggaaagtccctgggtttattaactgcatgaccttgtttttcacatctgtaaaatggacctataacagcttctgctttcagaaccagtttcacaatttacaagtctcagggcacaatgaaaatgtgaggttctctattcaaaaatcagtaaaaatttcaacacagtgagagcatagcattaaacaaggcaggggacccttctaatccagggacctgcgcgactatacagg

SEQ ID NO: 34623 - DNA, 1587 bp, Bovine  19866880992556
tgagaggatggggagggataaattggaagactgggatcaacatacgcacactgctatctataaaatagataattattaaggacctactgtgtagcacgggagactctcctcagtactctgtaatgggcacttccctggtagtccagtgattaaggctccatgctcccatgcaggcggcctgggtctgatccctggtcagggagctggatcccacatgccgcaactaaaggtcctgtgtgttacaactaagacccatcacaaccaaaacaaacaaacaaaaacactctgtaatggcctatatggagaaaaaatgtttaaaaagagtggataatgcatatgtctaactgactcactttgctgtacaactgaaacaatttagcattgtaaatcagctatactccaataaaattttttttagaaaaaagaagggtacatttcccagggcacagagtttcagggttccactgagaccctgctccaagccccagctccttcccactgtgatctgtctgctcaggaagcaggctgatgatgtctacggaacccacagcccagggcaggtttgcccacagcagacagcggagagggctggtggccaggctgtccaatcccttttgtaaggagcactgctggtttgctgccgaaatgagctctctgtgtaattgctgaaaaccggagatgtgatgacctttaagcagagcccacagcacattcctgaagacggttgcctccaccgccaacggagcacacagacaaacaagtgaataagcaaacaaaccaatgcctgttgggatgccaggtgctggatgcgtgttaattgcatgaacagtctcatccgcctgctggctttgatttgtgctttggggtgttccatcaagattttttaaacacaaattgatctctgttaattcatgcgtcagcgctgaatattttgacatgcgatatctcctccctttggaaaagctgtgcacgctggcaggccaatggagctcagataatctccccgctttcttctctgcaatgttccctgagcccagaattcctgcctggacttctcctctcgagattcttcctacactccttagcctgtttttctcagctgcttattcctctttctgccccaactgtcttgcctgcttcaagttttttttcttttctctagctttggggcgcaggcttagtcgcccggtgacacgtggggtcttagttcctgcgtcccctgtactagcaggttgatcttaaccattagactgccagagaagtcccttgccctcttcaatttttgttccaagagctagttctttctcctacctcctcagcccaaatccgttcatccctctcatcccttccctgctccagtttcctctctcctgcatcaataaaacccacatcgtgtctccacactctgctaccccctccgccttgcagtcctgtgcccctctcctcagctgccaccttctagcgttacctctgcttcttctgctcctgtgcaatttcctcttcttttaacttctctctctctccctggcctctatgctcctgctcagccagcctgtgggtaagagatgctcccactcagagcgctcg

SEQ ID NO: 34624 - DNA, 861 bp, Bovine  19866881062788
aagtgacttcgcacgcatgcacataccactccttgtagtcattattttacatccatgagaccatccaagcttacaaacagggaggcagggattactattgtattccacttttcagatgaaaaaaacgaagcttggaggtgagttaacacaacctgaaaataataaagcagagtcactgatgctgaatttggtgtgcctgtgggtgttacctttcaaaatggaagaaagagaaattcaaaggaataaagccgcaatggtagaatccattattctctggcatcagaagaggagatattttcggttgagagaacccccttgggcacaggtgtgtatggccccctccacctccacggggctgatgctgaaccctgagcattatcagcaggactggagactctcctccacacctcaaatcaagagcatccccttcttttcctttgcaatcctgatcgatgccacttagtgaaattatatctttcagcaaatgtgttttcagaacctatactgtctagttagtagctgtggttgactcaaacaggagccctgcttccggtcctgttggagtgtgaaggtgctgtgttgcatgaaccttgcttcacacacattcgcttccagctatgaatttactcttttaataatgcatggatgctatctcatttacatatgcaactaggaacgtttttctgtcagtagccattaaccacagcttcacagggggagatgtctggggtcccagaaatactggaaggagttttggagcagatgacaaccaactcccacaggcattcctggagacgagcctagatcttcagggaataaaggaaatattcccctgctcctttgagatgtttccttgctcct

SEQ ID NO: 34625 - DNA, 523 bp, Bovine  19866881085926
cacacatgcgcacacacagcctttacacatccttctgcatcttgggctttgacccctctgagcccacagggaaacccacagaagatgtgtgccaagtgggcagatctccagaagggccatcatcacgtggcaagccagccctgcatgctgcacagggacagacctcaaagcgagggacagcccacttcaccctggagctcacctgcccagcagaaaccctgagggtgagccctcggccacgtggttttacacacacaggtaccaggctcgcccagttgctcacagctatctcatgcctactttggggagtgtgacagattgaatgaagatggttccagctaagagagtcctataattatcaactgcggattattttaattaaaaagctttgcatcctcagctcttaatttctaaaatgattataaatgttattattaaagaaaaatccttgaagtgagatccataaatctcagcccaggctgagatgggtgagctggcacagcagaggaggccccgtgcaggg

SEQ ID NO: 34626 - DNA, 2449 bp, Bovine  19866881128921
cagtatgggagcacccagccccaagcactgttgacattcgaggctagatcgtatttgactgtggggatctgtcctgtgcattatatgatgtttagcagcattcctggatctaaccagtgggtatcattagcacccatcccaagttgcaataacccaaagccctccagaccttgtcaaatgttccctaaggcaagttcaccccagtcaggaaccactgacatagggggtcctcagtaaatggtccctgtcatctcaatccaaaaaccacacaaaatgccataaagaaggcttatccattttcatgcccagccccctcttcctgttgcctcatgggaaattggcagcaatgatacccacaagatctctcggtgaccctcttgagactgggaggtgccttggtggcaaagctcagatacctccctgctctcctgctgcttttttggccccatttctggtctcagaagtccaaacacaatcagaacaggtgccagcctggctcaccgggactctcgctgattgaaaactttcctgggcatttttggctgttggaacattccatttcacattgatttattattatatttttaaagatgttgagatttaagactcatcaaggagtctgtgcttgccaagacataattaggagaaaatgacagaggtagtaaatatataattaactcttttcctaatgccttttgctggcattcttcatctagccacacagcctgagaaactagttctctggaatctccaggcaactagaaaccaattaccatcgtgtttgcatattgtgtttttgagtaacgtgtacacatgtttgtgtgtgggaagtgaagtggggaaccacaaagacaaacatggacacacacgtagtcttaggtcctaattggcttttggttgattgattgatttgttcattaattgattcattccttgagtcaacaaagatttagcatttgcctattgtgtgtcaggcaccatgctatttccatcctgccaaaatctgtcctttactgtaagccatcaagtttccacatatctagacacaaagtacatatgcatgtgatgtcgggtggagttctacacattacgtacatatgtaatggggttcagagagatcaagtaacttgtcaaaagtcacatagctattaagtaataaaagtggtatttgatccaggtctgtctgattttcactaccctatacaaccttctttcaaaaaatacttgcccaaagaggtgatatttgagctgactttgagaggtaagtataggtatttactggataaacatggaaggaaacagtttatccaaaggctggtggggtgatgatttaggaattccaagaatgaagtaaatagggagatgactaggtgttttgagaggaactggaggagacaagctgggcagggctcaactcaaggagggtcttgtattgccaggcctctcacacagtccacagcagtttgggtcatacctgacctgaatgtgagcgccttccttcagcaccctggacagctcccatcagagcctctgcctccagccaggcccaacaggacaagttacaaggtgacccccaggcccattaagaaaccaggcagcacttgatatcacccagtgactgtccccagccttctcttgcccaggaagcaggggaccagttaattgcagggtgatcgccatgttcttgcggagcatttaatgtagcatgtaattgcagggtaaataaatacagagctatttccagctctcagcccagtgctgtgagcatggttgtaattacggctgaggattggcttggtgcaatttctaagcaatggctccaggcctgaactgggtcagccctcatgcaggccctatctgctcccaggagaaccagggtgctgatctagccaagcttctcctttgctcaggtgaccagggccttgatcggctgctctggactcctcaggactctaacccgcccttgcatcttggggtccctcagccttctgattggtgctaactctgggtttgtatcaaagttctgccacttactggctatgtgactatggacaatttgttgcacccttctgagccacacttttcatctgtaaaaagtagataaaattaatatatattgtgggacttccctggtggtccagtggttaagaatttgccttgcagtgtaggggaggtgggtttgatccctggttggggaactaagaaagatcccacatgcctcagggcaactaagcccatgctccacagctggagaccctgtgtgctgccactgctaagtccgcatgctcaggggcccatgagccacaactagagagaagcctgtgaactgcaacaaagatctggtgtgtcacaactaagacccgatacagtcaaataaataaatattaaaatgatgataataatacatgttgtgaagttggaaggattcaatgagataatgcatgtaaaa

SEQ ID NO: 34627 - DNA, 581 bp, Bovine  19866881207582
ctacttctgactttaatgaggccagtttttagcaaaatgaatgcagaagtcatccaggaatcaaccagtgagcagatctcctgagatgcattacttcagcaaatgagttagcatctcttggtgccgggtttccttgctgcagaatcagaatcgtgtctacctgtgcgtacaatgtccttaacaaatattatttccccaccaccccaccccttcccggtgctttcctgttttgcttggcagacccccaagctgtgtgtcacatgtgataacgccatggacctgggactagagcctggtctgccttcctgggctctctgcatcccacccagctgctgcccggaatgccctggggagggggaattggaaatacgtacttgaagtgctgacattgttatttctgctcttttatacaagcatgaggcaagttggctctgcagaatgttgtataaatacccagataagaagattagtgagaaaaccctgagagcatcatagcttctaaagcctgctttcaggccgggaagcggatggtggcacagtgccagcctctgtaggttacatgttctaacatgcctctttca

SEQ ID NO: 34628 - DNA, 2931 bp, Bovine  19866881282932
caacagatagcaagtaatgttgactttaaatgtctaacagttataaaatgtttcctttcaaagtgaatttaagttaaaaaattgagttatctcgaagaaaatcaccaagcaaatgaaagaatggtgttacgaagacttgtgaaaatcacaaagatagaatcccagaactgggaatgtactttagctgaaagacacacggtgtagcagtgagaattctagacccttcagaccaggtgatggggaaagtgtctggttcccagactttcttaacatgccctccagtctcagctctgagggtgagtttcacgtatccttaggatgaatgccacctatttccccctgtctatttagtcattcagcaagtagatatgttaaaaaaaaaaaaaaagactaaaagacccaaatttgctgagcagagagtcccatccagcaccaagtctgagctctgggaggtgaggttaggaagagaggagatggggttggcaggcaaagtctctggcattacaggttgcccagagagttctgagttcatcaatcaggtgagaccaagtctgagtggaggtgagctctgggtgacagtggtcagctgcttctgatgtacatgtgacccgtctgagtcagagcattgcaccgagacaggtctacaccagtgctggaggccagacagtgaggtcaccggtgtgacttattcaaatgatgtcatagagagaccacaagaataggagtcaggagccctgaactctgacttcagttctgatttctgttaattttaagaccttgggcaagtcactttatacccccagacctcaactttctcatttgcagaagggcagggatgggtactacctcttagctcattgggctatcgtgagcattagaagtgagatttaaataaacaacaaggacttactggatagcacaggaaactgttttcaatatcttgtgataatctgtaacagaaaagaatctgaaaaagaatatatatatatatcccaattattttgccatacacctgaaatgaacacaatagtgtcaatcaaccataggtcagtggttaagaatcctgcaaaagcagggggtacagatttgatccctagtctggaaactaagatcccacatgtgcagggcagctaagcctgcacaacaagtactgagcccatgctctagagccccaactactgaaacctgtgagccctacagcccatgtttcacatcaagagaagctatttcaatgagacgcctgtgcaccacacctagagaataggctgcaactagagaaagcccttgtgcagcaatgaagacccagtgcagccaaataagtaaataaataataaaattattaaaaagaataacaagcaaacaaaaaaaagttatccctgagcttcgccagggtaggaaccatgcctgcttaatgagctcatgtagacccagtgtctgtccctggtggctcagacagtaaagaatctgcctgcagtgcaggagacatgggttcagtctctgggctgggaagatacgctggagaagaaaatggcaacccactccaatattcttgcctggagagttctatggacagaggctatagtccatggagttgcaaagagccggacatgactgagccactaacagcatctgttagttctaatcctgttaagttctaatcatcttcatgaattaatatgtaagctgtcgagcagaaatgtcctacccattgaagggtcttgaaaatggtaggtctgatgatgcaatcattctctctagcaccagccattttctgcattgaggatgaatccatggcagaacaacaaatgaaggaagccagttgagttaagtggttccccatggattccaagagactcaaatatggacagatgcctgggtcccagttctgaggtgctgcaaagcacctgtgtcctgagctcctccaagctccagctttgccagtttgcccctgagttaagaagagcagaaatgttctgggctgaatctctgaccatgaagcagagagaaatggcaactggcaagagagaaaggtcaaacagtttattattctctggaaacctgcccaaggacctgtactagaggcaaaagctacaggaaaacatgtggactttcccagttacaatgactaagctgctcttgcttttctgcagcatctgtgggcttgaaagagacccatttgttctccagaaaaacagaccccagacacattcctgccttctgagctccagccacccacgagggtggaccaagtggactgcattttgcaagctgctttggagcagaaaggataaatagcttctttctttgaaatgtctcctgtgttcatttaatagaacatgattaagcatcttcttggtctaggtgaatagggatccaggatctcagagataaatgagggagacaggtgagatcaataatgcaatagcgtacatgaacccttgtgtggcgtgaacagcgatgctgtagaaatgtagaagaaaggcctcttttccagccttggcttccaggaggaaagagcctctgagctgggttttgcaggatgagtgatgtccaaaactcagcctctgtacacccacactgaatggaatcttgaagacagagtttggggcaaagtagaaaagaatagctttattgctttgcctggaaaagagggacacagtgcacttatacccctcaaaactgtgagtcccagcctggagggattttgtgaggagttttatagcaatggctcaagggaagggttgctagtaagtagcagggtgtgttgaagcctctactcctttcatctggcctcaggtgttctcttgaagagtttctctagtccctttagtctggaatgaagaatgctagatcttcagtttgttgtgggtattacttttctggggctcagaggtaaagattccggctgcaatgcaggagatcgggttctat

SEQ ID NO: 34629 - DNA, 1380 bp, Bovine  19866881365188
tctgcagaccccagatgtgtctgatctactgtctccccggatgtccaggcagacccagggattccacttactaactaatgaatcacctttcgtctcctggactgggcttcctcatctaccaaatgatcagtttgtactaaatgatttgtgattccttgctgatctgatctgaccatctaagctaatttcagagtagcaggaggagggagatgtttttggctggattttttttttttaatttttgaaataacctgtcttctctcttcccaggagaggagcagtaactatacagatagacaaagcacaaaagaacctacaaagcctgtaaaatgaaatcacatggcaaaacgtggtcattctgaggaaaagaatgaaacagtcccacgggaagttttctgagagttttcactcaactgtcaatcagaggtacagcctggcatcctttcagaagagctgctctattcaacctaataatctgagcagacagtttgaactcagcccagtgatatcccatggcctgcgtccagatgtccaggatgggcctccctcccacctgtgtgcaccccatcaatcaccaggtcacactgatttcgtctctggaataactgcaatcaccatctgatatccagtacctttatccaaagtcttattaactctttcctggatgagtgtggtagcttcccaaggactcaaggtacatacaagtcaccttcctcaatgttagtagagcagtatttttcaaacacaaatgtgatcatgacactcgtgtattagccatcttaaatatgtattagaaggccagtcacagtctgtccaagcctacatatccacattcacctctctctcaatccattcccttatgcctcagctacactggaccactcatgcttctcagacatgggatgcgtcccatgctctctcatctttttccctcacgcccagaatgctccctaacatctctgccacccctggactctgctgcctggagaactcctattcatgcttcaaggcccagctcagtcaccagcttcactaggatatgcccacttcaccgtgctttctcagctcgagttaatcactcccgtagctctgaaactctaaccccaaagagacaacactttcggtagttggttttgaaaattctctggtggcccagtgcttaggacttggcgctttcagtgtggtgggccaggttcagtccctagttatggaactaagatcccacgagtttcagggcatagcagggggaaaaaagattcttggttttgtctttattgtcttctgggttgaaagcttcccaggggaaaggaagatgcctaaatcctgaacagatggcacaactcagagagtgtgtcaatacctatttaagactagactatg

SEQ ID NO: 34630 - DNA, 1353 bp, Bovine  19866881395734
aactggaggggtgtatttcatatttcaacttcagaatctgacctgtgatgaaacagctggctggtggctgaacagagctaggactgaggcagagaccttctgccttgaggtttgggactctcccactctgctcttgacaggctcctggggcagtagaaaagggaggatttgggatccttcccatgtcatcacttaatactgggtgaccttggacaggtttccttgcttctctaagcttcagatccttatccgtaaagtggggtattagaatcaatttcagtcttacaaaggattgctgtaaagattaaaaggagaaatgccatatgcaaaaatatctgaggctgtttttgaagcctcaagcagagttgaggttcaaacccaggaacgagtgcctcccaaggctgagaattctgtgtgtctatgaccgcatctggaagcagatgacccaaactcctcttttgggaaagtgtagtctggggctctgatccccttccgcaagcctccagcctccggcacgtggaagagatagcctcagatctatatcttagctgggcagctggatggcctgactctgaccggtttttgccttcctctttcaagatggtcctggtttcaatctttctcacctcacatgatttcccagtcactgatctggagaccagggctttagccccatgtctttgggtttggcatcatctaggctgtaacctcaatcaccttgcacttgactttgctcctccccctaggatttgactgacagaagcatctagagatgcccagatgataggagaaaacgctgtgtctgccagagttggctggaccctacttatttcaaaacccctcacaatgtacactatacccttctgaccacatgaggaggaggaatggaaggatctttaatctcttatttcagatagagttgccagatgaaatactggacactgttaaatctgaatttcacagaagcaacacattttcagcaaaagtgtatcccaaatattgcagggaatataaaaactaaaagtcagtctgttgtttatctgaaatttaattgggtgttctctaatttcatttgctaaaccaagtggccttagtttgcaatcaaccatccttcccaccatgggcccctgaccttgagcctcagttctgaaaatggcttaacctggtctgggactcggccttgaaccccttgtacccagacaccgctgatagatgtgtccccattctcctgtggctgaccctcatcatgacaacctccttcctagtgtcccaggctccctgacttcctaactctcctgctgtttcacgggcacagtcttcctccactctttgcggccacagactttcctcagg

SEQ ID NO: 34631 - DNA, 1306 bp, Bovine  19866881507183
aagaaagtgacagtttccgaattctactatggattactttctgcacacctgactccatttcttctatgatttgcagtgaacagagacatttctaaccttttacaataactgagggtagatctaatcaatgctcctcttaccctcacatcccatccttttcttgaccaggtagagtctccttgtcaggggaaagcccttccctttaatgcattgtcctgaagccacaggcagggtcaaggtctcagtggaagctggtggtcattgtagctcatccttgtttcaactacctcgttcccatctcagaaaactccagtctagggaagagaatgctcatgtttcttaatgtaactactgcatttcaagctctaagacacacattctatatccgtatttcatttagccctcacaatgaccctaaaactaggtgctttctccactagaatatttgtcctttaattttagtagccaaagccccctgagatccctgagtgctgagataagcccaagactgatttgattattaggatctacggaatctttatcttcattgtgttcacttacatcatggggatggacaatgaaatatcacaagtaggattaaaatgaatattcatcaatgtataaataagtcacactatcatggtgtgccccctgttccagtttctactctgatggcgtcatttcacagtacatgccaaggtcacctcgacgttcacctcccctgctaagaggcagctggagagaaggaaggacggaggctgccaggcagcctttattggtcattcatatattcttattacctagtcctttggaactaaagtaaaatagatcctagccacatgttcaatcactgggtccctcgcctatgttccttatgacatgaactcagtctagctcctccaattgtgattatctgctttttgacaaacccacacccccaaaatagcattttattcctaccttatagaaaagaaaactgagacttctagagttgcagtaagttcatcgtgacggtgtgactctgggatcacattattgtgatcacaaattattgatgatgcacagaaaagaccacccttcccttcaataatgtacatgctgtcaagatccaaagacacttacgcatccaaccccctccacaaagacttccaggctcctgcaatacgtaaagctttctccattctgtgtgccacataatttagtacctaattagatattgtcttacagtattctcctaattgcctcaagtgtatttattctgcttctccattaagtttatcacagagatccttgagggtagaatttt

SEQ ID NO: 34632 - DNA, 1781 bp, Bovine  19866881612720
ggtagaaggggagagatggaacatgggtgatggggggcagggagattattctgtatgctactgtaatggtggattagtctttacacatttgtcaaaacccatgaagtgtactgtacaagagtgaaccctatggaccctagttaattacaatgtctcagagctgaatatatttaccatgtgaggtctcccacccgactcgacccattctaagaggcaattcactctctgttcttgcatctcctctgccacttcctctactggtgggattgtttctcgcgtacattgaactcattttaactacccactccagtattctggcctggagagctccatggactactatcagtccatggagtcgcaaagagtcagacacgaccgagtgacttccacttcacttcattctatacagtaaccaggaaaactaatcaaacgaaatcagaagctgaatccttaataaataaatgcaaacattatacaaaagagtgaaaaaacagaaaggatgaaggggtaagaagtggagtaatatgtatgttttatattttagcagaatcaatggatttcaaaacactaatcccagcccaaaattctgtccttgggcaaagtaccctctgggatctcagatgcatcatcagtaaagaagagcagaccttccctttctttgtaggttaagtaggaggatagtatgtttttacatagcagatccattgtgagaattacatgagttaatatatgtatagaaattaaaagaatgcctggtgcattgtcaggactcaataaatgctaactactgtagttgctgctgctgctaattttattactggagaatattcagtccaccaatgactctggtgttaaaacacaagacattcatatttcaatcaagagaagatgttattaaaaacgtgtgtgtgcgtgtgtgtgcacgcgtgtgttaatctctcagtcgtgtccagctctctgcgacccccatggactataaccccccaagctcctctgtccatggaattttccaggcaagattactggagtggattgccattcacctctccaggggatcttcctcacggaagaatcgaacctgagcctcccgcattgcagacagcttctttactgtctgagcgaccagggaagccttatggaaaacgtatgactgccctaatgagagcaatatatatagtctacctaccataatatacattgagtctaaattgactactctgtggttatgaaaataaatttattacaatccttaacaataaaagggggagggaaacaggctggccacttgattttcaaagacctttccatatcttaccttttcagaaacaatttttgctccttcagtttttgctccttctagagggcggctgcatgatctcaaaagaaatcccagtgctttgctttttttccccccgttcccccaggcaattcctggagttgccactagatggcggaaggcgatcacgatggtgctgtgtcaaaggggctgcccatctgtctgcggccaaggtagcggcaagctagcgagccacctcctgcaggcatctgattgataacagggctgtaattatctttacacaatcccgattgcagctctattgtagcctctctgttaaattaaactgcacaaataaatattctaggcaacacagcctccccaccagtccccaccctggtggcttccaatctcattaacatatcaaaacacaaactcagccctcccacttccctttattttcataacaaaagggccccgcctttcatctccccagcaacccagt

SEQ ID NO: 34633 - DNA, 714 bp, Bovine  19866880353182
acaaatagagggaggcgcccagaccattactgtgaactgggcctctgatgtgtttaaggggctgccaagtcacccagctccaaacacaacctgactgcaaggaacacggtgatacggctcctcctgaagaggatgagaaagtgacaagaagattctcgtcagtgagtagatcactctgagaacactgtcccccacccaaccttggagattaaggaagcagggagggagaaaccacatgagctcttcaccacccagctaaaggcctactgctttacagaacatcaatattaaaacgctcactcggctggtctggacaaaaaaaagcagcacgtgggactgactagtgaggctgaacttctataacgattaactgaggcaagaaactattcacccacccattttttcctcaccaaaagtgagtgcaaatacaataaagagagtcacatcttaatttttattctctccaactacttctgcagtcagttttatacattcaaggtattttctgaccattaaaaaatatcatgtggacacacccctatattttaaattaaaaaagaaaacaagaaaaaaataaacagtgataataatgaattataattcattggacagaaacaacaacaacaaaaagatatgaaccctacgtgttctcctaaaaagtttagaagttgtgcctcatacagccaggtccataatccacgaagcactggttta

SEQ ID NO: 34634 - DNA, 923 bp, Bovine  19866880363075
actcacgtccatgagtcagtgatgccatccagccatctcatcctctgtcgttcccttctcctcctgtcccctatccctcccagcatcagggtcttttccaatgagtcaactcttcacatgaggtggccaaagtactggagttttagctttagcatcagtccttccaatgaacacccagaactgatctcctttaggatggactggttggatctccttgcagtccaagggactctcaagagtcttctccagcaacacagttcaaaagcatcaattcttcagtgctcagctgtcttcacagtccaactctcacatccatacatgaccacaggaaaaaccatagccttgactagacggacctttgttggcaaagtaatgtctctgcttttccatatgctatctaggttggtcataacttttctttgtggggatatttggtgaatagtactaactgctatcacacaaggacaaggggtcttattcttgtttaattacctcttggcattactgtagccatagaagtattttgcattttttcttttctaccagtgttccttattggtgaaactgaacttgataaaaatagtgtatacaaggttatacttgactaaagtctcaactatttggaaaataatgataataaagataattatgtatctatttggagaaggaaatggcaacacactccagtattcttgcctggagaatcctgtggatggaggaccctggtgggctgtcgtctatgggattgcacagagtcggacacgactgaagcgacagcatgcatgcatgtatctattatgtgccagactgctcacatagattatctctaattgttataagaatcctttgatgttggtaatattagtgcaagattgactaatattaaggttggtaatattgactctaaatctcatgttttttgt

SEQ ID NO: 34635 - DNA, 1047 bp, Bovine  19866880388567
taatggtctgggcgcctccctctatttgtcctgccttgctggctgagtttaggcttaagtcctttattttatctcagtttgcttccggctttctgaaaaggagtgtaataaaaacctcatgcttgaaaagcacttaagacatactgagtaggaggtgctactggattacaaagcactacattttgtatttaggtttcagttaaacactttcccctgttcttcctcccagatttgagttggtgtagttccttggacaagggcatgccttcaggggaatctgcatttatcatatggtcaagtggaagagtgtaggcagatggaggcaagtgttgcattaagatgaggtcttctgggatgtacgtaggtttttctgagaatttgcctgcacctcgcatttcattgtaaggcttttgtgttcttggagtggggaaatctgcttgtaatacataccttccttgtctccgctcatcctatgtttgagaaatgagctgagaaaaaacaatcccttgtgattttgggatctgggttgctttgttattcctcagtattgtatttatgggagatgatgccaggctttttgccaattttttttaattggaagaaaagaacacatttttctaatgatacgatggtgagaaagatagaacaaatgaaaagggaacaaatgaaaagggaaatgaaaccccggcttgagtgaagttttcagtacctgctacatgtagatatgagttggttctgtattgggtttaagtgaggaggctcatgacgagggtggggtatataaccggttacagagctcttgccaccaccgggtactgtggcagtgattggagtctgtaattaggaaagcaatcaagactacaggattagaccttccactttagaaaagaaaaggacctggttttatttaccatgagctcagcttgcagatgatcattttgctgtggtttttcaagaagaccaccttgggagaaaggcatgtaaatcgcatttcattgcggttaaacaaatcagtgaaagttgcagggacaatccctccccggagta

SEQ ID NO: 34636 - DNA, 1130 bp, Bovine  19866880449454
tccatttcaggaagtaggaatttaaaagaaaacatggcctgttattgtctcagagtttgattgtgtaattcagctcgggcacttttcagcagttctgtgccataagacactcccctttaggaattgctttagtgaaaggtattctgggagttgtattgctacagagaatttccttcgtcttaagaaagtgtaagaaaactccttatttggattgagtcagaatggagagccagtccactgagagaatgtcagttagaagaaatgagcatgacattgtttttgatctattatcaaaagaaattcttgttaaggctccagtcagtactctattttagaattagtgtgtacagctgagcttgtcacagggatacctatattaccaagtttttggggggttgaaaattgaggttggaatttatctcatagaaaatctcgtcgggctgcttgatttaacagtgaggactgtctaattgcatcacatagtggacatcatccttcagtacaaatctgcgctccaaattctgacaaaaaataacaaaagtacgtgaaaaggttggtaaatgcttaacattttattgaaaaaattattgatatcaataacttttaattttctcagtcctttctgagcctgctgggttaaagaagtgtcctctcaagtgaaggaataaaagatttcattagtagtaatttgataaatcttggtagagcccttttgatgtatttccccaaaactgagaaagtaaatgactaacaaaaagaaaaaaaaaagttttaattgttagtcatgtccgactctttgcggccccatgaccaggctcctctgtccatgggattctccagggaagagtactggagtgggttgccattcccttctccaggggatcttcccgatccaggcattgaatctgggtctcctgcattgcaggcagattctttacagtctgagccaccagggaagccctggtagaacaattcactctcccaaactggcccttttcttcctgcttccatagcctctggctctcataataagtgattggggattccaggatcagatcaactggggatctcataatccactgggctcctctaaccaaaaaaaccatattagtgttctattgttacctaaa

SEQ ID NO: 34637 - DNA, 4086 bp, Bovine  19866880455721
ctcccgttgcccttttcccttaaatctttccgcactgatctgtcccctccgaccccagttctacgcggttggagccactgggggtggtgatccgccagccatctgtgtccctccctctatcactgaagcaccgctccactgccctccccaaaatcgaatcttatttgacggccatttgctcttttatctcacagaagaatattttaaataaaaaaggacactttctttgataggaaatacctggagggtttgataaaaatatagatcgccggcttcatcccagaatcacaccactgatgggtagagagagatttgcattttaaatctgagaacttccgttattacttttatgccattgtaagagtggggaaaatatgttcagaaggacatgcttcttttcataacaatccacaaatcttttaaaagtatgtattgctgaatagacaaatgagaagcagaaatatccaacctcaagcagaagttagaattttaagagctatataatgtgtcatcagtaaattttcaaaagacagaaaagaaaaatagaaaacgcagcttttgtttcattacctgaataggaagagtcatgtagcaacactgttggagtctgaaggccacacagcatcgtgtgaattgatatgtgaccttaattctcagataaaagaaattaaaatacagtttaggtaaagaacttgctgtccacttttaaaccttttgttggttcattgtcacttaacctaggcctcatttacctggggatttgcacagaattctgctggagggcctcagagttgttcaataacaatttaaaagccaatttaggattaggcagtgtaaccaggtgagcggagggtttcacttcgcgaaagaaagccgcagctttgccaggaagtccttactgtgaggcccagggcttgattagcccgggtttggaggagctcgcactcagcgcggggattaatcacggttcaagctacaccgtcccgttcatacaggcagcggtccgtgaggacaggcacgcgggtgccacaagattcaatacttcatgcctcttccgcgtatgaattagcacttaggggatcactgaatattaagacagtcactcccgactcatgctgaagaagtgcacacgttcagaagagtcatagcggaaatcaggaaccagtggggatgcgctgccttgaataacttgatgtgtctatcctgagactgcagtgttttccttagtagagaaaggcacacttatgaaacatttctcagtcaatatttttatttctctcaaccaaaggctatatcccctacctatgcttgttccaacagtgagcacactgtgtctgtgcggtgtggccacattcaaagagacatggagtccttctgtgtgctcagaattcttgccagtgaaaaaggcgggattcagagaaacgtgtggtgctcagcaagttgtggagagcaagggattctccttcaagggcactgagatgtagattttaagagagtagcactgccgataaaaattattaggttcatttacatttctgcagataaaaccagtctctgagaagaaaggaatatgtgcaagagaatagacagagacaaacgggcaaaaaaatcaaaggctggtaaaagggatgatgagtagaacaaatggctgattgttcatgtaacaaggttctagaagagagtggttccagtccagagtggttcagggatcagcatcagcagcatcacttggaagcacgtgagagcggcagcactctccctagacctactgaataggactctgtattttaaccaggtctctaagctgtgcatacccacatgaatgtttaaggttccctgttctaaaacctatagccagagagaatgacgagtagagatatgggctttgagctccagaacacgtttcaagttttatttttagatgaaggaaggtagagtaagagtttgagtctgggagttattttagcaagaggaatatgctactgtgtatcagaatatttggatatattaccattacgatgctggagaagactcttgagacaccctttggctgcaaggagatcaaaccattcaatcctaaaggaaatcaactctgaatattcattggaatgactgttgctgaagctgaaattccaatactttggtcagctgatgtgagcagctgactcattagaaaagaccctgatgctgggaaagactgaaggcaaaagaaggaggtggcagaggatgagatggctaaatagcatcaccaactcactggacatgaatttgagcaaactccaggagatggtgaagaacagagaaacctggtgtgctgcagtccctgggatctcaaacagtcacatgctacactccatgaaaccgcaaagagacatgactttgcaaatgaacaacaacaacacatatacatatgtataaaagaaaaacaattagaatttaattgaggtagttgagttgacaaccatgtaggataagtactttaagagatatttaaatgcattatgctaagtcacttcagtcgtgtctgactctgtgcgaccccagagatggcagcccaccaggctcccccgtccctgggattctccagacaagaacactggagtgggttgccatttccttctccaatgcgtgaaagtgaagtcgctcagtcgtgttcaactctttgggaccccatggactgcagcctaccaggctcctccatccatgggattttccaggcaagagtactggagtagggtgccatcattctatattttcttttatactaattcctaaaatgtatcagaactcctaactcctccattcccaaatactaaatgttcccaagaatgtcattctcaggcaacattttatcaactagcaattcaaaaaaggctcactctctacatgataagctcacaaaacatacatcaacctagtcagcacctaaagaaacctaatgcaaaattgtgattaacaccatgaaaagtaagggtcaagatgaaaagacggcaaagactaatttgtgtgagagaacagatcaagaaatatataggtcctctgatatccaaatccagggatttgatgaattctaatagcaggggatgactgtactgtcagagaacactgggtaagagacagatagtggtggactgaatgtaaccagtgtcatttacctagaagttcattgatagagaattgatacaatgtcaggaaaagatttaacccaggtgtccttcctattaaagaatcatgatgataatttatgttgcagcactgagcatgatccacactcaagagtatgaagttgtgagctttttatctgtggcttcttttcctctgggcctctaagtcattttgccatgaataagttctctcttaaaggcatacacagcagggttgcccagtatatataagaatcttctgcaattacagacgagtccgtgtgggaaaccatctgttgaagactgttatctatgctaaccatactgtactcagacactaaaacaactgtcctgcctcaatgatgtgtcacactaattctttcgatttgacttgctcatatgcaaagttggtaccgcctgtggacaatgatagcagctagtctaacttgaagctaacagccagttaatgactaagtttgctatcatagttccataagctttattttaatcgttgttaaagacacatttccttggtgtaatattctacaagaggcagtttagtaagccacttaagaagctgagatgtctagacaaaactactcaacacctctttgggccccagttcccttgtgtctaatatgaggataatattaatgcctacttcatagagttgttgtgaggattaagttgcatgtgtgtgtgtgtgtgtgcgtgtgcaggcacatgtgcatatggcactcagctcataacaagtgctatgtaaatattggttattattatcaaatgctagctctctaaatattactaatacaacctgtcaataagatagagctgactttattacttaacctcagtgaaggaaaagacaacctcttcaaagctttgattgtgttcttgagagagaaaatttgaccttgccttcaaaatttattagaattaaaag

SEQ ID NO: 34638 - DNA, 1974 bp, Bovine  19866880503197
aggaggacagtggttcacccgcggtcacacagctgcaggggcggtggggcaagaatgtgactccattcgcttgggcttcaaagtctgtgctcttttgctattctgactctagcataacaaaacagagacatttctaggggaaactgttctagatctaattctgaacagaaagaaactggtcagtaaagggaaagtagcaaaaatcttggaaggaaaaaaacatcattttggcagaacgaagagagggaggacagaaaagagccttgatctgcatgtgtgggatccacactgggaacagaattaaaatcaaggaagagagcataagagagtaatccctagacacattcagcaattttgtttcccaagcttaaagaatccaatcctacaataacaataatttaaaaaaatatttaatctatcactgttacgactcccccaaatcagagactcaacctagcaaactacatcatctttgtagacatgataaaaatgggagctgggaactaacataattttgaggatttgtctttaattgaataatactatgtctaacggaagctgaattgtacatcataaggtttctagtgagttctgtcctctatgaagtctagtttaataattctattataatgacttgaataataaataaccttgaaagtcatgttatctaaaaatttaattagcatacagcgaggatgacagaatcagcaattaaaagacctgaaaagtctttagatcaaattgaacaagttgttaaaataaaattaagtttaaaattttctaattgggatctaaataataagaaaaatatagggctggagaaatggtgtttagttgagaagaagacttaatgcaatctttgctaaagttattcagtttctctattgataaaactaaatggcttgtctaaaggatatctaaggtctactccatctcaaaattctacgaaatatttaatgtttatgatttttcttaaagtcctatattttgcaattggttcttcctttttggattacctatttcttaaaatcggagacggaaactgcaacccactccagtattcttgcctggagaatcccatggacataggaacttggggggctacagtccatggggtagcaaagagtcggacaggactgagcgactaacacacacacacacattttcattattattatgtttggtgatctgtggtcttttactactgtaactgccactccaggcttctgactaaggaactgtgaggttatgaatgggtaatgttttaagccactaaatttgtgttaacttgttacagagcaatagaaagttaacataattagcaacctggaaacattgaggaatagctttaagtgtcaccacacagaaaccactagagcaggtgagcgcttctgtgaaaagtatataaaagagtgaagaatatatgagaaaagccttgaggatgtctataagtagagtgctttaaaaaaagaagacgttagtagtagtacatgatttaaggtatttttgctaagtcacttgagtcgtgtccgactctgtgcgaccccatagacggcagcccaccaggctcccccgtccctgggattctccaggcaagaacactggagtgggttgccatttccttctccgatgaatgaaagtgaaaagtgaaagggaagtcgctcagtcgtgtctgactcttcatgaccccatggactgcagcctaccaggctcctccgtccatgggattttccaggcaagagtactggagtggggtgccatcgccttctccagattcaaggtatacttcagaattaaaaatatgaaggaaatactctactgataacatggaaataaccaaaagcaaacatttatgtctacctgttctctcactgacccatttccaccaggcactctgacgtgcactctctttttggtgagctgctatttcaaaaaatatgaaccaaaattttgcattaacccatccaaatacaa

SEQ ID NO: 34639 - DNA, 3159 bp, Bovine  19866880550234
tgaacagttgggcttaacagtgattgacctttgctgggtgatacggtgaaggcagagaacaatgaaggggttctggaattttaaaagagtatcattactaactgcagtttcaagctgggcaaggagagaggagagggcataagggaattattgatagtgaaaagtcaactagttcaaggtcccctgagagagcacaaatgctggagtgggaatggaagagtatctgagctgatcagagcatgaaatgctaaagtggataatttagaagtaaagcaactatggagataacattttggagtagtcttttccatagattgctacgatatgttgaattattttgatggagaccagccaagagctaacatacaaatcacaaaacatagacaaaaaatgactatggatatttagcattgctgccatttataagctaataagtgatcatttaatgttttgttcaaatctcaagtgtcaactctgaaaaaccaagggttacaaaggtaaactatatgatcctaatatctaaaaacgagtgcagctttctcaaaaggcacaagctcaaaataaggggaaaaacatgtctgatgtaaccagcatgtctctgtgatttcctcccctgtctttgtgctttgatgcagacagagcagggctgagtgaaagcccattaaaggacaggtgtgcatgaagctggcctgactctgtaactgacagagcagaatgaaacaaaccacttctcacactcaccttgatgttaagtttcccatttctatttctggtccagatttcatgacatgggctcaattactggcctcatgaatccattcccttcctcagttaaaagtgtaagtaaaattaacatctttttctttgttaaggtgtagaatttattccaaatgggtaatttaagactttctaaggcaattcagaggccacgagaaggagacagtctgggtcaaggaaaatgtggcacctttatttctcaaaggatccagaaagagaaagtctctaagaacaaggaaactgggggctaaatactgcctatattttgcaacatcatcatcaagaagggaaagtggttgagtcctcaccaaccattcacttcatctcagtggtgagataaaggtgtcaatgcaaagacaagaccatgtgtttcacttttatcctaatatctctacaaaatgcggtttagtcactgctgctgctgctgctgctgctaagttgcttcagtcatgtctgactctgcgaccccatagacagcagcccaccaggctccccagtccctgagattctccaggcaagaagactggagtgggttgccatttccttctctaatgcatgaaagtgaaaagtgaaagtgacgtcgctcagtcgtgtccgtctcttcgcaaccccatggactgcagcctaccagactcctccgtccacgggattttccatgcaagagtactggagtggggtgccattgccttctctgccttgtttaaaccgctgttacagtgtctgcctcattttactttctatttttgttctttatgtaaataacctctgaatggagtggtagccagcctgagtagatgccaagtcttcatcagttttgtgctccttggaggactacataatatactttatatttcatagacaatcaatggatgtttttggagttaaattcagttactctaaactgtttgacctctgaaaatattttattatccatgttgaagtaaaacgttagaattttaagatgattatggtaatttttgttttaaagatagacagtttcactcaatagtgtgttcacaaggtggttgatgatgcaagtgccatagaggactcaacagttctgttctagtttcaatagtccatatttcaacaattacgttcttcatgctaaactagactataatgttagatggtaagttctgagaggcagaaacatgcttgtcttaattactaagaattctcaattcttagtacagtgcctggatgcagtcagctctcaattcgtatttatgtgattgacattagttaaatgttgagccaacttaaagcttttgagaagcaaataggctatcagtaaatcagatgatgagtcaaataaggatataattccaaagactccatcgcttcagatgtgccatttaatgggcaccatttctctctttttatattgtgcattccaaggtggcatgtcagatggttataatgcacaaggtatatattcagctttgtttctgtgctattgtcacatgtacagcaaactgaaatggaatatattcatttatctgtaagattgcaatgactctacttttgtgactgtacctttctctttgcccgtctcctggctgtaatcttttgcgtagtttctggagctggcctctcggtgtaaatccttatctgaagcctacacttcaccaccactttttttggagtgagcgtggcagcaccgtttctagctgtggaactgacagaatcctgagagataaccagatgcataagttacttcccatcatttttaaaaataggcgttggggcagaactttgccaggggctcaaaactacagtgtgagggtacaagagtactgggtcattttactgtatttcctgatgggaaacacttttgctgcctttatgagtagcatggtttgctctctgacaaaacaataaggctgtgattccaggtaataagcctcctgatgggataaccactattatctgctagctggggaagttttcatcatccgtctcaagtgaaagtgggaggagaaagatgggaggatagtgaattaaaaaagagccagaaaagatgaatttctggtccaagaattcctgcttttttcccccctcgttatcttgaggtttttgtgaatgttcataaataagtacctttactaaaagatttcacaaggaagattaatgcaacaagttctttgaaaactccaggaaatatgaaacagtaaaaggatttctctcctcgcccttataactgggtatgtgcttccctggcaggtggccacatcctgccagagcacaccctccttgaaactgtcttgttggagcttatgtgtcttcagttatttgctggacattgtcagaggagccagaagaaatgaaaaaagaaccccttccaagtcactggaagccccccaggagtccttggtagta

SEQ ID NO: 34640 - DNA, 928 bp, Bovine  19866880582073
acagaagaatgtaactgattcttgtaatcagtaagtaattgattcttgactgtgattcctaatatgtttgattatatcttatagtagtttttcctggatttttaaattgatttttgttgttttcatttctttttgtggattggtcttctctataccatacatataatcgacatttaaacagtctttgtctatatattgtgttcctacttacacgtttaactgagcaatgttcaaaattaatcagtacttcaatcttcaggctgattttattactttatttatttaagcaatttaatatatttttattttaatatcattttcagattttcctacaattttgagtgggagatttcttgtgtgtgtgtgtttttttttaatctgttgccaccctcatggatatatttccgtctcttgtcatttaaaaattttacttgtatattcttcagtgaaacttgtcaactgatgagagccttatgcctgatataggttgtagaggcagcagttttccccccaagtttatctgtcttttccctgcaggtttaattgtttcttgaccaatttgtttgtttgtttcttgacacaggttcctctaccctgagtacctatgaattcatattctatactttttgtttagggtatattctttttcaactgatggcccagagtatgtggcctacatctgtttgcatttccatgccaaggtggaatttttttctttccctagttcactaattctggttctgttttcatagaagagacagctcccttctggttcctgggtttgtggataaactctggcttctaagttctggcttcttaccttggataagatctgtagtagtgttagctcttattcttccttattcatgaaacccccagcctctacttgtatatgtgatacggaatcctgtttacttaacctttgtag

SEQ ID NO: 34641 - DNA, 1414 bp, Bovine  19866880658518
tgggtcgtgaagttgactagatctataattccaacattatgaaataatctttagaacatagttgcacaaaatttataaggtttgggggtcgatgcattgacatctttctgttctctggtctaaaaggacagcagagggagccccctgcatgacttaaggaaaccaaaggcaggctggagaagaaaggtttcatggtcggaaattatgcatggtgccctctgctggaatcactgattgaaagcttggatttcaaaaagaaatttgcaagcacagaacccccaaaactttatgttaatgtgtgttatcaccagacatcataaagggcatagcagaattttctaaataaaactaataatttctttgaattaaaaaaataaatatatgctttacagtttttacatgaaatttgaggttgaaaaatgaaacaaatgtctgtataaaatctcacttctctaaaatttgtaacattactaagtagtcataatagtttctccataagtctgtaactcttatattctagaatcttaacatgaagtgtataaactatgacattcatatgacaataatgcaggtataacatcctaatgtaaaatagttttacagtgggtgaaataatccattcaaaaggttttagatttgggtttgtaccgactgaacaatatgattaataaatgtttttccttatgatagctcaccaatgatcccacttagagaaaaccattttaattctgcttactttttaattcctttgaggaatactccaaaaaaggtatcttttaatttagagtgattggtaataaaattactttcaattttattgtaaataaataaatattaattataaatcagaaattcatttctatcgagaaccaacaaatctctcaaattttccatacaatatcatgttatagtattatgtacgataatactatgtaatcacttgcaaataagacatttatgaagtccactgtggaaaccacttcttacttaactctcctattatatttaaatcccatgtagaaaagcactattgaactataatttgaaagtaacagaaatttgaaaactatttctttcattaatgtttgttacgatcaaatgactactgaaagggtccatctataggaaataaaccagatactgaatgggaaagagtttatttgatgttctgcttctattttacactgactaggctagttaatttactattaagcgcttttagtctatgacattactttgaaactgtgcttagaagatactcagaatgttgaactctaatggtgttcagttgctgtcatgtccaactctctgcgaccccatgactgtagcctaccagcctccactatccaagggattttccaagcaagaatactggagtgggttgccatttccttctccaggggatattcttgac

SEQ ID NO: 34642 - DNA, 745 bp, Bovine  19866880703814
ttttttattttagtgggtgtctagatatttgccagtatttctattttttggctatggtttcattgaaatgttagactcctaaaaaggtataaataacagtaagtagcttaaaattttcatttatgatgtgtattgtgttctattaaatcacctataaatttgcctgtcatcacctcatgataactgacaataattaggattgtctaaacactttgaaagtgattgttttttctaaatcatttttaataatcttcttggttagcattctcacatatactgaaggacatggttccagaattaggtaatctgcattagtatttgctttggaatattaaatcattcaaaacatttgctctgatctgccttctttcttcacccaattatctgtgtctttttcttttaacctttaacttgaaaggtattatttcatgaaaaacataaaaatacatttcacattcaattattatcattagaaacagtacataaaacattcaataaccacatgtcaacagtagcaccattattcttcagatcctttctttatgtcttcggattgtttaaaaaaccaataaggggttttttgactaatatttcctggctttcagcaaacacatatgtattctctttaaaaacagcaggtcccaccatacagaatccataatcctgagcagctgtccagctaggacagcactgtctttgccagccctactcagatgtgttgatagatgtacaccaagtctgctag

SEQ ID NO: 34643 - DNA, 1327 bp, Bovine  19866880714104
aaacctaaagctacgttctcctgttttagaataataaaggttgctcttttacatctgtctttcagtaggttctgaacacaggagaagatgaatgttatttattgtgacttagtattttcaaattctatctaattctctgcctaacctgggcttctacccaagctaatgaatgtggctggagaaaaacacacaactgtaacactttaaacttatgaccataacctgaagcttgccctcagcaccttttacacctttgctctcctctaaaactgccacagcccctttatcctcctctactcaactgatgacctggcttctgaattcactaggataatagtcagtgaggtgagagcttccttattctctttcccaaatctgccaaccctcttataactcatgtgtcctccctactcctactggcatgtttaagaccagttgccactctatactcaaatctatcccgcctgctttactctaggacatgatgcctgtaaacacttcctttcacttctgcatcattcatttcctcatctctgctggatcattctcatcagcacacaaacattgtatcttccaccttacaaagtccttccttaaccatatatctcttagtcctttcaggatgatgtaacaataatgtcataaactgggtattattaagcaatagaagcttatttctcatagttctggggattgggaagtccaggattaaggaatcagcagatctgatgctgggtgagggccttcttcctggtttacaggtggcatcttttctctgtgtctctctggaacctctttttaagggcagtaatcccattcatgaggactctgtcctcaaggcctaatcacttcgccaaagcacctcctccaaagccatcaccttgaagggtaggatttcaacctatgaatgtgggaggtgagggtacatacaaatggccagtccccagcattctccttctagcccctgtcccatttctctgtccctccttacagtccatctcaaaagagttgtctaaactcactgtcatgctttctcacctcccactttttcttaaatctatagctttcatccccaacactccactgaacccattcttttaaaggttgcgaacaacctccaaatccaatgatcgtttattaatcctcatcttattcaaactcctagaagcatttggctgtgacgatcaatccctccttttttattcatgtgacttctggcatttcacactctcctggatttctttctccttcattgactgctcactctactttgctggcacatccttttccagcctctgaatgttgacggcccaaggagtcagtccta

SEQ ID NO: 34644 - DNA, 1147 bp, Bovine  19866880722506
ttttattttttacatttaattctttgacttgagtttgatagcggtgatgaagaaaggagtaccaaaagctttgctctttgaggacaatgaagtcatcatacaaaagagtagaacttccaattttcctttggcaggcaaaaatctaaatttaccttttgggaattctttttcattacctgttgttgctcagtcatgtccaacactttgcgaccctgtggactgcaacacagcaggctcctctgtccttcactatgtccctgagtttaatcaaactcatgtccattgagttggtgatgccatccaatcttcatcctctgtagccaccttcttctcttgccctaaatctttcccagcctcagggtcttttccaatgagtcagctcttcacatcaggtggtctaagataggcttttaattttcttctatttctcactctcattatcttttgtttctcttctttctggaaaacatctgctcttgggactctgtgaaagtttaacagagtttcttaccagcagccagttattcccaccatatcaggatttcacatcgagataactgattttaaatgttgatttttaaaaataagattaaaatagtttcacataacagttcctactgtgagcattatttggacaacacctctaaaatagttgtcactcaggataatggcttttttactactgattcaagatctctttgtaattttgacttgtactgtgcactggccagagtgatgattacataagttaatcaaaatatttaacagtgcccacaaatataaaagtatccatgacaattagcttgaatgacccatttattaggaacataacacaaattctatatacacatgtcttggacatctctatgtaccactgcggatccacttggccttatccttcctcgcagttgtggttgcagggaacaggttggcacagaggttgccctgcttttttatgtgtaaccagaagtgcctcaccttcgtccttgtgcgcctcctctgacacccgcagcatgggatgcttgaacacacatgagcaatctgaaagtgtgggagatcttgcaacccatggggaaaccttgaccaatggggaatgtgagttaatggatacatgtttcaccttttcatccttccagcagagcttcca

SEQ ID NO: 34645 - DNA, 1094 bp, Bovine  19866880731375
actataaggcagaaaatgaatcagcccagtactaacgattacagtatgagacagtgattcatatgaaaggcagcataattactgtggatatcagattggatttcaaaatgaggaaagaacgttttagtactttctggtctaaggataaacataattgatttatgaataacatgagagtccagcttctctggcaaatatattgtatttcatgtagcaatgagcttaaaggcatttttcacatttctatgtgaaactcaatattcgcatgccagggaagtgaggagcaggagtggctggagtccctgagagatggcaggtcagcatcagacatgccagagcaagcccatctgctgcatggcagcagcaggatcaatgatacagcccagcttgaaaaaatgataggtgatggtttatttattcatttatttagttgtttaaaatgcaaatgtgatttactagaaagaatgaacacccttcttccccagaggctattctaaggaagtttttttcagtcctgattcttagggaagctgtgcagcccatctagtctagagcatggcacaggtacccttctgaagtccctgttgcactctgagcttctcaccaatactgtgtttaaagggctgggagaaatcacatgtggaaatatttcataaatgaaactttcaagtcctgttaggttctttgaaccatttttactggcatgacttggttaagtggggctatttatttgagttaggctgggatagtggttaagatcagagacccatgagacttcctgggtttgaacccaggttctgccgagtataagctgtgtgactttgggcaagttgagtggcacctactcttttggtgattaatattgctaagtgcctggcacagtgttatgtgtttgctaaataataatcatatatttgatctttttgataattctgtgaaaaaaacaaaacatacaggataagagaagttcttgcagttaaaagggaccttgttattgtcgtttagtcgttcagcgtccgactctttttgtgaccccatggactgtagccctccaggctcctctgtttatgggattttccacgcaaggatactgg

SEQ ID NO: 34646 - DNA, 1508 bp, Bovine  19866880756382
tgctgggtatgatttttccatgcaaagaattatccaacaaaagcctttcccataaaccccctctgctctgcacagggggttctacctgctcaatttttctataaatctaaaatatccagtttattaattaaaaaaaaaagcctttcaccatagagattaaatcagaagctatgctctctcatgtgctatcctcccaaatggcacacacatgtgaacacatacacacacacacacacacattttccccaattttcattaatattagtttggtgactgatacaactaactagatttctctcacatataatatatatacaagtggtgtatatttgcaatgcacatgccaatataaatacacgcacatatgactgagaaaggatatcaaactagagtaaaacatgcaattatgaatcataactgacattgagtctgttatcatattatgatttgtaaggtgttctgtgcacacagctgatgatggaagagatgcagacccagtgagctgagaaaagtcagagatatcttttgtatatttcccccacactgtgtaatctatgtttacataattcattttcatttgagaggggcagcgactcccatcctttctcctttttttctcattggtttaacaaattctcaaggtcttttaaattaactagaaatttcatctcaattgaatttacaattgtatctattaacataatctattaaatgataataaaggtaacaataaaagataaaatagagacaatgatcttaaatgtttatttttgcttggttacaaaataataaagcaaaaatgttaattcttcacataataaatgttttgtctggtttatcttctacaataaagaattattaataatctctctgtgggtggaagaaaacactgaaatgtagtttccaaatcttgctaatatagttagtcatttattttgggaaggttgttcttaaccaagttagcatgatcattaaggaatatttggattgttctgttttgttagcatagtagatgaatggttatgatgggtaatataatttattatataacttattctatgtgattagtatattacttaaatttattttaaatgtatctttatataaaaatatacatattacaggtataagtacttcaattaaaattagtttccctaatattataattcatagtatcatacaagaaagtaatttaaataattctatttgtatatattatataaatatctgtgtatgtgtatatatataaatatatattgcaacagtcacaggtcaaagacaaatctcatgaacataagttataattttgtacaagtatagctgtattatgaagggaaaatacagattttacttgtatattatttatcacatatgtattaaatattatttgacaatgaagtagtcatataaacatacaaatatgccaatagcatttgtaaattacttcagaaattaccatctgcagatatgtttttacagttataaatatgttacttatacaaatggat

SEQ ID NO: 34647 - DNA, 796 bp, Bovine  19866880758777
cttattttaaatatgaaatgtatctctaaaatactaacaaaatcaattctttttggggagtcttgcaaggtttggggatttctgtatgaaagttatcctttccaaatgactgcagtatttaaaatgcagagtcttacttatttttcctcttctcagattactctatgaccctctttctatttcagtacatcactgctaaagcagtaaactggaactaacgggagaaagaaaagctgaaactgcagtgttctagttaaaggtgggtaaacaacaaggctttcactggatggagcttcagaagtacagtctttaaaccaggctgccaagtgatcccctctcagtatatccctcagcttatcttcagctcttcaagcactagccggtatttatgggcaaaccaaaacaaaatgagtgtccttgatttttcaagtacggatacatttagatgattctttgaaatttgttcttatcagtctctattgataaaaaatttttaagagaaaaagcaacttgagtaaagattttggtatcagcctttttctgagtgtagcctttatgtcagtctaaagggaagaaattgttcggaggcttgtcttaaaaggctagataggaacacggtgccatttggtgctaggccccactgacagatttactgcctgcttggagccgaggccgcagcgtgatggaagtggcaggtgagggcttgcaaagaagattcccatgctccatgcatatgtgtaactggcaacatccagggtcatggaggggcaggcctgtgtttacagtcaggatttgt

SEQ ID NO: 34648 - DNA, 1247 bp, Bovine  19866880784500
aacatctttgcaaatttctcatggtctaagtattttgtaagaagggaaatctctgacttattctcttgtatttttagtagagaaggtcagatcgggttgtgtctagcagaggaataaatgaggtactttggaatttctgtagaattcaaactgtgaagggactgataatttctgagcattgccaaacccatagggtgaatcatatgattaaagaaatgtatagtattaaggaaatgtatcctaaaagcagaggtgttttaaaatgcattttgatattgctaatacttttttttttccgaatagctaataattcagagctctgagcatgaaaaagcataagatttagccagatctctagaatatgggtaaaagagatgcagaatcacaaaattcatgtttgcctggggccctaaacatatcaagtcatccacactactcaaatgatctggattgctttaacttctcgtcctggatctttcagtgtcacagcagactactgtgagggccagcgacccagtatccatggccaatttctttatttagagccccatctggttataaaacctatcttattccttggagatagaccagaaccacgggtccaatttacatgggttaggcagtacaagtgcctcttcagttgcaatattcttcataagctgcaatccattaattatggtttatttagttcgcaatgacttagtaacagcagcagcacgtggtctcctgaccacatggcttgatggccatcatggcctcccaacagggctcccagcagggcttgtgcagtgctcccagcctgtgtagaatgcagcagcacagccccttagtggtgcgagtaaccgaaattggatttgattgtctctcctctgtagtttggtttgggctacttttgtggtggactgactctcagttggctttgcagatttttaatgaggagcaaacattgttttggagtggcacagctgaggagcaggggcctggtgaaagctgttgtttttggcagaaatgatggcagaatcaggaataacagctgggaagagtgcacttaactgtgaaaaaaatagagggtatactaactggtaaactcaattgttggtgaagcttcagtcaatagctctgaattgaaagtcataggtttttgcaaaatactgaatttggaattatggtttcaaagaatctaaaagaatcatgtgtaggaacaaaccatggtattagtgttcccttagcatctctattggatttgg

SEQ ID NO: 34649 - DNA, 1137 bp, Bovine  19866880930563
tattagagcttaaattctatgatgacaaacacctatgaacccttgggctatttcatggtcaaactctgccttttttgtttcctcagatccttataaactatttccccatttctctttttctttgtttactcatcttcttgttttgttttttttttcatttatagttgccatatcattgtcttttgcatttaaatctttatgattttgtcccatgtcatgatctaacaagttatatacatttaatgaccaaataattgcctattaatttagctgtactcactgagaaaggttttctgaaacaaaattataagagtttaaagttatttaagttcaaattttgcatatatgaaagccatcttgtttttacaaaatgaattaggaaatttaaaatgtggtaatcatattttaattattaagaatattgtttattgtaatgtagaacaaagatgtaaaaataatgacatcgtaattctgaacaaatttttctcaagtaaagtcatagagagataatgaaaaaacagtgaagttttaaaaatctaagtagacattttctttggacactatttaggattttctttgagattgcaaatactttccaacttccaaagactgataagacagcttcttgaggctctaaaaaaatgggtaagttttattacccttcagggtcttttcatcctttcatcttcttaaggtgaataaattgttttctatgcagcattcaatctatagaacttttctctggagactcaaatcttcgtttgctctttgtagccatattttaaaaatcctataatattttccggaggagtaggctttgaatatagcctcaatggactcaaatgttaggaatcttaagtaaaaatcagcaaagttaagaatgttgtcttatctcattggtgaatggttgttttgtggctattaatttactcccttgaacttataaagtcctttatattcttaaagggaattttagatcaatcatcttataagaatctgtccttatgcccagggcataactagttttaaagaaagaaaatgttgtgtttacgaaggttacctccattcatggaaaagatcacaagagaatcacagccagaatccgtgtcttgaaaggagcttttttgtattcagatg

SEQ ID NO: 34650 - DNA, 1496 bp, Bovine  19866880943348
cttacatggtgcttacacttgagagaaacatttttccttgcctaaagttgaagatgatctaaaaaaggtaagatgtagctacaaaataaagtgttgaggaggtagaggttgggagaagttgggacttatgcttaactttctgcttgactggtttgatctcctttcagtccaagggactctcaagagtcttctccagtaccacatttggaaagcatgagttctttggcgctcagcctcctttatgttccaactctcacatccatacatgactactggaaaaaccataactttgtctatacagacctttgttggcaaagtaatgtctcttctacttaaaacactgtctagatttgacatagctgttcttccaaggagcaagtgtcttttaattttgtggctacagtcaccatccacattgattttggagttcaagaaaatgaaatctgacaccgtttccacattttctccatttattaccatgaagtgataggatcggatgctgtaatcttagttttttgaatgctgagttttaagccaactagtttttattatattggcttccctggtggctcatttgttaaagagtctgcccgttttcattattatagtttattttattattatagtttttattcctagttcataataaatacaaataatttttaaaaccagctgtggaatttgaatgcaagggttttctgtgactctaaatacagatatgtaatcattacagtagaattgatccttcctagaattttaaccttttcaattagctctgatatgcatgtaaataggtttacaggaagcctgaaaacactgggctctccttctagggtggaatcttcttgagctattttaatatgattcacttgatctttaatttataaagaatcttcagaaaggcctgcagaaccaaatttaaggcttaaaatgctacccacacatattcagagtattaggaagctcaatacttatcattgtggtagagcatattccaactcttctttcttgacaaatgcagtgacataatctaatggaatgttgagagtccccattttgtgaaataactacaaggcaacaatcctgtgttgaaataatgtagcaaactttctgtactgatcaacagtatttgtaatctgtaattttaggctctttattcaagaattaaaaacaaaatgtgaatagtctgtctggtttgcttaaccaaccatggggttttaaaatttaatacttaagcaacatgcaaattagaaaataacattttaggaactggtcaatcagaaaatcctatgattaaactatttgtttgataagcattcaaaaagaccccccatattcttcctcttttggcacagttgttttcctgcttctctggccttagggttttcatttgcattttatttgcattttgttcttaatgggggaaataaagagaaacgaaggagataagagaaagaaaaaagttccagatatctagcagtaaccaattccttggt

SEQ ID NO: 34651 - DNA, 3341 bp, Bovine  19866880984599
aggatgagatggctggatggcatcatcgactccatggacgtgagtctgggtgaactccgggagttgttgatggacagggaggcctggcgtgcttagattcatggggtcgcaaaagagttggacgtgactgagcgactgaactgaactgaatgtatgtatatatccatccaaaaagaaagagcagcaaatctgtgccaggtgtctatgttgagtctgaatttacccacaattaccccagcaagtaattaagagaaaactaattcagtactgaaatttctggggcctctcagatcaagtacaaacctatgctccagagaaacagccacactccagaggtgtctcttaatgtcccgaccagaaagatacacagtgtcacttctgccacgtcttttgtccacagtaggtcacagggccagttcaggctcaggggaaggaaaataaattctagattccacttcttgttggaggagtggcagggtcacattgcaaaagaacatgtgggttggaagagattgttgtgaccgcctctggatcacactctgccacaatcaggcatatggctgtgtgtgcactttgaaatagggtggtcagggaaggccttatgagacagcgaagtgacatctgagcaaagacctgaaggagaagggagcaagccttgtagatatctgagataaaagcattccaaactaaaataagtaaatacaaagaccctgacgtgggaacaagcctgacaggttcaaggaatagtcgggaagccactatcaccaaactaagagtgaggatgagggaaagaatggtagagatgaggtcaaagaagtcccaggggccagaccatgtagggctttgagggacctggaagcggaaatggacaaaaggataaatgattgagattcctacttacattcataggttaggcctatgaattagattgggcttatgaattcataggttaggcccctcctatgtggtgttgatgaagtcagtgaaaagtttacaaagaacttcttctctaccaaccccctaaaaaattccctcctgataattctgttatggtctagtcactaagctgtgtccaactctttgcaactccatggactgtagcacaccaggctcctctgtccatggggtttcccaggcaagaatactggagtgggttttttgtctccttctccaggggatcttcctgacccagtgattaaacctcggtctcctacattgcaggccgtctcccgcattgctggcggattctttaccaattgagccaccagggaagccctaataattctgtaaatagtcttattcacttcacaggcaactcaactctacttttggagtagagtcctggcagagtttgcacaagaaggagatgcagcctctgagaaagatttgcctgtacttctcaagccttactctgtatgaacggattatttattcatataaatgaacacgtgtgtacacatatacacatgtgtatatacttgggaatctaattgcagtttcagttactacataacttcccatcttaccagttcctgaaaactgcatcttctttttttacttttgtgtgtgatgtagttactgattttaaattttaaaatatgatgtttccctgttataatgtgtttaccttggagcatgaacagcagtagtatttaaagcacgtgttcagaactaattatgtggcatttggttgcttcttttcagggaaacttttaaaagcagagtatatcctgggcagtctaataagcaacaatggagcaacgggtaaggtgctgtcatatcgtcaccataaccgtcacgcactgtccctaccagaattccagttcagaaacaactcaatgacctcgtagttactgtgcactgaatattcccgaaatccctggaactggctctgccccagtgaaagaagtggctttggttgagcagtttacttctctgtgtttccattttctcttattaaaaaggaaaacaaaacaaccaagtcttctaatattgccctgctctattgtggagggtgttacctaatcagcgttagttgtggaagtaggtaactccctgggcttcagaaaaggctcagctgaagctttgtaaagaattgtgaatggaaattgagcctgtaagttcaggagaatacacttacagctttatgtatttcagtgatctgaaaaataaactgtatttggctatagagaaaatgtaataaaaacttattttgaaatggatttcttagaatattttaacatacatgaaaggaaggaagtcctaatagttgagtaacaagtaatttaagcctcagatatcttgtctgaatttctaggcattcaacaagtttcccagcaagttgaacacaattcccagtcaactttttttattcctattttttggctgtgccatgcatggcatgtgggatcttagttcctggaccagggattgaactcatgccccctgcgtggaagtgcggtgtcttaaccactgaagctagggaagtgccctagttgacttttaagctcaatatacttggatataaggtcccaaactccttgaaacttgtagacctttccagtgggaagccaattggaaataaaaatattgacgataatacctcttttctgtggccaccatcactaacctacaatatgcattatttcccatcttctgcactccccaacacacacacatatagattaaaagccagggagaaagtaagggggtcaatgtggtagagaatattgagagattatgataaagagcctgactatttttgatgtttggccactggcagttatcaggtcccagcttcttgcccttgtgccccacatctggacaggctgagttttttttaaagctcatttatcagtaaaccttggcctagcttgtgggaacctttaccccagccccacaccctaatcaaaataaaaagagaagccatccaccactcccttcacttaagtcaaacagaccagcttaggtgccttccctgccctcctcagaaaggctcattatgtgagcactaaatctttttatatcctccctgtgcatgtgtgggatcatcagtttcaacatccaaaccaattttgggtgaatggaatggatcccgccctcctctcaggaaccacaagacagtggaagtgacactgtagttaattaacctgggaagccttggaggcaagaccactgaggatgagccctggagtagaaggaggagggagcagaatcccaagtagtgggaatgacaagtgcagataccatgaagcaagtaagtgtgtgtgtgtgtgcgtgcacgcatgcaggtgttcagtcatgtcgactgttcatgaccctgggactgagctcaccaggct

SEQ ID NO: 34652 - DNA, 785 bp, Bovine  19866881002035
cgtcttgactgttgtttaaagagaacaagcaatccatcattgaaccagggagtcactttctcatagaaaagtaaaatcagcatgtgacactactcagccctagtgttttgcagattaaaatgatacatggcgactcacgtgttcctaggaagattaagtcagttatcttgttccgctgcccagacaaaagaattcccctcaagcagtgagtggaagctttacagaaacgaaaaagttgggctcaattgtacagtggtaaaacaaaatttagcaagaagatagaaacaagaatgttacttcacatgtaggcaacctccctgcaaaagatggtacaaagaagaatccatcctgaacaggggagctattaaatctttgtacaagcctctgctgtttgaggtgccaattttattaccagaaatagatacacaatttattgtctgactgccttagcaattgatttaaatacagagaaataaatgagcagccgctggccctggggcagttagcttcctaagagtaggttacaatcctgtagctacagtatccagttattaacagtgtttttccattgtgtgatctacacagtgataaaatttttactgaatctcacacagaagtgagttcacaatggaaggctgggattgcagcctttggttcaccacgctaaggccagtatttattgtattacagaaagcagatttttaaatatttgaatctataacggttatatttgtttttaaaagtaattttcaaaaggaagaaaactagagtaagtatcaaactgt

SEQ ID NO: 34653 - DNA, 1022 bp, Bovine  19866881020844
aaactgcctatggatgtcttaatcatacacacacacacaaattttgattccacattgtgataagatttgtttaaacaatactccctgtattcaactgctgtgcatatattttccatttcttctatttcagtatattatcttcatcatatcttgaaaaattcagtttttgtttaataattaaacaataatttgaaccaaataatagattattggaagtaacacattgaaagtatttttagtttaactgaggtagttttatactccagcacaactggatcatggacttgccccaggggctcagtggtaaagaatctgtaggcaacgcagaagatccaggttcagtccctgggttgggaagatcctctgcaggagggcgtggcaacccactccgatattcttgcctagaaattcccatggactgaggagcctggccggctacagtccacagggttgcaaagagtcagacacaactgagcactgagcacacacacaactaggtcatcatataatctactaaacagttttactttagagcaaaattattgtttgaatgttgtaaaatttgatcccaaggctagaaagaaatgataatacacaacttaaccttataatctttttctgattctgcctctcatgtaaaaactgggagttgggttgatattaacaactttcacatttaaaatgttgacttggactccaataaagaaaaaaaatgtgaaaattattgtgtgagctttaaaaagatttgacttgatttttaatttacagataatagagtagtattagcgtaggttcttttccaagttgagtgttactataagtgaggaaaataacatgctgtcagataggaaataatgacttgcaagcattatgactacatctagattcataaagtgctctgaaaaaaaaatgctgctccacaaatagctatttggtgagattatcattagacatctgaccaaatttaaacatttttacgaaggaaacagttttccttaattgttttgtattttttaataaag

SEQ ID NO: 34654 - DNA, 4774 bp, Bovine  19866881027518
accgatctgcttagatctctgctgctgtttttccaatttcctaccaagagtaaattggttttgctcccattattgctctttctcacgtttcagttggtcttacgagagaaaatggctcaatgctgcaacaatgatttggagaataccaatcccttgatttagacaacagttttttggttttttaaaaaaatttcttctcatctgttgttctggatgctttttctcattttttataaacagagtagaacaaaggactattgttcttaacgtgcactgcatgtgcttgtaacatatatgggaaagcataacaggaagggttttcttttccagttacatattatgctcctgcctaacaaaagtgctagcggcatgaaatgatgcaataaacctctctaacagtagctgatttgtatgcaacaatgaccataagggtaactcttcagcaaacctgaatctcatatataatgcatagcagttaataaatcatagtaaaatcaaatggctgagagccagcaatacctaactagtaatggaaaggagtggaaagatttatggagagacagattctgtctggattttgcttttaagatgcttaccaactgcagtggagtatcttacatggcttctaactagatgagtattctgttgattcattccatcctcccccccaccccgccccaacccccgtccccagggtctctggctaccctttaccttctaccaccaggtggagtgttttccactaaccatttaaggtttaatacttcagaaccaatacaaatcctatgggttgaaagtgttccttttgaacatctagttatgtaaataagtttttagcaaggtgtttccctccatcaaatgcatacagataaatacactttgaaacctttgctcaaaagtatttttctttaaataccatttcacatacatcaacagagaagcaaggctggagttttgttttatagttttaaacaaagtgttctttagatgtgctcattgtatcttactgccagtgttcttctggctgtagtttgtgaatcttagaaatgcagaatttgaaaatttgtcacatgtcaagacgaggaatattgaagacaacatgtgccatacagatctgagagaagcattcacttcaaatctgtttctggttattagtaggtcttggccaatttccggtgctgacatgggctattgagatgtgtggcaaacatgtcaccttagagttagaaatatttgaacttgaattatgacctttaacaaattcttaacattaaaaaaaatgaagataaattgctgacagagtggcctgtagatagtattaatgcctctgtttgattgcctacataattttcatcctgtgcgaactcaagtttttattttagattgctttacatttaccgctggactttgctggttgtggaaaagaaatcatcttcccaaatattacgatactaacataaatacttttactattcagcaatgtatattgatgtctattggaggtaaaaatggatgaaagggcatataagaacccagttttctttttttgttgtttttctccccagtgtcttagaattatttgccttcaattatggtagccacaagatggcagtaattcctcattaaatggtcaattgccactgccctggattacagggtagtgactgacgccaggttagacagaggtaggataattaggagaagtatctccttgagttaagggttaaaataaaacggtgcaagtgttagagatcatgggagtggtctgaagtaagtgaaattagttttatcctgatgtctttcgatttcccggtggcagaaatttcaggatttcaggtggaattcgagtgaaatgatttggcatccatcagaatagtactcttgaaggttatattataaaatgactgcattggaataatctgaggatgtgactagtttcatttctctctacagtaattaatttcctagtgactgtagagaattaggcttgttttggcagctaaatatgcagtgacgctcagcagtacatagagatgtttcactgtaaaaatatccacatgtccctgagataaaatcctaattcaaaataaaataactggagacaaaaatacataaagtgcctgatgcctgcccagcacactccgtacttcaagaatttggaacagcctatatttcaaagtagtactggggtgagcaggagtgtagacagtatagcaaatctgaaaatagtgcatttttctgtttattctctacaaatggctccagttgatgaagatggtgagctttatttttgttaatgttagccagcaggggtaaggtatttagaaattgcagattcggaaaaatattgtccataagaatattttttaaattatgtaaaacagatataactgcataatagcaaaaaagctagcagaagcaatgtgtcagaaaattattcgtcacagagatctaaaaggctaaatatggcaaatttctgaaaaatacaacataggattactatttttaatatccaatgaattggattagttttacatatttaatggaaaggaattttattcatttttgttggtggtgtgcaaagcttatttcaactctattttgtgtaaatagtctctgattttctgctctatattataatcctgattgtagtgtttcaggattgtgatgggttttctttgtgtctctgcatgaaaagagaagagttaaaagagttatatggctacttcaaccttaaagtgttattactggtaataacatgattagaacaaaagcgtgtttagaaaaataacatttactattttgactcaattattcatattgtatattttgctagcagagatccattgacttagaaaaatacttctatctttccctatgctgacgtctaaaacagccatttttaagagcagttcaatgaatttagttctatttcttattttaaacttataggcagaagctaaatttagtaactataaatatatgacatttaatatacttttacaactatctctgtgcatatcaaagccattagagtcatgctcatttaagccggggttgaagcagatgtacagttatcatagcaggaggactggggattagggtcattttcttcatgtagataaactgtgtttgaagtatggagaccacatttaaagaaagagaggaagagggtggttgagcaaacctatgttcttttatctgtctgtttataagccttgatttattcatgatataacgatattgtagaacatagctttgaaaattctgtactagaaaaatgaatttttcctgggaagtggacacttctgaagctgtgaaaatatttaagaggagagaataaagacttataatctagattttttttctcaaaaaatccttctaagttatatttatcaaaacctttaaactatgattagatacaacttggcagactatggatacttcccagtcaactgataaattatgttcaaaattattacttattatgacataatgaggggtgtgggagggaggttcaagagagaggggatatatgtatacatatagctgattcacttcatcgtacagcagaaactaacacacactgtaaagcaattctaataaaaaataaaatttaatagcatgtatattgcatagccaacactttacactggagtattagtaacaaaacaatagttcagtaatcattttttaaaataaaacaggcaggattatgactaaatgaggcatctcttgattgagtctcctctctcaacaataatttggcatccacctatagacaacagagctttttcgggagctgtagaatccaacatcatatggcaaggagtctgtgcctacccatgtatctgtaacaggtatggagaccttggtcccagctgtgggccctgcagtgactcatcaactagctccatcctctccaggcagcaatctggaaggcactggaaatgattgtcttagacaaccacctacagatgacagagcctttgttgaagttcaggtttccagcacagaagttacagcacagtattggagcaagaaagagaatataagtttaaatgcataggaaggatagttagtaaagactggaggagatgactatgatttcaaatataaggaagcaacacaaaacttcaaagaacatgaaaaatcaaggaaacacaaaactgtcaggggatcacagaaccttccagtaactgattcaaaagacatggagacctgtgatttcgtgttagagaatccgaaacagttgttttatgaatattcagagagctacaggaaaatatagaaatctcatccctcaaaagcactaaatatgtgacatgctggatattatgtaaatatataacatgctgtattaattagctagatagggagttatttctcaatgtacgtatgtattaactcaccatgatgtacactttaaatattttacatcttcatatgtcaattatacctcaataaagctgactttttaaaataaaaaaaatcaagatgctgaaaaaattcaacaaaatcaggaaaacaatacacaggtaaaatgagaagcttaacaaagagaaatcaaaaaagaaattgaacaaaaattctagcactgaagaacacagtgaatgaaatgaaaaatacaatggagggcatcaaagacagaatgagtcaatcagaagaaagagtcctttagttagaacacaggaactttgagattatccagtcagagaacaaagaaaaagaatgtaaaataatcaaaaaagactatatgagccacataatacta

SEQ ID NO: 34655 - DNA, 1859 bp, Bovine  19866881068244
ccatggaagccgcattctcgtggacaagaacctaaccaggctctttttggatctgcacactctgggttctgcccacacagacccccacctgtgtgacttgctggagagccacatcctagatgagcaggtgaaactcattaaaaagatgggcgcccacctgaccaggcctctgcaggctggctgatcccccggctgggctgggcggtctctctttgaaaggctcacagtcaaacacaactaggaccctccaaagctccaaggcctttgaggagccctcaggtgtcagggcggagaaggcaatggcaccccacttcagtactcttgcctggaaaatcccatggatggaggagcctggtgggttgcagtccatggggtcgctgagggtcggacacaactgagcgacttcactttcacttttcactttcatgcattggagaaggaaatggcagtccactccagtgttcttgcctggagaatcccagggacaggggagcctggtgggctgccgtctatggggttgcacagagtcggacacaactgaagcgacttagcggcagcagtagcagcaggtgtcagggcttctacctgaaacccctctctgtggccacttaggcagttttttaaccatcctggagccctctcacaaatcttggaccaaatggaagcaataaagatttttgcagacaaaaatttccaattcaattcaatcaggggaatattaaaattatacattacaattagcaagtcaatccttgattatgcctctgatctgaaacattgtcttgaaaacagagaaggacaatgaagctagaagaaaagaacacatagagagggaaggttctatctaggtgggtcatatcttaaattaataatagtataaataaaacaataactataacataccacttataggtctgcttagtcttttattagcctttagttaagattctgattctacatccaatattggcaattaaaaaatgaataatttagtaggtgcttttagaaataatattttttcatgaaaaaaatcttccattaatagtgattacagagcagtagaagttaagacaggtagattttggatcgagagagacagatgatagacaatcatacctaggtagctattcagataaactgtaagctttctgatatggtgttaaaaataacactaattttcctgggcagagtttccactatataaacattagtaaaacttgagttatgtttcaatacatgatttctgcaatttatttcaaggcaacagaaaaccactaaatggtcccccagtgtaaggagaatttaaatcatgtcatttcttattaaggttgtataaagcacctgtcagcaacattcatacacctacactagtaattactggtattgatttgcaacactccaggatttctcaactaatcttaaaggatgtcaggaaattatcaaaacaaaattaacatccttaatttttagaaaaatatgtctgaagactgcaagagaaatcagggaacatagccaagataaaatattacactttgaaattgcaggaaatcaacaattattacctattgtaagtaagcaaacgggtggctacaagtcaggaaaattactccttcaagctatagaaagatcatttgcctgatacaacagctccctccagtggcagttaatggtaacctgaccggctggctgctgctactaagtcacttcagtcgtgtccgactctgtgcgaccccatagactcccccgtccctggggttctccaggcaagagtactggagtgggatgccactgccttctccgactcaggtgcaaatatgagcaaaggaaagaacaaagacgctcacacggggaaggggctt

SEQ ID NO: 34656 - DNA, 2880 bp, Bovine  19866881092492
ttgttaatgatgctgctgtgaacaaggagtgcatgtaacttttcaaattagtgtttttgtttttttcagacatatttccaggaatgaaattgctaggtcatatggtagttctctttttagttttttgaggagtttccatactgttctccacagtggctacaccaatttacatttccaccaacagtgtacgagggttccctttttctccacatcctcatcattctttgttattcatgtcttttgatgacagccattctgacaggtgtgaagtgatatctcacactttgcttttggtttgcatttccctgatgattcatgatgctgagcatttattcctgtgcctattggccatctgtgtttcctctttggaaaaatgtctcttcaattcttctgtccattttttaattgggttgtttgcttttttggatgccaaggtgtatgagctgtttatttatgttagatattatccccttattggtcatatcatttgcaaatatcttttcccacttcagtagggttgtcttttcatttgtcaatggcttttttttgctatgcaaaagcttttacatttaattaggtcctggttttttttgtttgtttgttttgtttttgtttcctttacattaggagatggatccaaaaaaatactgctccagtttatgtcaaagagtgttctgcctacatggtcctctaggaattttatagtatcctgtcttacatttcaatctttaatccattttgagtttattttttatgtggtgttagagaatgttctaatttgattcttttacatgtatctaggacaccttgtatttttaagattagaaaaatgattaaattgctaacattaataaataaagtgtttctctcttcattcaagcagacttctcactctcctccttgacaaagtgcactgaatagtacagagcatggtgccctaataaaggccacacagaaacatgagctcagtcagtagaacccacttccagagaatacatttacttatattcttgtctcacaggcggcaattccctttctgaccaattttctagagaaaacttttctttttgcgaagcactaattagctaacctgaagattctcatcagttgagatcaatatcaatcaacatcaaatacttgatgagacacatggggaagatcaggtctatttggtttattttcaaagtctttatcatcgacatcactgcccgctttcttatataaatatatacagcttgaacaagagactgtgcagaagtatgtaagttaacttctgtatatctagagattctaggacatttaccactaccactttttattctaaatactttatatttctgagcatgacacacattctttcaagttgagttcataatatgatttccagtgtacagataaggaaactgaggcattaaaacagtggttagagcactaattgtccttcacagttaggagactgctgttgacagtattaagagagacaacaaggcaagtcagttactgagctggattaaaccttcaacttctcctaggtttacgcttgatcagggaaccaccttgtcactcccacaaggtcatggaggtgggtaaactttttacaatgttgctgactttaaaggagtcctatctttatttagttaaccctttatcttggcccttcctatttgagatcagctgtctacatatttccatgtttcgagtatactcaagagcaagactgtaaagaatacaaaaataaatcaggacataaagattatcagcctgaaagccactaggagacaaaagaaactgccccaaagaacaagggaaattaacattctttcctatccacctggcaagaactaagatcaaaatgaactgttggcaagctctgttaacatggaagcattaggactgtagggatcctataaaatattctagcactattaatattaaggtttctaaggacccttttatcaatgatcattcttccccgttaatacaatgttttgtaagagtctccttatcaaactgccttgaattctttctggaaaaaagaatatggaatgaatgaatagttggataaagaatagaatatgtgcaagctttataattagacagaccatggcattgaataccacctttgacatttgttgctgctgctactgctgctaagtcacttcagttgtgtccgaccctgtgcgaccccatagacggcagcccaccaggctccgccgtccctgggattctccaggcaagaacactggagtgggttgccatttccttctccaatgcatggaagggaaaagtgaaagtgaagtcgctcggttgtgtccgactcttcacaaccccatggactgcagcctaccaggctcctctgtccatgggattttccaggcaagagtactggagtgggtgccattgccttctccgtgacacttgttaggtcatgtttatctgacactgagaagttacttagcctctctgagccatttaacttctatgagccaaaagttctcatatgtttaaaaaataaataataatatctcctcttatggtgattaaatgagactacatataaagcacttgacacattgtagacattcaataatcaagagctattaattaaagcttctcaccaacctagattaccagtaaaaccattcagtatcaaggggaggtgggaggaaataaagcctgactatctttatcacatataaataaaacattctattaaagcattttgaaaatagtttgcatttattacttctatgatttagtgggccaccaatagattaaatacatgttactattccttacctctttgtacaaagaacaattcattttacaaatgtgttgaaaagaaataataaagtttaaaatttcttatctattctcaga

SEQ ID NO: 34657 - DNA, 2211 bp, Bovine  19866881094142
acagtttatgagatgctttatgaaaagaacataaatgaagtaaatttagttacttctgtcttccttattttatacgtgctcctggatttctggattccatgggaaccacagaaaagagatatgttggaatatgtttagtttttttttttaaggaaaaaaacactattcccattcatcattatttttcttctgtcaacgtgaatttagaaaaccttgctactaattttgcaaaattgtgattttaaagattctaaaaacctgagtgctttctattttacctagaatttttagttaccatgttacatttggtgtgcttcaaacttcattgactaaataggaattatctgttatcattcattatgtaggttagtaacaatatgagacatatgcctttagtaaaaatgcagcaggaagggctacataatttatgagacccagtgcaaaataaaaatgtgaggcctcttctttaaaaaggatgaaaactttctggacagttacaatggagccttaaaccaagtttaagacccttctaagtgtgactctatgtattacttgtccggacatttaaataattcactttgtaagaatgaagagtgcatactgagacagcaatgcccaaatcaattcacttagatattcccccaaacatttctagtacaggtttcccctgatatccaaaaaaagacattaccatgcaaactttcatgagccaaaacggagcaaagcaaagaagcagtaccttagaatacatctcgctaacagatgcacacaataaattgagaaaaattatggatgctcacagacacaggtccgtggcttgatgtagaaatgttgagtataaatcctggggaaggcgctcagtggtgccctctcactgcaaggggaacccagtgcgtctccaacactatttttactttttttcataaaagtaaaaattctcttccattctggaaaagagacactgatgaagatcttcgataaacaaagtggcagaaaacaaactttcaaaaagcaggggatgcctgtaaatattattggcatacattgcctagaatcactgggaaacaaaatgttatttaacgaatgtcttacatcattttaaatctaagcagtataaactgaagtaggttccacagttcttttttttattattattcagttgttagtacttggttctatgaaaagttttgaaatttaatgtagcactgtaaatttgaaacttttctgagctatatatttatatgagatatattttgataatatgtttatagtatgcatatataagaatgttttatatatatatatatatatacttggtatacttaaaatcataaaaataaacaaattgaaattgctgtttaaatttctttaaatagaaggtctcatgcttcttgcctaataagagataattgactgagtaaggttaaagcattgttcattcatttagcaacacttattaagtacctacaatatcccaggcaatattacaagtgctgataatgctgcagagaacaaacgtggtgcacagctgcatgaaggccagtgtctataaagagatgaatggatgaataatatgtggtatacacagacaatagaacattattcacctagtatatatataaaaagaaatggcaaaggaaaaaactattgtttaattccactgtgtgagatgcttagaataagcaaatttatagatacagaaagtagagtagaacttattaggatctaagaataaaggagtgaatttattgtttaaacagactttctgtttgggatgatgaaaaattatagaaatagtggtaaaagtacttaatgtgttaatacacttaaaaatggctataataggacattttatgtacgtatatttaccatgatttaaaaaaaaaaaaacttcacaataatagagttgtatgcatctcaagaacactggaaaccagaaagggcaggcaagtgatcagaaaaggaagatggaaatataagactattttaaataaagaagcaaacaaatacatgtttgcctatttctaaatttaaataaggtgttcccctaaatatacagtttaaaataaatttcttttcctcaccataatttatgatccataaatgtcagaaaaatatatcccccttagcagcagaagtcagacaagatcaaacagaatgcatttggggtgatggtttatattaggatattagtctttgagttatttgttt

SEQ ID NO: 34658 - DNA, 1258 bp, Bovine  19866881138562
ggcctgcaaagcctaaaatgtgtattagttggccctttacagaaaaagtttgcagaccctaatacacagtagacttaagtctgtaggaaatactatttcctcagggagataatattgtttcaggggtttagagcaggtttcatagggaaggtaacattgaaggataagtaaaagctcaccaagaacaggaaaagaagaaaaatatcacatacagaaaggcacaagaagagagaacactgcatgttaggaaaatagaaacaggcagagtccatttggtatacagggtacttggcatacgccaagcgaaagaatggtagagaatcctttcactgacttcccctgcctatgctgccctgttcatgtcaacaaggaataaaacctacaattttaatgctgtactctaagggaactataaatagaaaatgtaattaggctggtaaaatagatgaaggttatcttgtcaggtgtctgaacttcatcctactctgaattggaaggttatcatttatcataaaaagttaaaatactaaggtttatgaatgagttaaagttttctgagattagaatagtcaatgttttccttttaatgttattttgatttgtattctgacaagactttctgaatgagagaacaaagagtgagatcacactctttacccaaatgcagacctgcatataatcctacatattcagatggacattatgttgtatgtttgaatgccatgcaactaatcatctgtcacagaagaaaaaaaaggctgggcaacttagctgtaggaaatagtttgcagatggaaattgttaagccagggaaagccaagtatgggttttagaaagtttaagtccactgacaggaaaggaagatggcccaaagcacagagatacaacagggagagcagtctagaggtcactgagcaggttatttgaaagacaaagtttaaggaagaagcacagaggaaggacacaggttcagtatatattaagaacacactgactagcaacttatagtggtgtgtgcaggctcagtcgggcccgatcctttgcaaccccatgcactgtagcccgccaggctcctctgtccatggacttttccaggcaagaatactggagtgggttgccatttcctactccaagggatcttcccaacccagggattgaacctgaatctcctgcactacaggtggattcttcacccctctcccgctagaggaccacaaagtttgtagcatagagactgtgaatgtgagctgttaaggga

SEQ ID NO: 34659 - DNA, 673 bp, Bovine  19866881254364
tgttcgggcccagcgcacattctccttggagtaagatctttgcatgcaaacgtttttcattaatgacatatttttatgtagttatttactacatagaatataagcaactctttaattcagaggatgagtagttttttccctatttcatcaaataggcactgaacactcctgataatatactgtgctcattaaggtttatttgggggcttgctgagtttgccgttggttaactgcactgtttggcttaactgtcaggctgtggagcaaggggtcatccctttaatctctcccctgttgctcttcttagcaatatgctacctgtaatggtactgggctccatgtgccttgttctggtccaagagttagttctagttagcattctttttcttgcaaagaccagaaatgtattcaaaccagtgcaagtattaaaaggcttcatgagagaatataatgacttctcttggacataaaatataggaagtacgaatcatctcagaagaaccagaaaattgtcatttagttactcctattgtccccgtgaaggtgtcatatctttgtgaatggaggtgtaatctgttctgcttttcctgtaggctctttctgtgtgtacttagaatgcacatatgcacgctcagtcacttcagtcatgtccaactctttgcaaccgtatgga

SEQ ID NO: 34660 - DNA, 842 bp, Bovine  19866881420223
tatatcactaacattagaaaatatagtacatttctttaaaaatttttatatcttgttgaagtcatcacagagaaaatttacttagtgtatttataattatacaattttgaatatctatgatatttgtttctactgagcttttcttcttttccaaaacattatatattttaaatttaaagaaaatgtgcctgcttttattattattttgagacatttttctccatagtaatctttcttattcccattgctccattgtgaaacttttttttaaccttaattccatctgtagtgcctttagttccttctatttttgtatttttaaattcttcggggcctccataattttcaactaatcttcttgcataagattaaatttaaactcctccttgtaatgatataagatctttaataaatgatcttatagcttctaatgtattatgttgataattatcagcggcactttaatttttgtggaatttccctctcctctctaaaaactaagaaactaaaatgagctcaggggtttagatgacttgttcagagtcacagatcaaggaacaaagatctcctgatactcagaaccttaccccatgaatcaaacacatagagagggctgtaccccaaatctcccagccccattcctaaagacctcagtctacttaaggttaatttttaaaatctatctaggatggcatttgtaaattgtcagaagcttgagtagccgctgtacaaaaagccttcatgtataaacatctccgaaacaggcaaatgatagataacacatgagcattttttatcttcccagcttcagccttttgctagcttataaattttttagaggg

SEQ ID NO: 34661 - DNA, 436 bp, Bovine  19866881820724
tagaaatgacccttgtcatcactctgaggatgtggggcagaagaaacaaatgaaaagacacacccagaagatggtttctagaacaggccccttggataagagatgagcccctgcgactgtgggccacatgggcgcccagggcattgttcccactgtgtgtgtgagggcgcagggtggcttcaggataacagggctgcagagaacggcagcagctcagctggcccaccatcccgaagtgacgagagcattgcctaaagtttcctggctaagcacactccctcagtaacatgtttcagattttgatgttgcatttttgtgactataaagtccttcctgtgcacatattatagggaataaatcaagaaaaatgttttcagtatacgatgtccacacagtttcttcgcccgctgtttagctgttgttgggaaagacttca

SEQ ID NO: 34662 - DNA, 891 bp, Bovine  19866882264666
ataaagcatgagaaatatgcacttactgtaactattgaaactagagaactggtattgatttgatttccccagagaaattgtattctttcgcaaatagtaggtttttatttaattttactgaggaacaaaacattatcatctttacatggtgggagaagtcattaagctcaaaacatgcagaataacctctcctggctacaaatattcagtgggctgcacagaagtgtccgtttccgttttaccactgataaatgatattctcccctgataggaatctcagcaacatagctcctttggttcaaaaagaaagaaaggatatgaaagcaggtcatggtcacaagacctgtgtttatcttatgaagagtaaatcagtaaacaggagaggaaagctttgtttatgcttgaggccatgaagattgggaaatagtagcatgcaaggccaaagatgacagttgggaaagtgtgggtgtgtctgcaacacaattcacatgtgaattcgtgcacattcatgcagcgttatgttcatgaatatgaaaaggcatgataatatatgaatatatgtaaacactcagagacacactccatctgattgtgttatgtgtgtatgagggagtgaatacacaggcataaatgggaatatcttaaccatattctaggcctggaaaatatcctaaaaatgaaaacattaaagtttatatgaattcacagatgggagaataacaaaagcttagtcatagaaaccagggtgtctttttcctatttctacattttgtgattgacgttaagaaagataaaaagtcttttgctctatgcagtgctctcctttcattgggaaaaaaatggggctggtaggctttcaatgacagctcttacatggatctaaagtaccat

SEQ ID NO: 34663 - DNA, 1837 bp, Bovine  19866880415157
tcattaaaaaaaattctttccttatttcatccccaacatctaatccattagtgagacccattggctttaattcaggatacatcccttaggtattggcatcttttatttccactgctgtcacccccggctaagccactctaacagctcttatggatctctctttgggtacttgagaccagtactgctttacagacactatttggggaagatatttgtattcgcagaagaatgcaattctcatggatccaccttctggaaaacatagaagccatctgatctatgctgagagcagtaccaaccacatggagggcatccacaaggattttgtgaatgaattacacttattaatgttttctaataacaactccatggggcaggtattattaatacattttacaaataagaaatccaagtatctttatgtaaaggatttgtctttacacaagagagtggagattggttggatcagtgcattttgaggaatttcatgaagcagagctatacttaaaaagaacaataaatcaaacaaatagggctccactctgccctcaatggcaacactgccattcccaaattctcttccttttacatctcactgaaaatgtctactggattttctcttaaatattttttatcttacttttcctctactaaatttcagtggtgatggatggaatttttattttgtataaatataaaaaataattaattaaattatttattttcaaaattctaaaagaccagtgtatttcccactctgctaatattctgaagataaacccaaacaggttgttatgtgattttaaatgcagagatttgttttataagcctttaaacatgagtgacattatattagcaatttttatttccattgtcagtgttctcaatagcagcaacaattttcatttgcacctactttacattaacattgcattacattaacacggtatttatcgtatcagagtatgtatttagaagctgaacagacattcaagtagggtacttcaaatagatggcagattttgtaaccattaaaacattttagaaaatcaaatatttgtgtctgaactctccaattattattttctctgtcatccaaatgattagcataaatgaccattaggacacatgaatcaaaatcaatgcaacattaactcgctagagcagagtactactcaaaccgagtagctgatgtggtaggtaaatgggaaatgggtgagaagtcacccagatacagtgaggttatcctccaccctcaccctcattccccagatgctcaagatgataactcaaggtttttttcttatgtggaagaagaactggtaactctaagacctatcaaacctggattgttgggaaaatttgaaatttagctaaggctcattggatcagattgcaaacaataaaatgatcatgaatgcccttgacgagaaggtcacagtggagtggcttaaattcagtttcctagtagaccatttgcagcaatgtggagaggtactgatgtgtgaaagggatgctcatgtttgaatacacatgactacccactacccatgcctgcaagacggcagtgatatggctttgctaatattctcatctgtaattttctgctttaatagaacatagatgtttgtttataccaaagaccgtgactgtgagatcattagctgttctatgtttttaagtttacacaatgagcatgaattacactaattgaaaagcaaaacaacgtattatttaacattttaaaactagtttttgtatgtcttagccataaattatttcaataaacttgtttccatcaagaatccaagaagcacaatgataacaggagtaaaca

SEQ ID NO: 34664 - DNA, 1619 bp, Bovine  19866880473529
gagttagcaacacaatatcccttcataaatgcctttatgcgtcatgaacttagtgatatttggtctctgttgttgcaacccaaagccttgacctttacaagactgattcaaatataacatttgatttctatctagggacaacgagccacaaaaaatctgcagtggaaaacactgcagattcttaaaaatttttgtatgattattttctttactcacctactttttcacgtaacaaagtaaaaagtagaaaaaagtgtagaataacttccactcatggaaaattaaaccctttgcagggacataaatttttatctacagagaagaatactgttgaatttctcttgtgtttagtggcagcagagttctgcgtttatgccttccatctgggttagtcacccttttcttcatctagttagttccactgctggatggagctaacctgcaggcgcaggagaaggtgaagagggtactttaggtcctgcaggtaaagtgagcagagagaataggacttcattattgtctggccttcaggaggagtattgcaaagatcagcactttccacactgtgaagtttcactgtcccccagcatacctcttatatattaatatgctaaaatagtttctaacacccttttaaagtcgaattttggaaggcttccattttattattcaaacttccaaagtctccagatttctcaaaatggtccttattaaaaaacaaacaagccaccctctgtaagtctgagagaaaggagtatacctctctcttatccttatgctttctagcgtcacaaggaaaggagctgtcttttaagttgacaaaatacagtgaatgctctcatgtcagagtagctaaatacctggagtttggttcttaaaagtatactcaaatattttggcctctattttgattttggtgaaaatgtcctcagcgaatccagcaagttaaaagcaattaacagcccaatttcagtcgaaaattcctttgcacagggctagtgaaggttaatgcatcgcctggctgttcccctcagcccactttcagcaccaggtgcctgggtggacttatgtattctgaagaagataaacatagataaaatggtgggattcctttaatccatttaatctcttatgtattgagaatagagagtggtacaaagatctattttgttcaaaaagccaagtcatacaacatctcgaagatggcaaagtaagaaagagctgacatcatgtttctcaatttaaaacattgtgcaacaactactggagcaaaagcagaaaggttttcaaggccaaataatgacttttagttgctggaaggcatccacgctcaacagtctgtcaggaagagacaggtggggctggctcaccacctggggtgcaggctggtacagggcttttattaacattactgcacaggagcggagaagataaacactcagtgggtgtagtgaaaccaccaggccatatgtttggcctgaatggaaagtctccttctccaaaataaacctacctaaggcaggcaccatctttaaaaaagaaaatcttgggtaccaggcaaatgcattccaggatttagaaatataatttgtatgctgctgtgtcttcagtgccaatgt

SEQ ID NO: 34665 - DNA, 830 bp, Bovine  19866880543219
ccagggatcaaacccagggtctcccacattgcaggtggattctttacgagctgagccacaaaagcctttgcaaaaaacctgaacattttttttgacacactgataaaaaattgtttactgagttcttttgtttgttctacaactgtttgcacccaaatagaaggtgtttttcctttgaaactgtgtatgtagtccttgtgattactgccagagatattcttttttgttatttttaagtttcaattcttagaaatgcctcttttcctccattgcattttttctatttttaaaatgtctttgtgaatgactttagatgtgtattacaaattggacttcagaggtctgtgctggcgtacctgactgaaagtcttgattgcctcttccagtgtatcaagtttaattaatagccatgaaaacttcagactgctctttattttaaattctcctaaatgagttgcttttcagtggtgctagctaatcccttgtaatccaaagtcatcaaaaaatcatatgataatgcttttcgtataatacagaaataatttacagcattagtcaaacagtttcaaaggtgtcattatttgataattaccccaccccagggccattattgtactacataatgtgactaatgctctgtcatttttttctgctgaaactacagccgcaaattgaagagtaacacattctggcctttggttttctcagtcagcctgaaaaaattggttgtctttttcaactttagcagcttaatatctcacttcaggttttgttgttgttttcttttttaattcataaatatgtgatggtaacagtggagataacatttc

SEQ ID NO: 34666 - DNA, 3633 bp, Bovine  19866880611844
aaaatattccctcagccctttgtacctttcaaaaatatcattactgtacctggcatctgactggatgtacccaacaagctttatgcaccacagtctctgaacacatttaacaaagttctctttgaaatagctgcaggtctttatgaacctgatgaaatatgacaaatacggaggccagcaggtttggggtgaccagtttgctaaaagtaaatctgatacctgtttggattgccacttccaaacatccataaaaaggaattctgcctaaaaccatttattgctgaataggaaaaaagtttacactttgatgaagctgagtaatacacacacagagctactattctattcatgttttgtaattgctttaagtccacaagttatttttaaatacatatggcagaatccatccccagtgatccatacctttatatgatcccctgcctttgggagggacaggtgaatgtgagctagcactcctgtgattaggctatgctatgtggacagttgactttaatgggagactattctcagtggacatgatttaatcaggcgagcccttgaaaggattaggacactataaaagagttatggggatgtaatgtacagcacagcgaccataattaatggtcttaaaacttctcatcagggacttccctggtggtccagtggttaagactctgaactcccaatggagggggcatgggtttgatccctggttggggaactaagatcccacatgctatgtgtccaataaataaataaaaacattttaaaaaaaagaaaactcatcacaagcaaaaaacaattctgtacaagtaatggatgttaactggacatccaggtatggtgactatttcacaatgcatacaaatatcaaatcatttgttgtacacctgaaactaacataatgttatatgccaattatatcttaattttaaaaataaaattttttaagaattaggtgtttgggttcttctggaggaaataagaagtgtggcaaggatttgctggtgaaatttttctgttccagctgttccagctttcaaaatggagaagaccacgtggcaaggaatgcagatggtctgtgtttgctgaagcagcccctagctgatggccggcaaagaaatatcagtagaaaccactgtcttacaactaaaggaaactgaattctgctacaaccatatgtgcctagaagaagaccccaagcctaagatgaagacacagttcgcctgacatcctaatttcaccactgtgagaatcttaagagagcccaggtacctagtgcttggacttctgaccgacagacctgtgaaataagtaagtattgttttaagccactaaatttgtggtaatttgttatgcagcaatagaaaattaaaaatatcacacatacataaccacagcaagaagctgaaaaacatgacaaacatatgccctgtttatttacacttttattaataaagacaatcaaaaaaggataaggtttcaatattttattcaagttttattttaagtgatgttaattacagcatttgaagggggagaatctaattccacacaaaatggaactctaaaatgtacccattaaactgctaaaaaataaactttagtggtgagaatacaacagaagtccaatttagattctgagtgttgtcaccatgtgattacagtcacagagactcttcccagcttgcagctggggctcttagaagctatttcatactctggtgcaagggcaaaaaaaccacaacgtgagagggaattaagtcctgaattattggcttcatcacaacttctccaccccaaaatggcacaaaagaaacagctaccacatcctgcagactactttttgtgtaaaagaggtgatggatggaggtggaaaaagtccctgcctaaaaaagtccctttcagataagtttgtacacaccatcaaacaaagagcctctcctcaatcaattaggggaggaaaccagggttcaattctcaggaagttacaatttcattcagttactcaataggaatttacaaagtgcctgcaaattatcagcttccacttgcagccatttctaggtaaaaaagaaacctgacatctctaatggggccagcaagctccccaccaagtctacagctgaaaggaccttttttgaaattgggtttcttctgtacctctgaaagggtaacaccctaaagctgaatcatctttaacctggaagtctaacatgatatttagcaatacttgcatcccagacatacaacattaaaaggtacactaaattctgaaggtagctatgctgcaaaatagtttaaaattaaacgattgtacaatagtcatttatgcttgaaactccagtcctagaccaagcttgtggccaccagcattgacgttcttgccatccagcagagccgacagtgtcagtttgatacctgcaggagaaatcagggagaggaaaggaagagagaggtaaaaaagaaaggagaagaaaggttagctcaggagggtcactgcagcacactggagacaccacatcaggttcaaaacctgttccagcagtgtgtgatcagcaggagcaaaaccacagggccctcaatccctgttactcaacaccatctgactaatgactaggcagcctaggatgagctgataaaacaataatgattcttccacagctcacccaaagccacttaagggactctgctttcctctatcctctcaatatccctgctatagtcagcaccatgcagtaaacttctttagcaaaagccccctgaaacaaaaccctagccatgaatcagactccaaggtcttaggctcccactcacagcacggatacatacacacatacacacatacacaactaaacgctattttctctagaatagcttgattctgccatcatgtaatcttagatctccagaattcaaagccccaatttaatcaaactaacctcaaggtggtattatttcctatagctgtaacattaattcgatggactgacctagctaactttgcagaagaaacctgcaaaccagttttacaatgaggatgatcgataggctggttttatgaacttgctggaaataagtatcaagtattaggtatacactgggacaaagaatggaagaaaataactaaaaatgtaatatatgttagccttggccttttttctcctacttatcacctctcctgttctccaaatgttttataatgacagcactcctttataaacattcaactataaaatgtgatatacactcatttacaatgttctgtacagttatttataagcaattaacctaaagcagcaaaaccagcaccacattttaagacagctaatctcaccaatacatacctggctttagggtctgagtatatcctaatcctatcaggctggagttgttcactttagcctagtcaaggaaaaggtaagagtgaaaatgttaaatacttcatgttaccgtctccgaactgaataagagctttttaaccaaccaactctggatttcagcatcaaattctattttttcatgacctctttgtttacaggattcattaaattcaatatgaaatatattaagtttaggaactacgtctcagaaagtaacacaaagagataacaccattttcaattaaag

SEQ ID NO: 34667 - DNA, 2923 bp, Bovine  19866880671861
cttgatggaaggcactgtcttgtccttctttgtattcattatgtaatgaatcataatgcttattcaatttaactcaataaatttatgaatacataaaatacagtggttgagtttatggatggacaagcagtagcaactaacaactcccagtccccacccccacccgactatactccttgagaagtatttgtttaatgaaaaacatggacagaagagcctggagggctacagtccatggggttgcaaagaattggacatgattgagagactaactctttgatttacttttttttacatgagcttaaaaatcagatagaatcaagtttaaattccaactttgatactcattgagcaatttaatctcattgatccttattttttatatgtgaaaactgaggacaataccccttatgatatagggcttcttgaggattgaatgagtgaatattcatagataatctatcataatctggaacacagtaggcactcaataaacatgatcctctatttccccctaataccccagacttaatattccagttcttcaaactgggtacctagcaatgtgccaagagtgtcacaaagcagctggataaacacaatggttttcctcctgtatatatgtttttctatggatggtacataattgtattaatataaaacaattgttcagggattcttctactcatcaaatgtttttgagcatctgttatgtagcagcagcctgctgagcacaagggatagtctaatgggaagaaagaaaggaaggaagatggaaggaaaaaatcaaattccgacaagtgctgtgagggaaacaaagagactgcagagataaaaactggggttgggggagccaacctcttcagatagagtgtgcagagaaaagttttaaaagcagtggatgcaagttggatgatgagaagacagccatgctaagtgctgggggacaaacatttcaagtggaaggagtaggaacacgaaagtcacctgaattcttcaggtaaaacaaatgtcatctttgctggtttgacagtttccctgacttcctgctacatgggagtctttcagatacttaggaagcactgccctggagaagactttgaacaccagctgcaagaggtaggaatggtggataaaaaccactctcctttccctcggtatttaagttggcagcttccaagggctataactaagcatccagaataagctggcacaactcaaatatggagggaaagaatgtgaactagatttatatagctcttaagctttatgtggcacttgcattttatgataaagattcatacaaattaatataaaataaaaccaagtttcctctccgcatacactggatgctttccttttgcctcatgtgggcatactgccacaaatggtaatggcttctctttatatagccataggaaatcacaatttgaaaacgtattaagtgattgtaactttcactagtcacacatttactgacaagctctggttttgctaaagtaatcttaagagaaggagattcgagttgggtaagtttcttgaaggagggataattttatctcatttatctttgtgttgctaagaccttgcacagtgctagggacatagtagacgttcattactctgaattaaaatgaagctataattttcagttgagattggtgaggggcactggggatttctcgctcttgggcatctgtcactacagttaaattccagtgaaatggaagaatgtgaacattccatagcatatgcttctattcacggtcactggatttggctgcacttttgactacctgcatattctgcatctctaacacctgggaaaattctttttgagacagtcttcatactctcgataatgggtctaacaaaatgccgtaccacatgaagctgagggggcagaaagtaattaagtgcttccaggaaggaggaatacttatagccatgaaaatccctctgagactgtgcttagaggagctgtccctgctaccctaatgaaattatggagaaaaaaatgtaagcaatttcttcagatgtgaccttattttccttaggttttcaaatggttttctaaatggaagagaatttcttttcttttttacaatctggaagcaaaaatatatgttgtatgagaaaaacagcatgccagtgcaagattcaaaattcttgatagtgagcaacactggaatttggtctcctacttacaaatttgaagaaagaaaaaacacgccccatgagaaactgaatttaaggtcagattaagtcaaccataaccatatgggttagcatttaaacatttatattaacttttcaaaatgaaaagtcattagggaagtcataccatagtatgtaccactcatttccattttgactttttatctcacaaaggtcacagtatgacaggcacaaactcagaatttactccattgttatcatagcaaatgtttcttctattactaggctaaaatattttgtccggttggacagtttaaactcctttaaaaagagtgtagttacttggcgacaccgtctcttaatttgttagtgagtgtaacactgactggccttagaccactgcctccttgtgcctccgcttctattacactgggctccccatttatccctttccagtgactgagaccagaggaaaatagagatcataccattctaacacacaagaaagaatcataaggaatcaccttacaaggacaaacagtgaggttgagtcatggcatgtccttcttctatgtcatgttatatcttatgtccctatatactcaatagcctattctgtctgacctccatattgcattttggtaaagcatatagatagaagctcttgaaacctccagtcaagaagcaacaacgggaagccaaaaactaggggagctgacttcacatcttacaaacagcaggaaag

SEQ ID NO: 34668 - DNA, 1089 bp, Bovine  19866880723371
taaagtggtctcttttttaacaagcatgttaattaatgctgattgcaggatggctttgcaaagggaagtgaacgtttctatatgtttgaacgtagaatcattgtagttcattgctatggaggcaattcatcttgtaaggacaaacacgactctgtttagaagctccaaaagtgatttctcacttaacaatctcttgccaactccaactgagccatacaaaatactgcaaccaattacagttggtgacctttacagtaaaagtaaccctgaaaatgtaagaaatttttttttacgagaagtaaaaatgcatattctaaaggctcaaaacaactttaagttttactttagatgtagaaaaatgcctgcaaaaatatgcttcttgatatttcacatgttataatatgaaaagatactccacagggttactggagaagtgctatcaaacagtgttatagatttatttatttctatgtatctcacctttggacattttaagatgaagtgcttgtccttttaattaatcaaaagtgctgttcccttccagttagctaggtcactcagatctctattcaacatttccccccagttctttggtttacttctagtactgaagaattaggtctggtaattaaatccaatatcagcagagttttgtcaagtttatttaggttccatgcaaaatggaatcccttagggagagagaattaatatattgtgaaatataattgcagagaactatatttaagttatttttgaaaaaagagcttagagacttcccttgacttaattcagcttcagtatctttatgcaaatcttttcatttatagctcccatcctttataattagatgtgttcttatattttctgctgactttctgcatcaagaagctgcttttgtcaatgattttatataaatcagtatgtctcccactgattcatgtacacatgtagacatatgtcaacatatcttgatattttaaatatttttaaaatgagacaattattgatataaaaagttagaatgtatatataaatatataatgcataatacttgtagttatatcatatatgattatatacttttaacat

SEQ ID NO: 34669 - DNA, 1708 bp, Bovine  19866880764250
tccttgcctggataatccctatagactgaggagcctggggggctacagtccgtggggtcacaaagaatcgagcatgactgagagactaagcacagacttgctcgagaggtagggtagccataaaccttcaatttgtaaaaaaaatcgcaatgcctgcaaagtgcaataaaatgaggtatgctgtgtacaactgtgtttatttcctgagactgctgtaacaaattaccacaaattggtggcatgaaacaacagaaatgtaagttttcactgttggccagaagtctgaaatcaagttgtcagcagggttggttctttctggaggttcagagggagaatttacggcatgcctctcccctagcttctcttctggcaatccttagcattccttggttttaaatacatcattccatttgctgcccctgttttttccctctggtttctctcctctgtccgtatgtctcaaatctccctcttctttttctcataagaacactaattattggatttaggggtcacccaaaatccaggatcatctcatctggaaacctttaacttaattgtatctgtaaaggtcctatttcctttgccatttgcagcaaaactgatgtcctcagagggaatcgtggtaagttgaagaagtcatacagagaaaggcaaatactgtatttatcacttatatgtgggatataaaaaaccccacaaactagtgaataaaacaaaaaagaaacagtctcacagactcacaggatacagagaacaaagtagtgattaccagtggggagggagggacagcacagaggcagacagggagagggggccattatgaggttatatgaaatcatatatttgaaacttctgaaaattatcagccactacagaatttgaagcatcttccattcactaaattaaataaatactctatttccaaatgaagtcacatgtgcaagtactaaggattatgacatggatataattttcaattcaacccactacaacaaccaatcccaggtggaaaaacaagtttttgtgatgtcaagggggccaaagacaatgagacccaaacttggggtaagtgttcaaactcatgcacttaagaaaagaaacaaatctctattcaaaataaaatgttcttttgtactctccattcagacttcttctttaagctgatggaaatttctgtttttatgtttttcttcatgctgcatttttataactttttcattaaatagtttaaaatgacaaaggttttcagaagtgttgaatcatcattactttttttcttttccttcagcaataaatcaaagaaaatagaacattgcctgttttgtttgcatatcttttcctctctttattgcaattttatttacttggtgaatttaccttggcatttccatattttcagttcacttttatttacagttttgaaataggactttctgaaccatgaaaagggcaaaaaatcagctgaagttctttgataactaaatttgatatttgatcaagcaaatatgtgtatctgcttaatagtttaataatattaagaacattcactgagaccaaactttagttttactttaagaacttaaaagatctttataagggaattaaagtactttaaaaagcaatttgcattttggcaaccttttgtctacagatctctcatcagtaagtgacaaataacttggaatctaactttatatttttaacg

SEQ ID NO: 34670 - DNA, 1700 bp, Bovine  19866880864979
cctactctatttagagtaattaccatatttcacatccatcaatacagccaggtattgctgtatcttctcacagacctatgagtcccactcactatgaagaggattgagcgtggtgaaggtggaatttaaagtgtaagggttcctggagtgtataatgcttcaaactctgaaattataaatgatttggaagatacacagttatttttgtggttctagtatgttactttggtaccatgggagttcataaatacagatatacaaggctctatgatatgaaatgataagtcctttccccatgtgcatcagtaacaaccaactttttagtagaataatattatatgtcattaaaatagtgtccaataaaaaagaggtatggaaacaacagactgatttcagtaaaaccaactagaatgccactgttaacttccacgtattgtaacagaagttttaaaaggatctatttctctggaaacagagaaaaatagcaaatatactctgagtctggagtcaacataaaatatttacaagcacagcatgacacctgatatgcttcaattgtgggaatttagaattctcctctgctatgtttgtgctgggaaatggaatgttgtctccatgttgatgaacagttataatggaaatgatatgggctggagttacattagagattcttagagtccctttatttcagcatatttctatgtgtaatgaacccaaaatttaaaaatacttgcatttttgtggtagttaagagataaggtaataggacttctatcatactgagaaaaaggttagacttgcttcaggtataaaagataagcagtaagactgaatgaatctaaatgctttctaagaaagaaattttaataacataaaatgataatttcaaataaaatctttgtaagacaaaagacagataattctcatattaaaatgctgaaaattacagagaaagagagaggaattaaaagtaacaactacatacagctgtgacctaaaagttaaggtaaaaatgatgtggaggatattcatcgtgcttcctgcacatttgcatatgcagtgctttggaaatactaattaactgagagtaaatttgtaatagttctgaattctcccaccacaactaaactatttgaaactgtatattgcagttcaaaccctggcacatgaattacaaattaattggtccagtactcttatttctatggatgaaagaagtgaggctaagagaagttgagagatttgaatgagtttacaaatttttgatgagtgaaagtaaggacatggttgaggcttcttaaaaccttggccagccatctctgcagaccaagtggttagttcatgctaatttctattatttaacatttacaattatttatgctgcaataaaaaaaaatcaaggtaaagtaagcatttgaaaaccacttgagaaaggaaacaagatggaccattttccatagtactgtatgaaatgcatatgtatgaaattttttctatgctgtctggggtccaattcatatcatttagctatgtgtttttaaaattatcaaacttaatagcacctgaacagaagattttagagatgatcaatgaaaaattctgcttgctgctaaataaatccattctgggtgctctttggctcgtttatttctttagaaacgatcgattgagtgcttaatgaatgcctcagactgtgatga

SEQ ID NO: 34671 - DNA, 1532 bp, Bovine  19866881069172
acaagagtcccctatttctctcttgggtgggaagatggcactgaccttgtggcttagactgctctgtgctataaaagcttttgtttccttttgcttattaaaactgttgtaaaaacatgcagcatgtgtctggagcccatgagtaagtggggaatttgctatgaaaacaggctaaagagatttcagaaaggtagtctcaggaacacccctggtgtatgtaggtttgtttgcctggcgtgtttctatgagattaacagaaaacgtcatttctcccaagtcagcaaaatcaacgtaaattctccctgaatgatgcttggaaacctcgattttcctggaagtgtgtagaccggatgatatatatgtaggtagtattgggtggttcttctttattggaatggtgtggtaaccgagtatgggagtgctagtgaaagctggtgaagcaagtttcctatagactccagctcccactgtctagactgctccaccgggcgtttctcctactcgtggttctcaaactcactagatgtccgctcattagaagtccattgaaggcttattaaaccagatgggtcttaaccctaaagtttttaactgggaacgtcagggggtagaattctattgggttgtcgcaatgttccttccagttttcccttaagatgttaaggaaaaaaccctgaatgaatttttttgccaatctaatataatagctctgataaattatctggtgatacttaatacttaggtccttggtactaggatcacacctgcaataatttggagttaaggttactttgtcagcacatgcagtcatgctcgtttggttggatgctaatgataccaaaactggagaaatccattgctgaaaagtaatgaactaagcactagatccagaaaattccacataaacgaatattcacagttaaagccgctgctgcatataaatgtgttctataaattataatgtgatagagggtgctgtgataccaggtatactaaatatttcagtgatttttggtggaatttctgcctttcccattagctattaaaagtcagtaaatcagaaatgactagaattaaggacaaagttgatataccctaactttctcattttgctttttggtagacaccaggcttttccaaagtcctttagcatcttgccagattcttttgtttttctaaatcctctaccaactctattccacccatattgcgctgtttattcagtacaaatatatacaatgttttcatttgtaaacatggtcatctcatttgtgaaaattttttctcttcagttaattctgtcaaatcatgactatgtcactgcatttactttcagtgaaaaaaaatgtgctgtgcactgtgagttttatccttgcacataattgaaatacaaatatttttggagaggttttatgttcaaagctgaaattatttctaaaacttttaaaaagttgagagtgtttgctctgatgtttgatgaaaaataactgatatacccttgatttgcaaattaatattgattaaatatcaat

SEQ ID NO: 34672 - DNA, 848 bp, Bovine  19866881166881
cttggctctgtagtcttctctgatactgactcacagaattaatcttctttaccctatgatcataaaggattttgtgttaacatgtattcaaaacttcaggtcatgcttccttaaatattctctacttgaatttcagactcacatttaattgcccaataatcatctcactgcattcatcctcaagtccttcaaatttaatccattgccacttgaacatacccttcctgactggacttggtgttcctcctgtgctggatgtcatccttgattcttccatctcccctaacctctcaccttatgtaattgataaatgtagatatctgaaaacaactaacccattaaaacttctcgttacactttctttttatgaagtatttcaattttagttgaaagtaccaagtgatttacttactcatcatcttctagggccaaaatttaatgtgttgattttattaatctgaacaacattggctttgcatttaaaaaattcaagaaacagccaagggtcatggggctaatcacttcaaattacttttctttcctaatctctacccactttgctagttttccttatttgcatgaggattctcagagaattatcagatcaaaaatatgacctaccacatcccttcctttttgaaggatgaaaataatttttgaggtcattcttgaaattggaacattgctgaaaagaaaaaatcaagtggattgataattttgagcttaaggagaaactctgggttaagcaaaacatggatgtgtcatgaaataacaacattgctcattaaacatcctgttaaaacaggatgtttaaactttcatttaaaattatcatagcaatattttat

SEQ ID NO: 34673 - DNA, 2545 bp, Bovine  19866881289924
ttcctggttatttttaggtctaaaaacctaaaattaccatagataaaatgagaagtgaaacttctatagtaaataggagatggcagccttcttcaacctaaggagatggcatgagaaaagccagcgtgagtggaaacatcaagtgcgtgagacaggcttgatctttcaatgttcagcttatttagctaaagtcagagtcgtcacagtcacccactggtctttgcagacactcacaagactgggtggactgtcacatagggataaagagaaaagaagcagctttactctttgtatcaggaagttgcacattactgtcaattgagagagaaagtaaattactttcaaatgatgcccctgcagcgtcaactggtgcaggctaagcccctagcagcccccgcagcgtcaggcgctggtgctggggggacatttgcaaacactgccagggtgggagtacctcacgggaagagctgggctagaaagtttccctcaggataactaaagaaaaaatcagaggagagtgaagcacagctagtttcctggtggagaataattgtagcaccttctgtcactcactgctaaaatagtcccattatgtaaatacatgtggcttgctcccatcgatagttgcttgtttcaggtttttttctccagatagatttgatattttctaaacagcaaggattgtagcttgtattgtatttcttttctagacacaacgctactcccttttgcctgctttaccagccagcacagatatgaattctcttatccccacttcctctccttactccctaaacatgaggacagatagacctcatcaagaatagacagataagtactccttgggcattgtttagtgaacagattttcagacttgttctcctggtacttcagcatacttttgtcatatctctaactagagaagttaaaactaaaatgcaatttccagaacttaccatgtggcatgcacgcatgtacatgtgcgcgcacacacacacacagaggagacaataaaatcttgaaataattcaactcaatttaaagttttattaaacctttagtgcatggtagatattgtgctaggttttgtagataacagagaactgagtaagactcacccataaggatctactctgtggtaaaggagacagacagggacataaataacttttaaggggagacagactgtaataaatatgacctggaagaataaataaaacattattaagagtatcaactatatccataatcacagaggtattaaaccactagagctagagtttaagctacatatatagtttcgattagaccatccttctttccacacatagacttcaggcacagctctgtttggtgatctttatttcaaaattacctctctgtaatacagttttctaagttgatttcatgtcttttggtctttcttgctaaattagcacttctctttgcaaatatatatattttttgctgttaattatttgttctccacgcctccctccaggactctctctccttctatagtcttttacctattttcctgtccattctattgttatcttctctccttgtcaccttttcccatatctgcaatatttctccagacacaatgctttcttttcttgtattattatcctactggtaggagaatcaattttcttttgaagggaaaatattgtcagaaggacaataattcccctcaaataatccctttaattctgggtcatgctggatcttggaacaagtgagtgtctttctttgtaactgtccatggctctattaacaaaactgctggtgtttctctgaagcataagcagttgaaagaggtaagagcacagacataagctaacactttgattcagcgcaaggttgggatgtggtatgtatgtcctctctgatggttgggtgagcctcttctggtgggataaacagagtgaatgcactcaagccccccctgtttcaggtgacggtctcttgtatttgtgcatttgcctaacacctcattcatattcagtatctcactgaaccccagccccaggactgtgattcagtgtggtcctgcctcatccctttttcatacgcaaaaaagaggctgaagtccagtaacattaagagtctgcatgtccctgagcagctggtataggagcccttttttttttttttttccaaattcagtgctctacttcaaaactagcttctcacccctggtgccaacatgcagcatgtgagggcgtcacatggtaattgcttgacactcacttgataaaaacttgatctcacactctaaaatgctcatgattgtaaagaaccacttaggaattaaatgtaactgttttttcccatttcctcttttaaaacatgctctgctggtttcgattaggccgaaaatattataactgtggtttagcttgtagtagtgatgcttcaccaaccaagcgtgagatggaagttcaagaaacatcactggagaaaagggagctctcctcattaataaaagcaattagtgtggccccagctgagcagccaactcgcccaggggtgttctcgc

SEQ ID NO: 34674 - DNA, 1202 bp, Bovine  19866881324859
taacataataactcagtgagtacttatgtatgacaatcacctgaaaggaagaactctgaagagtaataacaatcgcagtttataaccctttccaggagcatcttatccctgaggacgtgctagcacaaaggttaggaatagggtagctggaaatggtagtcttgtgacacggggctgctgacccatctttccatgccctccaaggtgatattgttaagatccaagctgagagcttctgaaatgacatcttgggtgggaagcattttgcaaaccctaaagggcaagggaaatgttagttataattattactattcagagaaatctttttcgaagtggttggggcatgaaccttcccatttgagaaggtgagttcagtacagctgggttggtgcagcacgaattgtttttctttgtctttgagagcacacttcagaggcctgccctctctggaaaatgacttgatctgtaaatgtcaatgattcaaaaatatttctaagggggattctagccacatacaagtcagaggctcagttagaatttcctgatacttgaggcaaacactcctgtccagtcccacattaggactttccctctgaccttatatttcaaggagggcttcccaatggtgagccgaaacctcctgcggagtcctcatttgcccctcagtcagtataaaggacactctgattagagcctgcaaatggcaaacattttagtagctacgtttacatttattcttactattgttcatagaacggattcaaacgtgattccatttacagtcagctcataaatagttggttctaagtttagccttaatccctttgggaatgagttccttttatggttcacaatgtgacttcctagtttgaaaaagtaaaaaaaaaataagcaaatcctctaacacttagaggaaagcacattctatttcatgagctttcttaaaaattctgggggcgtgcttaagctacttgcttgccagcgtgaagccacaaaggagaaggcagaggtgacagaactcgaaaacccctccaaagggtaaaccagagggaagggagcaaagaaacgattcttagaatgctcagtctatataaacaagaaaaaatttcataatattttaaaaacaaacaaaatctaaagcaaattagtccatcagacattcattcagcttgtctagctttgagaaatgatgaattcagaat

SEQ ID NO: 34675 - DNA, 586 bp, Bovine  19866881327819
aatcgtgaatctcctccactcattcaaatgtctcttctttaagacctggatcaagtaaccttcctctagtgttttccttatgttctcacctcaggtgacctctcctactcttctagctcccagggcccatttgtcatttagcacacactgccttgtgttgcctatatcttgctggctaggcagtgagttcctgaaattccaagcttatatatcattacttattagattgtatcttattcctctttgctttgacaacccctagaaaagaacctactttctaatagattttcagtggtggctgccgaataaattagccctaaaaatcttctgtgactttgtgtgtctcaaagtgctaagcactatgcaattaaaaaagaaaggtctaaattaaagtgtgaatcagttccagccaaccttagtgcaatgatcagtgtgttcttggggctgcctgacctgctgtcctctctgctaagagaattctccataactgtaatagaaacctaatcaaaacataattaggaaggcaaactactgtaaaaagccatcatataatgcattccaacaagagattgggggattatctgca

SEQ ID NO: 34676 - DNA, 748 bp, Bovine  19866881377679
aatcttcccttttaacagctatgagtgactatttttagttgtaatatattacctttcaggaaggtagcaagggcaactgaagatatgttaaatatatatcaccatcaaatcatgtggataaaagtgctttttcgcttttgaaattacagcttcatatataaaggattgagtaacatgggtgacaggtttgtaatgtgctcaagtgggacaatttatattttatgattcctaagatcaaagagatgaaatgtacagtattcaaatatgggcttaaatacttgtaactagcaatcccaaatggaatcttagttaagatttgtaaaacagtatgcactaaacatcttttcaaaataatatgccctaagtgttagttgctcagtcatgtctgactctttgcgaccctttagactgtagcccaccaggctcttctgtccatgggattctccaggcaagaatactggagtgggttgccatttcctcctccaatatgcactaaactacagtaaaattaagaacttctgttcatcaaaagaaaccattaagagcgttcaaagccaagttacacatagaaaaagatatctacaatacatatgtttgaaaataagtcattaagagacaaactagtaaaaaaaaaaaaaaaacacaaaaccttgaatagcattttacaaaataatattctgatatccagtaggcatgtgataaaatgttcaacaccattacttattcctctatcaacccaccagaatgg

SEQ ID NO: 34677 - DNA, 788 bp, Bovine  19866881382766
tgttcctgggagtgtgcagcacagtgacttgtgtctagatatttaaaacttgaacctgaactctgacaatgtcatagtagaggtgaaatacaagttctatgcatgtgcaaaggaaggggaggtgaagaaatggtagttgcgggatgactaatgattgtaatattatggaaaattggttttttcttagtctctatataaactcttggatattaactgaatttgtattttatagtatttatgtgtggatacaataaatattattactgtgccagttaaaaatagatagtctagtctctgaagaaactttgaaagagtgttcttcagagctacatgagcttattaataataaatcatcttgctccactgttaattgtatttttccctaaatttttccatgagtaaaatgactgcatctccattttgatttgtaattaaaaattctgaaagagctctaaactcctcttgaatctaccaaatctggcctagtaaaagccatcttcaatgacttatgtgaatacctgtcagaattaattggattgttacttgaaagttcatgaaatgccattcattgccttttaaaatattcataatttcaagtttacatcttgatgacttttgtttcctccttcaagttgtcttttcccagagttaactcttacttctctgaattcctattatagcctctttcggaaagtgcttctgccattcaccatgtcttgtattatatgttctctggcgttacactgagaggcattatgtcttcctatttagtttgtcatcatcttgag

SEQ ID NO: 34678 - DNA, 1028 bp, Bovine  19866881394494
ttggaaatttgatctctgattcttctgccttttctaaatccagtttgaacatctggaagttcatagttcacatactattgaagcctggtttggagaattttgagcattactttactagtgtgtgagataactgcaattgtggaacagtttgcgcattctttggcattgcctttctttgggactggaatgaaaactgaccttttccagtcctgtggctactgctgagttttccaaatttgctggcatattgtgtgcagcactttcacagcatcatcctttaggattccaaatagctcaactggaattccattacctccactagctttattcatagtgatgcttcctaaggcccacttgactttgcattccaggatgtctggctctacgtgagttatcacaccattgtggtaatctgagtcacaaacatcttttttgtatagtattttgccacagtttattatttacactgcacgtgattttccctgggtcactaatcgtggttttcacaaagatgtcctcagttttcactgtgctctccagttacattttagccattttcaatcttattttgtgtttattattcttaccagaatatttgttagaggagttttatttaaaagtcttcgtatttatttcttggagcaaaaaatattactggctgttgtaggtagcaggcagggtgtaagcattctgcttcagcaataaatctttaaatgatgaccaagtgaagcttaaatagtttgtgaaaagctgatcagtgcagtaaagcacaagaaatgcactgtggaaatactggaagggcactcaatggcttacttcagatgtagaagaataagaaattactgaaccatcaaattagacaactgagaagaagctgaaaacttaaaacaaaaatacaaaattatttagtgtacacgctagaacctatataatatggtaagtgactgcaggccttctataaggtacaggagatgagaaacagactgtggatggatggaatttcagatactgcaaggattgcctagtaa

SEQ ID NO: 34679 - DNA, 1407 bp, Bovine  19866881512679
ccagtttgtctattctaatcaggtttccttctaaaactggttccctgaggagagaagggcgactctcagctgaactagagctcccaaagggaatagtcaaggtggaaaacttcacagcagcagtccaaataccaatccaatcgcctatgaagaataatactttgacttaattggttcaatcaaagaagtagtcccaaggttctgcatgtgtttctcaggctttacaatgaaagaaaggttatacttaggacgtgggtttaaatgtagaggaggagaaatcaccattaattttgcctgccaaaaaatcaataactaatgttttaacctttctctctctttctcactcactctttggcttaagaaataaaaactctgtatatattcttccctatgatttatgggctggtttgaaaagttagaaaagtaagtcaataacctctttagacaatcctgttaggaaaactgtctgatccaggaggcaattagaattcaagcttccatcaaggacttctctttgtcattttcaaatcctattttcttatagtgattacctacaattacaaggcaacaggtcactattggaatgtaagctcttagaattcaaggtacttacagtattttgatgtgacatcaatttctgtattttcatcaaatacagaatgtatttgataacgtatataaataggaacccaccctaccctaagcttttattgcccatagaaatgaacaataacctgagtaccagcaaaggaagaatgaactccaagagtatgtaccactgagacttgtaatctcagaattttagtcagataacaggtgtcacacacctgttgctttcattctgattaaacttttgaactgtggtgttggagaagactcttgagagtcccttggactctaaggagatccaaccagtccatcctaaaggagaccagtcctgggtgttcattagaaggactgatgttgaagctgaaactccaatactttggccacctgatgggaagagctgactcatttgaaaagaccctgatactgggaaagattgagggcagggggagaaggggaaaacagaggatgagatggttggatggcatcaccgactcaatggacatggatttgggtggactccaggaattggtgatggacagggaggcctggcgtgctgtggttcatggggcctcagagtcggacacgactgagcaattgaactgaactgaactgaactgaaatttttaaaggctgtttctggaaatgttgtcctcattaagatattctctatttccactaagtatcttataagtcatactaaaattgtttccatctaacttagaaagactagccaagtttgtattacattcagaaaggctgccatgtggtttctgtttggacaccacctgcacatcacca

SEQ ID NO: 34680 - DNA, 748 bp, Bovine  19866881721633
caggaaagcacattcttgttgaggattaggtctggatggctactctgcccaccatgctgatttgcttgtctttcatttgcaagtcaccaactcaatactcctgttttgctgatagaatgtgttcacttatattcactcatatggaatttttctggtagtcctcctcctcactttaaatgcagcagagtgattacttctgaacccaaagagcagcgagcactgcaagaaaggtgggcaaacaactgcatagcaatcataatcagaacttgaccagaaaagggcttcctcccagggctgccaaccaaaatcacatcaagcaattttaaaggaactaggaatttgttttcattgcttctccctgtctgcatctctctctggcaggatgtttacttactgatcagtctgagcaattgcaccaattcattaaaagtaaataaatcaaccttacttggtgactgcattatcatcctgaagtccaacctctaggaataatgttgccaagttgagctttggcaggaaagggatgcagtgcccaccatcctggctctgccttttctgggctatacacactcagttacttcagataagtctcaagggattgattataccttaatcaggaggaacatactttatggggtgaaagcaagacttcagaaacaaaaagtttctaagaaatgactccatcacttagtccatgatttctaacaataactcaacctctctgtactcagttctttatctatacaat

SEQ ID NO: 34681 - DNA, 685 bp, Bovine  19866881924286
tttatggaaatcaacctggtttgggttttacgttttcatgcaaatctatttataaaacataatcaacacaatgttagataaagtctaccttctagtttgcaaaagactaaaaaataagatatataattggtcatctcccttgctcaaaaatatcatcttttaatactccatgccttttcttttcaattaagctgatcaaactgaacttaaatgcaatagaataataagaacaaggcattccataaatagctgattcattgagagaagtaagaggatattcacagagtaactatggccatgatgagaaacactgattaaaataatatagttggtctggtgtttttagtttcctaacaggaaaatgggtgccctctccccagaaatcaagttcatcatatggaaaatgcaggtaaatataatgcagttaaaaataagaatctatatgattacagataaacaattagtgagaaattgaaagattacaaggaaagtgggaaaagatgcagaaacatgggcaaaatttgacctgggaaactccacagagagagcataagaagaggagggtctgaagtcatggtggttttccagtcagtcacttgctgtctgtaagagaccattttcattctggaaaggtctcttggatgagctgagtttttaaatgaaggatttggacaaaatggtgaga

SEQ ID NO: 34682 - DNA, 1581 bp, Bovine  19866880101002
atttggaaccagtctgttgttccatgtccagttctaactcttgcttcctgacctgcatacagatttctcaagaggcaggtcaggtggtctggtattaccatctctttcagaattttccacagtttattgtgatccacacagtcaaaggctctggcatagtcaagaaagcagaaatagatgtttttctggaactctcttgctttttccatgatccatcagatgttggcaatttgatctctggttcctctgccttttctaaatccagcttgaacatcaggaagttcacggttcacgtattgctgaagcctggcttggagaattttgagcattactttactagcatgtgagatgagtgcaattgtgtggtagtttgagcattctttggcattgcctttctttgggattggaatgaaaagtgaccttttccagtcctgtggccactgctgacttttccaaatttgctggcatattgagtgtagcactttcacagcatcatctttcaggatttgaaatagctcaactggaattccatcacctccactagctttgttcatagtgatgctttctaaggtccacttgacttcacattccaggatgtctggctctacgtcagtgatcacaccatcgtgatcatgtgggtcatgaagatctcttttgtacagttctgtatattcttgtgtcaattttaggtctaattaaatagcttttgattacaatagaaagaaagtgaaatcgctcagtcatgtctgactctttgtgaccccatggactgtagcctaccagatcctccctccataggattctccaggcaagagtactggagtgagttgccatttccttctccaggggatgttcccaacccagggattgaactcgggtctcccgcattccaggcagacgctttaacctctgagccaccaaggaagcccaatagaacggcccaaatcactgactgctcccccaaacaacccctgaatgatttaaacaatcttgcagtcatcccccagaaagcaaaaacaaacaccctggtctctgtatttctcaaaatatgagaatgaaaaatactctggcttcactttgattgtcaggatgagcagaaagttcatccttggaaggtttgacaacaggaacgaggcagaggaggctgaaggagtctttactgactcctgaacagagctggctggccagtctagctggcatgtctagatggtgaggccagccttctgtcaccaaaacacacagctgaaatggatgaatgcaggactctagccagagcagatagctgcaggtaaatgttaattaacattaaatgacaccagatcatgaaggggcagggtaaattaggaggagaaatgaccaagaagggacttccttggcagttcagtacttaggactctgcgcttccactgcagggggtgaagcttccatccctagttgaggaactaagatactgcaacccatgtggtatggccaaaaaagaaatgtgacaaaaggaagtaactaacatgcccaacttttcttgtctgggggattctacttatttttcaggtttcgtttcccttcagtcaaaatctttaaagt

SEQ ID NO: 34683 - DNA, 1008 bp, Bovine  19866880447943
cgatctcacatactgcatggtgaggccaaaaataagaagtcacacctgtaaaatgcccacaacaatgactggtatgcaaaagcttagaacatgagagatgacaggtatactcacaaacatatcttgtattcccagcacctctctagttttctggcacattgttcagtaagtgctttttgatgaatgggagggattttaggtcccatcagccaaaacttcagtttacaccttggttatgcctgaagtctgggaaggaggaggttcggggtgaagacagccatgaacagtggaaagcactgagagcacttcaaaggctgccctgatgtcccttgtggaggagcatctctgcaggtgcctacatgctccagcctgtgatgctttgattccagggctcataggaagacctggagcagtgtgagggtcggccaggtgctccagagctgcccagaggagggaagagcttctctgtatgctacctgggcagagataatgtgtctgtgtagcaacttcatctcccagccataaaatattgatggtcctggtgctggacggagaccaggagatactcccttggaaggtgctgtttgctggctgctggtgaatgattgatgactgggaagtaaaatattgatgttttgagcagcacaccaggcctcttcccacccagaggggcttgcgtcttatgttattaaaggcaaaaattcagagactaggttactgtgcttctgcttaggacccaacagcttttagccaactatggcttggagatactgtagaattttaagataagtgtgggagatggattcttggaattagtaaaaagaaaccctactttccttcggtgtgaaaaacttgtaataatagctttgtcaatgcattctttttctttaaaaagttatgtttattaaagttgttcatgcatagaacttaaagaaatgaaaagataaaaaaacagctctcttctgagacacccctgagtccccactattttatcctctgcatatgtga

SEQ ID NO: 34684 - DNA, 761 bp, Bovine  19866880467187
tggaacctaaacccaggcacttccctatgcaccagtcagcttgggttcttggggaggtgtcacctccagggagtttccttggaccaaagaaatccagggaaaatgaagcactgatcttgggttaaaggcgagcccgattccaggccgggcccatccagcaatgtccctgtgacagtccagctattaatcctgagcgctgtccctctctgcaggcactgcctcagctgacccagtccccggccctcctgtcctcaccctcatcctttaagacgttaatagatttcctatagcttcaggtatagcaaacctctgctggtctgaactaatgtgttagtattttaaaaagacttcttgggaattctctatttctcttccttattttccctttcagcaccaaaagaagaaaacacatgacctcaatctgccagccacctttgaaaagaaggccccttggggacgaacacattagcaatccacatggcttatttaattagtgatgaaaatgccaaattattaaagtagccaaaaaatactttgaataaaaagttggtgattacagttcccatttcatttttacccaaacacatatggtagtttcataatgcaagaaattattttcagacagaaataattacatagggctctcaggccacttttagcaagggaccttgctatgcacttttaaatcacaatttgtgctgctgctgctaagtcacttcagtcgtgtccgactctgtgcgaccccatagatggcagcccac

SEQ ID NO: 34685 - DNA, 855 bp, Bovine  19866880470771
ctatagcacctattagcacctgcaaacagcccgctctgtcttcctctcaacctagatccaaaggggccagcttcttaacacactaaaggctggggagggggacgagggggagaaatgacaccccttcagcacttcaagtccagtccagttttccttcatgaaaactcagtctttgaatggcaacaaggttcacaactcatttgcgtcataggaccctgtctgctcccttcccacccaccaagggcacctgaggagtcctgacctttggaacctgaaggataccctccaggccatcacaaacaggtctcaggagagtccttggcaaaccatactattgctggccaggtacctgggccgacttcaaaataggagcctgaaggtaagaagccctcatcctactgccaatcccaatccccaaccccaagaaaatcaatgaggccacttgttattcacaaagagccactcactgcaagacatgatagtcactttaacttcaaggcttcaaatacttgcaccttttccacataaaagcctctctttatctggtcacagggccatctctcagtgcactgaagaataagggtgttttgatccccaacaaaaatcaaagaaaactctacttgctctagaatgaaatgtccaaaagccacaacgtgactgagtgtcttagtggaaaccaagggatcaatcatgctgatggctctcaaaggactcttcaaaggacccattttgacccccgctaggtagcccagccacctagaagagcatcctcttgcacacggcttaccttataattgctagagttcacccaagaggtagcgagtccgtccacaagtttgtctaacatggtctggt

SEQ ID NO: 34686 - DNA, 1108 bp, Bovine  19866880513892
gagcttttgttctttattacattcccctaagcatcactcattgtttaaggcagggcaaatcctgtcaagtatttatggagctcttttcttctccttataaataaataaatctgtaaagaaagcatccactaatctctgttttctctaacctgcttgattttctaaagttaaaaaaagcaatcctggtgtcctgaaaccacagccaaggcttctcaacattttcagttaaaatacctgttatttcccaaccaggggagagcacaccaccattacctatacttacagcacacagctcagtgctgttgacttctaactatcacagggtagtgtgtgctcattgccctggtcttcttcagccgcaaaaatattcagaacttgggacttccgcagtagtcctgtggctaagactacatacttccaactcagggggtgtgggttctatccctggtcagggaaccgggctcctatatgccaaatggcatgcaaaaaaattttaaaagaaaaaaacactcagaacttactgtccacatagaagagttctcatggcaacacactaagtgacaaaaagaccaaaaaataaaagaaactgtttttattgctttacaacaagccagcaacagacacaacacaataatcacacataacacttgacatccccaaatggtgtacaaaaccagaacatgctcctccacttaaaatctatttgtgaaaactgaaatccaaaacttctcccaagaactttactattctcaagcagaatcaatacttaaagaagcaaagaaaactagtatcaaacttactgcatatgtctgatcacataattcagaaccttttactctcaatccaggcagtgctattactgcacattttagatggccatcctaggtactttaagactccaacaactttcttctttccacaaattctttgcagaaagagctgtcaagaaaattgttctaaaacccaacaatgcacagcaatttatgcctcatttctacttttttcctcataatggaaaatttggccgtccttaactcagcctgataacaactccaatgcccatgccgaaaatcctacttacaaacaggaaacctaaactcatattagg

SEQ ID NO: 34687 - DNA, 1105 bp, Bovine  19866880539568
caccgctttgagagtgagagggtatgtctgggtttgaatcccatatctgcctcttaggaacttggcaactgggccaagcccttaacccccgtgaacctcaatttcctcatctgtacaatgcggaacagtggtcctggcttccccacagatgtgtgaggatgcagtgagctcagagtaagccgaagaatgcatttgctctgattatcaccctgaagaacctcgtatcttcagattggtgctacgggcagagtccactctgggcaagttgcaggtcctgggtgggggttggggaggttcgcccatccccgggtcttcatctagcaagtctgctcgaagctgtcagggctcacctggatgggattctctccctgacagctccttcctcagaggaggaaggcactctgtatccccacaaccttctttcttccccctaagtcccttctactgttctttccaccctgtgttctggaacattctggaacaacagagctcggtcccccacacctgctccttaacttcctttcctcctgccaggaatgtgaggccgaagatgaccatttacgtctgccaggagctggagcagagccgcgtgcccctgcagcagaagcgggacggcagtggggaccccaacctgtgtggtgagttgtggggagcccctcccctgggctggtgagagggcagcaaagcaacagggagagtcctctggctgagagtgtctcccctgatctgccttgcatgcaggaggggttctgctgtgcttcatcctgggattgaaatgtataaggtggagatcatctctgagacggtcttgtcccatttaccaatgtcccatctggggaaacaggcctggagaggagacgtggcccccgaagtcaccaagctacccaggggagaactgggagtcgggctttctggctccctggctggtgacaaatgccacctgacaagtgtattcccaggagtgtgtcctcctgtgttcccgcagctgggtgaggctttcccatttggtttggctagtgcccaagagagtcttagaccacctctggggcacatggttctttggggctagcagttttcagcaccttgtttctgagcatctttaagt

SEQ ID NO: 34688 - DNA, 2379 bp, Bovine  19866880607581
acaatactagtttgtcacaaataagttgtgatgatatagatggatgcagaaattaattcccagagaagacccgggcagaagctgaccgtaaatgtgacagaggccacaggaggcggcagtgttttcctgctcccggaggagaaaaaggcggggcagtgtacatttggagaagaaggtgctattgtgtctcttttaaaaagaaaacaagtttcttagttgatgaggctgtgtcttgtgtctagacaagtgttcgtcacggcactatccttgatgaactccaggccgtgttgaccagacagctgacatgctgaaaacctcctgtgagtgagtcatgaaccccagcatggcaactctgtggtttgggcaagttacatcgtcactttgtacctgagtctcctcctctgccatgcaggtcggccgagaaacctggaaatagagcaggggacatgctggtcccatgtgggctctggaaagatgctaagtctttctgtcatgaaagaaggcgagacagcaatgtggctctgctggaggactttgacccaagtccctggcatggatgcaggatactctcctggaaccaagatcttcaactccagccctagggcttattgagttctcctgggctccatgtgggaatcagctctttcagacctgcaagctttgagcaggtcaggggcctgcctgcccagaatgaccagtcttggacagaattttaatggaagttcattaacattttcctttcacttctggaggatttgctttgagagttgggtggaatattatctccaatgagatgaaagtagagtcctcggatgaacggagcccccttgttccaaggagtccctgtctgatgctaagtttgtacacatgtacctagccagcccctgcaccccacttttaggtccaagacactgggaacattgatttaaagtttcccaagagctgtccccttggtgccttggtgaactgggagaggttgaaaacaccagcacctgggtttgtttgcaggcaggcaaccacacattggttcagccttgatagacctgctctcaggtgctggcctatgtgctcacaatggctactttgggggatcctttttcggtgcacttaagtggccaggagtgggtcacagccactgagcaaggagctctcccgtcccagagctcaggcctctcccagctggaccatccagtgtggaagctgagaccttctgtggatatttatgtttaaacttaattcaatcaaataaaaaattcagttccttagtggcatcagctccatttctgggtgcttggaagctgcacctggctacctataggatacagcaggtggagaaggtttccatcattgtaggaagttctgttggacagcctggcccaggtgtcaggactttccacttgctgaggaaggctggttgggttccgtgaccaagatattagaggtggtgggtgacattcacctccagatgaatccatgggtcagagccctgggcgcatccaagccaccccagggtggctctgtctccccgccctgagccagactcaccccctaagctgtgtacttgcccccctgctcccagagaggtcagaacagagaatctggtcccagcaacccaaggtcagcagtttccagccaagcaggtctgggctgggcctggtgtttgctgagctcagcagccctgaggccccatggcaagctgggcctccaccctctagaggcagctggacaccccagtccacctctttgactccatctgcccttctggcaccttcctcctgcttcccagctaaagatgagctgaaaacaaggacagcggccttcccaaatctaccccaatagcatcagcatctgcctgtgggagcctggcagagccccctgctcctgtgaaagcctttgtctctccatgtgtacgtgcatatgagtatctatgtgcatgtctgtgtatgtgtgtgtgcatgctcgcgcacctgtgttatcctgggctgaggctttggatctaaggacaacttcccttccctccccatcgtatattgatgggagggggaaatatttgcatttcagtcctgcccagcaagctgttgctgtgcttagtcactcagtcgtgtctgactctttgcgactgtgtggactatagcccacccaccaggctcctctgcccatggtgattcttcaggcaagaaactggggagtgggttgccatgccctcctccaggggatcttcccaacccagggatcgaaaccaggtctcccgcactgcaagcacattctttaccgtctgagccaccagggaagtctcgcccagcaagctagggctgggttaaagagttcatggaataacctccagcatgtgaaagaagctaatcctagacttgagtccag

SEQ ID NO: 34689 - DNA, 2607 bp, Bovine  19866880669395
aacaccttcctttattaaatccctactacaaattggagctcttctgagcactttatttatttttattgaagtatagttgattcatagtatcatgttagtttcaggtgtacactttagtgattcatttgtacatatatgtatacacacacacacatatggcttccctcatagtttagttgtaaagaatccgcctgcaatgcaggagactcggttcgattcctgggtcaggaagatcccctggagaagggaaaggctacccactccagtattctggcctaaagaattccatggactgtatagcccatgaggttgcacagagttggacatgtttgagtgactttcactttcacacacacacacacacatatatatatatatatcggagaaggcaatggcaccccactccagtacttttgcctagaaaatcccatggacggaggagcctggtaggctgcagtccatggggtcgctagagttgggcacgactgagcgacttcaatttgacttttcactttcatgcattggagaaggaaatgacaacccactccagtgttcttgcctggagaatcccagggacgggaagcctggttggctgtagtctatggggtcgcacagagtcggacacgactgaagcaatgcagcagcagcagcattgagtatagtttcctgtgctatatattatgtgcttgttggttatctgttttatgaataatagtgtatatctgttaattccaacctcctaatttagcctttccccaccccctgatcctctttggtaactataaattgttgttcctgtgggtctctttctataaacaatggaatattactcacccataaaaagaatgaaataatgccatttagagcaacatggagggacctagaaatgatcatactaagtgaagtaaaccagaccgagaacagtatcacatcgcttatatgtgaaaccttcaaaaaaaaaaagatgtcacttccttgaatgctccctgcagctgtaagcagtgctgatggggagtagaagctcagggaagttacctgagtggccaatggccacagggttgtggggtgtcccacactcagcacagactctcccagcggtcccaggagcatcagagcccacgtgggaaggaagaggcctgagagcaaagaaacaggctactgattgccacagatgaagactgcaggagagggtgctcaggtctcctctcctccgttctcagtcctgtgacccctcccagagcgcctgctgggtactgggttccctgggccctctgcaatggtagacaaaagaaagagtaagagtcctggagattccagaaggtcactgctgagtagagatggcagtaggagctgaccaggctagccctgcaaacgaagggatctctccgcagccatggagggtgaatcaggatgcctgcctggcctggtcctccttctcctccccccagagaacttacatgaaactgttaagaggtaaatgggtggcgtctatgcagcccgtggactgtgtgaggccagtagtggcccctgacacactgggcccaggtctccccagagtccggttgcttgggaatgcagcccaaagtgggtggtaaactccatctaaggctaaatataatatgaggcttcctctattaaaaaaaattccttacaccagctacccaaattctactgcttaagaaacatccataccttaagattgggaaattctgtctctctcaaaggcaaaatgtttcacaggttgggaatcacccacgagcagcaatgccttcaggagagttggcccattctctcagcagagaaactgaccctgagtgagaccctggtggacaagttttgctgagatacgggagagagaatcatggaagtgcgagtcgggtgggggcgctgatccaatgagctggggcaggaggcccactagacacactcaggactccagcaggcgatgctggcaggcggacagctgagcacaatgacttcattttcagcttattattatttaaacatggaaaaaaattgaggagagacaaaagaagtttgttttggcaacttgactttcagcttcaggaaagtcatggcctagggttttcccccagcatttgttcccctgggtcttgggtgcaaggggtggggacaggccaggtgggtgcaaaggggagggtgacatcccagggccacttgttttgcctacaagaccataggactagggtggctggttctttatttttttaactgcagtcctgggtggactaaaatactgctttgggttttttctttgttttggttttgctttgtttgttgtgattgctgaggacagagcactgcttctagcccaggctctgcagtgtggcctcaagcaatgagctgccccaccctgggcctcatctcaaagaacacacacctcaggtctgtcacttcaggatctgggatggtgtgtggtgcctgctggggcactgaccacctccactcttccattcagaggaaaccatttgcaaggattcttcccagtcttccctcttcagagagccggtctgggccctctggccatccgccatgcctgtaatgctggtgcttgatcccacattttgccaacagcagaggagaggg

SEQ ID NO: 34690 - DNA, 1327 bp, Bovine  19866880691767
cttcctgggtctactgaattgcagcagatgctagaactcaggcggggcctctgcatgcccaggtcacttgctgagtgaggagtacctgtgctcagatgcactttaaacgtcttatcaggtcacacgagcagggggcttaggttttctgtccctcctgcctgagccagccagtgggttgtgctcccccgttctctcgcggtgctgttctcttagggggaagttactcgtggcacctctggaccccatctgagggtcccagtggggaagcatggtgttccctgcctgagtgttctggtgggtggtacagtctctgagactctgctgtggttccttggtcctgtttgattcaggcccatagttcttctttgggttccttctaaaataattgattgcattatctgaaagtaaacatctgtggtttttttgcatgtaagcatttataagttcctttacacacacacacacagtcctatatacttggaatctcatgtgatttaaaaatgtaaatacagaactgagtgaggaaagaatgagaagtcttgatggaggaccaaattgtaaaataaagttggtccttttcttctgaatggtgaagtgtaaatttgggtagaaccttgtcccaaagggatgagactgtaggacatgtagagtatagtgcctccctgccccctttgcctgttctgtgtctctttctgactctcctcttctgatcactgcagtcggttatggggttgcaatgccgatgggctgtcgaggcacccacctccctttcctcagcctaactccatccccaccgctccctcccacaagactctcaggcgctcttactctcccaggtaacaagccacctgtcccacttgtctgaggtgtcacaatattattgcacttccaaggtcgtctcaggtctctggggaagcctctccgccgcctccggccgagaccagcagggtagagccttggtgagaagtgtgagcaggtgcgtgacctcggtcagacctcatgaggatggcttctactttgcccctagggcaaggaactgttgcatcacctgaccacattcatcagcatcttcacttgcaagccctcagcccagggcagtgctcagcctcctaaaggtgcctgcaccaccccagcggtgcactgtgtccccagccggctgcatgggcctgctccttcccacattgcacttgtggcctcggtcctgctctcagtggtgtgggatgtctttcctgctgtcctgcatgtggtaatagtctgaagactgagatccagaaaagcagccccaagaagtcgctccctattatagctcattaaaggggctgctcca

SEQ ID NO: 34691 - DNA, 1915 bp, Bovine  19866880724003
ttgggttcaatccttgggttgggaagatcccttggagaaggaaatggcaacccattccagtacccttgcttggaaaatcccatggacagaggagcctggtaggctataatccacagggtcgaaaagagtcagacacaactgagagacttcacttcacttcatgtatatatagatgaggtcttctctttaaaaatagaaatctcagttttaagcaccatattaagagttggtttctaagagtgaaacgtaccaaaaaggttagcagaaaagagcatatatactcacacaagagatttcctaacaggttctgaaacattaaatccccaggcttaggtgaataagaggagaggagagcatttgatacgtcatttgatagcatgacagctgacacggccatcccaaatttcccaagggagctgggttacacccacaagagaaaaagaaaaccctattaagtactggttattcagtgtaaaaacagaaggtgtaagagggcttggggtataaaaagcatggggagtttttttctgctactgaataaagaagtcaagctatagagaagtaacacagcaatagtttaaaatttgggtttcatttcagcaattcaaaataagcacaggtactttacatttgaatagcactttccaatccactaagtgattatacaaatggtaccttctttattcccctacaaaacttctttaagactgttactgtcacgcctacttacagattcagaagcaaggaaaattccagggtcacacagtatgaaacagaatcaatatttgaatctcagcttttaactccaaatccaggactatttccaccaggtcacagccactgctttctcatcaagaatacacacaactctctatgtactttagacctgtgtacacataacttggacttcccaggtggcttagtggataaagaatccacatacaattcaggagatgcagattctatccctgggtcaggaagatcccctggaggagggcacagcaatctactccactattcttacctggagaattccatgaacagaggagattggcaggctacagtccatggggacgcatagagtcagacacaactgaagtgacttagcacgtatgcacacataacttaggaaaaagatctacagaggaagcatacatacaccacatttaatgatcccaaagtaacagaatagcctgaacagagagcagcaactcctcctggcacagcgacacatactaagcaggggctccagaaacaaagaacaaagaggaagaaccacaggcactcccagaagtaaacctaattgtcagcaatccttagctcggagagctcagtacttcccacagatgtctatggcaagctaaaggtatggtcaaaagtgggaaagaaaaagaagaaaaagggtaacttgtaaccactgagagaaactagctgaagggtgaacagaaacactctgttactatttttgccacttcctgtgaatatataattattccaaaatgaaaaaaggaaaaagtgaaaaaaatgcacataatgtggacaggcttaagttcactgaacacctaacgtgccagccaatctgccagatgctgctgtcaatgagctccgggtccactagggagggaaagacaagtgaacaatctatttcaacacagtataccacagtgttttcctggaagatcagctacttttctgatgactcctcagaagacaaagaaaaaagaaagactacaacagtgaaacaaacataagagtgccccagggaatgctcttacaggtgcactgccatgaaaacatgctctattactctcacccccaaatcattttctttgcttcttattccttgctccagaaagattcagactggagacacagaacctgatgaacgagaagacctacagtcacagagctttca

SEQ ID NO: 34692 - DNA, 1658 bp, Bovine  19866880777759
ttgccattttgaagttatttctcacacctgtttttatctgcgtaacactgtattaatgatgtactgctttcatttctaactatacagacacatatcagtattagctgaaacgataaagaagggaatacatgatgctgattcagaagcaaggatagaagccagaaagtaagtgtctgttgaacaccactttcttaagtcattgcttttctatttcaggttcactgtccagattgccttataaaagttcattaagtcacacgaacatggcttgctaatcatgactttgttaagtgacccaaaagaccatttcacaatacttctctaattttttgtttcagaggttgtggagtgcccaggcctgagagcctgattggtactatttgaacataaatgggactgacgtagacagcggaaaaagctcattttttaatttatgagacattatcacatgagccagaaaagcacttgcctgcatgtcccatgtcttctcttactcacccagctctgttagtccccagtggcttgttgatttactgtgaaaactccccatcacggggattcttagccagggactacatctctgccagggtcaggtgggcgcctggaaagtggataagggtggctcagactgactgcagtccacagctcactgtcctgctcatgtttggagtcatcttaccactaggactggctgtgatgcagccaggagggtgtggcccccacatcccacgcctttctgggagtcatcgtgccatcctgactgtaaatagcagttttaagtttgatgctcagatgtcttctctcagacagcacaaagatgcatacttcctctattgctttggggctatttttctctgtgcttttgtggctggctagctcttctattttttttttttttgactgtgctgcacagcttgggagatcttagttccccaacaggggactgaacatgtgcccctcttgcagtggaagccctagtcctaacactgggccaccaggaaagtccctggctcttgtgataacacacattccaccagtgcttacctcttggagcactatggattattcagctgcatatacctacctgacctggctctcaactgctctttgctctcagttaaggtctgattccctggttctgagtgtgtggagggcctcattcttcaccctgaagcacaacctcatttggggaagttcctacccgaataagtgacttaattaggaatggatttgttaatgatctacttatgctctttttgtccttattttatatttcgtgccccccccccatttttttctagttttttaatcataacacagtatacctttcagatggttgtgagcatcatcctgtttttcttttttatatgttaacctaaagccgttttaaatactttgagccagggagtgccacatgcattttgcttccatgaaccagtcccctcacattccaggtgtaattctagatgttttagctctgtcttccctagtcttcccagtcttgcaggttagattctttgatttccatgttcttaatgagactgagagtcagacagatggaagaacttgcctagagtcacagagccagtaggtctcgggtgaggagtcagagcagtgctcctcgcttcactcgctcccttacgccgctgcggctgctg

SEQ ID NO: 34693 - DNA, 1372 bp, Bovine  19866880840075
tgcattgacaggcagattctttaccattgaacccccagggaagccatatattatatatatggtgtatatatatatatatgtgtgtgtgtgtgtgtgtgtgtatatatatggtatatatatatgtgtgtatatatatatatggtgtatatatatatatgtgtgtgtgtgtgtgtgtgtgtgtgtgtatatatatgcaggctgtgccacaaggcacatgggatcttagttccctgaccaggaatcgaacctgtgccctgcttcagtgggagtgcagagtcttaaccactggaccaccagagaagtccgtgaaagtgagttttaatcttaagtataaaagctatgtgttgaaagaagcattgctaggtcaatcctgagtggcttaaaaccaaatctaaatgaaagggtttctagaacatcaaaatgcagcttagttcacaacctttaacagtaacagaacactcttgacatcgggtgggccgctggctgcttggtgaacaattcactagctcgtaaactgcacccacaattgattttctcttttgtcataatgttggcttcaaccgtgaagaatgatgacaatagtcctcagtatgcaaactatgcttcctaatcagtgcatttcccattatccagtctccttggggaaaaatgggacatcacattgctctgggggggttcctttggatggcttgatctgaggctggccacgggtttttcctgtaggaacttgccagaaagctctgtctccccagagcaaagggtcaggaaagctcagaaggtagcctgccctttcctttccagccatagacatgtggttaattccattccattaccctttgtctgagttgcaattgaaaaaaaaaaaaaacaaacaccaaagaaaaaaaccccaaactctcttggcctctctgccctcaagataatgtgatgaaatggggcagaactgcccaccagctacaccaataacatcttgaaatttcactcttaaccgattaggaaacacaatgtctccgccaagaatggcctcatttatcacagctcccagaatgttctcgctggactgcgtggatgagcaaggctccctgcgaggaaggacaggatgagggaagacccagtgcacctgtggaaacacagattctttttccacgcagcaattaatcttccgctctgctaaattacagcagaggcgggctgtctccggagtgaaaatctgaggtggatgtgggccctggaacagaacagagaacctgcctgatgacagctaaacaccagcagctcaggggtggcagtgagcaggggcatttgaaggacgggaggagatcctatttcctgtcgaccattttttccttcttccttctgggtaaagaaaata

SEQ ID NO: 34694 - DNA, 1860 bp, Bovine  19866880862060
tcggatacgacttagtgactaaactactactactaattaagtgtacctgcttgtcgtcatttctgaacatttgcttgcttgtttatgttagccagttacactggcgtgcctgtaacagagtgcagtcagtctttgtgaacttaaagcatgcagttcaaattgtgacaggttctgtgttctcaaagaaaccttatctttaagcaaacattcatcaatattctgagtaatgatctcattttaaaaaaagttagataaggaaattatgcttttccgaggtagacactgttaattcactgactttgaaaaaaaagaattcctgtgtttctaccaaactgcaaaaaaatcagcagaattggaaccgttttggtcacttagggttggtaatgacccagaagtctgcctgaccccactgtctctcatcatcttcaccctctctgagaactcatctttgccccttctggcctccgtgtctaccgaagagtactatcctcctttctctctgttgcctgtgtttactttgctttctgtttgcttacatttataatctttgcttcttatgttacatagaccacaggggtgaaacttaaagttcaccgtgagtcaggcagccagccagcagccgggagcttggcatgtagagggaagtcaagagcaccaacccctgtgccaaaaacagcgtctgccttgggaaacttgctccagcctcagtgaaagaggggcctcagacggaccttgaagtgcagcttctggcattttctcttcaggcattttcagaaaacctatgtttgattaaatgcttcctgcaagcaacttcaagaattcctggagttttatcagaggaagttctccttgggttcaggtttcagctccacatacccgagctggtctgtttaccagcagctccctgcaggttaactcctgtaacctggatgagagtgaagcttggaaaggttggtggggaggaggaaaccctcacgagagagcctcactgcgaacctggccgtttatctccctgtctggtcagtgccctttgcaaccctgaggtgcgccgggaggtttctgctttactcctgtcaggacttaagtgaagctgccaggactccattcccagtctctctctcctgccgcccagctatctctacttcttagtggcctcctaaattgctcgacattagtgttttccagtttgggatattatcaatgaaatcatccagtattttctgaccctttcatttttttccccccatgtttaaaaactaagacctcagatttcatcagttagtattactcagttttctgaccagtatgttgtgacacctatgaacagtgatttcttacagttgaagggcattggtgttccactgcagggccaggttagagaagggatggacccctcttccactatctgcctagctgtgtatcacaggccagacgcttggctttcccaagtatgctgtggacggaccacagtcctcaggacacacatgagctgaggaagaagaagagcacttcatctagtgattgctgcatgatggggcccttctaatgatatgctgttgttctccaaacaaaccgatcacggcaaaaactaacctgaactcaagtctgttttccaaaggacagatctgttcccctttcgttgtgtcacccagaatggaccttctgggccttgtacagttgatttctccaaagcccaacttggtcctctggagaggtcttgacttcctcctcattttctgggccagctcctccattgaaacatgtaaatgcagatcagcgaggcatgccctggagctgactatgccagtggtgaacatttacacacatacacacacacacgcgcgtgcgctgtgggaaaat

SEQ ID NO: 34695 - DNA, 896 bp, Bovine  19866880900574
ctgtcatgcaggggcagctgtgggaccccgctcccctaagccactttattaatgacccaggagagaccagtagtgtctctgttaaagtcacaaacgattctggactgagaagccttgggaaccacggcagggaggactgacaaattaatacccaaattaaaagcttgaaatatatgggcagcaaataagaagaaacttccctggaaaaaagaaaatccagtagagatttaatgaccgagtctgttgcttacttaggagaaacaaattctcctagctgattttggtgctttaaaaagtgtgtggtttttaaattaaattattcctaatttttcaaaaagaattgattttggcaaaaatcaattgggtgccttcccccacaccccgccccaccatcttaagtcagtatgtatagacactccactcatcaaatacaatcctgggaaggattgctactgacaatgacctgagttccaaggcttcataaaatcacagactggaactaactaactcattttagataggaaggggcctcagagataatgggtctcagttctttataatgaaagtgaagtgcacagagcctggcctggtatgacattgcctggcagtgtcaggccaggctgtctgtgccctgtcctctaccatactggcatgccttttcctttactgtctgtggcatgattcctggtagcccataaaagggagtgacaccacttcttgtttttttttttttttttaatttaattaatttggctgtgccaagtcttagttgtaacacttgggatcttaagtcttcgctatggcacacgggatcttaagctgtggcatatgagatctacttccctgaccagggatggaacccaggccttctgcattgggagtgggagtctcagcca

SEQ ID NO: 34696 - DNA, 736 bp, Bovine  19866881043153
tttgtcctggctttattgaggtctatctgtttattgttttaagtcttcatcctgaagtatgaaaagagaaagcccatccctcgtctcccccagtcctcagaggtaacttctgctaacagtgtggagtccatcctttccgatctttatccacaaatgtataaacatataaatacatatatgtgttctatatatttttttctccaaaaataaagtagtgctgggacttttccagtggtctggtggttaagattctgccttgtaaggccggggacaaagatttgattcctggttaagcaattaagatcccacatgccatagggcaactaagccctcgaaccacaattagagaagcctgcaagccacaactaagacccaacacagccaaataaataaataatttaaaaaaaaaagtattgccacatctttctgcaactttttcattttctgtttttatactgaagattgtatttcagagacttctggtatccacctcaacatgtaaagagcttggaagttgccactcccatccttacaaaatgaagaaagttaacaaactgaaaaccaatgacttttcttagacctataagagaattaaggtcatagggcaaatcaccacccctaaatctggagagacaggtgaatccaaaccatctcagctgagatcaccttcccttgagcacaggctgctgcagtcttcaagtgctaggagaactttcatggtgactttgatgaatgg

SEQ ID NO: 34697 - DNA, 1151 bp, Bovine  19866881169774
tggtaacttggattaaatctgcaaaaccccaggggaaacctgagtgaggtctggggtttagttaattgcactgtgcccatggtcagttttgataatgtaccatagtgaattcagatgccacccctgagggaagctaggggatgatactcaggacctttgtgtactgtttttgtaacttcttgagagcctatcattattaaaaaaaaattttttttaacagtttgattggatataccaagaccaatgatgaaatcatttgttctctcttatttgcaacacatccattgttaacctgcaatttgtggcgaggtgttttagagttgtcgctgaacttgatttggaaaaagttgacatcgtttgataggtggtctttctgtctaggaatgttttgtgttgtattttttcaaggtatgttttatcttccagtaaaatgtgtgtagttttctttaggtaacttgtagatattttaaagtttggggttttaagtttgttcttatggatggatcttttccctatctgtattctttaactggctcttgctggttacatgtccctgaacagaatccccacacctttcaaatacatgaaattcttttagcttgagaaaatgctcttcattctgcagttagagacaatgtttaacaggtttttattcattcctttaaacttgctctcagaaagggtccatctgttcagttattgaatgtagatttaagtatctgttttcttcatctgagtatatgggggatgttctttataaagaaatacaaagttgtgctctgtaaatgtaatgttaactgtattgttttggattctgtctttgaacattgtagaggtgctgtctctctccaggggtcatgtgcattacctggggggccctgggtccctaccaggtcagatggacaaatggggtgtcctgtccatagtgtgatatgaacttttcttgtccctggcttttcttctctgctttggtcgcagagccatgaggcctgggtgggcattgagaaggcctctagcttgccgaagccccaaaattgaaaacagaagtggaaaatgtaccattaacctccctccaggtcagtcttacgaaattcgactgctggagaacaggaaactgggagattttcaggatctgaacacaaaatatgtga

SEQ ID NO: 34698 - DNA, 966 bp, Bovine  19866881199337
tgcccaggacacccttggcccagcatctatctgcctcttagcctctgagctcagatcgtgttggctcctgtcatgacagctggagatgcatgaagcaaggctgctggcaaaggaaggaatctgaggaaactagattcttttctcagaacactttttgcaaaaccaacttccctaattcagggcccggttcatttattccagatgtccctccagtgttaaggccacaggagcccaacagatacttcagaagtaggaagcagtggatactagcaaaactcattaggaaaaatgttgtcatttagtttaaactaagtatacacctcctctatgactcagcaattctgctcccagttatctacctaagaaatgaaaaaatacgtcctcacagagatgtctattttaatcttcatatcagtatagttcattacgtcaggtgacacaaaataaatatccatcaacaagaaaatgatacagtcaatcctcattattcacacattctgtatttgtgaattcacctactcatgaaaacttatgtgtagctccaaaatcaatatttccaagagccttcaagggagcacatgttctcaactaaagttgaaaacggcaaaatccccatctttttgttgcaactcctacaacgtaaataatggcttctttgctgtctaattagcggcatgtttttggcattttattgggtgattttgctcttaaagatgactcccaagcacactgctgaggtgcctacctactgttgctaagtgtaagaaagctgttacgtttcttacagagaaaatgagcttagataagcattaaacaagcttttttacccaaaatacatattccagggacttctctggtagtgtagtggataagaatccacctgccattgcaggggacacggattccatcactgggctgggaagattccatatgctgcagagcaactaagctcctgagccacaacta

SEQ ID NO: 34699 - DNA, 1492 bp, Bovine  19866881266459
tctatctgctttcacacttttatttctcatttccaacaacttagaaatgatatctaacacttttcaaataacaaattattttagtaaaacaaaagaaggcaggctgcattttacagcaaagtgataccctagatacattcatgggttagggtcaataattttatgattattatctagtttatagtttgtcagcaaataagtacttttctttagctacagatttattatagaattttcatagatttaaccagcatgacagtttcattctttcctcataagcatgttagctttcctcaagaaactcaaaagcatgcacatttttaaccaaattaacatctatgggcctcatttcaatcaaccccaattaaagatcattaagtggctgcagataaaggacaatgactagtctataattactggctctttcatgctgaaaatccaattctcccatgagcatacgcacatctgcatgatttaaaaatgtacatagaaaataatttgctttttgaaacccatagaaggaaaaactgtaatttttgcttcaaggggtttgctaattacatggagatggaaaaaaagaaacatctacaaaacaacatatttttaactctcatattcctgccactcaaaactcaaaggccttcaggtaacctagcaacaaaaaagaatcacacaaagatgaagtattccattacagccaggtcactcacccccaactgctgctcagatgctttttcactgctgttttcatcacaagtctaatacttgtgaaaaatgaagtctttggcatttatataatcaattacacaccttaaaacatagttttgaacatgtcaagagaattacaacccaggacaaaacccatttcttccctaagtgtattgctattacattaatagttcctttcaacttagctcaaatccagagcttttatttcttacttaaaggagctttattgttcacaagcaacaacaacaaaaaatagataaattagaattcatccaaattagaaccttagatgccaagaaagtgaaacacaaccaaaaactggaaaaagaatatttgtaaatcaaatatctagtaagagtcttataatctagcatatgaaaagaactcttatagctcaacaataaaaacacaagtaaaccaatttagaaatgggcaaaggacttgaatagagcttttcaaataagatcgtttgtagaaacaaccaacaagtacatgaaaatacactcaacatcattagtcatgagggaaatgcaaatcaaaataatgagacaccacttcacacccactacaatgactaattttttttaaaaaagaaagaaaacagtgtatgttttgttttgctggagaggatgtggagaaaatgggaaccctcacacatcgctggtggaaataaaaaatggggaaaccgtgatgggagacagtttgacagttcctcaataggaggaataattctggaacacagaaatgccacaggatccagcaa

SEQ ID NO: 34700 - DNA, 1580 bp, Bovine  19866881292839
ttgattttgctgtaaattaattgtccatatatgtgggagtttatttctgggccctctattctgttccattaatctatgtctgtttttaatgctagtacatacagttttgattagtgtagctttgtaacatagattgaaattaagaagcatggtgtgcccagttttgttcttctttctcaagattgctttggccatttggggtcttgatggttttaaacaaagtttagcattgtttattctacttctgtgaaaaactctagctgtttcttacacctacatttttgtatctccttgtctatcagtttgtgttacttcagcttcagaaatgggtttaagagcaaggagttcattcaatagggcaagaaaatgatgcaaaagatgcaaaagagaaacctcagagttattcctttcccagggtgaagaatttaggatatttgtgttccatgtcctgtttaccattggttgtcttcctcctagaggtgttgattcccagatgcttctgatctgctgtgcagatgaacagagcagccttccatgtttccagaagagccttcaggtatagaggtgtagatgctggcagtcggtagctatttggagcatctaaaatgatgtggtttgcagaaaggatacagagcctcgacagtacctgctacactccaaatagctgtgaaccctggatatcagttctgattctgtcacgaataaattgtttgactttggataagttatgtgtcccttgtgcctcagtttcctcaaaagcagagtgagggattaataatttcatctcttcaactaggatacagagtccttgggagcaggaactgttctttggacaccctgtccttccggcatgggtccagttcagttggatgcctcttcttgctgcttattctatcagtcactttatctaagaccttcaggagactccaaacatggaggatgtttgtgtttccaagagccacactattaccatgcttgggactagttctccttcactagcccatcctttgatgctgaacacaaactctggaagcaggtcgagaagatggtccttgagccatctgatggagcagaaaacaggaacatagggctttggatggactaggtactcagaaatgcttgcatagctagggactgaaaacatttcccaaattttggctgaacagcaggtgctccacacagatttctatgtacatataactttgagtgaacacatattctaaaatgtcacccacagccattaggaatgcagaggctcttcttggtatgggccattaactaccgtttatgaactggtttaaatcccgtgaacggtgcacccagggatgaccttggctcaggtgtcagtaaattatgctgcatagcgctttgcctcatgctaccatccctgatctgaaggtggctaattattacccaggcagtaggcatgtcctttccatattcatgggatttccacttctgggttgtctgttcatttccaaatactttctgaattagtctctgaatcttttctgacttctctaaaatgtaaggtttaatttccatcaagagtcatccatgtctataaataacctccaaag

SEQ ID NO: 34701 - DNA, 1400 bp, Bovine  19866881336881
atgttatactgtaaaactattatactttatcttaatattgaaagtcagtaatacttgtctgtgccacaaaactctaaacttttattgacttaaaaaagttacaaatcttccaaaatataattttgattttgtgtatgagtcctccagtgcacactgtttacattttaaaaattgatgtttttttatagctgcaaaagaaggagctggtgctgttgatgaagaggattttattaaagcatttgacgatgtgcctgtagtccaggtgagtgaagatgtttggtttgattaaaaaggatgggcttattcttcagatttcattttgcaagcatgtgacacacacagtttcttagtaggtagggtaattctgactatcaagaccacaggaggtctggggtttgcaggctaggaaatgttagggcctctcagaactgaaaatggatgaccttccagttagaactggtgagaagtggcttgctccagtagtgagttcgtgagtcaggtcacacagaagagggggaaataagtgactccattccaagagagaacaaagaagcatgcttatatctgtattttccttagagaagtctgtaaatttgaagaatgtaggtttctgaaaggtataaaaaatgttttcataaaaccttagtttataccattgtgatacttcccttaagtacctgacatgtgaagcagagatgacttacagaactcactgtaaactgctttgtgccccagcattgtctctggttgatgggggcttgtggtccattggatgtcagtgctcaggatccctccagcacttggtatctgtgtgtgtcccttgtcacccactgcttagttgccatgtgtatacaaagcagatagcaggtgttttaggttcaggttcatccttatgtccttgaccttcctatcatgccttactcttggtggattttttcctcccccttactgtctttggagtaagataccaggataaatgagaaaataggtttgaaagtgtttaaggttacaagcatagacacaccttgctgtattgcccttcacggtgttgtgcttgtaaatgctgcagtttcacatctatgggcaccttgcctcaagcatgtgtacggtgccgcttccccatcagcatttgctcaccttgtgtctctgtcatgtttggtaattctcacaacagttcaactctccatcagcaaaaagattacagttctctgaagactcagatgatggttagcatttgttttttttttttttttttggcaataaaggatttttaaagtatgcacacggcctttttagacagtgggcatactttaattgggcagttaatagactgcagtataggaaaatctttgtgactcacttcattgtgattttcactttattgcacctgcagtgcactg

SEQ ID NO: 34702 - DNA, 845 bp, Bovine  19866881367174
tgtgtggtatttttgcactaaaaataaagtctatctttacaggtatatgttttagggaactataaacaagatgagtggggcttgctgggtagagcaaagaatctgcctgccagtaaaggagatatgagtcacaggtttgatccctgggttgggaagatctcctcgtgtaggaaacagcaacccccactccactattcttgcctggaaaattccatggacagaggagcctggcgggctacagtccatgaggtcacaaagagtcggacaccaccaagacacagcatacacacacatgcgagaagagtatgttcaaagcatctcccaggacctggcatgtattccaaataatgtcaaccttcccagcaataagtaccatcagtaaggtgacattaaagtctgttttgtttctgagggacatgtgagaagctaccaagcttccatctaccactggatagcaaagcaaatttttaatttttttctctgaaaacacagtttttggaaggaaaaacaagtaagtttgctactgggcccatgttgcctgcttaaaggacctgcctgctggatatgtgaggtccttacgacatcagtttctagacacatggagcctctgggaggatcaatgagcagcgacctccacgctctgcacaagtgactttcagggcctcccacccccaggctgttaaaacgaaaggtcagcatcctgctggtgagcgagtgaggaattcttcactgacacatacctgctgagtgatttgttgggtgctttttccatccagcaggcagctgtgggtaatgtttaaccagaaaaagaggggctaaattattcaagacatgtttacaatgca

SEQ ID NO: 34703 - DNA, 1124 bp, Bovine  19866881396775
ccctaccccttttgcagggggaagccgggcttcctaattgtactcagaactgtgtctgctctgtgatggaggaggcctggcaggcagggagccccatggatcattaagatcattagattctgtctgcagctgttagaaaacgagcattcatgcgtgtgggactctaccatgttgcataaatgctcagtgtgaataactgtggccacagagcatttttgctttagagaaaggaaaccttttgcagccaagggaagatggccttcagctttgagaaacactgccctcctgagtggaacactaaatcccaggttgtgggattccttcctcctgccatggtagtagcttccagtagtgtaaaggagggacgctttttactctgtgaacaagagagtatcaactgtccgtttccttccagagagagagggagagagggagggagcatgaggactggctcagatgctgcaggctactgttagtgatatttagatacttagatatctccccctctcttttacccctaaagttgaaactaaaacaccaactttgaaatattcacacttagcctccattttacagaggaggaaactgaggcattcagaggaaataatttacctacagttacatagctagtaagtagaacagtctaggtccaaagtatgcattcttaactactgtgcagtattgtcatgtcagtttaaaaacaagattggccatggttcttggaaccaacctttcattttaaagttttttaaaatttattgtattgaactataattgatttacaatgttttcttaatttctgctcttcagcaaagtgattcagttctctgtatacacacacacacatttgtatacacattgtttttcatattcttttcccttatggtttatcataagatattgaatattgttcctttgtgtgggttggtaaagaatccatctgcaatgcagaagacctgggtttgatccttagatcgggaaaatccccttgagaagggcatggcagcccactccagtgttcttacctggaaaatcccatggacagaggagcctggtgggctacagtccatggggtcgcagagcggacacgacttcagcaactaacactgtcaccttctcacctc

SEQ ID NO: 34704 - DNA, 2900 bp, Bovine  19866880164099
cagtccaagggactctcaagaggcttctcccacaccacggttcaaaagcaccagttctttggtgctcagctttctttatagtccaactctcacatccatacatgattactgaaaaaccatagctttgactagatggacctttgttggtaaagtaatgtctctgcttttgaatatgctatctaggttggtcataactttccttccaaggagtaagtgtcttttaatttcatggctgcaatcaccatctgcagtgattttggagcccagaaaaataaagtctgacactgtttccactgtttccccatctatttcccatgaagtgatgggaccagatgtcatgatcttcgttttctgaatgttgagctttaagccgactttttcactctcctctttcactttcatcaagaggctctttagttcctcttcactttctgccataagggtggtgtcatctgcatatctgaggttattggtatttctcccacaaccttgattccatcttgtgcttcttccagcccagcatttctcatgatgtactctgcatataagttaaataagcaggatgacaatatacagccttgatgtactccttttcctatttggaaccatcccccttggtccaacacaaatttttataagtaaacagcacacacaattctgttactatcctcctgttgtgtaactccacctgagtgtttccacactcaaagcacccagccacaaacaagggtgattctgagcatgagctgaagacagatgaagacctgatgtaggtcacccaggctctagaaggggccaccttctagatcaaagtgcagccttgccaccagctgcctgcctctgagcaagcaggtctttggattagctctgccacaagccatgagcaaccgttagtctaaatttggggttggcagagataagaggccaggcagatggcctggatgagagcctttccagggcctcagtaagaatctacaactgacaattgtcaacagggttaatggactggaaacatgggcatgtcctgctaacaaaggcatccccaaatccctttagaagaggaggtatgggttttcagtctacaggcttggttgtttacccgagtgagtattcctccccataagacccctaaacagagatgaataagggaatagcatggcatattgcacacttaccatcacaggtttcttctgttagaagcatttttctgattttctttcttcccttacctcttgggcagcatgaagagaaatcacaagtcatgtggaggctaaggactccaattgtaggtttaaatttaggttcttctattagctgatggatgctggggcaagtcacttaactgaagagtttgtgaaaatggggttatagcaatatttacctcggagatgctaaaaaaaaaaagcattttagataaatagtgcctgttttctgaatcaatggattatttttatcatgaaagaagaaaataaatcatatcttgaaattgatacgctgatagtctcatcagacaagtagcctctttggagggctccagaagacccctggtgcttggcattatgacctaggtacttccttcctcactttgtgatgaatcatgatcaagtgtgcgtgcgcgtgcgcgcgcgtgtgtgtgtaagagacagagactgtgacagttaagggacaatttggttgtgctgtgcccagatatgttgtcaaacataaatgcttctatgagattgttttgagatggggacagggaggcctggcgtgttgcagttcatggggtcgcaaagagtcggatacgactgcacgactgaactgaactgaactaaaatttaaattagtgggatcgaataaagacaattgctttccctagtgtggtcagccttactcaatcagttgaaggcctgaataaaacaagactgatttccctgggtcaagcatgaattttgtcattcagttggctttggacttgaactggaacattagctcttcctgattctccagcttgctgacccaccttgcagattttgggtttgccagagccataattgcatgagccaattttttaaaaaagaagtctttctgttggttctacttccttggggaaccctgactgattctggtgagacaagaagactatcagcattccctgctggcttatatcacctgagagacttcacttgtcaaacctgctcacagcgctttttttcacagtgattctgcattttagaaatactgcagtgtttctgtcttgtgcctgcttttcattattttcttatttgggataaattaaaagtgtaaaacagggaatacaatggtcattactagactgtactatgttcaagggaatcttaattcaaactaagaccaaagacacacacccactcttgaagacaaaagacaatacaagatagtttctgtcaacataattctattataaggacctacaaaacaaggattattttaataattatgatagtaataacaatagttgactcttagaaagaaaatgaaagtgaaagtcgctcagtccgttccaactctgtgaccccaaggattatatggtccatggaattctccaggccagaatactggagtgggtagcttttcccttctccaggggatcttcccaacccagggatcgaacccaggtctcctgcattgcaagcggataccagctgagccacaagggaagcccttaccagttattggctatatacaagaatttacatgtattatttccttaaacatgataatagtggtgggaggccttcccaaatgtactggagaatcactgcaggcccctaaattttagtgtttaatttctccctacaaatgatgcatttctttgaattttatttaattattttttaagttttgactgtgctgggactttgttgctgggtatgggg

SEQ ID NO: 34705 - DNA, 1786 bp, Bovine  19866880196575
ccgcctactctgtgctcataacccgcagtggcacaattaaggggttaaaaaaactaaggtgcaataggggtgtttgtagggagctctgaactctgcttaaaaatggtaccaagatacgtaagaatatactgaaggtagaaagaggagattccaacatcttccattaattacttttctaaggagcctttcaaccctactctacctgccttgagagtgttttgccatttgcctcccaacctcattcagaccaggaaccaacagcaattagcctcatctaccacaagcctggtgttggagaagactcttgagagtcccgtggactgcaaggagattcaacccgtccattctaaaggagataggtcctggttgttcattggaaggactgatgctgaagctgaaactccagtactttggccacctcatgcgaagagttgactcattggaaaagactctgatgctgggagggataggtggcaggaggagaaggggacgacagaggatgagatggctggatggcatcaccaactcgatggatgtgagtttgagtgaactccgggagttggtgatggacagggaggcctggcgtgctgcaattcatggggtcgcagagtcggacacgactgagcaactgaactgaactgaactgaccgcaagcctagaaggcttaatcaacctaatctcgtggtattgcaaaggctgctaggaaactaaaattggtgtcgttgataagcaaaccaaatacaaaggaagccacagaaagctaagttcaaattctcatttaagtttctattttaaaagctaaaatacagcaaacatcagtgagaaagcttgaaagaagtcgttagcatctcagcagacaccatttggacatatttctcagcaaatggcttctgaaagtgcagtgagaactctgatttctattggtagctgactagagagttgccctgactttacaaccctgcagcaacgtctttggattcggtggacatacaactctccccagtagggaccttgcacagttttcaaatgtagcccctgtgattgctccagaagctgttttgccactcaatgtgttcagccctgaatttagggatggtccccaattccgacttgactatttagtctgatcattaagcagttcctttgtctttcttccatttatttgtttacttacgccttctccttctccctcccggccaaccaccaaactttcagtccgtccctctcccaccccacctcccccttggcaaccacaagactattgtctgtgtctgtgagtttgcttctctttgctagatgagttcattgtgtcatattttagattccacatataagtggtatcacatgttgtttgcctttttctgaattacttctaaatgatgatgaggtctacttagcaagtatctattctgtgccagatgctgggcaaagtgcttggcttatcttatctctaatgtacgcaagactgaaaggtagatcacagtctccaaccctaattacagaaactgagcttcaaggaagtcaaataccttgttcatagacacataactggtggttacagagctaagatttggattcagataactcaggatctttgtcattgtgaacactgctcctgatttatagaggtgtcctagtcacagcttctaccctggacaccaggaccacatcctttctcctattacttggacttgagtgtctcaaccaaacagaagaggccttagtgtacaactaactgtttcacatagtttaaaaaaaagttctagagaacttacatcaaagccaa

SEQ ID NO: 34706 - DNA, 3289 bp, Bovine  19866880414821
tgtaagacatggcctggggtcttctctctagctcagttggtaaagaatccgcctgcaatgctggagatcccagttcgattcctgggtggggaagatccactggagaaaagataggctacccactccagtattcttgggtttccctggtggctcagctggtaaagaatctgcctgcaatgaggaagacctgggttcaatccctgagttggaaagatcccttgggaaaaggctacccactccagtattctggcctggagaattccatggactgtatagtccacggggtcgcaaagagtcagacacgactgagtgactttcattttcaaggcatgacctaaaaatgtaacttatatcaacaatcccataagagaagttttattcttatcttccccattttatagatggagaaattgagacacaagaagattaaataacttgtccttctaagtaagtatgacgagccaggacctgaactcaagtcgtccaatgccacagttcatacttgaaccgctgtacacactgcctgtcacctggccaaagggacaaaggcagttgctcatttatctgttttatcttttggtatctacacttgcttttctttaaagagggggtctctaagttttttaaagtttgaaaatcatggaactagatctaattaagtcacttcaacagtctaaaatatagctttagcagagctactctaaaggagaaagtaaaattgcatccctcatcttccctcttctctttacacatggagccctaaagacatctctgcaaattccacagcaggacaccatccctccaactgcagagaatgaagaagactctctgcttctcaaagacagaataactaagaaagcaatggcaacttttatgccccttgcactctccaaaatatataggaaagaacagactcaaagggacttagaacctaattcaaatttcaattgattcacttgttgtagaagcttagaggatgagcttgaaaggtgcacaacctatgaagaattccaaatactgaatctgcagctgggataagcatagagtggcgtgaaatttcactccaaatgtcaaggctactgctcgtggccctgagctgctcttatttttcagcatgtgagcacatgttttccaacacagagacatcaataagtcaagccaaggataatctctaggtcattaattaaagcctgtgtacaggcatgaacacgatatcatcatacatagcatacggagccataaacactacatggaaccagcagctataaattatgagcatataattcccttgagcttcataaaccataaaaatgaagctcaagtggtttgtgtagtcatttgaatcccagaaggaaatacagcaccgtgattcaaaagttgcttattgtttatttttatataatggatggatcctacttgtcaattcacgcgtgccctcctcccaatggggccgtccatcctcacactgactctctgtcagccatcccctcccagcctggcttcccccaaggtctcccctcttcacagaaaaggcccccctccatggcaggagcagaagcagcagcctggtgggagtttggggcttcttatcccactagcagacattaataattcacgagagcagtgtaactctgtgaatcatcaatgactttttttcatgggatgcagcatttgaaacactgcattccatgtattatgacttacttacagatttggaaaaacagcagctattgagcactaacgtcttcatgaaagtattgttttaaatgatgtcttcccaatcccctgtcctcaaatgcctcgtctccattcaaaaatgtgatgttctttccttaaatcctgtgcattcatccactcattaacctaacaatgagaaatcaaatatttagtgatcactgattatatacttggaaacgtgtcatacttaggatgttttcctctctcgagaatgtacaatctggttttaaagtaaaataaaaatacactgcagagcatgagaattggagtcaggtaaaagaaagtgaaagtgaaagtcgctcagtcgtgtccgactctttgcaaccccatggaccatacagtccctggaattctctaggccagaatactggaatgggtagcctttccctttcttcaggagatcttcccaacccagggaacccaggagtcaagtaaaccagggttatgtttgaactctgctgcttcttaactgtgtggtattaggtatgacacttaatttctcagaacaatcatcttctcatctgaataagtgaagatgataatatgtgcctttctgagtagctgagagttagtaacatatacctcttacttgctatatgcccttgggtaaattacgtaacccactcagtgtctccatttcctcagtctgcaaaatggggattgtaagtgttcttctcatgttattctgaagattaaatgtgttattaggtgtaaaacatacagaagagtgcttgatacatcataagagcccaactgatgttagtggctcaggttgtttctctacataaagtgcctatatcataccatttagtagatattcaaagtagtataaaataatatcagtaataaataagaaactatttcatatcaaattatgttacatagtctaaaataatttttttaaagaaacactcccaaaggacggaacacagggactcaaacctgtacatctatgttaatagcagcattattcacaatagtcaaaagatagaaggaacccaggtgtccatctacaggtgcatagataaacaaaggtggtacatacatataatggagtattactcagcctgaaaaagaaaggaaattctgacacatggtacaacatggatgaaagctgaagattttatgctatgtgaaagaagccatttacagaggggcaaaatattgtatatacctcacttacatgaggtatcgagagaagtaatatttacagaaacagaaagtaattaagtggcttccagaagctgaagggatgcggtatagagtctctggggaaggtgaaaaagttctggagatggatggtggtgatagacacaacgcaaatgtacttaatgtcacactgtacattgaaaagtagttaaaatggtaaatttcatagcctgtaattttaccacacaaaaaagtttagaaacagacggcatgtaaagagggttaaagaagtctacgatgtctccttagaacaggtggcacaataattgcatcttagaagacaggaagatctggggaaatggcgtgttccgagtgaggggagcacccgagtgaggggagcacc

SEQ ID NO: 34707 - DNA, 1935 bp, Bovine  19866880440332
gcagacaggttctttaccctgagccgcctgggaggcataagtactgaatctttaaaacaaaaaaatagcacacacacaaaaaacaaaattttactagagagagattttatctctctgcatcatcattaaaacaatttgcttaagcttcttaacatgggacagctgcattttaagttatattgcttagtcactcagttgtgtctgactttttgcaaccccacagactggttcctctgtccaccaggttcctctgtccatgggattctccagacaagaatactggagtgggttgccatttccttctccagaggatcttcctgatccagggattgaacccaggtctcccgaattgtaggcagattctttactgtctgagctacagggaagcccatttatttaggcataaatactagcaaataaatatatcatggttggtcacttaacatctttcttcatttctaaaatggggcaaaagcttagtggaagagaataacaaaataataacataatttaaataaaatgatctaattcaagcatcatcacctctaaagttccatagaaatgagaatagaaaaaaaattgaatgattcagttatgtgcatagctttccctttccacattatgcagagaacttaggttaaagattggtaaatatagcatctggtacatggtgagttctcagtacgtaggtctgaataaatgagtaaatggagttaatgtaactcgttgccttcactggacctttcttaagccatcccacgttggaattcattcaactttacacaaaaaaagattgtgctattttcacaataaatatacaaatatcacatagtagtttatgagaagtcaggttatactgcttgtaacctggaacagtaatactgagagattttggaatgctatacccaatgatggatccacactctgcttattccaaacaagaaaagacattcattgactatttagtaatttatgtttgtttgtttagcaactttgcaaaaaaaaaaaaaaaagcacaatgagaggagtgggtcctggtacagtggaaagagagggaagacaaaggatttaattccaactttcctactatcttatcatgtgactttggctatggcacttggcctccccaggtccccagctcctcttctatgaaatgtgtcctcggataaaatatagcctataagaaaaaaagtgcctccaaacagtgaaagagacttgagaacaattgtgctgatgcatgtttcgaaatgtctgttgacagaagagtaagatcaaagagtccagatctcaggggaagagttcctagaacacatatgttgggtagagactgagaaagtgcagttcagtatatatttgttcaacaattactatactatgtatgtggcatctaccaaaagatttgagttacatgatgaataagatagtccctgctgccatcaatatcttcacacagataccaagataaggactatgatgatcaatctgtgtcactatgactaaattacaggatgcccacacatttggccaaacattatgctgggtgagtttgtaggggtgttcctggacgggcttaacatttgaattggtagactgagtaaaatgaattgtcttccttaacatgagtgggtctcatccaaccacttaaaggcctgactagaacaaaaaggctgaagaagagggaattcctcctgcctgactgtatgggctgagattcggggtttttttccccagtcttcagacccagccagaaaattggctcttcttgggtcttgagcctgacagcattcatactggaattcatgccatcagttctcctgggtctccagcttattgactatgtatcttgggacatgatctccataaatatatgacccaattctttataatagagccatatatatggctttctctggagaagcctaatacaaggaccaa

SEQ ID NO: 34708 - DNA, 1388 bp, Bovine  19866880531716
atttagcaaaaagaacaaaatgcttaaaaatcatcacgttttgaaagctaaatgtgagagctctgtgggtaaatcccctaacaagtgagagattttgaataaacagtaattatgtagcaaaaatctaagtaacagctgcagggaatgttgaaacagagcctggaggtttgtgtacgtgaaggatgtaacctggtggaataatttattatctggaaccagagaatccctatgcatactaacgctatgcatatcatctgtataggaaattttaggaatgaaaatacttccatgtcaccttgaaacatttattgctaaaatgtttacttttcaaaagtaatgtgatgttagccagctgtggacttctggtatagtgatggttaaacataggtatatttctttaatattgtcagagtttcctggcctgaatatggcagcaattttccatttcctcattgaacagaattttttgaaagtcagcagttgaagtaaatgataagacaacaaagaagagagaatgaagagagagagagaaggggagtagcctgttgagaagagatgaagaactatggagttgagcaccccgtaagtataaaaattaagtaaaaattttgcatatgtttgtactctgaatttttcctagttaaaaataacccacaaaggcatcaagaagacctgtgaccagagactgaatcatctttgcatgacatcaacatgacccctcgtgcaggtcctcaggaaacagagtggaacccccattccagatccgaggggacaagctgaggaccctgtccatccgtgtgcatgaggacttcttgatacagtcagagatcatacagccttctttcctacatagttctttctggttattcctactctgagaactgagaagttcataatatatcccattttaactgctgtttatagaaatacacttgtcagagtccatcaaagccaaggacagtgtaaaaaatggagaaagtttccaatgggagatagtcatggaaatcccccaaatgaggaaattgtaagtagattttccatatgactctcattctttaagaatttgctccgtgtatgcaatcctactttcggccagctccaaaggaaatggcctctcacccttcactcattcaccaaaaatcaaacaggaagagataaataatccttccacagtgtcccaataaatccttaaggattgtctttttattttcaacttgatgcattaatcaaatgtcagttgaaaaatatattaaaaagttagatgattttatttccactacagcttatgttgcagtggaatacaatggtaaaacatgtttgtgaagtgttgggctgtaatactgtatatcttctgacataagcagtattataggggttttatctttgca

SEQ ID NO: 34709 - DNA, 1119 bp, Bovine  19866880535592
ggttggtgaagtagtctaccaagtgtgtatggcttggtggttttaggcaatttcagttacaaaccatggtttccctccagccaggatgtaatattcattagtgaaattatgtctgtgtgaagaagaaagataggcgagacttgtttgtgaggacggagtcctcctctggcataatcctagcagtggggtaccttgccttggatcattcagacaaaggctttacttggccgcttcttttggccgtgagggtgttgttgtgaaggctgcgtctcgagtatccttgtgaccagggccatcgaaagctgggaattgtgacaggaactgtcttgtaggacaacatttaaagttctgactaataaacttgggtggcagaaggaaattttatttgacaaaaaatattaactgttcaaaatattcacttattgaggtccccaaagtagatactattatcctcgctttacagaggtgagtcggtggaggagccagggtccaaaccagccaatctaataattgcattgtgtgactgattcatccacaaagaaatcatgagactctaggcatgggaacggaaagcaattacttctgtttcccactggaaacctttctgtgaggggtgaaaccaaatgtaaataacaaaataaaggatgagtttaatgctttgtttactttttaggtttcattaagcacctcaaacggtggcctgtttgagcatctagctaaaataaggcatttattttaatttgcttttctgccattcaacttacatgtctttggaagcttggaagtgctaagaaatcatttcaagtgcagatggtatatatcgatcagttcttaacctatttactgagaagaaatttgtttgtgtatttaaaagagaaataatccttatcatcaacaataaaaatgtattactgtgcatcaaaataaatctttagatcttgttagtttcctttaatgttttctgtttattctgaaagctcttactaattggagaaattcatagaataccaatgttttgctgctgctgctgcgttgcttcaatcgtgtccgactctgtgtgaccccatagacggcagcccaccaggctcccccgtccctgggattctccaggcaagaaca

SEQ ID NO: 34710 - DNA, 1248 bp, Bovine  19866880537025
ttgtacctatcgcagttgcttataattaatcaggtgctattttctttttttgtttagttttgaataggctcattctaagtttcagaaataatcattcttaacagaagagccctgtaacagtagacaagcctattaagacttgtgtcaagctgtgaatctcaataccttggaatatcctaagggtctttggctggaagttataactgcagtttcacatagtagttgtttttttaagacgaagagaattttactgggaaaaaaatagtttgttccttttctcaaatgcagggctgagaaggcattgatatattaggattaataacagatctttaagttacttttataattaatatttagtcatcaagcatttttaatgtaaaagatcttagaattttgtatgtactctttataaaacatctatacgtatgagtgttttaaattttgaatatctattgtggaaaacaacacaagaggactgatttaggttgtatattctctttaagtaacttccatagtaagcattttaaatgtctgtgtttcttttcaaactttatattcatattctttgcacatttaaagtataaatgcataattttcatatatatttacttttgtacagcataccttacaaaatatttttttaacgaccaaaattcaaaggatacaataacatgtcgatcagatgggtttctctgacgtgttctttctaactgagttaactgtttagcttctcgattccttgctgttaatgttgctttgagatcatcctgcaaaaagacattttttttgttaataaatatctctgacttaagaataaaatacacacttctttaagaatgcaaaaacattccctatttgatccaggcatcattaccactggaattattactacattaccagtgtgtgtctttgtatgtaagactatctgcatgtatgtatttaatatcctattaaatagtgacagaattgcagtgcaaaattatatatatatatatacacacacacacacatacatatatatgtatatacacacataaaaatttttgcttgtggtggtagttacatgtatatacacatttattaaaacatttaaaacaggagaattttactgcatgtaaattatacctcaataaaattgattttaaatacagaacttttggaatgtaatatctaccatggtaacccagaattaatagtactgtactgcattctgaaagttgttaggaaactaggtcttaaaagttctca

SEQ ID NO: 34711 - DNA, 1490 bp, Bovine  19866880665470
taggcatatttggatatgaccagtatatcaaataattctattaatctttttaggtgtgataccagaaaaatgccattttccttaggagctacaaaatatttaggagtaaaatgttacacagctacaacttattttcaagtggttcagaaaaaaatatgaatgtatgtgtttgtatgcatgtttacatacacagagagaaagcaaatatggcaaaacattaataattggttaaactagtaaaagatacatgcacagtcattgttttttttttttaacttttctacaataaaaatttttcaaaattaaagctgggaaggcaaaccaagatgtaagctcattgtctttggggaaagggaatgtgaagacactgactcaaatatttggaaattctttattgactgtctgatatattactatagaggattggctatttctcttagaaattacataaaacaataagataaacacagaaatagttatagatctgagtatgcatacgcatgcccttcccaggtggtacagtggtaaagaatccgcctgccaatgtggcagacacaagagcagtgggttcaattcctgggtcaggaagatcccctggagtaagaaatggcaacccaatccagtattcttgcttggaaaattccacgaacagaggaacctggtgggcttaagcccatggggtctcaaagagtcagacacgactgagcaactgagcacacactcacacacacgtttatacataatgtgtgtagatatcttctagctacgtctgctaattagggcatactaagcatggtaatctttgtttctaaatattatccttaagagctttttagagaaatagctgtttccaggaccgaagcaggaaaagtataagatgagcctggaaatcttgtggtgccagacaggaaatgctccaataaagatacagttatgtccaaaagacataggaacaaattcgaagggcttctaatggccaaacctatgacaatttgggaaacaatgaactgaagctcattttagtcccaaatgaattaccaaaggaagaaaagcagcaatatccttaactagtagaacaaaaaaactgaagcatactcacaagctctccataacgtgcagttgaaatcatacgtagaggaaaattccctgtgctgctcaaacacaatccccctgtcttcataaataaataagaaaaaaaaaagagtttatgtaagaatatcagcaattcaattttaaaatatatacattatcaatgtaattagccttactaaaatgttaggttctgaacatgcacaggacttgctggtattaatgaacgctggttcacatcggacacacctgtcaatacaacaaaaattatttttaaaatgttaatgaattagctctaatttaattgagagcttgtctttctaacttaatagattagaatagattcattcaactaagcaattacttgcaataaagtaaacttatcaaaagtatacactact

SEQ ID NO: 34712 - DNA, 1016 bp, Bovine  19866880690861
tatactatagagtatatagtagacaatactctagaagagtatgaatctagagagaatccctaacatgtcttatttttgactgtggcaaagatgaggaaaaaactagattattgcttgaatagagcatcagtttgcttgctagagttgatttttcttgttttgttttaaattggaatttcttaaaagtactttaagttataacagagatgctctcttaactttttactcccttgataacattaaataagtattatataaagtatatatccatgttaagtcttgagaacccttgactataagcaaagaaaagattcgtgagagctatttatcagttgtgttcttttgctgtagctttgtccagacacagagacgagactaaatgctgcttattcctttggaacaacttatcaacaaagtgtaagttggaactattttaggcagtctacattttggcttcatttttcacatcagcaataattgaaataattattaaatttttgaaattagtaattttttgcaaaaagaaagcgaaagtgaagtcgatcagtcatttctgactctttgcaaccccatggactgtagcccaccaggctcctccatgcatggaattttctaggcaagagtactagagtgggttgccatttccttctccaggggatcttcctgacccaaggatcgaacctgggactcctgcattgtgggctaatgaataatttatgaatgatttttattaataaaatcagcatgaaaacagtaccttgtcgtccatagagtcttaaacatcataattgtgtatttgcttctggcatataggtcttaaaaataatctctacttttgagcattttagaatgaagtagaagtacttcatttttaataaacaataaagtgttatcactgcctcctccctcctccctccagtagcaaaatgcttccttttctctccatgcttgtctccctccctccctgaccttccttcctttggtaatgcattttaaaactacagtatgggacaaag

SEQ ID NO: 34713 - DNA, 3044 bp, Bovine  19866880704878
aggcccccattcttcgcttctgctacattcctgactccatggctcagacagaagtgagcagcaatacccagtttgcgcaaagacctgggatatggttaggctggttccacatctttgcaaagaggccctttcctcctgccgcctcccctgttgagaatgactcagcacagtggagaggcagccagcagaagagcctgtggccaaggccaccagcacgttgtgctgcagagcccggtggctctccctatcttgggctttcaaaagcaacccaaataaagatgagctaggtgccaggttcattgatctgcggcggttagaactgaggcggatgtcagccgtgtccccatttggcgccccttccaagctgtgctggaaaggcgctggaggatgcctcccaggggtgcgctggaaagctggctgtctggctcccactcactttgtttgtctgggtctctgtctagtggcaaggcgaccatccaccgcagagctgccatactaggattgctcccctttggcacttccctttgtttttcattcctacgagtaaaagaagattattcattgaataatcagggtcaattggttattcaagaacattctgtaagtgttacaggatcggtccttgacttttagaaataaaacagactttcagagactgggtaagagccagcttagatactgccatgaaagggggacggatgttagcagcatcatgggaaggtccttccaaaaacccctcaaaacaggactggctttggagagctcatagctgttatagcagagctgtttcttcactcatctagaatcctaaacactgaaaagtatacaaaaacaatactcactaaccacctgacactgagcccagccctgctcgaggtcctggaatcccaggagaggctcacggtggagtgaggacaggtgttaactcttggtttcctcagaggaaccatcaatgaccctaacagaagttcacacaagatgtaatgagagcagagcaaagccaggcatatgtgctgggggaagagactatcagaaaaagcctcggcaatctctttgatcctcacacccttcttcacaagggccttgtgtaagcctttcatttctaagggaatttctttacaacactttatggtttacgatcccctttctctaattctatccttgtgataccctcaccagagagaggcttctgactgggctcttggcttagtgggaataattaacatttattgagttcttaccaggagtcagccgttgccccatgtaagccatatctcattcaattttagaacatttctgtgaatcaccttttatccccattcccacttacagataagaaaactaagacttagagggattaagtgagttgaccaaggtcccacagttggaggcagtgggttgtaacatgggcagtctcatggcagaaacctcactctaaaccaagtgtcagcaaattacggctggtgggggaaatctggcccactgcttgtttttataaacaaagttttattggaacatagccatttccatttgtttactattgtctacgactattcttgtgctacagaggcagaattgagtagttgttacagagatgttatagcttacagggcctaaaatatttactatatcactcttttcggaaaaagtttgctaacccctgatctccatcagcctcccttcaaattaaaccaaaatctcatagagggcatagactgtctcattcatccttggctgtcccctcagcctccaacttgggagattccagtattaatggttgcatttcaatggaccttacacacttgctcaattaaatggatttaatctgtatttaagcaatcccaaacctccttctaaaacagtagacattcaggcaaaaatcgtatttgctgcaatcttcattaggtgagacaaatttcagaggtcaagactggtgttctaacaggacagcaaggagaatcctaaattaaagtgtgtgatacatttgtagcaacctctttttaaaatgagttattctgtgagcggctcacaataaactgcatggaaggaagaaaaaaaaacccaatatatctttcagcactttggaaactagaaagtatacacaagcaaaaccccaaggatacaagaataaataaagcctgcactaagtccctggtgctttgcaggcagcccaggaagaaagcagaagcaaaggacgaggtgcaaagtgggtgtccatttgcagcagtggggagggaaggcggacctggaaagggttgcacattctgttgggcacctttgaaccaagggagaccacacccccaaccccactcagtctttatcatgttacatgtgtgcatgctaattagcttcagttatgtccaactcttttcgagcttatggatgtagcctgctaggctctgtctgtccatgggattctccaggcaagaatactggaatgggttgccatgcccaaccaggggatcttcctgacccagggatcaaatctgtgtctcttatgtctcctgcttggcaggcaggttctttaccactagcgtttatcatggtgtttgcccagttttggcaactacccagtcaaggactgcagtggtgtgggaggaacaatgggcccgtatggaagatctggggtcaagtcccagctgctgcatgccctggtgacttcctggccatgtcacctcgcccagaacttgactctgagtaagtcaatgaatgggtgtctaacccaatgagatgaacacaagtgctggagccagatagttctgtatttaaatctcagctctttattgaagtatgctgctgctaagtcacgtcagtcgtgtccgactctgtgcaaccccatagacggcagcccaccaggctcctgtccctgggattctccagacaagaacactggagtgggttgccatttccttctccaatgcatgaaagtgaaaagtgaaagtgaagtcgctcagttatgtctgactctttgagaccccatggactgcagcccaccaggctcctccacccatgggattttccaggcaagagtactggagtggggt

SEQ ID NO: 34714 - DNA, 1844 bp, Bovine  19866880724347
ctgatgcctgggcataggtctgaagttggcagaagcctaggaacagggttttaaaaattccccaggtaatcgatgtgcaaccaagactgaggaaacacagccctggagcgacagaaggactttctaggtggctcagggggtaaagaacctgcctgtgatatagtagagacaggtgacacgggttcgacccctgggtcaggaagattctttggaggaaggcttggcaacccactccagtattcttgcctggagaattctacggacagaggagcctggcgggctacagtccatgaggttgcaaagtgtcagccccgactgaagtgactgagcacgcagagtgattgaaagtgctgatgtggctctcataaccccctgctcttctgaggtgggtccaggcattcagcttagtaaagctcccgaggtgcttcaaatgtgcagtcaaggttgagaaaatcattgctctgaccagctctcaaattggaggtccttacttagataggcagcagcagcaccatctaggaacttgttaaaaaatgcaagttctcaggggccccaccccagatggactagatcagacttccctctgtggtgtaacatgggttcagcagggagatacaccaaacatagttataaattgtgatgctgtctcgtctgtgattttctataaataaaacaaataggggactcagtcgagattccctcttcctccttttctagagcaggggccattttatttttattttcatagaaatgtagaccagccactgggaaaagacaggataaatcattcatgacaggaggagacacgtttgcaagaacacagatttgttgtccacccataggcaattaaatgtcctggagaagagaaaaagagagaggggaaagcacagaaatgcagaggcctgtggattctgagtgggtttcatgtttgtaccactttccagttctggaacttttcatctgccaagcctgtctaaacattgagcacatctggcacttttaagattttagtgtcaaactaattttcttggagcccaagccagactcttctggtaactaagtaacatcccaaactgtgggtaacaagaaactcaagccaatgtgtaaaatcctgtttttggtctctcttttgcattattacttttaaaaactcaagagaagagtttctctggaagaaaaaaacatgagaaaagaagaagatacagacagtacccacagaaaaaaattcaggtaacctggtgagccctgaaaggcaagttgacctagagcccaccccgtgagagctgcacacgaggggaaggcaaggggtggaagggcctggaactctgcacacagccccctgcccctttctcctttgtgtgatacatacattaaggggaaatcccaaatggctttcaggctctaacagcctgaaactgtgttaagacgcatcccaaatcttatgtttcacaaaatcaccatgaaagcaaaaaataatgttgacaacccattaggaatataaacatcacctgttcaagacattctacaaagcaaaggttcttaaaaggaattaagagtttgtgttttgagaatggaacgagcctggaaaacaactcttgaaccctttcaatgtgcagggctccccagtcattggtgaaaagactgagctgagaggaggaaggaagtagagctcagaccctgagccctagggtcatcagaggcacggccatatttgcaaagaagctcctgcctcccctgatggacgggaaacatgaatcaccctgggaatgccttaaaatgtaggttcctcagctcccactcagcggttcttattcaataggcctagggtaggatctgagcatcca

SEQ ID NO: 34715 - DNA, 1082 bp, Bovine  19866880729020
gggcagcactactgatggcaggtggccaagctccaggcctcggctcctgcgtcatcgtcataatcactcgcgttgaaacggtgctctgtggttaacagactgctccaagctcagtagccctttagtcctcacagcagcagaagccaaggcctctggggtttggtgacatcccaggatcgtgtgaccaggaagaggaaaggctgaggtttgacctggccttcctaacgctgaatcccctatccgttctttctgcccttgcaggggtcatcaaggcaaatgctctgggggccaggtagctaatctaaatgagagaagctgactggagtagaagacattagggagtagtcaggactctggggagtcagacaacaagctgtgcctcaaggcatctcaaggccaagcatttcgaaagcaataaaagccaaggccatttattggatcaccttttcagtgttcaggacatcccttctcgtggttttggtggaggtggaccgcactttatcattgagtagcactgacttggtggcacgaataagcatggccttggtggcagtaagtctccagtataaatgaggaagatcgagtaattctatggcttttaggatagtattacagacccaagggtgcactgaccttgggtaggagcctacccatcacctacccatcaccttgcctacccatcactttgccttctctagaactttcaaagtctgatattcaaagtaataggacattaatggttgatcccttatgcctcaaccccaggcctggtcaaatattctccccctccttccccacctcttcctccctctctgaaatcatggggtggctgcacaggtctctatgctaaggaaaaagagtgacagggtgactgagacagggagatagtcaggccccccaaaggcaccctgagtttaccttctcatcagggcatgggagctagagaaaagaaagagaagagggtggttcatgcctttagggagagacagaacttccccattagtaatatattagtgatatgtggcccagtgaaggtcaagggtttttgccaatcaaatcaaaactcctcttttgagggggat

SEQ ID NO: 34716 - DNA, 1834 bp, Bovine  19866880755294
tgaagagtgagagtgaagtcactcagtcgtgtccgactcttagagaccccatggacttcagcccaccaggctcctccgtccatgggattttccaggcaagagtattggagtggggtgccattgccttctccacatccagataaatctgatctgttcacaaaaactgtattagtgacatacagtgacaaacaacagtcactgtctctgctgtatgtcaccagggattccctggtggctcagctggtaaagaatctgcctgtagtgtgggagccctgggttcgatccctgggttgggaagatcccctggaggggaatagctacccactccagtgttctggcctagagaatttcatggactgtacagtccatgaagtcacaaaaagtcagacattactgagcaactttcacgtaagttatatctcaataaaactgaaaggggaaaaaaaaaatcaaaccccatattattttaatctaattttatttcaaatcctaatttctgtttgtctttcttctgtgactgtcaaactatccctcactagctctattctgcaactttaagtttgaacaactcttaacaatgacacctagatccaattctgtaggaatttggggacttcaattccaaaatcttttaaaattcagtttttaaggcaaatataagctctccagtttataggaagtcccaccttcctttgcttataaagaagttaaagaaatcttaatcaaactgaaaggcttttcccactcattggagagtctgtaagcaagagaaagaaatgcagagactagagttagttaagtgctgtagctcctgcttctctctttttcctttcactttcattttttttttagctataagaagataaaggaaataagcatagcaaagatcctctgctagagccgtgggtcctcagatttatttttagtttcagctatttcaattaatatttcaaagaaaatttcagcaggggtactggtaatttgagtgagatttaatgatatataaatggatgtaaacaaaatgttagtttcaaaagcaaagattgagggtaccttagaatttcctatcattatatataaactaaatcctgcagactctgaaggacccttcagagccccactactgataagaaatgaaatctgaaatcagattgtctgagttcaaatttctgttctgctggtttctttttctttttttgttttgctgatttctaattgttctgggttcaaattccagttctgctcatttctaattgatttctaatataatatttgggcaaatatttaacctttctgtgccaccacatcctcatctataaaatgaggatatttaaaagaatctatctctgagggctactaagtaagttcatctgtgtaatgcaattaacacagtgctaggttagcatactatgtaagaaattagctatttgctatctttattattaatacactgacccaatggactgtagcctgccaggttcctccgtccatgggatttcccaggcaagaatactggagtgggttgcccatttccttctccagggcatcttcccaatccagggattgaacctgggtctcctgcattgcaggcagaactctttgccgtctgagccaccagggaatctttattattgttcctgtcaccttctttatactacagaaatcctgttgtggtcaagagctgacgatcagtatgtaaacagagttaaaaatatagacaggtaatgttacttaaaagtataatctcctgttacctgtataagtccaatgaccagccaaagagcagaagataccgcgtatctcaaaatgcggctgtaaggagctatgtagctag

SEQ ID NO: 34717 - DNA, 1862 bp, Bovine  19866880864228
ctggctttcttcctgtctctagatggagctccttttggtcacccagtgaataggcttgcttcagaagtgctctttttatcacatggccatctggccaaggccagagcaggtctgtgggtttgctgctctgacctcacagactgttttagccaccagaacacctgttgacactttaacattggaaagtgtggaaaaatagcatcaaataacccagaatttttgttaagggcaggcaaagagagaggaggagggggcttcccaaatactccagtacaaagaaagcactgtgcaaaaatacctatttttgttaacacaatgctttttgtaacaccaaaaatgaaagtcagtacctgaattagacccttaacacacagtcattttcttgccctagaataaacctggaaatgagcaagtgcttagccagactggcctggtattcttatgggtggatgatataaacccttgggttattggaggttagctgtgacaacatggagatggtccagcagaatctcagtggtgccagacaggaagcttaaaatagacttgcaagtgggtctgagatgctattcgcctgatggctagtgagttaaccgtggcctttgccaaaatcaacgattagaggaaagagaggctgctagacaatctttagctccttcttccctccaggtcttagatgagaaatcagcaagtatttactattaagcattaggtacttgttttattcatcctggcgttgagaattgctttgaaattaaattatttgcagttgtgcgctgaaatcaacaaatcatctgtaagaaagaagcagatcatgtactgtggctcatttcttgtgggtcagaggttataggtgtgttcagacttatttaatattttaaaagtagtccatcctcatcagaattcatgaagcagtagtagtttgagggaaatatatgtatcattgttctcttgccaaattagaaacaaaaatctcctgcattgacctaacatgacaacgaatatggaaagtaggtatctggggttgctttccttgagaaatccctgctaatggggttgtcttgaatattaaggatgatatgcatgggggaagggtttttattgtctagccatcagacaactaggcagtgaaaaattacactttttcgttcagtgtgtctctacagatgattctccagaatacagaaggtaaaagatttcagaaaggtttcaggggagctgagaacttggggtggatctagagcactttacagtaggtgccaggtcatgagtgcccctgaagcaggccatgccaatctgcagacttcagcaaaagcccctacactatgaactcaaaaatagtagctgctgatctacacatttctttaaaactataattctctgcttacctggacagcataactataagagtataagcttcccaaggacaggcatggatcatgtcacttttatacatccatatacacccacagcttggcataatagtgagaactgaggggtagtggatgcttactttatactgtcttctgttctaagtgcattgtctggctgtatcctcataacactcataacaggtaggttttaccgttatatccatttcacagaagaggaacctcactgagggtgatttgcactgcttacataaataggaagtagtagagtgtccgtcttacattctgaggcgctatgctttagtgaccgctgcacaaaatagatgctcagtaatgaactcgtgtcaaagtacagaaagtttcacattttcattatgggcccgacagtaaagtatatccttataattgcagaatttccacccatgtttctgtatctgtaaccagcaataagttttgcacagataagtgtgt

SEQ ID NO: 34718 - DNA, 911 bp, Bovine  19866880908693
tgactagttggcatttcacaaacttagtcagatccaggtaactgaattaatttagctagtgcccttctacacatgttgggggaaaaaatcactcatttcccttgacatcagttctaggctcagatccaacgcctgagtactctgattcatttctactgcatttatttaatgctgctatttattcattcctttatgagttactactaattaaacacctactgtgtgctagcactgaggatacaattctgaacaaaatagaccaaagtctctgtcctcctggaacatgtaatttagacagaaaacaaaccacattaatgagtaaaatataatctctagaagactaggtgtattttgtactcagtagaaaaacaaagcaggaaagggagctacaaaatgccatggggcagggaggaggatttcaggcactgaccggtatatttaagttgagtctcaaggaagtgaaagtgaaagtgaagtcgctaagtcgtgtccgactctttgtgaccccatggactgtagcctaccagactcctctgtccatgggattttccaggcaatagtactggagtggattgccatttccttctccaggggatctccccaacccagggatcgaacctgggtctcccacattgtagagtcaagtgactatctgggggacgaatgctcctcgaaaaggggtggcaagtgcaaaggcctggaagcaggaacactgacacatgtactgcagtgctgagcactacagaccttgtgaagatgcggaaatcatgtaaggaagcaggtgatacagaggtactaaagctaatagcaaatcaactgtttaaaaactggaaagtgaaaagtgaaagtgaaaggtgctcagtcgtgtccgactctttgcaaccccaggtctatacagtccacggaattct

SEQ ID NO: 34719 - DNA, 813 bp, Bovine  19866880960744
atgatttttcgaatgaataagttcggtgtcaagttaggtctaattccaagcccataaaccttccagatatccattggtgcctctcaaatactcttttttttttctttttttaaaatttaagtttatttattttaactagaggctaactactttataatattgtattggttttgccatacatcaacatgaatccgccacgggtgtacacgtgttcccaatcctgaacaaatactcttgttccaacagaagagactgtggtattgccagttttgcaactgaagtaagctcacatgcagccataaagacccagtgcagccaaaaataaataaataaatctttttaaaatagtgcttaagaaataagagtgaagaagctaacattgagagacattatttctaaataaatgttataacctcactttgcaaattacccagacgataaaccaatcaaacaatcaagtcagtcaaagctaaattcatcatatgtatatcaaaactgacaagtaagtaaatgtgtatgaattttaagaaatgtattttaggagaagaagtgcccctcatccatcccaaaactcattcttaggctaaattgtttcaaattataggggacaacttttcagatatttttttaagaggaaattattttccaaggtgacatttcttcatatatatttcagaagacaaattcagggcaaataatgcttatatatttgaaactaattattagaagttgaaagggaagagactcaaatataacttatataagttggactttctgagtatttctgaaaacatttggaaaagacatttcatt

SEQ ID NO: 34720 - DNA, 1256 bp, Bovine  19866881008526
aaacagctgtaactgctctcagagttagctaccacagccaggagacagtcacagattgaggccatcagttctttgtttggtagagaattggagagttgctccagttcagaaacagaaccttcagaagagtttggcaaaattagtgcaatgtcctgtgagggaggaggggagttggggaaaaaacagtttttttagatgattgtcactatcacttcgagcttttatttctgaaatacacagcaatcagtacttaatagttattgaaatagtataattattatcccatcccaaacacagattcaaacacattaaatacaaaggagttgttctgcccttctacaaaggttaatacaaggatacgcacctaaagaatttgcttcagtgtttctactttgtaagactgacacctaatcacttggcagcggaacctgattcacagtattcttattttaaaagaacatctctttgaaaaatttttccttctggcttatactaagtgtagtttctatgttcaaatggttaggttagtactttgggtatgaaaatattttaaattattatatttattcatctgaatatttttaaatttataaagaaagcattcagagaaataaattttaataaatatatccatacttgaatttaaaatatcacaaaaagaaatggatggaatgaaaaaacatttaggcacaatcttccaatattttcctctcgtttttatatacatctaaaattcaagtttttcaatgtcagcaagtttacctaacaataactaaaaacccacactattctttttacagaagtaaagcagactttacagaaacatttttaggtatgtgttattgcctttaaccacttcaatacactggaaaccactattcaacttgggttaaaactataaaacaaagcttgaatagaaaggaaatacaactaggtgaggccagccaagaatgaagtttatgtgatcagggtagctaggatgctgaactgttactcagcatggtcatacaactcaatattaattataaaacaaataccagctgattggacattttgaggtataaagacttaaaatagcctttttaccaggtccaaaactattttctaccagatctcctttttgtgaaaacaaatcacacaaaaaatgttccttcttgacttgagtgttaaatgtaaccaaattggatttttttttttttagctagaaaaacgtaatcttctaatatgtgtgtgcttagtcactcagtcatgtctga

SEQ ID NO: 34721 - DNA, 747 bp, Bovine  19866881031734
agtgacagagacgctaatggattgatacacccctgcacatactacatgctcaataacttttggctaactaatttttaaagagacactagcatgtttcaataattataataatgtcaaatgaatatataaatcagcacagtaaaacagcataatttcagatgagtttcagacaagagactataaaaagttgtccaaagatataaataatgtaagatgtacattaaaatgcacttatttcagtaacagatgacacaaacttttacaatgttagagagtttcacaatcactttctttgaaattaaatgggtagaccgaggttggaccaatgcttactaatttttttaatacatctagttagttttaaatttttttagacacatcacatttaagaaaatacgtttatattgatatgcattttgttaagcctttaaaagaatccatgacaatgattaataaaaaagtggggaaacaggaaaagcaagaagggaacaaaaggtacacggttcactgtgattggcttccaggcagtcatccaaacgattaatccaagctaatcctggtacttctgtcccctttgccaacgactgatgttaagaaagagtttgtctcagactaggttctcagaagtagagcctgagatacagattagctacacatgatttatggagaaatgactcaggagaaaggggaatcagaaaatgcaggggaagaaaccaacaatgtagctttgagttaaattacagggag

SEQ ID NO: 34722 - DNA, 1185 bp, Bovine  19866881105177
acttgagagctattcgtggttatggggatggtgcagctgagctggaaacagagttctgcacgcacagctacctgatgaacaagggtcaggggctctgttagcttcgacctcctgctagctggcccgtgcccagggcctgcctacctggccaggctgctcggtcacagtgaaaggactgcttcgctctggtggcaggctgctttggggttggtacatctgaatcattttcataaacagcaaatggacctcgggttcagatgcccacacatcgtgtgtcacagcagccttcagagaagcgtcacaaaacaggcagacggaagatcaggaaggaagttagggcacaggttagaagagggcacgtttccgaaaaggtcctcacaatttatcttttgaaacgcagagacagctgcggggcttcagagggtgtcgtgctggaacgagcacttcctgggacaaagtaattacccaatggctccccagcgctatggagaccagtgaccagcagcaaagggcctctgactaatgtgaactgaattttaaaaggcgcgattttgccaaaaaaagaaaagcaggacaataatgaaattcataaacatttgagtatgacatttatgacttttcttcttttgtgcttgggatatttttctttgatgaaatccagggcacagagactttacatcctggctattcagagttaagtatctccaacttcgagtatgactgccttgtgacaaaacagagcgcggggcaggcgtggaacttgcagcttcaaactgtcataaaaacacagaagccataatgaagtgtgcctcctggtgcctttattaaaacctgctggcctgacgctcccagacaggcctagcccgcaccacctgctgcaagcctgggtgagccgccagcctggcgtgtggggtagatttgggccctctggcggtgcctcccactgtcttttgcactgatttcctttgacctctagagtaatttgaaaacagatgatgttttgctatggaaagttttcctcttggaactgtgcccaagcttttgatatgggaaaatttttgcatcagttgcttaataattcccaacacacatcgtaaaaccctcacaatttagggtactttagttcaccctaccaaaaataaatcaatttattaaaaacaacaaagggaattattttccacagta

SEQ ID NO: 34723 - DNA, 1530 bp, Bovine  19866881107543
tatgaagtttctatgtaatgaaaagtttcaaacacagtaaaatggtgattattgaacaattaagaaaatgtaattaatgccacttacctgcacacttaaaaatggtaaaatggcaaattttatgctatatatattttgccataataaaaaaatagaaaaaatattagtagatttcaatctccaaaacataaatcaaagaactgtagagtagccaaagtgtggactgtccattttacatatgctctatataatctttataaaccttctattatacctaagacttaaataattcttcaacttagaagcaaagaatatatattaagactgttttgagcacttactttttataagtaaaaaggaaaggaagtttccataacagtgatataaaacattatttatgtatgttttctctttaaattaccttatccaaagttttcatttacttatgtggtacctttaaaaagaacactgatccagaataactttttttcttgaacaagaatctccaccccttcccttgtggaggtatttttcactgttaccaagtttatttatagacctaacccaagtttactttatgccgttccttcaaatacatatagttagccattacatctaaggtttttagaagaatttatcaaagatactgaaaactcctataggcaatgaacattgttaactgtttaaatggcaattttttaaaatacatgcttctctatatttcttttttttacctcaaataactttatatctgaattcagttttgcaacctcttcattaggacttggatgacttcttgctggtgatataaactttggttttttgaagggatttccttgcaactgacttggtgctgctgatcgtctcatatttagcagtattaacctgaaaaatacccaaaagtcatttcatcagaagtctgattagaactacctcccaaatatatcatcactataatcatgacatctttaaaaatataagggaataagcctgtaaaaagccttagaaaacaaattcaacagttggaaacattttattttccatcacaaaaggcttttgaaatgtattaagattcaaaatatatggtacaaacctgaacatatattgtaccaattttgataaaactatagattagataaaaacaataaagccttaaatgtaatttagatagtagtttcaaaatcaaagaaaacataattattcacatacatatattaagcatgttggcttttttcctattccccaatccataaactgcatgcggggagcaatcattgttttcttaaccattttgtaagcagcatcaaccacaaagccagatacataacaaatacttttgaatgagtgaataaaatcctggcaattgaaagaatacatttagagttcaatttttactatcctatttccttttagagcagtgaggtattttaaataaataaatcaagagacaagaaccatgtttccaaacttttgctcaatgttttttccatcaggacaggacagggagacagataaaagacaagaacatta

SEQ ID NO: 34724 - DNA, 961 bp, Bovine  19866881188664
actcaaaagatatttcaaaaataagcatttataaattaattaaaaccaataaaattcgaaaatcacattaacatgttagtgatattttactgaaattaaaatgctaatcacaatataaacattgtaccaaaagatacggcacgagttctttcatgtccaacaatcttcttctccaatacaacatgtgcatgtgtgtgtgtgtgcacactcagtcgtgtcagactctttgcaaacccaagactcaatactttgactatccttaatgtgaacagaaaaaacttcatttggtagaacaccccattttgtctacctctgttctcatttgcagacatgaaatcctgtattagtactcagttttatggtggccatccaaaagatccaacatatgcatacatacttttactcatatcatttaaaagaaaacacaaaattctaagtttctctgagaatttataaacccctgaaaacatgtccaaacatctctaaggacctaaaacctatctggaaaacacttatcccgccaactgagagagatttttatcatttccttttcatatcctttatcgtcccctcttcaataccactttcctttcaacctacgacacactacctttaaaaaaaaaccaaccaaaaagtctctctggtgccctgctatccctcaagataccactccttcccttcgaaaccacatttccgtattgatttacatacattatttacttcatacactgcctccatctgcctgtttccagtcatcacatagccattacaatacggcttttgttccaaacactttctgaaactatactctcaagtattaccaaaacctgcaaactgtaatgttccagcagctacttcttgacttctctaaagcacttgagagccaaagggcttatctaagactcaactacaagtttttcaaaatcccttcatttagtcataaaatggtttttaatttatc

SEQ ID NO: 34725 - DNA, 1421 bp, Bovine  19866881191037
cagtatctcttggagataagtctgaatgttagctgtgtcctcactagtactaaaaacttttctaaacattatgtccttggatttaaaaatcattaccttaaaaattatttcctctgcagttctgcagagctatggtgcacccacacagaactggccagcatggagttcagacacgagagctccaaggaattttagacacaaaactcacatgtggttgaagaatatttcaggaaagatgcaggaacttcaaggaatagagcggagaggactttactattctgaccagtttattcatagagtcataaatactaaatttggaaagttatctgggccaaactcttcattttaagatgagaaaatatggcttaaaatagattattggttaagcagttactttgggaaaactctggctttttctgatttccaggccaatgttctttccattacattgttaataatatcaacgacaaccacaacagctactgtttattgaataatgagtgtgcaaagctatttacatacgtttactcatttaactccggcaacaaactaatgaggcggatattgttcccattttacagatgaggaaaatgaaggtcagaaatattaattacttccccaaggtcaggatactgatgtttatatcagtccacagtatagaaagcaagaaggggtatatgtgtcaaggattggtgctgtttgtttacatacaacagaatgtctccatttttttttaatttagagatgaaaattactcctaatctcaaatatcaagggccctagaatatacattctgaactgtcaggtcagaacaaaactttccctgaagtgtgtctgactttacactgacaggaattaactggaaatgagggtgtggcacttccccattcttctgcatgtcaggcttttagagtttagacacgagatgagtcataagggaaatgtgtaggcttttggccacaatggaaatactcattttcccaattgctcagcagcaaaacattgaggccaactctttttgtatgctaggaatgttaaaaatatttttcagtcttagtgttgcttttaaaatcattaaaccaatttctgttgcccctgctgcagtttcaaaagatcctatactcacaagaaatttgcctgctccttaatcttgatttcttatttttccaactttaattaaaaggataacttcctcacactggcccacgttatagagcttgaattttaaaacttccaacatgtattttctgaaaatatcaaaggacacttttcagaaattctgccttccctaaaatgttaactttacactaagcaatgctatgtttgaatgtccccaaaacaccagaatgagttcttgacatttctctagtacaaaataaaagcataagaagagagaaagagagaatagcagtgtctgaaat

SEQ ID NO: 34726 - DNA, 860 bp, Bovine  19866881269713
gatctggccatgttttctttatatcactgtaggaacaggtctttactggcttattttctttaaagtaagtgattttctgcattttaccttagtgccacaacctgaataacttgtaagctctctttatgaagcaactgtttttacttgagggggtttctaatcaagagtatttgggcaagtgctaaactccccattccctgagcgtgtggtgtttattctatgctttctttgggttataacttgggcctcgtaaaaactgtgtgcggtcacactcagcagtgtcattttcatcccaggcacagaagtctgtctctgttttgctgccagtgccagctcaagaaaaacgttttgttacttatgtgggatgtggttttgctctgaaggtaagtttcagagcacaggttactgaattttaaatgtctgcttaaaaaaaaaaagtctgctaataagcatgtaagtcttcagagttaaaatgctttcaaaatctttggtgtaaaatttagtttaattttagaagaaagtatgaattgttctattttactaggaagtctgcatttatttataataggtatctcattctgaagatctgccttaagtaattgtttattatttaatgtagactgttaatcaagagtgaatggtaccacgctggctaagcgctgaactcttagcattggttctctgcctccacgttcctttcctcctcttcccatgggagcccccctccctgcttcactgttctttcaggggatgtgatgttcttcacgtgcctctgccgtacatctcatccagttgtgttgtgattattaagtgactattttcccactgacctgtgagcctcaggaagagaggaatcatcc

SEQ ID NO: 34727 - DNA, 1072 bp, Bovine  19866881275555
ggctgtgatgttgatgcagactctgtcagaacatgcctgagcctgcacgtgggtaagatgaggggcccccacataagcatttgacctagtttcaacctcaggggctcttaattcacttccaaggaccagatgaagtgataaccgtgaggcgccaccagtctggaatttagctggccctggaggcgtggcatgtgcgtcctgtgggtgaggtctaaattagatggcaggcaggtatgtacacaggagtggtcattactgcgggcagatgtgcacggctaatggctggcagtggtgattgctgcagggggaatttcttgataaaaatgagttaaaatgagacaatggattatccggaagggtgcttttctacagactacccttttattggtgaaagcaatccaaggaaaaaaaatcaagccattaaaaatgaaagccactctaatgtatttatttaatatcatctatgtagctcacaactgtatgcatacataggagtctgagtaaattaaaggaaatactgtttttatttttttcccaaataaatggaaatgggaggctggtacgttaaggtgataaaagaacctaatgtacaggggcagagggactgcttgcaaaagagctaaatttttatccatgtaagccagactgcccaccatctcattacactgcagaaagcttacaagcattgctcccaatcacaaagaaaaatcagcatgcaagtgacctgtgtattagcatctctgcaaatctcaggcaggagctgagatttatataccctttacacacccctgaggaaatacccgttttatgccattgataggccagatgtattttcctctgtgaaatgtgattggaatgtaattagaagaaaatacactgtgtattcaaaaacaaatgcactgtattctttaaaactccatggtctttagaacaggcagcaatatcaaattagaggagctgtatggaagggttgtaattgtgtgatcagtcctgtgtggttacatttgtgacagagcactgatttacttctgcagccactgagctgaattgaaaatttcacatgtctcaaaaa

SEQ ID NO: 34728 - DNA, 718 bp, Bovine  19866881329318
ttgtggtagccttgtataaactgtgttcctctgactttcaatcccattgcatatcagtatgccctaaattgtatatttttttaaaatacaaatgtgaacacatccctccttttcttaaaaatcattcaaagattcccagtagcctcccagaaatttctcaactctgtggcactttggtcaagactcttcatgacatgggtgatgcctccttttccagccttatccctcttgactccttcacactttcatgttgtccaattataccagaatctatttgcagaacctataatttgctctgcttctcacctctgttcttacctgttgcaggttcctatacctccatttctcatgcttctggccaactttctcttcattaagactcagctcagatgctttctccccttggaaaccccggcctcatacagagttcacagcctctcttctgtacacccctggcgtcatgtccctgcctctggtggagctcttctcatgttatactgtgatcagtagctctcttctatatcagcacctatagtgcagggactgtgtcttaattatcctggtaagagatattcaaacttactgaatgcaaaaatacagagaaaggtttgaaaaatagtaattatattgaattgtcaaggagtctgcttcacctctttggagcattaatagtgtcatttgcttttatcataataatgaagtgaccaaaataaggaaa

SEQ ID NO: 34729 - DNA, 1407 bp, Bovine  19866881335544
cctatagcataaaatgcttggcacaaagtactaattttaacttggcttattcccaaaacatagcaatatttgtgtaaaataacttgattaaaaatacttggaaccctaagatatttacataactgggatatatataagaggagagatggttgctggctgctttgggttaggtttcctacaccaatgcctacaccttggcagggttatcaaaggatgacagaccccggggtccaatctgcagcttttcatgttcagaaacttgcatatgcttaagctctagggaaatgagccatactaaccaaattaagagactaaatcagactataaattatataaatttattgacctataaatgagacctgcctatttacaccaactggtctatgtattctgtcctataaacggtccatggggaagccaagttattagcactaagttgtctggtgaacattaaaccaaaatacaagggagatgaatgatcctaaggcacaagagttttaaaccaggagcacgtaatcagaatcacttggggcagctttttcaaaatcttcatgactgggtcctactctcagagaatctgaactggctcacaagtgtctggagtggacaaatgtactcttaagagcttccctgaagactgtaatgtatactcctaattaagaatcaattaatagataacacctttatgttgagacagcctgattcatggaggtgcatcacagagatttaccagttagacttcccaaatcaactagacagggcaatctcttctctgactctatgcaacccaatactctccttataagaagatacacatacatcatatataagaagatacacagaaatacacaactcttaaaagttgtgacttataatatttttattggttatatccatgcacatttcatgaagagaaacccatcattttgactgaatttgggaaaacaatctagtttcagttggaacacatttattaagccattgcttaaagattacttatatgtgtgaaaggctcatttcaatcatttttttattgatccttacttgctatgatgttagagggatggtaaattatgtactatatttgaagtttgtagtatactctgcctgttattagttaagcggtacattctgggctatcataggttttttcttttaaggaagaattcaggcttctttttttgctgggcatcatgcccaaagagtttaatttttatcactgtgtatagaatctgttcctttaaaagttgattaataaattgttataatcctgttgactgcagagttatagaaagctgacttctcctatgatgaactatgtaaatataatccactgtaggaataaacatggagaaatgtgacagaacactacatctcctaaatacataattaatgacctccacataa

SEQ ID NO: 34730 - DNA, 1837 bp, Bovine  19866881359162
ccttaggtggatcctacttgagctccacggcgcaattccacctgacccttacggatgtgaacgacaatcccccacggctggtcaaggagtacacaggcttgttcttttgctatccccccaaagcacccggaagtctcatttttgaggccaccgatgatgatgaactggcatttcggggtcgacactttacattttcccttggcagcgaaagcttacaaaaagactgggaagtttccaaaatcaatggtgagttgtcaaaagaacattgagaaaaacactgatgggcgatgaaatgagtttttaatttgccttggtgtgtgtgcagcactcaacacagagctttcttccccgctccagaaaggaagttcatgctgtggaaacttgcacaggcaagctctccagagggttgaaagcccccaaggttgggaaaagacagattgttaacactcagtgtcccctttggtgtaaacgaacagttggacagtagttggtgtacatgaattgttttccaatcagagcagcattgcaaaacaaccagtggcagctgagaaacagattttgtcatgatcttttaaaaacagctttattgaaatatagttgacatacaattaacagcatatatttaaaacatacagttttataaaagttgatataagtatgtgccactgaagccatcagcaccatcaggtaagacgactccaccagctccaccaggtttcttcatgctctgttgcaatccctattttccaccccacgctgttcatccctcagtcagttcagttgctcatcgtgtccaactctgtgaccccatggactgcagcaggccaggctttcctgtccatcacccccaagtaaccactgatctgcttcctgtcactgtagattggtttgcattttcaagagttttatgtaaataaaataacagcatgcaattttttttgtttggttaatttcacttagtatacttatttggagatttcaccgtgttattgcatatatcaacacagcactcatttgtattgcagaggagtattccattgtatatcatgatttattattcgttgacttattatcacttaaattgcttccattttttgccatttcaaataaagctgctatgaacatttgtgaaaaagtactttgtaggagcctgtgcttccatttttcttggttaaatacctggaagtggtcatatggtagctatatggtcaaattttaaggggatataaaattgcttcccaaatagtctgtaatatgttacatttcccaccagtgaacgagaattctagttgcttaatattcttcccaatgcttgttatgctcggtctttttaattttagccattgtagtgggagtgtagtatttcattatggttttaatttacatggccccaatgactgatggtgttgaccagcttttcataagcttatttgccatccatatatcctcatcagtgtagtgtctggtcaaatactgtgcctgcttaaaaaatttagcaaaggtttgacttctgttgtggtctttgtcagatatatgtttacaaatatttttttccgaggcactattatatttttattttgtaacagtaccttttgaagagcaaattaagtttttttgatgaaatctaatttattgatatttttcccttataatctgtgactgttttgcatattctttaagaagtttttgccaagatcactaaagttttctgagatttttttttcttccagaggaaaagaaagctatggttttagcttttacaattagctctatgatccatttcaagttaatctttcttgcatgtatggtaaatgtcaaggttcatttttttttaaat

SEQ ID NO: 34731 - DNA, 1602 bp, Bovine  19866881366593
attctaccccttaaagcccatgtttctctcttttttaaaatacaaaataggagccagaaaggacatggaatattccatcatctcatcctctcttgtgtgtttatctccttccaatatatccattactgggttgctaaaggtcatggggagagtgaagcctgtggattattaatagaatacataattcgcttaaataacattttttttctccacatgattttgtctaaaaatattgtgacataaaatttgtatttatctcctttaacatttgagagttaggcagaataaatgatctgccctataaacataatttcattgttgttcatgtgcagatgctttagtttcaaggaagctgaatcaaccagcgcacatggtcacttgaatcaggacactccagacacagagacgggagacagtgcagagccaaggacagaagggccaggagagaggctctcctctcgggaggaagtgacaataataaaaatttaaatataagaagaatagtaatagtttgtgcttattgcatgcttattacttctgtttacaacagcactttggctattatttccattgaagagaggagaaaattaaagcttagcaaggtggtgacttgactgcagtaatgagtgagcaagaatttgaatcctctgacttcagagcctcttacttcaccacacacagggctgtttccaaatgcacagtagaagagcctgctatttacaagtgttgtcttgcaaattttccgggaaatctttgatcattttttaaagcatttttgctggaaggaatcctgtaagatcactgcctcagagttcagatagggaaatcccgatagtattcttcttaaatctaataccttttgatattattcagcccttttatcatctttgtcattctccttgagttcctctagaaagatgatacattccctaaaattatggatatagctcaactcctgagaggcatccatttgcaaatagatgaaaagctttgccactgtaggtgagatgaacaaggtagactgacaacgtggcaggttaaacattccattaccactgacctgctcagacacacagacacaatggctcactctcctgtcccctggtgaaaaatcaggggagaaaaggggcccatatatacaaaggttactttttaatccaatacctggaaagaagtagaaggtttacaatcatcaagcttaatcttatctaaacttctgaagattttatacagaggggtgaaggttgaagggatggggatgggaatccttctaaaaccagtattcatgttggcaacagcagctctccaaagctacagttcacattctgcagcactgtgggcactttttttctcttatacccacccccctccacattcccccagacacatactagaaaaacattcaaagccagtttttaaatgcaagcatacattttttctttctcgcaaattagtttccccttaatgtaggtattgttaaaccactgacaggcaaacagcaagaatgcctttacatgagtatctctttcttccaaccccagcacaaatataaccatcctcacaagggcttctagccgtttaggtttcaaggaccaataaatg

SEQ ID NO: 34732 - DNA, 1026 bp, Bovine  19866881403846
ccatgggattctccaggcaagaatactggagtgggttgccatgccctcctccaggggtcttcccaactcagggatggaagccaggtctcctgcactccaggcagatagtttactgtctgagccactggggaagcctgggaaggatatggagggccagctataagttatacacatatttctgactgtggtgggtgcccctaacccccttactgttcaagggtcaactgtacctacttccaagaatcttaaagtcaaatagggcaagtaattgatagattaaaggaaaaatccacatatcaaaaaatcattaaaactgctacataagttcttcatgactaaggccttaaaatgttgatggtaagattgggatccttcttgtaaaatcctctatacattgcttatttaaataagagagacatgccgtaaactccctcttctgttctgcactgagaaatataagctaattaatactcaatgttacaatacctcaattctcaccataaattagggagaaatatagcacagaaacacaaagtaagaggaaaatatatatcactgagaacaaaagaatatatcactgagaaccagtgggagttttcaaaaaagacagacacatcatattaaacaaaagctcctaaatattttgatctcctagatacaaacctagtttcactcatttatcacctgaagcatgcagtctctggtgagcatgtccctgtgcaaaagaagcagattcctttgccatcaggaagttctcttatccatgagtagagacaaattaccatttggtgccagcccatatggggcttctcgctgaggagaactccattagggtatgatgagttttatctgactgataaccatggaaaggcaatctctcctacctgtcactcaagaaagatttctttaagggcttcatttgcatccctttaaattgttttaaacaatagtggagaaaaagagcttagaacacctcaagatcaaacggcaggagacttaagctgtccaagaactatagctccacct

SEQ ID NO: 34733 - DNA, 1021 bp, Bovine  19866881405142
actgcttcactggtgctccttgtgtgagggttacttggtaacctcatgtactaaaatatcaccgatgactgtgttcgagctccctgaactcatgcttcctgatgctaccatcttggctgctttgccttccaggacctgacgatgactctgaaccatgtcaccatgcgccagggcacggcgggcgtgcagccgcagcagcagcgctggagcatccccgccgacggcaggcatctcatggtccagaaggagccccagcagtacggccagcgcagccgtccccctgccgcccccgaggacccctgccgccggagctggtcctccgactctacggactcagtcatctcctctgagtccggaaacacctactatcgggtggttctcatcggggagcagggggtgggcaagtccactctggccaacatctttgcgggtgtccatgacagcatggacagcgactgcgaagtgcttggaggtaggtggcctggctccggggggctttacggggtcagcagcggttcaggaggaagagcaagtgggtgggtcatttgtctgcagagttgggaactgcaattatgccttcttggctctgcctggggagccgagtccccacagaagcgctggcataggcctctgggacaagaaagtgaaaatgcttgtagatagaagctgggccagagagggaatttcttacattccaggtctaaagggaccggggagacggttttcagagggtggagccggagggtcaggatcccacctctggcttttgtcaggtctgacctggacctttcaagcactcagtgtagacacagcctttttccatggtgatacttaaaaccaagccaattagaaaactgttaggatgaattcattagtttgtttattgcagtattagaggatttgctgctgctaagtcgcttcagtcgtgtctgactctgtgcaaccccatagacggcagcccaccaggctcccccgtccctgggattctccaggcaagaacacggaggggggccattagagg

SEQ ID NO: 34734 - DNA, 606 bp, Bovine  19866881406858
aactcaaaggggaagccatggtttgaggctaagatgccagtggaatgtccatccctggcatatactgaccagctcatacaggaagcagtagggttgaagctccatcatcccctcctccaccccagccacaggcaaatttacaaaggaattcagaacatgctgatgaggatgctgaagcccttggaagccctctgcgactataggcaagaggatgatggtgaggaccaaattccagtgatgaagatggaattgctgactcggaacatgaagcattccagtatccatacttggatactgaatacatggctgaaggcagcatttgttcctcctacaacacatgatccgccagacagggagtttgtaccacatactctagcagtccatgtgagacagttttgaaatcaatgtgaaatggaaatcaatgtgatgaaagatcaagacccaataaagaaaatgcagggtcaataaaagcctcagtgaagttaaccaaactgtcagatttatatcaggatgatagaggtgcaagatggtgaacagatttagaagaaattctgaatttaagaataaagagatttgagtttttgcacttaaaaccagaaaacaagg

SEQ ID NO: 34735 - DNA, 1379 bp, Bovine  19866881461173
actcagcaaggcttgaatccggtgtgaattaaaaaaaaaaaatatatcagagcacttcatagctacccagggctgagagcatttaatacccgcagggtgcctctcctatgcggctctacttatccaccaggcaccagaatcagaggcagtttagacgcatcagctcacagaaccacagcccaaacatccacactcccaccccgacatcattcccaccagctgtcccttcgccccaccttttctgagagctccttccctgggaatcctcccctggctgcgaaacctgccctggtgtcatttccattcccagataacaccaactactttaccccctagagcacgttccacccagatctcctccccagctggtatcctcttagacatccccctgacctttctcggcgtgaagggagagcatcacctggccgacttggatccagtctctctctcagctggtctggaggaaggtcaccctgtctcagagctaatgaggaagtggttagctttactggagttcagctcagaccagcccagcccagaagccaatattgttcaaagaattagacacgcggccaggtgcactttgccccagcagtcaatcaattatccctgacttcctgggttttttacatattgttcgttgtttagtcactcagtcttgtctgattcttttgcaacctcctggacggcagcaggctaggctcctctgtccatgggcttttccatgcaagagtacagaacgggttgccaattccttctcagggggatcttcctgacccagggatccaaccaccatcgcctgcttggcaggtggattctttatcagtgggccacctgggaagccccttcccccaataactgaacatcctctccattactggggtatcacatggctcccagtacaacatcgccaatgtgctgactttccttctggaatttaacaggggccttggactttgacttggacttgggcttccctggtggctcagctggtaaagaatccgcctgcaatgcgggagacctggggtcgatccctgggttggaaagatcccctggagaagggaaaggctgcacactccaggattctggcctggagaattccagggactgtatagtccctgaggttgtaaagagtctgagtgagtttcactttggactttgaaattaattttctgtctttggaatagaggaccctttggtctttttctttgttgatcatgaggaaaagactggagggagaattaccacagagccagtcccagggctctcagggtcaaggacacatttcctgagcctgacacgggcaatgagaacttacttctccccatttttagtcagctccctaatgaactattagtctactattctttgtggagaag

SEQ ID NO: 34736 - DNA, 611 bp, Bovine  19866881475698
ttctttgatcttgtggaacaaggtcatttgatttggttcacgggagggcagaagtgttaagaatgtgagagttgcttagcctcactgacctcatttttctaaatgtagctatgttgtgaaacaaaggaagaaggatccttgctgggcctgccggtccaccgagcatgctgactgctgacccacaaccagctgatttcacttcagggtccccgagacaagtgaggcttagtcttctcaaggggatcaagaaggaagaagcccatctagacagtgggctgtgctcttgtgctttgactgtaccagatgcacactagagacagatggagaacgcagtgcagctcaggagcggcccagaaatgagtatcagaatgactatcacatttgacataaaagcgaccttgatccacatctttagtgtaggtttccagagtgactgaggggtgggaatgaggaatccgtcaaaaagagcccttgactttggaaaaggccataggcttttattgtttaattggaaacctcattttgagtggaaaaagtggtaacttgttcttagtaagtccaatctcagagagtgagaaaaaggacttgatttgtgttttgggggaaggcta

SEQ ID NO: 34737 - DNA, 866 bp, Bovine  19866881714841
ttcagtcgctcagtcgtatctgactctttgcgaccccatgaatcgcagcatgccaggcctccctgtccatcaccaactcccaaagttcagtcagactcacgtccatcaagtcagcgatgccatccagccatctcatcctctgttgtccccttttcctcctgcccccaatccctcccagcatcagagtcttttccaatgagtcaactcttcacatgaggtggcccaagtactggagtttcagcttcagcagttttacctttgttcttattgaaaaagctacaggtttttcttttagagaactctgtgataatgtattacttttccttgatatatcttgttacgtgattttaggtatttttccatggatgctgaaattttatctttaattactagagttttaaaatcttaccagtgattatatttttctacttgtactaagtttgtatgataagaaatttacattctgttttcgtggtaatgctagaagctggtatttgaatttcccagtttatagcatatatatgaaaaaatacttaatacaatccaatttacttgtgcttttattttgctgagtgattttattacttaaatagtaatgtcatctataataattggtttttattttgtttatattctagttcattcagcccctaaagaaataacagtgtctaagggacaagaagagaaacctgatagcctagttaaatatttcagtgttgtttggtgtaaagcttcaaagaaaaaacacaaaaagtgggaaggtgatggtgttcttattgtaaaaggaaagtcatttacattaaaggatttggaaggcaaagacattggaagaggtattgtgatattacctgatgtttatgatttgg

SEQ ID NO: 34738 - DNA, 991 bp, Bovine  19866881926196
tgactgctgaccagagccgtcctcttcctgcactcccagcatggctctgctatcgccagtgttggccacgtgaaggtcaacgccatccacgtgggccacgcaagctgtggccccagaaaatgccactcgaagcactaggtagttgaggaaagaattgggatcaccaacttgagcctccaaggagatgtcattatcaagcctcttgaaagcattaatcaaagcctccttaacatcaatatcagtcgactccccagtgttgaggtcaataagctcttgccagtaagtcctcaagctgttgaaatataacttggatgcctccttactgaagtaatcgttggggtgcttgtgccactggagaatgggcagcagggctcgaccactctctacagcattttcgatctccagcaaagtctcgtggggtaacaaagagacagcaatataataaaagagtctttcactaactgcctgggagcaagcacagcctgcgtggccatcaaaaacccccaaaagcatccctctggtctgcaagcaggttgctgcactcctccggtcctcaatgggtgcgtttgccggcagctgattgctgtcaaatccaaggacagaacttacatttttgccatcaaattctggcactttgaaactgtactcattagctttcaggatgctattgacttggggaggtgtgaggtaaaacttctgcggtgtggaagcgtatctccttccttgggtgtactgccaccagctctcctttggcctgtaaaaggtagcatacgccggatggggtgtgtatctcgggcgactctgcggaatataagggggtgagcagcagagatgtttgtggtggcagtaacatgcagtgccatagattctgctcagttcacagttacgaatcagagggaaaaacagttgaagttggtgctggcatggcatcagagaacagtggcaggctggaacttctgaccgggattcctagacagcaatttcacaggta

SEQ ID NO: 34739 - DNA, 1702 bp, Bovine  19866880353643
gtaagataaagaaagtaacatctaaaaaaagaagtgaagcagaaaggcctactaaatacaagctgtaggacttttgttttacttttagttttgatgaggttgagtctctgcgatgggggagaggcaggaatgtgaactttgcccagtgcctgccatcaatcagggcataaacttccccgaaggccccggattcaggtcaggagatgtgagagccctaggaggagggaggaaggagcagctgtgaccttccacctcttgcctggttcttgtgccttgtggtctgggtaggggccagactctctgctgcccatggggagagctggtgttccaattccaggccttgccccatcaagaaaagcttcagagtacagacttcaggctggaggaggcttgtccccactgatccaggagcaagctccactcctgtcccaggggatggggtccctcgggggcctcatcctcacagtctaagaccaggaggctgtgcctgaagcgggcccacctggttccacgcctggctgtgcagatcaccagctttgtgaccttggccaagccacttctcctctctgagcctccacttcctcctctaagaggagctaataatagcagcttgtcgggatgctgtaatgattcagagagggatgggtgtgagcagtctggcagaacagaagtgtgtcaccgtgcccgtcactgcaaatatccgtccaaccactgttggccaactaacagacacagagaagatgtcccaggatccagctggggaatcccagatgtccctggaaaccctgaaacccaacctaacctgactgactgtgctaagtgacctcccctgggtcctaagaactacctgtgacttaggtcagttaccactgtctctgttttacaggtgaggaaactgaggcctggagacaccgattctcttgcccagggattagaggcagagctgggattcaaaccaggcagtccaactccagttcctgggctgatccactattcaactgcctgcagaaaccccacagctgggacttctggctatgactctgagctcctgatgcagggggctgggctttgatctgtggtcagggaattagaccccacatgctgcaactaaagagttcaactgtcataactaaaggtcctgcatgttgcaactaaggcctggtgcagccaaataaatataaatattaaaaaagagaagaaaccccacaaccaccggggtcagacgtcccgttacttgaccgagttttcccaggatctgttatacatcaggcctgggagaaggccacagggaccctgactcagccttagttcctggaagccgagggcggttccaggccctgccacgtccgcctgctgcttaccggtgcaggccacagccgcgaacacccagcactggccgtacttgacgcgctggcagccatctctcttccagcgccgcaggatgtccacactgccgatccaggacatggggctgatgccgtccgcggtagtttgttgtcccagcgccccagcagcacgccctggtcattgttgcagttgacctgcggacccatgaaagcgtcagaggggccaagtctgtggttagtgacggctgtgatagagtgggcatgaactcagcacgtggtgaaaggcaggggcggggccttccaggctgaaggagcagcaggtgcaaagatcccgaggtatgactgatggggaggtt

SEQ ID NO: 34740 - DNA, 1499 bp, Bovine  19866880384509
ccgagccactggtggctccaggtggaaggccacatatgcgctcagagagccaagaggggtcccagctgccccctctcctccaagacagcggtagggtgtgaaaagggctgagacacactgcggggacattgcttcatttcacgttcacgtgagtcttctgaggggagcactctctttagctccttttgcaggttggcatagtgaggctcaaagaaactctgctcccctcaaggagatgtaaccatgaagtggcagagacgggacttgaaccgaggtctgtgggtccaaagtctatgctttaaagcgctcttgtcatccaagctttagaagaagcccagaactttcgactgaactcctggggatgaatctagtgatgggctggtaaatatttaacaactagctctctggaattaaaaaaaaaaaaaagccttgatttgtcgtgtctgctggtttctgcggtgttaaaacttccacttctgctgacgtcaagctaccagcatgatatcactgaatgtggagttgggaagagatgaacccgatctgctcctgcacgagagaagagccagcttcagcacaccactgcatgaacatcctgccctcagcccaggccccccagtaaaggcctgtaggcctgtctgaggaatgaatgagggctgagaaacctgctcctccagctagggccccgcccagaatatcctaggaagctggggttaatctttaaaccacctttgcaaatacctgcagccatttcaccagccagggttggcttctggtgctggctctattgctgacttgctgtggggcttcaagcagccccttccccttctggcctcagtttaccaaccataagcgatttacctttgttgagcacaacctcagccaccctcactcctgtcagttctaaccttcccagaagttgtctgtggacatgtttactcccgtttcatgggcgaggggacctgggctggggaaggtgacgggctcgtagaaggtacggcagctgggcaaccagtctaggtttgaacccagatcagtccagtttaaggccttgctcattcctggtctcccagatactgtactgtaccctgaggccctgcctcccgtggtctcgagtttccctccctgctcctctcaggagaagtccaggcttctaccgtttgacccggagtgggctttactttcccatctgtgaaatgggaaaactttcagagaaggaaaacagaggcagatggtggtattcaaagctggattcaggcccaccttcccctgtgcagtaatcccaggaggacctgtgaaaagccaagggtgggactagcacacgtgctcagttgcgtttgactctttgggatcccatggactgaaaccctgccaccaggctcctctgttcatggaattttccaggcaagaatactggagtgggttgccattcccttctccaggggatcttccagagccagggattgaacccgtgcctcctgccatggcaggcaggttcttta

SEQ ID NO: 34741 - DNA, 1555 bp, Bovine  19866880399646
cccctcccctccgcccgcccccgccgccggccctgaggtttcctgagcccttggctacccttcccccggtgtctccgcacagccctgttcacagagacgccccacgacatgacggcgcggacgggcgaggacgtggagatggcctgctccttccgcggcagcggctccccctcctactcgctggagatccagtggtggtacgtgcggagccacagggactggacggacaagcaggcgtgggcctcgaaccaggtaccgcccgggagagccttatccgagtggggctgggaggatcctggcccccccactccccgggagggggtatgtctctgcccctcatcgtctctgaggggcacgggctcgggctccagctgtgctcgtcctctgcagcccccagcagtctccctcccttcctggaatggaagcttggtgggggggtcggagtagggagcggagcgaggctatgtacttgggatgcgcgcagctggtagggccctgcagggagcagagtcccgcccttcaggtacaggtggggaaactgaggccagagggacggaagctggctccaggttactgggcaaggcgcgtctcctgactcaccttctccaagccctgggggcacttgctttgtagtgaaagtgaaagttgctcagtcctgtctgactctttgcaacaccatggactatggggtccatggaacactccaggccaaggcctggtgtgctacgattcatggggtcgcaaagagtcggacacgactgagcgactgatctgatctgaacctttcccttcttcaggggatctttccaacccagggatcaaacccaggtcccccgcgttgcaggcggattcttgcaagccctctaaatacagggcagtctttgcccagttcggtccccccaccccacacacacacacacgtgcacgcatgcccttccacatacctgcggacacaggaggcagcccagtcacggcacacgtgcacactcacacacacacacacacacacaccgtggaggcatatgctactggtgtccccgcccacctgcctggccagcgctatcaccaccaccagccccactgccagtccctgcaacactgcctgtgggttttctctggaccacagagcctgccggcacggaaggcaggctgggaaagggctccatcaacggctgacagcagttggagggtaaataccccagctccctcgcccttcagtcgggataactgaagagcatccccaggtgctcagagggagaaagttcagttgcccacggtggtaactggcttgaggacatacccaaccttaacttcctttgctctttggtatcactcactcactcacctcctggtgtttcctggcatcacctcccaaataaatcatttgcacttgaatctttgtctcaaggtctgcttctgggggagcaaactaagacactctcattcttacgcttgtgtgtatataggtattatgcaaacacatatgtgtctgctcacctgttcacatatgaacacatacatgacacactcttatatgcacacacaggcatgctca

SEQ ID NO: 34742 - DNA, 1623 bp, Bovine  19866880438496
accaaagggaaaaaaaaatttaggcacaaaatccataaatgtctgattttcgcatgtcatctgctgtgttctcaacttgagggacgagtcagtggaatcctttctaaagttctgtgacagatcatggcatttactgggttcctcctttgtatgataagccctgttgggtgctattagggtggcaagaaataataactccagttgatagcaaaaacactcaccttgctgtgtgataagtacccttggagtgttttgcacagaaaataccactggagttctgagaaaacacacatcatctctggcttggcagtgattagagaattgggcattggagatgcataagcttttgatagattagggattagtatgcatttcaagtgtatttttacagtgtctaccttggcaatggagattgccattcctcacgtgctgggagctgatgtggccatgtagtcagcccagacttacatggatatcaggtccatggctttatttatttttagagtcatgacaactgcccccatctaaataccctcttctttaatttaaaaactattgagtaatccaaaccaaaaaattttttttcaaatctgctttctctccacctatttgtgattcagaaaaatgaggtctcattacacttctgagtgagcttctcaggtggtgctagtggttaagaacccacttgctaatggagaagacatagagatgtgggttccatcttgaatcaggaagatcccctggaggagggcatggcaaccactccagtattcttgcctggagaatatcaccgacagaggagcctggagggctacggcccatgaggtcgcaaagagtccgacatgactgcagccacgtagcactcagcacatgttgtactgttgactcagggcgtcagtacagtaggttgtgtgctcctaggaaggggggttcgttttgttagttgcagagtggattattggtgctgatggggcagtgctacttggtctgaaatagggagtggtcgttagcactgttcttttctaaattactgcttagttttctcagaccctagaaagccaggaaaacttgcgtgaagttatcctgttggattttgtgaaaaattgctgtgggaactggaaaataaagagcaggtggagtttttttttttttttttaataaagaccagcagggattgttgaacttgagcaatctgagtctgtgactgtgacatagcatattattccagaaggtgtgtacaaggagtgcctcgtgtttgagcctccatgctgatgagcaggaatagggctgggaagggtttgcacctcctcaggactttcttctagttggactggaagggagttggttattgctccagtactttcctgcaagcactgtctaacaagactcctgtatctcaagctgttattttgctgggagctattctcatcttgatatttctagaatcaaaattatatggaaaagaatttacttcttttcctcattcatcatccaacttccctgataatctgtactgataaaccaaacactcattttttggagctgtttcaatatgctctgaaataaatcagatcagagaaaagtaccaaaatggcggtctaggaaaagcatctcttaatgtaa

SEQ ID NO: 34743 - DNA, 906 bp, Bovine  19866880592771
ttattaaatgtgtatggatagatttgtgtggcccactcccatgtaaaatcgagaagatttgtgggaattaagtggaagctggtagtgagggaaaagagaagtcaaagagcgcatatttctaggttcttgacatgagtatatggatgactgatggccctgcttactgtgatggagattggggtaaagaattggtagaggaaatcaggaattttgttttggctatattaagttcgagatggctgatagatattccaaggtatgatgccagataggcagatggatgaaatagttggaagctcagtaggaaattaatttctggagacatgaatttggaattatccccctatacatatttatttcctgttataacaatcatgggtccccaagaccacttccaggttggtgactttctaggaggactcaccggacttagtgtgtagttgtgttcatggctgtgagttattacagtgaaaggatataaagcaaaatgagcagagggaaaagaggcaagggctgcagtccagaggaggccaggcataagctcccggggtccactcgtggtgggtcccacgcgacacactcagttcttcccactttgagttgtgatggcacacgccaagtgtcaactacctgggggcccattagagatttagtacctaggggttttgttggggttggtcacaggtattcttggccaaaattctagactcgcagaagaaaagcaggtgttcagcataaaaccatactgtttgtacaaacagtttaagcacagaaaaccaccctcttccattaggacgtgatggggccatgtctgaaatccaagttcccagatgccagtcaggggccagccctgtgagcaggcctttgtcagggcagcagtctcaggcctgccgtgttaactctttt

SEQ ID NO: 34744 - DNA, 2346 bp, Bovine  19866880675659
ctccccagatttgtaattcccatggctgtctccttcaatatgtgctggtggccttgggaggcaccctgcccccagcctgccagccctgctgcatgggggctacctggcagggggcctgggcaagtccccaccctctctgtgcctcagtttcttcatctgaagaagaggagggtgacagtggctgcttcccaggatgtgctagggattctgtgagatatttcattaaagaaacaactctgtaaaaaggaatgaaatctgataatatgctacaatatggacgaacctcaaaaacattatgctgagtgaaaaaaagcatgtcccccaaaaccacatattctattattccatttatgtgaaatatccagaataggcaaatccgtagagacagaaggcagattggtggttgccagggcctgggaggagggggagtgactgcttagtgggaggatgaagatgtcgtgggactaaataggcatggtggtcgcacaacttggtgactggactcaatgcccttgacttgtacactttaaaatggttaattttatgttatgtgaacttcacttcaattaccactaaataaataaataaaaaggaaacgtttttataagcacatacttgagtcagacactcactttataaaaacactaatggatttaatccttacaacaaggacatagatgtaaacaacagctgattccctttgctgtatagcagaaactaaccacattagcaactacaagaaaaattaattttaaaagatccatacatcagcctctgcagtggttgttattattatccccattttacagatggggaaaccgaggcacattgagtgttagcggtttgaattgttattgggtgggcaatcagctggggctgggcagggaccccacttaggtcaatgtgctagtgtgtccctaaaactcagcagtgagtggatgttgaggccctactgtgtccagaacaccgaaacagactcttcacctgcacagatcatgtaatcctcaaaaataagcctttaaccaatgacacacgtgggaaccgaagcccagagaagtgaagcaacttacacagcatcacacagcaagaaagagtggagccacatcctagggaggggggctgtgtgacaataatacaggctctggtgtttcctggaacttgggttcacgtcctcgccctaccatttactggatctgtgccctgtgatacacagtcctctgtccccgagtgttagattttttatctgtgaaaaaccataagattgttgtgaggattatggatcatgccctgcactgggcttggacttgtgaaaagggctctgttgtatggatgaaaaggcatctacatctgtaaatcctggacttcacctgccccccagtccctctttttcctctgggtcctctgccccttttgccaacacatcagccctccagtgcgcagagcatggtctgaagagcctgaggctgcagagatgaaggcagcctccgattggatgggatggaggtccttgacaaggggttcgcctcgtgccggagagtaaacagctccccaccaagggcaacatttctttgatgtctcctgtttcatccaaaatgcatgagttctgtattccatgccataatatattcatgtttgttttaatacaaaagtaatgttcttttcccatttgtcggggcagcggagggatgggaaggaaactgatgcctcagaaagtcacttccaaagcctcagtacagccagaagggagccctccattcatttctttggtcattcattctacgagcacgcattcaggcctcctcgttactgaaatttatgtcagtcctccccacatgaaagacacagggaaccttctggcaaatcagacaggatgctgtgccatataggtgagtgggatttcaggtctatgggccagagcgagcaagatctcggaggtgccaactaaagatgaatcgtgggactgggccagtggccaagacagccagagctggtgacagtggtggaggtagctgcccaccgatgggcaacgtcagctggacctgcatcccaagcccttctggtcaagaaggaagtctcttcctgatgccgctcgaatttaacacccatctctcacccatctcccctgttaatgagaggaaatggggacggaggctcatagccttcagcaggcaaccttctctggctagaatttacgaacgctgtttggttttcatagtgtttatttttcctgttaccctctctttatggcaagtgatgctgattttccatttatggcagtaataaaagtctccttttaagtggaatttatttaagtaaaaaagagaaagatgctttgaaaataaatat

SEQ ID NO: 34745 - DNA, 1107 bp, Bovine  19866880727657
atgcattggagaaggcagtggcaacccactcccattgttcttgcctggagaatcccaagggacgggagagcctggtgggctgccgtctatggggtcgcacagagtcagacacgactgaagcgacttagcagcagcagcagcagcattttgaatgtactgtatattttatacaggctgaggacaaacatgggtttctgaaacaggaggtggtagagttgctaaaagttcacttcagtagccttgggacacagatctgtagcaagcacagaagtcagttaaggtgggaaaatttccccatcacatggtaggagtgtggtaccctggcaggagtgagagcttggggcttagattgactgcttgaatcctgtctccactatttcccagctccttgaccttgagcagcttgttatgcaagccaccccccaagctttggtttcctcacttgaagaaacggggaatggtcttacctacctggcagggttgtgtgacgattgaaaaaataatgaaatgtcaagttctgggtatataataagcacacagttaatggtcactgttctgtagcttggataatcacttggtgagggatctggaggaggaattctttatggtttctgtaaaccccgagattctctgacctcagtgcctccttgagaagctcttggtaaggtttatatccaacttggcctattgaggactgtcctggcttacttaggcagctttgtttaaaggagggggccaaattcccttgtgtataggtttctcagccagtgtctctctgtttttttgatatgtttactggaattctcaagtttctaagtaatttcagtctgagacgagagagtaggattgatgtcaggctgctttaacacaggtgttataaacaagattaagaggttgttgaaaagatatcagtggagctccagggctagcttcctggagtcattctaaattgacagctaatgggtagtttgccttgatagctctctctgagttgattgtaaccagctagagattcacccacagaggaaacctttttatgaaaattcactttactttcctttataaaaaaaataaagctattataacttgtaatgatgtctttacatg

SEQ ID NO: 34746 - DNA, 1716 bp, Bovine  19866880791274
ctccctttcggtgctgttatgaagaccaagcataaagtatgtcagtaccttgctcagtacttagctgctgctgttactagattttcctagcttcctttgaaattcctgtgtaactgttaagtaagccaggcccccctgttcctaagagcatcctccttcccaaataacccagaaggagctgtcctagcagaccagagcattggcaccattcggtgctttgtctgaggctaagctggaataagctttggtttttgcttgttgttgttttttctttttttttgaaggggtattgttttgttttctgagagagaccagagtaagctgttgagcattctggagcagcttgcatggagctgttaggaaacttggcctgcttcccacaagattatctattatcagcactgaagagagtatgaaattgattagcactgatggagagaaacgactgcagccattctccccagcattcccagtgcttccgtgtgccacaggtgtggggccctgccattccctgacaaacatctgtctccttgatgccaaggccgttcagctgggccctggcaaacattccaaggctgtcagtgcccagcagccttggtgttgctcagggagtcggggcgggctggggggcgaggggtgcgtttgtgagcagcgcgctccgccagcactcaggctcctcctgccaggtgaagctgcctcccaggcgtaaagggacttggaaccaacagcctctctcctgtctctccttcatgcagtctcctcccgcaagtcacagacagtttgttgcctcactccaccctactccctttaaacttgaatgttctatacctactaggaattcagcaaatatttgttgaccagaattgaatccttgtttttcttgataacgttgactatcagatctgtaaggaataaatatctcatatattgtgccaggcctgcaacaaaaacaccttaaataaattgaccaagagaagggggatcaggtattgacagtctgagtgtctcggagccaccgctgtccctgcagacttcagactgccaagggcaccgtgcagacgtccacgggtttacagttgaccaggacgcaccaaaaagaatcccgtcatgtggcacgtgtttctcaggcacctgctctgtgcaggcactatcagctcgacaccggcttggggtgagcgcaggttcaagtgtcgagagaaaaaggggcccagggagcactgctactgctgccgagggctggacgaatccagggcgcgggggagccatctgcacctcgcgtcaccctgaacagtcctgcagatgaggcagaagccgagctgcacctcacagggggcatacagggcatttccaggagcaggagcgaagcagcagcagtgggaggccaagttaagtttgggggccactgttaagttatattccaggaacagaaggtgtgatgggggagcatggactttagagccaggcagcttcgggttctccgactgcagacacacagcctcatttctccagctttcttttcttcctttctggtgttctgttttttgaggtgcacatctcaacctgtgggtgtgtgaggaattacacatttcagaattcagtgacatagatatcacacaggtgaaagatgctttcacaggtcctggcatggagagttgcgagagaacctttccttttttctctgtgaggactgtttctaccaccaggcctccgcataca

SEQ ID NO: 34747 - DNA, 1312 bp, Bovine  19866880801757
gaggggacgcccaagggcacaaataatggcagatgtggatcactgagggccccacatgggactgacttaccaccagaagagggtcaagcagagccttgagctgccggggtgtaacaggcagggtccttgaaggagacagaggcactggagctgtaatttcaggagactataataaaggagctattgtgtttagggaattacgatagcctcgggaatccaacaaaggatgatgcagctcctctgggctagacaatggagcctttggcacccctagtctgaagggcaagagccagatatggttactggaatccagggagagtagctgtggctccaagaggcttctgcctggcaggaactggggcctttggtggagggagcttacagggagggacctgggaaagaaacaatctacctgtctctactccctccttctgattgcttgctcttgcttcccattggccagaccctactggaagcaaaagggaagggaccttgctgatgtcatcggcttccatggaatatgattctctctctcgtatctccgctccactctgccctttagggcttataagtagataaatctgcagagaagaaagggaaagtttcaaggtatcactcactctgccccatcacatgtcttttttttctttctcctgtagatctcagctcaaatgtcacctcctccaggaagccttccctatgttcctacccttctctgtgctcccataacccttagactgacgctgccacagttgtgctggcactgtctgttgaaatgacttgttttccactctccctatactgggcacgcctcaagggcaaggcatgtgttttaatttctctctgtggctgcagctgtgcctaacacagggtcaggacagtagaatattcactcctgttcaccaagcggataaatggatgcatagtcccctccagttctgctccacttctggacccctgcccctcgggggagaaatgctttctgagagcccatgtggaataactcaacatcaccaatggcaggtggggctgggggtgggacacccaacccttgaatccagctgtaccttagcacagcctctcctgcttgtgatgccaaggccctgtcagaggcatgacaaacagcttggctgatggcttataatgtcagagatgatggaaacagggaggcaacggctgaaagaatgggttggggacgcttgtcataactttatttgtgggaggtgagttcctgtcggctgggtgatggatggtgccagggcaggcacaatacagacccttccactgcatctcccccttctctctagaccaa

SEQ ID NO: 34748 - DNA, 2308 bp, Bovine  19866880886088
tgactcacctgtggtctcactgctgacagtgggcagaggtgggagccaaactcctgccagtctgacctctgagtctttgtactcggtgtaaggctttaattaatttttggcgagtgtggcttgagacagcttcttgttctggggccttgttctgaggccagctctgtctcaccccccatcccccaccagtgcacacgcaccagctgtgaacacctaggccacctttcagtgtgtcacccagaaggaacatgaccacccccgaggagggcagttgaattgacgaatgtgctgcttttggggacatttctaatcataagagtcctaagaacagctactgtttcttgagcgtgccctgtgaggagtgttctgcccattttgctgatggtgacactgaggctcagaaagaggctgggcttgtcacctggcctgggaggtcagagctgacattggtacccagacaggcagatcctgcatccctgtgagatgggaatgggggtcctcccctgaggcaacctgcacacctgtccacacaggtacctggaacggcaccaccagggtggccatcaaaaccctgaagcctggtacgatgtctccggaggccttcctgcaggaggcccaggttatgaagaaactgaggcatgaaaaactcgtgcagctgtacgccgtggtgtccgaagagcccatctacattgtcacggagtacatgagcaagggtgagggaagctgggagggccctggtgggggtccttgcaacagggcaggtgggacgcgcttcacttcccaccacatctagaatgagtgtgtgcctttattttttaaaatttttatttatttatttataacatcaaaaacattttgtgttggggatgagcaatgttgtgacagtttcaggtgaaaggcaaagagattcagccatacgtatgcatgtatcccttctgccccgggcctccctcccttgagctctcccattcacctggttccaggctggcacataacattgagcagagtaccctgttctatccaataggtctttgtcggttatccatctaaaatatagcagtgtgtacatgtccttcccaaagtccctaactgtccctctcccccagcaaccataagttcgttttctaggtctgtgagttagagtgcatgcctttaaaggtgaaatgcatgaaaagaatcaacttcccacatccatggaacattaaactgcaggttgcctttctcggttcattttgtttttagtgatgtcccacaatgcatcagtgtccccctgtctgctgcttttgtaaagctgtttgccatttctagggctggaaggaaaattccctgaatcctccaagctgagccacacctgggtcaagttcctggcttgacttttacttagttttgaaaataattatttttcaaaattccacttttggaggtataacttacatatgataaaatacaccctggtggttcagtgggtaagactttgccttccaatgcagaacatgtaggttcgatcccttgtcagggagctaaaatcccacatgcctcatggccaaaaaactaaaacataaaacagaagcaatattgtaataaattcaataaagattttaaaaatagtccacgttaaaaaaaacctttggaaaaaaaacacccatttaaaatgtacagttcagtgagttttaatgaatggatatgctgtgtatctcttagcatagttgagataaatatctccatcaccccagaaaacacctttgtattcctttgcagatagtatgctacagtcccaaacccatacagccgctgatgtgctttctgtcttcatagatttctttcttctagaacttcatatatgaaatcttttacatccacgggttttctttcttgtgtattatcggtagtttcttcctttttgattgcttagtagtattccattatagtatagctgtgccattatagtatggctgtacaacagttctgttctcctagaggtgaacgtttggttgtttcccatcctgcttgccttttgagtgacaaacacagactttattcagagataggtttacataaaatctgctgtatggttaaagcaagactggcttgccccagtggacaagatctgggaatcactgcttcctggctcagggaggacagagtgggagctagagctgctttctctctgcccagggagtttgctggactttctcaagggggagacaggcaagtacctgcggctgcctcagttggtggacatggctgcacagggggagtcagcccctcccacctcctacatctggccttgagctctcccgcccacctg

SEQ ID NO: 34749 - DNA, 1157 bp, Bovine  19866880892056
cctcccagaattccacccaacccacctgctattgcatgtacagctctcctctgtcacacttgtggtcctgggaggtgatatgggaaagttgggtgcccccctggactgggggctccatgagggcaggcttccactggctccctggcacccccttaaagtcagatgaatgaacgaatgactcggggagcaggtgcatgaggcactgtgggcccgtgttgggggcagtgcatacacacaggtatggacgcctggccttgagggtgtcctgtgtggccctgaagcctgtgtgcatgcagtgtgtgagtctacgcacacacacacacacacacacaccgtgggacacggtgaccctgcgtggatgccaggcctgaactccattgccctgtctctgtcttcagaacacgctgacggcctctgccaccgcctcaccactgtgtgccccacgtccaagccgcagactcaaggcttggccaaagatgcctgggagatcccccgggagtcgctgcggctggaggtcaagctgggccagggctgcttcggagaggtgtggatgggtaaggccatgcccccggctctcccgcccctgctttgtccccctttgaaaaccaggcagatgtctgtcccatgtggcttctccaggccccatgagtcccccaacctttgcttccatgatcttataacctctgtgaactgtgggtcctactctcaacgtggaactcctccagtggtgggcagtagcaagctagggccccagcaagccatgcctccagctgccgtggtacccgttttctgagaactgcttggggctgggcatcgtgattccccagtgacatgccctgtggtctgggccgggtggcttccctctgagccttgatcttcccacctgtaaaatggggctggcgggggccggggggtaataggaccccctgggggattgagagaatgcttgccctacacgtgtccccacgttaacttcagccgtgggaagagaaacctcagctcctagatggagctccgggaggtgcagtctagagggttcctggcctgttaacgatctcctgtttcactctggagaaatggccaaactgtccttgaaaacaaacgccgtgcagccctgacaaaacccaggcccccttctgctgactggtctctgcgga

SEQ ID NO: 34750 - DNA, 3714 bp, Bovine  19866880904327
ctaaaacgtggcccgtcctgtgctaggcatggtagaatagagaaacgaggacgacaaacaccctatgtacacagtccagggaggtaggtggttacgcaacgcccatctgtgggcacttcctgcatctgttaactctcacttggctacagctgcttgagggcagggctcattttgaggtcacttcttggcctcagagcccaggaaagggcctggcaggaaggaggaggcagtaactggtaaatgaatgggtggatggatggatggatggatgaaaagccaggacaatctctgccctttctcattttcctccaagcatctgatttagctggtaaccagctccatggaagttggttggaactggatggcaaatctggagctaaatgataacgaatcagcaaaaggttgttatttatagcacaagctttgggtaaccgataagacctactttcctatatcatcattccacatgacaattatgtttttttgcagatcgacattatttccttatcaagacaggaaagtcaggaaatttaactggaagagagtaatagttatttgctaaatcaccaaagaagctacgtgatatcaaaagatttaaaatgtaataagacacaaatatatatcaaaacagaaacagactcacagatgttgagaacaaactcatggttatcagtagggagagggaagaaaggaggggcaagacaatgataggagattatgagacacaaactactgtgtataaaaataagcaacaagagtatattgtacagcatggagaaatacagccattattttgcaataaccttaaatggaatataatctataaaaatgttgactcactatgctgcacaccagaaactaattttgtaactcaactatactctaattttaaaaatgtaataaaaagcactattaccaagcagtgagctctggtagcacagactgtagccagaatgccagggtcttaatcccactctgcattcattggctgtgtgactgaacaagtgacttaaccactctgtgcctcgcgtttcccatgggtataatgaggaaaacttgagactctgtcctgtgtgtttgttcctgagaattcaagaagttcatgcttagaatagcaccttttctgttaagtgaagtatgtgaagtgaaagtcgctcagtcatgtccgactctttgcgaccccatggactatccatggaattctccaggccagaatactggaatgggtagcctttcccttctccaggggatcttcccaacccagggatcaaatccaactcttgtgcattgcaggtagattcttgaccagctgagccacagggaagccccttttttctgttaacagcgtcacaaagttagcactcagagctacctattaataccaatggagtcccttggacagcaaggagatcaatccagtcaatcctataggaaaacaaccctgaatatttgttggaaggactgttactgaagttccaatactttggccacctgatgcaaagaaccaactcactggaaaagaccctgatgttgggaaagactgaaggcaaaaggagaaagggaaggcgaagatgagattgatagcatcactgactcaatggacatgaatttgagcaaactctgggagatagtgaaggacaggggagcctggtgatctgcagtccatggggtcacaaacagctggacacagcttagtgactgaacagcaacaaatggacggaacaggctatccccagggctggatgagctgtggaaccctggtggggagggcgcctcccaaccatggcccttaaatttgtcatccttaaggagtcaggacaagcggagtcaagtcccagacctgctatcatgaccttgagaagttcctgcccaagctgtcttgagtctctcccaggtcctttggttccagacttcagggcttctacatttggaacttatggctgttttagcctagtctgtggcgacatctagtggtaatatggggaaatgcctgacattcttaaattgtcttcaacctattatcaactgtatgaataatacagttaacaatattaactgtatgaacaatacctgttacattcttcaccagtaatggttagatactccctatgctagacactgaatgttacatgagttgtattagttaattttcaatgtaattctataagaagaaaattgttattacctttattttacagaagaggaaaggaagattcaggaagatgaagccaggaagttgcctaaggctacacagctgtaggtgacagaactggatttgaatccaggccatgtggacctgaagtttgcatttttaactcctctatgtcaggcctctgcatgaatgctgagaaaacatgaaaaatcatattcctgcctcatgcagaacataactataatctatagctgttttagggacaataaatgaagcttagactttcatgcttgaataagctgtaacatgtctccctaatattccttggagaatttaggaccgagggggcttttccttcccaggtgaccgagtcaatcccagaagataatgggatcctgacaaagactcgctgtaaagcctagattgcagaatcccagttgtcattcattcatccaaccctacaacaaacactgagttcctagtgtaagccaggcatcatgctaggctgtagggatacagtggtgaacaggaacaaaaaagcccctgacttcaccgagctcacagtctgatggtggaggagccagacatggagattacaagctgtcactgtgtgaaggagaagaatcataaaaaagcggacctaaggtccctttagtgtgagggagaccaaggaaggcttcctggaggtggtgacatctaactggattccggaggatgagaaaggattatgaatacaggtgacagtattataggaaaagagaatagaatttgagacagcccagaggtgagagatcaggactggtctagagaacacagacaggtcagtgtggctggatctgtgggggtgaaaagagatgaccatgacctggtcatggtcatatcacacaaggtcttaaaggagtttgggttttatcctaagacaatggagagcctttgaaaggctttaagcaaaatacctgtatctttaaaagatcacgctaggtgaagtgaatagattggagaaccagagaggttgtggggaggtggtggggaggccgggacagatgtctaggtggtgatggtggtttcatggagggtggaggcaatggtgatgcagggaagtgggctggtttgtttctttggaggcaaggctgttagaatttgctggttgcttaaaatgtgaagagataaagaaaggaattgaggatgattcttgggatttgtgcttgaaaatggatggacttactgaaatgggtaagactgagggaatagcaggcttaaggagactatattgagttcaaatataccccagagggtagagatttgttgttgttttgtctgtctagggttgtgctgcgtgattgccccagacacagggatgggaggaggtaatagatgcaagaagtgctgcggagagagaccatgttaggtctgcgtgtttaggatcatgccatcgactccctctgaagaaccaacatgaggagaaaaggaaatcagaagcctttcaatacttagttgcacacaagaatactcttttactttcctggagaagccagaggatccacatgtccataacacaggaa

SEQ ID NO: 34751 - DNA, 1086 bp, Bovine  19866880928546
ttctttaagtctcacgatgaccttatgaggaggtgctgcaattgaccccattttacagatgaggaaattggggcacaaagaaacgaaatagcttgtccaaggtcacagaatcagacctggaatcaaacctttccgggaatatagtctaagcctgtttttgtctttgatgagaaaattgcagatcagagaggtctcatgacttagccgaggtcacacagcactccaggtctcattgggggaaaccagactcaggctggctcttgggccccagtgctgcccaattcctcccctaaatgctaactctggaagacagggagtgtttaaaggacagctggctcctggcactcaaggccccagaggccgacatcatgcctgttagttcatagttatatttgggcccgggtgtgggcggggctggcaggtagccccttactgggcaggccccgtactgtcagcggtggacggcagagtggcagggagggagatggaagagtaaacagaaaccctcccgggcagccgcccaaccaggcagagaaagttctgtttcttctctccaccacccaagtccagaaggggggaccggccccgctcgccctccctatgactcagacctccctgcaaaatctgggccctgccctccccccgaaaaagagccagttggaggcaggccctcagcacactgagacctgagacactatcctcccaactggggaaacctcccctttgggaatgagagacaacgtggagacctgggcccaaatgctgactttgccacagacccctggaacattcttggaagagcccttctctctgagcctcggtttttccacctgtacaaggggtctcgggggaagcaggaagtgccaagggcgcttggtaaagtgtcagaggctgtagggaggtgagggatggttctggctcttcagagttgcctgtggagatacagaggccaagaggtggagggggctttggggagacagacacctggatctacaatggccagcaccctctgctagccaggagcaagcaggctctcagacaggccccacggccacttcagaggactaggtcccatttactcagagt

SEQ ID NO: 34752 - DNA, 1611 bp, Bovine  19866880955174
tttgactggtggacctttaaattgtttttgcttttatttttcttttttccttgtaatgaattttgtagaaaatacactttttcttttttaagactagaccatgctcctgaaatgcttatgtaaagcctcttttgttcccagagaaaagaagatctcccggagcagtgccctgaaagtgctggaccacgccatgatcgggcccgagggcacagacaactgccacaagtttgttgacattcttggcttacggaccatcttccccctttttatgaagtctcccaggaagatcaagaaagtgggaaccactgagaaggagcatgaaggtagggttcgccggagaagtcagcctcacttaaaggtgttaggagaaatgggggagatgagagctgctttggcgaagtgctgtgcagctgaggagtcgactctcaggtggaagtgtgctacctttttcttttttatctgcatattttctgtgcctggaaaagcaacccagtgacccctggtcacagatggcctttgtcacgctgcttctggtggttctattccctgctggcctgttaataagccggtgcgtgaggggttttgttttcttcactataatttgtagcgaggtgtctctctgatggaagacccttttgaaaagagtaatgaggtagcaacacatgtcacctccggagtagcgctttcatgtatttctgtattaaagtatgattcagccaacatcaggaattgccgaaataaactatttacagcccaggtgcccctttttatgtttctcctccctgatggtgcgcactcccagcaaagtgccatgaatcgcggtgctggaagcagagtagttgctgctagaccagtcctgccctgctattgtctagaggcctgctgcttccctctccccaataaatgacggcagcgcaatctggagggccccggatttatgagcgctgacggttctgctggaggctaacaaacacttgcagaggaaatttacatggttgggtggttattttaaagtatggagaaagggctacaggggcgatgaggtggtggtgtgtgcaaaagaggaggacctgggctggctgactggctaatttagtcatcttatcagaagttaacatctgtccccatgatttgatttttcttttttatcagtgattagtagaatagccatagatgtctgcaaaatcttttttattccataccctcctagataaaagtttgagacttcctgtctgtctcttttcatcttgacttgacttagtctctaccaacttgaaatggctaaaaggaaggtggtgtggcatgtcttcagtggttaccaccagggataccttctttgacggaatcccctctccagacccagcaaaaagtctggcagggaagaactacaggctggaggtctgacaacacatagaaagttcaggtcacctcaaaccaggtactgactgaaaccccagctgttgaaacaccagctgtgagcatgttaaccccattgctggtcttttttctttcctcaatgggaatttatgcatgggagagagaatggatggtcttgaagatcttggaaataaaatttaggagactgtcaccattcattgaaatcctgccaca

SEQ ID NO: 34753 - DNA, 1848 bp, Bovine  19866880970985
attacgcgtcacttccggcgcggcggaggaggcgggagactgagggaaaggctggaagaagaggtaagggaagactggcgcgagcaggagggagcccaacaacctcgagcccttagaggggaatcccagggagacgatgaggctgagagatcataacctgggaatggaacggggcctttctccctcacctggcaggccgcagccacactcttcctcctgctttctgacctaccaccacaaaaagcttttttttggttctgccaagccacgcacgtgcactttttctgcctccacaccttggagtttgctcttctttctccagaggtgacgccccccctccccacgtggtgggttcctactccacctccagaaccacccgtagtggctagttccgatgttgagtttgtgacagcaccgctgtaaaacacacctttgtgctgttagttgttgtgcgtgcctgcgtgcgtgctcactagtgtttgactctttgcaaccccttggactgccgtgccaggctcctctatccatgggattttccaagcaagaatactggagtgggtttgccgtttcctactccagggtatcttcctgctcttcggggaattaaaggctgccctcttgagggggtggggtgaggggtccatttgactgttgctcaaatttaagtaccatatgttaactttgtgggtggataaggaagtcagtgggttcgttaacctcctttaagaaacactatttgacactctgttttcagaaacagaaatactctgtacccttttcctatttcaaaaaagttataaatttcagttatcaaatcagcagagcagtttgttcttttaactgataatgaggttggtggtagggagttaggttattgtagacataacagaattttaaaatgtcccgatcacagtggaaccgaccagttgaagcagattccacttcggagaccctgttctattatagttgatgcctgtttttgctcttactgccctgttttttgcttagctgcttttacttttccagactggaatggtgataatcatagccaacataatgagctgctgctgtgagttagacacgttgttttcacacagtgactcatttaatcgtcgcaacaaagctatgagatggtattatgtattcccatttggcaaatgaagaaactgaggctgagaaagtttaggtgacctacctaagatcacatatctaagattacagggaagggactctacctatattttttaccctaacaccttatttgtagctgattgagtgaattaatatcaaaaagctgaaaagcctaaaatcacagtcaatatccagtcataattataacctagggcctttgagtccagttgctcagtcgtgtccgtctcttttcgaccccatagactatatagtccacggaattctccaggccagaatactggagtgggtagccgttcccttctccatgagatcttcccaacccagggatcgaacccaggtctcccgcattgcaggaggattctttatcagctgagccaccaggaaagcccaagaattctggggtgggtagcctgtcccttcttcagcagatagtcccaacccaggaatcaaaccagggtctcctgcattgcaggcggattctttaccagctgagcttccagggaagccccaaatctaggccatctttctgtattaagtaacagtgtcatatagtgagcacttttacaccaagttcctatgtattaagcatcttacatacattcttttatttaatcgttaacaacagtcctatggggaatgggtatcactatttgatatgtgagaaaacattaaacatggatgagtaatctgttcagt

SEQ ID NO: 34754 - DNA, 1160 bp, Bovine  19866880976868
gccaagatttcagatgcatgaaactccttcagtcatgtgagaaggtaccgtcattatcttttacagaaggaaaaaaaaggcaacttagtgacattaagccacttgcccaaagtccttcaccctgtggtgaagtaggcttgcccaacactcaagtttgcacacttggaatacacaattcaatattactttcctaggtgataccatatgacctctgtgcaatggtggtcctgggtacaactccaaaggggcatttccaagatgcgtgtgtccctctcagcacctaagatggctcatgggcccagccttcttttacgatattcccttcccttccccactgcacgccaagaccaaactttccagaaggcaaaagcagaggggccttcagatatcagcagggcataggtggtacccagtgctggacacaaagcaaggatgctggcttttctaggcaattctcacttctgttaggaaaagtgagaaggacgaatgtcaaaggtcctggagaatcacctcgccatcacgtcaagcatactttccaactaaggcctcatgtcatgtgtcctagagaccccaccagccccaaagtaccaaaaaaaccctctcaggtctttgttcctgttattctctttattccattaacagattaattacagatttcaacttttcaatgcaacaagtgggtaagccagaatattcacagcatcttgctggggcaccatgccaaagaaaccaagtatctgggtgcctgctctgtgctggggatacagaaaaacaagcaaagtacaaccacaatttggactttcttctttttaaataaaggggtttttcattcctcttttcaagctgtgaattgtccttagcttcttttatcaatattcacttcagccttcagaacttccttcctttttctggaactaatgtgctgttctgaaagaaaatggagacaaacacaaaattatcgatggttccaactcactgttacagctcttaacttggtgacaacagagaaaccaaggtcctttcccactatgagatcccatttgtaagggaataatcattcctctattagtcctatttatttatgtcccacctcatttcagaaaaagaaagacagctcaaactaaagctgagacaacttaaataaacaataaacacacctg

SEQ ID NO: 34755 - DNA, 1093 bp, Bovine  19866880982830
atgagtatggtgttggtatgtcccgtgtatcaaaatctgtgtctggctttgtgctgccattggcctgggtgtgtgtttgtgtgtgtgtgccagtcacttggtaaatatttattgggcactgactacctgccaggcacggtgccaggctccagaaatcaggcaggcgcagtcccagccacactgtcttcagggaagacaggcctgaaatgtcttcaggcaaaagacagacaaaaaaagacagacaaaaatgtagccagcaaggagaaggaaggggcgccggctgagtcccagggtccagggaggcttgatgagctgagttctgaaggaagagaaaggaactgttttctaggccaagggactggcctgtgtaaatgtcagaaggtaggaaggaatgcgaggctgggaggcagccagggttgggagggacaggggaaccaggtccaacagatgagatggcccagagggtgagcagagtgagctgcacagaatcttgaaggccatggagaaatctgagccttctctcaggctgcaggaacctagggtgtgctgctgctcacagatgtccgctaactgtgcgtccatgtacttaagaactatcacaggaaagatgctctctgcacatggaaatgggtctgtgtttgtctgggaatctcctaaccagagccccagctggtgcaggaatcgccagggattggggtgggggtgggcattgcacgatcatgctgagtacatttattttatttaactaattagcatctttgcatgcccctcacgtggggcccagcagccttgaattctaatcctctaagtcaattagattattttctcctttgtgttagatgcttcttaaaccccaagcaaaatcatcagtgagagagttgccatgaacagggtatattaatgtacacagaggtctccacctggccaggcttaactgatgggtgtttggacaagaaacaagatgttacacatgggcgtgccattggcagaggatgagggtaaggggccagggtcggtgggccagcagccaccgtgagccagaaatgatttacattttaccagctcagaaagggcctgagggtagatagcacaa

SEQ ID NO: 34756 - DNA, 2155 bp, Bovine  19866881048140
acatttgagatggatttttgacatgcctctgagatcctactagaaaggatcctatagaggcaattcagattttctccccacatctcagatgatctgagtggcacagtggggtccatgaatgaggttctgggagccccaggctctattctccaactacctagaaggatgagggggctgcccccccacatctcggtacaacacgtgatatctggagggggttggggggagggcctctgccagaggactagaattgggtctccccaaagaatcctggattttggtgtctgccaatctgatgttatccgaggctcatgggttctctcatctgcataacagggtgacatcctgagctcacagagagcagaggacacatgtaaagttacctcctatgctataaaaggtctaccacacacaggctgtccaaaacagcactaagcttcatttcctcagctttttgctctgaaactcaccagggcataagacagctatgtaggtgcccatctttcctcacctgaaagcaactgtggcaaagaccgtgtcgcacatggagtcaccagtatcccccctcatggtatccatccaatgcctacactgtgcctgacaccatgctagacgtccatgtggattaggctgattactcttcaccatacaccctttgagcctccttttttctcacctgccaagttcctacttcatagaactctgggaattttaaaaaatgacatgtgtgtaaagagatgggtactgcacttggcacagaacaaacgaactgtaagtatcacttatcatcatcttcattttacagatcaggaaactgagaaacagagaagttaagctgccggggctcagtaaatgacaaagtcgggcttagattgaaggcagttggcctctggggccaacaggctttcaagcacccaacccagtgcctggtacatgacaggttgagctcaatcaatggcagccagatcctgagcaggatctagaaccaaggagacctgcatgagaagaggagcctgagaggctaggtgtaggtggagtggcctcttaacttctctgtaatggcagtgactatatccactccccaggacagtgctgagcattgagtacaaggatgtacgaaaggtcctagcacactaactggcacagaataaagcctctgtaagggccaactgtcctccttttcgtttgacagatgagaaaacagaggcttagaagaaacttgcccgatatcactcagctagtaaaagtggctgagccagggctcgatctgggcaatcttacttcaaatccctagccagctcctggcacacaacaggccagggcttgtaccctccacctggcgctcaacggggccgagagaataatagtcactagtgtcagaaaaagccggagggggaaaacgactggatgaactgagaatcctgagccccggtcggtggaactttagacaagcaccttaaaccttccgaggcctcggtttccttctccgagaaatgaggataacactgtttccaacctcagcaagcgcaatcgatcacaggcccgggcctggaaagccaaggctcagcaaagcagctacaggagccgcgggagtgggtgcggacgagggctacccggggtaggaccggagggggacggaggggatgtttacctttgcggagctcgcgatgccacaccgacacgatggggcccgcgtgcttgcggtggtggatgagccacagggagagggtctgcacgctctgctgagagttgctcagctccgagagcttcttctccagcgccgactcggagaaggaggacatggtggcggcggtgagggccggcagggagcggcctaggccgcccagtgcggcgggaagagtgacggcacgaggccggggcctcactccacccgcctgcgggactctttacggactgacagacggccggggggcccggcgggggaggggatgggtctccgcagtaacagccacccgcaccgccgccacaagatggccaccgacctctcaccccgccgcgagcgcagggtcaaagggcaagcgcagaagtgttgggacaccgtggggcgagagtcagagtgtcgaaaacaccctagtgttgaacgcctctttgaaactcgctcttgagtagtccgagagcagcagaccgggaaaaa

SEQ ID NO: 34757 - DNA, 2127 bp, Bovine  19866881111285
acacacacacacacacacacacacactgggtcacgtgaccccacagactgtagcccgtcaggctcctctgtccatggaattctctaggcaagaatactagagtgggtagccattctcttctccagggatcttcccaacccaaggacataacctgggtctcctgcattttaggcagactcttgactgtttgagccaccagggaagcctcatgttatcaagaagaggcacaaaaggaagggaacttaaaccaatgaaagtagtttgggagcacatccaaaggaggtgaatttttttttccttaagagcattattgaagtataattgacatgcagtaaactgcacatgtttaaggggtgcagtctgatagattttgacacatggatgcacacatgaaaccatccacatagtcaagataatccatcaccccaaacgtttccctcccactccccacgtgctgcctttgggctgagaactgaaagacacatgagttactctgctgaaatagtcaaggaaaagcattcaggtggaaggaagagcatgtgcaaaggccctggggctggaatgagctatcagccatctctccttcttccagctgcctgctatacccctgccctggttgcaacttttagcacctcgttccttggtgtaggacagtttcagccaaccatgtattcactcaacaaaccctcagccctctcctgggtgcctggaacacacacatgcctcagatgctgtccctgtccaggagggacggacacggtgtctcaggggaagggggcggggtgcagttagggcttctgattatgaggcatttcttctgtgcttgaccttataccaaggaagccctttatgcgtgccatcacaattcccattttgtagatggagtaactaaggttctgaaaggtaacttacccaaagatatctctttgggcctcagttttcccatctgtagaatgagtggaagtgcgggctaaggggcccaggtagccctgtctgctcccagagtccttcacctcagggtcctctctagtctccaggaccatgggcagcaacaagagcaagcccaaggatgccagccagcggcgccgcagcctggagtctgctgagaacacccacggaggcggcggcggcggcggcggcggtgggggtgccttcccctcctcacagacccccagcaagccagcctcctctgatggccaccgcggccccaacacggccttcgcccctgcagccgctgagcccaagctgttcggaggcttcaactcctcggacacagtcacctccccgcagagggcggggcccctgtctggtcagtgtgcctgggagtgtgaatgccgggtgggcggtgtgcccccggagggcagcgatgcccgctttctgggctgctgtttctttctcttaatgatgggggaggagtctaggggttacttggtcttagggcctattgggagttttttggaggctttataaactggaaaatgtggtgcacacgccattgcctttagggctgaattctggtgcacagtataaagggccctagagataaagggctgcaggtggaaactgaggcccagagagccgggggcttcttggggaggcccgaggaccaggtctgaggctttccttttcgctctggttagccttgagatggatcaggactggaggcggtgagtggccaaggggacggggcaggttttaggagagagcgagctcgggtcttcagaggcccgaagctacgagatgcgcccctgcgccctctgctggtattgagcgggtacagcagccccgggcgagtgaggcttagtaagagatgtagatgtggttctggagaggtaagaccctcacacaaacacgggcatttctaccgggacaccttcagacggacacacacacacagtcggcagctcattcagagacacccatataggacacgtgcacatgttaggctgaagattccatcgtggacacagagacagagggacgcaggaatgggcaccctccaggcacagccacacacccaacgcagatgcacacaaatacaaatgcacatacgcagaaacgccttctactcccagatggagacagacacgtgcagtcacagcccttcagaagtgcacacatgctcag

SEQ ID NO: 34758 - DNA, 1231 bp, Bovine  19866881114905
tggtcatcaggttccctgaagatgatgttccgtcaactgtcctgtccaagaacattttcacccccaaacaggaaattcaggtacatcccaaagggcttcttcgctaaacacagaggagaaatggacacatgagagagggcagcagagccccaggcactggctgtggtttagatgatacgttgtagcttggtctttgccaccctgtggatcaggcagggcaaatgtcagccccatcctggagcttaaaaaaacaggctcagattgcctgccggccagttcccagaaagcagataactagagacaaaatcagaacctatgtctgtttttcctaaacatgcaggaggttcattactcagatcactgcttgatgccacagcacagatgggtctggctttgctcctctgtgttcctgcatagaccagggccgatggagcccacaggtggccaactcagctggagcatagggctttcaccccctaggccagcccttcctctctccctgggattcaccttccttgcacacaaatattagaaatccctgcccagcccagtccatgggactgttgtgaggctcaaaatagttcccagataaggaaagaatagctttgaaaagtttctaaagcagtgtacaaaatgaacacaataattgttaaacagttggagccctggttaaggaaactgagtggatccactcagtgtactgttttggagtcctcagaaatgattatactgcagtaacagggaaactcacaatctgaaataatggtgaagtgttccaagcagactactgactcttactccacttagaaaaaagccaagggcccaaaaggtagagtagtagtagtatttttaaaattcttcctgatgttgctatagcatcatttaagaatgtggaatgcagttaaacactggaacgtataaccatgatgacaaagggtgctaactgattttgtagggtggggtaggcagcagcagctgccacgggccatattagaagtcccttcgtgacagtgacagcaaagaggagctgaggttaaaaatttgggaataggagtctcacatggagctgccttgtcatggagctgggttgactggacattggcaagcaagaaaatttcaaaatttaaaatcgttaatacagcagttagctaacttaagtcagcaaaatatgatgacaccaccctgggaactcagaaacattgtgaaatccagcgtcctgcctgggatgtgt

SEQ ID NO: 34759 - DNA, 1814 bp, Bovine  19866881275655
catggagctggggatagggcttcccaggcagagggaactcatgtgcaaaggccttgaggcagggagtgtgtgctgttctggagaaacaatgggaaagcctgtgagtctggagcacagaaaattaagacgagcagatgagaggtgaaacgaggggatgttatcagcagggctgggccatgtggggccacatgggccttgggaaagtttggcttccatcttcgcacaaggcgctgattggtgtcccctgtgtgaacagctccaacttggggaccagggaggtcagagctgaccaagtcacctgggagaagtaaatctgtgggctggactctaggtattctgtgggggcatagatcaggtgtcaagaggaggaggcactggaggctgggctttgagagtagagtaggagttcagtagcaggaaagcaggaaagggtgagagccaggggtaggggcagtgccatgcagaatggctggaggctgggagcaggaaggggtcagctggggagctggagactaaggtatggtaagggctcaggagtcagacaggcctgcattcaagttctgaccatgcctgcttgccgggtgtccttggctcattcatcttgtctttctgagacttagcttccttgtcttgaaaatgggaagagtcaatatcttcctatggagtgagggttcaaggagggctgcctggaaccatcaggtcctcgggggagtgggacctgccctgtgcggtgtgaacactgggcgtgtcaattgccctgatgagttgacctctccccagctgtcccatgaaggcttcgaggggatgagctcactaattctgaaggtgctggcctcagaaaggatgttggtggccaaggccatccatacactgggtgaccggagtcctgccttgcccttggtgtgtgaggaggctgagttggggagagctctgtgggtccagcttgtcccaacttttggaaagcttgccttcagtgatattaggccattttccacctgtgagtactgagacccggagggggaagacacttggtagggtctcccagttgccaagtgacagggctgaacctgggcttggggctctgggctcctagtccagggcagggcctcccgtgcctctgcaggcctaagagacccttcagaggtctccatcccctgccctgggccttttgaccagagcctcatttcctgccttagctgtgtggccacccagcctctatctctcttgggttcccccagccctttacttcccctccactgctcctccccacttatctccatggtaaaccactctggtctccactggagcccctagagggttgggggccacttcctttgggggcacctcaatttcctcatctatgaagtgggatggtatgagtcatggctcctggggtgtcccaaggggactgaaataaagcgtttagcacacattagctggatgaatggggcgggaacagctagatacatggtcaagtccatcgttttctggcagctgacacccccttcctgtgactcggtttctgatgctgtaaaatgggcatggggcttgcacttagtagggccaaaaggaggacgaggtgaggccataacctaggctctcacctggtggctggctctgcatcactatccctggggagggtgaccccagaggtacctcccctgtgttcaaggccccgttcccagctgtctgtccaaaggcagatcactcagcctctctgaacctcagcttgtgcacacctccctccttaggattaaatcaataaatgtctcccagcgcttaaactacggatatccagtaaaggttacgtcttt

SEQ ID NO: 34760 - DNA, 859 bp, Bovine  19866881275862
agtgttagactcttcaatgagcttttctttatctgtgatactaactgcacacaccaaaagtgtgctgggtgcaatgtggtatgttattagcaaagtgaggaaaacgctgcattcactgccatcctgctaagttgtttggtgataacagacaaatttctcttctacatgttacacatctcctcttgtgacttataagccacactgttactgaactcctcccaccccagtggtgcaaagtcattcccctctatactcaagtaccctgctgggtccacataccaggtgcttcagtaagtctcagcaaacgacacagcttagaaaactcacattagacaatttggtttgtgggataccacctgctatttttcgctctgctcctgagtctccctgggatagattataatttcatatgatcacactctatttccataaatataaaaattaccaaaattgctgccattattacctgtcgacattttaaaaaggagaagaaaaaggaaatcaacatggcagtaaccacagagcacaaggaaaaggaggtggtggttttcatgtgagaaggagaaggaggtagttagctctgaaaggagggcaggctctaaactggaaatctgcagctccccagcaggtaaggaacttcagccctcccgggagcactaattctttcgggctcataaaataagccctgctgtggttctgattagcgtgagcctattgcagcagccaagtcaaagcatgaactccatagttctccacggagaggagatttctggattgtttatctcagagcagagagcaaaggcagcggaccacagttaaaggggaaagctaaatccagccacagttaaaaaatgcaaaa

SEQ ID NO: 34761 - DNA, 1377 bp, Bovine  19866881297771
gcttgaaaaatatgacttagagctttacttcttttgtggtagaaattgtgtgctatggtgcttttcggttgtggaatttttgaacacttttggaatatttggtgtgtactcccttctacatattttccagctctaaaatcctgtgtttcttttttgtctttcttagcccaacaggggcacaaaacgtccccgggatgacgaagaggaagagctgaagatgcgtcggagacaagctggtactcgagagcgtggccgctatcgggaggaggagatgactgtggtggaagaagcagatgatgacaaaaaacggctgcttcaaattatcgacagagagggtgaggaggaagaggaagaggtaaggtggcagagatgggctgggggctgagatgctcagccttgatgcagtgtctgtagagtgtgatttgggattaaatgcttagtttctctgagcttcccagcttaatctgtaaaatggggttaagaatatttgtttcacagtgttggtatgaaggttaagtggagtttggaaggcattttgcaaagtgtgaagaacattacagatagagtttttaaattattctggattatatattataactgaggcccaagcactgaactgtggggctgttggtatggactgaggaggatcacggtggtttcctagcccatactgagggcacatagatggcactcatttttaagcacagtcaatagtctttgaaagaggaatagaattttatcaaacgagtggaagaagggcctttcaggcagttaaaacagccttaccaaagcaacaaagttgaagaaattacaggaggaggtaagggattgggtgtttatatgtgattgaaaaaatgctgtttagggaaagagctggccaagcctttctatctgctgttcctcaggtggcctccgggcctttgcactcactgctgcctctgaaccttctcccttctgtgccctcttgagagtaatcattctcttactctcttaccactttattttacatactgtcttcctatttgttattttactcatttgttgtcctctccccaatctcctctgaaaatggggacgggctgggttttgttcacagctgtatctctagcattccaagcaatgcctagctcttggtgtaagccctgaaccaatatttattgaatgaataaatgaatgaagctgaaaagaatagaggtaaaatatcagcgattaaaaatcaaatgaccttgcctttgtgtcttttgaaatcttgaagtgttaacttgtatattatttcaccctggcattttgttcaatatgaattatggaaatagattcttaagagccagctgttttttggttccctcaaagacatgatgctaagttggattttaaaaa

SEQ ID NO: 34762 - DNA, 815 bp, Bovine  19866881333959
gttttccttttttctgctcccaactgcctgttcagaaatgaagacccttgtgtaaatttcatacaactgctgctttggttgggcttgcaggtaataaaagcagaaatccactaagtaggtgaccttcctggacaaaaacggctggcttctctgaataggccttttgcctctgcttctaaaagtcaggataaagtctatgcaggatgaattttttttttttttcctttggaaagtatgtattttaggatttttgaatccccttctagtggtttttcttcccatttctcttcactggaactacaagcttttgaaccactgtgcataggcatacctcattttgtgtgtgtgtgctttattgtgctttgcagatgttacatttttacaaattgaaaatgtgtggcaaccctgcattgtcagatgatagcattatttactaatacgatatttttaaaattaaggtatgcacattgttttttagacataatgctattgcacacttagtagattacaatatagtataacttttgtatgcacttggaaaccaaaaaattcatgtgattctcactttattgtgatattcactttattgcaatggtctggaaccaaacccacaatatctccaaggtacacctatgcctttataggacattttatttgaaaaatagtatttccttcccttcttatgtgtactttgccgtgtaaactgtgagttgaaatattgctgttaacttggctgtccctttatcatatgttcatttaagtagattcttctgcagtatttcccctcctcctcctcaagtctccccagtctttcc

SEQ ID NO: 34763 - DNA, 1596 bp, Bovine  19866881352478
tttctcatagtctctgggaaaggggtgagactgcagttctgaagccacagacttgggagggaaggacgaaagaaatccccacgtggggattattacccccacttcgcagatgaaggaaatgaaattcaagggggtaaagttatttatccagacagtcccatctggtgaacaatgaagctgggctctaaagcagtggctcttggaactacctgggggcttagaacagcgccagcgccacagattctgacttcgtccttctggggtggggccaacatggatacatacttctaggtcccctccccaaccagagcaactctgatgtgtggttgagttcagaccgctgctcggaggatggcacgctctgtggccagccttgcagcgccacggaagcccttccacatgagccacgtgccccgttacaggctcagccccagagagacccccagtccacgcctgcaccttcccagctgcagacgggcagcctccccacgacccgcagggcagcagagtggccacctcatcactgatgatcacctcatcgtctgctctcagagcctctggtttctcactggaagggtgaggcccaccatccagcttccttggccgtgtcctgtgagcgctgcggggagaggtgtcggctaaaggtcagacggtacaaagaacaccaagcccggggataccaaaactagctttaatttgtccaaaagtcacattgagctccacaaagagtttccggaggagccccagggtggccccgctgctgagccggcctagaagttctccagcaaggccaggatgcgcttctgctcactctcccggaactccgggctccggccgtccccgatgttctccgcgtactctggggagacaaaggcagggtcagggggagtctggggagcgggggccatcgtggctgggtcatgtcgcacttctccctgaaccctggcgcctgggggtgtgtgcctccaggggcacccacagcggtggctgtgcccagactccttgggtcctgaccgcgaggtccatggtagaccaactccctggcccctgctcgcgttcctctccaggccgagccttcctccacttaacacacacagtgttaactatgggcaggcactgccccagagccggtggttctgagtatgaccccaaccaccagcagcaacgtcatgtaggaacttgttagaaatgctgatgtcgggagctccccagtggtccagtggtgaggactcggcactttcactgctgaagcaggtgtgcaggggagtatctgggagcgagcggcagggggcaagcagagctggggcttcagtggggagcagacctagtcccgctgagaggggagcaggcggggcgggcatggggcaggtgggcccctgtcggcacttccccagagatgagaagttacgagagagctgtaagcagaggaatgacatgatctgtctgttcaccagcgctcactctagctgccgcaaggaagacacagtgaaggggccaagggcagaaagaaggggatgtgatttgatggtggtctggcccaaggtcatggtggaggagagatgtcttcagatttcagatgtatcctgacagtgcctc

SEQ ID NO: 34764 - DNA, 1150 bp, Bovine  19866881367009
agttcttattagtttttttttttttcccctaagaaagcaatttccttacactacatgcagtttggacctgggtttttgtgtgtttgtgtgtgtgtgtgtcttaatttccaatccctagtgcttcttgtttgtgtttttaaaattctggaagtggagaatcagaggcagagattaactaggttagtctttggtattctgacaggatgatctggacacagaccgaactggacaacacacttaagcctgcagtgcagagaatgctatgcaccaaattccaggcatatagacacagatggaaagaaagcatcatctaattaattccctggagccccagacacaagcaacatccaactcacccttgatgatgtgcctgacgattttgatggagcttccacgcatattcaggatctggtgaaccctctggcgaatctaataaggaaaagaaagagtggacagagaaagaaagagcatcgtttgtcctggtagacatcagaatacatcacgttggaagtattcagttcacccccatccctgagaaagaggccccacggagagtgaaggaattcaaggagtgtgtgatccacttccttctttgagagactctcccctaagccggtggcaggcaaggaggcagggatggatgggcccacccagggcagcccctcctacctggggcacgttggcattgcagatctctgccatgatgtagcagatgtgctggaggacaaagagcccagcatccaagcgccggaggtagaactcatcctcgatgtcattgtctatgatctctccacgccggaccatgtcctagaaaggaatgaacattggggaacaaaagtcagacggtgagtggaggaggaaagaataggtttctagtcctctcacgattcacaaaagaatagtaacgacaactacaacaacaaaagaaaaccactctgccttcatttgcctcctgctcgtctccttattctaaagcatcttacgttctcattgttaacggactagaggttcacagagtcaagactaaagtccattattttgtctatacaatgactcaaggccaaaatgatctcatccacacattcaacctgaaaaaaataagctgatggggacataaatctatatatctgcttctactcattctttactt

SEQ ID NO: 34765 - DNA, 858 bp, Bovine  19866881546390
ctgttggatcccacctcgtgttccctcctaatgcattcagagtgactcttcagtactgcgtgaggggtgtgctccccccttcccccgcaccccccagaggtgctcttcacagaccagaattcctctccgcagccaacctacggctgagctgcagcctctcgaggcggggagatgaggcccagaagcgctgacaagccctccccagcagcagtgatgcagagcgccagaataaactctgaagcggcttctcacggttgaaaggacaagactcaagctgttttctcacatcctctgcctcttaaggttacaacagaccagcctctgatccaattaaaatccctatagtttatgttttcgcaaagaaggacaaagcaaaaatgacctgtgcttgctggcaacataaccagccatgtatggctgtggttgataaatgaagagttaaaaaagattaaaaatttaagtcatgactgccacgaaattgtttattcatggtaaggtgttttgggcagttacagctgtacaacagtaaattgttaacaaccgtttcctgaagaaaaatttccattatagatcacagataagacaagaaacagagtgcagtgccactgggagatcaacgctccaacagattgagaatgtgttagatgcaagtcaagagggctgactcttccctgaaaccacgcccaggaaaaatggtactaggaggaagatgacatttaccctagttgctgcatctgattaaaattaggtaatttttaaaatttcaagtgcactttaaatttgatgtaaggcgtaattaaaaaatcagattaaaaaaatataattagggcagcaggggaagattagcagcaagagggg

SEQ ID NO: 34766 - DNA, 686 bp, Bovine  19866881590006
tgggatgggaagctggtatgttggtgaaggagcctgttgaactatcccggtgggttttcctgtgtctgttctgtcatagagttgtcctctatgagaggaggtaaagctgaataccctgtgtgaacaggaaggaaattggagacgcagtgggtaaacctaaaggttgccctctcaggaatgtgcttaaaactcttcatgaagattagcaaagctattcttgtctctaaaatccattctcacagtctatcccaggtccccatttagacattaccctaatggaagcctgggaccggtactaggccaggctgatgactcgaggatccttcaagctttggagttctttaataagttatttgttgaatgaatggcctagcaaatactattttaacttggccgaggtcttgtatgacttaggttcatgggtatttgttctcgcctgaaagtccctcaaatctgtctcaatcagggttctggaatcatggaaattggcaaactagccagagatcagtttcaacttttagaaggtgccaggttgttgttacaagagtttattaaaggatctcaggcatcctgtctccctgcttataaaatggaactgttaattacttctcgtccccagagatggggtgaagatgaaaaggagcgctttaagctctgcagaaggaaagtgctatttcactgggaaa

SEQ ID NO: 34767 - DNA, 1347 bp, Bovine  19866881618553
ccccaaccccagacctcactcttcaaggcctggtggggcgggcggggtggtggtgcttttccagacagctgaaatgtctgtgggaaaacagtccatggggatgtgaccctgttagcatcgtaagcaaagagtaagcttccttctgtttctccttaagtaagttgcactgtcatgatgtccctgatgaaacttacacccccacttgcagccccagcacaacattctcctccagagaagccacgttagtccttccacatctatccttgtcgctgaggaatctctgttagacctcaagggccttactctcctagtttctatttcattattatttctatgtcttcaagggttatcagtgtaaaaatgctgacattcctcttctccccactcacccttcctcctgcactttttcagaggtgagcatttaaggctgaaggtccaaggatctgaaccgggcttgtgagcgccggtctgtgtcctggacaacagttcttccccgtcttccagtcggggtacccctccctctccctcttaacataaacagaatagctcagattccatgtctgaacagtaaacctgctgtctaaagtttgctttaatatgtatgcgttcaacgctgctgcctgtttctaagctcaatcaaagcctttattataagagcatttgaaaatgctggggaaggagagaagggagtggatgtatctgccccatctttctcactctctagaccgactcactctctccctctccctctccctaaccccgaagttgtcccttcatctagcatctcttttttcccctccagtctctccctttcttacacacacacagcaaagagaactctttcccaagacctctgggagggatctgttcaatatttataaactgctgcagcagccataataaccggaggtagctggcaccaccacagtttgctccaaataggattccactctggaaacaaagaacaagtcagggtcaggggtggagggtgagatgtgaggtgcacagctggtaccagctgccagggccagtgggagagcactcagggcttgtcaggtctgcttctggggccggctcgctgtgggcccctggccgctcacctgtccctctgggttgctgtacatttctgagagccctgtcagccctgacatttagtgaccgggcacgagggagcatggccccagccagtactccacatctcttctgattgctgaggccccttgaccccgggacatcccctccagagccttacctgttatgaggatattgacaccagatgccctgccagagctggactgccttggagacttttttccgcaaaggatggggaacaggcagggtagggta

SEQ ID NO: 34768 - DNA, 1046 bp, Bovine  19866881812985
tcctgcttgaatatcctacttctggttatttattcgctccccactgctgcacatttccagccatatgctacaggaatacatcacctcatatttgcactcaaacatccaaagacactggcggttcagatctttaagaagcttagaagaaagtccatacagaatatagttttaaggttaaaaggcccaggaagccaaatgcatcttctttatatgctatgtgcttgagagaaggtgggtcatttcaacaaaaggacaggcaattagaagggtaaaggaaataaacaaaagactcaagagagtaaagccagcaaaaatcagctgaacactaaaggcctctgaataattacaatgcccctctctgtactttaaaataaattttttaaaacaattccaccaaggaagatttttcaatcaatccaaggtctggtacacactggacaaagcaagaggtctactgtgccccgggcctacacaagcctttaaagagaaggtgttttcaaaacacataccctggcgatcttaagtacaaacatagctttaagcacaaaaatctgtagaatctgtcactggagaattttttataacaacaaaacatgggaaataactacaatatcaataacaaagaaagaccaagtaagtcatattcccttagagtcaccattattcaattattgaaaactgtcatgaagattatgtcacaacataggaaacagcacgtttagttaaaaaaattaacagaacagaaacttacaagtgtggtaggcccaaaaagctgttaaaaatagaaaacaatcatgggggaaaagactccaaggaatccgcatccaaagatggatcgtgtttttagcttctaaaactaaaaatacaggagacaggaatcctaccattcatttctgtacaagccaagcacttaacacattaccgtatcagtgctttaacagttttgtatgtctatattctaagttatatttaagaggtatgtatcaaatttattaaaaatttttttcactgaaattttcaatctatccagatatgtttccaaacag

SEQ ID NO: 34769 - DNA, 809 bp, Bovine  19866880433705
tccggaattgatctctgctcaacctacgcatcacccaccgcagtcaccagcacagattcagatgcagctgcagcacgaattgcaacagcaggcggccttctttcagcctcagtttctcaaccccgcctttttgccccattttcctatgaccccagaagctctgctacagtttcagcagcctcagtttctctttcccttctacatacctgggacggagttcagcttggggccggatctgggcttgccagtaggctctgccgcctttggcatgccgggcatgacgggaatggccgggtccctgcttgaagatctgaagcagcagattcaaagccaacatcacgttggccaaactcaactccagattctccagcagcaagcacaacagtatcaggccacacagccccatgtgccctctcaaaagccgcagccacagccgcaacagcaacaacaaccgcagcagcagcaggccagcaagttattgaaacaagagcaaaccaccgtggccagtgccgactgccccatcgtgaaggacgtaccctcttacaaggaggcagaagagatggccgagaagcaagacaagccaaagcaagaatgtgtaagtgaaggcgaagggctcaaggaaagcaaagaccttggaaagaagccgaagtcctcggaaccatccatcccgccaccccgcatcgcttcaggggcccgaggaaacgcagccaaagccttactggaaaacttcggttttgaactggtcattcagtacaacgagaacaggcagaaggtacagaagaagggcaagagtggggaaggcgaaagca

SEQ ID NO: 34770 - DNA, 1986 bp, Bovine  19866880445192
attttggaatcccgtacacctccaccaaggttataagaaaaggttgtgtatgactacatccaaacacttttttctttaggtagaaagcttgtagcattgactcgatcttggagttatgatccccccaaaaattctaaaataggccaaaaatgtttttgacaattcccaaaaatagacattttgacttttcacttatgtctacacagaaagaaaatacaattgtcaacacagagaaaaccacaacgttaattctttaaaataaatgtaaaatctacatgcccctatttgattcaatctttcataactcatatgtcttttaacataaaagaatgtatacagtatatacattcttatataagaactgtatatggaataaataattctgaaaaataattaaataagtacatttaacagtataatggctaaaaaatggattaaatttcaacctgacataaaataaccagtttgattcaaatatgaaaaatatatgtacacatctgttttaggtaacataaatttagagctgcataggctgatcttttaaattatatatttaacccacaggttgcttttagtgccatgtcttgttaattcatagaaactagcagctttttacggagaaggcaatggcaccccattccagtactcttgcctggaaaatcccatggatggaggagcctggtgggctgcagtccatggggtcgctaagagttggacacgactaagtaacttcactttcacttttaactttcatgcattggagaaggaaatggcaacccactccagtgttcttgcctggagaatcccagggactggggagcctggtgggctgccatctatggggtcgcacagagtcggacatgactgaagcgacttagcagcagcagcggcagcaactttataagaagctgccttgccctgcaaagataggcaattcctttaagacagacctcttctgagtttaatgcttcatggactaaatattatggttcacatatgtcaaatagacatttcctagagttgcaaggtcaatttgacattctaattaaataatccgtaaaaaaaaaaaaaaaatcctaaagttccatgagctgaaactgatcaaagaatagaacgaaactttacctattacctgagccctgagaaatatactttgatgaaaaactgtgactcaaccaataagtcaggtctctgtcataactaattctccatgttgttaaataaaaaattgttcctcagaaattccatgatatagagtatttgcaggccgatctggcaatctaaaagtcatcaaagaaaggatgggaaaagaattttaagcaaacatttgaaacattttccttctaaaattgacaagattcaatgttgtctgaatgaaaggcctcaaatctgttagcaatgcatgatggagtgaaactcagttaatgcatttaaaattgtaaaattgtttttaaaaatgcctttcttattacattcaaatgcaattttcaagacagagtcataacatgactctgtgcacagtgctgtgtgtacaataaagcagcagaattaatcccttcccctgacgacctctagcaatgaaaacccattatagtaataatatttgtacttaggtcatgatgtttttgtgctgaatttgaatgtcatgaaattattatgtatagtggttgatggggacatgtatgcagataattacataaataatcctctttacataggtgcaaggtgactttctagatcaggcggaaactagttgcaacctaataaaactcataataatttttgttactgctaaggcatggctctaactctcccaaagggtgcttatacatattttccttttcacagggatccaatgagaggatttgagtagaagcccagtaccttcaaggctcctggctactgcattatatgtcagaacccatcctcaagatataagtatccattggcacatgaacatcttccatagggtcaaggatccttcag

SEQ ID NO: 34771 - DNA, 965 bp, Bovine  19866880474137
gcatacatagcattattcaatgaactagatatttatttagacactttacttttcttaatggcttatatcaaaaaggccatatctattgagatttcaacttaattttaatgcatttttgaatgtctactctaaacaggtcatgggaagtagtaaaaataatgattaagaagataagcttaagatttagatgcttgagttcaaatcctcggttctttctctcatccactgagtgacattgggcaaaatatttaatctctcctcattgataacatgaaatgataatactacctaacttataatattgtcacctcacaaatattaattattatacttcataatattagctgttatagattttattataattacaatatgatgtgtcattcatgttaggcaaggaaaataaatgccaggtgaatgataaagtttgtctgccttgaaggaatgcacagaaatggtcctttattgaaatattttctattctaggtagaattttgctgttatatagttgctaagtcctgtccaactctttgcaaccccatggactgtagcccaccaagctcctctgtccgtgagtttctcagtctggaggaaattggagtgggttgctatttccttctccaaggggatcttcctgacccagggatcgaacctgtgtctcccgcattggcaggtggattctttaccactgagcccaccaggaagccctggtaggaaatgtcatgataaaaatattttatttcccttgagatttatcagaaaatagttaaaattcttgtttaatatgttaagtatgactatattaataattgagtaatatctgttggattttatccaaccttctcagaaagaattaactagggcaagattttttttagtataaaaatactatctgccttatgaaatgttcattttgattccatatattctgttcttttgtgagcaagtttctaggtacaacactt

SEQ ID NO: 34772 - DNA, 1145 bp, Bovine  19866880606879
caggattgtttagtggctgctaacacatactcctgttggagcaatctggtggctcaggtggcttcccttatgtcactgtcactccgcagagtttaataactggctcaaatattgtaaagccaactcagaatgaaaacacagagtaaatatgcagatacagtttttaatgtatcacaatgagcaacaaacatacttgatgaactatttccagaagaataagttcaaataccatctacaataaacatcatttcaactatgacaacaggtctgtgacaaaataaaaaaaaaaagttttcaaaaccatgttatttaccgtaatacggtgcatttgagacttcaaacattacagtaacaaaaactaatgagactactctctctatataaaacatcaataacatttttggtttagtttatttaaagttatagccataggggcttttattaaaacctcagggtgcatttcctatttaacccaggcgttgagagtacatgttgtgtagacaatgattgcgctgtgataatccctttgatatccaggaaaaaaacaattctcattctcaacctttggaggctgtcctttcatttctcaccctaacaacgtccatccagttaaagttttttttttttcttttttttttctcttttttttttttggctgctgtgcagttgtaaaagtttatgtcgacacactgtcggaatcatcatttgtaaaacagtcctttgttttgtgaaaagcgctctgttccatgctaacacactgttgcacatcgtgttaactgccaggacagatcgatctcacaatgctgctgcttaacattcatgaaaaaggcaaaagcaattttctgaagcctttggattcaggacattagctcactatagcggcaggattgcaccttaggaggccgtgttgtctcttacgaaacacaatcaaaaaagtgtcttcaggattaaaataaacgttaaaatactaaaacaaaacaaaacaaaaactccaaattaagaacattaaaaagttcacgtaaaatatctagaagaaagattgctgtgatcgttatcccaaacgaaaactgtacaagaagaaaatgtaaaatgaaatgtgacttgatttgatcattaaaacagtttgaagcatgattggagttaaa

SEQ ID NO: 34773 - DNA, 3206 bp, Bovine  19866880695668
cgtataaaacatatctgatcagctgatattgttcatggcagaaaagctggtgctgtgtgcatcaacatggcgtaagtttgagcagtttctttgggctgattacttgaatgtttataatatcctgacagattttgttctttactgaagatttaaaacagaaaatagctactagatgtccatggtgaagatgctagggcagtgaaaaggtgagtgcagccatcagtggattggtaggtaaagagtaagcccatcccctgcgataagaagacagggcagtggttacaatcctctgcatgagaagcctccgggaaaaccttggactttagagtcaggaaacatggacttgatcctcagctctgttccttcccaggcacataaacttaaacaaatcatttgactctatcactctcaattctaacttttttttccccatccatttactcaacaaacatcaactggactcctattcacaccactagatactaaatagtgagctgaggggttacaagttagaaacacatgggcctcatcttcaaacaatgaaagcagctagtatgtgcaccaggcactatgtaaatgctttctactatccaatatttatcaggtttaatcctgggagcatttatcctgagtttgaaggatgataccaaaccttaaaatgattaaataaactcgagagagacaagaccttaacacaggtccatctgatgctgaatttgctgctcaagattttgtggagaatcttgaagaaatttttcttttaacattttacaagattttagtgagggtcaaacgaggaaagtgatgtgacataaagtgttcttaacctcaatgtactatgcaaatatatattgatattactgttaacatggaaataacaaagatttttgctccattactttgtcttgataatactcattcagatcatttggaccatcccaggtaaatggcacccacatacaaaaaaagaaaattctaactatattaacaaaaacaccatgggggattccctatcagtgtttctaagccagttgtatgtggctcctcagtgaatattaaacaaataaaacccaagtaagacattttcctacatatgaaaatttctggaaagcacacatctactgtttacattagacctggaacatcttattaattttttaatgtatcttagggttattcaccaattaagcaaaaataatggcattagtatagcacctgcagaccttataaatgtaaaattctttaaaactcaaccagaatattgatgccatataacactgaattttcatcgaacacacaatttttatatttttatcccaaaccagggctttaaaaccgaaacataaaaggttaaggaaaccaaatgaaaacaaatgaacacaaaaaagccctccatctctcagctttgccttctttacaccatttctaccatttgtattcttgtgtacctttaatagaacaatgtgattttatacacatttaatacaacacaaattgattattcaattggaaggaaggtttgtcagtttgtcaaaatttggggtctcatttttcgatttctcacatacagttagtaaatgcaattacctggagctctttatatgaagaacattcaatgaagggaatttttatttctacagtaacaacataactagttaaaaggaataaagtaaattgcatgatagttttttaaatgttatttgatatctactgacacaatataaagtttgattacttggatcttgatcaaagaaactcattaaagatttaaggatgaatggtaggtaagaaattcatttttttggcatacattttttaaaactaaagaaaaataatattttttaaaagagaacaaatgttgacccttggaaataaaatcgagaggaacttagtggttgctaaaactattaaaaaaaaaacaaacagctttttattaaagtcataattagttttatctccaaaaagtatctttttcaaaaacaatttttattgggatatgttatctaattagcaacatttaaacttgtatttcttccaaatattttcaaatgacccaaattttgtcatacaaagttaatagttatacatgctatggttctcaggtaagtactaaaagagttttccaccacgttaaaagcacacgttactaaggatggaatgcatttcagttgatattataatggaaatattgaattaaaattttaactctactgaaccagtataaacatgggagattggcctttatgtgtatcatgctttaaagtgtgagattaatggagtttttaaaatacacattggaaatttcttcactgaagaatgggatatttataaacattttccttgaattcagttcagttttaatttcctttattttttcaaaccagtcattggaaagtttgcccaaatttttctttatgttgatcatagcaccagatatgtttaaatacttaagtacttaccatctctcattcataataaagtacacaaattttgcatttgcttataggaaatgtaacattaaataacactaaaataatgttgttatactttttttggcaacaaaaagaaccttggaaactgaagattttgttttatatactactggttctcgatttcaaacataacaccagcataggaaggttagcagtgaagtaacgacaaccttttcaaagactgcatcattcagcttagtgacacacgcaggcttactttttctaacaaacttgcacagatatcatttataggtttattaaggacaaattggattatgatttgagctgacaataattaatgacatttacaaatgaggacatagaaactgttcagttcatctggggacatggggagtttctgtccaattaagagatttttctgtttaggtagcaaccaaaaaaaatcattttacaggaatggtactcccattctctaatagagtgattaagtataggcttttagaacttatttaccatcagcacaatcattaacgtgtaaatttattaaaatgattacaatggtcacttacttccaaaacaaacaaaacaatgaaataaatctgcaacagctttgaagtttgtgtggggttttatgacacagtaaagacttatatttaatttcactgtgtttccacaattaaagacacatatacacataatctttaacattgaaaattagctactaaatatgcatgtattggtttaactgtgtgt

SEQ ID NO: 34774 - DNA, 1208 bp, Bovine  19866880710291
aactgctactccctactacattcaagttatttttttctgtaaagaaatagaattttaaaaatcttacaaattgtatttgatgacataccaaacaaaagtatgaatattgaaaagtattccagtatctcaaatttgcatgtgactgtgggagggaggggcagttttcacaggggtctatggttttccagctgtagatactactttggtcaaagctttccacttaaaaccttgaaatcctatcttgaaggttcagacacccactttaggagtagaagtaattccatttctgtacttcatgtgcctcttgaggccagatctgccagtaaatgcttaattgggttggaagatagtggatagtaccagtttatcatacaggcaactgacacaaaactttttcacttatctgaggttgggctgtgtctgggttcagagatgaaaggtcagttctttatccactaagtcccctagacattccaaaatccccagtacattacaaatttgaacagtttaagctctcttaaataaagaatctcttctctgggtaaagtatacagtgtatatagatacagtggaaaagaaacatgtgaaaggtcgcagccatgaccttttaacatcaatagttttatttatagccaggctcttagtctatagggcttaatataaaagcaagaagaaagacaaaggtatctggttagctttataatagctatccagttatataaaatttggtctttttactcttgagctgagaataaaaaattataattaaagtgatggctgtttcaaagtaaagaataacatttctcaatcatttttaattggacacattccatttctctctttacgtggcctaaaggaatctacaaggttttaaagagatttatttcttcatttgtgtgattcatttttaaaagacaaaaaataacattattttatttttattgctacctgtctctttgtcacctatgtgatgtcttgctgtgttaaaagttacacatacaagagttgtagactacagtagctgaaaccctgtttcattgaactttagtaatttcagaaatttagtaaacatagatgcatgcatgtttttggtttccaagatagttctcaaggactttgaagaaataaatgtctaaggtacattgagaagttcagagaggtgggaaaatccacagtgggagcaaagtgtgaaacaaagctggagaaca

SEQ ID NO: 34775 - DNA, 2029 bp, Bovine  19866880728368
aattctaggcatgaagaacagaaagaaaaagacactggtgtggaaagtgtttggctggagaagaacactatacactgttcttggtggatgagttgtggggaaggggatgccggggagaatgtgagtgtgatgttgaatgaggttggagagataggcatgagctggtaaaccaagcaatttaggttttattctaggtgcaaagggaaggtcttggggtgatttaacatgggtagtgacataacctgattcatgagttacaaaaataagttagaaagagtgtgagaacgaaaacaatgagaccagataggaaactaatgtgaaaattcaaacaagaaacagcagtggcctgcaccagtggtgtcagtcaagatgaaaagatatgagtggattcagattacattttggagttacaaacaccaggattcatgtgagaatgagagtgtgaggtggtggagaaaaggggaaggttaaagggtgttgttggattttctatttttggatcaagcttagagaagctccaccacttggttttaagcacaatattctaagatgttttagacaccaaatagaaacattaaataatcaaggaaatttacaaattctaaaggtcctaagcgattcttctttcctttttatgagattaagatataagttaaatgagaacatctgcatcatttcatcaaaaatgaaaaattaaaggaaatcatagtcaccttcagatagtctgcaaatttaaagagcactgtgtgatgttaagaaagatgatatattgagattacctagaatgatttaaggggggaattatgagaaaaattaattttctaaaatagtctgaagagctacaattgaataaaagagaatataagttaaacatcagaaataattttctgggcaagagtaattcaaatcaggatgtcttttaaagtcttatgaaagctccttcaactgagaccattaaaaatgagatgatataaaaccctagtttagaaagggagaaaaaaatatattacaaaggagatggaataaatgttctagcaatgtttttaaaagtattttttaaagtgtttttaaaagtttttaatatttatgaaaccagatctagtgagttaagtgtttcacctttttccaggggaacagctttagctttttgtgtaatttcttacaattggtggaaatgaagttaaatgggccaatgtaattttttaaatgccctttctggaagtttttgtaatgcagaacagaaaatatttatgtgcatgtctcatgtaaaatggaggtgtgctaaagaggggtaggagaaaattgataatgctctgggaaaaaaacagatttgcctctacttaagtgaagaaaaaccagattttagaagagtataatacaacattcaggtgaaaaatatgtagttgttgtgagtaaatgaatttgctcttagttacaaagaatttttattccaaaatggctttaatacatacagtgtgcatgaataaaatttagtcttaagaaactgatacatcatttttatttttaaggttagatattgagatgacttggatttattattttcccattaatcattatacttctgcagaaaagttgtttgaggaacattgtattcttgaatcagagcattggtaatctttttttattgtacaaaggtatttgaaatatttttcaacaaaaattcttttcatatactaattttatgaagacagtaatttccattaataataaatgtggcatcatttatatacggataccctaatttgtttccaaaaggatttaaagcagagtgtagcattatgaatctgggaagcaaaacatttctgccatcatacaatactcctctgcagtagtaaaagaaaagatgtgagagccatttaaatgccatgaggagaaacatgagaaaaatcaatgctgcaatgagtaattgaatgatgttttcaaaggctgagtaggtcatcattagacatgacacgattgaaacaaaattcccaggggtttttcaacctaacattagtggaatccagta

SEQ ID NO: 34776 - DNA, 3644 bp, Bovine  19866880728701
taattaatgaaatagctgtgtgcacgtgaaaacttcctgtactggcatcatagatgatctgcaggttacataatttgtccaaagaggtatacctgcaagacgactgtacaggatactcattttcaacatgaaactttcttaggtcttgtagtgagattttttattttttccactagtgaaaagcaatccctgagatttgaaaatactcaacacttgaattacacatatattcgattgtaccagaaacaacggcatgattttcttccttcaggaagccagcaggacaccttggaagctgatagaggcagtataattgaaatatttagtttgtgctgaaaagaagtacacttggtgccatcttggccagtgggccaaagcaaggcaagtgtctgtacggtggcactgtgaaagtacaatgtagtgtttaaatacagccaggcagaagccagtggataatgctcagtaatgggttaatcaatacttattatggttttattggttcactaaagagagaacagaatctagtgagcacagagtcgaaaaaaatcactgcatctgatctagataacatctactctccctaagggatttccctattcaagaatccaatttaccatgcctgattgacaaggattggatcctagggaatcacataactctttttaggacccaataaaatcctaatggatttgtctgactggccaggagacttctagttttactaaactgagggtggtttgttgcaattagcctctattccacttgcagttgaaaaactaggctattaggagtcatccttgctctgtaaatgctggagtcatgctgggatgtgcccgctgaaaggaagtacggggctgtatgaaaagaaagtccttatgataaattataaacgtttgaaagcttctgaaaaatggtaatcaaaacaggattcaaatgaaaaggggggaaagcacaactaaattgcatgcttaaaaaccatttgttggtcagttagcctttacaatttatttttcattcaggtaacagtaacagaaagaaacctctctgtttgaaagcagctttgaactatgtaacatttgctatctgagcttccccttacctgaagtttgaaaaaaatatcattcacccacaacaaaaatcttgtagatagttgtctctggaccagttcttttcttcctagaagataatgttttacaaagcagttaacttgttcgagcacactgggatttgatcatggcacactatcttggcagctcttaagtcagaaaacagtggtagtgtgatgatggtttgaagtcagggttgaatcatagctggaaaagaacttttaaataatacaacttgcattttgaagcaaatatccctttaatgtaagaatcattggtgcatccctctagaatcatgtctgctctgccaataaggcacaaattacacttcaaacatgtctaaattgaatggatttcacaatcagaaatatgtttacttatgaagtgtctttgaatagacctcatgatttcctctttttcttagacttggagagaagttagtgatgtacagagagctcacataaacccccattaccagcatcctagattaaagtttccaaaatctctagctaaagtgctatgctaattgagtgcaaaaattcatttccagtaagaccatctatgataacagatgtttaaatatatgaaatggacacataaacttcctaatgctaaatgattcttatgaaattatttaaatataggtataggatattgtcacatttaactatctatacattttttaatcatgacattctagctcagtgattgttaagaagacaaaaagtgtcgtgtatgataattacagagaaaaactggaaaaaaggcaaaaatagagagatggaagcaagtagaagaataaggaggcaattgaaaaggatattgataaaaattgtagcatgattacttctttaagtgagttataagtaactctaatttgtttggctttagtttgaaaagaaaacacttttgctgtggaattagaaaaacacaaattttgttaaaagttaaaaatgttacatggtgaagtatgataatgcaggaattgtatttgaaaacatgataattctaaggaaactccagataatctcagaagtgttagagtgatggtacagatgagtgcagtttgtctttctgcatttaccaggctagatttacatagggctcaaggttatcccatggacagaggagcctggtaggctgcagtccacggggtctcaaagagtcggacatgaccgatcgatcgacttcactttcactttcaaggttattttgcaagtatgttgttaaagtttgtagggtaagttccatataattctgacaccctaatggtgaaatatcttatctagaactgatatatttacttcaccttagcttcccaggtggcgctagggataaagaacatgcctcccagtgcaggagacataggagacctgggtacagtccctgggttgggaagaccccctggaagagggcatggcaacccactctggcatttttacctggagaattccatggacaaaggagcctgatgggctacagttcatagtgtcgcagagtcgaacatgtctgaagcgatctaccttgcacacacagtacacattgaattgttttgtttccagagacaaaggaatacatttaaagatgtcattagaagttactgggcttattttaattagcatatagatgaaatattattgaaatattatcataatagagaattattcagtggataattaaaaggtccttcatatgattttttacatttgtttataattataactctttttggtgctctagtactttaaatgattttttgcttttagttaagaatgtagtaataattttctcatcttcagtaatattgcttattcatgtataatttgctaatgaatatttaattttttatctactgctaattttatttcatttatagtacaactagcagtgtctcacccacacattatataattttcacttttaatataaaatataaatataattttagaaggctaaatatttttattcaaaatcaatatatctggttagaaattaaataaaaagtaaaagaaaatgaaaagaattcctgtttaaaattatgatctcactcatttgcttaccttatctcataaaactcaacgcaggctagatcacaaaaggtgatcagtcttctgtccatctctcctcctaggatgattgcccatagaaactatcccccctactgtgaggaggttgggtcaaatggagaggctgtgtgtaggtgttctagtcaccatccccagctaaggtctcagctgacaaccagcatctactggcagatatatgaacgcacaggtcttcaagaaagaacaatccctaacctttgccccagttgatgtcaaatgaaacagacatgagctatttttaagccttcacctaatgggaaaatcatgataaaaattaatgatacttctcttttaagtcaccagattttggaatagatttcaggtagtaatagaaaaccacaatcaatttagctaattagaagtaggatgctatgacagcaaaatataaaacatgcttcttgggagctgggtaatggggtggaagctggaagga

SEQ ID NO: 34777 - DNA, 1225 bp, Bovine  19866880799912
ttccagacttaatattgcaggaccagaagcttttttattctgcaatatgaattgtgcaaatgtctatctatatacaggcacaatccattttaaatatccacaaatttccctaaagtcccaagtggtttccttggcaacagggctgctgaaatgtaaagggctaaggtagttaggatgttgcctatcgttcttcctctctaggttattttaaatagctgcaattttctttgcacatctaaaaaaaaatccacagtggtgggagatacaaaggcgaatatgagagacattagaggatagtagtacatcagagtctaatttgtgtggacaaattattactttcactgctccctgatttgcagagcaccattttcatgtaccaaattgtagtacaaaagaagagcaaaccataaatacatcagaataatttttagatagaatgagataaaatatctgcaaatagcttttgacaatagaggcagtgattaataatggcaagatatctttgcaagttcttttcagttcacaggggatagcatgcatctgatgaggccaggcattggtacaaagagcagaaggaaattcaacagcagtgggcaaggaatattctccacaacctacaaccctagtgcatgctcagtcgctcagtcatgtctgtctgactctttgagaccccatggactgtagcccactgggtttctctgtctatgggatttttcaggcaagaatactggagtgggttgccatttgcttctccaggggctctttttgacccagagatcacacctctatctcctgcatgacaggcatattctttactggaaacttcaaatgtttattatgtgaattattttgtcaactattggtaaattattgaaggtattatttgctcttatttattaatctgcctttcgtacttcctcacatggttgagcatgatgtcctaattattgatttttaggtgtgtccatggagtacccactacagggattcccacagcaaagggacctcttccactagaggatcaaattgcaaagtcttctgacattttcttagggtttgcctccattccttctatctgcatgaggagcctagaaataaaggcatatgtctagcagcaactccctcgatatcactgcttcatgtaaataacttgttacaaggtgagtgcatgctcagttgctcagtcatgtccagctctttgcaaccccatgccctccaagctcct

SEQ ID NO: 34778 - DNA, 1343 bp, Bovine  19866880804686
ctataacgcaggagacccgggttcagttcctgggttgggaagatctcctggagaaggaaatggcaacccactccagtattcttgcctggaaaatcccacggatggaggagcctggtaggctacagtccatggggtcgcaaagagtcagacacgactgagcgacttcacttcacttcaatcctttcttctgttacagatctaacttttataaaactgctaggttgacagttgattcaagtcttcggagagaaactattcacagttttaagggtatgcccctccctggtttcctggatccaggcttcctgaatccttctgagagaatcattctagtgagcttctggagatcttactgcccttcctctggtcgttttccttgaaccccagtcactgtttctgagcaaggaacagctagtacactcttctctaatcctgtctgtaaggacagctaaacctgggtgcatagctctcccattacttattgcccagactgacctccaaggtcttgtttttctgctcatattgttctaccctcttctgtaaaagcttaaccttgctctgaagaaaatctctctcttcctcttaaccaaacattctttatttctctttcatttttcagaagatcatgttctgatagcttttaaaatccaattcaactcttccttgtcacccaaacaaactttgtccttaaagataagagtattcccagcctggacttttctatttgccttagcttttatgtttgaataaatttcattaggtagcttctctacctcaagcaaagatggtcgatctctcttttaaaaaaggctcctctactggggggctattcactgatggaatcactacccctgcgagtccgaacgtagttacctgaagacaatgggttggggaaagattttctgagacaaaccatgtgaatgcaggcagttagccttccacacattacccccttgacaactaaacgcagaccgggaaaaacattgactctgattcttacctatgcctgctgtgaagctctgttacccaaaccgaacttaactgctctgaaatctatgtatgttctaagtcacttcagtcttgtctgacttgttgagaccctatggactgaagcccaccaggttcctctgtccatgggattctccaggcaagagtactggagtgggttgccatgccctcctccaggggatcttcccaatccagggactgaacccgtgtttcttatgtcttctgcaatggtaggcgggttctttaccaccggtgccacctggggagcctgatatctatagccctagcttgaaggcctttttggggaaaaaaaatacaataaagctaaaatcatt

SEQ ID NO: 34779 - DNA, 915 bp, Bovine  19866880897439
ttttgcagcaattgttgcatatggattatatagattgaagagcaggggacatactaaaattctgttcacctgatccacatgcgtgtggcagcccaaggctttgttgtgggagcaatgactcttggtatgggctattccctgtatcaagaattctgggggaaacctaaaccttagaagaggagatgctgtcttggtcttcttggtggtgcttgctttagttagacatctcatattgaggttatatgtttatgctgaaaataaattgtttgggtcagacaagaacatggtaatttgaaaattggcctcctttcttgcaggcttggtttgcctggtgaccaaattactggtgactagttcactagctaggtcattcaggggagtcagaccagcacaaaagaaacatgtcacttttaaatacacttgatagtggtacctgtccaccttcttaaactcttctgttgaaattagttctaaagaagacaacatgccaatcctgaaaatgctcccagttgctgcagaatatcatatgcttttgatgtaatgtaggaatcctatttaccccagttaatgtaactttctgacggccttgtggactgagtactgttttaagggctggttggctcttgaggaaccctttcagaacagtgcatggaatacaacattataaacctccctgcaagtctgtgtgtgtttttaaaccaaaactaaaaagctggtaacagagccactttgaagtagtatttattttagaatcataaacatgagagtaacttaacttgtggatcccttttagctctttagtaattgcagaattatattttgctgctgttatattagaataattttaaattattttgaaacatgtattttaagtgctaatgcaaaggtaaatgaaaaacactttttaaatgtgtg

SEQ ID NO: 34780 - DNA, 978 bp, Bovine  19866881053717
attgactctttgagccttaactgtgaattttaccgaaaaacaaaacaaaaacaatgcaattaggaaagatgaaaacaaattgtgaacctcaaaataaatttaattataaaattcttccaattgacacacagtattttcacctaagtttaagaagcagcatctataatcaagtggtcccagttggcctttaatttaaagcttccagtctttaatttcagtcattggtggtgaaaaaggaagaacatttttcttacagttattgatgcaaccaagatctaaatctcaataagtaatttcctagtaatttttccaattgttagctaaccatgaaatagtttcattttggcacctgtttgttaattgattttaaatagttcagtattataacagctcaccactggctcaaataatggcataattgatctgtgggaaatggttatgtagttttgcctgtttgaacactggagaatgtcagctgaaaacaactgttttatttttgacccatatgatgctaagcagttctttagcacaataatttaaagaacaattttcattgtttactggaatccattcagaattaataatattataatacaaactaaacaatgatgcttatattcctaccgtttaggacatgtatatacatagtgttttgaaaagcataataaacatttttgatctgggagataaacattaaggtgactgactggaacataaatttattctgtcaaaatactttaacaaaaagtcttactattttaatcattgttacatagtaatatctgttatatattttttcttcctggcatgagttaactacaatatttacatattgaataaataaacgaagtcttgaagttttgttgttcgatgaaataacaccaataaaaataacaaaaggaatgttgcctgaatggcagtagtctttttggttgaactgtttctgcagtaatcatgtataaaaaagtataaaacaaa

SEQ ID NO: 34781 - DNA, 842 bp, Bovine  19866881060806
caggaaatatgaaggatctgagattttattctgcttggaaattaggaatgtagcttgcggcactgttatgcaggctagcagaagacacaaactccaaggtcagagaaaaagaccgtaattattcctggcacatcagtgagcagaatggacactggcatatttgcaccagttttccttggcttctacttctattgtgcaatgtgaatgggcccagatggatgcctgtatatacagtatatgttactggactcaaagaggtaccctgagtttagggaacctgaatctttataatggggagtcaaatgagccttctggagggagacacatctctacctgtccagactgcaagcaaagctgtcttttgttttgaagggagacactatattttccaaggctgcttgccttgaaaaaataggctggaacaaagggtagtcagtgacttgaaatgaaggtcagtgtctcatttcacaagatgggcagaaatgtgggaaactgctcccggagaattatctttcaacaggctctaaaaattcatctttctttacaaacttggacattttgctgagagctgtttccattttaattgctcagtacactatgccagttagtcagcatcctagcttaggaaaacacattttgatcttattaggctgtgggtatgattatcatatgaatcataaatgatggtatgatagactcaccaccttaaagcaggagcagctcttattttcttcaattacatataattactcttggaaaattgtatgaaaagactcattttacactggtgtgtcacttaattacacaccaggaggacataaaaactcaaaatattctataaa

SEQ ID NO: 34782 - DNA, 944 bp, Bovine  19866881089951
ataagtttgattagagaggacaaggtcatgtgctgaatgaagataggtcaatctcaggcatcagagcaaaaaaaaaaaaaaacaaaacacccacttgttaaatttacatttacatgaattactgtccttttggaaattattttgtttcatatttattcagactacatacatagtttttagggggaaaaacacactttgaaaaattgatgtgtatttatgttattttgtagtttatagtccccgagcctatattgctttttgtgttcattacagaatagtcatttgatcaagtgattttcaatacattgtcaaaataaattacattcacttcattagatgtacaggaagtgtagctaaagcagggacaagtattaatttaggactctgcagaaactgacactccatcttatgaccctgaggctgtattattcaagatacctagtgatggaaggaagtctgtctccatagcaattacctaaatcttttatcagtcatttctggaaagaaaattagagcaattgtgtcaggatggtcatatgggcagaaattgcacactcattcaaaccacttatgtctctgactttgtccttgcttgatcgctgcttttgtttactactctgcgtttgaaagcttgattggacacgagcagatgtgccaaactgtaaccacaaaaggtcagccttttgttttcttctcatttctttcttccttccttcctttctttgtttcttccttctgttttctttctttttcttattttatttttctttcttagcaaaattactggattgtactgtttcactctagtgaacaaattactcaaattaggctaacaatattaagaaaagtcaattagatatacttaaaataagctgcagcatcttttcttgctcattactattacactcagtaatatttaatagtcagggaggcaaaaaaagata

SEQ ID NO: 34783 - DNA, 1826 bp, Bovine  19866881129491
tgggtggcagcgatgaggaacagaagcctggttttagctaaaacaaggatttgagatgaaagaagggtcaaagatgaatacagcctgagttgctctagctggggcagcctgagcagtgaagcatgcatttcagtctaactttcaagagaatgttcctacgccaagatgagaatgttacactatgccaagatgggtgactaattctcagagcatccaacttctctaaacaaattcaattctggatttgagtgctgggaatactgactgatggcatcaaagcagcactgccaatattaagaaattgcttgtgaaaaaaaaaaaaaagaaagaaattgcttgtgatacaaacagcctcattcacattactttcttcctattgacttttatttgtgagcgagagtgggagttttgcatcctctttctctctatctcttctcattcaaagtgactccatctactcctgtggtctttaagtagccatccatcctctgggcagtctcagttttttttgttgttattgttgttgtttttccccctgtagcccagacctctccagatttgaattccgaactctgatgcggaaaacttctcatagtttctgggtggatatatgtaaaatgcatccaaaactcagtatgtctaaaacaaactcctgatttcaactctgtttccttgcacaggttcccagctttagtaatgggtaactccactcttcctgttacccaggacaaactcattcttgtcgattttcttttccttacatcccacatgtaataccattgcaaactgaattcaacaatacagttgtaattatcctcccctttgtgtgttgcttacccaaaagagtaggcctttaaaaaatctctgtccctcctatccaccttgtagaatgtgaactcaggatctttctgctccatcatcttggccacatctccctaaattaattttttttaaatgctcaacatctgaagaaagttttttgtcaaacccaatactccaagactaaatagagagaagtaaaataaaatgtaatgatctggcagtaaacaggtcttgtttcattcttatttcaacttgactggctgtgccactttgggtaggtttcttaacttctctaattttcaattttcttatctcaaagtgtgattaagaatgttgtgtttctaatggtgttgtctgggttaaattaaaaacacatgtagaatacttagcacactccttgtcacgtcatcagtgttccataagtgttaaccaccatcactaataaagtttcctcattcaaaaaccttttttcaattttaaaagctcaatgaaaatttcaaagtccattgaaaatttagcttgaaagactctgaagagtgtactaaggatatttaccaccaatattttttcttctgcctatcatttgccaaactgtcactaagatttctcaaaaatacacttcaatggtttctacattgaaggcaatttatttgactggcagcatgatagaggaactattagtaaaatacattttaccaattttacaactctctctggtagcatgatatcaagatttgatactgtgatcttaaataacagagccaacctttggaaaactgtaaattagaaattgtttaatttactttcttttcactaaatccctattccagccttagacagagctgcagtcttctggttttggatatgatacccactatcacatgtggcttatataggctcaaattaaaattaaaaaaaatttttttaattaaaattcagtcactcagttggactcaccacatttcaagtgcttaaaagtcatgggacttgtggctactgtactg

SEQ ID NO: 34784 - DNA, 869 bp, Bovine  19866881225910
cgacattttataatgtgcccaaccccaaatgaaagtgcgtgtttattaggacaggtcttgatttaaatagaagtgatgaaaataaagcttggcccaaaatggaattctttctattttggtttgaagggaacaataggctgggaacagaaaagaagagctttgaagcacctggttctaatgcttgcagtaggcctttattagatgtcataaacagaatgatgcattcctcgatgaaggacttgcagcccacagaagtggaggtaaaatggaggacaaagagtcctgctaaaacaacatggttaaatggtccctttcaatcaaacactatttattaaaggcagaaatcttaataaccttatggagatgtgctcggtcttctcattttatacacgactgcccttccttttccaagctaaacctttccactggatttgaaccctgaatgacatcttgcagggggaccaccggaagtcagctcgctaattgacaaacatgctgtgagagaaaggagacatctcagtatttttattttgttcaaggaaaattagaaggctcagggacccctctccggagtcagtggagttagacattcctgtgagctgcccagccagaggaccacaaaggtaatttcggccatcggaaactgttttaaaatcaggtctgttttgcatttaaaaagataaaagaatgttttctaaaatgacaattgctggttggccatcgattcggagctttaatctcatagccggctcaaatttcccattatgtctcaccgaggcttagaaggctcgagaggccaaactatggcctccgacaaaagtggaggggggttgcagcattaagaaacacagctgtgctcgcaaactgca

SEQ ID NO: 34785 - DNA, 713 bp, Bovine  19866881406274
gagagaggtgcctttaagcattgaagggtgtgaggaagttaattaccatgtgtgggttaaggtttgattttcctggtatattcaaaatacattaatcttataatagttcacattcattttttaaagtttttaaagattataggaggaccagtgtagctcttgacttatgaaacaattcagttatgccattctgagtcattgtcactggtctactcataaccattcttaaaatacttgaaatgccttattttaatatctctacggattgactgacttcaatccttcatttgattctgaaatggtaaaataggaaaagtcatagttacttttgtataagttcagaaatatgacctatgtacagtattatatctatcctatagtaatatatctataacatagtaaacaatcgggtgaaaaatgtaggctttaatttccatgtttggttcagtctatgtgatgccaaacaagtgagtaattggaaacatttgtgcatgacttaatttttcatgcattaccccagaatcttgggataagattcagaatcttgcaaacagaggctacatctatgacctattaacaaactctcacttcttgccatccttttttctctgcagaacccatcactagtagggaacaacaaaatgtgttagatcagccttgcaacaaacttacaatgaacatctgaataatggcttttctttttaaatctgtag

SEQ ID NO: 34786 - DNA, 963 bp, Bovine  19866881505086
ctgaattgtggaacctatcacacaatcccaatgcaaggaatgtaaggattttttttgttaaggtctgtgcttagtctctttaataggattgaatatcatttgctgtctcatcagttttattttaaaaaattaaatattcagtctcctattcttccctttcctgcatatgttgattccacacatggatagaaaattcaaaacccacagattatttgacgtctgaaaacaataacatttactccttttcccgaggtcaaaccagacatacggagagaaacaaaatttttccaaggctaaatcctttttctcctcaacaatgtttactttctcttttcaaccccacagtgaaggaggagtttaggggtctttctattaacaatggaactcctggggacttctctggtggtccagtgggtaagactcaatgcagagggctcaggttccatccctcatgggggaactagatcccacatatccaactcagaagtctcactaaccacaactaagatccaatccagccaaaataaatatcaataaatacattttttaaaaaatgaaattcttgacagtgatccttggaaaaactgtatccacaaattcttgactttagttttgttcaacatttcagagtagaaactagaaaatgggtgcacgtgggcttgctaagtcacttcagttgtgttcaactctttgcaaccccaaggactgtagcctgccaggctcctctgtccatgagttttcccaggcgagaaataatactggagtgggctgccatttccttctccaggagaccttcccaacccagagatagaacccgtgtctcttatgtctcctgtattggcagatggtttctttaccactagggtattcaagtataaaataaggagcgaaaaggaaatgcgggcagattctgtgatggtttaagaccatatatgatcaatgaaacatttcttagaaatgctg

SEQ ID NO: 34787 - DNA, 1198 bp, Bovine  19866881643975
cagcagcccaaagatttgaacttgagtcccagcccttgccactttctggattccggatgttgggtgagtcgcatctcctctctgcgattctattttcactccaacgagacagctcggtccgtgtcccacagtccttgtggtaacgtactgagctaactcatgagaatgcattctgaaaaattgttatacgtaagagaaatctttgtgatggaagctaagaactgtacaaataaataaataaacagctttactgtttttactgtacatgtctacaaatctctacttttcctgaatttacttacagatgcatttgttcattcctggtatttctttgtagtttattaccatttaaaacaatatgtttatctaaaaggatgaagatttttggagtttcttccagacatattatatttcaggagtgataaatattgcaaagtatatgcttaggcttgaatcatgtcttcatttttcttcaatgaattctaatttcacttttaaatactacagataatctgggcagagggaaaaaaagcaaagcaaaaatgcaaacacatgttaacagacagtagtttttaatcattctgtatcttatctgtctttggaagtgaatctaattagaaagtcattatctaacttgttctatgttaccaataattctgtcttttaaagaatgtagacctggtacattttctggtaagtttttggatccgtgcctttacagtgtcagtgatattaaagtcatagtatgtcttggaaatgagaggttgattttaactaaaaattttgcatcttgggtgctgttggaacttatcttttctaatacatttttcccctaaaactttcgtaatatccaaaatcatacaaagcctatatagaatgttagaaaaataaatattttctaagcattcatgatccatgtgctacattaggactgtaaattaagggctgctgtgttgcagaaatcagccttccatatcatagttttcctccacgaatgaggcaagagtcagccagtaaatatatgtggtcaacctcagatttgcctcactgggagttcacatgtatttttaactgccttcaattgttaatgtattcctcaaatgagatgcatcaccttgaagaatgactttttgccccctgggaacaagccaaacaagtatttcattcgctatataatcagttctaccttcagcaacat

SEQ ID NO: 34788 - DNA, 3940 bp, Bovine  19866880361590
ttgattcctgggtcgggaagatccgagggagaagggataggctacccactgcaatattcttgggcttcccttgtggctcagccagtaaagaatctgcctgcaacgcgggaaacctgggttcgatccctgagttgggaagatcccctggagaagggaaaggatacccactctggtattctggcttggagaattccatggactctatagtccatggggtcgcaaagagtcggacatgattgagcagctttcacattataattaactgtttttattatgtaagtttcaggtgtacagcattacagttcagcatctgggtactctaaccagtgtctgttaccataagcgtggtttccattcatcccaaatgagtggcccccagtgacccattttgcctacccctcaactccattcccctctggtaacctttaatccattctctatctatgagtttatttttgttttgtttgccccttgggtttttttttgttgttgttgttgttttagttttattttacattccacatatgaatgaaatcatgcagcgtgtctttctccatcttacttatttatcataataccctctaggttcatctatgttgtcaaaaatgatgggatttcatgttttttttatttatttattttttaattgaaggataattgctttacagaatttagttggtttccaccgagcatgcttttttaatggctgaataatattgcatcgcatccatatactacatcctcttcatccatcagtggacacttagattgcctccctgtcttggctgctgtaaataaagctgtgaagacttcttttccattcttttgggggatatacaatcaattctcattatttgctgtagttatattccataaagccacatcaaacactgaattagcaaattctaagtatttccctgaggagcacctcagggaaatacttagatatgtatcacacagatgataatcttaaatcctaaaagcaacctatcctggcagattctgtgttctttattttacaaaaggacaaaatgaggttcagaaaagtcaaatgacttgtctgatgccaccccccactaaactcacccaactggcctcagagatgaagtttcttgttctacctggcaccacctcccactgtctccatccttggtcacctctgtaggagaatgagaacaagaaaccagagcctcacattgtttgacctcagctgagaatagactagcctggcaactcaattttttttttttttttgcatgtctgtgtcaataacccctactctgctacaagtgctgatgtgaggattacaagtaagccttagccaataggtggatttgcaaacacagaatccacccacaagaggatctgctataccaaggagcagaactgctgagtcatagggtgatttggggcttcccaggtactgcagtgataaagaattcacctgccaatgcaagagatgcaggtttgacccctggattggggagatcccctggagtaggaaatggcaacccactccagtattcttgcctagaaaattgcatggacagaggagcctggtgggctacagtccatggggttgcaaagagtcagatgtgattgagcatagcagcactaggtaattttatgggcagctttctgaagaaccaccaaactgttttccactgtgattgtactattttaccagcatgtaggatttttatgacaggtaaataagttatcatttgtaggacgctaagaacagtgcctggcaaatagtgttatggattgttaattaaattcattaagtagatcatgccaccagggttagctgccaagttcaattccatcccattctcaagagagaagctcacaaaataggtatatgttagggacaccagtgagtcagatacaaaagagaaaatggtccatcctctcctaaagcccaaactactctcaaccagagggggacacttcatttttcacgtttacatagatatgcctggagcccacccactcaatcactactcaagaattgaagctctcctctgttaaaaaatcaatcacttttccttatgatgtgctaatacaagttcactgcaaatatctgggaaagcacagattaagtagaacaaagatatgactcactttactcctatgctgttgtacttcctttctatgttttatgaaactgaagacataatatatgtgatatgtgtgtacttttgaaccctgcattttacacttagcattatattagcttgagattttgtgtcacttaaagtcttcaaaattctgatctctaaataccacctggaatctcattgtgtgctgatgccaaatcttaagtattctcccagtgatgaatattgttcccaaatttctgctattataaacaacacgataatgaaaatctttgtgcatggagatgtctataagtcaatgattatctccaaaaaaacttgatcagactagaacagttgaatgaaaagtacattttaaaatactcctttctacaatactacttcctcaggaaaattttatctttttaatgtttctaatttttaataaaattttacctggactacaccagatttctttgttatattcacatttggtacatgttttttttttttttcttaccactcttattttcaagtatcgtcctacatttatcattattggacaactggcatctattatatattccccccttatcctagtactaatacctagtactaataaaattatttgattaatgcctctcaccagtatgggcttcccacatggtgaagtggtaaagaatccacctgccaatgcaggaaacacaagagatgcaggttcgatgcctgggtagggaagatcccctggaggaggaaatgggcaacccacttcaatatgctgcctggagaatcccatggacagaggagcctggcaggctacagtccatggggttgcaagagtcggatgtgactgagcatgcatgcacgagtcacatttagtgagtcacagctctcccttttcctctatcgtgccttgaataaaattctcttttgagactcccacgtagaagatgcaggcataaactctcaggctaatggcacaggaaaagtatatgagacctctttttgtttctcaaatatccatttcatggtggtagatcgactcaaggaacataatcagggccagattgtgttcaataatcctgtgagtgtcaaattcttgggatgaacatggaaaaagaaaattgggagaaacaagcaaatggctgcatcctgtggctgtgcatcaggcctcgatttgacctgggttcccatcccagctgcccttcacaagccgtacgacaccagcaggaaactaaggaattttccttgttggtaaaatgtagaatattggcaattcataggtcgttataagggttgaatgtgatatgatggagcaaaggaaaaaaagaaaaggagagagaaaaaagaagagaagggagggagggagagagaaaaagaaggtatattttctttctctttccgttagtatggcttgtgtttgaacacttcctgtttgctcaatgagcgtggttcctcacttccagggcagtctacaatccatcactgttgtcttcctttggaagctgttatgaggagttttaacagtccccgttctctgtttgctggaagctgatggaaaaactctccttatctccaatattagaacttgtagcaaatcgatacgagggtataacatccttcaccatcatacttggtaataaagcctaactagaaaatgtgcagaaatgccgtgttgtctggtgcgttttgccagcctgaaaatcaaccctgttttctccaggacggattcgccctcattgatcgaagcgttaagaggcagaggctgtgtttcagccctcattaagaatgcaaacctcgtctgcaacttctcacttgaaacctgaccataccagggg

SEQ ID NO: 34789 - DNA, 1883 bp, Bovine  19866880479919
ccccccacaaaaaaaaaaaaagctatatatggacacaggataaatggcacatttttggttgagattttaataacagtgttttcaggtttgattctttacaataaacagaagtttaggatgtgtcttcaattggtgacaaggggaataataaagtctccccccaaaatgcagtttgctagatgatggcttataaaaaaggggatctctgaatgtgaaggaaaatcacagaatgagattttaacaggacaacttaggaaatgactggaatttttcctgattgggttttctttccttttttgattttaattttttttttaattataaaaaattttaattgaagtgtaattgatttagaagaagggggcgacagaggatgagatgtttggatggcatcaacaattcaatggacatgagtttgagcaaactctgggagatagtgaaggacaagggaagcctggcgtgctgcagtccatggggtcacaaagagtcggacacgacagagtgactgaacaacaacactccctcaaaagcctatcttaccacgtccacatgtgttaaaactgttagcatctatggtgttccctgtgcctgcctgtaagaaactccttcaaaggtgccatctgctttagcatcctcagctcatggagctgagagaggcaatgttaagctgaactggactgcaagaaagagagtcaaatctagaaactgggaaaccaaaggaccctgaagatgaaaaactgcaggaaacccacaccatccccgggaacacctgaatcctgatgacgtcacttcctggaaagagacgtgggttttgcaacctctctgctacttgcttcagtcaacagagatcagggctctccactccagccaaggtctgctctgtgtcctccttggtgctctttttttaaggataaactgctccttctgcccctcctcctatggactccttcagcttaagacaatgaaggaaaaggagccttcacggaagatgctgagttcacactttttcacttggtaccaatgtactccaggcaatttataatcagtgcactccaggcagtttataatccagcaaaacacccaggcaactggctgaatttccttcttttgaccagtgctctgctctaataaaacatgcagacacgagcatacacatccctagcctttctaaatgttctagtcctcttgtcttgagaattttatctttctactaagtatgatttcagaattccagccataatattgccagcaaagaggtacaattctaccattacaaccaaaacgattaggaagatggctggaatattaaaatgaaatcatgtacaaagcagtcaccaacaatgtgttttatcgcttggagtcaccctaagtccctggcaaacgtggcattcattagttatgcctggttattcctagcaaagagcaagttcattacaagttagcaaatttcaattttacagcaggtgtgttattcagagatttttaaaaataaattgctcatatgaggataagccatataattttattttatttttctgtctgatatagtaatgagatatcaagggtacatagaccgaaagcgacaatttccatcttctgaggtaagaaaatgattttcagacaaactaatatgatataaatatgcaattttacatgtatggcttatgaatcttgcttcagtcatcacatgagcccagagggtaattctttcttttcttcattactcattatgtgaccttggcaatgataaatcttagtttctgcctttctggatctataaagtgggctcaataccgtggacgggagataatcactatatacccaatgattcctcacaacacatggtcagatataaaaggcttaggacgcgcagatgtattatt

SEQ ID NO: 34790 - DNA, 1548 bp, Bovine  19866880504043
cgtaggttagttttgtctgtgtttgtgttttacataaataaaaagaatgggtgtcctattttgtgtctggcttcttccattcacattatttatacagttgctgatcattttttctcattgttgtttattattccattgcatgaatatgctacgatttatttactcacctactgttgataagcatgtggataatatctcattttatcttagaattttgaagactctgtttcattttcttctggtctgcattgaggtggattaaacatttggtttctccatatagtactacttggacatagctcccttttctttatagggatttaacatttttctctgaatatctgctattttgatttttcaccatagtgtcttggtatgtatttacctgcattgatcctactcactcagacccttttatcaataaccatggatgttattgacatcatctgctcttccttacaggtaatcacgcttcataattacctcatttacttctcacagcattcctgcaaggaagggatcattgtacacaatttacaggtgagcaaactctagctcaaaatacaaaactcctctgccccaatttggaaagaatcccaattctaataactgcaatatcctagtcatgatttaatacattctagaaacaatacattcttatgggctacctgcttctacatgttaatatggcattctgattgtgtagtgtaccataaagagcagtaaaaagctaaacatgcaacaccaatacaagcaaaaaatataaataaaaccaagggtttcctaacaaaatatgttaaggaaatattagactaaacaaagtttacttattttgttttaactacaagacttaaagcctttaatatgtttctgagctctaaatgaccccaagggaaaaatgtgaggaataagcagcattccgtatttcctaaatatagaacgctttttaagattatgaccagtttatttttacccaacattttatcatgaaaatttgcaaaaaaaggaaaagttgaaacaactgtatagtgaatacccatgtactcatctttcagcttctacagttaagactttgatgtatttattttattatttatccatctatttatccctccatttgtccctttatccactcatttatctgtctgtatatctatctatctattgatctattcattcatccatccatccatctatccatccattcagctatccatctatttactctttgatccattcatcaacccatcatgttaggggaagcacactgattgaaactgcccaccctggccaggcaccatagtaaccattggcatgagttgttttatgacaggagatcctgataaggaatacggaactaataagccaccaccaaccagaagagttcgggaaaggtcgaaaggagacaccatgtgtcagtccacttcccagaatccctctcactagcatccattttggctgagcgatgcgtgtaccaccaggaaactggtggtggtacattagaagatggccaaagaccacccggaaactatcctatcaccataaaac

SEQ ID NO: 34791 - DNA, 1615 bp, Bovine  19866880521694
tctcctagcaccatcatgaagctgtcaacacccatggtgggtgctgcaaagtataaaggacagtttatccacacagcagtggcagcatcattgtttgtaagatgataactgcttcaggtagcagcaagttccaacattagcacaacaaaagctttgagccgaaccatctgttgccactgtggacaatctggtgggcttgccaaagccatttatccgcgtagagtgcatatccacactggccagtcctcatgctgagcagaaaggaaatttaaagaaaggcccatcatttatcattgtagacagctgtgctggagtgtgggcagagaatacttttttttttttccttgagaaaaacaaagaccctgaagatggtaatgctcactcagctccaagcgttttgcaagctacagtccctccagctcattcctttcttcttgcttttccaggttgcaaatgaggagttggaggcatggatgtttgttctgtgtgtgcatgctcagttgattagtggtgtctaactctttgtaaccccatggactgtagcttgccaggctcctttctccatggggattctccaggctagaatactggagtgggttgctatgtcctccttcaggggatcttcccaacccatggattgaacttgtgtctcctgaatcgcaggtagattctttaccgtctgagctactagggaagcccatggttggttgtcacacgagggcacctggaattctttggttttgagctgcgcttggcacctttgtttgtgtctctaaaacggaacctctctgccatgctcaggaaaaggccattgattttggagctctcaaccctcaacgagggtgcagactccatctgctgtatgtgaagaaaacaggacatgggaggggtctccccacctcagctcttgaccctgggatcagttctgccttgattgtgcctgtgaggccacactgtgactttcatcggctctctctccttctagaaaatgtttaatagtgtattttgggactgtgttggtatacagagaaagacacggatattataaattcagacatttcctttaaccaagaagttctttcttctcttcttctttttctttaaagaaattaacacacgttcacggaccctgaaaatcatcatgggccctcggcacgaagtctgcagtgtctaatgagtgaattggtcccacatgtgtgtgtttgaaataaaataccagggatgaaggtgcctgacatcattgttagtgtcaatgtaaaaaaatgaacaatgtgagaactgtgaattaagtttgtatgtggggcaaaatgaggactattgcctgggagatggcatttcagaaaccgattctgggctatcatcctcatcttgcccctcataaaacttaactcacaactctcctgtgcacaactttttttcagttgccattaacaatagcttaacaaaggagctaaactcacagcttaagaactggaatttctgagtttcaattctgctggcctctatgcttacaaattaaatgagtttggacaagctacttaatttttcatacatatttatttttcatgtgcatgcgtgtatgctaagtcacttcattcgtgtccgactctttgcg

SEQ ID NO: 34792 - DNA, 5306 bp, Bovine  19866880543010
tcccatttcttttgtggctttgtaacttggttattcctttactatatgatgagcacatttctaaataaaatttattttatagataactttctttttcaagttagaagagtttaggtaaagttgaaatctccttgaccaccacttctaattctggtcctctcccctctgccttgagataactactgtttggggtctttatttaagtacctttatatctacgtatgtgtacttgtcctggaggaagaaatggcaactcatggcagtattcttgcctggagaatcccatggacagaggagcctggtgggctagagtccatagggtcgcaaagagtcagacacgactgaagtgcgactgagcacacaagcacgcaccactctgatgggcgggtatttttgttttaatctgcatgtttctgcttacctggcaggatgagctctttccacaaatttactggccactcagaattcctcctctgtgaattgcttcttctcacattgggctgttcatctttccttattgatcggtcgggcttctttatattctgggaacacatctactcttggccttctgtgttgtgaatatcttccccagctgtggctgctcttttaactttgcttctggtcttttattattttttttgtcatacaaaatattttaaagattttctttgggctcataggcctttaatccactcagtatataactctttatatggtgggacttagggatctaattttgtcttccacagtgtttttattatatgttattgattccaagatgtactctctgcccccacactttgccatctctcagatggaggtgcatattattatcagtgtaatgtcataatggttttttgctcttttaatggtatgtgaaatagtatgtgtcttactatcagtggcaacttagattcactgaaaggtggaaatagtctaggtttatcctaattcttcatacctaagtaagatgaaccttctatttctcttattcaggcacttatggtctgataatatttcataggaatattacaatcactttgtcaaattctgagaagaacgcagagttttgatttgctcttaaattggaattacattgactacagtttctttgggggtgatcatcacggtgaaaacacaccgtcaggaccccaggctgatgtcccaggttaaggacttggatcaagtgacaaggtgagaggctacagattcaggattctgtcctctactctccttccccaaagttgtagttctttttaagatcctgcttgctggaataagccacctcctggaacagtgagaccctggcctgctgaggtgctggtgctccagctaagtggccacttgatggagacacgattcttcaggctagtggaaatgaactcttaggctcttctgagtgtaaaacgccatgaacattggacagcacagtgtgatctggaatgctgaaatgttaggtggaggtgagatgctgctgctttgtaattttgcctgggaccagccctgagccaggaggagcaggaagaaaggtgcccatctgtccattcacttgctgtggctcctggggaggccagggaatgtcctggttcctcttagccttggctctcttttcttttcatctcttcttctcaccccaagtatcagaaaatatttcaagtggaagctggcaaacaatagcctgcaggtcaactccataagcctctagattttgcaaatgaaattttattagcacacagccccagccactcatttacatactgtccaagattttcgcaaatgaaaagttattgagtagtttgaacagaggtcatgtgacctgtaacatctaaagtattcactatctgaccttttatggggaaaaaacaaaaaaaggtgtgaaatccctgtttgaagcaagagacagctgacccaaaacctatttgtttcccggattccgaaacttagattgcctctgggatttgattctgttcctggtatagattttccttttctttggaaaaggttagctggcctctgatagctcagaacaaaaatatgaaaacatgggtgaaatggaccccagcaaaatgcaatcactttcttctggtttaaggtggtccttgaaaatgaagcagtggatgcagaggctgaaaacagaatcaggagacagaatttcagggaaacttcccagcagagttaattttcccttccccaggctcagtggggagaggacgccaacggagggttattacagccctttctcagaaactcctttaggccaactaagtgagccggtgaaaggtggctcttcaaattgtttgtgaccaaattattggtttttgacaagaactctcttggatctgaaatttctgactgcctttctctgctgctcttcctacctccatccacttcatctccatctcttcacactatgcttttatataccatctggcccctgcctctgaatgtgaagtgtctgagagccaaagcttatgaactgtgaatgtttccttccactgtgaatagccacagcccagaaggatgtcctcaacatactgcaggtggaccactagcacgtggacatgggtctgttttagaggacacgacaatagacttaaaaaataatttattattaataaattatcaatgacagaaataaaattttagactaccagaaatttgcaaaatcattctagtacagcaaacccaaatttcttgagtagttctgcttgggtaaaacccacaactcaataaaaataacaaccgttgtggtaggctgaataatgtcttcacctcaaatatattccttcctgcggaacctgtaaatatattagcttatgtggcaaaacggactttgcagctgtgattaaggtcaggatcttgagatggagagatgattctggactatccagatggacccaccctatcaaaaggttcttatgagaaggaggcagagttcaagggaaggaaatgtgatcgtggaaccagagaggagggactgagagagagagagagagagagagagagagagacagattgtgaggttgatgctattactaataactttgactctgaagatggaaggggctaggagccaaggaatgcaggcagcctctatgaactagaaaagacaaagaaatggattttcctctagagtctctagaaggaaaacagccctgctcacaccttgatttcagctaagcgaacctcattgcaggcttctgacctccagagctgtcagatgataggtttgtgcagctttcagccaagacatttgtggttacttgtcacagcagctacagaaaactaatacaacagataacaagcatttcctaacttcctggcaccgtgttcagggtgtcatctgatttagattcacaactgcctgacaagtgaggaattatgcttcctgcttttggatgaggaggttgagatgccaacagagaagttacagagctatgcttcaacccgggtctgtctccctgccaagtttatattttccctaagaagctacaggttttattttcttgggttccaaaatctctgtggacagtgactgcagccatgaaatcaaaagacgctagctcctttgaaggaaaactatgactaacctagctagtgtattaaaaagcagagacatcactttgctgagaaaggtctgtctagtcaaagctatggtttctctaatagtcatgtatggatgtgagagtttgaccataaagaaggctgagcgatgaagaactgatgcctttgaaatgtgctggagaagactcttgagagccccttggacagcaaggagatcaaaccagtcaatcctaaaggaaagcaaccctgaatattctttggaaggattgatgctgaggctgaagctccaatactttggccacctgatgtgaagagccagcttactggaaaagacccttatgctgggaaagattgagggcaagaggagaagggggcagcagaggatgagatggttggatagcatcaccgactcaatggacatgaatttgagcaaactccgggagatagtgaaggaaaggggagcctggtatgctgcagtccacggggtcacaaagtcagacacaacttcagagactgaacaacaaggggctacacgggatatctcactcctgagtggtttgctcaggacctgatatttaccagggggtggtccctcagatatttcttttgctattgactctcagcatagtggggagattgcaggggtggttgatggataatcaggtattgtccttggttgagtgacctttccccatttgtctttctcttggctccagtctctctatctacctaggtagagggtgcaaataatgtgacatttattcattcattcatctctatgagacttcagcatgatatttccagttcatccagatctgtggacacaaacacgggactgagtcaccacctccatccctcccttggagtttgaacatcgaatgtaggcttctccaccagaggaaaatggctttaaaatttcagccataaagtgttcaatttagaggcagagagtgaataggaaccttcacaaataaacccgtgactgagaaaacttggtatctcacagaaatatatttatcttgttagtgttcctggagaatatttgcatagcaggaaaaagagcttttaacttgtttccttatctcgccttcttactgtagagaatattttccccctgaaggtgtatctcgctattgaatctggcgtttaaaggaaatgtcatcaggacctgtgatgaaaattgaattttttcccaatgcctaaggatgactttctttaactaacttagccgactcccagcctgaaatggaggcagacattctggtctgctttgaatctgctcttctcttcctgtttcaacttcttttatgcctcttgccttcaccctctcctcctatgctgtctgtatgcttcccccaccctgcctttcttctctgttcatctctctccttgaatggaaaagtccctaatctttttcctcttgtgcctgctttggtgcagggatttcaaagtctgggaaattggcaggtctttttctcttattgacagcatgattctgtattccatcccaattcctggatttccatgaacttttctggggagaatggcagctgccttctgcacaggtgagagagtaggtgtggggggaggtagaaatggaagggctggcatttttttttaacccttaagcaacctaaacttccactgaaacttcttcatatgactgtttcaagagacgttcccgattgtgatctggggagatgtcagcttatccaaggaataaatgttagaggacatcagat

SEQ ID NO: 34793 - DNA, 907 bp, Bovine  19866880567392
cttccttcctaaaggcaacattttatttgtgaaagtgctttgaaaagagagggggatatcagcattattttagagagtctttctaaagaaccataacaagtctatttgaatcttttatttggtattaactagatattttatcataagtgagcagggagtttctggttcactagtctttattgctttcttgaatgcatctcaaccttttccatagttcaagtccatataatcctcaatccttttttccttcaaattttaactccttccctgtgttccccgtaactcttcttgttaatatctctgagaatgcactgttgagctgtcatcttgaatgtgaaaatgctttgaacttacggtgaattgtgccttttaaacagtactgtaagaacttgagccattcagcttggtatacccttagccaaaaatacatgtcccaagattttcacccctttcttttctgagtgcctgagggagccctgtcctgaagcaatgcatctgttttaggtttatgtttaaaaggagtccttatctctgactctgacataattattattttttaaaagttggttttggtatgtaccatttttttaagtcttttttgaatttgctacggtattgtttggttttatgtttttttatttttttggactcaaggcatgtgggatcttagctctccaaccagggatggaactcgtaccccctgcattggaaggcgaagtcctaacaagttgaaccagcatggaagtcccttgattcttgcataactaaataaatgttcttgggggtcctttgggcttcccagtggcactggtggtaaagacgggcctccaatacaggagacataagagacatgggtttgatccctgagtcaggaagattccccggaggagaaaagggcaacccaccc

SEQ ID NO: 34794 - DNA, 2114 bp, Bovine  19866880573220
ttccccacataagtgacgtcacgtggtgtatgtcttcgtctaacgtacttcacttcatatgatcatctctagatccatccatgctgctgcaaatggcgttatttcatttttcacgactgagaaatatcccactaagggcttccctgttggctcagcggtaaagactccgcctgccaaagcaggagacatgggtttgatccctgggttgggaagatcccctggagaaggaaacatcaacccactccagtactcttggctggagaattccatggacagagaagcctggcaggctacagttcatggggttgcaaagagtctgacatgacttagcgactaaacagcaacaacaatatatgctggtaaagaacccacctgcgatgcgggagacctggcttcgattcctgggttgggaaatcccctggagaaggacatggcaacccactcccgtattcttgcctggagaattccatggacagaggagcctggctgtctacagtccatggggtcataaagagtaggacaggactgagtgactaacattttcattttctgtgcatataaagaggaaaaacacacaggtctcctcactgaaggaactctttgtctcctgggaagcagtcatgattacagcacagtgcaggaacctgacatgatggaggcgtgtcctgggtaccataggagtaaagaaagcaaaacatgaggcttcctgggggaagttgggaggggcttcttgcagggggtggtgttgagtggggtcttaatggacacataggagttcatcagtttgcttcaagaaagtgcagcgatattacagggggaccacatacgagatggaggggtcagtagacgaccagcctgttaagacaaggaaggctagatcatgaaacgcgcagaggcagaccctgctgctgagtttagattctatcctacaggccactggcctataataactgttttgcataccaggatcctgtttcaatgttcagaaatttcacggcagtagtttcattgcaaattgtctgagaaaacatatcacagcaaaagttatggtaagctcagtgatgcatttaaattaatttgtactttgatcagcccaatcaaatctacagacgtttgagaaatagctgtacccagcaaaacatacgctgttctcctcgtagctataaataaaatatgactgggtctattctactcagtaacccttctccccagcatcttacatggtgaggctcaacactgaagtactacgatctctgtgttatgtctttctacgtggtacccacttgtggactgcttctatcagatgctcctctcttttatgtaattaggcctgttccgcaccttttctcttctttataattgctttctgctttctttcacgttctttctggataatgtgttgtcaaattgcactctgaggtgttcatctaaatcagtggttctccaactttcctgctcattggcatccccaaagggctggttaaaacacagagagcccaaacttccctggtggtccagtggttaagaatctggctgccaatgcaggggaaatgggttcaatccctggcccaggaagatcccataagactcgggccagctaagcccatgcaccacagctaccttaagccctcaaggcctagaacccactctctgcaacaagagaaagaaaatgaaagtgttagttgctcagttgagtccaactctttgcgaccccacagactgtagccctccaggcccctctgtccatggggttctccaggcaagaatactggagtgggctgtcattcccctctccatgggatttttgcaacccagggatcaaacccaggtctcctgcattggaggcagattcttttatcaactgagccaccagggaagcccaaacggctacaccccaatacaagataaaaagttaaatgtttttaatttaatatagaaaattaattaattaatttttaaaaatacagattgctgggcccacaccagagttcctagatcagtggactgggacctggaaataagcatttctaacagaattcccaggtgatagtgatgccacccgtcctggagccatttatttacattatttctcttctactttattatcagcctgt

SEQ ID NO: 34795 - DNA, 1071 bp, Bovine  19866880583510
aaaatggtggtccggtggttaagaatccacctgccaatgtaggggacacaagttcgtcaccctagaacctgtgctccacaacaagagaaaccaaccgcaatgagaagacctcaccactaaaactagccagtagcccctgctcgctgcaactagaggaagcccatgcacagcaatgaagacttagcatagtcaaaaataaattagtaaaagagagagagagagaatgtgatatttgaactcaaacccgatggattagtcaaaacttgcttggtttgggaggagatgaagggcattcatagcaggaagaccagcacgtgctgagttctagaggcaagcaagaacaaggtgggttcaaagaatgatgttaacttcaagactggagtttagagagtgtgtgtgtgtatgtgtttgtgtgtgtgtgcacatgcacatgtgagacaaagccactggggtgaaactgtgcagggctttcaacaccgtgctcaggacttaggagccttcagttagatcagcaaattgcagcctgaaggcccaatgcaacctgcccgttttcaggtgattcattagctacgaatggtcttcacgtgttttatgtgttgaaacaagtccaaagaagaataatacttcgtgacacatgaagatgatatgcaattcaaatttccatgttcataaataaagcttgctggcacaaggccactcacgtttgtttatttattgtctgtggcagctttcgctacagcagcagagtcgagttgttgtggcagagaccatatggctggcaaaacctaagatatttactgtctgcctcttgacagcaaaagtttgtggatgcctgagttaggaaagagagaatgatgtgatcacactacagaaatctctatcacgtcgtccaggtttggaagataaccttggaagtttagaaatcaaggtggaaactattggtatcctagtaaaatacttatggaggaaatgcatcagtcaggataaagcaggttgtgctgtggtaacaagcaagccctcaggtccccaatggctttcaaggtgggttctcattaaaaatgtgttcacaga

SEQ ID NO: 34796 - DNA, 1928 bp, Bovine  19866880583999
cctttccctgcatgttcccttagcaccctgcgcttcccctattagaacacacatcacactttactggaaacagaccaattaactaccgatcgatttgctgcatgacaactttgctgaataatcagatcgccaaaatggaaaggagagacctttagatgaaatttgctgaaggatcaattagaggaatggtcaatttagaagtttcttctaaacagtatctgaagccttagtgcggctgcctgggtgtgcaagtatccgtgtgtgtgttcaggttagtggggaataaaaagatggaagggggtagtgatactccccactgtggccccaagcttgataaataatgtctctaataaaagtggacagcaacccactgcccccaaggagactggtttcagcagcgtttgcaggagtgttggtccaggcttcttcccaggccccacgtgtctgtatcaagtgctcaaaaaggactgagagtctgtccctgggctggcttcccaaccaacatgatggtacctggcatggtagaaggtgtgaaacttgctgccagatggagacccagcctcacctgcatcccagagacacataaacatgtgcacaagctgcccaaagcagggggcaactggtagccaaaacaacaagctcaaagtgtctggtactttccagggcatggtttatcttctctgttgatttttagccactgcttttcagcaaaggaaagatttctggagaactgctctaaaacaccattggctggtgtccccctctgtccccctggatgtgcagaattttctctttgccactcagtcctgcgcccctaggcctgggccccacacgtcatgtgctcagcacacacgagctgtatgaaggagacggggccaaggcaaataaactcccactggaccatctgtttagagaatcatttagttccctggtggtggtgatcagttgcttcagttgtgtcataataatctattgtttaatgatattatattttaatctatctacccactgcattgttgggtactcaggttgacagcaatttttcaaaaatattgaagaaaataaatatccttgtatatacctagttataattgttttaaagaaaacaattaataaatagctaatcctactgcatgtgtgttcagtcactcagttatgtccgactctttgcaacccgccaagctcctccatccatgggattctccaggcaagaatactggagtggattgccatttccttctctagaggatattcccaacccagggatccaacccgtgtctcctgagtctcctgcattgcagaaggattcgttaccctctgaaccacctgggtccctccaaatttgaacaactatgcccactccccagttcacaaatactagttttctagaagcaagacagcacgactaaagaatgcagaattccacctggaggtgaagaccaagcgtccaaggtcaagatgaaaggagcacttgggggcagtgcagttcagtggaaggaacagtggcatcagatagactcctgtgtaaccatggtaaccatggccaagttaccaaacctctctgggtttgagcatattgttcttttgaaatttgcaaataacggtgatagtaacgtctgccccactcagatactgtaatgaattttatacacatgtatacatacatacatatatatatacatacatgcatatatgtatataatttatcatacttgctagtacatggactatgcacaataaatgacagcaagttatgactacaacctggggaattcaacaaagtttatcttggaagtgaaagtgaagctctcagtcatgtctggactctttgcaactctatggggctgtagccagccaggctcctttgtccatgggattttccaggcaagaatactggagtgggttgccattttcttcctcagggggat

SEQ ID NO: 34797 - DNA, 3945 bp, Bovine  19866880600744
tgggcctttgctcatcttttatgaacacacagagacatgtttctgcctcaggacctttgcacttgctgcaccctctttccgatgctttgcctccacatcttcctgtggctgcctcttgttggtccagatctcagcttaaatgttccctccactgtcagagaggataagcctgagcgcctaatctaaatagcccatccctaccattctccatctcgtcaccttattttatcagctcttgtttagtccctcagtcatgtccgactctttgagaccccatggattgtaacctgccaggttcttctgtccatgggattttcccaccaagaacactggaacaggttgccatttcctcctccaggggatcttcctgactcagagatcaaacgtgcatctcctgtgggagaacccgagtctcctgcattggcaggctgactctttaacactgggccatccgggaagcccattttatcagctcttatcactattcgagcttctttgcttgcattcatttatatgagctttacttgtttgttgcctgtttcttccattctaatggaaaccccacagaggtaggaacttgatctgtgttgttcttcactgcatcttcactgctttggaggtagcccgtcacactgtccgtgttcagagcacatctgctgaatgaatgggggttatttctcgagcatgtatgatgtgtaggttgggtgctgggaatacagctttgaatgacactcatgtggttccttttggttgttattgtagttgctaaattgtgtcccactcacgatcctctggactgtagcccatcaggctcctctgtccatggaattctccaggtaagaatactggagtgggttgccatgcccttctccaggggatcttcccaacccaggagtggaacctgggtcttctgcattgcaggcagattctttactatctgaactgagcaagtctcagatggggtttcttcagttgcgaagttgaaacaagcatgtgctgaagaggctctcctagctctattttcttagtgtgccgactcctccagggtccactccttaaggaaagcatggctgcccctggtgatgattctcagagccgttccctacttggccctaaaaggcagtacttgagatcttggctgaaccacttcttttcccagcgtcctaaagagggagttggaatgggataagttatgtgttgtggttttaggcattaatgaatatgagaaactaaattattggattttgcaatgcaaattacattttgcacacaaattcttcatttctgaatgctaaggactcataaagaatgtcaatggtttatgaattagaccattagcatgcaatttgtgattcaaacagcacaccagcaccgtgtaataagcaactatataaagagtcgtgttgtctacagtttcaaaatattttacttgatgccttagaaagttctcaaaggactccaggggtccatccttcctttctcccttccctcttcctctccctgcctccctcccttccctccttcccttcttctttccttcttcctccttctctcctttccttcctccctcctcccattttctgcttctctccctccctcccatccttcatctccgtttgactctcctccccttccctccttgtctcttaccttcctttcctccttcccttcttgtctccttccttctcctccacacctacccccatcattctctttctatcggtcatctacatcagccattattcccacctttcccagattggattgcaggagccgaagatgaatctagatgaacccttccttgttttaaggtcagaaactctgaagcccagagagtgaatgggtcacatccaagatcctacatgagtagaaccagctggcgccaggtcactgacatgtaacactcacccctccaacaactccttcatgccaaggtgcagttgactcatctctgacactttccttgagagtgttttcatggagggagagagattaggaccctggcttccaggtgggattagagggtggaaaagaggtgagggccctgagagaggaaatgtaacaaggaaaagtgagtgcaacctcatcaatttcagcaaatgtgagtttcatcaactctagagtttgtccattgagatgactgatctcaaggcggttaggaccagcaagtggaattgaggtgacatttcagctcagttggaggtataaggtctcacaatcagacgatcagtcaagggatgaacaaccaggtaaagtggggagcgtgccattacttagagaagttcaagttgaatgcagacatgaatttaggggaatgtaagagcctaaagttcctctgcttccatagaggtcaaccttggttgcacctcagctgggggcagcttttaaagctcttcacatccaaacaacacggagcattgattaaatcaggatttctgagggctgggatctggagcatcagtactttttaaaacttgccttttacaaattctaatgtccagacacagttcttcagaagctctagtgttcttcagaagctctgtagctcagaagttctaaaattttagtgtgcatgagaaccactgcaggagttgattgtaaatgttggttcctgggcttgtcttcccagatattctgattccattcctccatggcccattgtccagccaccacttctcttccagtgacagggaggagccagatccaaggtgatgggttgacatccacataacagggtgttacctgaaaactgggttcacttctttgtggatatcgagtcaaaagacacagtcagccaaagatgggaaaaggaaaagattgatcatttgcggcaagtaaggagaacattggggatctttcccaaagcagtatcttcctgaatggcaaaattggggaatttttaagctaaaggtgccaccgtggtaaagaatctcttgccaatgcaagagacgcaggagactcaggtttgatccctgggtcaggaagatcccttggataagggaatggccactcactccagtattcttgcctataaaaatcccatggacagaggtgcctgccaggtccatggggtcacaaataggggtggggtcatggggtcatgactgaagcaactgagcacacacacagaagctaagggtacctgcatattcatgaaggggcttgggcagagggaagtatagcctagaattagggcaaaggttgacagaatccaagctttagttgattcaagtcacaaagatcagaaaaggtcaacatcatcagcactgaggttctgatcaacctggggtctcagcctgaagttacctccacctgggtaggggccttagttcttatggaacccaaagatttgtattggattgtaatgtatttcccttgaggaggaactaggactctgttttatctgggaactgttgtttcttaattgctttttctttgttcctgagtccttttgttcccttaagatcattaattactgagacctgttcaagggcaagcattgagaccaggcttagatcacaaaacggtttaggtcaaaactggcttgtcttggggcttccctggtggtccagtggttaggacttcccactgtcagtgctaagggcccaggttcaatccctggttggggaactaagatctcataaaccacatggcaaaaaaaaaaaaaaaaaaaagagaaagaaagggttctcttatgtcaagaaagccacatccggttctctttcttcctgaacctctcccatcccatcggcctataagagctctcacttgagtcccacagacaaagatggctttgggagtcctgctcagaatcggtgtgggacaacatttagcttcagggatatgcacaggaccgttgccttgactaagaagttagtgatataagaaaacaaaacagcagctacttatttcaagaagcgtttcttctctccccagtttgaggga

SEQ ID NO: 34798 - DNA, 1751 bp, Bovine  19866880728476
taagactctgttaatactcccccatcctatgtgttctaaacactctgaaagctttttaattcctacaaaaatatggcttatgagctgactgtctgactgaacagacggatggatgaacgagtggatggatgaatgcaaggatgaagggatggaagagtgagtggatagatggatgaacagctcaattaataaattaactttccttcccatttctgaaagtttttagccctttgaaagtgaaaagtgaaaacgttacttgctcagtcatgtctgactttttgtgacccccatgggactgtagcccacaaggcgtcctttgtccatgggattttccaggcaagaacactggagtgggttgccacttcttttgccagaggaatattacttctcccagagactgaaccctcatctcctgcgtctcctgcgttggcaggcaggttccttaccactgaaccacctgggaagcccccacctcttgagctctatatattaaaacgagcaaagatatgaaactcatgatacctaaaacgcatgtgtacgtttatgtctactattgaaagaaagaaataataggccagttatacttcaatatagaaatattacccaaaacacaattattattttcatatctattgaataaatgtcctaccccagtccaagaccatagacccatatatttacaacatggcattaatattacccaggtcattttgtgttctgctttgttcatttcataattgatcaaaaatatttggcatatttccacccagttttcataattatcgcttttaatatctgcaaaatatcctatcatattgatggaggatcattcagttcatgattcccctatggatggacattttaaactatttctatgtttttgttgccattgttgtcattggcaataatgctgcaaggactaataaaagatgtgaatatagaaagtctgattaaaatttttcatcaatttttcccttccccaaagagcatttgattacctcagagctcattatgtccttaatctctattatcattttcttttttcaatattcatacctattggttacctctcaaaattttgtaattctcccattctccccttcactgggaagctatggtggctcagttgtaaggcctgccaatgcaggggatgctggttcaatccccctagaggaggaaatggcaaccactccagtattcttgactggaaatcccatggacagagaggaatctggcgggctacagtccatggggttgcaaagagtcagacatgactgagtgactaatcagcaacaataacaaactccctttctctagccttgaccttaaaaaccatgtgcaatcatttgtataataacacagatatgaagtcgaaccaacctgaattcaaatgctgtgtacccctttgtagctccatgaactcagagaagtgactgaatatttctagctttcaatgcttcccaagtggctcagtggtaaagaatccacctgccaatgcagaagacccaagagatatgggttcagtccctaagtctggaggatcccctggagaagagcatggcaacccactccagtattcttgcctggagaattccatggacagacgagcctggcgggctacagtccatgggcttgcaaagagtcagacacggctgagtgcacacaactttcaattggctaaatgagaacattgccttcattataggtttattttacagcaaactccaagaaaactttcgctgttactctta

SEQ ID NO: 34799 - DNA, 1256 bp, Bovine  19866880755952
atactggagtcggttgccatttcctcttccaggggatcttcccaacccagggatttgaagctgagtctcttatgtctcctgcattggcaggagggttctttaccattagtgcctcttgggaagcccatccaagccacatatttcccactaaatatgaattcccaactctttaaattatcccaccatagctgttttcagtgggtgaaatggtaaaatgggaagagaatgagttgaaaggtcaacatactgactgcaagacaaggcaattagatgaggtgcaggctcatgaaactgaactagaagtcaagcaacaaaatggaaaatggagctaatgatggtctaattgtccctcccctgtaatgtggttataaagattaaatgaatcaatatatgtgaaatgtttagaacaggctttgggcatagcaggcactgaatgcatattatctattgttgttgtaagtcagtgccaagggtgtgttgggtgtgggagaactcaagatggaaaaacaggagataatggagttctatttactatttcagtgtttaaagcttagcctaaagtgctattgatgaagtgactcctgtataatgagaataataaatactaaaaagataatgagcttagaacatccctcaaaaaaaaagccaattgtttactcaattatggtaaattgcttatgtagttcccacagattgtgaattaagtctcctttgtcaagcaaaacgccacataggtatgtgtgcttgtatttttctttcaattgttgaagataatgatagggatataaaacttcttgaattaaaactgtatttctggaccaagtgaagcatacttatgcaaagtcctacctcatgacttgaaacacaataggaacttgatacagtaaatctcctccattcgaaccgtcatgttgcaaactttggaacgatgcgaacgcgtgttccatcagcatcaggtatgagtgagactgcagcttgtcctccgtctcctattgctgacgatccttcagctgtaccatctcccaccacccctccctcctccagtcagtaattcttcttgcctgttcagtccatgccagcccccggatgccagttgttggactgaattactgtactttttaaggtactatactgtaagattaaaaatgttttattttttgtgtttgctttttatgtattattttgtctgaaaagtgtcataaatctgccccaaaatagtaccatatagccccttgtgttagctgggaccaagctaa

SEQ ID NO: 34800 - DNA, 1728 bp, Bovine  19866880827500
aggctctgtgtgatggctggtggatagtaggggctcacgtgcatgcgggtttctggcatttgtcctcatcagacattatagagagagactcactctgtttgggagggattagagcagaaggggaggtatttcagtttgctttgaaggatgaatacataggttttcaagaaaggaagggatggctggatgctgggacgttgccagcaggaggaacaacatgggaaagcatctggggggggggggcggcaggcagaacactgaagtccttgcatatctgaagagtctggttcaaatgaagtgtcaggggtgatcgtcccttcctgaggtcatgctgtttgtagatttctaggttgtgcccagccatggttaacaatagattccgtgctttcggtctcgtgtcttgctcccaccgtgtattttttctttgcttcaacctcagcctaaggttcggacccactgctcctccatccagctgagcttcagcctgcatcacgcccatgcatttcctctctctcttcatcctctctgacctggtatttcagcaaaggaacccatgaaaggccaactttggctcatgtctgtgttctttgtctgtttccttatcgtttttaatcattctcttttgatttgataaatgagccttggcttctcccagctttcctaaagacccagggtaaaacaacaagaacaacaaaaacgtcctttctggtagctgttgcagttgtgagggaaaaatgagcctcctctatagtcaataaatcactttgtcaccttaatcttttattgatctcaataaaagttgtattttgtttcttaacaaaaatccaccagagaggacatctcgtacaggtgagggtacgatggaagtagtggtcaagccattgcctcatgttgttatttatgttatttatggattcgagggggccaaaggttgaggggaagagatcaagaaagcattcttgcaagtgatgcctcatattttaaaagacacgcttgactccaggtagcctactaacagatatgactctgaagctatattttatgcagacttttataaacagatcataaacatcccacttctccaagtgaggaagggaaaggctctgtctcgctcacaagtaatgcatctactcggtcggttaaatttagaagatggcaatcattgtatccagacatggcttcgtctctagggaagggtcatccaaacaggttactcagggaagaatgagtaatgcttcatcaaggcttggaatcaagctttggttaaggcttgcaaaaaatatattcccccctcagtgcagaggaaaagatcgtaaaaaatggtctctgatgttaatgtttatgtcctgcacatatattaccccagggtatgggaagagggagggtttggtgactcaggcacgggaaaaaaaaaaaaaaaaaaagaggcaaagtagggtagaatgtgcacacaatccttttctctctcacctactattttctttaagactcagtagccatctctgtgacggcttcaccccgggacccagattttatttatttatttctttacttttaattttgtattagagtatagctgactaacaatgtttcgatagcttcaggtagacagcaaagggactcagtcatatgtctgcatgtatccattctcccgcaaagctcctcccatccaggctgccatgtaacactgagttgagttccctgtgctatacagcaggtccctgttgg

SEQ ID NO: 34801 - DNA, 1074 bp, Bovine  19866880827981
ctgtaatacgagcaaaaagaagatagaaagctttgaagaaacaaaactcagctagtctaatattaatgatacaagattcctattctgggaaatatatctatttctttttacatcttgttgtttcagactatgcttgcatatgaaatagccaaataaatattgtttccataataaaaatactatcacttatacaacttacaaggaaagacaaaaattaagctagtgatattattgttcagttgctaagtcatgtccaactcttggcgaccccgtgggctacagcatgccaggcttccctgtccattatcatctcccagagtttgcccaagttcatgttcactgaatcggtgataaatgaaaaggaactttaccttgctaaacattttttaaaaacctccatgaattgggctaaaacacaatacagcttgatcagattgagtataattttgtgtacctaacaaatgtcagccaaagagttgattgctcaaaatgatattctgtgctgaaaggttttggatcaagaaaacgtttgcatataattgctattattaaggaaaagtggttttcctttgcttatagtgatgaggcttttctagactagcatgtaaagggtggtgggactgtctaagcctggttctccctgcaagtttcttcctctctctctcacccaggcagccgatcgccccctttccatcagatgctcacctttgctaatgagtagttaatgggttctggcatcattgaaggcataagcataaacagagttgtaggatcccggggtgtcctggtgttctgtaatcatgcatgtaagatcctcagatccagcccttgaaccgtttcccactccccttaatagtttcctggagcatcgagtgttcagaaatacagctctattttaaaacctccaagtcaccactttatctggctccatcctctcctcttggaattgataacgtgttgactcagagtcataatggtaacttcctcatgaacagctgatgttgtgaaattaacaaagacgagaactccccgacagggcagccaagaaataattataaaaatgtacttcagtca

SEQ ID NO: 34802 - DNA, 973 bp, Bovine  19866880835553
taacccaaaaatatgacagccaaaaatcatctatgttagattactttttcaatagtagatgatttatagttgattaggtaattaaatcaaatacaagtggctgaaagtaaatctatttttatcatccctgtaaattaaaagttctgcatcataaaaaatcatgaccatcttgaaaatgactagtcaagtaccttttagaggcaagcaggatttattgtcaattaacgtattgaactgtagagtcagcataaccctgtgcttgagacttttaaaattattggcttccgcttctgaggctgcttcctatcatggtaatgaaatgtatgtagttatcctcatattgaacaattctgtaggttgcgtttatatctcactataacaacatttcattttattattatctccaatcccctgtaatgaatacaaatacattccttttctccatcatgagtttatcaattttcattgatttgcctataatgaatacagtcaggaaaagaaaggcagacagatcatatccattaaagtgtctttggcttcaaaagtttgtctgtggtactgtttaattaaaaaagaaaaagaaagtcatcaggaaactaattaaaaagagacatttactttcaggcctgcttataaacatgaagtcaataattattatataaaggggcttgggagctatcccacttagagaaattgggcatttatatccagcccacttgaagaataaaatgattaatgcttatcaaatatttaatgcatatggataatcccatattactagttatgatgttctacattttaaagtccaagtggaagcgtagaagctaaggtgcattcatgacaaattcaatttttataaacagatgcatttggtagttcatatgcatactgatttttgggcaaagtcctataaacccacactagctgggtgacattgagaaatttgtgtgtgtttctagctgcaccaatcttc

SEQ ID NO: 34803 - DNA, 1725 bp, Bovine  19866880837740
tctgccaggaagatacacccatggtcccatgcagctcttgcctaggtagaggcatggggcaagtgtgaagaagagcatctgtatatggtggtcagagtcatacctgggcataaagggggaggccccggaagcaggaactgagccctagaggcccacatctgaccactgagaaaacattccatactgcctgcccccttgtcaatctctccttggggatgacttggtttcaaggtggcagtttagggagctgggcaagctttcagcttggctgcccaaaccaaacgtaaaacaaagcccatctccgtgctccagcttaatgggaagcatgagccatctgtgggtgttccttctagttcatttgctgcattggcaagtattaaacagcactgtaaagatccagagaaattatggaaatgggtattagcattaaaatcagagtacaattagaacatttcactgcgtaattgtttggcagggcctgcgaggaagcgaaggatttccagcactatgatttattgctcacaggtctgacttttcagaagcctctgggccaggcacacattctgggggtggcgcccctgacatgacaatacagttggacgctggttagaaacttacaccatctttgtctgactcctggcaaaccttctttggagcgggtacataggctttgcaaaggttgaccagagctccatccagacgtggtgaacacacagggatgtgggagaaaccttggtgccaggctcccgtgtctttgtcagaggaagcgttctatgtccgctcgtaattagcactaggacaggtgtcagagaaaatggttaatcgctgacatggcccacagtgctttgtaagtaaacaccatattgcaatagacacgcaattaattacccaacactccaattaaacatgttcaaaatgaaaatgggggtgggggagaaggtatcggagccgcactgccaacatcctccctatttttttttcctctaagaaataataaatgactccaccactcctgaatgtcaccaagctgtttcccagcatcccttggctccaggcccgaggctgccactgttttctgggaagttctgagttgctggaccaaaagcttcttaaatatattccagacccgatgtctccattggctcctgtagcatctattatgggaggccttgctcgtattcattctcaccaggtcgcagccccatgacccagcttctgcaggttttggctgatcatcactcacagctatatccctccctgaaaaatgaccttgactggcaggaacccccaccttgaggatgctcagagaacagcaagatttcccaccggagtgatgctcacctgatgcctgagtgatgtgtgaatccagtgcccagcctcctttcctggtgctgggaaaacttgtgatacaaccaatgctctagagatcctcgtggggtcaggtggtggctccactctttgtctaatcttttgccttgccctgttcttcttcccttgttctttcagatgtttctctgcattccttcactcaataacttactcgcagggacttctctggtggttaagaatctgccttgcaaagcaggggacacaggttcaatccctcgtcagggaactaagatcccacatgctgcagggcaactaagcccacttggcacaactagagaacccatgtgccacaaccagtgagcccaggtgccactgctagaggatccgtgcaccaca

SEQ ID NO: 34804 - DNA, 1282 bp, Bovine  19866880851616
ctggcttgtcctgttggagcccagattcaagctatgttctgatatggattctcatttaagatttatatttgtctaactttttaatgctggatgaactaatgaacttctatcagagaaagatcaattggcatttgaactcaggagagttactgaatgcactgctaattttcagtcttttgacatgggccaaactataaacctgtacatccatgtagcagtaagcagaagctgattggcagaaggagattcggttcccaggaagcaggaggaagctgccgttgaaagtctatcagacctttttgtagacctcataagaaattccattattccagaattctaacatgattgaaaacctagggcatcagttactttcagaagctaatcatattcttaacagccagaacagtgtgactttggctcaagataggtcaaacttggttttttttttcccttttggtgggggtcagggcagggcagagggagatttaactagattgaaaacagctatgaatctgaaacatacttgaataaaactttgctaccagcctgacctatgtcttcattaaaaggggtcattttcgaagtttctacacattttgttctggccagtatgaagagacaataggctgtggtctgtctctagcacagtctcatgttaaaaatcaccttgacatacacaaagggtatttattgaatcgaattgaatatgttgttgagaaaggccaacccgtacatccaaagggagctgtccaagacccaggtgctgaaaccaggagcgacaatattaagaagttcacaaattattaatattcagcttatttgtagttctggcatcacactccaggctagatgcacacaaaacacattatgttgtttatataataaattggcctattaaatacccaggtcatttcttgagtcatttcactttctatgatggccagaatggggtcacatgatgctttaaggagagaatcaactttcaaacccaggaaattttacttcagaaaccatccttttaaccctcaataatcatatgtctcctagatttaaactcacatccaattaaaaacttaactattatattctactacttcaggtaagatcaaaatatgggctggaagttttctatacttttcaagcatgcatgtatttcttgtctttcagaatcaaagaggataacatgctggcttaatctctcaatgctgtagcactgagaaatctccaacctcttaaatgtcatctcttcaagactctgggaagcgattgcaaagtggggatt

SEQ ID NO: 34805 - DNA, 3899 bp, Bovine  19866880857445
tacaaaatagaaacagattcacagactcagagaatgaacttacgattgctgaggggaagcacggggggatgggatagttggggagtttgggatcagcatgtagacagtgctacatttaaaatggacaaccaacaagtactcactgtgtagcgcatagaactctgctcagtgttatgtgagcagagttatgtatgtaactcagagttatgtatctgggaggggagcttaggagagaatggatgcctgtatatgtatggctgagtcccttcactgagtccacctgaaaccatcacgacattgttaatcagctataccctaatacaaaataaaaagttttaaaaaataaaataaatgttctccttatacaaagcactcagtcaatgtcagggagtcaggaaaccctctctgatcattgtatcacaaatgccatgctcctggggctactgcaacagagttaaaggcttcttttcccctgttgccttccacggtcattcccgaccagcttaaaggagacaggcagctcagaaaccaaagaaagctgaatatacagagatggtttcagaagggccagagtcaagaggaaaatgtctatgtctcacctctgccagcttaactttttgggtgtttgtttcaaaaaaggatagagttaggaaagccaaatcactctaggagaatttttcaataattgcctttttttccttcagatgttcagaggtgatctccgccaccatcaagatccagataaaaaggaagtcaagtgtctcagtgcagagcccggcctgcctcgtgagcagggaggttataacgagaagacagctgtctctaaggaaagctagtccaccgttttctcgtccagtctttacggatcaggcccgtgtggcagaggttgaatcactctctctgaaaacaaatgcaaaaacctttcaagttcattcaaagtcattacagcactttccagaattgaatccattaccgtaacctccgtgggtgtgtaaaatatgaaattaccagcaccctcacatagccagagaatgggcaagttagcagaaactgattatggaagctttgggagcagcccctggtgtattaagtgtctcgatgacaaacagcaatatattatttgtgaaattttgtttgatgaaattgtcttgtccgctaatggggcttcgctttgctgatcacagattctgccgtctaacacactgacgtgggggctgagcttaccatgttgtgactgatgaaaacaagagagcgccatggtggtgatacgcccgatatccattttgtgtgacagtcaggatgggaacggactcattccaaacaagctgagcgtggtttctcctccctccaccccgtgggtcatactttcagagcagactatcatttaaacttttttgccctgctcctcactcccttgtcacgccctattctttgcttctcttccctctttttatcttatggatccacttctgagccaactttgttagcaggcaagatcaaggtaccctaaaagataagtcagcccaacgtggtcctttctcctagctcctggtttctggtttatgttttaattttaattaaacataatcttaattgtttttaactaatttatttattttagctgtgttggatcttctttgctgtgcaggcttctcactgcactggcttctcttttgcagagcacaggctctagggcgtgatggctcagtagctacagctcatgggctcagtagttgtggttcctgggctctagggcacaggcttgatagttgtggcacacaggctttgttgatccgtgatatttgggatcttcctggatcagggatcgaacccgtgtcccctgcaatggtaggcagattctttaccatggaaccaccaggaaaacctctggcttatgtgttgatttgaatcaaagctagttggtctttgctgggaacggagaaggaaaaacagcagtcagatgaagcattccaacattccaacactagcttgctgagacctcttgggatgtcttcctggctcacaataatgtaccctctggaaagaggtgcgactctgtgacctccccttctgccaacttgctgctgctaagtcacttcagtcgtgtccgactctgtgtgaccccatagacggcagcccaccaggctccccgtccctgggattctccaggcaagaacagtggagtgggttgccatttccttctccaacttagccatgactgaaagacaccaggcatgagcacctgagcaaagctgggccctttggttcccttctaggactttgctacttagaaggcttagtaggggctgtacatctctgaagctgagtcatggcactccaggcttccctggtagctcagctggtaaagaatccacctgcaatgcaggagaccccagttcaatttctgggttgggaaaatctgctgaagaagggataggctacccactccagtgttcttgggcttccctggtggctcaattggtaaagaatctgcctgcaatgtgggagacctgggtttgatccctgggttgggaagatctcctggagaagggaatggctacccactccagtattctggcctggagaattccatggactgtatagtccatggcatcacaaagactcggacacaaccgagcgactttcactcactcactcatggtactctaagagaagcatcatggaatcttgagcttaggtcatgtggcacacctggttggcttgtgtgagcttagtttctgaatcagggattgaacctgggcccccagcagtgaaagcaccaagtcccaaactctggaccaccagagaattcccagttcttgcctttattgattctttgttatctactactttctggggttccttatgttatcacctagttcctcctcaataaaacccctcttttttaactgtttgctacagctcatttctgttgattataaaccaaatagctttaatacagtaaatacagagaacatataaacaatcaaactggactgagcaatatggccagtgatttccacactgtttatatggtgagtgcaaaagagtctgggctttcaaatcagacccaggtttgattctagttcgactgcctgttggctgaatattagagtcggttccctcatgtctctgtgcctcaatttcttcatctgtaaaatggggataaaactgctaagctcttggggctaatgtcttttaattgaagtatagttgatttacaatgtttctggtgtacagcaaagtgattgcatttgttgtttaaaggtgcaggaaaatggtacctaacagaccccccctcttagaaaggttagtcctccagagaatagcatgatccatactgaggaagctgacatgttcccctaaccactggcatgtccctttagaaagacatctgggcaccttcgagcaggaaccaaaagcagaaagaagagctcaggtaatgaagctcaaatcactacacacattcagagccatctatgaccacctgaaacctacatgtctagcctccccatctctccaacttccaccataccctggaattcagccacataaaagcaatactcccagttccctggtacgcaaggaaagttaatgggtgtgggttaagttagaacacatgaacattcttccatcgatattttaaacttgggacatgaagacattatgtgagagaaaccagacacaaaggaacaagcatatgatcctatttgtatgaaatgtctgtagacacagaaaatagaattgagattgccagggctggagggaggagggaatgggcttctttctggggtgataaaaatgttctggaattagatagtgatgatggttggacaactgtgtgaatgtactaaaaaccacagaagtgcatgctttaaaggagtgaatttttttttttt

SEQ ID NO: 34806 - DNA, 1222 bp, Bovine  19866880907473
attctgtgagtcattcactcattcatcaaatatttatgcacatctactatgtgccaactactattacccatgttggctggatatccagcaaacagaccaagccagaaaaaaagccccctgcttccttgatgtgtatgttctccttggggaggcagatgataaagatggaaatatataaagaagaaaaaaagacatctagaaataattgctgctaataagcagggtaagggatggaaaatgagtggaagaagatccagttacaggaaggtgtgtgtgtgtgcactcagagcagatggtaaagaacaagagggagggaatgattttgcttcttcaaggcatgtccaagaggactagtgcggatgagtccgggagacagtccggggaggaggtgacattctggaggaagtcagggcctttggaggtcatgctaaggaactttataaaaatacattttccctgcctagtctcctgtttgcatgagcaacatagataagaaatacataaaatccttcaaatagcagctgtggggcttgcttgagcacattatttgttattatgttatttgaattgtaggatgcagcgagcatgaacactgctgtttgcacagccttatttgcctgtatactgtggtcctggttaatgcagacatctatgcaatcttcctgtgttctatggcttccccagagaagcaccatcgtggattcaataaagctagcaataaagcccatattaataatgtatgcagagctatatatgtctatttataaggtgcagaattgcagtccaaatgcttcccttctctcccctcagatgaatgtaagtggccccaactatgttagatgaggtttctctctcaacccgacacccctttttgccacactgcatattaagagctgagctaagtggtatgccagccccgggaccactgcatacacattaccctttggatccaggatgattatttatgcaggaaatgggagataaagcatgcctagaaacatgctatgattcacagctgaaaagaggaataagtaactgggaaaccgtatgaataaggagatgaataagcttgcttggaaggcacactttataagagaggcgcttagggaggcaggagaatgcagggaaaagcacctgatgtgtgatgagcacctactatgcgtcagaggacatgctagagtataagcgtgtgcatatgtgtttcctgtgcatgtgtgtgtgt

SEQ ID NO: 34807 - DNA, 1429 bp, Bovine  19866880921703
aaaaaaaaatgggataaaaaaatcgttaggtcattgtaaggactgaagaaagtgtcttgcaagcactattgcagtgactttcacgcagggcactgagtgtgtaatttctcagtataaaatagacaaccagctagcccttctaagcttccattttctcatctctaaaatgagggcttttttactctttcagtggttttcagtgctgactgcaaactaaaaccaccaggggagttttaaaatatacagatgcccaggctccatgcccagagatactgatttaattggtctgagtgggggctctttgcactgacagcttttaaatgctcccaggtgagtctgatgtgaaaacaagagttgagaatcactgcaagagatgaggatcgctttacaagttagcagtctaaacctcttattaagaaaagaacaatttaagtaatcattaaaggtataaattttcctgcagaaatatcccaaggtgatgcctttgaaagtgggcaattaacccttcagcagaaaatgtttaaaaatttaaattcaaactcagcaaagtcagtctgtttaaggagaaaattaattaaaagaggaaaaattttatcactctaagattgttcagcaaactcttttattgcctctgtcatgctgttggaaggactctcatccctaagtattaaaaaaaaaaaaaaaaaaaaaactcaggcaaaagagatatcaattttattttgtgaaaatacttggaactaatgagtatgtgtgcttttcatagctcccttaggaaatgctgtacagtaaatataactgaaagtaggaggtagagtgtttattcatcatgtatatattttataaatgcaattaggaaaagaacaatgcaacacggaacatgatatggctgctaagaattcagtatattttcgaaagtgttttagagacctcgccaatgcctgagactcataaaattatcaccttgatcttactcagtccttgcaatttgcattgttgcataacggtacaaatgaacttacttaaaaaacagactcccaaactaagagaacaaattcatccttgggggagatgggtagggagttggggatagacatgtatacactgctatattttgaatggataaccaaccaacaaggacctactgcaaagcaaaaaacaaaaacccaaaacagaatggaatatatcttcatcccaaaacaaaattcctgtaggaaaaataagttatattctcttaaaatatgaaccaaaaagaaaaaaaaaaaaaaaaaaaaaaccttggagaactcacactggaaggaatcttcaaaaccagtggaatgagaactgaaatatgacatagtatacggagatgtgatcccaagctgtaaaacaaattaactgtgtggccttgggaaattatttagcctgtagaggacatctgcttccagac

SEQ ID NO: 34808 - DNA, 1304 bp, Bovine  19866881142522
accttaatgtaataattgtgagtcctattatgtggggaaatgagaggaatgagagaaatgaggtacttggtgtgaaatgacccacaaagcctgtgaaacagtgtggtcttggcaatgagagacagctgagctctgatgccagccctgctgtgtactgttccataaacttgggtgaacaagtgatctaatctctttaagccccaatttcttcatgaatacaatgaatctaataaaataacaactcatgagctccttatgagaaacagctgagataacttaaagtaaatgcacataaaacatctgtttagctcctttttaacgttcaaagtgcatgggtgctgcaaggcagacgatgggcgggagggaaccatgagcttgccttgtcatccactcacctgcctgttgtcattcccaaggaaaatggggctggaataataaaagagtgcctggtgtagatccaggcaagaatactggagtgggttgccttgccttcttccaggggatcttcccgacccaggaatcgaacacaggctcttgcattgcaggtagattctttaccactgagccatctgggaagcccatacgtgtacatatatcccctgtattttgaatttccttcaccacggagcactgagtagattataagcttcatgagcacaagaatggtgcttatatcgcagataaggaccattcttgggctcatgaaacttataatttactagaatggaggagactcactctgacttagtaaatacacaagtgatgaatgttctgaaaagtgatggacacaatgtgacatcttttccagggagatgaaaaaagtctgcagagtcaggaactatttctagaagcaagcaatttttttaaatccaagccctgaataatgaattcattcatctcagtggtaaggcatggggagagaggaaaaggccagatcattggaggaataagaatgagtttggcacatctagggggccctcaaagagtagccaagttttcattttgctaattgagtacatcttttaaagcagctattgaatatcataatttcatggaagaaagaacatttgaacaccaggaaaataaggcgacaatattagattaatgtcagccctttgaattgaataaattcgcagttataaaatagctacttcgttttgcgtgtttttatttaaaactgtgtctgtgaccattgtaggtttccaagagcggtatggtgcatgctcagttgtgtctgactctttgcagccccttggactgtagccccgtggtctcctctgtccatgggatttttttaggcaaaa

SEQ ID NO: 34809 - DNA, 1501 bp, Bovine  19866881165550
agactgaagctggacacagtggatggtgtgagcccaaagtaggatctgggacttaatcatttatttatcacatggttgctgcacattaacgtggggcaaggaagaagggcagctgtgagaagtgggaatttcagtatcagagtaatgacctgggggagatactttcaaagaggaagggcgttgcgactattcatctcagccatgttagccagactggacttctctttagtggcagaagttctttctttttttttaactaagaaaggttcagattaataaactgggacacacatatgaataaaaaaagtgtatctggttgtacttttatttttaataggacaagcttaaaaagaaagggttttttgttgtttcagggcacttggtctctcttattatgaataaagcataaaccagcccacttagatcattgtctactgtgactgaatttctgtttctctctgggcaaggctcttctctctgggctaactgaagtgaaacagaaatttccaggattctattattttaaaatttctgtctcggaagcctgacttgagaagggttggccttcgtatgttctaaattttaagaagagtaattattacaatgataataaaagaataataactattaatttatattagctattaaaatagattgagtgctaacccctgtgttaaactctttaaatattttcttttatttaatccttgtcacaactctgtacttatcccaaataaggaaactgaatcttagactaagcaacctgccaaggggacctgctttacttgtgccatgtgggtgaacaaagctctgtgtggaaaggacatctctcttcatctacgcccatctagtcctcaaaaccacaaggaaattaggagccacccccgcccctatctccctgccaagtcatcctaacatggaagcaaagctgtatgtttcatggggttgagtctctgcttccacgtgagattatagcttattctccaattaattatgcatagcctctttggctaataaagtctaaacaaagagcatttaatccaattcatggtttttttttctctccatcgtgagcagcctgtcaaacacaatcagattccccatgcaaagcagagaggaggcaggcgtcagccacacctgcttagcggggttgcaagagggaagctcacagtcagggaacagttggcggcgcagatggtagagatggaaaggcttcgggaaaagccactctaactgcagttcagcgctgggaggggggaccatttgggggtttcaggcaaagaaacacttcctcgtccctcctgacttggtccaaccaatagggggtgagaccactcagaaacaaaaggcacagaaatttaccaggcttccctggtagctcggtcagtaaagagtctccctgcaatgcaggagacctggctttgagccctaggtcgggaagattcccctggataaggaaatggcaacccactccagtatccttgcctggggaattccatgg

SEQ ID NO: 34810 - DNA, 1137 bp, Bovine  19866881206682
cggcaaagtggggctaactgtcccagttgttgcgtgtgggcttctcattgcggtggcttctcttcttgcagagcacgggctctagggcacgtgggcttcagtagttttggctcccaggctctagagcacagacagcctccatagttatgacacacggcctgagttgctccgcagcacgtgggatcttctcagatcaaggactgaaccccatgtctcctgcactggcagatggattcctatccactgagcccaccagggaagccctcagcataaaatttttaatgttcatccatgttgtagtgtgtgttggaatttccttcctttttaaggctaaataatgttccattatatgtatatactacattgggtttattgatttgtctctttaaaaaattatttatttacttggctgtgttgggtcttagttgccgtacgtaggatcctcgttgtggagcactgactctttagttgtggcgcgtttgctgagtttctccgtggcatgtgggatcttagttctctgaccagggatccaacctgcattccctgaattgcaaagtaggttttcaaccactggaccaccatgcaagtccctccatttgtctcttgttggacatttggtttgttatttagcgcttttgagcaaaagacggttgtgtctggacattcatggagaaaaatgtttggggggttgaggggatgggcaggagtttagaagggagaggcactttgtggccaggcaaggaatctgggatctggctaaccaggaaagataaataaatttaatgctactattaactggtgctgagtgcatgcctgctctgttgctcagggggtgaagaactctgtgatagattggctatgtttttcatgttcatggcaggagggggagatggtggccatgtatttacattcccatctaaattgtttggctagtttcatagtccctctgggtaaggcgctagctcctccagctcttttaaccagcgctgaggggctgctgggcagtgtctgaagggtcatttccagcttcagatgatagcctctggtttaagaggcttgagcaattcagcctctgcccttggcaatatcttgaactctaggatcaatagtattttattttgttttctctttcctccg

SEQ ID NO: 34811 - DNA, 1663 bp, Bovine  19866881293401
ccactgtttccagccaaagcacaatttgtaatttgtgtttaaccccaagcagagattgcactctaaaatatcttcaggagcagagactgcaccttaaaatatcttcaggaggaggctgtgagataggtaaatgaaatgtgcaaattgaaagagatactaagtgttttgcacttacttcccactcttaagatgttttccattaattctgttacatttagcattatgttgttggtcaatcaaaacagtatgtttttgtggtttaatcactaagtcatgtcagattccttgcgaccccatggactgtagcacaccaggctccattgtccatggaatttcccaggcaaggatactggagtgggctgccatatccttctccaggggatcttctcaacgaagggatggaacccatgtctcttgcattggcaggcagattctttaccactgagccaccagggaagcccccaatcaaaatagaatagtagttaccaatttgctactactgtattaaacaaacaaaacgaagggaacaaaataagtccgcgatggatcatattttgagattccaaatagtagtgattactatttctgttagtattactgagatcacttactgattagctactatttgccaaaccctttcgtgtgataattttaatccttacgacaggactcaatgaaattgatagtttgtccctgtttggcagatatgaaaactggaggctcaaggttattaaatgatgaggtccaaagaaactgagcaaagctagagatcaaaactaagcctgaaagtttcctaaaaccatgctttgccagctactctatctgagcttaaggattcactatttctcctctgtttccttcctccttgtcttgtttctattttgccagtgggattttttcttatctacagaagatacaacctccccacagacttccttggttggatttaaaaccctaccgcagattcttcaagttgatcaggagcttctagatgtaaataacatctttagcctggaagagtcagatgttttcagccagaagatgactgcagaatctttagacatagttttgttgaaatgagttgggtgaatatttatcaggccttgcctggaaaattgcatggacagaggagcctggtaggctacagcccatagggttgcaaagagtcagacacgaatgaatcgagttatacacatgcacacaggcacgggttatttatcattccaaggttagagaggatattttatcaactctaaaccaagtatcactgttggtaagtttcatgagagagtctgagcttcagagtcatgccaggctggctcagatttcgattttgtctgatgtttttctgcctctcagcctcagattccttgtgggtttaataagaaaaaaaagttccagtgcttgtagaacatacttggaccaggagcagaaactcagtgtcatcttatcagtcttattaataccagctgtatttaagattgtttatatagttcttggatttcccaggtgacacagtgataaagaacctgccttccaatgcaggagactggggttcgatccctgggtcaggaagatcccctgtaggaagaaatggcaacccactccagtattcttgcctggagaatcccatacacagaggagcctggtggtctgcagtcca

SEQ ID NO: 34812 - DNA, 893 bp, Bovine  19866881335869
aaatcccagggctgatctccttcagaacggactggttggatctccttgcagtccaagggactcgcaagagtcttctccaacaccacagttcaaaagcatcaattctttggtgctcagctttcttcacagtccaactctcacatccatacatgaccacagaaaaaaccatagctttgactagacgaacgtttgttggcaaagtaatgtctctgcttttcaatatgctatctaggttggtcataactttccttccaaggagcaagcatcttttaatttcatggctgcagtcaccatctgcagtgattttggagtccccccaaaataaaatctgacactgtttccactgtttccttgtctattatttcccatgaagtgatgggaccagatgccatgatctttgttttctgaatgttgagctttaagccaactctttcactctccactttcactttcatcaagaggctttttagttcctcttcactttctgccatacgcaatagcatgggggacaaatgcagggactctgggacagatttgtttttaatccaagctctacgatttcatgctgtgtgggacaggtgacttagcatgctgttactcagttccctcatctgtaaaatgggactcttaatagtaccacgtcatatgagagtcattaagattaaatgggtttatatccaccaagaaccacaaagtgatcagaggagcctcaatacatgttacatggtttttattacttttgaaataagtaaaaattcactcgggaaatgagacaagacggtaggcgagaaaacaatgtgccgatggagccgagagagaaagattttattttttattttttctgagttgaaggaagaacagaaagatgtagcacacacttccgtcttaaacca

SEQ ID NO: 34813 - DNA, 1439 bp, Bovine  19866881421201
agaaaggtgtactctgtgagccagaaaaaagcacctagctgctacctaagcctgaaggttaaagacatccttttcagacttagcgatgggtgaatggattctgatagagaagacgagagcctgccaggcggctcaaatcaaacgccagaggggaaaggaggggcagggcacttcgctctgcatgatgatctctttttcttctaagggttcgcacccctggaactctgtcttttcaaatatcctccccagcctcctgggctctgagttggtgtaccccttcccactgagtcaaagcatttgcaaggaaaaaaaaaaaatcaaatccgacttggcatataacctttcaaggcactaggggaccaattccaacttcatgcactcagcatctgtctttttgtgaagaagaacagaatgaggactctgggaaaaggaaatggatctcaatcctcataaggttggcattattgcccccaccgaggaaactgaggctgtgatattgcgatttataataagaaatatgtgtatggtcttcttcccacatctggcacagagttcctaaaacccctggaatttcctcctgatagagagctttaaagatgactcttgttatattaataaggtgactttgggggacctcacccaaggatgggaaaagtgagtggcagaggatgagatggttagacagcatcaccatctcaatggacacaagtttgagtgaactctgggagatagtgaaagatagggaagcctagtgtgctgcagtccatggggttgcaaaagagttggacatgacttaggatgggagctggttgccaggaaaacaagccacatgattagagggtttcagtcctccgccgacacacacccccatttctgggctggaggttgaatcagttgccaatggccaataatttaatcaatcatgcctatgtaatgaaacctccataaaaactcaaaaggatagtgtttggagagtttctgagctggagaacacatggagatgggaaaagagggcatggaaactataccttttccccaccccttgctctagaggtccttccatctggctgtccagaattatatctttttgtaataaactggtaatctagtcagtaaaatgtttctctgagtcctggggcgctcgaggaaattaatcaaacccaaggggagggttactggaatctcagatctatagctagatggtcaggagtacaggtgataatcccgacttgagcccttaacctgtgggatctgattctgtctccatgattcagttccactccagtttcagaatagagctgagttggaggatacccagctggtgtcggagaacctcttgggggtatcggggaatcctccaatgccctgctcattccctgccattcactgtagttggttccagaaccttagctgggatcagaagggaatcagggtcagaa

SEQ ID NO: 34814 - DNA, 1393 bp, Bovine  19866881459377
gggaattcttatggcccttgctgcattggcacgccccgttgtcttgagatcctacccgctatttgcagactggaaatgttggaatgcgagtaggattaggggctggaagcaattaaaatgagcaaaccatctgtggaggaactggggctggagctgagtcctcccatttatcaatgtcttcagcaaggagccctggcctcctccggtcacccagtacagctccctgcaccatttcagtccccaccacagcggctggtggagccctgcatgctgattaaaaacctggtgagtaatggggacaacacacgtctctattgcttaggtagatctaagccagttaataaccttctttaaagcgaaagcaaatcaagtcctattttaaacattttattgacaagcacaaaaaggctgctgtcggtggcccaggtaaatttatcacttggttttgttacttgtttctgactcatgcaacggacaagaggatttaaatcatcccaagcctcccattgttacaagacaaggggaaataccggagcagggaaaatgggatgaaaaggagggacctcggacttcttaagttccttttgtagcaccaggactttgctgggtacattccttacgtggactcatctgatgctcagatagcttttcatcatggtattattttattcctgttttacagttgaggacatcgaggcatcaggcgtgaaatgctttgctccaaattgtatggtaatggggagcaaggtttcaaagcttcatctggcatttgcattcatactctgtcactcaaggtcctaagacaaaacaggcgacaaacacaagttggggacatcctggggatgtcccaggagacttagttaagggacctcttctatttatttattttatttggaggataattactttaataatactgcgatggtttctgccatacatcaacatgaatcggccataggtacacacgctagggagcacttctatgaatgacagtgagatttagggaaccacggggatggttcagtagcccagagctaggaacagtaagatggctgttgctgtttaggcactaaactgtgtccaactctttgtaaacccatggactgtagtctgtcaggctcctctgtccatggaattctccaggcaagaatactggagtgggttgcatttcctactccaggggatcttcccagcccagggattgaaccaccatctcctgcattggcaggcagatgaccactgagccaccagggaagtccagtagaatggttaccactcctaaacctggaggggaagggaagggagtagttgttggaaccttgtaaaacatcatgtaaaagaggctgtttagagaggaatagtattttcagtccaaggacagaatcagtccagt

SEQ ID NO: 34815 - DNA, 1088 bp, Bovine  19866881501397
cagatgtttcttatgtataagaagatacacacatgcatgcatatgcacaatcctattgacaataactattttattaagataatgtgcatgtacgtttgtgctcagtcgctcagtcatgtctgactctttagtgaccctgtgggctgtagcccgccaggctcctctgtccatgggattctctaggcaaaaatactggagtgggttgccatttcctcctccaggggatcttcccaacccagtgatgaaacctgtgtctcctacactggcaggtgaatctttaccactgagctacctgggaagcccattttactaagagggactctagaaagggactgaaggggttctttacttttccctttcaaccttccacattcatttcttacttttcttttaaagtaatggtagtgggtcttatttaagtggtaaacttttcattgttaactttataggaacatatttctatatattttaatcatatatgcattattatacacttacaaaaggaaaatacctgcctatatactcatgcattacaaaccaaactatattgaaattatcagcttgtttatcttatgctttgacaacggaatcacctagcacagccccggaatttatcagattacccaggaaatatgtactattattgaactgaggaaacaagatgtccattattttttttacaggtcaactctcaatatcatttttgccaagcaagcttcttatttcttcatattctttatctaccatttcaaacagaaagacctttattcaatgattcattcagccacctgacaagcgtttttcatgctcttcaagaaggagagaaaagaccaataagtcgtctaagtcagttgctttctcctacacttgatcttctgggttatgttctcctttgggagaaaggactttatgggaaaagattttgtgtcaccataaaagtgatccagcacccaggcaagacagcacagtgacctgaggccggcactgcaaatgctgactcatgtttcatctggggacagccagtagttctcctgagatgaaagatgaatacttcagatttatttgtggaaaataaccatacagacccc

SEQ ID NO: 34816 - DNA, 885 bp, Bovine  19866881538242
ccgcggaataattaacccccaaatgagcaggaacatctctgtcttaaaacatttcaggggtgggggagggggaaggtggcattcacgaagcaaaaaagaggaagaacagacaaagagagagcttcccccacccgcatccatcctaaacagcgcaccttttcagggcatctggcaacctcatgcaaattcaaacccatgcacaaatgcaaagaataattgcccgttaaagcagttgtatatttttatggttttgatgcagagtctgcccccccccgtcgggttttgcatctgctgttcttccatctctcccagagctctaaaactttaatatgcagtttataaccctcaagtattttccatgggttttgttgtgttccttctcttgggatttccgggcttgctgagatgatctcatttgtgtttattttcgaaggtaagcaccacattcgtaaaagagacagagggaagggctcacgcattcgtagctgtaaatacattgaactcgaagctgctcggaggtgggaggtgggggcgtctgtcttgcgggggagacaggcaataagcagttgacactttggtaaatggcccatttgtctggttgatacacccacacatcttccctttaaaaatgttgatttgccttgatacttgagcacatcacagcatgcctctggttacatccctgaagtttccgtttcattgagttcagcggtggagaactccttattcctaagagctgagacggttgctctgctaacctcgtccctctctgctctggatataaatctagctgaaggttgggagtgggtgggctgcggatgtcgaggtgtcaacaagatgtgcaattggcatttgctccagaagctcaggccctgttttcttgga

SEQ ID NO: 34817 - DNA, 769 bp, Bovine  19866880805830
caagctcacttgtctttggatcaaggtgttaatggcagttttgttgctatgagttgttttccaaatctttatcaataaacttgatcagtgacctgcaaaattcattaagaaaaatgctttcactcacttttattttgcttaaccatattgttgtttatatttcactattcccaccagcccttttatacaggtatttaaaaagagatgatttatagactgattagaaaatatataatattttcccagtattgagttttgggattcttaactaggatgatttacctctagctatacaatcggtcaaagaaaaagacataacaaaaatgtgtagctgaagaacattacagtacattgcagcatagtgtctcaacactcctcccaggaaattccctggagatggtccacggggttagggcatgggcttgattcctggtcagggaaataagatctgtataccagggatatagcatgaccaggaaaacaacaaaacaaacaaaaactgcattccaagaccacatcatctaaattattactgcaataatttaccctacatccttgcatttttagccaaataacaaacagaaaagacaacatttatgatctccattgcacaacagaaaagatgcatttttctaatttcataagaactttgatggtcagcaaaaacatatacctaggacttagaattatctcctaaatactattcactggctttttttcccccaaatgaattgtgaattttaatagaacacagactaggatttaaata

SEQ ID NO: 34818 - DNA, 754 bp, Bovine  19866881068154
aataactcccttagatagctcttcacagatgtaacactcttaaccctaaaagtcccgagaattgttaactatgctccccagggattatatcctttctcctcccccaaggaatctcattctgacatcaaaacaagcaagcaaacaaaactcaaataacttaaccctagctaggttccacaccatacggcacgtaggatgcaggacgcaggatcttttctccctgattagggattgaagtcgtgcctctgcaccgggagtcaggagtcttaaccactggaccaccagagaagtccccgtgattgccttttaatgtcctactgacaattcatatttttctttcagtagttaaatataaaactgaaactaagggaaattactttttcaatatatacagatcatacttggttaagcaacatatatcatgctcagggtataaacattcaagattaacagaactgctttgaaaatgtaaattcatatgacaatgagttgctttctacttttcatttaaatttttaaataagctaccttatattatttattctccaaaagatggtgatgaaaggtcagtctatgttctgctttagagatcttaacagtacatgttttcttttctccttgccttcccatttctcttcctttttcttcttccattaatatacacattttctgatgataatataatttatgaagtagtgaattatgcctagttgctagttactttctggccatagaagttgtatgaatatttttt

SEQ ID NO: 34819 - DNA, 1472 bp, Bovine  19866881076210
aatatgaaaaaggcaaaggtatgattttttaatagaaagaaaagtaaattttgagcagagacactacatgcaaaccaaatgaaaaagaaaggggtaaagttaaagtactttgagaaagagtaaatgaaatataccaaaaggtaaataaagcatgttcaagggctctgcgtatcatctagaaataaatatggttttagttagaataaaagtcattgcagagaagagtctaaaactaatcaaagccaagaaaaaagaaatgcacaggataaaacatgaggtatagagaagcaccatgatgatggaatgaagtcaaaagtgtaaaaaaaaatatgataagaaaattaagggtagaaaatgaaaggaagattgcatgagagtttgagataaatcagaatcctttcaagtagagaagtaagaaggggtcagggctggagataatgggacctccgtgaaatggaaagtgtaatttattcactgaagtggtggatattgctatcaattttaatgacttctttgcatcagctttcagactagagaattgagaaaagatattagcaaagagacatatatttgcatatctcagggaaggagaatgaaataaatatcaagctaggggaattattaagttattaaactatttaatttctggcaaactacagaaaaaattgaaaatcaactggattttagaaagcagtattaataaataagaagacctttatcaggtaccttttaaaaacactatagcatttaaggacttaaaaaaaatagccaagctttctagactcacttatttttatagccacagtctgaaataattcttaaaaacataatactccagcagctatgtatatacatttagtcaatcacagaaagcttgattaactttctcagagaatgttggtttgaatacacacacgatgcacacatacaaacacacttgcattcattttaactctgttttactctgccaggggaaagaagaattttctcctccaggaagtcttttcacctcgacagagtataagaactcatggaagtgcttggaggcagtcattcatatacccaccactgtgtgaatgatgaaaacacacacagagacaagtgatggagtatagagcatgctgtagccatcaccgcctcatgctgcctaacagcttgaagaaaccaaaagcctcacgtcaaattatcctagccagaacctcacacttaccatctcctgatagggaatacagataaaaatcatcttttccccatcttaagcagtgtagagcaaagtgatttattaatgggcatgaaatccaaacaccatctgtgtcaaccaaaacaacgttctagttatgatttctgttaaaattttgcctgatttgatctcagaaaatcatctgtgaaaaatcacctctgaaggtctcatcaaaggctgaagttggaattgatctctgcactaatgagtttgacttcacaggagaacatca

SEQ ID NO: 34820 - DNA, 1410 bp, Bovine  19866881104134
tgtgatttgtgttctttacattacattatagtgccctattcttctgcctcatacttaaaatcttgtaagttttgtctataatgaaaaatgggttttctttatagattcagattaatgcttcattaaaaaaaaaacataaggcaatccaaaatatcaactatgtagtgtaagtcaattccatgttcttgtaaagtctattgttatattgaagtccatttccccatacttaaaaaacagttctaggggtcaggggtagcaaccagccagaaactaaccattcctttgtcttttaaatccttgaatattcttctatatttcttactccagctatgttctaagtcagcttctctttaccactaaaatattgcccacatagaatgatatcttagttctgtttaaattctcatgagtattttttttccttgaactgactctgtaaaatgttcacacagagcagacatgcctactgttccaagggatcattcaaaaagccagcagactgtaaactgaatggactcttatcttagaaggatgaaggacagagcaggcctgctgggatttgaagagttggttccagggagtctagatatttcaaaccagacgcttacacaacccatttctctctggccttatgactgaatgcactaattcatttaccattcaaagcgcccttctataatttatgccacatactgacatgtatttaactctctaaaatgccttgaatataatttgtttgaaagatattatacacaataaactataatgcattttaagaggcaccttggaataaaaataaatataaattgaagaaaaatgcttattaataagcatttatatggcacttcatgtttacagatggttttacagtcagtttttattactttaatgtgccaagtctctttgggatcaaagtgctacttaagtacatctccggattttattcccctggagtctagacttgtggggtcaaacgttgtaaagacagtctttctggaaaagttgtatcctaaagctattaaagaaattttaatgtgatgaatgagagtacattcaagacatggttttcactgaaatgcctggttttgaggaaatcagaagaataaatttgtatgacctgtaataactttatgcaactgaagttaacataagggctgtggtagctcacctgacttcttaccggtatttgtagaactagatcttatagaccagcatccatgggctctatgaagtgtttcctttgttcgagtacgaaagcacacctaaagagctgtgtcttttttatttccatgtcaggaatcctcctggaaattgccactgttccagaagtgatgcagattccagactgatggcctatattttcggtcttatggttcaactaatgtgtcactccttcttctaagatgtcag

SEQ ID NO: 34821 - DNA, 1070 bp, Bovine  19866881281233
aaatactttctggaaatgtgatggttatttttaacgaacaatttggttttgagcatcagaataaacacttctgtttcttcatcaaaatgacataaaatgccttctatatgtgcttgagctgctttagataatttctctctgaactgacaatttttaaaactacatttcccaaatgttttaaggtaaatactattatttacttttttacatcactgtggtagaacatgtatctaagtaatactgctttatctatgacacgtctttgataattcatccagtttgacaagcttaagctctttagttagcatcaacactgatacaaaaggagacttgaacaccatgtaccattgaagcaaaacaacatacaatcattgtattgttagaaaaataaagctttttaatggacaaaaatagctggtggagtggagtggtatctttgcttcaatcattgattttctcccaaaatatccagaattaacttaaatattctttgtccaatgactttaacctataatgaaaaacaggactcatgtctgtggtataatttttagagtgacattgagaaggattatggtaatacacatatgataaaattgtcgacaatgactgagtcctataattgtgaactaaattcaaggaggctgccttcatgatgataactaacagcgttttcattttgattagcttaccttttcaagtattctgctaggaacctctataacacaaatagaagcaagaactttattatcatcactatagcaactgcagggaaatttatctcaaaacagttggctacctgaaaattttttcaggacagaaagaagagcagatgatccataatattttaattcatttttaaatattgttctgtggtctaaactaaagcacttttacaagaacaagatagtccagtaactttgtaatttttttttaagcaataagagcacatgtatctgtataagtgtatgaatttttctttatgaattaatgtttagcatctcttttgcatttttgaaagtagattacaaaactcctttgttaagaatagttttatatgaatcattcaaatt

SEQ ID NO: 34822 - DNA, 875 bp, Bovine  19866881288792
ctgtcttgacttaattttaatactaatcaattataattgataagtataaaaaatcccatgctgtagataaactggaaaatttcatgaactatcacttgatttttgaaacaatgaataagtgaataaattccatcaagatttgggcattattctggacagtcacaaatgacgcctttcttataatttttgatggctcatttccactaaggggtcagctaaaagatactaacatcttgtatctttttgcacagtgtgtagtataagtttttattttcaagagagaatacactgtatctaggactattcattgtagtcattcattttggaaagttgtggatatgcattttgtcatgaaatatattcatatattgcatcaaactaactgattctaaaaaaattacagtcctcactcatgattcttaattgatttagctcagcataatcaatattgatcaggtataggaaatatgcaaaaatgtttctaggtagagttgtcaatattctatcatctccttcaccttttcatgagtcccaaaataaagaaaaattgttagtataaaaattgtggtactatataaattaacctctttgtacccacttatttagatgtccctatcaattctcagctcaaacaaatgaaagaagttgaacatttaaatcatactttaattttaattttgaacttttagatccagatttctttttaaagactaaactgctttaaaatagtcattaaaatatcatttttctttttaccaactatttctaggttttgaaagagtctaataaaacctcatagattaattagtcatgacctgaagtcataatttaaaatattagaatattatgtaatgtattattacatcaaaaacaca

SEQ ID NO: 34823 - DNA, 1727 bp, Bovine  19866880442958
tctataagggaaagaatctgagaaagaatagacatatatatgtctaactgaaccactttgatatacccttgaaactaatgcagtattttaaaccagttatacttcaattagaaaaaaaataacatttctgaaagcaaagatgatgtttcaaataagctgttttctttaggacatgggtcagcaaactacaacctgtgagccacatccagctaccatttctatttatacagtctatgagttaaaaatggattttacacttttaagtagttggaaaaaattacaagataatattggtgatgggtaaaaattacatgacattaaaattccatgtctacctgtaaagtttgttggaaaacagtcatagggatgcttttttgattccccaacatttatctagagggcgtttgtggttcctgcaaataaaatcattgccacagtcaaaaaaaaatgaaataaaataaaaggtttattttctttttggctgtgttgggtctttgtggctgcatgcaggttcttctctggttacggtgagcaggggctgctctgtagttggggtgggcacacttctcattgaggtggcttctcttgtggagcaccagctctaagttagcatgagggcttcagtagctgtggctcagaggtttagttgctctgtgacacgtgggatcttcctggatcgggaatcgagccctgcattggacctcttgtctcctgcattggcaggcggattctttcccacggagccaccagggaagccccccacacgcactctttcacaaactgcctgtggctgctttcacagaacaaggatagagttcagtggttggaaccagaaactctatgccccccaaagctgaaaatatgtactatctggccttttacagaaaatattttccaatgttcctttaggtctgcagcattattttttcttatgtatgtgtctcatttttttcccctccaaatgtttctctataatctctgttacttctttctttcttcaacacttctccaaagattacacggcaaattagcaaagcccactttaatactgaattgtactttcctacttgccaagtttctgaaggtaaaatgtattttagggaaaataaagaacaataatttttacttcagtctaaaattaatttgggtcacaatattaacacaaggctaatgaatttcagaaggaagggaatttttttttttaatgagtgaaacaatatagctctgaatacttctagttttatctttttctggagaaacagatttaattttatggtaggaaccagaggaatcccttcacatttggggtccattgaaacaaacaaaaaaacattaactctttccgggccagaattagtcagaggctgaacagctgctaaagcacccctgaaaaattctatttctcaactcagggatgcagggaagggctttgtgcttttaggtgaattccctgactatctggtgattgcttgtaaggtgacagggtcccctttagcatcaaaagagaggaagtgagcaggaatcctggtggcctctttccaaagtggactgccgtgttgagagagctgtctggggcagtgggatgggaccatgttgatggttggcttatggagccagagcttggaagtgaggtgactgcctgagagttagcctattaaatagatggctccaagtgtgttcccaggaacttccctggtggtctagtggggtaagactctgtgcttcca

SEQ ID NO: 34824 - DNA, 1495 bp, Bovine  19866880473944
tggctccatttgttttcctgcccagggttttttcctcctcctgatgtctgttagggaagcccacttgtggcattgttctagctcaccgggtatggatgattttgtacccggatccagtctcgtgaaccatgctgttagagttctccggagaaacagaaccgatagtgtgtgtgtgtgtgtttctgcatgtgtatgtacgtatgtattcatctccggagatttaccttaagaaaattggctcatgtgatggtggaacttgacgtctaaaatctgcaaggtaggcctgcaaactggaggcccagggaaggactgcagttcgaatctgaagacagtctgctgacagaatttcttctttggggggagaacgtctgtgtttttctactgaggcctttaactgatgagctgaggcccccctggcttatggagggtgatcggctttacttgcactctcctgacttacattttaatctcatctaaccaaatgcctccccagagacatcaagaataacatttggtcaagtatccgggtaccgtggcctagccaagatgacacataaagttaaccgtcacacctgcctgtggttctttccctgggccttttaggaaatgctgtttgcattttctgtcactctgggcaagcgcatctccgagttgcttcactccatgagtcagtttgtggcctcagacagttgttgctcttgctgctggaccagcgccagtgaggggaggccagctttcgagccggggcagccggcggcattgtgatgtgtgagccacagaacagtgcagcctgacctttacaggctcggccctccgaggccgctgggcctcctgtggactatggacagctgctccctggcataaagaggggatctcgagccaacatcctgcagagcatcttggggaaagagcagtgatgagatggcctactgagtaatgctttgattttgcttctaagctaggttcatgtgaaaggtttaggaacctggaggggccgggactttagagtttaatagcgcagccaggtttgtgggagggaaggggccaggtcgggagaagcacgtgctgggtggcagcggcctctggcaaagtcagatgctctgattgtttttcgttaatagatgcgctgttggccaaatactgggtttacacctacacgtgctggcaattaaaccacttcttggatgactgagcaaagatcttgtgcctcctgcctcagtatttagaagtggttcagttcagttcagtcgctcagtcgtgttcgactctttgcaactccatgaatcgcaacacgccaggcttccttgtccatcaccaactcacgaagcttgcacaaactcatgtccatcgagtcagtgatgccatccaaccatctcatgttctctcgacctcttctcctcctgccttcaatctttcccagcatcagggtcttttccaaggagtcagttatttgcatcaggtagccaaagtattggagcttcagcttcacatcagt

SEQ ID NO: 34825 - DNA, 2809 bp, Bovine  19866880486590
cccgggcacctccctttccgtggctccccactgttaaggacaccccctagatgctcctggggggtggatccacgtgggacagccctgccccttactccacacggagcctgaacctgacagcacagtgcttcctgcacccctccaccccagaccacacaaactcctccccaggaggcagcttcatgaagccacttcccacctcaagagggaaagcaaatataaaacagacccaaaatagtgcgggtctgaaaagctgaaaaccagccaccataattacaagtatttttatcccttgcccaaaaaggagtagcagatcattttccaagtgtctctctaaggagcttcatctgttccatctcaagtgctgcgggctccagagacgccaccagaaaggaggctgtagcaggaaaggagccaaagagaaatcccagggtggagacaccaagcgaaaacagggcctatggtatcatcatccatggagggcgggggccacaccatgagatggagaaaagaagtccaaagatccacgagagggaccaggagatgatggaccaggagatgggcagggacgtgagagagctaacaaggctgggatgtgggcgtgtctgcacaggagcccggctgtccccactcaacacccctggccaactgcattgagtgatgaagggccaggggacctgcaagaaataaagaggtcccactcggcgagaagggcatgctgccccaagtggaaccttcccctctgctaccctggagggtcgcctgagcacaggaacggttggggacatatgatgagcaaaagaggcatcagaagaggccctctaagccagcacttgggctttcagcagtgactataacagccacaatttcttcctattatccctcctcatcccttcattaagtccctcaggcttgacaagctcagagctagcatgctgggaaacgctttcatagccatcatcccccttagagtgaaaagttgaaccagccagctaggaaggcctggttcctgcttctagccaacatgatacaaagagcactaactctggagtcagacagccaaggccataacctcattcaatatgtgaagcctggtgactgtgggcaggtggcttgtcatctccatgcctcagtttcctcatctgtaaagacacagctgtagttttccagtagtcatgtacagatgtgaaagttggaccataaaggaggctgagcatgaagaattgacactttcaatctgtggtgttgggagaagactctcgagagtcccttggactgcaaagagatgcaagccatcaatactaaaggaaataaccctgaatattcattggaaggactgaagctgaagctccaagactttggccacctgatgcaaaaagctgactcgctggaaaagaccctgatgctgggaaaggttgagggcgggaagagaagggggtgacagaagatgagatggttggatggcatcactgactcaatggacatgatttgagcaaactctgggagacagtgagggacagagaagcctggaatgctgcagtccatggggtcacaaagagttggacacgactgagcaactgaacagcaacaaaatatgatcacatatttcacatcatgatatgacagaaaaaaatatgcctaagaaaaatattaatatatctgctggaaaatagtattacaaaatgttttaaatgggtgtattcaaaggtacatctctctgctatttgcccttatatacctaccattcccacctcagcatgaaaataatcatggtcccaggaggaggaaaattaggaataccagctaacttacagccagtatcactgggacatagaaaaaattcattcctgccatgcacccaagttgtgtgcaaatgggtgtcaacctgacatatgtgactacgtgtttgtctctaccacatgaccctgagtggtattccagacctgagactgcatttccccagaaatacttgccttgatctcctacagaaacatcaacttgtatataagcatcatcatgaccttaaggagagcatgaattcaaaacacaatgagaattaggtcttcaatgaacaaacaatgaagtgtactgcaaatggaaattgtttataggcaaaaaaacaagtctacatttttcaactggtattatcttatgtaattaactggctgaaaaatattttaggatatagtaaatataatatgatatctcttttaagagacttttaaatatgaaaaataaagcaatgacatccagtagcaatacgtacaccaaaaatccaaatgtcgattgctaagtatcattcttcagtaaaaagaatcagggctccttggagaggtagctgataacacagctggggcaggaaaaatataagatgagccaagagcatcttgtggtgccagaaagaaaagaagtgcttaaaaagggggaggcatgattttctggacacagaaaccaatctgaaagaaaaaaaaaaaggtaccaatgctcaaaactggaaaaatcggaccaaaaacataaacaacagtagtaacccaaataataaaataagtatccttgagtccatattgatagagaagatggagagacagatggttgggtggatggatgcaaatcataaatccgacacaggcctaggctacaggatccataaagatttcttacatttcaacaataaaaagtcaaataacccatatttaaatgggcaaaggatttcattagacatttctcatacaaaaggccaataagtacatgaaaagacactcgatgtcattactcattagggaagtacagataacattacagtaagaca

SEQ ID NO: 34826 - DNA, 982 bp, Bovine  19866880658872
tggcttattctttgcctgatgccaagcatgccaaagcgttccatcttgctatattgcctagttccacccattcatcacggaatcagagatctgcagtggggaaagaatcttgacagtcatttggccagggctacttgtatctggacctcggcccagcccttcacatctaatttaagatggtgtgtctgtgtgtgtgtgtgtgtgtacattagttgctcagtcatatctgactctttgcaacctcatggactgtaacccgccaggctcctctgtccatgggattcttcaggcaagaatactggagtgggttgtcattcccttctccaggggatcttcccaacccagggatcgaacccgggtctcctgcattgcaggcggattctttaccacctgaaccaccagggaagcccctaaattaaggtgaggggctaccaaaccagatgaaatagaatcttccaggtctcgcgggaaaacgcaattccacatgtcagcagttctgctgttcacttgcatagtgtccccactcctaatcaccacgccactggtccctataaccctccagcctttcacagccgtatctgcagaaacccagtcttctctaccttgaagtgaagacttttccacctaagtggattatcctgcagttacctgtagcaaacatcatctttgtgcacggaccctctttttccatttgtcagaatcacttccaaattcaatttcattttcatattcagtcactctggtcccaataggaatggtccccaaacttcaaatataagttgcctgggaacactttcaactttgaaaataaagtgtggccactgtgcaatgggtgtgcagaggtgaacttgggagacgacattaaacaggagggaaggaagagctttctgcttctagtgatgaaaggttgctttatctataaattccataagatcaacactgcaagttcacacgttcttatataaaatgctttgggccagag

SEQ ID NO: 34827 - DNA, 2482 bp, Bovine  19866880728840
aggaccaagtgctgtccatctttctgttctgccatcctcactcttaagctgtcattctcaaggaccaaaattgatgctgaagctccggctatcacatctgaattttagacaataggaaacagacaaaaatggcaaagcaggcagcacccagatgaattatctccctttagcagccctcctggaaaaggcaatggcaccccactccagcactcttgcctgggaaatcccatggacggaggagcctggtaggctgcagtccatggggttgctaggagtcggacaagactgagcaacttcactttcacttttcactttcatgcattagagaaggaaatggcaacccactccagtgttcttgcctggagaatcccagggacggggaagcctggtgggctgccgtctatggggtcgcacagagtcagacacaactgaagcgacttagcagcagcagcagcagcagccctcctgggaggccacccccaacatgtctacctatatctcactgatcagtgcttagtcacagagtcatatgcaggtgcacgggatgctgagaaatttcgtgttctccccttgggcacattgcccccactgctaaaagataagcaaaatggatatttggggcaagcaactagcagattctgctacattcctatatacccagctgctacatcttgatggaagaccagcagacagaaagaatctaaagacatcatctctgctctctaagtacccacaatctgattgaagactaagacaaatgcagttgagataaatggcactatccagcaggactgaaatggactacacgtcatggtgcagtcttggcagggtaagttttatgccgaaaagaaggcagttagctattgagcacttactgtatactgggtgctatgctggtcactttatgtatttttacatcttagtgttcacagcgaccactgaaaggaattattattatttcagttttgcagaagaaacctggaagggttatgtttaatgtgtccagggccacacagccaatgaggatttagaacaggatggcagatttgccaaggcgagggttgcttgcctgctctagtccattagtggtagctgcctggggaaggcagtggctctgtggaggaggattccaagaatgggtctgagctcattgagaaaggccgtgattgattagctatgtctgccatggacacggtaatggggagtggtggcacgagtgacatgcatttcacagtcctgctttcgagacttctggtggtcagtttacctatggaaatgctgcgctggcactcggatgtctacatgtgcacagagggtgggagcggggcacacactgccattaagtgagatggtctcaggtgtgctgccaagaatcccttctggctcccctgctttcagaaagtgggagctctgagactttctaagatgaagaccacctctaagcctccagaatctgaagctgtggttaggaagctaatgtgtcctttaggggaatgtggcgtggaggaatgaaggtgcacatctcagagttttagcggctgctgccgaataaataaaaatagctgtaagtacttctgcagctcttctattcaaggagaaaagtggctaccctgtgggtaacagatggactttctcccttgcttgtggaaggtaagcactcagtttaaaatcacaggtaaaagccctgtcattcccccggcactgggtctccaactgaccgcttagcacagagcaaatcacgtctctcaccaggcgaaggagccatccagtgtggccgagtctgcctcctgtgtgtctcaggtttgttcccccttcttcactcttaagctcagtccttcgtctactcttgctaggatccccaaggggccccaatccatgccacctttccctctgccacaatgactggcctggatcactcccctttatgtgtcactgctgtctctgaaacacttggcaggttccctatctccttctgggcactgcctgagctcccagcacagcagacaagggcctgcttccccagcctgcactggacatgggctgctctaggccagccagtaagatcgtgccctgattctctagctgctctgtaaggcatctatgacccaggcctaagccagtcagctcattccctcactcccctggccacagacaatggttcaagaaagagcacatgaccccctaggatgcagtgaggcttttgttgggatgaacgggcaagcgattcttactcctctctcactggctaacagttgatcgtattagagctgctacagctgacttgacccatgagaagagagtccgtctgagaatgtgtccccagagaataaagcagggagctgtcgagagcaggtggacctcgtgtgaggccctgatcaacctgtgcctgaagctggagtaccccagaactggtcagttacagggagtagtaagttcccttcctgtttagcccattgggtgacttttctgtcacttcccgggg

SEQ ID NO: 34828 - DNA, 1185 bp, Bovine  19866880730580
taaaattaattaaaaaaacaaatgtaagattatgaaaataacattaaagtaagaatatgcctagaaatgtacttggaaaagatacacaagaaactgacagttatctctggtaagaaaactgtcatggggcagggggtgaggtgggggaagaggactaatttacccattacttacactcatacaggacttgatcccctccctcatatgaacatactaccttaaaaactgaacatataacaaattgcttgtatgttaattacacatacactacactgcctgtgcagacatacacacttgtatagatttctaatcagaaagtcattagaactgaacaaaactagatgcctttatacagatgctggacaagctcaaacaagagtccagatgtaggtttggcaagtatctggcatcatttttctacccaggggtggcacccagagccatttatcagagcagtgtgggaccaggcttttctcatctgtggagaaggaagcctttgccctaaaaaatgagaaggttggattctcttctgtattcttcttaactgtccctgatatcagacacccatgtgtgtcttggcttcagccgttagcaagtccttctcaaagaggttttctgtgtctgtgtgttcagtgctctctcccagggatctgtgtttaggctaaagaacctccttcttctctaatttctgacattaacttgggttttcaattttatgcaggtctaccgaagctcagtttacagctcaacacgatcaaacaaaattactggttgttattaggataaaactcccatgcctggtccatttattccacaattaaattctctggtgcatggtagattaaaagtaaacatcagaatgtacgtgggatagctatttgtggaatactgccataatatctcagaggaaatggtaaaaacccgtggaaggatgagatgaactcttggtcatgtagcttttcttaggatttcaatgcattacaatttattgtttattgagaacccgagtggttacttcatttccaagaacccaggtgtacacgtcactgacatttttccccctagactagggttccacctcctaaagggaaaataatcaccatgcatcatgtaaagtttatctcaaccagaagtgtaggcagacactgcagaaatttttgtgcttacctgccaagcacaaaacat

SEQ ID NO: 34829 - DNA, 1372 bp, Bovine  19866880746559
accctgcagcagaaggacacagctaggttgcacccagatttctgatgggaaatgggagataatgtgacttagctgcctcaaactgccaagttcctggggtaacttgttaacatacatcaggacttccctggtggtccagtggttaagaatctacctgccaaggcaggggatccctggtctgggaagataccacatgccacagagcaactaagcccgtttgccacagctactgagcctgtgctgtagagtctgggaaccggaactactgagcccacgtgctgcaacccctgaagcctgtgcaccctagggctctgcaacaagagaagccaccacaatgagaagtctgcgcaccacaacagagagaagcacccatatgccgtatctagagaaggcccgagagcagcgacaaagacccagtgcagccaataagaaaaataataaaattcattttaaaaatatctgttacacagatcagatgtagaggtccaggaaggagtcagcaacacttcttcacaagttgaaggttggtgtcctgaaaaaaactgagattttgacttgtgttttaaagttcattgttggcactgttcattcattctacttaaatggtaacctttttgtgctgatgaatgcttttcactgcttttcctgtttctgaagcagtttgcaaagtggtttaaactggataaattaaacagggagggggatgatcctcatctgaaggttggggcataaatcaatctgctacaacaaataaaatttataaacagttttctacagtaacattttaacaaacatagttttctatgacaaatagtcatagtcctggaaagtcagtagtctttggaggtattaaatttttcattgttactcgtttacttagtaaaagcttagaatctcaaatttatgatgacaaggtgtgaaataaacagatttgatctaaaataaaggaaagctcacatgtcactgttccatctaccttatccttctcataaaggcaatccgttgattcagggctctgcgttctcaaaagcacctggagcctcttaaagttcctgccacagaagtctgtgtggtctttggtctcgattttaatcaaggctgaattaaagatacttgaggctggtaatgtctctgcttttgaatatgctatctaggttggtcataactttccttccaaggagtaagcgtcttctaatttcatggctgcagtcaccatctgcagtgattttggagcccagaaaaataaagtctgacactgtttccactgtttccccatctatttcccatgaagtgatgggaccggatgccatgatctttgtcttctgaatgctgagctttaagccgactttttcactctcctctttcaccttca

SEQ ID NO: 34830 - DNA, 1656 bp, Bovine  19866880752334
cactgatctcgctcgcaggcaacaagagcaatgatgtcagggggtgggacaccaactttcacatcagacacctaggatctttcctgcccgtcaatgctggaacacagggaggttgtgagaccctcttcacagtcacaggaggtggggagagggcacccaaacaaacactgaatcaaccaggccaaccaaccgagcagtcagcccatgaatggaccgtggtgcttcctcagtgggtcaggcagttacttcctcctgaccccctttcaagcttgagcttccgatgagcatgtcagccccctagatcgccgccccaggcccagagtccaaaggaatccggggacacgaatgctggtctctacacttggcgggtctgtcgacatctgtacaagtggacaccttatcctggtttccctgaagggacagaagctcccaagccctttccccctggccagaacccttcacccttcctagctcagtgactcttcattcattcagcaaccagagatgtccctgtcccaggagaattttaaatactttcattctaggactatttagctaaagtcaccacttggcaacaaacagtcagtgagaatagagatcgaagagagcctctgccacccagagactcagaattcgccagctcctgagagtaaggggcttgttcctctctccacttgggctttctaccaacagccaattctggtctcatgaccccacagaatgagggtccacagatgggcgtggtggtggcagagaccctccgggtgttagaggaaccactgaccgaaaccacccaccctggccaggtgccatagtaactcacctgcatgagttatcttaagcaggaggtcctgggaaggaacatggaactaacaagctaccaccaaccagaagaattcaggaaagatcaaaaggaaagagaagacaccagcccacaagtcccaccaacctcccagaaggcttcccactggaatccttcttggctaagtgatgcgcacgccaccaggaaggtcccagagtcggagagactggccagagacgacccagagactaaccgcatcatgtgattctagcagtccactgcatcgatattatcccatttctcagcacaatgttggatgtgatactctcttctgttttaaatattctccaaatccaagagtacaattgttttcttattcttcacattatatgtgttttctctcttaccacaggtttctcattaaatgatacctttcaaagaaccacgtcttagggttctatatcaattacaatgtggtttaaccattttacgatttgtttgttggtgggggaggtggtggggcagtggccactggttgttttgccaacatctgtctaacacactagggccgtgtctgaaaagtcctctaggcaaccaatgtcggagatacacatcaacgccatcagccttacctcgatgagctttctttcataggagcttgcgagttcctcggcaacttctccgggtttctgctcagggactgtaacttctccatcaatgttccaaagatttgggacaacttttgggaaaagaaagacttctgtaagtaacttaatcaactataatttcctcaattaaattttttttctgtagaatttttttcgaagaaaaaaattgtttttcttcttttccaa

SEQ ID NO: 34831 - DNA, 1005 bp, Bovine  19866880752395
cccatatgacttaaggctttgggtgttcagagcctcagaccgtaggcactgacactgctcgtggggtcttagcagcagaggtctaatgaaggaataatggtctgcaccatgacgagcttcattccctccagatcaaaccagtcctaacggcaaccttgtaagaagtcctcctagcatgctgtcagatgatggcagattaaaacactgtgtctttatttacaggagacggtggtgtgtcagagcatttgactgaaaagaccatgtttccaaataaacttggtagctagctagggctgacctaaagccagcaaagtaaacagcaaggaaaggcagaaaaggatccagtcgtttggacgaatcatgtaatcaaatgacttcccaggtggcgcaatggtaaagaatctgcctgccaatataggagacacaagagactctggttcgatccctgggtcaggtagatcccctggagtaggaaatggtgatctacactccaggattcttgcctggaaaattccatggatgaaggagctgtgcaggctacagtccatggggcctcaaagagctggacatgactgagcacagacacacatgtaatcaaataccctgtttcatcacagggctccctgctatttttctgtgtaagcttttggaatattctaagaggtggaaggtcaaagaaagagaaaacagagcccctttctaaacctcacatttccacttcctgcaggaaaaaaggacaagcaccactgcctggtccggcatagtgttgtgaggatgacggaaaccaagccaggacatcactctctaactgctccagcgaggtctgccaccggccctgtgatttatgaccttgtctgatcctctaaacaagccaggaacatagataccatctcctctggcttccagataaggaagcagacactcagtgacatctaggaccttgcccatggcaaaggtaatagctcgtaaatgacacttagttttaaatccaggtctgcctcgctc

SEQ ID NO: 34832 - DNA, 1114 bp, Bovine  19866880910761
cactgctcatttgaaaatgacactaattgctattttaaaaacatgctgctaagtcgcttcagtcatgtccgactctgtgcaaccccatagatggcagcccgccaggctcccgtccctgggattctccaaggcaagaaacactggagtgggttgccatttccttctccaatgcatgaaagtgaaagtgaagtcactcagtcgtgtccgactcttaagtaccccatggactgcagtctaccaggctcctccgtctgtgggattttccaggcaagagtactggggtggggtgccattgccttctccgattttaaaacatgactccccccaaaaaaccagctataatattttgacttcataagcttaaacagacacagctgtttcccctgtacctgtggctccttttggaaatatcacagtggggttttccaacaagattttgaattttcagtttgaaggtgacctacagtgctctgttttgggtgcccagcattcctggcctgggtgcccagcacagggcccaagctatttgctgagtggacagatgctgacttaactttgggaatcagcagcacacacttacgcatgccagattcgcaatttataaatatttaccattaggatttgattttaactttaattagcccaactgttaaggatacctctgaagtgagaaatgtaatccattacttcgcaccagatgtagcttccgcagttggtcttttatctcggtttatggtgagggagacacagacatcaaatgactaaagcatgaggttttacggtgaactgatggaaacataaagcagaccaacctggaagatgaattcaagaccaaatgtaaattaaagaggctgaaaagtcctcaggctgatatgcccccggaaactgaattctacagatgctcaaaaaaaggactgcttgttgagttcttactctaaagtcagttaaaaaaagaaccattaagatagcttgtttttgttttagggcattaaaaacagaaagctctgtttgatgatggccgttgcctgtggatccctttcctggattcagaaaaatctgactatgagattacaccttctaaattggtgtgtttaccagcgcattaactggtgga

SEQ ID NO: 34833 - DNA, 1038 bp, Bovine  19866880928211
gcaggacttagaaatcaagtgtaactgcacagcccgcgatatcaactatgtcttgctgcctcacttttatcttctctccgagaacctcggtcaaggccaacgaaattccatgactgtccgacccccagcccaggaacgcctctctcacaggagcccctggaagccccacgtgcgggaggtgcggttgctattgcgatccccagcccccggggtgcagcccccactggggtccggctggaggtgcacatcccaacctaacgttcccctcgccgaatgttccgcagccctgaaaccacccactccccagcaggaagtacctgaggaaaaggcgtccagggtcctgccccgcgctctgtggaaaacaccccccgcctctgcagccgacatggctagcgagtattttggcctcaactgagtctgctgcgtagcaaggagctatgagactcttaactgcccaagcgccgggtggggcctgcccggctgggggctgcgccctctgcttggggcggggcggggccggcgggcgcgcaggactcggtcgctcggggcgccactagtgctgtctgagcggggcggaagcgtgagcggcccctgtggaatcgactggggttcctggcgagtggaggccacttgccagtcgcttgcgtgggcagacggagtgaatttggcctcaggcatgtgggcagaccttcgctaaaggtgggggctccaggtttaacaactaaagctgagccccggtctcccgcattcctggcgggttctttaccctctgagccaccagagaatcccaagattgccaccagggaatcccaagattacaggacactcggttaaattggaatttcagataagcaatgaatgataagtatgtcgtatgtaatttgcaagatgctggtactaaaatgtttgtagttgtttatctgaaacagcaatttaaggggacttgtattgtatctggtccaaaggacccagccctgtccttgggggataagacagtaccttccaccagccacctgctgtgattgctgacatttcatt

SEQ ID NO: 34834 - DNA, 785 bp, Bovine  19866881041244
tttctgttttaaatggtcagtatcttagtctgttcatgctgctatgacataagaccacagatcaggtagttcataaaaaaagcaaatttatttttcacagtctgggggctggaggtttgagatcaggatgccagcatagttgggtgaggacccttttttgggtcacagacctctcatagtgtccttacatgacagaaagggtgagggatctctgtagggtcttttttataagaatgctaatcccagtcatgatggctttaccttcatgacctaaccacctcccaagggtcccacctcctaataccatcatattaggcattaggatttcaaatgtatacattttagagggatataaacattcagaccatactgtgggaaaaaattaaaaggatgataatctttgagacatgagaaattcacatttcagtattcatatataaagttttattgggacacaaccacttatgtatttgtctctggttgctttcaggtgacaatggcagagttgagtaattgtgacagagatgttatggtctgcaaagcctaaaatatttgccatgtgtctctctgcaaaaaatgttgaccactgatctatgtgatctttggggctcatgacttgtacagtcagggcaagaagaatattcacagcatcttactttgaaatttattgcttccattatactttgagttgtggaaagctttacttaggcaagaatggtcagttaattaaacatttctagagttcttgagttggaggtttaaaatatgcaaaatctatcctgcca

SEQ ID NO: 34835 - DNA, 1002 bp, Bovine  19866881079271
ccccagaggctggagatgctaagggagcaatcttgttgctgcccatctaattgcccagggaaaccttggtgaaggaggaggccgcagctctgctaatgccttctgagtggtccctggggcttcacttcctccaggtgactcccatttaggccagccttaatgggtcccctgtcgagaagcccttgtgggggctgtgcagttaaaagtgcctcattcaaataatcaccatcagaaacaaacaaacaaaaaaatggcctctgggctgagaaggtgagctcaggctgtcagtttcaggcaagcctggaacaaggcagctgctcagcctcttctttcccaggctcttcttacctccctttccctgggggacaatgcacagtgcttagtagcaacccaggatcagatttcagaacaggcctctgatagcaggcgggagtgaggaacagtgaagaatctggagttttccccccagggaggctccagattaatacttgtggttcacttactgggtaccaggtgctttccaggtggctgagtgtgttggatgagcatcatggtggaggcctgctctcaggatactgatgtctggagcagggagacagaggctaagggaaccaatgagtaattgaagtgatttcagagagtgaagagaatgcgtccgtggatgtggcttggcctggagtgaaggccgtgaggaagagcaaaattaaagagtgattaagaaatgcttcttggacttctttagtagttcagtggttaagaatctgcctgccaatgcaggtgacaggggtttgatccctggtcgggaaggttccacatgccacagggcagctaagcccgtgcatcacgattactgagcctgtgctctagagcccacgctctgcaacgagagaagccaccacgcgagaagcgtgagcaccacatcaaagagtagccccctgcttgctgcaactagagaaagcctgagcgcagcaacgaagacccagcacagccaaaaataaagaa

SEQ ID NO: 34836 - DNA, 666 bp, Bovine  19866881100461
ctgactcattggacaagaccctgatgctgggaatgattgaaggcaagaggagaagagggcaacagaggataagatggttggatggcatcagtgactccatggacatgaatttgagcaagctctgggagatggtgaaagacagggaagtcttcagtttagtgacggaacaacatcagcccccacagtggaagcacagagtattaaccatcggaccgccagggaggtccagctgtgatactcaggagagtcctcactcatactgtctggaggggctgccagagtccctagcccttccttccccctcctccccaactcagaacttttgctggctaagttaccgacagctctctgcgttttgtttatcagaaagcaactctgtctcacagcatccttcatggcaaatttttttcgccatcagcatcctgctttttctgccgcttccgttgacgcaggtacattttacctctgtacccggcgaaactcagacctgagtacatcctgccttcccgacgtgactcacaggttccatttctgtgctgaaaacccagcttctccagggcaagctgtcagcctcctttacagcgacaagtccttcttaaaagtttctttctccttcacagaacctttaaaatacccgatccaacttctcgggtcatacagacagct

SEQ ID NO: 34837 - DNA, 1568 bp, Bovine  19866881128370
cttccaattgcctcgtctttaaaatggagtgaacccaccagcctgctttcctcgcagggcacagcgagtgtggcgtttgcaggggtcagcgttggaggcttggctcggctccgagctggcctcggctcgtctgtctcctgtgactctcttgctgtgtctctgctcgggggacgttcggccctccagcagggttcccgaggcaggagagcggtggacgtgttatctgtttacttgtggtcagtcaggcccggccctctccaatttaatatctcttgccgcccaccgtggcgcctgtgtattcgtctgattaaagactaattttctagctcccaaggtggaacttggcataggttttcttcttgtctccagaggagtgggttttacacagatgcctcagaccataagctgtgaggagcccagaggcaagctttcagggtgccccccaccccggcccgctgcggcccaccatgaggatgaagatgaggaggggagggtgtcccggtgagggggcggctgtgcgggctggccggcttaactccctggtgtctgcagggcttagcacaggcccaccgtcacttccccccaggcctgttagacacaggccccgagcccctggaagacaggctggcagcctgggagagtaaacctgattaggaatagaaaagagcattttccccagggttttaataattggaacgtgtgcagggatgcctggaaagagatactgaagcatcgtccacagcacgctcgtcctcttgggatagtttgcctgggcggatggggagggggacatccacctccacccccatcctccccccacccccggatccccgcagtgacctttttctgcacttggagcaaaagcaaattcctgtcatggcctttaacacccgcgtggccttgatctctgtcccgccacacgacccttcgggatgccaggcagacccttccttctgtttggaagctctcctccccaccctctgcccagctgaggccccttactttatcacctccaatttcacctttttctgcctcagcttcacctggccacgccccatcacgagcttcccttacccttcccggcatccgtggtgaggatttcacccagctggtaggagcgctgagagggattcctgcgccccagctgctggggttctgcctcccctcctgcctgtggcatcaggagcagcctcggcaggtgaactggggcctgagccagaagggcgtgtgctgtgggctcaggctgagcctggttctctgtgtggccccccgccatgtgaccttgggggctcctctttcctctctgaggggcgccctgcaggtgggattagggagcctgcccgctgctccttctagtgtctgggctcttgccctgtgttcccatcaggaggcccgctgctggctctctctgttttccggccttccaccctccctccctcagctggttcttgaagggggtttagtgtctcccggggggagtcgatgcagcccaggagttggaactctcacctccaggagcacccagagaacaccatcatctttcctcactccgcctgcaggtacgagtt

SEQ ID NO: 34838 - DNA, 647 bp, Bovine  19866881128624
gcgcacagggaaaaatctgcctgcagagatcccatccgacaggccaaatagtaccttggaacgtgaaaatgtgtatcggcagcttgctaaccaaatttcaaattaagtaccgcaggcccgggggacagattcgcagacagcgagctggaaacacaagagctgcagcctgggggccagccgtcccgagcaacgtctgccagcccgggccaatcggcaaagaggaagcaacagtttctgtaaaacatctccaaacgcactgaacaccaagaaaactgaagcgacaggaaagaaagagagggggtgggaggagagagagaggaaaggaaaagaaacaggtggaaagaaggaagggagagggaggaagacaggcagagagggagggaggaagaaagaaaaggagaggagagagagaggagaggagagaaggaagagacccagggagggtgggggagagacagcaaagacagagaagacgaggaggaagggaggaaaagaagagaggacgagagagagagagcaggcctgctttccgtcacctgcaagatctgatggggtaaactgctcagaagaatgaagaaaaaagacagcaggagagggagaggttctgagggaaataaagacaccgagccagagggacccaggcagac

SEQ ID NO: 34839 - DNA, 721 bp, Bovine  19866881232414
atcaggcctagggatttagcttcaacctccaaaattaagaatgtgttttctctctctgggcaactacggttaagcctgcagcccgacaccccctaaaatacatttcattccagggcttttagaattctttgaagaaacagtaaaagacagccacactttcaatgatttccatgtcaaaatctgcagaaaaaggaaaggactttacatccaattgttcttaatgctttaacagaacattccctgagaaacctcctcccagcagtttaaccttcaacgtgaaaggaaattgtctccatgattcaaactcgaggaaggcagaacagaactggaacgcatcagacaaatagccttctgtttttcttcgatttaaagctccacaatttgtcttcctgtcacaatgccttgccacataaaacatcatgaagaagctgctttcaccataaagatttggacgaaaggcaaaatatggggcattttcggcatgtgttacaacctgagatgagcccggccgagaagtttagacggggagcaagatggagcattcagacagttctggaagatgaaatgtccttcctggcagccaaaaatgaaggactcggcccctttttaaactgtcaacttcgttgactaaaagcagccatggcggggaccaaaaaaccctacagcgagagacagaacaagagacagttcttgcacgagtcacaattgcacaggacaaaaa

SEQ ID NO: 34840 - DNA, 1038 bp, Bovine  19866881245868
aggtgtctcgaagggttgagggacagaccaggtggcttccactccaagacggagtggggcgcgatctgatcaggattgtccctcccaggtgcccgggggctgcctggccctttcccgggccatgccctccaacccgaggctctcccgcccccgccacccccggctgggtggactcccggggcccaggcgaggaccaaggcagagctgggagggagcctgggcccggcgtaggcacccccgggagaggggctcgggatgaactaaagtcaaagaaacgcagggaaggtgaggcgatgacctggccccagaacgtctttccttgggacgctctcccaggaccctggacctgctacttggtccctcttcgccgaggccgccttccccgcgctccacaggagggccacaccgcggcgccgcctctgcgcgcccagatctggtgcagcgcaaggcctgggcgcccagactcggctgccctccggtacctgcagccctcgcgcatcgttctccgggagccggctggcccctgtccccaccgactcccaccaccaccaccccggatatcctcaccggagctgccgaacccggccttgcttcctcggctccaagtctcccgtcgtcagtgtttccaaatctgccctagctcacatcagccgattccagccagccgtcggccctctcccatttctcccacttcttcctctcctcggcttgaatttgactccaggagcccctaaaacaagaattgtaccaaagctgctacaccaaatttagatccccacacgcccctgcgttttgttttttaattgcattaactaagtatacactttgcagtcggctaggcgatttgccggcaaatgtttccaccacccctcttctccatttggctgcagtcaagggcttctcagggtatttccgaagaatcaaaaggttgggccacagagaaggtgacatactagggtgggggtctccttaattgaaaaatcatggggttttaatgggactgttttgcaaattttctcagcatgagagggggtttgg

SEQ ID NO: 34841 - DNA, 1993 bp, Bovine  19866881283261
aaacagtctccaatgcaggaggatcattctcactcacctccttgtgtgactatgccactcgaggttccacttccccagcctccatttcccaccgtgcactaaaatctccaagggctgggagttctttcccccttctcctgtacgtgattaatgagacttaaattggtgcagtgatagatgagttatcctaaaggcatcgaatatttaaaactgaatccctcctttgacaaaaatagtccgtgagtttcaagagctgctgtcctgctgtccctgttagcgagcacgtgatgtctacgggcgctgaatgaattcctgctaagcgctcaccaacgccaagggccgagatacgtttttctccttttgctgtccctatgaaggcaaagcgtgtgctttccatctttatcttaagtgaccagacttgtttacagctgctccaaataattatgtctgaccacatcgcgtcgagcacaccccagaccgtgcactcctctgattaagggtttctaaacggaattcttccctggaaacgagtctaaagtggatttcttcccttgaacaagctactgtcccagatatccatgtggtcctgggagaatttttgtaccacatcacgcttccttggtatacaaccttccatctttcttctgggtgtctgcttcccctgtacccacatgaacttgctcatccttgaagttcttctggattcctcatcatgaacccaagtccagagaaaagaaaaagtgagtgttaggcactcagtggtgtctgactctttgtggccccatggactgtagcccgatgggctcttctgtccatgggattctccaggcaagaacgctggagtgggttgccatgtccttctccagtccagagaaaagtgacttccattctggggccactctggattactgtgaactcctctcttgtctgaacctctggactgattgacggaaatagcaaatacttgagctttcaaagtcctagggtctccatcataactactcaactctgcccttggagcacaaacagccatagacaatacatgaacaaatgagcatgtcggtgtcctaataaaactttatttataacattagcagcaagcaggatttggcttatggactgtagtttgcagactcctgccccagagacctgcagtggccattctcagtgccctgctgagatcccttttaccagctgctgatggctcccagctgccttcttctccactttggccagcagagccttctctactaaaaagttattcacccctacgcccatccaatggggtggccaggatcagtgaatgggtgacttaggggaaagtacagaaagccagccacctgttttaaggcagaaaccattctgtggtacaactgatgctccagagttccctctgggatcaggcagaaaagtcggtctccaatcaagtccaatgcttgcttagctttgtctctttcccaatcttgcttcctcatcccccttctcctaagagcctcccttggtaaattaaatcctcccaaacccctgtctcaggctttgctgctaggaaactcaacttgagataagacattaaaacccatcctggctccctactggtctcgactttctctcttggctgtcttatgcttcctaggtttatctttcccagtacgactgtgagattcttagagggtgaggagtgaaatggaggctgcgtcttcagcacatagtataggacaaagaatgcaggctttttatgttaccaggcctgggttgaaattctggctctgtcactgactcggtttgtgacctaatgacaataacagttaacagtggcagtgataccggtgacagcaggtgccacacagtgggaagtgtgctgtgtggcaggcactctgctaagctgttcttggtagtggtgtctgcattctcccagcactgctataaggacccctagcctcagagactgcccaggtcacccattcaatggatgagagtaaggatagctaccttg

SEQ ID NO: 34842 - DNA, 1827 bp, Bovine  19866881354221
ctgtgtcccctgcccggacagaggtctattgggaggattaacgagatgttgggtgaaaagtccttcaagtcctgcccttccaggcctccctccacccactctgcctcagtgtctgctcttacttgggacggaaccgggaggcatgatgggggttcaaaactcctggacttcccaggaggtggggaatagacccagaaacttccagtaccaaatgccagactcctggttcctgttccatcccaagaagaggctcccgctcttcccacctgagtctcatctctgggccaaccgggaatgtcgcagagcctagaagtccataccagtacccagcagagtggagagtcaattgtatgtccttactttgagacagactttagcctcttgcctgatgtccctttgtaatttatcaaatggtcattgcctcagtgccttttcaggatgcaaataccaaggtctttctttattgtaatggaatgagatcccttttaccagaaatgagaagggtctgaacacaattgctctgcttgctaacagtctctttcaaaatctttatttctggtcccctttggcatctttgctcacctaaaaatcctcatttggtcacattttctgtgactcgggacattaacaataaacgacgagcactcgggggcctggggtggagaatggatgggattcgctggtggtggagaaacccagctgtccacagcccgccgacgcccgttctgaaagctctgctggccacttgtacggtctctgttaatgctcctgtctctgcaaatgccaataagtacagcgtgaaatttaaacataagtgagtttttacagctaattatggctaatgcaagctgctttcaaaattgccaagcattccttctagaatagtacagtttgcaactaggaattaggcattaagagccaaatttcataaacataatttagcagacaacaaaataataatactaagtgctttccgactggccattaggagctccccaaggtgggtctaattgcacacactcccactgggacttccgacagcacagaccataaggctcggaaaccccaggagcgcagtggagcaggcaggcattttcacagccctccagcctgcgtggtcaggagctgttcacgtgctcagtgatacggttccagctgcagcttttagccacacggctctgtccctcctgtcctcctttcctggtccatgtcacctcgatgttggcttgggatcgccaggtcaagtcatcactgcaaacattacaataatgaaaacataaaaagtggtgcctccccccttgctaaccccgccccccactagcctggctgtgaaaccacccgtgtgagtttagtgtgtttgtcccccattaagctgaggatacaaacacacgcacacacacgctctcaaacggacattgcctttttcttttttagttggagagtaattgctttacagtgttgtgttggtttctgccataaagcaacgggagtcagctgtgtgtgtgtgtgtgtgtgtgtgtgtgtacatatatacagaactctttctcttgagcctccctcccacccttctaggtcaccacagagcaccaggttgagctccctgtgttatagcaacttcccactaggtatctgttttacatatggacgttgtctttattttacaaaaacaagaccacacaacttttttacatcttgctgttcatacttaataatatatttggtgcctttcaacactggtgtatgtaaatctacctctttttttttttttaagaaaaatacatgtactataatttatccagtctcctgtaaataatattataaataatg

SEQ ID NO: 34843 - DNA, 2969 bp, Bovine  19866881370486
gaggcttgtttctgacgcctggcccgtagtaagtagatcttcaccaaatgttagctgttagtattatggtcgttacgggcttcccaggtggtgccagtggtaaagaacacacctgccagtgcaggagactatccctgggtcgggaagatcccctagagaaggaaatggcaagctagtcaatcttaaaggaagtcagccctgaaggttcactggaaagactgatgctaaagcggaagctccaatactttggccacctgatgcaaagagccaacccattggagaagaacttgatgctgggaaagattgagggcaggaggagaaggggcaacagaaggtgagatggttgcatagcatcactggctcagtggacatgaggttgagcaagttctgggagatggtgaaagacagggaagcctggtgtgctgcagtccatggggtcgcaaagcatcggacacaactgagcatctgaacaacaacaaccatcgtgaccagccttcgagtcccaggtcaggcacaaccaaagaactggaagaagttgaggatgtgcttaggtcaaagccaccccctccaggaagccttcttactgtgccccagcaccacccatgatccgtggcactttgtacctccagggcggtagacagagcagctacttctgagtcagtctgatccaggtacaaattctagctgtgtgaccctgggcaagttccttgacctctctgtgcctgatcccgtcatctgttaaaagtggacattatcttcctcgagggggtccttaggaagcttaactgagatgatgcacgtgcagagtgctcagctcagagcagatgctcagtaaataaaatggctaaactgtgttattttcactttctgcattttattatgaaagcacttacagtgctacccagctgtagactttaagctcttgattgctagaaacggttgatctgggtgccccccctaggctccaccaacacctggattcgagagggagctctgcaaatgttcattgccttgaatcgcctgaagaaacagcatcctaccccacccaaagaaccaggagcaggccatttcctttctccacggtccctagcagacttgggtcgcggacatttgggcatctgaaaagatacctgccagtgaaattctgagagctcttgtactggaatctagaaatcccaaattggcaactcaatgtcataatttaatatgaagtatgtcatgctggggcttccctggttcttcagatggtaaataatctgcccacaatgtgggagacccaggttcaattcctggttggaaagattccctggagaagggaatggcaacccactctggtattcttatattctgatatctcccctgatgctatctcagccgtcccaggccactggcttcccgcagtgatcatcatctccaggcctacatctgagctgcctgctgagaaatggcttacctacaagagggattatttatacctgttttctgtatgtttagaatcccatggacggaggagcttggtgggctacagtccatggggtctcaaagagtcagacacgactgagcgacatcactttcactttctgtatgtttgggcttccttgtggctcagctagtaaaaactctgtcagcaatgcgggagacctgggttcgatccctgggttaggaagatcccctggagaaaggaaagactacccactccagtattctggcctggagaattccatggactgtatagtccatggggtcacagagtcggacacgactgagcgactttcacttcacttcacttctgtatgttcaaaccaaccttcctttatttctcttgcccttttctttgtttatgaggcccatttttcccccttaccactgagacagaataaattgagtgtgactaaggatttgtgacaccattttcactgtgacagctggcaacataaagatgcacagcattttcataaacatgtactcaggcaggataaaagtaaaaagtgcccaaggagaatctgtttacactctccaagcctacgtaacaccgaaagcattaaggaagtccatttttaataccaaaattgttaccggggtgcatccctgatttcctgattgattcgaggcaagtttctgatattaatgagaatattaaattatatggaggttgcctcctaatcctctgattgatttgaaatgaacttgaatcagggcagcttaaaaatagcctttatagcatctttatgacctgataccatggagaaataaatacgaagctaatgccacggaaggcttcctcctgatgtaggggctgtcttggccaggagttcttcctctggtggtaatttaagaagatgcttgtcatcgccttacagcagttcataattcaaaaacaatctatacataatactcaattaaggaaccacagagccatgtcggccacagatgactgatgaacggccgaatggaaattctgcccaactctagaaaacaccgctaaaatcaatccccttgtcagggaaaccatgatttattaacacattccttaacctgcatcgaattgtgaatcaatgtgtccccatcaaaagctaataccaaaccgagatggctcggacttcatacaggtcctggtggcagaagtaactcagacaaggctgcacattaccaggccaagctggttgtgtctgtgtccctctccaggaggggcctctcgggagagatggggagcactcactgtttaccgagtgctccacggacagaggagcctggtgggctacagtccatggggtcgcaaaagggtcggcatctatgcccttatccaaacttctctgtcactgatgagacaggtgtcattattctcttacaggtgaggaagtcgaggttcaccaaggtcagtaagtggccccaagatccccaagggcagaacccaagtctgcaggcttggactctggcatctgagtacctgggttctgatcctggctgcc

SEQ ID NO: 34844 - DNA, 1396 bp, Bovine  19866881426633
aaataagatacagaattagcctggtgatgctcatcatgcaggcagccataagaagtctgggaaacagaatttccagttaattgagatttctagtgaatagaattggagaaggcaatggcaccccactccagtactcttgcctggaaaatcccatgggcagaggagcctggtaggctgcagtccatgaggtcgctaagagtctgacacaactgagcgacttcactttcacttttcactttcatgcattggagaaggaaatggcaacccactccagtgttcttgcctggagaatcccagggatggggagcctgatgggctgccatctatggggtcgcacagagtcggacacgactgaatcgacttagcagcagcaatagcatgccactttaagagaactggtgccctagtgaattgggctgcttcccaggtggcgctatagaatctgtctgccaatgcaggagacctgggctcaatccctgggttgggaagatctcctggagaaggaaatgcaacccactcctgtattcttgcctggagaatcccacggacagaggagcctggtgggctacagtccaatggatcacagagtcgtacacgacctggcaactgaacaacaacaaacgtagtgacttgttatgtagtgggggtttataagacacacttgggaatccttgatagtgcaggtttgaggctttcagaagttgagctgttgcattgctccttctggcccagcgttacaactttgaggttcagtactgtttacgagtgtgttccttttcagttgttaatatttttttaaaaaaaaaaacttctcactttgaaatgggctggcattcgaaagctgtgtgagcagtctgagcatttggcttgtttttaatcctgggattttcttattttgggcagtgaaattcacatggagtgtgtttattcatgcttccttgactcacttctcccacgactgttcttgaatttgcatcgccaccgtatgaatgaatcaagaatctgtcaggtttggtcttttgaggaacagataaggagagctgatcaggactttccaagaagcattagcttctcattaagtggaaaatacatggttttacacggaagcgagtgtggatagaataggccgtgtttttgctttggagtcatgatcactccgtctgccttgcaaaatgtgccttttctgggtaattgtcctaaagcatagagtagcttgaatgacactccacctgcaaacaccttttccctatcacaccgtgctttctggttatcaggtggtgcgataggactcgtcaagccactcagctgtgtggcgcggaaagtggctctcatttttttgtctcaggtcaactcgcttctgtttaagaaacagcaagaataatctgtgcagtcaaaa

SEQ ID NO: 34845 - DNA, 697 bp, Bovine  19866881542598
cgggttaatccctgggtcgggaagattccctggagaaggaaatgacaaccactgcagtgttcttggctggagaatcccagggacagaggagcctggcgggctacagtctctaaggtcgcaaagagtcagacacgactgagcacacagtacagttagctgaccttgaagcttaagtgttggttcttcgctcatctcctagcccctctgatggtaaccaatgtgccacgaactcagctcagagctgataaatggtcctcctcacccagcaatccatttctctgggaagttgctgaaacctcccaggctgcctggacattcatttttaaagccccagtaactccatcaggtaatgaaagatgttgagagaaattagagaagcagagaaagcaacagcaaagtttcaaccaggacacaagctctgagtgacttcccccagaaggctccttctctaactctggccgcttacataatcctccctgatggtgagtgtgttacaccaagattgcaaagcaactgccttgtgaaagtaacagaaaccatgtgatgacacccaagtttcaactgactttcctttgcaaaattttgccctgggaaaagagagtcaaagactaagaatgcctccattttgactgtctccactccagttgaccccttggaatgtcattggtaagaacggcagcattgttagaatgtcgca

SEQ ID NO: 34846 - DNA, 576 bp, Bovine  19866881914838
atccattcattaaagatatgctaatcacctactatacatccaaacaccatatgttaggcaccatgcattgaggccttcccaatccatcaagtgggtttatattccctcagtttatattccatttatcttccctcattaaaaaaatcataagtgcttagacttatgtcaatatgagtataaatataaggcaaacaacactatgctcctagctagctctcacagcagacacggttaatcaaccacagcactcatgcccacagggtttgactctaacctaaaaatccctttcagcacttttcttcaggcagccccttcccagcacctaaaagggaatccatgtgcctactctgggtagaagaaagatcccaggttttgaaatcagactacagtgtatgagatggttggatggcatcactgactcgatggatatgagtttgagtaagcttcaggagttggcaatggacagagaagcctggcgtgctgcagtccatggggtcacaaagagtcagacacaactgaacaactgaactgatactgatacagtagtgtatttgaatccatgcatcatatgcatag

SEQ ID NO: 34847 - DNA, 1030 bp, Bovine  19866880457026
caaccccccacccccgcggttcccacccagcaggggcccccctctagctctcggcgcgaggcccgcccgcccgccggcaccgcagcgccccttgccccgggggcagagccgcagaccacagcggggtctcggcctggggttgggggcgctcggattccagctccgctagacacacgactggtgaaaaacccggcggatgcgattcagggaacagccgaaaaaaaaaaactaacaagttttggcccaaagaccccgggggctggggttcccagtctcagaaggtaaagaatccgcctgcaatgcaggagactcaggttcgatccctgggccgggtagatctcctggagaagggagtggctacccattccagtattcttgcctggagaatcccatgcaccgaggaactttgccaggctactgtccatggggtcgcaagagtcggacacgactgagcaactagaccactaccaccaccaccctgggggctgggaggctccaaggaaaagcgacttcgccgcccagagtccaccgagggctcccagcccgggtctcgacaccccgccccggggaccagcgcgcgccgcccggacgccgcggatggggtgggcggcgcggctccgcgctgtcacctgtcggagcgcttggtccagctgcggcgccgaggacaggctctcggcgtcgagcttcgtttcttctttgcagtcctccgtcagctccaagtgatccggtctaactagtacttcgtgcaactgtcccacctccgggaaaaagaaagaaaacaaacaagaagcagggggtcagtttcccctccctgaacgcggggacctccatcctcaccctcctccatcctttcccatgcggggaaggcccactcctctcggcggatccggcttcagaatcctggctcgcgcgtcgtctgcggctccggtagccgagagatcggtacagccctgcccccagtcccaccccccacccggatcaggtccgaaaaagtcctagaagtccgcgctcaggccccccagggactcca

SEQ ID NO: 34848 - DNA, 2018 bp, Bovine  19866880480483
tggaaatttcaaataaataacaagtaatttttagcttacgctggcccaaatattgcatggagcatattatactaaaatgtcctatattacctggcagttctaatattcaattaaactaaatttcacaaatatttacttacttagttacctcagggcttacttacctgaaagaagagaggatgaaatcttggtctactaaaatagaagctttgcctggaaaaatcttaataataagccatttagtaccactaatttttttattaataaatgaaagaatgtgtttaatgaattaatgatttcttatgactaatctggttaaaaaaaaagtctcttcctggaggagttttaactgtaggaaaaaactatactttagaagatgtcctagagttcagttgtctatgttcacatgtcctgtgttcaatttaaaaatatttaaatagatacacattgtttaatgttttcccactggggaggcttatacagtttcccagtttgactattgctttttatgattgtgattcttccagttagtggaagaggaagacagccgatccttgtgagtgataacagagcaaatacattcaggaggcaccgaagtacagcttcaaacaatgaggaaaaagtgaggcctgcttgagaaacaactgcaggagcaactgacaatatagccctttatttcctcttttacagaaaaagcttagaaaaaaattaattcataatcacaagaagaactaatgacaagctaagacaaaacagcgtctaaccacagttctcatggttagtgtgaaacatacaacttatctaagacatccacagctcatactattatcagcaacttttaaattaattaccaacatagtctacaacatgtttcaaagagttgaaagaacaggataaaacatgaccaaagtacaagtcagaatataatgctggtaagagtgttatgtgttttcaaggactaattgatcatacctggttcagacttcacaaaggagatggtattgaggctaacttaaatatgttacttaatggataattacaaatttataacataataaaggtgagaaagagttccatatctttaatagaagaaaagctgaactaatgcaaagatttcacactaattattctatacgctaagatggagagttagatagaagagtatcctttaaaacagtctttacttgtattttttttcgtttcaagtaggtgagttttcaggggcttttgttttgtatttgtctcatgttctggaaacaaacagtacttggtacacagaaggcacatgatcaattttaagatagaaaccttaacactcattctcagctcatcatttatcacatccagttggtcactaggccctgtagattttacctccagcattttttgaatccgttctctttgaacacttttatttccattgtcttatttcaagcctttattttttaacccagttactacaatacccttctaatctacattttcttaaaagacttaacttcttaaacaaagcatttcacatcaagccctaaaaatatccattgcacacaaaaggggtccttaagcttctaggtggtggtttagcctctaaatcatgtccgactcttgcagccccagggactgtatcccaccaagctcctctgtccatgggatttcccaggcaagaatactggagtgggttgctgtttccttctccaggggatcttcccaaccccgagatggaaccagggtctcttgcactgcaggcggattctttaccaattgagccaccagggaagccaaacttctagaggtggcagcaaatcatactgttctttgagtgtagactgtaaatgaaagaccatttgagaaaatctgaagtgtttaggattggtcaagatgaggcaaaggttaatgaaacgacccttcaaattctggatgggaaactagcagcccatggtttgcagtcataaaatggtccatgaagtcaggatcagaagttatcattctgattatcacacatattaggatcacgtgtg

SEQ ID NO: 34849 - DNA, 1390 bp, Bovine  19866880496607
tttcattcagcagacttttaattccataaatatttggctatctaatgtgttagctgtgcttccccaatggctcagcaggtaaagaatatacctgcaatgcaggacacaggcgatatgggtttgatctctgggttgggaagatcccctggaggaggaaataacaatccactccaatattcttgcctgaaaaaatcccatggacagaggagcctggagggctacagcccaaagggtcgcagagagtcagacatgactaagcacagcaacaactagtaattaaattcttatttattgtaatctagtaatgttatttatagtaaacctgtctgtgtgctaggcattattctgagtactttatgtttattaggcactccatactttttttcaaaatgcatgttatttgtattcactgtattaaaaatttgactaaatggtctattttacttgtatccacatgttttctatattgcttttctgcttatcattcacttcacttggacccttttctttgtcccacgttttctctaagtaaatactctttgggaatctcatcttctcttgatgctgtagagagtcatggtattacatttgtatatcttggaacaaatgttagagcaaagaaagtgacagccttgagtaaagcagtatcacacttcttttggaaattgctatgtatagtctagatggacatttgaaagcctgtttgtagccctgttaactgtatgatgtgaagatcacagagccagagactgaaatagtaaggttgttcctgtggctgtgttatcatttttatttactggactttttctttacaatgctaaaattataagatagcgaaaagaaaacttgaattctaacccagagctttcctatcagaatgaataacctggtttatccactgcattggtctttgttgcttatccacctagggattctgggctttgtttgtcaattatgaagttaaaaggtcagcataaagaaaatgagataaaatttgcatccagtcagttttgttttatagtcacaggcaaaaagtttaggaacaagatggaagagattggtttaaaaggttactgtatttcctaagtagtactttttgctcccacaatttaatgccactgaaattggcatgtcttaaaatcaggtatttaatatgttagtgttttgttttgttttcctcttgaaaaacttataaatagtgtcttaaaatatatgacattttagaatcaagaaaacagtactgaaattccctggcggtccattgcttaggactctgagcgtccacttcaggggtaatggggtttgatctctagagaactaagatcccgcatcctgtgcagcatggatgcaaaaaacaaaacaaaaaaccccatgtgtgtgcacactctat

SEQ ID NO: 34850 - DNA, 384 bp, Bovine  19866880592408
ggagagcgggagaatgaatgccgggctctttgggggcctccgagggggctgagtaccagccttgttgacagccagagccccagcgtcccacgctttcaggtgcgggatccggaagggcgcctacagccccctccgcggggtccgcggcatcagcctcgccccgcctgggccgcgcgtccccgcgcgctctcccaggcccgcgggcgccgcgggggcagggactgggcgcggaaggcggcagggagggacctggaaaaaccacccagattgcattgcagtgggcgaggccgccggaggagccggttccgccgagccgcctgcccgcgggacgttctccgcgcgcggttcccaggcgctcggccctgcggggtgcggggcccccgc

SEQ ID NO: 34851 - DNA, 821 bp, Bovine  19866880843315
attaaaattaaatttataattaaaaacaaaacaaaaacaattcccgtctatgccttacctgtcattctgtgtataagcaattttgtcccagtgcagactcaggaggaaattttgtttactgaatcacctgtattgtgttcctgaacacattaggtttaccccaaaggtctccagtggtgtccagttagtccttcctagaaatgaaattagtttggaagagtagcataatagataaggttccatttagaatttttgtttttcatttatcgctttttttttttcctatggcaaacatttcaagagaattaaaatatttttcacgaagagtatttcttgcaagtattgtttttaattttaagactttttaaaaaatatctcttttcagaccaccaaattcaggtgagagatggaggaaatgagtcattaggaatacaagtcatttactgcaaccaaaaatacttacacatgaaaatgttttatttgagggttacaggctaattctttagagttaaaatagaaggtttctattaaaatctaacaattctagcaaaaaaagagatttaaacaattttagaaatcttttaaaatataaagtatattgttgatcttcaaaatgcttttgtgcgatagaatggtgtatgaaatatgcaagcttggtaatttacctgactgcacacacccagacatctatttttgaaagctggtgaaaggcatttcactgcagatgcttgaataattttatgattatgtcatgcccaggttaatttcagaaaacacttaaatcagggtggcgattaacaaagtaacccaaaaagataaaa

SEQ ID NO: 34852 - DNA, 1083 bp, Bovine  19866881020545
aaaaagttaaaggactaatataaggatacctaagagcccatttcagaataagaggtccatcaactaaagtaaagacaaagatttatttccacgaacagaatgatatcctcatcactaaatatttttatagtagtttgccttcataaattctcattctattaatttcacttatcaaaatgggcctcactcaggttaatttacaaaaatgcagatttgatagcagaacctatatcctgcatcttgctttagtatcacaattcttctctttttgtaaatcagccctttccagccccttcaaccccaaatcaaataaggaaaaattaagtgggagtagttttatagaaagaattttgctgaggaaaggggaaccatatatctaaaaattaaaagtaacatttataaaaatgacatatgccattattatatatatatatgtatgttttaaaagacagaatcagaaaccataaagagatttcattcattcaaacaattattaccaaggatttgatattattacctacataaataaattatgtaattatgtaggataaattttaaataaccagaaatcaaatgaaaacctcccaataaataagcaacagcaataaaggccccatatataaagacagacataaagattacacttcagaacaattttttaaaaaaagtcatccattgatatttttattttgtgacaaagacatatctaaaagaacctagagcttcatggtgagtggccattactaaaataactgagaaaaggcaaaaagaataagaaggcaaggactcttaaagacagcagaagatacaaacttttatgtaagagtgacatgaaatcagattatatacaaaagattttgaatgtatgcattttaactaccttaaaactattcaagaataatttgatatgctgaattagataactgaggttcctatgtaatcctaatttatctatccagttcataaattccaagcacttcagaaatgaaggcaaatgccttgagacaaaatagctttgcagaatctttttgcttctgattatactaggtctgctccaacactgaataattccctagaggctac

SEQ ID NO: 34853 - DNA, 1502 bp, Bovine  19866881269790
tgtctctgctttttatttttatttttttttgagattaaacaggcaagttttattatcaaatgtaacaattctacaaaaattcagtagtattgtagtattcctgcctatcttaaagtctttcagagctctgggcaaacagcatcttaaggcagccaagtataaagaactatttttatgatcttaagtgccagttatccccaattttcacacaacatggtttttcttatttttcctactgcagttaaatggacattactggtcagtgaagagggactgtttggctttccatttaaggtattaatcaaaataatgcaaagtaaataaaaatagcagccacataaatctgtatggcattgcattcaagctaaggacattaagaggaacttaaaggaacatgtgcacttggttaatcaaattcggtttttctctttggagttacacgaggcagcagtactacgtagctagtgtctaatattgcacttctggagcataaacacagctaagccacagtgccacacaccgacagcagcacctgttctcatcacatcagtgttcacctctcagtctagcatgctgactataaccctaggctttttaaaagttttaattattcgacagttaaggcattagagaaaaaggattaaggctatcttattatatacaagcattcacttcagttagtatattgctttctagaatacattgttcaaatattctcatttgtgatattaaaaactatggaatttcttattaaagtccgaagcatcaataatgggaaaagtacagtataaaataatacatacgaagccacagtattcagttacagttcaaactagaaattaataactacacatagcgtgcttcatttttggttttatattttggcccctagttcatttttatttacaactgatacccactgagaaaaaaaatgcaacttttaaaatatgtatattttgtgatgggtgtgccatttcttctcacttattccaaggtgttttaaaaatagtttttggtggcttttaactgtaagacattgtgatggccaagagcctgggaaaataatagctttatttctttttgtaagtctgggacttacgcactccaagaccttattcttacttcagaagagcacgtgattgtgcagaagattgtgcatctatattggtgccatgttgtaccttggcctaaaaacttgtgaaggacattcaacattgcctgaaactcacttatatgcttgcaatttacttttgtttccatttcccaacgtcaatgatgcacattctcctcactttgctcaaggcacctaacacaattgctccttcatcaagataataagtccttgcattcacagtaaacaattgagacaaccagtagtgagttccctagatttctatcctgcattctttcaattttacctgtatatgtgagtgctcagttagtcacttgtgtccaactcagtgtgaccccatggtctatagccttccaggctcttcaatcca

SEQ ID NO: 34854 - DNA, 1115 bp, Bovine  19866881294653
cactgccttcttaattttaggttcaatagatgggggaactgggctcagatatctgcattttttaaaagtagtagagatgagtttgattcatgatcagacctgagcaaaggtgatatgctctacacaaagacacaatctctacaagccttccaactccccacgcccatggcctgtccaagcctagcccacttctttcactaaacatttctgacctccccaatggactcattatagccctttgccatcctcttatacaacttctgtaagctgccctggactattgtacctgtattacctcctagtgggctgcccaggtggtgctagcgctaaaggatgtgcctgctaatgcaggagacacaggggacgaaagagaagtgggttcgatccctgggtcagaaagatccactggaggaggaaacggcaacccactccggtattcttgcctgaaaaattccatgggcagaggatcctggtgggctaccgtccatggagtcgcaaagagtcggacgggactgagcctgcacacacattacctcttagtcgacaaaaaactctttggaggcaagcctgcaacttacttgcatcctctacaatgttttgaatgtaatagatggcacttgttctaaaggcaagttggtatcccagatcagattctggaatagaaagattaactgacaagccagtgaaattcaaattaagtctgaagcttagtaacgtatcaaggtgaattcattatttctgacaaatgtgtcaaggttagggaagatggaagctgggtgaagggtatacaggagctctctgtactttgcaacttttctgtaaatctaaaattactccaggacttccctggtgacacagtggataagaatccagctgccactgcagaggacacaggttcgatccctcgtctgggaagattctacatgcccaggagcagctaagccctgtcgaggccacaacaactgagcctgagcaccccagagccttgctccacaacaagagaagccgccacaaatgagaggtggttcttcttgccactaatcagaagcttgagcaccctaacgaagacgaggcccctgctcgccgcaactgaagaaagcccactcaaagaaatg

SEQ ID NO: 34855 - DNA, 1344 bp, Bovine  19866881362588
gcaaggatactggagtgcattgccatgccttcctccaggggatcttctcgacttagggattgaaccgcgtctcttatgtctcaagcgttggcaggtgggttctcttaccactagtgccacctggcaaattcttacctgtaaggtgaaaaataatcagagtggtcatgaggataaatgaaatgtactccctataaagcagttagcataatgtccatagttgctgatcaataaaaatgttattttcattaaggaagttggaaagcttggaggttgttctaaggtttacgatttcagatgcagaattactcttttatttattttttttttgaccacactgcgtggcatgtgggatcttcgttctctgaccagggatcaaacccatgccctgtgcagtggaagcaaagagtcttaaccactggactgccaggaagtccccagaattattcttaagtataagtaattgtttcctacacataagtgtttcctaactttatttcttaaggaaatttccatattattacatcacttgcccattatacatgttttcacactgtatttcaattatttgcttccctagctgaaagctggggtgggcctcattttggttatgttctcagtgcagcagcccatagcatttgttgaattgattttggaaatcattcccacagaggcagatgactgaggtaaaggagaaagatctccaggagggaactttgggtcagaaactacacactttgctagagactggcagtctacagattggatttctcattaactgtgcacttacaagtcacacagaaacatattttcacaatgctgccatctgctatgttcattacttggcttcttgctgcctatttataaaattgataataagcacagtggtgatttattaaaaatttagaaagagcaaacctctgctgccttattgtttacacaggcagagatagctgccccctatgaagtcagaccttcttgactggggaaggggtaatagaaaaagcaaccgattagaagtaacagctgggttcccaagctgcctttgctgcttactacctgtgtgaattgaaagaatcagtgaacctacccaaatctcacttgtctcaactgcaaaatgaaaataatacttgtcctatcctttttctttttaacagatttggaaagattgagaacaggaggaaaaggggacaacagaggatgaaatggttggatggcatcaccgactcaatggacatgggtttggctaaactccaggagttagtgaaggacagggaagcctggcgtgctgcagtccaggacagagtcacagagtcggacacgacgagcaactaacaacaaaaaaca

SEQ ID NO: 34856 - DNA, 1047 bp, Bovine  19866881375226
ctggcagtatagctctaaaagggaaaaaaaaaagaaagcttttagtttgaagctacatgagatgtcagtctgtcccatgtttctttcctcaaagagtgagtttgtggtttcttgcacttaggagcagggttaaaaaaaaaaaaaaaatgtgtcatgaaattttgagaagacttaaaagtccacttggaactgttttttttcccccaaatttcaagctaagaaccattctttaggtagatggagtgtgtgagatttgagattgctcctacatattatctatgtaatcaaaaggcagttgcttgggatggtatgcagaactggtctctttctttcaaatgtgtgtatggaagggcgacctcatggcctcagtgcttccatgtgtcgatatcactaatatatctcaaggtctctctctgtttgtttaggcctgtcccctccctcctacacatttccagctcccgcagcagttattcctactgaagctgccatttaccagccctcagtgctcctgaacccgcgagcgctgcagccctccacagcgtactaccccgcgggcacccagctcttcatgaactacacggcgtactaccccaggtaaggctcacaggaacaaaggactcctttgacagccgccgcctgagtccacaaaagaatgttgcccgctacatggaaggttagcatggcaggctccagtttctggtcatacatatctctgtccaagaaggttgtttcaagacaaccagaatgtttatttttttatccatgtcttattgacagcatagtcttttagattacttatgtatacaactttccctttttccttttgttttagggctgttcgtgagttagcccagtaatcattataaaagagtgacagtatcaagtgaatgaattacaaaacgagaaaatctgtggtgagggcagttcatttttaagaattcatgtcagcccaaaatagatgaaagctgttttaaattttgtagggcttgtattctttcccctctaagtctttactaacaagtccagaatgagatttttcagtacttt

SEQ ID NO: 34857 - DNA, 849 bp, Bovine  19866880870229
tcttgtctaaagggaggaagagtcttttcacccaagctatgaatagagcttttcttttgaaacaaagtgtgtgaggtacagtgagcaaactgcaaaggtaacaagttcttttgtcatatggtctcctacaaccttcttgtattttaacagttagcgacagtttgtagcttctaatcaactacaatcgataaggatgtaacagcttctgctattcaaagtcatgcaagcctagctaagcactagtcctaatttcctaacagattatcagaacctaaatcagaaagttttagagattcaagaattttcgacttcattaccgtaaaattaaaatactatttacttaactctttatatttaagcattttataattaagagttgacaaactagcataaataccagatttacaaaaatctacacagaaaaatacaaatataatcttttattatataatacacacatataatactttttttcattgaatacatgaaaaacctcttacactagtaactactgtgaggcaatctagtctagtttactgagaaagggaaagggagatactcccaaatacagcgtcttgatacaattcatcagttcacacactaacgatgaaatataagagcctgggtcaagtgggaaccacaaacaccagccagcaccccgtctcctttccctgactgcatggaaagcagagagaagagtacagcaagcccacctacccttgactcacactttctcctctgaaagaatcatccccctagctcccaacaaacctccataatagaaaaagataaacgtggggattatgccaagcgaccccaagctttgttctcccgctcaagacacattca

SEQ ID NO: 34858 - DNA, 1081 bp, Bovine  19866881265912
agaaggaaatggcaacccactccagtattcttgcctggaaaatcccatggacagaggagcctggcaggctacagtccatggagtcacagaagagttggacacgacttggagaccaagcaacaacaataagcacaaccttggatggatggatgaactaatggatagtcaaaggaagtgttacatttccatttagggtctgcaaaaacctaaagaccatcattttccccctctactgggcttctcttgggtctataatgtgaactcagatctgctcatttactggatttctctttcctcattcctcctcacaagttcacaagaacatgcttctctattctacatgtgcctcattgccaggttccaagtactcctagcttgcctcctaacttttctttccatgttgccatcttgatattctggaccaaggaggctgaacaagagaggatgtgtttcactgatcaagaaggggtcccgaaagggcaggtctactaagatgtagatttgtgtgggcgtagggtgcactcaactgcagcatgctcagaccacctgctggctcagcacctttccaaataagccatatactgagagcctggagattggaatcagaggaaagagctttggatagtagtacaagcaagagttctacagttgcttcgtccactagccagaaggtccattaaggaaatttatttcagtgttttggaagcatgaagattttagttcagtcatggagacttccagtcatcattgtgctcagtcagcatattcaaagactgcttagaggggaaaacccagggccctgggccatctgtaagaccaggcacacccacagccatgatggggaggtcctccattgagtatctgttagtgggttgcaagaatgacatctggtcatcaaggcaaaaaccacctctgcaacctgattaatctgtaaaattaagaatttagaaaggaataaaaaagtccacaaaaaaatttactaaagaaggatgcagtgaccaaggaattccttgctcttaaagccttcatgtcacacaactgagacgtcttagtgatcacctggagactccattctgcctca

SEQ ID NO: 34859 - DNA, 663 bp, Bovine  19866881349701
actttaaaaatggcccacactaaaaaaaacaaaaacctaaaaaaattttggctgaaatctttaattgcaatgactagaggtgaattaaataacatttttttaaaggaagtctactctattttcacacagctaactttttttgaggaacccaggattgatttacaaattgttttgatcagattttgtcagtaaagaatcaggtttgtttcaatgaggggggtcaagctctttgatgtatattgatcacttttatgaaacacgtgtttgcagttaattgttatagcaatgtattaacttatttggaagttgataacttttcttgggaagaaaaaaggataaatttagatgtaagattagtttaaattgttaatccataatttatccttgagtgtattattttacaattctatgatactttacaaactggaaaaagaaaaaccccaaagctttattatatagataccatctttaagttgtttcattttctgtactttctacattttaccaattttaattgtagccttattatgatgtgttatggtaaaaccgggcagaatgtaattttgtctgatatttaaaaatgaaaagtatgtaggattttaagcttctaaatatttcaaggacaacattacacatataggagttcatttattcctttttagt

SEQ ID NO: 34860 - DNA, 1559 bp, Bovine  19866881403237
cttggtcgcccgttcacaggcatcaggctgatacatttccttactgcttatgtgtgagctgtaggaaccagaaatgggaaaaacgtttccttgcagtttgggcattcatatggcttctctcctaaacaacaaccaaaaagtacattcagtaaattttcacatattcacattttccctaaaacaagcagtatcaatttaaaaagggggttaccaggtgtgcttgtgatacaattttatttagaatcatcacttttaagttgaaaaccttcataaatgtcaagcaccaataaaatgttagtctgaactatgtgctgaccagtaagagaatcttctcttcaggtgcatgtaacaatgttgctcacttttaaaagttcaaatctttctcagataccaaaaaattatatcccactctttcaagtaatttttttcttatcctgtgtcactaaactatgtaattctctatattctactctacttaaccatctataggagaaattaatattagacaaaaggaagcaaaatctcccataaggcttaataagtgtggacatctatcgttgactgtatgagtcacatgaagaatatttatccttcctatattcataggtttccttgaaaagacctttttcagtggggaagaaaagtttaaatacaagtattgttacaagccttggcttattaagctgggacgtatgtgtgtgcttagttgctcagtcgtgactgacaatttgtgactccatgggattctccaggccagaatactggggtgggtagccattcccttctccaggggatcttcccaacccaggtctcctgcattgcaggcggattctttaccgtctgagccaccagaaaagcccaatactgctggagtggtagcctatcccttctccaggggaacttccccacccaggcactgaaccagggtctcctgcattgcaggcggtttctttaccagctgagctacgaggggtgtatgtactcctagatcaataaggcagagttcgctgtgtgctcagttgctcagttgtgtccagctctttgcaaccccgtggactgcagcctgccagattcctctgtccatgggactctccaggcacgaatactggagtggattgccgtttcctcctccaggggatcttcccaatgtgggaagcaacctgtgtcttttatgcctcctgcactggtgggtgaattctttaccactgagcctcttggtacgaaaagcatcttggagtttcaatttcagtgacagtggttacagtaacttagaacatttaagtattaaaacacagtatacttttgctgcacaaatacaacatctttgtgaaatgtcaggaaaaaaaaaagaagcttcctgcttgcagaggcctcagttacgtcactccccaagaccttccagggtacaaggtgatcttctgggtcactacgagtactctgacagaaatttttgagttgaatggaatattttcatacaaccccattttttttttttttaaactttagtttgcatatgttctagttcatgaatgtatagtctaaaggtaccgatgccctgg

SEQ ID NO: 34861 - DNA, 1410 bp, Bovine  19866881656833
aattcatttcatttttgtactaaagagcacaactgtgaggtgaaatactgtcaactcagaactctaggtgtcttttttgctggcactttgcctcaaagcgcaaacgatcttctacagaagaccttctactactctggtgatgtgagtcgtcacattttaatataaaacagaagagtaatgaacagcattcttctgtgctcattaacactattttactaacaacaaatatagtttaaatactttatataatgtataagtcagcttgacaaatatttgataataagcatccctgaatacattattcatgcaagttcaacacaaccatgttaaaggcagaatacacaatctttggctgtggcaccataaatgatcacacattccattatttgattaatttggagtgcactttcagtaagagtacaaaggcttgctctttgttttatagaactgacaagtatgggagggctgatgcttataggtaaaaatcgatttttgacacattactgcaaaatacactcatcttacacaacacaaggtgatttataaggctctgtggaatactcctaaaatgtactgcaaagaacaaaaaactataaatgttaagccaaagaagaaacaaagaaaatttaaaactatatgatagaaatatctaatctatggttgaatatacagaatacagtaatactacttttaagtacagaattttgaggaaatgttttaataatttggaatttctttttgaagtttacattcgaagactgccttatcagaagtaataagtgcctgtatatattggacattatcatatgaaatatctggatttaagatttgcacttactcttttgcttcttaaatctgatttgaatccaataatagaggaatagtctcggggaatatgtactaatatagtcacctagaagcaacaaatttctttgtttactataattcaacttcattttgggttgggaagatcccctggagaagggaaaggctacccactccagattttagcttggagaattccatggactctggtccatggggtcgcaaagagtcggacacgagtgagcgactttcactttcaacttcattttggcctttttcaatcacagaaatggtaagaaaaagtgtattctcttgtttgctgtgacatgttcacttatcaatattcataattctcatccggtttctagataacccatgatatttgcttctttttctctcttctgcttttagtcttgtgggcaatttcatgtagatcctggtaactaataatcaaactcaaaatagatctgtatttctgtaactatggtaaaaatctgatagaagtttaaattatcattaaaacacttactctgtggattacatgtagattatatttgttattcttacagatgaatacctgtatta

SEQ ID NO: 34862 - DNA, 2296 bp, Bovine  19866880397331
ttcaaaagcatcaattctttgatgctcagctttcttcacagtccaactctcacatctgtacatgaccactggaaaaaccatagccttgactagatggacctttgttggcaaagtaatgtatactttatggcagaaatcaaaccaatattgtaaagcagttatccaaaaaaaagctcaggtttgagcttgaacctttgcaaattgctcaagcacccagataatattgctgcttctgctggtgatccagggacctcactttgagaagtaagggtacaggaagctcaaagggacatcaatttttaaagctgtccccatgggtcttaactctccagtgaataaaaatgcagtgctcctcttcctcagttgaatgatatgaatgaatatctcttaagggcatcaacggtgtccttaagttaattggttttttggaagtatttttagcaaaattactgtgcatttatcttaacacaaatccaggaatttgaatatattcatattctgataaatgaagtcttcccttttaaagagtgctttttttcttattgctatgcagagaagtatggaaatttagagcttaagtgcatttattcattcatcaaacatttttttaacctaaccatgtgctctgaattctgacaggttttggaataaagagagaaaatcagaaagggactctagagaaggttccagagctagtgaagatgctgctgggtccagatcatagaattcctgacccatagtgtttcttccttgatacagcaattattctgtggcaggatttcaaaaataaaattctgcaagcccaaattctatgtttcccattctttttcactgggtacattgtctaaatgctctgtcatagaaataaatggccaggagatatgtacattttcctttatggaatcaattttcccaactatatgatgagaaattggtttagataatttctaagaccacttccaactacaaaatgtatagttcaaagcagggatgggagttttggtctcaatctatatctcctctttgaacttttgggccagttttgagcttgggagttcattcagttttgctcacccacctgcatcacaggagggccaacatcaaggggtgtaggataacagattccacggtctacctgcgttgctcctgaaaggttttaagctgagggcatgaatcatactccccaccgactgacctgtatcttaatgtgggtttaaatttcatatcctttcctagattaatgttctgtgtacatctgagaggtctggctcactggccactccataaacaatagggaaggaccagcccctgatggctaatggtgaaggccccaggcatgatgatttagtgtggcctgtctctttgagtacaaaatagacctgctatctgattagtcaaactgggtcattctgggtctctgaaagatcactacagttccatctattttttcatccccctcatgaggtcagtgactcacttgactaactgacttgccacaaacgcagccaatgcccttgtccttttgaggatccaagatgaagcttcctttattgagttatacgtgcattcatcaccagttttatctcaactttttgtctgtattattttatcataatgtaccccagtagcctggatgaatggatagatggatggatggatagatagataaatgtaaggtgatttctatgtatcaaactcagttttcctggagaaggaaatggcaacacactccagtatttttgcctggagaatcccatggacggaggagctttgtgggctacagtccacgattgcaaagagttggacacgactgagtgacttcacttcactttcactttaccagcctggtagacacatgctatggttccttagtgctgggttgtttatcagacatggattttaattatgaaatgaacgttttcaaaaccaggtggtgagccgatgtgtaagaccatggagcctgcttccctgcgcaagtgtcatcatggcctgaagccggcactcagggactgctgttcattagaatttatctgagggcagaaacatcctcactctgtcaagactcatatagcacgcagaggaacatgaggagcacttctgattttaattacctgcagactgatcgtcctttaccacgtgactcccggcatgcaaaccaacagtcttagcttcagaaggagcctgactgttcacactaatccgtatccttcactcgatgcttcagtgtttctgtcagcttcctgttcgagaccgggctgacttctttccggcgtgcttcctcgctcctccggcacac

SEQ ID NO: 34863 - DNA, 1150 bp, Bovine  19866880418640
atttcttgcagtggcgttgccagctgaatggtttaggagacttgtaaaaagcagacggccccaaattcagttcactggagggtttcaaacctgtacagagggatgagagttcttcaattgctgaaatgaactggtggtctcaaggtgattttaagtaaaaagcctgccacagtctcagtaagatccgatgggatttactgtgtcaaaaccaagggttgaataaagtgcagggataaaggagcctgactggccacaaaggggcagcttctaggtcagtgactcattgaaatggtatagatgacagtcctttggtgagaaggcagtggggactcctggaaggagtgtaattagttctctgacctattcattctctcctcttgatgcaccaatattacattgggcaaatgtcacaacttcttggagtcattttttcatcataaaaagcaagaggaaagtgacttaaatggacaattatttagaatttgtagagaaatctgacccataacatttgtaatctacctgagctcagagtacatgtttgatttcatcaaagttttaagtcacatgtgtttccaagaagacttgagtcagtgcaaaattacttaaagctaagagcaaaattacactgtggggtctatttctcaaagagtgcaacatctatgaagaaaatcatcaatctatgcctgataattggaacgttaattgaccagaagtcttctcttatagaaagacacgtgtaaaaacataaacctatagcagcatcacctaaattgtgtattttaagtgctgacagagtcagacacaactgagcgactgaactgaactgaactgaagcggcccccttcagatattctgaattagaatgtcaaaggtgggatcctgcctgaaactttaaacagatgcctcagttgatgttcaaagatgataccatgagaatcagcatatgtaagcaggggccatgccaagtcatgtttcacaaacccaggttcttgcttcacaggtgcacaaaatcacaaaataaataattttgtgccaccccaactctcatttttaaagtagttaacctggtatccttaagcacccctatatttaaaatagataacaacaaggacctacttactgtatagcacagaaaacactgctcaatatt

SEQ ID NO: 34864 - DNA, 833 bp, Bovine  19866880594663
atccttactaatatctcattcttaaaacagtcatgaatgtagaagcagcagatgaattggcattcaagctcaaacttcaaatttggcatcaaatcccatgactcctttagctatgttacatcacattggtaacagctacaaagcagaatagcaactctgtgtgactgtgtttctatgcctgggtagccaatgagtctatttgatctctgaaaatcactctggatgttactgaaggcaggcaagagacttttggcagtaactctcttttattgcatctgttaagctgaaatttaggtaatttagtatgaaggcatggcaaaatgagtttcccactctgtgttaaaccttctaatgctttgtctaaatgtttaaaaatatgatgttctggcaacattgaattcactcaaaaaccctctaataaaatgaatccagtcaaaaacaatttttaaaagttgttgagagactatggtgtttgcacttttaagtgcagaaattctgacagagtttggagagcaaaaagaaggaaagtccagagtaggaaaaggaatatttccacctctttctctattgtctttctggttatgatatgctttctctggtcatgatccactatgacagtgaatgctaaaatactggtatatattggtgtatgtcccttctacttttaaaaaaaaatactcatatataacttttaaaatgtaatactatttttctaaggtacatttaaagcaacattttgtactctatttagttttttatacaagtgctcctcaaattatctgtagtaaagaatcaaatttttcatttttaaaaaaattttcatcttttgcaaa

SEQ ID NO: 34865 - DNA, 1227 bp, Bovine  19866880636755
tggcctatggcttttgggaaaagcgtgtaccccagtgctggactggcatttatagtgtggatcaagacaagaagcgacagctgacgtcttttttcaggctcacacttggggtctgcctctcctctgacatcccagcaaggaggaatcttacttgcttaaagactttgatttcatgtttatgtttgtgtaaatgtgaatcctgcattcagcttacatttatcttctttatccttactctgaccttacgtttatccccaggtaatacattcagttttgccctattccactgaggagtcctctacactgagcacaattattctgtctcataaaatcttccttcttttaggttaaaaccattcagctcctttaaccgttcttcccaaggcattatttccaagattcctccctaccccgctatttcttagtcttaactgaaccctgttctttaaatcttttaggacctggaaccataaattgaataaaccttgtaggaaagacctgattagtatagagcaaagttaaattatcagtttccatacacaggatattaaatcttgattcatttagtccaatactgccttagcttttcaggactctgggccacactgtggatacatctgtactcagctgcacaggagttagttgtatgcattcttttgaatttgtatgcgtttctgaattcatttcaaacctgctctgttttatatttatagtcttcctttgctccattttcatcatcaacttattttttttggtgtacatatatcacaagctgcctcaaatacttttggaaatgagatagagtatgaagtaatatagaagacgctataaccaatcatttttatttctcagacttacaaagcaatgttattttcttcaaaccagcctggattaagggttcacatttcagtattcctttggcagcttatcgattcatatttgcttacagaaatgagtctcatggagatgtctgctgggtaatatgttgtcttaactctctctctgtatatatatatttatacttttataatatatatatatatgtatatgcacacttacatatgtatatatatttatgtatggctctacacatataaaatgagcacacgttccttgaaatggcctctaattcagaattcttaaagtgtacagctgtcattctcattgctttagaatgggtattgttcattgccatctgttcctgtctcacttttcaattctacagtt

SEQ ID NO: 34866 - DNA, 2151 bp, Bovine  19866880655955
tgtatagtatggggtgaggtaaaaattaagatttttaaagttaatttatcagccaactttccttattcaactttatgaatgaaattttttttgtacacatccttgtatgttgctgctgctgctaagtcgcttcactcgtgtccgactctgtgcgaccccatagacagcagctcacgaggctcccctgtccctgggattctccaggcaagaacactggagtgggttgccatttccttctccaatgcatgaaagtgaaaagtgcaagtgaagtctctcagtcatatccgactcttagcaaccccatggactgcagtctaccaggctcctccgcccatgggattttccaggcaagagtactggagtggggtgccatcgccttctctgatccttgtatgggcatatgttaaattggccatgtacctggaaatcagaaatctgagcaaaataataaaaccttccagtgtttctcctaaacaactttaggcaggtctatcactggccaggatcctccatcccacagctgtaagagaaaaacatcccttgctttttcatctgtcaaggttacatgaaatagaacactagctggatgtgactacaactgtcaaaacaagataatggatggcttatttggacagatcaaattgtggcaagatttcctgtctccccagtaactactttactttattccactttaaagcccaagggatacatctgattggcggatagaaaataatcaaggaggaaatatcaagggatggcagtctggggggtttgggggcggaattaagacatattcccaaggatgcctttgatgtttgagaagctgaagtgccctccggatcagaatgctgcagggcgagcctgcagatgcagagtccagacaaaccagccgccactggtgtggggccgggtggacactccaggtaggttcaggggttgtgtctccttggaattcagaagatggtctctaaaaagtggtagaattccgtttgcattttcctgttcatgtccagcatcatgactcttgattcctgtgtaaacataattctccccctggccacagaggtcacccacataagcctgaggtgacaggatgatacaccatttggaagtcatctttctaactgagagcattgccatagtcccaggaagccctggcatcacagggtgtgagggaggaggtgcttttgaaggggctgaaagatcattccttcctacacaaggctttctggaattatagtctgggaggaaaatggcgtcttgccaattctaatacatgttcagactcaaggtgcagcctcagatgtccagatgatagaaaggaaaaaaaaaaaaaaagcgtaccttagatggctgttcttctttttcccttttgccttattattttattctatttaggaaataaaaaggtttcttacaagtaaccaaagaggaaatggtgaaatatataacattagcatttttattgggatttatgtattttgctaacttcaagtttcagtgattaagttttagacaatcaaagaaataactaaaataattacatttgtagtatacagacagtgcttttaaaggtactaaaattcagttcaactggtatttttttgagtactgccatttggccaagcactatacctaaagaaaagcttatttaacttacatgcagagtacatcatgagaaatgttgggctggatgaagcacaagctggaatcaacactgccaggagaaatatcaacaacctcagatatgcagatgacaccacccttacgcagaaagtgaagaagaactaaacagcctcttgatgaaagtgaaagaggagagtgaaaaagttggcttaaaactcaacattcagaaaactaagatcatggcatctggtcccatcacttcatggcaaatagacaggcaaacagtggaaacagtgacagattttattttttttgtgctccaaaatcattgcaaatggtgtctgcagccacgaaactaaaaaatgcttgttcctttggaagaaaatctgtgaccaaccgagacaccatattaaaaagcagaaacattactttaccaacaaaggtctgtctagtcaaggctatggtttttccagtagtcatgttttggatgtggcgagttggactataaagaaagctgagcgccaa

SEQ ID NO: 34867 - DNA, 1223 bp, Bovine  19866880696804
cctttggtaacaaaagcaggggaaatcctagctgctggagatggaggctgcttgttgctcaagctagggtgggctgagctcaagagcgcccttagggctcaccagaaatgtctcccaagcatttgaaccaccctctagagaattttcaggtagtcaagtgggacaactctggggaagaaagcctggggacaaacctagcagctttcctctccctgcagagctgtggattccattattagctatcaagcgtggttttgaacttcaggacgaaaagttgcgtatatgtctgtgtcttaaagtctactgtcagtagagtgatcagctattgagagatgtgagttatttttagatgaatacaaacgttggatgatggattgttcggggggggcggaaaacaaccttgaaattaaattggggaaaaaaccccaaacaagtgaaatgtaacagcagcaaaaacaaattccacacaaagaaaaattagaaaagaaacaaagcctcacggatggtgtttgagtgatagtgaaagacagactcaacacattgcctcgtcttgataatgcattgacccagcagagaatgatgaacaatacacacgcagggaggaaaacaaaaatcaccggttttgctgagctctccagagttcaactgaaatacgtccctgttcctattcaaaggtggccttgtagggcttcatagtcagtcaaacaatccctccatgcagaactgggggcttccctggtggctcagatggtaaagaatcacatgcaatgcaggagacctgggttcgatccctgagtcaggaagatcccctggagaaggaaatggcaacccactccagtattcttgcctggagaatcccatggttggaggagcctggtgggctagagtccatggggtcgcaaagagtcggacatgactgagcgactaacacacgacacaccagctagaattaggccactgctgaaaatacatcagcatgagggaaatgggaaatgtgtcacttccccatccttctgctccgccacgatcctctccatccccacgtgcatggtggaaatggctttgcctgtgctgggccaatgggtttcctccgtcacatacggaaaagtcagaccaaggtttttagatccttgtaattacagagctaaaaagcaattggagaaatatattctgcaccttcagaggtttgacgtgactttactgggacagagaacagggctgcg

SEQ ID NO: 34868 - DNA, 976 bp, Bovine  19866880729167
aaaagcattggttcctccagaaaaccttcaccatgtcatccttcgtcaagaaaacaggctggaattcagtgggacaagcttatactctacaaggacacctggcatccttccacctcctctgatgacctcagttactctcaaacaatcaagtactgcctgttggaatgaaaacagatgccactaaatgctactgtctggagcatggcatattttagtcaaccagtgaactgtacacagccaaatgcctctattcaccacaccaagaaaccatcttgcctactggacaagcacatatggtagataatttgacaggggaaggggagagtgggaccatttgtcatatgagagttcagttaggacttggaatttaattgctcactaagacttaagagagtccacaccgggtgttacagaagatactagaaactcatgataacctaacggacattgttttaatgcctgtacatgtcagagcccggtgctttgaattaccacagtgtttcctggaaaccgttttgccaaatatcttgaattcagtccaagcatttccccattcatagccacatggtggggtcagtagtgaagggtgatgaacactgcagtgtccttgcagaaggctcagactatgcaatatttaaattaaaaaagataaacaccattctaggcacattccgtgccacatcagcacgacccagttcctgttatccatcaagtaggttttaaaatagtccgcgttttttagtcctgcatagtcaacagtactggaaagttggcaggtccacttgtttaaacaaagctcccaagttttctgctggcaggtgtttccagagttcttggagcacaattctttggataggatatttgccaatatacatagcaacaggaaaaaaaatgtgttttcctttgccacagtggagacacaaaaatgccttagatgcaaagcggatattcagcttggggctatttggctctatgt

SEQ ID NO: 34869 - DNA, 1200 bp, Bovine  19866880772109
tgcgttggagaaggaaatggcaacccactccagtgttcttgcctggagaatcccagggacgggggagctgggtgggctgccgtctatggggtcgcacagagtcggatacgactgaagcgacttgcagcagcagcagcagcagcatactgttctctgtagtggctgcaccaatttacattcccaccaacagtgtaggagggttaacaaggaggctttttaaaaggaaggatgattaccttgatctgacttaaaatgccacagatcaagccatgccccacacaactctaatgtagtggcagtatatcaacttttcaaataattaggttaaaacactttcttgaatacttaattatgaagaaataattgtgacaatgcaatgaatggcagctatttgctgaccttggacgataccaaaagatacaacaaaccgtccctattcatgaaatgacctggacaccagctggtcataaaaaatgcaaaatatactctatctagaaggcaatatagatcatgcacatagaaacatccacctaacttttcacgcttccacacattattacaactgcttttatttaaaaatatatttcatcatatattcatgttttccatgcaatgaagaagtttgcttcacacatacacatatacaaatacacacacatgcactgcttgtgtgaaggtatcagaacacacaaaatacaaagctggcagggtgtgtggggctgggatttgatagttcagccctagtttctcaagatgttattttgcaagtggatttcaaacaaataattacattaatcaaaactctatttattctcctacattggtactgatttcacccacatttatcaaatttatgttccgcctcttgcctgcctctcacttcgctgggcaaagagaatgcacctgactgcatgctcagggctctgctttgaaacgagaggtctgtgaggctgagacatcagcctcaaaaacaaaacaccagggctcaggggcatctttcctgtccctgtttctcattagacctgctcctggaattctgggctctaccctagtttttaactgatctaaactatagaagcaaatgatgattgcattatatttagttctctgaacatggctaaattacatcattcttgtcatgttaggccgtgaaaattaaataccaactaagatttttagaagcagcttaaaaagaaaata

SEQ ID NO: 34870 - DNA, 1136 bp, Bovine  19866880822067
caaaaatgaaagacatataagaactatttgcactatttttacaactttccaaattatccccccaccccaaattcttaaaactttggagaactggaggagaaaatcaaaatacaggcacatgtttctgtcaatcattattttctagattgaaaaatgtggcccttcttggcccctaaaacacaccatgtgttatatgggtcttctcaccacacatctgacttttaatattttttctggctcagatgtttataacaagttctccagattaaaggtgtctttggctattttttttttttttttttttttttgacccatggagggatttctgatgatcctggatagaatcaagccctgatgaaagagaacttcagtgcagtttatgggcctgttctggtcaacatataagtctgttgaaatggcttttctcatgaagggatgctttgatccattagaacaataatgatattattgtcactcagccatctttattccaagagctcaagctatatataagtcataagaacgcattcataagagttggaaaacacagctttgtgagattgacaagaagacattttagtatcagaacaagcacgctctctcaagagcatttctttggggtcaggagaatggtaactgggtctgcaggacgttcacaccagcacttttcctctttaacatttgcaactccacagaggccgacatctctattttcgtttcccttggatctgcttggtctctcaggcatctgagtgattccttaatagttactcaccaacaaagacttagcattcaccaaaggacttgagagcaaattcctcagacctgcaaaccacggatgattagcacagccagcctttagtaattaagccatgaaatgaatgtgaaccttggaaaatttggaaggttatcacagaatgtgcccagtggctgtcaagcatgaaggacatctcttccaggagaagcctatctgtcttcaggatgtccagggaacccctctagctctggtgcaatttttccctagctggggattttctaatatttcttaatagctaatataaatcacaaaatttcataatggtagacaagccttctagggtgatttaatatgtatcatgaccaatttgcagtacaac

SEQ ID NO: 34871 - DNA, 2022 bp, Bovine  19866880854705
taatatgtttttttttactatgtccccatttttacacttttagtatgtgttagtttcctaaacatggttgaaaatagaacctaaattgttgaaaaatgatgtaatgtctgtagagtgcttggcacgtagggaggtgatacacagtaggtgttcttctttttcccttctttaccaaagtttttttttttcttctagatgttagcataattgcattaaattccgtgactataaatttaaatgtgtctgtttagcttactttagcttacttatttagagtacacatttactcagattcaatttagtgtaatcacagaattgttggagaaggagatgatacacagtagtcatcctccagctttctggagaaagaaagaagtgttacaaaatgacctggtaactgtctcaggctggacttcctgggcagctgctctagatggagcttagtgggcagggtgtttattaagggaaacccttaggatctctgtgggtgctggaggggaaggaaacagctgggcagagttaggagtcaagccacggtgcaggctctgagaccccaccagctgactccatggatctctggagctaccctggccctgcagggtattctggagccgggaccacgtggccaggcctagttggtcctccagatggaccagtcatcaggtgtggatgaccacaggacgtgcctaaaggggttaacttagcaatgctccctgctgacagcattccaaccctcagccacaaaccttcacagcagggatccaggtagcactttatagtcaaattgccacactgtaagagatgtccatagtgctctcgccgtttgtaccaaaacgagagtgtgttggaggaaacccaggctctacagctgactgctagggtagctcatggtagtagcctaataaacctggttgccacgacaatggtttttctttaaccaacctccaaaacagcatccaaagagcaagatggccactactcatggctaatacaaagactacagatgcactgctttgatctctcccaatggaagcaaaagttttctgtaaattaagacttcgaagtagctaatgtccctagcgcaccagctcccggcatttgtccagccatgaccagcactgtcacggtctctgggtatttcttcatttctgaaggattcatttccaaaggctctacccacacttgagcagccacttggtttaataaaactatgtgcatttcctgggactccacagggacggtttgactctagccatacaagtgaagtgtttttatatctgtctagttatacgtatgaggtgtcacagggatggtttgactctagccgtacaagtggagtgtttttatctctgtctagttatacgtatgaggtgtccccagtgtttctgttggtagaagaagcggttctgaagaaaatgattgaatttattggctggaaagaaggggatggaatatttaacccaggtaagtacaattagttattgcctccattaacgcatctgcaattttattcctgccttaatatgaggaacaactccctgcagatttccacatgacatgaagttaggtatgaatcatgctacttggggaggatcaagtttgtgcctttctccagagtatgatattttgtataaactacagaaatgacatacctgccaacaagagagatgtctaaaattttggatttatatccaacacaaatgagttgatctattggtgggaatttgaagggctatgatatgtttatcaagcttatcaattcattttacttgagaagtttcccgaattgtattttgtttcccctacagtctttcttggggaccagggaggagcacatgccctccttttattgattaaagacagaaagaatattattactattaactgtggagacatggataccagccctacatccatagatggaagctttgagtttagaaaaattccagaatgagagactagaccaaaacttctggagctagagatgaggacgtgtgtaaaaggaatgggaggggggtgctc

SEQ ID NO: 34872 - DNA, 817 bp, Bovine  19866880875722
tattacctaacaggatatgacatgtttatctccctaatcggaaatattcttgcttgcgctcagtggctcagtcgtatctgactctttgcatccctatagactgcagcccaccaggctcctctctccgtggactttttcaggcaagaatactggggtgggctgccatttgccttctccgggggatcttatccgacccagggatcaggaggacacacatctcttgtgtctcctgcatttgcaggtggattctttaccactgagccacctaggaagtcccaattggaaatatatgtacatttagataccaatagttggagagctcatatctagctcctgagagtatgaaaaacttcccaccaaagctgcagaaaggctacacagtttaacagatgggcacacaggggtgaacttacgtctacatggagccagaggccgtgcctctcgcagatgtccgctatctcatccagaggatcgaaggcccccagcacggtggtaccagacgtggcacacacaaggaacggagctgcaccctgcgagaagcacccacacgtcagagttcaaggatcatcatcatcaccacagaatccgtggcacagttatacatctggacatttatgtggtttctttggagacaaacattcattcagtgagtgtgtttacatttttccatcacatggcctctgcctgatatgataagtcacttcagttgtgtctgactctttgcaaccctgtggaccatagccggccaggcttcctctgtccatgggattctccaggcaagaatacttggagtgggctggcatacaaacagcttaag

SEQ ID NO: 34873 - DNA, 1277 bp, Bovine  19866880901811
cgggggcgcagtaacaggctttactactgagggaagcttcaggttcaccgcaaaatcgaatggaaattacagaatttccataccatataccccctccccccatgcagaccgcctccccccgccccgcatcaacaccctgcatctgtgtgaggcatttgttaaaaccagtaaagcaacacgaaacatcaccgttgaccacagtcagccagagcgaggttcatggtgaggtacaggatcagggttctgaccaagcgtccatcattacagcccccacaaggtcactgccctgaacttcctctgtgtgtgcctcgtaggccctccttcctttcctgagcccccaacaaccactgatctcttaactgtctcaatggtattgccttttccagagagtcagagctggaatcatatgtgtgtgttacagtcactcagtcctgtccaactctgcgacgccatggactgtagcccaacaggctcctccgtccttggggattctccaggcaagaatactggagtgggttgccatgcccttctccaggggatcttcccgacccaggcatcgaacccggggctcctgcactgtaggcggattccttattatctgagccaccagcattcctatttcaataggactgactatcccggttggagtgacatgtgggcattagtctggttgcattagtcaagtccacatgctttgtaaggatccaagcccatcttccagtagtttcaaggacactctctgctaggcccttcctctccagcttcagcctggaccctggcaaacagctgtcttcgtatgtcctgcaggctgtatcagggggcttgacctaaccccctaaaggccccactcaaaaaaggcccatccagaaaatgctgtccacaacagacgacaagggtcttctctcacagctttaactctcattttgcattgcaaatgtttttgttagttcaagttgttttttggaaataaggcagacacagactaaatacgtagcccaaagagtggaaacagactgtgcctctcagagcccgaccctgtcactggggggcccgcacatgggtggccccaggggatggacccattccagcccttccctgagagcagcactttcctgtctgcagtctgagcaacagcaccccacacccaggacctgccctcccttcctgccccctgagtgagcccatgatgttggattaattgtataattcccctaattgatggtattgattgatggccctgttaagagtggagtgttattgttggtacacacgtaaca

SEQ ID NO: 34874 - DNA, 1087 bp, Bovine  19866880914228
tggaaggtggtgtaagattgctatactatttatgagccaaagaatatattcaacttgcctacaattacatatataggacatgaaaaagttaggagtaaatcaggttcctgtggtccagatataagaacaaaaatactatgccgagcatccttcaagttccaggcactttgcatctgctttctcctcatccagtcgtctggatgacttctttatcgttagtgtgatgctctcaggagtggaaaatgtaaacctccaattttatgactcttcttttaaataactttctagctttcataaatttttcttgttgaatgatatttggagtgatttagccaagaactgatttacattcatgtccttgaggcagtttaaaattttctggatcatctaactctataacagtggttaaaatatttttgccgaagaattcattcctagatctcaatgtaaactatagtccccatgtctgctcacatggcagggattaagaggttaggaaaatttgtgttcacggtgcagagaatgcagcactttcaaaagttgcccttttttgatgaaagactgtttgcaaattaactggagtgcagagttgagctgggaggtatgagagacgaccatccgcttgagttctgtgctgggagttttctccccattttgttcctggtttctgcctctgttgttctctcgtactttcatctgttctcccaccaccagctgcttcctacacagatcaggcacagcactgctgctgggcttagaaacagatgtgttccccatagtcaaagggcatatgatctcacagaggagacggtgagcaaagtgtgcctgcctgttgaattgtttgattactaatttggtaagtgctctgaaggctgcatcagacatagttaattatgtattcaccaggcatcatgatctcccttctgtctcctgatgctcatctaaccagcccccctgacagctaagagtcaccctatgacacagatatgatgaggagaaaatggcaaacaaatgttttggtttctgagagagttggtatacacaagaggagagccttctctccccttttctaccattaatgcagaaa

SEQ ID NO: 34875 - DNA, 1698 bp, Bovine  19866881078650
aaaaaaaaaaaaaaaggaaagacttgcagtcttcactgtaatctttttaatggaagataattcccaagacaaacagtaacacaagcttattttcctgccaaacacgattcagatttgacaagggtgtctcatctctcccactgcttaagaggaaacagggtgatcagatctgaacagaaagagcttcatgaaattcaaagacttgtggggagctgaggcaagacaggcaagagaaaacgagacacttccccaaattttgcacggctcagctctttctgcagtggtttcagacagatggcagacgttagtctcatcttccatcagctgtcagcctgagaccacagtgaattcccttctagatgatctgctagcttttctgtaactcagggcaccacatctttggaatttttttcaggccatcctaatttcagctgttctatcccatagtctctataagtagcttgactttttaagttacaatgtctgttcaattccagctctttgttcaaggagtatctgcatgtaagaacacaaaccttaagcgtgcatcttgagaatggcacacacagacagatcgaacatcgccagccttccgtgaggttctctcgttatcatcgttctgctttgcctgtttggaactttacaggaatgggagcacacggtgtggggttgtttgggtcaggcttctttcactcagtctgacatctgtgagacgcacccattatgctggaggcagcaggaattgttccttttgacttctctgtggtgtcctaatttataaatacaccaggacatcggatgggggaacatcttggcttttattggtggacaatttggtcaccatagttactcatcaaagagtgggataaggcttccccggtggctcagtggtagagagtccacctgccagtgcaggaaacctgggtttgatccctggtccaggaagatccatggggagggtccatgccgcaaggcaactggacccacacaccacaaacactgagcctgtgctctagagcccaggaaccacagctagcaaatactgagcccacgtgtcaccattacagaagcctgcccgccctagagcctgagcttagctacaagagaggctctcttggtaccacccaaagagagagagcccacgcagcaagcacccagcacagccaaaaataaaaggaagagggaaagaatctgaaaatttaaaaaagaggggcaaaaataacagggatttcaaatccaatactgtggttcaaatactcatcagctctgctgcgtattagctctgagcccttggcaagttattaatatttatctgagcttgccttacagggcagaatgtatttagtatccgccattacagagcatactccgaatcaaattgtggaaattggttccaaggataagggccccaaagatgtttgattcccagaggcacatactaattattcgttgttcattcaacaaatgattgtgtagcagcgtccacatcccaggctctgttctagtagtagactggtcagcctgtccccatgacagttgggaagcaggataccaaagaagcaaacaattgaatgaacaagatcattttgctaccaatcagtgtcgatgtagggggcttccctgtggtccagtagttaagactctgcactcccagcacagcggcctgggttcaatacccggtgagggaactagatccca

SEQ ID NO: 34876 - DNA, 824 bp, Bovine  19866881166104
atagtgtggagttcacttggcaatacctctgcatgccccacacacatttaaaaatagttcaacagggctctctcaggacagatggaaactttgtgatcttccccgggcagctatcaacataccttctcttaaagataatctaaaacactgtttttcaaactctgattataacccacagttaagaaattcgttttaaatagtgatagcatccactctaaacgacaagaaacggaaacaaaagtgttctgatagagtggccatcacttctacatgaaatgcatactgatattttctatttccttttattgccactgttcattaaaaaggaaaataaaaccctgacatgacttacaattgaccatataactcaagattaattagtatggtggttcttaatccaagttaacattagaattatctgatgagattttttttaaaaaatagcaattcagggtcctctactccagaccaaaaaatcagaatctttgatgtgggataatttttttttttaagttccccaggtaaccccactgtgcagccaggactgcaaaccactgctctgagggatcttgaccttctgttgaaaaattctgatctagaagtttcagtaggcgttacatttatgttgaatccaggaaactttcaagtgctgagttttcaccagagcacataaaccagggtgattatctgccttatttttgtgctgtgaaggccaatcatcaaagttttatttggggtgtgagtacaagtgaagagtgattttcatccatgaacctaaataaagaacattatgggctcaatatgaataatgctgggagtctttg

SEQ ID NO: 34877 - DNA, 2908 bp, Bovine  19866881188250
aaggtatttttagggaaggtgggcacaatctagatttctttgaatttactcttcagttggttaatgagaaattaaccaaaattctgtttctctccgaacaccattacaaagagaggggtaaggagaaggcagccttcactctactaataaaaaggacaaacataagtcactccacttcttcctgccttgaatgcagacatctgtctaacacgtgggcagccacctaatgctgaaatctgatggtgaggctgagtgagtgacaaccgtcagcactggaactttcaagtcactgaacctgcgcgagcagctgccggcatctaacctgtttgccatgtgagaaagagaaaccccttgtagcttaagttaataaaagttttcaatcacatggagctatgaacatccttaactgtgacacagtgtgtctggtaagaaagcagagaaacatcttaaaatgaaatcacctaaatggaacttttcaccactgagttgaaaaataatcaccatttttctcttttgcaatataaacacttactatctgcatatgtgatactttccccaggtgcatgaggcaaggaagatggaaagtcaggttgctctggtttttcacttgtgtttgggaacaaatatagaaaaatgattctccatagagaagaaaaagccaggattcaaatttccagggccgacttttctctgtgcccagggccccaggccctgaagctggactccccactcaggtttcataagcccagatgtctgattttgaaaagctgctttgtgttggaagagtggagctatgtgtgatagtacgttaatgcgtccaatggttttacgtgtcttcatttagaacacaagaatttaccaaaaaagaaatatagtaatgaaagaatacatcttaaggagttgtggcttagcataagacagctgggttaagcattaaaaatgttcatattcttctacattattatgattccagactgtgattatatatttgtcattatatataaaaagtccgcttacaagcaaagaacacttagcactggagtagaacagacttgaaattgaatcctgggtccaccatctgttgtggtaggggtacctgcagctagctactgattacttattcagattataactttggacaagtcatttagtctatctgaatctcagtgttctcccctggaagggaaatgattaatacctgtcatccaggttgtgggaagaaagtaagaaataccactgatctaccgtatcagctcttacaattatcagccagcacgtgacagatcagcagcctccctccctgcccgagcctctgcaggaacttcccacggagtccctctgataacctgacccactgagatgttcggttcacgccctgcaacattcctgagcaactgctcaagccatttggaccgagttcaatttaataaacagacagattcatctgagtgaagatgatctgtgttgccctctctccagggctcttgtggttggcaaggctgaaagtcagaggtggaccagaggtcagaattattcccgtttggaagtcagagtcgcagatccactggagtaggagtccaagccttccctgaagagccctttttgcagtgacacagagaggaaaaccagatgtggattcatcctctccctgcactgctagatctcaagctcctctgtagattaaagatttacacaggctccctctctgttagtttactgatcttgaataaaggaattctagacaagttctttattcggtacaacttgtccaagaggtatgcagtatgtcataaaagggtgtctgccagattgtttcactgatttttaaaccaagctgacttcttattctgacaaccacagaataagagtttccaaagcttgaaacctaacctactgaatatgaaatgcaagagtcaggtaaattacaaagacagatgatagatctcagtgactgggaaaactgaggcttggggattggcctcagtccagaacttaccctgaatgagctaaggttctcctgagatcatgtgacttgggtcagaccccaattataacttaggatctgctattaaatgtcatggtaccctggaggtcacactgcatttctaagtctttgctaccgcatctatcatattagtttatttggattcagatattaccaatttagacgctaccagatctaaacattgtaagcctttgattaaaagctgtagctttgccagatgtaaattattatgtataaaatggataaacaaggtctgactgtatagcacagggagctattatattcaatattctatgataaattataatagaaaagaatattttaaaaagaatggataggacttccctgacatgccaatgattaagactctgcacttccactgcagggagcacgagttcaatccctggtcagggaactaagatcccacatgccgcagtgtggccaaaaaacccacaatgtacatgtgtgtgtgtgtgtatacatatatatatatatgtatgtatgtgtctgtgtgtgtgtataactgaattctttgctgtacagcagaaattaacataacattgtaaatagcctatattgcaattaaaaaaaattttaatggtagttttgcaaagttgcgtggatggtgataattaaatagttgtaacacttcctgatccccatcatgccgtgtatggaatcagctctgtgttctggggctggaatactgccgtttcagtattacacagacttctctttcagtacacacatgacgggataaaagtcaaacttgcataaaacgctcttctgatacggaggagtgagaaacgtcttcatcacagattcatttgcaagcagctaacatatattattgatccttggagtttataaaaattggagcctattaggctgtttcactaggcc

SEQ ID NO: 34878 - DNA, 651 bp, Bovine  19866881362761
ctctgtccggtgtgctttccccgtccttgtttatgtaagtcggtgatttgtgggctcaagaatttcaggatttatcgtcctaggaaaggatgatgggaaacaagaaaacataatcctctgcagctaacttcaaaacatctggctcatgcggtgtggaataaatgaaagaaatctacccaaaattcaaagagagaaagaggtggtagggagagagatggaagggaaggaagagcatggaagagtagaagaggaaaggaggagagagcacgaggtggagggtgaggtggagagaaggggagaaagagaaagtcaagaaaccagaagtttcagcctcgcttttcttctatgcaagtgatgaaagatgaagactgcaatcagaaaaaaaataaaaatgagggatttccctgaggatccagtggttaaaactccaagcttccactgcaagaggcatgggttccctggtcagtaaattaagatcctggatgctgtgtggagtggccagaaaaaaggcaagggaggggatgggaaggtgaaggagaagaaggagagaaagaaggaggaggaggagaaagtaattgattagtggaaatgtcaggatttctatcttttctttcctctgctcctttttggaggctaaataaaagcagaaca

SEQ ID NO: 34879 - DNA, 1846 bp, Bovine  19866881406519
tttagaagtagaacattttagatggttcagttcaaagacctgtataggataactacatttacataatacttactatgtgcctggcacggtaacacgtaccattctcacaaaaccctgtgaactaagtgttaccatccctacaaagaaactgaggctaataaggactatataactcgtctgtggtcattccactaataacagtagggtgaggacttttaaagcctggaagcctggtctcaagaatctgtgctcttaatatttatgggagaaggaaatggcagcccactccagtattcttgcctggagaatcccagggatggaggagcctggtgggctgccgtctatggtgttgcacagagttggacacgactgaaacaacttagcagcagcagcagcataacatgtctttattaaaaattagattccatttatttgctgtaggcaagggctttgggagtgtgtgccttaaattctattaggtaatcagtgtaggcagaccatctgttcccctctgctttgcttcgagcaaactgaccagctccaggaaggactgggcaggctggtgcaatggccactgtcaaacggagcctctgtgcacagtccgactctgttacacaatgatccatttacaaaggtccttgaaaaatatatccttcctgacattaggatcaggaatagttacaattgttccaaacaattggttggctttgaataaggactacttggtttaaaaacaaatatacatcccaacaatagaggacctcaggttgtgcattttctttcttcctctctccaggctctgctgggtgccctgaccctcgcttgcatttagatttcaccctaattctttttatttcatgtgtctgtaatttgtgaatgtttttaagttttttaaaacacaaattgatatcagtccactaataaaatgatgtatgagaaaatagttttgagcacttatgcaagttatagaattttacttaggatgctcaaatattttgatgttgaatctgaagtgtgtgtgtgcctgtctgtgtgcatgtaccaattataccataggttgcccagttagaaactctgaaataccacttaaaaaaaaaaattcctaggaaagtattatactaagataggacgggccagagaagaaggaagaggtttgctgtaagcatcagttattaattgaacactctcaggtaaacgaaacaaaaccactaaactacaagcagacccaaagtttgcggctgttgacttctattcatcctattcatggacaagtctggagcagcccgtccaggctcagcgcgttagctccaccaggaatgtgcgaggggctggagtcggatgttctcctggactttgccctggggcgtaaggtggactagacggagatggggttgccctgtacatgttactctcaattagacacaagtcctgccaaacactagcaaaattctcacaagaatgttcctgtcaactttgtagttcttcccagtgaaaggctagaagggcttttgtggaattaagcttgagaagcaacctatactggttggcaggccctgggggcacttcctggttcacctctgaaggttgaagggcaggtcaaggctgccgcttctagaatgaccgaccacctgctttggtctcagccgctctgttgtttgttctctttctatactgagtttaaaaagcgtttagccgctcccaaaacgtcccaaatgataaacatgtgtaatttgttgcagctgtagcgtaaggcttctcaaaatgtgctctgcaccagaatcccctaggcctgtttatttaaaattcagtttccgagattccattccaggctcataaattagatatt

SEQ ID NO: 34880 - DNA, 1216 bp, Bovine  19866881880761
ccatttatgaaaaagaatattccttgctgatttctagtctttttcaggttaaaggaaacacagaaacagaaatttgaaatttaccgattaaagaagactctagaaacccccctttcaatatcagaaaccaaatgttaccttcccctcaaatttcctgtgatttctttttgaaaacctacacataaaaatttggtggggagggaattatctattaacatctgtcagtcttaaaacttcaaagaggtggtgaaaacccctaacaatagcaaatcaggctgaaaggaagctctgggatgtggctttatctaaacagaagccacccacaccctctcagagttaacccctgagttgctcccagagaaaccagcagctgtgggtatagcgggtacaatcagcttctcctttactcagggaccagcagggagtatttcctcctgccaacccccaattacacatagaagagtaaactgaatacaaattatatacttctctgtgtgccaagagttttatataatatttatatttaatggacagaaaaccccatgagatagatactactattattataaaccccattctgtagattctcaaactctgattagagacgcccgctcgtaaccccatgccatgctgtttctaaacttcacatcactgggagccaattaagaatgcctttatacaagcgctcaattggatgaagtggctgtcttcacttggggctggcctaagtgactgcaggccgtccactaagtgatcccggggcgtccaaaggggcacatttgggtgtgtagactgctcccctcggttcttaacgaagaaccaatgttcctgccactgtgcatctctctcctgtctgggaatcagaagtcttacacaaggaagaaccttaaacctttttgctttcttctctcagaacccatcatcacaggacacagcttgtacagaactcaagacataattgctgaactactgagggaggaggcagatgggcccccctgcaggataaagcaactggaaattcattctctattgactaaaactccaagacaagaatagcaggacaattaagggagaaggctgggccccgctcaaaccacatacttctcattccggaagtcaggaaacctccccgaccacacatgcacagaaaagctccctgcaggctggagagggaacaatgtcatgggatgctctacccagaggcctcttcggtagg

SEQ ID NO: 34881 - DNA, 823 bp, Bovine  19866881926649
gaatggtcttgatccctgtctcctgtacaatgtcacgaaccttattccatagctcatcaggcactctatcagatctaggcccttaaatctatttctcacttccactgtataatgaggttggtcctagaagataactacccagtggtgaaaacatgaaactgtcaaccgtaaatattcaaagttgcccactggactaaaaggttcagaaagttctattgccctgtttgtgtttttctcatactatataagtatggtggcatctgcattattttatctaagccgctaagtaattcaatggcaggtgtcttgaaacaaagctagatataaatatttgatgatcacatttattacagagttaacattcatctcagggtggaatttaatttatagtctaaggatacctcctaatttttgcagagaaatatcacaggagaataaatgttaacatttcaattcaattcaacaacacttattgtttgtaaatgtttgtcatgctgaattgaattaaattaacatttcagtgagcatcactgcaggctctgtgacctatatttaaatatttgaaaaatggtcccttttctgtcgtgctgttagtcacagtggttctcttgccttaacttcccacattcttgttatccagcaagtcctttcctggagtgggcaaaagccatccatgtcccccatcccccgtgccaaggcagagtcctcttaggcatgttacttgaaacaaatatgaaattatcaacttggagaaagcgtctctgggaataacaattattttaagttagcaacatcagtgctttattttcatgatttatttttt

SEQ ID NO: 34882 - DNA, 763 bp, Bovine  19866882256130
ggaatatatcaagttaagtgtgaaggcatgactactcctttaatgtattcatacctacaaattaaattactaaggtttttttggtacaataatgtcctttagccccttcagtttttctggcgtgaaaaagaattaactgaccgcctgtccacattgatgtataaagagaaacatctccagtgtttgagtgctaattattttattggatttatgtaggaaaaaagacccaacaacccagagtatacactgctatttgccaataagaaatagacaagacctaattccaaagtcagctcttagcctcattcctgccagggctacattgcataggatttctgtaagtgagtgttacttcttaagattttattttgtttatttactttttggctgcaccatgcggcatttgggatcttagttctccaaccagaaattgaacctgtgccccctgcacagagtcttaaccaccggaccaccagggaaatcccaaacttattactttcgttattatgattttagccacattccctcgtgtctaatttctgtcttatagtccgtattaaacgagactagtcacgtatctgatcagcatgtataactcattgttcgctcttgaaaacggcttcttctgtggtctgtgattacagtttttgagacagagtcttgatcgccccttagagggtttttgagtcagcagtggattagattctgtttccattaatactgagttttattagaagcatcaagagaaacttttcctcagtgt

SEQ ID NO: 34883 - DNA, 1109 bp, Bovine  19866880121096
tattcttgccttgagaaccccatgaacagtatgaagaggcaaaatgataggatacttaaagaggaactccccaggtcggtaggtgtccaatatgctactggagatcagtggagaaatacctccagaaagaatgaagatatggagccaaagcaaaaacaatacccaattgtggatgtgactggtgatagaagcaaggtccgatgctgtaaagagcaatattgcataggaacctggaatgtcaggtacatgaatcaaagcaaactggaagtggtcaaacaggagatggcaagagtgaatgccgacgttctaggaatcagtgacctaaaatgaactgaaatgggtgaatttaactcagatgaccattatatctactactctgggcaggaatcccttcgaagaaatggagtagccatcatggtcaacaaaacagtccgaaatgcagtacttgaatgcaatctcaaaaacgacagaatgatctctgttcatttccaaagcaaaccaaacagccaaattagcatccaaaattattaattgattgaatttgttgattcactgaacacacttggcaatttcacctaaagggtcagataagcagagtgtgtgttaatgtttatttactgaagaactctcttattcaccaccccatagaattatatattttaaaaatcaacttcaggcttagaaacaaattgttggatgttcacagaaatgttgttgtaaaatgaatgaatttgtcaccaaaaaagaaacacataatcagactggctgaatgtaccctaattagatctcagccttgggttgacactgacacatgtgttgaaccatgctttcagcaagatgaagtctcattatatgggtggtcatgcctcttgctattctgctgttataattttaacacatttttttaatgtatacttcgtgtttcttttctttaacttcagccggagtaaatgagatggaattgtaagtcactcatagaaagatttaacatttaaaaacttttgaaatgcactgcagtgaagcattgtagttgcaacattaaaaaaaaaaaaaaaaaaagtagtgagtgccttaccaatataaaaaaaataagactggatttctgaaat

SEQ ID NO: 34884 - DNA, 1402 bp, Bovine  19866880666989
aaaatgagtttgtaagccgactgaatggactaagagagagaactatatctaacaataatttggcatacccactaaaaaataggtacagtgaggaaacacatataatcatgaaatctatgaaagaggtattcaaatgtaaataagagtaatgcaaatataacacaaagcaggatatttagagccatttgattgactaaaattaatgtctacattaccaaatgttgaaagatcagtaggatctcttagtgctggtgatagtaaaaacatatgacgactttgaaacacaaatttatattattctgtaaaattgggcactcatataaactataagcccagtaacttgaaatttttgttcatacctgggacaaaatgctcgcacatattcaccagaatgtataaaaaagaatgttcatagcagcaccatctataaaaagagaaaatctggggaaacacacacacacacacgtgtacaaatcctcaggagaatgtaataacacagtagaatagtatatacttgtgaaaatgaactacagttgcatgcaacaatttgagtgagactacttaattcagatattgactgaaaaaatgaatttctgaaaattatatgttaagaagttaagaaaatagctaatactatcaaacacactctctgggatctggcatttctccattcaaaagttacccttttgtgtcttatgaaagtttcaacagagaatacatttttaatgtgcacttgccctggtaacaaagagtgtccaatacttttagaaggaagaggcattaagacaacccagagaaaacaatgtctggctgaaataaggcaagcggtcatttatgaaggtgtccaggcctgagaattgggcaaggccaatgaaaacaaaatttgaaaggcctccaagtcaaccattccctccatttttattctcccaagagctgcactgaaacatggctttaagaggtgaatttggatatacttgagcagtctctgaatcttttcccaccaggatgggccaggccacttccctatattggtgcttaacctaatttggaatcctcttttgcaaaatgcctttaccacctgcctgaggtgaaaggaacgaagctcatgccaactgacggaaatgttttctgcaaggctgagttaacagggcaaccttacattatcttttgctgaataaggaaattattttttccaacagagaaggctaagaatgtacttttctttattctctcaattgaaactcaggttaagtggagagcagccgaagcagcagatttcacatattgggggtgatacctgatgtgcttctatcttgaggaattcatgggaaaggaaagtgtgttttctcatagactatccctagaagacaatacaattccttcagtggcatatcttctctgg

SEQ ID NO: 34885 - DNA, 1219 bp, Bovine  19866880670860
ttttgatgatttgtaacaaaccaaaacccatcatcacttcactggagtccttatttgttgatttcttatgcaatgaaatatgcatctgaagaaatttgttttcccctctaaagattgattttgcattcaaataaaatgtgatagttagaaatgtggatgtaagcccatgttggatttttgacatcttggaatttagtaaaataaatagaaaaaacagaaaatgaaaatttagatagtatctattgttaagtagaagagactctggattaaaagttataggtagtgataccaaaatcatttaggtcttattttgtgactctaaaaatgaagctgatcgaaataggtaacaagagcattttcagcttaaatagtcaatgattaaatgattgtagtcaatgaatataaggcatgctatttttctcattggtattactgttttttttttttttttttcctttttgaaaaaccaaagaagagtggaaagaatggacaattagaatatggaaggtctttagaatgagaggaaaagggaagagccattaactccaaccaagagtaggcagaccacatgggggtctcagtctagtcaagctcccaaaagacagactctacctcaggtagtttggaaaaaaaactttgctgttgtgattttgttttaaacatactacacaacagatgttccattacacttttctgtcagaatgtctaaataaagagaatggattttgcttgtttctttgctatctcaattttagaagtcttaattaggacattcaagtaggttgttttctgtgtttgagatggaattctcatgaagccatccccagaggtgctcatcctcattccagctgctaaggaacacttgtgcccagtacacattctactgtgacatgaagggcctcatttcatcccctggcaagggaggtgtcaagagaacaggtttttgtctgaatcatttgtcattttcctgaacatctctgaaatattgggccacacatataaacagtctgattttgtagccacagaaatgagaagaaagtgaaagtgaaagtcactcggtcgcatccaactttttgcaaccccatggtctatacagtctgtggaattttccaggccagaatactggagtgggtagcctttcccttctctaggagatcctcccaagccagggatttaacccagatatcccatactacaagtggattctttaccagctgag

SEQ ID NO: 34886 - DNA, 1428 bp, Bovine  19866880716990
aaaaaaaatatctgggacttttaaaagagaaaaaaaagaattggtgatcacagatcagcataacaatatgataaaattttcaagaagtttgaaatagtatggaaattagcaaatgtgagcaaatactgttggaaaaatgatcactaatgactcattcatcacaggattcccacaaaccctcaaacacaaactctgtgaatcacaataagatgaaacacaagaacatgagttatgcttgtacagaaggaaaaaaaaaatgaaagccaaatgtatgttagcgtattcagcaaatagtaaagtgctagcaaaatatgagctaccattattattattattgttattactatacattcacacactcaaaaatacgacctatatttttacattgcagagtgccactgaggattgttatatagggctgtcaaattataattttctgaatgtttttagatgtaattataacacccattcattttccttcttgccttaaccatcaccatctctcagttggcttactactaactaatagtgtcctaactagtcctacccactcttgtccattctgtatgctgctgctaggctgtcccttctgccatcagatttgattttatgatatttctgctttaaacatgaaaagttttcctattgtgctaaagacagagatcaagcatcttagcctggcctgtacagatcgtccttattctccttctctaattcacttcattgctttctacttgcctcctcacactctccaccatagaaataatgaactagttacacgcttgcaaaaactttccgtgtccttacagcttttgcctttactgttcctctgtctggactgtcttttccaacatctggactacctagtgctaaagcagaacagaccagatagtaacattcccttaagctttaccagtcaaagccaacacaacttcccataaactcctgaatctgtccctattatgacactgcatggtttacttgccccaactaagtgaaagctgcttgagaacatggatcatgtcctttttaaatcttatgtaatcagaatttagcatgtctggcacaattctgatacacagcaaactgcttcaaataacatagtaaatgaataaaatacatggataaatagaaaggaggaaaggaaagaaaggagggagaaagtaaagaaaagagtatacaaggaagaatgaaaaatttatgtcctcttactcaagaagaatataaaaacttaataaccttggttttggaggtatgaagatgggatcagaagcatatgcttctgtaagttccaagtgttatttttagagaaaataaattatagtgtgtttttgtatagcaaactgtaaacctatcacctcctgctgtaaatctgaccctccatggaataacatctttcctgtcatcctcagtgtttttcataagaca

SEQ ID NO: 34887 - DNA, 1415 bp, Bovine  19866880729549
atgcctgacatcacagtatttatccctagaaataatgacaccatggcaaagcagcaatgtgactgcattgcaggaccaagcagtgtagcaagggagaccctaaaggcagtgcttcatatccagatacaaagggattcacaatgaacacatcaccaattttaataaacctgatgaaagttaagtagattggatatgaaagtcaactatacttgagatcccctgcttgtcttagagaccctctttaaattaagactttgccaggtgattaagaagaacaccagtgcttcaaagggaatcagagtcttgttgtctgtggctccacgggcgaccagttctctttcccttcggtccagacggaagctttgttctcccgaagttgttcaggtgctgagcctgtccaaacaagggaatcgagggaggctttacgaccctgcacctttttgaaaagcagtgccactccctcggctcgaaggccccgaacatcaaatgcctccctttgccaggcagcttggctattccccaggcattttcaatctagttgggtaaaacaaaaattgcataatttgtcattattttcaaggaatgagatgtgccttctacaatcccttccgagttaaatacaatgatgctgaccttcctgtgaatgccaatgccttctttctcacaaagaatagaaataaagaatgggaaaagaaacacccaattgattgcctataatttgctctggtatttgttatttgtgtcttctttgtatgcattttaaggataggtagcagaaaaattattttcccaagtctttattaaagagaagccaaatcctctgggaaaagctgggactggaagccaggacttctgagttaactgcaagattcaaaacaaataaatcacatcaatttaggcaagtcacaagtcatataatcattcaatttcctcatctttaaaatgagaattaaaatgatcctctctaaatatatcccatttaattatggaactaaaatgaacaaaattgataagaaagtgctttcaaatgttgaatattctctgtaaatgtaaagtagtttgaatgagaaataaagggggccagaattcttagacaggagttctgcttctctttctatggtgaaagcttcaaatccaagcagagaggggaaccaagagcagagaaaacaactcagaaaaaatcactggaaagcaagggcatcctaaatctcatctattaagagcaaagaaaaacatctaaaaacttccacccatatttttttgtgtacagtgcttttctgctgccacttggttacaacaatagtggagaaaagtaggcccataaagaaagattgattgctgggaagatgatcaattgccactgtgaaaggggtgcaaactgataaatgtttttttttcttcccctctcttcacaa

SEQ ID NO: 34888 - DNA, 2011 bp, Bovine  19866880870702
ggcttcccttgtggcttagctggtaaagaatgcgcctgcagtgtgggagacctggttcaatccctgggttgggaagatcccctggagaagggaaaggctacccactccagtattctggcctagagaattccatggactgtatagtccatggggtcacaaagagtcggacactactgaacaactttcactcattttctctgatcctgggacttccctggtggctcatagggtaaagagtctgctcgtaatacgggagacccgggctcaatccctgagtcaggatgatcccctagagaagtaaatagcaacccagtccagtattcgtccctggaaaatctcatggatggagaagcctggagggctacagtccatggggtcacagagagtcggacatgactgagcaactaaccctttccctttccctttctttcctctgttgctacttggccactagctgagaatcccagattttccctcacaattagcaaagagcattggtggcaagtgcacgtgcctcattcagcccatttcttgctgaggattgtctgtggctgttttcagggctgacatatttctctctgttctctggagtgagtcaggagaactgactcagggaaggcattccaagttctttgtgcagtggtgtttaaaatgcaagatccctttctcggagagaaatgacttgaagggcttcaatgcaaaccccccgttctgctctccaagcagctgtgaggctggcagaccctgcaggcagagaagggactggcatgggccatgatgatacatattcagcagcaagaggacttgattctgcaccttgctggttacagctgccagatcatgagcgatcgatagagaactttgttaatgatgtggaattcacttctggcacactctgcacaaatacatatgcaatatattattagtgccttcaactatgggccagtccagatgtgatttaattcaaagtctgattatcttttcctttttttttacctttataattggaacatcattgatcagattctgcttttaataaaaatggcaaaccatgcagcattgcttgaagaaacttatttggctgcaaacatcagaaaatcacaaggtaggggtaatgaaatgacagcggatgctgtggtggaaaaggaaagccactcacaaagtcctggagtccacgtttttaagaaacatgaagcgggtggattatctttggaaattactagagaagatgtatttatatagattcctttccaaaagatgaatccaatcatcatcccatagataaatgcggagtcttaatggcaaatgttgatttaatattcgagtctgagtcttgcagtaaaaagactgaattgcattagaagagctgggctagaactgggcagacacggaaacctaataccacagcaaataaatctggcagcacaatttaaaactgaaaagaaatagaaagataaatgatgtcataaaagattcacaggggcgtttttaactgaactgctaaatattttaaaacagaatagccaaggccattttgtattagaaacccaaatgagtggctctctcaatttattaaattgagttccctcagtgtttattgggcctggtctatctgaaagattctgtttgaggcaccggagtattggaatattacccaaggatattactgactagtaaggaagataaggcaagtagcccaacaatttaaataaatactataataatttaggaaaatgaatgacaatcatatcttcattcctgcaagcccattttaagcaataagtctagagatgttgcctcctacgaagctcctatgccatttgttaaataacccaagtttcttgtctgcaatcagggactaggctcttgaagtggccttgccatattggatgacaagtgtgccatcatgtcagatcatctgtttaactggagtgctgggttcaagaaagaggacaggacaggcagaacaacaatagaggcacttgcgaatggcaagaatcatttctaagag

SEQ ID NO: 34889 - DNA, 1842 bp, Bovine  19866880900162
agaggagtactagactgcaactccccctagaaatatggcttctatttagttatttccatgatcaacagcaacttcctgtgtctaactcaagcatcttcagtttgccctaagtcagttccttctatgctaagtcacacagtaataggggatggttgactgagaggtcattgaaattggcatcaaccaggaagcagtccttgaagaggaagaaactgtaatctggagaaagacattaaaacacattgtgctgtatggtaaggtcaacttgaattgttgataagctaaccctgtctctagttgcccttctgtaaaaattaaatctgtttctttgttctgtaagcaatactgttttccatgtttcttttagatttttgtattcaggtgttcagaggttatcatcacaaagatggaaaataaaggaagtaaactgagatagaattataaaatacatttaaagaagccacaaattagaaaagccataagcttgtgctgagagtgagtgagaagatgatccagcaaaaattaaggtgaacatgtccaagaccaagtgaggtcttatacattgggaatggtacttggtttctctctttacatttctcacctctaattcttttgtcttcctttcactgtctgcagattttctcttatgtattcaatatggctacctttacataagggggctaaatgctttcttgtttctagttcagaaaaaaaaaattgtgaagttcacttcacagttgaagagatcaattgtttagatcatgagtacccctctgcatctttcgtcatcatcatggtcatcatgacgtgatatcttgatgtattaagctaataatggtcaactctagagttgatagttgggtaaatctcatccaaacttccagtacaaaaatggaatgaggacatctttctatagaagctattagtcttcgtggaactattaccctcatggatcactgacttgttgtggcaaaagggctatgagccatgttgtgaagggccacccaagatggacaggtcatagtgcaaagttctgacataatgtggcccactggaggaggaaatggcaagccactcgagtattcatggtgtcagaaacacatgaacagtataaaaagacaaaaatatatgacattgaaagataagcccccctgtttggaagttgtccaatatgctaatggggaagagtggaaggcaattactaacagccccaagaatgaagcagctgggccaaagcagaaacaacactcagttgtggatgtgtctggtggtgaaagttaaatcagatggtgtaaaggaattgataggaacctggaatgttaggcccatgaatcaaggtaaattagacctggtcaaaggattctctggtggctcagagggtaaagagtctgcctacaatgcaggagacctgagttcgatccctgggctgggaagatcccctggagaagaaagtgtcaaaccacttcagtattcttgcctggaaaaatcccatggacagaggagcttggtgggctacagtattcttgcctggaaaatcccgtggatggaggagaaacctggtgggctagagtccatagggttcaaagagtctgacatggcactactgagtgactgtactttcaagtagaagatggctttataaatcaatgcactaaaatggataagaataagagaatttgggaggagccaagatggcggaggagtaagacggggagaacactttctcccccacaaattcatcaaaagagcatttaaacatcgagtaaattccacaaaacaacttctgaatgccagcagaggacatcaggcacccagaaaagcaacccaactcttctacaggag

SEQ ID NO: 34890 - DNA, 1754 bp, Bovine  19866880914527
ttgggttgggaagttcccctggaggaggaaatggcaacccactccagtgttcttgcctgggaaatcccatggacaggggagcctggtgtgttatagtccatggggtcacaaaagagttggacacaacttagtgactaaataacacccaagaacacgtagaaaacactaggaatgcatgcccagaatcacacagctaccctctgacctggaatcatatatgtgtgtgtgtgtgtgtgtgtgtgtgtgtgtgtgtgtgtataataatacattaatatattcaattttaattattcattaaattttctgaattcttccaagtgcatctgagggttaccagtataatcactggtagtatcaggaagaatctaattgcttgactatgaacactccaggaagtagtttgtaaacccacacttagagccaccatgaccaagccactcaaccaatatttagtaagtggtacaggcactgtgttggtatcacatttgatcctttcaatgttcttagaaattaaaacccatatccacaagtcacacactatttctattcataagttgataatttaattctctcctcctctctctgcctttccactctctccaacaatgtagcagagtgatgaaaagcagagtactgcaacaaggatgccaacctcagcttcataccataagattcgtgtgaccttggaggaactgagttaacttctctatgattcacttttctactctacaaaatggaagcaatccaagcattactttgttgagtgacccattaaatgttatatatgttggacacaaagagactcacgttcaaggtcaacacttagagtcaagctagaagtatattatgcaaagcataatacatcaaaatatgtttaattgttaaatggagtgtatacaccaagggacaaaatctaaacaatgcccaacagatagcattgtggttttgaaaatggctgagtggataattcataaacaatgcttatttccccatgtaatgccttcagcagctcaacacttaaggcaatcaaattatcctaaaaaggaaaggaggcctcacaaatctatgacaaaattccttcaaactgaagacccaagtctagtttctacctagccacagtgatagacaaatccttttcatttttgttaccatttatcaagcatccacagcatagtttatatttagaaaaaaataaagaataaaatcccttctttcaaacactttatgttctacttgggttgctaaagtatgcatttgtaaaaaaactccattataatatgtgtaattaacctcaaaggaaattgcttttgctatgaaaattcagagagagtgtgaggacgctgtgggctaatctgatcagaaactatgatatgatggaaatatataatatgagatttaaaagtccagataacactaggcgaaagaaaatctggagagatcattttgggtatataaaccagagtaaatccacaaccatgaaaccaaatgaccagtgtatgtaaagtgtggaaaatccaggaggttctgctaggcaggatgaataagcaaaacacctttttggttcctttaaactttacatatcttctggtgaagagatacacaaagtttgcatgaaataatttggaaaataataaaaaatggtttgactgcaagataatatgagccaatgatgaggtatgtgggtatttaaagactaacaaaatttgagctacattaatagaattatggtggcttgaaagcaagagagtaataga

SEQ ID NO: 34891 - DNA, 1500 bp, Bovine  19866880944075
gttggggaaacacggaaagtcctatgtatctaaaggataatgcacacttggcattatgataagagatgagaaagcaagctggatcactttaaagttttgaaattcatcttaaaacagaaaattctctcctgtttgcaaaataaaaaataattaaagtcaaaatgccaaataagttctatatttaaaaataaaaatttgatgttactgatattagaggaaggagactgtaggtgggaaatggttgaaatgcccaggacctgaacatctatgaactatggcagtcagaacagaattgtagagcagggtctgagttatatttcagagaaaaaataaataaataaaagaatctgtacactagaatgctctgtgctagaagctatgattgttctctaacagacaaagaataagattatcaacttcatttcacaaaactgattggaacacttggattagatgtgcagccacattggtttcttaataagttatcttcgtactttaattaccccgtccagcaagacagagttgattaatgacagatcttagcaggagcctgcctcaaaacattgacatcatggtgaaatacagactagagaatgtccttggcacaaagaggggaaccaaaaacacagtccagagttgagccaagcactttcagatttttttcctacattctcaaattagacaatgcttctacttcctatagcaaaaaataagtgatggttgtggagtataatcactagtgtgtaaattatctgggaatcttgataaaaatatagatatggatgaagcaggtcttgtttaagaccttggatattgcatttctaacaagttaccaggccattcttatgctgctgctccatgaattaattcagagaacagagtgcctaggatggttactgcagcaaagctttcttacgttaaagcacggactgtgactctgactacatctcggttggacagggtgctccagctctctgatttcctgcaaagttcaggatcaaagacagctattttttgcacattacaactggcaaggctcacaataaccagtaagtgcagaaatcttgataaatgtgccccaacatagccataagaggataattcaattaaacactcataaaacatccagacttaaaaatgttgattccaactattccacacttttcatatattctcccttctggctctagagggtttaaatatttttaaattagctcattctgcccagagaggtcttcatttcttcatttgttttatttgatcacattaacttataagctgcctcatatattttgggaatgtgtctggggacagaaatacaataatgagattagcatttcctcccctaaaagttgggctgcggtgtggactctgcttctctgtcatacttgctttcttcaatacagtgtttcgcacataataaatccttaataaatatgtcttgatgtatacatttgaaatttttcattatttatgtgagcgtgaagtatgtaggtttcc

SEQ ID NO: 34892 - DNA, 802 bp, Bovine  19866881128047
tgttgcttatactagggaaattacataataattatattttaccttaaataatatcagaaaaagtttaattaagacttttaattaatagttgaaagattaatcaatcaacaattatagcaatggttatagggtataattgagcttaattggaggggactgattaatgattaaaataaacctttcagattccttgtcttgaaaatattaaaaaatgatggattttggctcataaaaagaaaatgccaggattgtagacttactgggtccttggtaactaggccatgaaaaggaaaacacatgattgaaataaaagaaattattctattgttcagcctttacatcattatactgataatttggacaagtttgagattaatagaggaaaatatgcatctgaggaagtctataggtaaaggggggaaaaaagaaattgcttgagacagatttctttggaagctaatttctcaggggtgctctttccatctctaaggataaagtggttgtatgaattcaaatgacattcttatcagagcatcataggaatagattcattagagatcagacatctcaaggagacagtccctgtttataggatggcaaagacttctctcacttctatctgatctgttctaatcaaatccaaatagcgaatgggaccaatatcaattcttcctgaagatagttcaattctctttggagaacaggtaggtatctcatttcagggtcatctaactgatgaggatgaatccctcaatgcatagcccagatggagatattcaagctcaggtcggcatgaatgggt

SEQ ID NO: 34893 - DNA, 1850 bp, Bovine  19866881148249
agaaaggagagatctgtgcttgactgagaatagtttcaaagttatgatcctctgttttttgagattgagtgaatggtgatgccaaagggaaaggagtagaagggaagataaatggtatggctttaatttgtgcattttttatttctgtagaatgcgtatagacatgtaagggtcattaactttcaatgaaagttgaaaccatggaaattcatgaaggaagaagaaagaaaatgaggtcactcagttgtgtctgactctttgagaccccatggactgtagcccaccaggctcctccatccatggaattttctaggccggagtactggaatgggttgccttttccttctccaggagatcttcctgatccagggatcgaacccaggtctcccacactgcaggcagacattttactgtctgagccataaatttcccaataaaaagaatgcatcacaaaagaagaagagaggcaaactacatgaggagttttacatcatagagaatgtgcagaaccaataattggtacatcccctatgactatgagtgtaattcctttcccaccgaggttgcactggttaagttgattgacatctgctctcactgcattgcgagttttgacaactacttcttataaagttcaccacacaaatgagactaaaagtccatggccaaagtcctaggactgttgggagacattatattaccttaaaaatctttataacctggggaggataatgattaatggggtaatcagatggaaggtgtggaattttaaatagtagactgtgtcacttagagtggtttgttactccattggagatgacaaagcccgagtacataaatgatgactgaagcattcataaatcaataattggtaaaatgtactcatgtatagctaagtagattctgtctggtaggttaaataaactgattacagtatactgcaggattcagaggaattatggacaaggttttattcaccaaagaaagctagagacaagtattgttttataaaagcatttttactggcaagaaaagaaggaaagaggagtacttggaaggtgggtctaaagtagcagattgaccaggaagagggctatgatttttggaaatcttgagacagatgatactatgggaattgtgagcacaataagggaattttagattatacttcccggtaccttccctacctggtagcctttatggtaccctggataaaatttggggacattattggcatgttggcaagtgtcacaatagaggtgttatatagggccagacaggcaggctctggcagtttaagggaagagtaaaggtataatgtcaccgcttttaatctggagtgtgtgaagaccatttctgtgcatgtgctcagtcacttcaatcatgtccgaccctgtgcaaccccatgggccattgcccaacaggctcccctgtccatgggattttcccagcaagaatactggagtgggttgccacgcttttctccaggggatcttctcaaaccagggtttggacccacatctcctttgtctcctgtatctcaggcagattctttaccactgagcctcagggacgccctgaagaccatttctcaactatgttaaaatcacctttgaaaaaagaagtaatcatgtgtcacatttcctgatttattctttcatttttgatatttatatcctatgtgaggtctccccaactaattacaccattgaaatgtcctgtgtactgaatccttgtaattgccatgatcttcatcacagggtccttgaatgtttatgtgtgaatgacccttagagataatacaaataaataccatctccaagtttcaaaagctaaagaaaagacatgaa

SEQ ID NO: 34894 - DNA, 1331 bp, Bovine  19866881153190
aataggacagagattcaaaaccagctctgcctcacttcaaagactatttttttttaaattccttctctgctactatgcatctttatcttttagacatctgtctatagaaaaaagaatgaacaaaaaatatttacacagttgtgtgaaacttccaaaatcatattttgccttttggcattttagatcaccttcaagcaaaattaaaatttcagtcattttcaaagtcacccattgttgtagatatctgtcattgtcatgaactatgtaacctgaagtaagtccacaactgaaatctgaaattatctaccaagagatagatatcctggactgaaataaggaaacttggggacaaggtaaaagaacacttaaggtaatgaaatatagagtcattagcactctagcaaagtaatataagcaagctgacagcacaaaagggaagaaattttattgtactttggtacagcaggaaaataagatactcggggcaatgcagaagggctggtaaatttgaaacaaatgaaaggcaataaccttaaatatagtgataataggtctgtgggattcactactgtaggacatgtttaaatgaaataacagtatggactatggggtagataatttaatgaccaataaccttgctggtgttttggctaaaaaagatacacagcatcctcatgggcctgatctgatcagcccaaggacaaggagaatttaatttccccatgaaccagaataaagtattcatcagagtaactagagcttgcattctcatattattaggacctgtttgtgaactagattcccagctcaggtattaaacattacgttgcaatgggccccataggaaagtgatagaaaatgtcagtgtaaaagatcactctttttttttttttttttccctccaatagtgggctaaactgcattgaaccattctaatactctcttctaactgaaaaaaatttactaaataactggattgagagtaagatttccatttatgacattaggaagatgaagaacagaagccaaaatgattgttttctgcattaaaaacaaataaacatacaggtttatgttattcttacttaatttaccttctggatccttccatcttacaacataaagaaaaccaccttttatagtcttcttagcattcgttatataaataaaatgttcatattaggaaaaatggataactagagggaactcataggaaataaaggatacctcctgtccttttaaaaaaatcaataacaaatgttgcatatacatctctgcatatatgtaagtatatttgtattaaaaaagtctttggagaaattaacaggtca

SEQ ID NO: 34895 - DNA, 2532 bp, Bovine  19866881192940
atgatccctgaattcccactcactgctatatacattttgtataacaactcctacttgagggagggaagaacctgggaatacgacaaaatagctctctgctggccaattacagagggagaaggaatctaagtgattactcctactggtatgaaagaaagataacatccgtgttgtgaattgcctgtggaggccacgtagcaaggaaccatgggttacctctaggagctgagcagaatctccagtcaactgacggctagcaagaaaacagatcatacccaatcataccagtgcaaaggaaatgaattttataatatccaataagcttagaagaggaccacaggcctcaggtaagaaccacagtgccagctgacaccataatttctggctgataagaccctgagcagaggatccagcaaggctttattaagacttgtgacccacagaaaccgtgaactaataggtttgtgttttttcagctgctaaatgtgtagtgattggttatatagtaatataaatctcatacggagccctttgactaccactttatttctgaagattgagttcacataaacaaatgtgaacatgtgatgagagaagatgttggaaaaataataccagtacactcgacagagttgagacaaaaggaatttatgggcaaaacagacaacgtgaaactgggttgcctttggtctggtataacctcatctcagacacaggcattcagatcagtactcacttccatgttcatctagttttttatatgcccacgcttgtgcttggtgtgagtacatgctgtatgtttgtatttgtttagtaatgaatcacatcagatattttaggactagttgttaaatctcttataatggatagaactgtgcaagtctgccattgggggaaattttctcctgacctcagctggtgatcagcttatgccctgaagcataagaattgataggccctataattttatccaagctaatgtaacagcagctgctgtccttggtgcttgctctctgattaaattcccaaattagggattgccttttgtaacccgaattctgtcatggtggtaaaatctgacaataactgctcttatttttgcctctcccatcatggagtgtgtcttcaataacacatggaccatctcagaccatcacatattcctctggcactttattagaatttggaattttgtaatcctactgaaaatgagattgcatgctttctaatgtaagaaaggagagagagcccaattcagctctaaaactgcaattgtttgcctacctccagggacacatctcacagattgccatgaaaataaattggaaagtttacaattccaaatcattgcctaccatgtattactacacagacaaaaacaaacactaccaccaccatcatcaccatcaaaaatatacaaaaacatacccaagaactttcatcccttcatgaggggaaatgtattacaattagattagactataaccattcagaaagtgtgtttgttttcttctgctttataaatgatttattatttattagtatttttttcaagactatcttcttcattccttcaggaaaggagcagtttgggtttctgtgtcattaccaaagcagagcaaaagccttcaactgcggactgctgcaatttccaccataacagtcaacctagcaattagaaccgtttgttacagtgacagcaaagagaaccattttcaagcaacaaggcagaagagtaggagctggaggaagccagagcatgctcattcgaaggggactaacgccacacagcagctaatcctggaatagcaggcagtttagggaactgaggctacaagggctgcagtattcgcataaattcatgaactctggtgacaggtctgattctctgagaatgaaattggctcagaaatgttgacatttgaggagagacaaaggatttttatttagaccactttctaaattattttaatattaaaaatgaaaataaaaagatgaacatttccattgttaattctggattagacagagtatttcaggttcagaaaatatctcacaatagaaactttgccaacaaagccatatttattttacaacaaagatttgagatataacttcaacatcttaaatctagtgtcacttagtcatttcccctgattttcatatattttaactaagttaaagttttatcggtagcttgagagaaaatgctgtgtttgacatttttttccctccctttatttttctccttgttcttccttttcttttttaaaatatagtctccttacctttggatttggttctctattctagcaatgacaaactgtataactctgggatctgtcagtgtctcttagatgtttatttctccctgtctctaataaagcaatatacaacttgttcacctcaaataaatcatctgagtattaatgaaataataagatgtgtttgacttttctcagaaccaggtactcttccctttttgttcaagagctattattatatagggattcaagacatagccaactacag

SEQ ID NO: 34896 - DNA, 1491 bp, Bovine  19866881202515
attgactgtgatttacttaaattatgttggttgggtggtagaaagagttgaaatattctccagtctcttttatttatatattgacttggggtaatactgttttattttgatttattttgagtttcatcatttcaactaattacaaccagaatactcaaatattttcattggttttacatttgaggacagtttcttgaaaaactggcttaaatccaggcaggtttccctctccctaggggtgggattttaacaccacagttttctactgcaactctgaagtgaaccgataaatctcagcaagttcataagggttcacattctattagaaaaggagaacaaaggaacaaccgaattagagacaaatgatgtgaccgagtgccatgaagaaggttcattagaaactaaagacaaagctatgaaatgttcacctgaaaaatgtttgcattttcatagaaaggtctgttctgaattcagtgactgatttgtggggggtcacagcaacacgagtgaaatggcattctttgttcatttgtcctgccacccaaacaacctgaattttaaatctttttctttttgaaatacatttcttctctctttctctgaaccatcatcaagaggcttaattaatgaattagtatttgcagaaatctttgatattctaagatgaaaggttttgcacgagggtaaggcatcagcgccagcagtaaaatgtcctcttgatgacagaatgcatgaagtgttaggctggaatacatttgacagctacaattaaagaggtttgatcctgttttcctgctctgtttttatcatgtacattattccagaggatatgaggctaataggaaagctaaattctcattggccagaaattgttgatctatacacacacatacacattccccagtggttaaggcaggtggaaagtttatgggcagcctctttctggggcaataaaagcttcttttatttcaaattctctttttacaccagttgctattactctgaaaagctcctagcatttggaaggcaataagcagggcataaaatccattctttcttgaacaggtcccattcctaggactgcttttaaactaactggtttacagcaaagaaacagacagctgagtctcctgtaaagcctctcaggaaatgcaggggactgcaagcctgctaactagctgagtgcagtatttggggaatagatacctgacactgactgggtctgtcactattttcttacccgactgaaattctttgaatcttaaataagattaagttgatagaattgatatagactgtggatagagaaaatgccttttcagttcccattttctgaagaaatcttctttttggtttaggctcacccaaagtctttcatttgagaaaatcccagggctagctccctcttatgttgtggtagggttggggagtgaatgtagatttgggatacatgttcagtgcctttcctgggcaatcaattcagggccttat

SEQ ID NO: 34897 - DNA, 1090 bp, Bovine  19866881245152
gaggagctgtgtgtccctgaataaaatgtcgtttttattgtagttttactaaggattgtcccaaagagcttcataagtcttggtttccttggagcttattattgcttagaatagtgccatgttgcactctcatttagcatagcacatcagagtatatgataaatttattttttctaccttaaattcccacagagcgcaatgatagagacataatgcatctgcatacacatgcaaggtagtttgaatttaatgcatttcatatcattaaagttaacatttcatgtattacattttcttttagaatacacttgcatacatccatatccatatagatatatgcacacacacacacaaaatcccattatgcagatcaatttacatgatcacaatgttcatatccataaagcagtgaacttcccaaatcagatgcatgcataaaagcattgatgcataaaatttccatcttgcaagtacagagaaagttctagtaggcatttagtgccatgacaggtcacttaggttacagctagctatataggacatgctaataagatttaaccttctttgtctattgctgaagaggggtaaagaagggaggggtaatactttcttatctttgaagatatcaaagaaaattaaaaacaaccactttctctatgatccctgtggctgaatgtttccctttggctgaatatttttgagctacataaatgaggtatacagtaaaataatatatatttttaggggaacaacatgaagtcttaatccagtctctagtgatcacactataagtgacattgataaaacagaattttatggagtatgtgtacagaattatttccatctccatacttgatatgacttttcatttaaagtaagctccattgagattaatatttaaaatggaaagctaaaaacccaaagtgccatatgacaacacttaagtgaaaatttattagacctgtcatttctgttaattattgtcatttcagctaattactagccatttctgttggttattagatgtgtcgttttcttttctaagctgccatgtaacaccatctctgattctgctttcattaaatatttt

SEQ ID NO: 34898 - DNA, 780 bp, Bovine  19866881269435
ttgccctgatccattgtttcaaactccttccttgtttttagaactgtagttaacagctacaatgcagtcaatattgctttactctatataacatctcccatacaggcaatattgcaaactccttttttcttttaaataatacagtaaccaagttaaataataaagaatagcccagagagagagagaaaaaatgaatgttgtgtacaaaaaaggaaaaatcagcccttctattttatttgaaagaaagttaggagtttatgaggtagaggtccaggaagatcatacatcatgggaataactactgtgttttcaagctttctagaatcatcctaattttatgaaggcaattttgaaatgtcactgtgaagtgatgagctttcagggaaaataaaaatttgccaataaagcaacattgtattatgccatggtaaaagaagttggcttcaattttaactctgaaatttgagtgtagaatgtacttttgtgaaagatataaactattttcaaatgacttatatagtgtagaaagttcttgtattaaaaaaatgcatttaggaataaacatgggatctaataaatattctaaatatgtggaacagagaatcattgttaatattgttctaaacaatgcataattgtagaaaatcatggttagaattcttacctgctcgggctgttctgtaagcctgttatacttgccacgtccaatttctgtagggccagttctatacattctttgagaatttggttcaattgaagcatcctctgagatgaagctcc

SEQ ID NO: 34899 - DNA, 887 bp, Bovine  19866881331190
ttgatgtgaaattaaaaaaaaaaagataagaagaaacaacaaacctctgaggttaaataatgattttcttatttttatatcccatacttcttatttttgtagtatcaatataggttggatgaaataactctctagcaaatttctctaggggaataaaattttctgaccatccaggaaaataattatcaggaacacaactactaatcaacaattatacagaatattgatcatgctagtctcatctttcatcttggccaaaatatataaccaatggtggataaatcatgcttatcctgttctgtttatttgacataaaactttgcagtcaagactctcactctagtcctgccaacgcagatgcccatgtttcaatcttaactagttaggtaacaaagcagaagaaattttaaaacaagaagtctctggtcacggaacatccagatttagcttttcccttgtaagtacattgcctcctttaattgttccctcaaacagacccggaagagaaaacagttttcatttgtgaaggcaaatgtaaaaatgaggaccagtgaggtctaaagtcggagaaggcaatggcaactcactccagtactcttgcctggaaaatcccatgggcgtaggagactggtaggctgcagtccatggggtcgctaagagttagacacgactaagcgacttcactttcacttttcactttcatgcattggagaaggaaatgacaacccactccagtgtccttacctggagaatcccagggatgggggagcctggtgggctgccgtctatggggtcgcacagagttggacacaactaaaacgacttagcagcagcagaaatctaaagtgtatctgagatagagtagtagagttcaaaggggagtacaa

SEQ ID NO: 34900 - DNA, 1099 bp, Bovine  19866881369186
tatgggatgcgtttttcccaattactagactcacaattgaactttacactgtgttttactttcaaatgcctgaactcagaatggaatttctaaaaatctgctttgtagaggacatacacagtgaaggtgaataagaaaaaaaaaaatctgttttcagaaactgggaagatgatggtatattaaaagtattcctgtgaaattggaggaggtaaaaaaaaaaaaaataacaaggctggccaagcttctttttgtgtgaaattcagtcatccattgctgctctggtcccctgggtttgtacttttcctctctccatgactatctatcactgcttgtaaaactcttgcactaaaagatcttaaagttcacagtaaagcaatgcaattattctgagtcattccttcttaccttttaacctaatcttcagaggtgccgagactgaagaagcgcggttcccaaaatgagcctaatcttgtctctgaaaatagcacttccttgccaagaagaactttctccttttgaatggctgcaatgatgagaaaaagaagctaggcttcattaatggccccaggcatggtgggcactatgtctgagcgcccttgctttctgcagagaatagcactgtctacttactgacgctttttctttttcccctttttatccttataatgctcttggcagaaagctttgaaatagctcattactgatttctaattcaataagttaaaggagtgaggggaaaggcaatgcagactcatatttaactataattctttggaatgcctactatgtggcagacaacaggtaggtgctgccatgacaaccctctaaatcaagcattatgaacttagtttagtagcataaaggggctaattcctatattgtaagacaatcatcacaggtggggaatctgaacccagatcttcagatgccaaatgcattgatcacttcttgacctttattttttccagtttattgaggtcaaattgacatgtaacattgtattgatccaaggtgtcagtctgttggcaatcaggggttaatgaacaagacagtaagtagcaagaaagggagataggagatactaggccacttttttttt

SEQ ID NO: 34901 - DNA, 1413 bp, Bovine  19866881390256
ttttactgatagtctataatattctaggctctggaatacaatgataaaagacacaactcttatccacaaagggtttatatttctattcaagtcattctcataatataattggaagtgtactatcacggaatgattctcagtggtactgcataacccagaatagtgcataaatagttagatgatatttatatttggactttaccagaagaagcagttcagaagaaagatcgagaaggtgtggacacagaggttgaaaataataaagtgaggttaatgccttataatattttctatgatttcatcagtttgaagtaatatgacatgcttagcccttttttattggatatttgcttataaccaattttagttttataaataatgttgaaatgaatgatttggtacatagagcttttatcttttttttttgaattatcctgttagaatgtattcccaggcatagaattattggcaaatataagggtgtgtatacagtgtctgtacacattccaccctcccagctgttgtttataatcctgaatagcttttgaaaaggcttataccaatttacaatgtcaaaagtaatatatgaatgtaccaatttctagttttttggtaatcttatagttcctcaaattttgctatagttccagagaagtggaagtacttttggaggatgaaatatttgaccaaaaacatgaatgaaggaaggaacccaacacatttagggtatagtgatgagtatgaatagcatgtttccaaatgaagcacattaatcataaaaatcataaaattttagcatataattttgtaatgtgaagcaagaaataaactactgtttgaaagagaagcaagaccaatattcttcacagggatttcagatttgtgcattgggttgtgacacaatccaaccttcaggaaaaaatcaccattggtgtattttatttccacagatatttatgaacattatacaaaaactttcagctgacccaagtccttgctcttatttattcatttctcagttggtaacatggacagtgttttcagatgagccatggacctagatgtttttcttacagtgagtcccaccaagtccttagtcacttagaagtgtcaggcagaaggaactctgacaggcagctctgtcaacctgaacagagagttttagatcaagcccagaaacattactgtcaaaaattacaacctcagcgttgacataaatgttgacagcaccattttcactgatagtggtatcagagcatattatgattcacaaaggactgtccaactagcaatgatttagatgaaatgctcccaaatagtaaagggagaggaagggaagaaacacaatataaagagtgcaggttacaaaattttatcattctatggcagcaaacatctctcctttctcataat

SEQ ID NO: 34902 - DNA, 1043 bp, Bovine  19866881407460
ctggaaaaggaaatggcaacccactccagtactcttgcctggaaaatcccatggacagaggagtctggcaggctacagtccacggggtcgcaaagagtcggacacaactgagtgacttcactttttctttcatgcagcatagtgagagctgattagctgtttactggaggcctagtccacagctctgcagatcttcagggcaagaggaactagctaccagctacatgaagtgacttgatggggtcagaagagcgtttctgactatccaagtctgactagctatttgacacttgcaacccaagctgctgctgctgctaagtcacttcagtcgtgtccgactctgtgcgaccccatagatggcagcccaccaggctcccccatccctgggattctccaggcaagaacactggagggggttgccatttcctcctccagtgcatgaaagtgaaaagtcaaagtgaagttgctcagtcgtatctaactcttagcgaccccatggactgtagccaactatcctttagaaggtagtaaactatcttctaaaactaattcccttacacaaaaattgctgcttacatttttagggaatttgcactcctctgaatcccatatgagagctctacaagtttatagattcttttattttaataacagttgaactacattctgaaaagcacccaccccacatgttacttttttgtatatgagaactagaaagactaacatttttccccaggacttttaaaatatgcttttgaaaaagagcctttgaagctactgtaggcaaaagttattttaagtctctgttaccatgttttttttttttttttttccttctgttctaatgaacaagtgaacttctaaaaatttcagcttctaatagtggctatgagaaagaaactagaaataaagctgtgtggaggcttgctctatttcatgggactttctggaggattctctattgatagaatagaataacttcaacattcaccagtttttcttctgatatattatatagcacaggttttcctttacttattatg

SEQ ID NO: 34903 - DNA, 1001 bp, Bovine  19866881558076
taattgcagcatgtcatttctatttacctgatgaagcattgaacccagggccacctgcattaggagcacagagtcttaaccactggaccaccagggaagtcctctcattttttttttttcttttgttaactatagaagctaataccttacactgattttcttatgaagcacttatgaaaaataagtgggacagtatatacgaagggcttccttggtggctaagatggtaaagaatctgaaagtacatgcaatatatttttataattaccattaatacattttaataccaaaaacttaaaggaaccaaaggaatggaaaataattttgctaagaagggaaagaaacagttttgtctgtacaaaaagaagatggatatcattcatatcaaatgtctaaagttatgacatttcctttcctatatgagtctgtgcacacttagggtgatagtttaatcgctaagtcgtgtcagctattttgaccccacggactgtagcctgctaggatcctctgttcatgggatttcccatatactggagtgggttgtggtatccttctccaggggatcttcctgacccagggatcaaacccatgtcttctgcatctcctgcattggcaggcagattctttaccattgagccaccagggaaattagacctaatatttgtgcctgcaagcatgtagatatctgtatctgcaagcatgtagatttacacaagcagattagaactgcttgcttcctttctctgagctaagctggaatggttccagaatgaaagggatcctgattaatcccccaaaccacctgcaggcctaaacatcaatggaattagctcaaaaagcctgaaaaagactcaaagatcacaggatgttagagctagaagcaattatcaaagccagctctccctacccccattttgcaaacttctcagatgcagagagaagttttgagttatctacccaaatgcactggggtaaatgagagagcaggaattccaagtggg

SEQ ID NO: 34904 - DNA, 5150 bp, Bovine  19866881647828
tatattttgttaagtgaaaagaaagtaattctgtcctaaagaggaattaattttaaaaaataaagggaaagaatatgacacaattttaatgtaaaaaagaaagttgcataaggtatgtgggaaaaaaaagccttgagagaagaattttttacatggtcaggcctggctaagatagaatgaatttagttgagtaaatgaatgttaacattaaaagtaagctagtacaactctaaaatttagttttatctctgtgtaaagagaacaaaattttcattgactattgatctgcttttgagtacatattatgaatgtctttttaccttttaattaatctgttgtaactttttgtatttgtctttgaaatattttattattgctttggttaagtgaacaagtactgtttcacagtaacttatgaccttatttgaccaagtattttaaatattgatatctttgacaaacttccccaaattaaatgctaaataaattcttttgctctctagctatctttttgatttttcagaggaccacttaaaaatctcaaagagagatattaaactaattagtcttatttgacatgctaaattgcatgagaagcattgtcaaataggtgataataaaacttcctaggttttattatgtggatgaatgttattaatatgtgttatataaaattatatccaatttctaaaattctgataagtcataattctagttattttaggtgttgtaacatagaaataactaaatgtctttgtcaattgcatgataataagatatttaatcataacagtttaagtcttgttatttataaacagttttttttttttttttatgctttagcagaaatgctttttcttcaagaagatttacaggacttttgacaaatgcatgtttctgataacttatagaccaaactactgaactgagtaagaaattatagaactaatggaaaaactgattgctttgtaaaactgctaacaaatgatcaagatcaaaaataattaattacataggactcagtgacctggtgaaaatgattataattttcatgacttcttgtctgaaatattcctggctttttaatcttcattttcccagacttaaggaaaaatttttttctcttttctcttaagctaattatgatttacaacaatttggtaaattccctggtgactcaaagggtaaagaatctgcctgcaaagcagaagacccaggtttgatccctgggttagaaatatcccctggagaagggaaggaatggtcacccactccagtatttttgcctgaaaaaccccaggaacagaggagtccatggggttacagagttggacacagctgagcgactaacatacaaacacttacacacaagcaaaatgaaaacatttttctctttctccccacctattccctccaggatttggactcttattgactattattatttttatgacagtatagttgtttacttacggtaactaaatatttgttctccttgtaacagcacagttgaaaatattggttacttagactcaaataggaactaagattgcctttatggagtcataaagccccttgggtgggtagggagtgaacagcctgatatattgcttataggatttctggaagccttactaggtgagtagtaaggaaggtcacatcctggcagaatttctcaggatatcttggagaccttgagaaaagacgaattcgccaaaattacaaaattttatccaatggcaaacctttgtttggcttcttagcctaaagaggccaaatgttcaatcttgagattctttatgaaaagttacagcaaagtaaagtaaagtttagtcactcagttgtgtccgactctttgagactgtggactgtagcctaccaggctcctctgtccgtgggatttttcaggcaagagtactggagtgggttgccatttacttctccaagcaaagcagattaaaagatctatatagtcaatcaccattcttgttgtatttatgtaaataatcaggtcaagtttattgaaactaaacttatctcgtaagcaagttagtctttataatctaagtattaatactaacttgtaagttagtaaatgactatcttctctctgtgtcttcatatggtccttctgtgtgcctctgtgtccttatctttttcagggatgccagtcacgtcgccttagatcccactctgatgacctcattatgacttaagtattacttactcagtcgtgtctgactctttgtgatcccgtgggctgtagcccactaggctcctctgtccatgggattctccaggcaagaatactggagtgggttgccatttccttctccagaggatcttccagaccaggaatcaaacccaggtttcctacatttcaggcaaactctttactgtctgagccatcagggaaactacttctctaaagatcctatctcaaaatatagtcacagtctgatatattggttaggacttcaacatatgaatttagaggggcagcaactcagcccatagcagtcccataatagaaaagccattaaaattattatggtacacgtaattatactcttcagtcatttaaagttacaatattttgttaatattcttgggtgttaagaaagttttcatgttaaagagttaattttaaaaatgaataatacattatttagaaaataatcttaaaattataaaagcatgcatatatcaaaatatatattaagacacatattttaaattaacctaattcttgctccatctgctcccataaacctaacaactcacatttgtatatatagggtaggtaaggttgaaagagggaattactgtctgctattttgtctgagttgtataaacatgggtatttaggattctcttttaggcattcttaaagaattttctttaataagcatttattatttttagatctctacaggggaatactgtcaacaaagaaatgataaaatagcagaagctcaacatagcagaattaataatactaattttaacagatttaaatttaaaattctaagtttcttaaaattatttgcacttgtatttcactttcatgcattggagaaggaaatggcaacccactctagtattctttcctggagaatcccagggatgggggaccctggtgggctgctgtctatggggtcgcacagagttggacatgactgaagagacttagcagcagcagcagcaggatgaaacatggaaagctggtttatgtatataaaggtcccttaggttttcattgttctaaacaatgaaatagctcagatccaggggtgagtcagcaggaaatggatgagcccagggcagtatcttcagagaaagtaagaactccaggcatggttaacctatagaggagaggactaggatgtcttcacagttttcacacgtgtgacgggcttcaggtgatggggccaaatatcagatggattaattggattacatgtgcatatctagaaggcaaaactaagatcaatattttcttccttttaatgcaagtatattgactgcctatcatataccatgtattgaagaataaaaaaatgctaaagaagcagatatctgctcaatacattttgaaaaggacttttaacagttattcttagttgaaaaggttgttttaactgtagggagtcaccgatccttaaaatgttctgagtgagagtgtatgcccatctcccaagggtacagcatcaagattttctgaatccaggtaatttagaatgatggttgtctaacctttgcactgagaaaaattactcagaggactggttagaacacagattcctggccataaccacagaaattctgattcaacatataatttccatttctaataaacttccagtacatgccagatgttattggtccatggaccacacttggagtagcaatgtgtaatccggggtcatcttcctttcaagattggtaattctaaaatacagacagagaaaaatgtctgcttcatcaaattcattttcctcagctcaccaaaaagggaaaagatggctgagggaagggaagaaacactatccgatcaaaaacagaaaatgcccaaaatgacagagctgtttctggggcagtgagatgtttagaagtcaaaatttcaaggaaatctcccagatgattcttgtaaaatgatttcaaatatacatttttttttcaaagatccccaattacactctacacagctcttagatttcactgacaaagctttaaaaaatgatgcatttactccatgcaggcagcagtctctggagccgaagcctccgcgttagtgatgtgtcgcagctggctttcgagctgcgttgaaagcttcaagctttggcacgaccgagcattaactcagcattaagcagaagctttgacactggagactacaaacttggatggattaaatacacattttgaatatctcacaaaatactagcagtaaggaggatacagaggtttttaaaaagagagtgaaagagggaaataaaaggagtgcaatgcaaatgaacagagacttgggccctgcaaatcctagctgtcctgccttctctgagactccttttccttcagatgctgcaacatttacatccatctttcccacaagaatggttctgtgagatttcaacttatgggaacaccactggaccacaatcaaaaatatttgtaataatgacaaactttaatctagcatcttttattgtttaagagattaaagccaactgcaagtcagctcccggcccagaatagcaaaaagaaaaaaaaaaaaaaaaaaacgtcaccagacagtaagcattcagtatactcacacaggttactaaaatagagtacagataaatgtcaccctctagttctactgtgcttataactttcacaacagtttcacagatattgactcatttgattctcaccataatccacatgttagatcaggattatcatggcgttgtccaggggagaaaaataaaaaaagcaaaagtgtatctgagagatttagctcctgcccatggttatatagaaaattataggaaatgtcaggacaagattccagttttactaaaaccaagtttcagagttttctcttactatgcatagccatagattatattacctactattattacaggaataaatttttttca

SEQ ID NO: 34905 - DNA, 685 bp, Bovine  19866881757126
tgtatgaatcttttcctagtccagcctgtgcatcctattttcagtctatccctgcccaggaaatatagtctttcaagaatatgatttcacaaccatgaatctatctatacttatttctttggtgatttcatcttgtctaatggctttaaatattatctatacactgatgactttcaaatttacatctttaacacagacatctccctttcaatccagtcccacatatccaactgctgctgctgctaagtcacttcagttgtgtccgactctgtgcgaccccagagacgacagcccaccaggttcccctgtccctgggattctccaggcaagaacactggagtgggttgccatttccttctccagtgcatgaaagggaaaagtgaaagtgaagacgctcagttgtgtctgactcttagcgaccgcatggaccacagcctaccaggctcctccatccatgggatttttcaggcaagagtagtggagtggggtgccattgcgttctccagtccaactgtctaccagatagctacttagttttctaagagatgtctcaacatagcataccttatgactgagatctaatttttctaaaaaaaaaaaaaaaaaaaaaaagtggcattccctatagttttcctcatctttctagtaccaaaacaaactttgactcttctatctcacatgtatc

SEQ ID NO: 34906 - DNA, 853 bp, Bovine  19866880208502
aattgatgcttttgaagtgtggtgctggagaagactcttgagagtcccttggactgcagggagatccaaccagtccattctgaaggagatcagccctgggatttctttggaaggaatgatgctacagctgaaactccagtactttggccacctcatgcgaagagttgactcattggaaaagactctgatgttgggagggattgggggcaggaggagaaggggacgacagaggatgagatggctggatggcatcactgacttgatggacgtgagtctgagtgaactccgggagttggtgatggacagggaggcctggagtgctgtgattcatggggtcgcaaagagtcagacatgactgagagactgaactggactgaactgaacaccattttatgagttagactatcaggatttttaaatttcctcatgtaccgtaaaattcaactttaggcaaaatatccaactattcttaccttcactgccttcagtcataaaatggaaatactatctgctctgctgtatacaaaatagttttccaaactataaaatgtgatacaaatggtaatagtgtcaattattttaaatgcctatggttatttagagatcaaaggctgttttcaggggcagtcttgagagttaattcttttagactgttcactgttttctacagggagcaccaagaatgaaggtgaccagaagaaagccaaaaataaatcatagaaatacagagcagcatgtattctcacattctgccatacagtaaataccttctcagttccctagaatattacacaatagtaagtgtatttctttgactattagttttgaaaactcccttgtttcatataacaaa

SEQ ID NO: 34907 - DNA, 701 bp, Bovine  19866880339715
ttttactttcgtgcattggagaaggaaatggcaacccactccagtgttcttgcctggagaatcctagggacgggggagcctggtgggctgccgtctatggggtcgcagagagtcggacacgactgaagcgacttagcagcagcagcagcaggggctggtcctaccgagacgaggagggtgcaggggccagccgagaggaaaaagcagtctggttgagtcccggcagcagtgacgaacggggctcgtcccagacgtgcgacgcttctcgccaggcaggtagcgtggacaccagcaccaagggccctccgggggacctctaggaatctgtttccacgccgtctgacctccggcaaggcggccctcagaggcccagagagcccgcacctcctgcagacacttccctgcttgcccagagaggcaagccccgcagacactcaccccacggccacgcggcgccaacgccgggccggccgcacgatgagcgcgtcccaggcggctgccaaccggccctcaggggagccgactcctggggggcgcgggcgcgggccccagctgcagcgaactccacagcgagcgcagggccgaccccggcagctgcggctccagcaggaagacgcagcccaccgcgagcgccaggaagccagcgtacgcggagccgcgccacagcgccatggagacagaggcgtggaagcggcggcgaa

SEQ ID NO: 34908 - DNA, 3289 bp, Bovine  19866880381212
cctcacaggagagctccttgatgctgggaaggattgagggtggagggagaagagggcgtcggaggatgggatggctggatggcatcactgatgcaatggacatgaacttgagcaaactttgggagatggtgatcgacagagaagcctggtatgttgcaatccacaggtatcacaaagagtcagacacaactgcacaacaagacatggacaaggagtgtatgtgaggaatcaagggataggaaaaaagcagcaataggtatggaaggaagcaggtaaatttggctacagaaaagttgaatttgaaatgtctgtgaagcattcagtacgcatcagactgatctggcaatcaggaagaagtgtgcagaacaagcaaagaaaagagtcaaggatagtacacagggacggccctaattcttaagaaacaaacaaaggaagagaagccgaaagaaaggaaacagaaaaagtggtcaataaaggaaaggggaaataaggatagtatcgcagaaggaaaaaaaaactttccaaatccatactggaacaaaacattgctagttctttgcactgctgtgggtacaaatgtgacaggtacaaaaatcacaaccttaaaagcattacaaagctctgaatgccaaaaaaagacaataccaaggatatattttgcatgatgatactatcctctgccagcaagtatgtaacatatatactgtcaccaaagatacagtttagaaaaaagaaaatacaaacggttttaaaatatacaaaggatcaagctcaccacaagaattatgaaataaaagtgaaacaccatttttcacctatccagagatcaaaaagttaaacactatgctgacttgaacatatgctctctaccataagaccaacacgtcccagagagtagcggctccttcagcctggtcttgaaaagggaagacacatggagcacactggaacctgctccacagactatggctaaagcccgccaaccatagccgatctgaaggcccacgaggaataaataaggccactgacattctgaggttgtttgttaagcagcattatcacagcaaaagctaactgatacacaaaatgtgaagaaacaagatttcacatattattaaaataatgggttactacctgccatacaaactgagtgacagagacagatgcttaatcaaagcctgcctctcgtgttctctatcaccgcagcctctcaccttgcatgcttcataatccttctggatataatagagatgtatcaaccagttctgcttctccaaaataggaaactccggagctgggtagcatattttgacaaaaacaaacagtcattgttaggttttctccttgagcattgtcctcatgtctaaactaaccaaaaggagactgtaatatcatgttaaattcttcatgctgctgaccatttttaaccaaagtgtattaaaaatgtgtggattattacactaagagatacttgtcctactagtacaaattcaatatatattcctgtaaagtttgtgtggttcataatatcagtttctcaactgataacttgcctaaagggaaaaacagaatcattctttccctcttttcctttctctctcttccgggttttggtaggtgaataaaatgactttccaaaagatatttcaggagtattactaacaaaatatatataacatagttaatatcacatctaacagatcagaggaccaaaaatagctaaacacagtcttagcaatagctcaaatgtgaaacgttatactgttgcccagttatgagaagtcaacaaggagaaaaatatttcagacacctcagacactgaaaatgattcacaatagagaaactatgagttactatttctttgaattcaattaaattataggtaaaaattcattaagaagttaacttttctatggtaaaaagggagacagttattcacatcaacctcagaacagtggagacctcaaggaagaaggaagaatgaattagaaatcaataaaaaggagaattaaactctttaatgctttagctatcaaaaaaattaaaagctctaaaatatataagtctaaatgtttttatttattaaatctggcctgtaagcacatgggtatttgttattttttatgcattttaatacatgtttgaggtattccctgattagtttaatggtcacttttttttttggccacaccacaccacatatgggatcttagttccaagactacagatgaaacctgcatcccctgcagtggagactgaaccactggaccacgggggaagttttggtgttcccttatttttcaaaatgtaaaagaaagggtacaccaggggaagaaggggaaatgatttgtaatcattctgttccagaaccttaggcgatataacaacaaaaaacccaagacttacatgtgcataatattaataatgatgggaaggaaaaaagcttactgtgacccagaattaatgttgaaagtgaaagtcactcagtcatgtctgactctttgtgaccccatggaccatacagtccatggaattctccaggccagaatactcgagtgggtagccttttccttctccagaggatcttcctaactcagggatcaaacccaggtctcccacattgcaggaggattctttaccaagctgaaccacaattaagaatgcttttttcttttccaatagggaatatcttttccaatagggaataacaatggagtttataaagtgaaattatgacagaaatatggatatgattttataaagaagaaagaaaaaaagattaaatgttaagcaacctaactcttcattttccaattacccacattctctgactaggatcacccttcttctagtcagtagggcttatgtgagactcttcaaagacttttttttccttccttctcttcccctgtgccccatcaaacatcagatattagccattcctgttctgcctaactaaccatttccgaagttaaatttcctacagaagaccacacaaatcatcaagcttaaaggcagatgtgagtgggtgtgtatgcaatcttaaagcaagtctcaactgtatgacctacctcactgttacctaccccttttctgaaggaaaggagacactgaatcctttgagtttataatatcactatcactgcttctatagcctaaagaaaatttataaaatgcaaatttgagtctttcttattattaaaatcttggacttcctgggtgacactagtgataaagaacctgccagccaacacaggagacacaagagatgcaggttcaatccctgggt

SEQ ID NO: 34909 - DNA, 1351 bp, Bovine  19866880468266
aatggttataaagtggttctatctaactcacattctattttggaaaacagtgtaactgacacagcaaaatctacctttccctcttggtcttctgtgcccatagctagtggtcacttagagtagggatcagtgtcccccttgatttccctgctgctaaaactattgctctattccaaatgatgtggctctttgtttttcaaaatcctatcacttatgaagtgagagatttaattttaatcacaaagtttagaaggatgtttttaatatatttgatacgtgtctcaatttgactcaaataggtgtcaaaatataaaaatgtgccctgtgcaatgatgctgtaggtgtataatcaggtacaagttgctctggagtcaaacccgagcttaaacaccagtgccacttttaaattttgtgactttgacatgtttttttttcttttaagttcttctgatttacaatctctataaaattgaaatggtaatactttttcaaagtttcttttgtgaaaataagtgaggatattcagtgcctagtataacggcttacagaatgacaataacggtcattagttcctttccctctttttaccaatgacagtttaatataatgagttggttctaacttttgaaaaattttgaagaggtgacaatagaaaccattttcctataaaattcaatgtgtatcatcagactctaaattctatgtaatccgctgcaacccagattgtatgtgttttatgtgtgtttaaataaatacattaaatacacatgtgtatacatacacacaaatatagcagatccaagactgactgacttgatttgaaatggttgaatctgcagtgtaaaatgtggatcagccatggttaggaactgaaatttagcataagagagaaaaggacttgatgtacaaaaatcccggtatagagcacttgggggatgggaggggacgggttggtgagacaatcagattggtaaattgactaaatgctcctaaccctgtaattttgtgcgtagagcacactgtgctgtggaaataactgctcttagattttcattgtaactggactgttcaggttgcccagagggaaagaacattcctaattctaataaaataaacttttattttgtttttccattagttacttatgtttatttttatattaagaaaaagacattggtggcctaagagtcacctatattatgtgccttattcactgttcctacttaacataaaatgtcaagatttgggttcagtttctttccagggaactctgaatgagactctccccaacaataaacttggttaatgaaaaaaaaaaattcaatgtgaagaaacttactataagcatatt

SEQ ID NO: 34910 - DNA, 1568 bp, Bovine  19866880528945
ccctatgctgtacagtatgtccttgcagcttatttattttatccgtagtagcttgtacctctaatcccctccccctatatggcctcttccctgtcccctctctccacaggtaaccactagtttgttctcttcatatgtgaatctgcttctttttttgtcttatttagtggttttcttttattttttatattctacatgtgatgacatacaatatttgtctttgtctgacttattttactaagcatgatactctccaggtctattcatgttgttgcaaattccaaaattttattctttttatggctggataatattccattgtgtatatgtaccacatcttctttatccattcatctgtcaatagacactgtcttcttcctgtttgggctactgcaaataatgctgctataaacattggggtgcatgtatctttttgaattagtgcttttttcatacacccaagagtggaattgctagagcatatagtagttctatttatagtctgaagaaacttcatactgttttccatagaggctgcaccaattcacattcctaccaacagtacactatggttccattttctctccattcttgccaacatgttatctgttaattttttgatgatagccattctgacaggtgtgaagcaatatctcatagtggttttgatttgcatttcatttggtgattagtgattcccaggtggtgctagtgatgaagaactcccccctgccaacgccggagatttaagagacgggttcgatccctgggttgggaaaatcccctagggcatggcaacccactccagtattcttgcctggagaatcctaaaggcagaggagcctggcagaccacagtccgtagggtcacaaagagtcagacatgactgaaacgacttagcatgcacactgtgattagtgatgttgagcgtcttttcatgtgcctgttggccatctgtatgtcttctttggaaaatgtctattcagcttcttctgtccacaggtcacttactcttctccttcggttattccttttctcaatttcaacttcctttattgtttttcaaagaatgatggaggctgatggtatataccaaccttccttgtctctggccatgtctccaggtctgagaccttcccccttgttgtcagataggctagccatgcagagaattccaagatacagagctgacagtagaggcccccccaggttgatattgacctgtgtcttgattctagaatagtctggagaactgcatttctcttggagtaggctacttataactttaaattgggttcttatcattctttgccctaataatactcagttataagcctctttcaaaattcttaagaaattgtcctgctcagctgccactgcctgcgatcttggaccaaatacaactgaccttgttctaatttgcacagctgataactttgggaccagttgactgttttgcagatagaccaaaactaggtcagcctctgttttccaaggcacaaatcagcacacagtgttgaggaaaacagccaacaaacataaatatatagacaagtttttttatactt

SEQ ID NO: 34911 - DNA, 3342 bp, Bovine  19866880569723
ccaactcccggagttcactcagactcacatccatccagtcggtgatgccatccagccatctcgtcctctgtcagccccttctcctcctgcccccaatccttcccagcatcagagtcttttccaatgagtcaatacttcgcatcaggtggccaaaatattggcgtttcagcttcagcatcagtccctccaatgaacacccaggactgatctcctttagaatggactggttggatctccttgaagcccaagggactctcaagagtcttctccaacaccacagttcaaaagcatcaattcttcagtgctcagctttcttcacagtccaactctcacatccatacatgaccactggaaaaagtgaggcttaataaatatccgtagtaggagggtctagggtcccatttgcagctcactcttactctagtttagaagacagcctttggccaactcagaaggtagaggcccttttgcagttaaatgagaatttatctctggggaatgcaggaaagaactgcttcccgaagcccagattccctgcctttgattcacagcgcctgctctaccgcttgccccacccaatagctcagtactgctgtttacaatggttttatggaaagccctcatttggtctcattgtactggcccccagttccatagtctttcccaaatatgaaaatgttattttattgaaggtcattatatccattttaagttgtctgtctgctgatctccttctccaaaatggatagaagtgattcaaccaaatgtagaagaatcagctcttaagctttcaaaattagcccagctttagcactgtgcttggatgtagcctataaaatcatagaataagaagcagaaggtcagctaatccactgttatgggagtcccacagtaaatgtagtttgaattagatcatgagtttataaaccaggttgtatatgaaaatcactttaggagccttcctaagaacatcagttcccaggccacaccttcctggtagaaatttccacagcattccagacatgtaggatgactcttcttaagtacttctagtgactgaacactcattacttagcaaatctaagctcatcccattatggtacagctttgattattagggcaataagagagagtagctggaagaaaagatggcagacatccatggtggttaaatctgtgttgtaggattttccatattttataatatgaacatgcataacttttgtaacaaggtgagaagcaaagtacagtgtttcagaaaatggaagagcaagactgagaatagagcaggattacaaatggcctcgtaaaaaaaaaagctgaaccacacccaatgagcacagaggaacggtaataggaagaagatctgtttcctcagggtcctaaatgatctcgcctctgcacatctctccagcctcatattcatcttttttttctgctcacgtccttccctctaactttgcatatctctctttgtttcagcaacactagctgcctttctctcccttgaacatgcaagctcattcctgtctcaggagccttccactagctgttcccctttctctgaaaagttcttcctctgggtctttgtatggtaggatcattcaaatctcagcccaaatgccatttcctcagagaagcttttcccaaccacttaatctacagtcattctgtaccatatccccttttatattttcatggcacttactacaaactaatgatttgtgtattgtctgcccccattcctgtcccagcattcgcatctttgttgctcactgttgcatccttggttcctagaacatgcctggcacatggtaaccactcggtaaatatttgtcaaattagtgcatatgtacaaacctttgttttcctgaaactgaataagaaaattaactctgcacagaatgtatatttataaaaatagactttatgattcaagttgaccgcatcccaatgctatatgttgggggggggggaaacttttgttttctatgagtatgcatattttaaaggttttcaaagtcagaaaacttaagtgatttacaaatggtgctttataagatgagcttatatataagacaccaagggacagactccctttactggtccaagcttagagttcagtacaatctgagaaacttttgtggatcactgactttgtgccaggtacacccagggcagaaactcagctctctagatttcatcatctggaggagatggccatattcataaggcatttttatagaatgcacagtaatgactactttcatacagaagctcacagaagttatctatactcacgtgaaggttctgcagcctgatcgtatgcgtctttagaattctggaacactcacaagcgtacggtctttcccttcccaggcagtaacagccctcatggaagccccacctctcctctggacagtaacatgctgctggtcatcatcgtttccgttggtgtcatcaccatcgtggtggtcgtgatcattgctgttttctgcacccggcggactacctctcaccagaaaaagtaaggagccccagatgtagcccatacattttttgtatgtattcttttgcttctgtgtgacctctgtgtctggagttgtacacagagttaaaatataaaatacgtgaaaagcaatgttttaaatatttttaaagaaaatgcagaatgattcctcttgctaaatatgtgtccttctgggttcgggaagggaagaggggcacactgaaggtgggtgaagggggctttagtgaagggaccatttacaacgtccaaggtgaagttagcattaggcagcagtggtgacaggcccctgtcatccttagaaaggtgagagctttttctgaagaaaacagagctgtttccagagctctgaagcagcaggagaggacttgcaacaggaaccacgtatggtggtaggaatgtaacgactgccaccctctagcccagcagggatggggcagaagaggaaataacctcccgccctccagtctcttgtctgtgccttctactggccacactgaactggaagccagggcagagttaccaagcagatatagttcatttaactcagcctctgaagtcacaagagccaagtgtacagaatcagtctaggagaggaaagtagatgatgtccagccttgttgggagcccctttggaggactgactgtctctgggcactcaccgaaccagatacacaggagtctgtggaatttcatggcacaaatgccagctgagatggaaggacaccatagacctctagttctaagtttaagagtatttttaaagaagtgctcccaaaggctcagcggtaaagaatccgcctgcaggcaggaga

SEQ ID NO: 34912 - DNA, 1494 bp, Bovine  19866880580655
tatagagttgaagaaatgctttctatattggggagaatactccctttttctatcatttattgctacaaatacttattccccctcaccctgtttgttatttaacttttgttatggagggtttgtcatgcagaaatcttcatttttatgaagtgaagcatatcagactttgcttttatgatctctgacctacataacatgcttaaagagctcctccccacctcaagaaatactcacttacattttcttgtgctgtaaatgcattttcatatacacatataatccatcttcctccattaattagcaatgcctcttttctcatatactgcatttctacacacatttctggagtctatatatgctccatgatttcctttccttgtgctattcctatatcatttcttgcccaccccattactgtaatgtactattctctctctctttttttgtttaaaaaaggaatctctatcccctactcctcatctcttttagaattctcctatttcttttaccagattaaccataaaattatttgattatattaaaaaccatgctggtactttgattagaactgtgttaaatttataaattaatgtaggagggatatatgtatatatatgtatctttatatcaaggcaagaggaagatctgtctctatttaaatcttttttgtatctgaggagcatcctgccatggtttcagccctggtgcagccctttctctcatttttgtttctttttgttcatttctgtcaagtttggggagggtagttttgtaaacctgcatttaagctaccatgattccagaagtctttagatttgcactgaattgagggcgaaggcggggatgatgagctgaagctgtgggtgtgggtgaaattcagaaggagagtaaatgttaaatgagagcaacagaagcttgcaaggctccagcatttatggggaaagtgaaagcggtggatgtgaatgagagcaggcatgtggaaaggagaggtgagaaaccagcagagaggtgtcaagtaagtcagaggaagggaacatttcaagaatggcacagtcagtagaggccagtgttctggcagatggtggagaatgactgcggtggagccgtgagctgtgtcggttgtagttggttactggtaaggtaaccttatcatttagtatttaaactgggacacttggagaagactcttggacaacaggaataaaccaggattattcctggcaaactggaacacacggtgaccctggttggtggtgacctctgagaaagtggtcttagttgatgatagctaaggtgcccaggtgcatgggttgaagagtcaagacagtaagagtagattctcacttcttcttttcagaggtttgggtaatgacttatacgctatatggaaaagaatctgaaaatgaatgaatacatgtatatgtataactgagtcactttgctgcacacctgaaattaacacaacattgtaaatcaactgtactccaataaatt

SEQ ID NO: 34913 - DNA, 916 bp, Bovine  19866880620020
ctgcatgtgttgaaagagaatcatccatcacaataacatgctactactctatctaggaaccaagagaatcccatctgatctgactggcttagatcactgcagttcatctgcctcgagcagcccggagtcaaagttcccctgtcaatgataggtttaggtcagtaacctagggagcactgatctggtggtcagggggtaggatcattttcagataaatgcccacacggtagcttgtaagcacatcatcaggattttctgtatcatccacagtctctacatgctaaagtgacatgtacacgcataatcccactcaagagacacacaatggaacactctgtttgggggcctttacctttgggtgttctgaactggacagcttcagacatgggccccatgccctttgagttccgggcttggattttgaagtagtatggtgtgtcaagtgttaattcctgtatctggtgagtcagcctgtttcccacaacaggctcgataacccagtcatgtatctctgcattcacatccgtgctgtaatatatgatgtaacctatccaaagggattaatggaaaaagaaaccttattcctgctctttcttttgcgatcagtaagtctataaaagatatatgtcacagcatacacaaatagagaactagttacagattaacaatagtaacaagtattttaaatgctacactaaatataatacagagaaaaccacaatttcaacagtgccagactataaattattatctgtatcagcagctgaagtaataaaagtagttaaggtaaaaatatagggttaactactctcaaaagctaggaaattatataaggaaaccatactaatcaacattccaacattctgtacttcaacggtctacttcagttaagttaatgcagttttgaaaaaactta

SEQ ID NO: 34914 - DNA, 2430 bp, Bovine  19866880632609
ttaattgccatgaatggatcaggtgtgaaaaatagccatgaacaaatgctgatgatctgagaatatactgggtcagccttgagctgtttagcatgggatgtgcttgtcaagtccaggacatggaattactgaattccctggtcagctgatttcttctctggttcccgtctgaagtgccctgaaaacatctttggcgagcctgggtgtccttttaggctcgcctttggtaagcctttatctttaagctaccatgtagctcagatggtaaaggatctgcctgcagtgcaggagacctgggtttgatccctgggtcgaaaagatcccatggagaaggaaatggcaccccattccagtattcttgcctgagaaatcccatggacagaggagcttggcaggctacagtccatggggtcgcaaagagctggacatgactgagcgactaacactcactttcacctctgctcagcacttggagtttggagaaatggattggcaagaaattccaggctgagaactaagccaggggaaaaggggatcgctggcttcagaagaggccaggtgatttgggggcaaagttgataatctcttctccttcacatgaagggcgaggccgtggggggaacccaaaagcagagattcagaggcttgtctagttttctgtgcaagttcttggcagaaccataaatccatcccagctgagaaaactgtttacttccagcaccaagccaagcaagtctggccttaatagactgaagctggttggatgcttctattcttgaatttggtgctgttcacagaatattgatttaaggcacttttgtttctcaaacccctctcaaacctggatgaagagccagtgtaaccttggctttaagtagaaaaggcagagggaaagatgagggctggccgtgagggttcaattgcaggtcccagacatccctcttctgggggtgggagtgggtggggctttagagacagagacctgtatttacattggcgtcagtgggaggggtcactgataaagtacagggcatggttatgccctgtgggagcatctggtcaactagcaaatcaccagcaaaccccatcaaaactgtgtagtaatgttcctgctgctgctaagttgctttagtcgtgtccgactctgtgcgaccccatagacagcagcccaccaggctcccccatccctgggattctccaggcaagaacactggagtgggttgccatttccttctccaatgcatgaaagtgaaaagtgaaagtgaagtcgctcagtcgtatccgcctcttagcgaccccatggactacagcccaccaggctcctctgtccatgggattttccaggcaagagtgctggagtggggtgccattgccttctccggaatgggcctaggcatatcctattcggcttactccatttcaggcctcctgtactgccctgtcataaagaaagtgaaatagtgttctctacatacaaagcagatccctaagaccagcacaggcgcgtggatgcatggcacatgaatatgaatcatacttctgtgtgggcatataggaccccatgctcggacagatcttttgcttgtttttttgtgtgtgtggggttgtttttgctttttttaattgtattggagtatggtttctttacaatgtggtgttattttccactgtgaagtgaatcagccatacgtagacatacatcccctcttttttggatttctttcccatttaggctgccacagagcactgagtagggttccctgtggtatacagtaggctctcattagttatctattttacacatagcagcgaatataatgccctgctgtcacctctgtgacattcttaatactttggggcaggaatttttatttttgcattgtgtcccacaaatgagatatctttccctacagctaccccagaactcatcttctaaggccttctcatccaacttggagaaaaaccgaatggaaattcatccagaatctgatggcacagagggagtgaggaaagaggaaagtttgtgtgtgttcatgtgctaatgacttctgtggcacccttccagcccgtgtttagatttcttaaacatgcctattcatcttgtcaagtttcagcctagctcttctgaaatagaactgctcgcagaaatatcctggcaataggctgtttgggtcctgccacctttcctgggcttcctgctcacagagggtgctgttaaggggacatctgtctcctattgaaggaagctgctaattcccaggattgagctgggaggacagacggagtgtaaataacacttccaggggtgggggacacaggagtggtggagggtgtttgataaaccatgtctaaagggaaaggaggcggagcctattggctaaatcaccagagaattacatcaagggaaacctgggtccactcccaaaagcc

SEQ ID NO: 34915 - DNA, 1520 bp, Bovine  19866880634196
caggcaagaacactggagtcggttgccatttccttctccagtgcatgaaagtaaaatgtgaaagtgaagtcgctcagtcgtgtccgactcctagcgaccccatggactgcagcctaccaggctcctccatccatgggattttccaggcaagagtactggattggggtgccattgccttctcctaagtacatatctattcatgggcttattctgagccaagagagagctggatttggtttttggtcagacctgaactgaggagggaggaagagaattatatttagattttactgtaaagctaacaggctaagcaaatacagtagctggcatttatataaatacttgttgaatcagtgaaggactagacagcctttatcatcatctacaagataagctctaatagagtgaggagttttctgttagctttggtatactagtacccactttcacttttcactttcatgcattggagaaggaaatggcagcccactccagtgttcttgcctggagaatcccagggacgggggagcctggtgggctgccgtctctggggtcgcacagagtcggacacgactgaagcaacttagcagcagcagcagcagagcaataggcacttgatgatatctactgaatgaataaatgaacattcattcatttatccaattactggtgaggaaagtgaagtcccccctggagaagggtgtgcagttggtcagcagtgcagctggggtcaagtttggggcagtactctctatgtaccatgatacccctcttgacatatggaatatgagtcatgggaatggatatcaaaaagcagaaaacactcaaaaaggttaatcctcttgtacaagccccccaagtggcactagcggtggacatttcatgtttccagctgtcctctgagcacagtttgggtatgttttgggacatttgctgaaatgtgatgttcctacttgagtagagcgggagctctttctttacattagccatacggagtcgtcgtcctttcctggtggtgatttggttctctttactctgtcaatcttgttaggcacaagaccagctgcacaatgccctgcatcttaacagacatgatctgacttacataatgctgggcaagatcttcttgctgaagggagacttggacaaggccattgaaatctacaagaaagcagtggagtaagtgttggttcctaaacaaaaatgggagcagacgtgctctcccatgcctgagagaggacgtgtgtgactggttacacattgtggtgagttctgtgagttagggtgaatgttaagctaaagtatagagctcccagtgccttaaataaggatgacttaggtttctttctcacctgtcagtgtggctggtcctgggcagctctctgctccacaaggtcagtcagggatccaggttcctcccatgttaagccatcattccacaggttgttgcccaacccctgttgataatggaactgactagcgttcccagtgtggtattctgtttctcctttctagggaat

SEQ ID NO: 34916 - DNA, 1202 bp, Bovine  19866880640408
cagaaggatatcccccactggattaattttaagggacagatggagacaacataaagttgctttccccttataccctggaagttcacttaggccaaatacactacccagcttgcttaagtgagtttaagtcaactgtccagacaaatgagctcccagatggccacaatagtcacctgtaaaatcttttcgatgtcctagaaaattgagagcatagccaaaagaatgaaaatgtcctgatttttaaatggggtgatagatgaagtttacaacctggttgatgagtaccaccagcaccaacaaaaatcttgatgcgattattaaacaggtggttcccagagcactttcaaaagcaagtgtttgccaggaactagtgcagagtcactaagaacaagcctaacctcatttctcttttcatatgaattattagattagtgggtcgggagggtataataggctcagtgtcttatttctgtgaggacttttagtgaatccctcctgattctctcgtgcaaaagtggagacctgtcagcggggactgagaggtagatttatagtcggttgaacaattgttctccaagtgtgttgatgaatgaatccatgtcaccctggactgcggggacgggggggtctctggcagcattccaatgggctttgttctggctctgtccaggttaatattttttattaataacttggaagatgacatagaagccaattttatcaaaagcgtggaagacactaaggcaaaagagatagtgaacacacatgaaagactataaatttttaaaatttgcagtcatatccgctgacacatttgggaaatgaaggttgaaatagcagcaaccagggcaaaacctgctgagggctgatttaagctcagttttttcaccttcttggacaaattctaacttgcacagcctgctcatgctgggggctctgttggttacctacttctctatgccactgtgcccagggtcagcctctaccttattctcctcattaacttaatgacaccccagttcctgcccgcaaatgagtcctgacattgccaagcaaaccccactgctgcacttgagctccatcaagaccttcccagctcaggcccctgccttggctcagccacgtttcagctctctgggcaccctgccagcttgtggcccattacaagtcccccagagctctgtgaacagggcaagaaattc

SEQ ID NO: 34917 - DNA, 1560 bp, Bovine  19866880681896
tcattataccctacccacggagaaggcaatgacaccccactcaagtactcttgcctggaaaatcccatggacggaggagcctggtaggctgcagtccatggggtcactaagagtcggacacgactgagcgaattcaccttcaccttcacttttcactttcatgcattggagaaggaaattgcaacccgctccagtgttcttgcctggagaatcccagggacgggagagcccagtgggctgccgtgtatggggtcacacagagtcggacacgactgaagtgacttagcagcagcagcagcataccctacctggggacgctttcacttccagtggttccattttccaagaaaatgttcctggaccctggagaggggccaggcagattgctttctatggggagctcccatggctgccaggggcctattgtgtcatggggtaaggggagcccagagcagaggcagtgggaaggccagcacagtatagagatgggtcagtctcagggaacctacagagccagtgggtcagaagagtgcagatcactatacttttaatcttggaaaatagatctcatgtcacgccatcaatggacccttgcaacattgtcatgggggccgaggcaaggctgacacccagacagtcacctctgcagggtttagcaaggaccggaggacaacgtgcatacaaggagcccttccccgactccataatgccttccaaaccatgctagctctcacttgtgtttttccttcatgtcactttcacatttttgtcatcccaaggttagtgaacaattgttcgatgattatttgctatttgaatgaaagagcctatgaaggcaggaaccacagctgtgtccccagaaactaacagtgccaggcccacaggagtggatatttactgaatgaatgaagacatgaatgaatgggagtcccacccttagtgctgggctgaggccttggggcaggattccagacactgggaaggcttgcatagccaccaaggtgcttctgggaagaggaaagtcctcgtggggtgcctagaggacagggaccatgtaggcttttgctcagttctgccgatttgcacgggtctgggcttgtctctgcgcgaccaggcagtgtgtgagatttgcagcctcagacacaggtgcgtagggtcgagcctcacgtcgcaccacatcctgcctcactacctcctccactcttggctcccttgacacccaaaaggctcttgtcctgaccagggcactcccagtttccttcccaccactgttctgtccttcccactggctgccaaacttcccccacccccctcctgccaggcccccgccttcctgtctctggacccataaaaagtcactttggcctcaatcaatagactctctctttaacaagggagatgctggtttgcagaatggagcctctccgctgggcctagggagagctagtttccgaagacagctctgctttgcaggataatgcattaggccgcatcagcagatttttgctttttatgaggacatacaggattccccaaagaaatcttccagagagggtgtgg

SEQ ID NO: 34918 - DNA, 813 bp, Bovine  19866880688501
agcgacttcactttcacttctcactttcatgcgttggaggaggaaatggcaacccactccagtgttcttgcctggagaatcccagggacgggggagcctggtgggctgccatctatggggtcgcacagagtcggacacgactgaagtgacttagcagcagcacatgggatgggaggctagagctgactggaggagatttcccctcctgtagatcacttaggcattagggaaatcccagatgtaattcttatctttgctcatctgtacataagatattttcccctctcctttcctgatcaagggaaaagagaaaccagtacagctgtgactgcaagccattagtttttataaacatgtgtctgcggggccagggtccttcgttcaacaaatgtttcctgtgtgccgtctctgtgccacacacgctgactggcattagctatctctgttgatgcttagagatgctgtttacagcatctttggggacatgaggcattccagagggcagtctctgaggaagtggcttggcctctctgagctcccaggagtctttggcatccacttttaggggagagaacggctgggaggggcacgcgaggctttcttggagactaagaagccacgaggctgcaactccacaggagctgggagaattgtacaaactcaaatgaattagaagtgtaaatggagcggttcgacttggcttgcacagtacaataaagatctgcaaacactcagcttcgtattgaattcgaagcagggtgattaattcattattcacttcccagccggaagggaaactgtgtatacccgggg

SEQ ID NO: 34919 - DNA, 1880 bp, Bovine  19866880729713
aagagcaaaggatcagctgggcctgacctgaaatccagatctctgcttttctctgcttgctgtctttcttgactcaaaccagttccagaaacttgtgtgtctggcccacattgtgtgctgggcccacagcgtgtgctaggtcactcagttatgtccgactctttgcgaccccatggactctaggcccgccaagttctctgtccatggaattttccaggtaagaatactgagtgggctgccatttcctcctccaggggatcttcctgtgccagggatggaacctgcatctcctgtattggcaggcagattctttacccctgagccacctggggtctcagaacttgtgccagcaactcccaaagttcacattagatttaccactttagaggctagagtgcttcaagttcaaaaataccaggcaagaggctttattggctcagttgtcactcgtccattcctatctggtaagcaatagtgtgagccaaaaagggagatgcagtagttattctctctagtttgcaatagaacatgggggaaaccatgtaccagcatcagccagaggaagcagcagcagtgcctggctaagtggactttagtggacttgagtggacttgagctctctcaagggaaggggagcagaccaaaggagaagacaaaaataacagagcctcatgcaatggacctacatactctttaggtgcatgagagatactccaggtaaatccagaaatagttgctaattgggaagcaactttgtagttagttcctgagttgcagttgggacaaattagaaaaatacagtttatcatcatcaaagtgacctatataaatcacaaactggaatggcatcagagaacatatctacaaaaggaaagagtgaacaaatgaatgattgttgacatacacttgtttgatgtaaaagacaatttataggtaaggaaagaacactttcactaagcacctctctcttgtcatttcccaaacgtttttcaaatctaaacctttcctttcataggtacagaagggtgcctgaaaatcagccagtttatttaggagcagagtctaccaaagatatgagctgtgtattctgaatccctcagcaggttatctttttaaataagaaacacactccatgtttcactgaatcgaaaataccattgtttgtaagacttgccattgttttatgctctgccaagaaataataaagactgctgattaaactctgatatcatgctgttttatcacttgaaattttttgtgcttgttgaaagaattcttttaaacttatttaaacataggtttttcaccctacattactcttgtgtgtacataaaaaggaaaaatctaagcaaaataaattggccacagtgttcttaaaactttgcacacgcagaagttggctctggtaagttacttcttgaattagtgttttttaagagtgttcctttctcctttctctctctctctctctctctcacacacacacacagagtatcatcctcactgatgcaacatttctttcagaattcttcattagtatctcttagattttcttccaagcccctcacctaattttgctgtgcaggggcaggcaatgacagcctcttcaccaactgctttctggaagatagaaatgtttaagacacatcctgatttcagagttgttaaaatgtgtaagagtgttttagaacaactgaaacatagtattcataacgggttattgcagtaagccatgagttataaggggaagtgccatgctaatgtcaagggcaaaatttctggtgacatttagattcaagacaaagcagtagtaacatcattttagttggtacaatatttccaatatcctgctgccaagtctgtgacttctctcccatatt

SEQ ID NO: 34920 - DNA, 2319 bp, Bovine  19866880801002
tattaaacattccaactattaaactgctttaaaggtttaaaaagaagagtttaagtattaacagtaacagtcaaagtaaaatctgctcattgtttctttgctaatattgctgtgtttagtcactcagttgtgtccgactctctgtgaccccatggactgcagcctgccagactcctctgtccataggattttccaggcgagaatactgcagtgggttgccatgccctcctccaggggatcttcccaacccaagaagcaaaccagggtctcctgcactgcaggcagattctttaccagctgaactaccagggaaacccagctactagggaaggtaacattagtgatctaaaaaattacaactggtctccaataataataataaaagatttgctattttaaaggaatccaagtaaagttgattctattgaaactagtgtagacttgatcaatgtgggaaaaaaaaatttataccaaagatgtgttttcagaaagactaaattctataatgtcttaacaagataaggaaatccaaaagcttagctgagaactatgaccaaactcatgctatgtaatttgataggagggtaacagggacatacaagaattattttgttacattcaaaaatgataagaagaaaactttttaaagactttttttttgtactgtaaaagaaaatttaagaccatggtatttaccatgttctgtttgaagttatgacattgatagtaaaacataccacagatacctgcaagctacacattaatggagactttcaacattatgcaatacaaatcgaccagaatttagcccccaagaggcacttttccttccaaactacaaatcttgtaaactaaatgggagctctaaaaataaagacacaatctatgaaatctggcaaatttgactcagatattaggaaatgaaaaaaggaggagaggaaggcactcgggttttaagtgccaaaataactctttgtgactagctagtgtttttcaaaagtattattcccaacttatgactcactttagagaaaagatgagaaaaagaagaaatggtcagtattagtggctttgtacgcttaggattttcatactaaatataaaatagaagcacttttttaaattgtcagtaattagtctctgaagaaaggataaaaaatacatagaaagaccccaacgatgtgctacagaacaaaagtataattatagttttaaaagcacagcaggctagataaggccttaaattccctatcagagtcattaccgtatcagtgaagctagagatacacactcactttccacaaaacacttagtataacaaagtagctcaggtttaggtcaaagatcacccaattagagtgcctcatttgtcagatccactatagtaagcggattacttttatctacataaatgttcttgatttgtatttggatattctagcccactgacaatagatcaccccaactactaagacataagctcatctgaaataccatgaacagccaaatctcgcagaaaaatgcaaaggagaaaaggcatactttggcagaatactgttttagtcggaaaaaattagaaaaataacctaaaagcttttatgcttctagggatgagaacctcttgaatatgggcatttaactcacactttcaccccagcacatttaaaatgccaaaacaagtctaaaataggagagaacatcaatactggaagctaggaatggatgccattcacatgacgaaactgttgaagaatttctgtaagacatgttagatagatttggatggaagaacaatgtcaagagtcaactagtgacttatcttcctgaaaagaagtgctgtgactcagagagaaagcagaagcaatactggcaaaaacaccaataagaaggacaagagctagggaaaaggtggtccacagggagaaaataagaatccctccagctggaatccaggttaccactaccaaccaagggcactggaagcaactgcccaggacgggtactgcagcacaccaaatggccatctaggaagtttaagaatgtctcccgtaaacagtgggcagaagtagcaggaaggcggatgagtgactacagcataccacggcctgtggctagcgaaacacccactgagggggaaaacaaatcgagaaacagaaataagctttaattaaaactgcctgtgtgaaatttaacaaaattcttaaaaactgtccttttttgagacaagagatgaaagatctgatattggaataacaagctaaagttggctaagaaaaaatcagtgagagtggaagaaataagtcatataagaagaaaaat

SEQ ID NO: 34921 - DNA, 1284 bp, Bovine  19866880875512
tgtgtgaggcaggaaattcttttccttctcaatccgtggcaatcagagtgataccaatagatagcctcaataccagtctctcccagacttgagccgggatcactgaaccagagcatcccccagggccttaagtcagtgagacctcaggaacaagctcagaaagaagcagagaaatccacagggcttttgtttgtttcatttctgagcaattcgtcaagtcactgaccagcaattaatgcttcagaagaaggtaaaggtctctgataatgggcctacccactcgtgtaatcctagaaaatatgccttcctgaccccttcaggcaatcagctcataccatgaaatatgaaatccatgcatgcataactgtgaacgttattaaggatcataaaaccatccaactccttcaaaaatctcagccttatttctaacacaattaccccctgctgcagactggttattcatgatgaaaagatacatttcctttcctttgttaaaatataccagtcattaactctactgaacgattctattatggacaagttgaagcttttccaggcggggagatgtccctgcccaccgaaccctccctgactagatctggagatatccagatgttaccctttgataacctagaagagttctctctgttcattccattaatacccatctatgtaagttgggcttcccagatggccctagtgggaaaaaaaaaaaaaagcaaacaaaaaacccgcctaccagtgcaggagatttaagagatgcaggcttgatccatgggtcaggaagatcccctagagaagggcatggcaacccattccgatattcttgcctggagaatcccatggacagaggagcctggcgggctatagtccatggggtcgcaaagagttggacatgactgaagcaacttagcattagcattatgagtgtaattatgagcataatgagtgtatctgggccgagcaggatctgggagctgtgtgctcctggggagtagagtgaggtaacacataaaccctcacccccagctcagtacctacctgagtgtactgatcaacacatagggaactggtttggtgaactatggaatatcagcatagggtgtctgacaaactctgcgtgtcccagcactgggggagctccctcttctttacccctcacgttcctatttcaaattggaacgggcaagttcccacaaaatgaccctggtccccttctctgctgctgattggaccaaggtcagcacctgatcagaactggactaagcaaggcttcttcacaag

SEQ ID NO: 34922 - DNA, 1056 bp, Bovine  19866880886709
atcggtggagaagagggacctggctgcctctgtgtttgggctacagaactgagatggaaagtgttattttagggtgtttccaagagtgagggctgtgattcgagcagcaaactcaattacactcaccttttcactttttgaaaataagaaataatgtttttaggccataatttaccctgttgacattttatttatttacttgggtcaggagagctaatttaagttaaattctttcaatggactttgagttatgggaagaggaagaacacattttctgttaccagaggaattttgtgtgtaaacatacacacacgtatgcacacacagatgtacacacacagaggcaacacacacacaactacaagtcaagcagacacataactagtcatttagaataacaacttactctgtaagatgcaagagaagattctttaaagtaatagaaataggagcaaatccaatataaattttcaaacatttttccacaagataaaaatcaaagtgtaacaaagtgatactttaggtgcctagaatatctggaaacttggccttttttagtaacagatcattttaagaacctactgtatgccagatgctatggctgccctgtttctaccaagagatgaaaatatgagccccgattatctgcgcttcagtcctggggacgggacaagtgaatgactggggtattacatgagaggttggcagtaggaagcaaatgaaccaaggagaatcttatagggagaatgaccagaagttgcctgaaccaatagagtgagaagaaaaacaagtgcctgtaaggtatcatcaattgaatttatacatatgaaaaagcaagcatttttgaataaaggaacaaacaaataagagccagatcttaagaaaggtgggggggacccgtcggctgggacaggtgcctttctgagacagaggcagggcatctgctcgcaaactatgtgatttctcagaaagatcccacgcagacctgtgattctaggatgcttccctaaccactcatcaatgtgttctttccagccactaaaagaaatttaagga

SEQ ID NO: 34923 - DNA, 781 bp, Bovine  19866880908033
tgattttcatcttcatttacttttgggcattttccaggtgttccaaaaatgcatttctttaatattggaaaatctgataaatacaacaccaaatgggacagttttgtaaaaatcaccaatgataagaggatatgatttcaaattaaaacaatgataagcaggaaaaagagaggagaaaaaacaaaagtgctaaaactaggaaattacaagcgaatgctttgatttgctgctgctgctgcttagtcacttcagtcatgttcgactctgtgcaaccctatgaactgcagcctgccaggctcctctgtccatgggattctctaggcaagagtacgagagtgggttgccatgccctactccagcagatcttcctaacccaggagttgaacccaggtcttctgaattgcaggcagattctttactgctgagccaccaggaaagcccatgatttgatttatttttgtataattagataagtttaggcttagcatatgaaaatctataaatctgattattttttgagtcatggcttgcttctgttatctaatttgatcaccacccttaagttcctcctctgtagaaattctgaaatcactgagtgacttctcaaaaatgcaaattcctggggcccacctgggagtctctaattcaagaggattggcatgaggtctgggaatctgtgttttaatatttatttatttattaacttggtcttagttgtgagtgggatcctcaatcttcattgcagaatgggatctttacttggggcatgtagatccagttc

SEQ ID NO: 34924 - DNA, 819 bp, Bovine  19866880979497
ggcagaaggcaacagtctggtagaatgggggccaggcttgagaagtagcttttggaatactggtgaaaataatgaggactttactatcgctttgtgcaggtcactagcatgatgttttctttagccgcacaaggggaggaaggacaatgaagacagagaaagtgagtgagcagagggaggagggtgaacaggagaaaagagaggagaggagagaggaaggaagacagaggaaggagaaggaaaggagcggggcaggggtgtggggggtggtgatggggaggaaggcttcagcactctagcagctctcaggctggaaaggaccatcaattcctgtcaaaggcacccagcctctatggcacagactggacatgcagaaggctgggaggcattcccctgacaattcagaggaggcttcttggaagagggagccttgaagaaagaaaaacttccaagcccgagcctggctctgggaaccacctctgatggcccagctagagagaagggggcaggtggcaggaggggaaagggcttccttctcattgccctctccccgccgcccattgttctcccattcccaattgggctgctctgcagaggtcacccctaggctaatgagaaatcttcctgaagtttaaaaccaattaagcaacaaacgtcttctgattagttatttctcttgatgtgaattttaatgaagcatcttctttcccctccctccctcccaagcaccctgggggttaaccagcctttggtctgccttgaagagccctcagcggtgtcggaaaggctaaagaggaaggaagaggggctaggaggggt

SEQ ID NO: 34925 - DNA, 775 bp, Bovine  19866880985379
cttcccctagggagctgaagtctgtagacttccccccagataagtcccctaccatgatatacaccatcacatggaaccataggaaagggagtgcatcctgggaagtatttgagcacgctcacaagggacatatagctttctccaggaggaaaacagatcccgggggctctcagtctcacgggaccttagtttcaattccccatatggagtctcagacctgtgaatcatgcccaaggttgaaattttacttcgggtatagtttcatagagaaaaagagcttgttcatttagataagactctttttccacctagaaagctctgccctacatgtccacatttttaaatcagatgcatccttcagggtctggaataaatgccatctccatcagaaagtcttctctgatcttcagccgagagttatctttcctccttgtcaaatctcctagtcctgaattcacgtgtctcctgggcagaacagatgttgaccattccctgctatgatgcccattccctccctttctcagcctactgctgaaccctcagcacatgcaaggcctggcttggtcgagttacagcatgaactgaattgacctgagtgaagctgcagacaagcccagagtcatcacagtaataattctctgcaaatggctgctggttggctgcataaaactcctaccctgaccacagaaatctgttttccagagctctctagtgccctgcacccctgatctctccaccacaacctggtccaggccaggcccgggcccatgcaagc

SEQ ID NO: 34926 - DNA, 1219 bp, Bovine  19866881045073
tttgaaagttgctaatatagtagatcttaaaagtcctgcaagaaaaaaaaaagaaaattgttatgcaggtgataaatgttcactaaacttattatggtaatcattgcacaaaatgtatatgtaatacaccttaaacttgtacaatgttatatgccaattatatctcaataaaactagaggggggaaaagttctggcaagcctgctgctgctgctgctaagtcgcttcagtcgtgtccgactctgcgctaccccatagatggcagcccaccaggctcccccatccctgggattctccaggcaataacactggagtgggttgccatttccttctccaatgcatgaaagtaaaaagtgaaagtgaagtcgttcagtcgagtccgactcttagcgaccccatggactgcagcccaccaggctcctccgtccttgggattttccaggcaagagtactggagtggggtgccattaggaaaaagcaaaagaatttagtacaaagtgctggcagcttagcaagtcttctgggagccagaagggaaggccccaggtggctttctctttacatcacttttcctcttcctctaagcttgtttgctccatggtcttcccacagttcagcttcctcagctccccccctaaaactctaccttgggaatttgtttaactggccctatctcaccttcaacgttacatgaccttggagatccacaacccaaaccaactagctacagactcttgactcttggctcaaattctcagtggagagctctggccagtgaattcactgcttttgaattacgtgctggttcagtcacttatagggtggtaggaaaacctgctcactgggggtcatgtcggggagcagtttctctgggaactaactgacatgtctccctggggtgagagaaggggcaggtaactctagtgaagacagcttcacacagatctcactggctcctttcctttctgtaatagcccagatctcttcctgtgtgaacatctcctttgaaagggatgttatggtcaggtgggctgggtggggtgagacagggagggtagatgaccaggataaggatatgctgggggaaatgaagccaaatgcccaagatcaaagctagagaaataaagaaccactgccaagtccaaaggtcaggagcagagtggaaaatcggacgcagagccaaggtcaggagccagcagaactggaaaaatggaaaccat

SEQ ID NO: 34927 - DNA, 732 bp, Bovine  19866881062999
tgagtagttttatttgaaagggagagaattcagaaaatacaaatgctgaagtgcacggtgactgacagcaaaatgtaatttagtaattaaataatgttatgttttagtggaatgatagattagaactcagctgcaaaagaaacaggttatagttataaaatgcttaatgttagattacaattgacagtagtagaaaaattagattgtttaaaggacaagtggaagacttccatttctgggaagattgagtagtattttccactgatcttcctgttgcatacaactgaaaactctggacattacaggtagaacacatgtaagactctgaaaggtggagagaggaagggaccttagacctaagaaacaacatgatgttttaagttccatgggttttgtttttaccttgtatatcccagcttgagctgaagaagctggtaacctgcaaacaccactaggcacaaacaaaaatgcaccaccaaagtgtgttttctctaggcaaaggaccagagaggggcagcaagataaaaactacttcaactactctaatcagtcctactccagccaaataccacataaagaactgtgaccccgtcctctccaatgccagcaaaggcctagtgggatgccgagacttctgccttcaccaggttgtgatgaaccatcctccttgctctatggtgtcagaggctaagtagagagccaggactttcatcccaaccaagcagtattgag

SEQ ID NO: 34928 - DNA, 2534 bp, Bovine  19866881076297
agaggaatgtgggatcctcatggtgtggcgcagagtgagcttggaaaaaccttgtgccccacacggccctcccttaggactcaggcaccagcaccctcccctcgggtgtgtggcagctgtgtgtatgtggggtggggggcatcttaactggtacttcaccacctaactgcacaccaggatctacaggggctgctgtctgcacattaaaaactaggttctgactaggccgatcctgagaggcactcctgtagctgcagagactcccagctactgctgcccaggacccagctggggagggcctggcctcctcctgcttgggtcagattagtgaacactgagtgggcaggctctgcagggggccgtgactgggctgtgggaatcaaagacacacagtattgagtgggggatgtggcccaaagatgagtaatgatacaggtttgaacactaaataaaacagtagaaaactcaaagcaaagtgatagatcatcaaactgtgtaaaggaaaaccactggatcctcagagtagcgggagcacaccttgggctgagcagtcagcaaccatttagggaggaaataatgcgtgaacttagtctttattccttattactgtcattattccacagaagcttgctcacaggaggctggagcagccgtttactcttagcttccagatcaaatgcccagaagtcaccattgggcagcagggctggggggtggggtgtggtcagcctggctcttggaattccagcctccttaggtcccaacgaagtgacaggtgctagggcgcgcccatgaggtggaagttgcttcaggaaaagcagcctgtcctgcatgcaggcccacacggtgtgctgcacactggggtttgggagtcatgctctgggtggggagggacccgggctcctgggtatgcgggctgaggggacagaactttcctgggactcgaggggcatgaccctgccagcctttgacaaaggcacacagcacccatactgtgtttttgtggggttggggtttctggtttattgccaaccatggtcctggccgtggcactgtgctccccttaggccatggcagctggggttcactcatccagaggcccacctgccccgagccaaggctccagtgaggtcctgccttccccacacagcttggagactcaaagcttcttccttttcttcccgttgtgttgaccgggcttttctaggggaggagtgggaccagttaaaagctccccatgccaaccggttcatcttctcccacgacctctccaacggggccatgaatatgctggaggtgtttgtgtctagcctggaggagtttcagccagaccttgtggtcctctctggattgcacatgatggagggacagagcaaggagttccagaggaagaggctcttggaggtaatggtggcactgttacagaatttcacagatggcagctcatgttttccttcggatttccgcctctctcggcctctgcagcctgcactgccttgccctaggtcccagcctcccgggataggtcgtggaggccaagaagcctgcctcccactccagcagggcacctcatggtgttcttccaggctcaggcggcagcttgagtaggacaggtcagaacatcatcttgcctgagcctctgcttcctgtgctaaaccaaacatggctgcaggctgcagtgtttgtggtctgtgtccttcatgttttccgtatcatctcattcacatcagcgtgttgcagattcacacagcacttgaagccgattgctcagtttaggtccccaggaagaggctggctgtgtgaacgttcaggggggtttcccagtgcactccaagtccttaactccagcgcctccctgcagagcctagttgtccctgttgggcaaagcctcccttgtccacagagactgtggtcgcccacgtagccaggagctctcatgaggatgcactgcctcttggacccatccttccctcttgcctgactccttgtttctgatggcagtgctcttctcttgtctctgcaggtcgtgacctccatttctgacatccctacgggtgttccagttcacctggagctggccagcatgaccaacaaggagctcatgagcaccattgtgcaccaggtaacccacgggcagtactcggggctcagtgtgctgtgggtgtcatctcacccagacccggtccacgagatccaagtcaggagccaggactgccctggagcaggatctcctgctaagttaggaagacggcagagttactgatgggttcatttagttcagtttagccaactaaactaaaaaggcatgtctgactctttgtgaccccatgaactgtatagcacgccaggcctccctgtccatcaccaacccctggagtttacttaaactcatgtccattgagttggtgatgccatccaaccacctcatcctctgtcatccccttctcctcctgccttcaatctttcccagcatcagggtcttttccaaggagtcagttcttcacatcaggggccaaagtatggagcttcagcat

SEQ ID NO: 34929 - DNA, 2785 bp, Bovine  19866881114883
acaaaatggtacaaccactatgaagaactctttggcagtttttatggggttaaacatatctatttctagaaactagaaattccattcttggtgtttaatgaagataaatgacagcacatatctacaaaaaaagactaatacaaaaagtgtttacaacagctgaaaaagccaagcaaacagataacaattcaaatgcccatcaacaagtgaggaacaaatcgtgatataatcatgcaacagaatgctattcatcactaaaaagaaatgagctactggtttatacaacatggatgaagctaaaagacaaaattacactgaacaaaagaagcagatataaaaatatatcctgtggtttatatatatatatatatatatggcttcccaggtagctcagtggtaatacaggaggtccaggagatgtggattcagtccctgggttgggaagatcccttggaggaggaaatggcaacccactccagtattcttccctggaaaatcccatggacagaggaacctggcagactgtagtccatggggttgcaaagagttggacacaatggagagactgagcatatacatagatatatatgtataaagtccagaaataaaaaaagcttatctacagtgattaaagtcagaccagtggaaaaaaatcagaccaatggttgtccctggggagttggagactgactggaaggaggcgctcctaagggaacttggtgttccaagttcagaaatgttctgcatcttttttggatggtgcctacatgaatgtatacaggtgttaaaacttgcctaattgaatatataagatctgtgttttttattgtataaaattataccttaataaatattacagacatatctttaaaaaagaaaacacaatggccattaaaaacatggattaatttgtgttctgtctaccccaccccttcagcctctaggtcgtaagcttcaggtggacagaacatctgttttatcttctgtattcccagcacctactactgtgtctgggatctcgtgaatgctcaagtcacatttgttaatatcagaggtttttaaaagcctctgtgcattgagctgtggctttgtattgagctgtggctttgtatctccctctgcagacatgatccattcttggcagatgctggtggccccagaagctcgagcacaggtgctttgtctaggaagggagcttgcaggtgggagcccagcagggccctgggtgtccttgggcactgacagggtcccaactgtgagcaccatctgctcctgtgaagggtgtctgacagcatccgcagccagggacctggaaggtgagtgcctctgagatcgaatatcaggctcccatccccatcctcctgcctatggggctgcatggaaagtcactttaaccccacaaacagaaagtacccacacatgtactgctttgtaatttgccaagaattttcccacagatgatcttactttatactccctaagaccctggaagattggtattggctaactctgtttcacagagaggtaaagtgacatcccaaggtcacacagctggcaagtggtagaattgggattcaaaccaagtttctaaccatttactactatattaaatgcagtactgctgtgtcatttaaggaccttcagaagccatttcttaaatctgaccccttcaagctctactggactaatggaaagataactaacaaataccccttatcttgaatgcaagttattctacatgcccctcaaagatgagcctgcctggaccaccactgtgatagtgtcacatctctatgtcaattttccatactcttcaccatctaccaagtaaaattcactctccttagctgctgttcagtgctcttttgcctaactcatctttgtggcttcatcttccttaaaaccccttgcattctggctggttatgtcactatcctcatctctgcaactttgctcttcaactcgccctccacctggaataccagtttcatccatcttcccttgggatgcttttactgacctttcaagttgggactgaaatgccactgccattccagattgtagagttttacattacctgaatccttaaagcacctttcacttggcattaacgtcagacatcatgtacctcactttgtcttctttattagatcctaaggtcctagaatgctagattcatgcctatttccataacccctgtagttactaacatagctatatactgtagacatttaaaggtgttttgttgagtgaataaatgaccacttctccaaccatggcctatgcatttaatacccttttaaatgcacggttttaaaatttttctgcattttaactttatgtattggattaacacagcttccatcttccatacacgatgcttccaatttgacccagcctgctgctaagtcgtgtcagtcgtgtccgactctttgcgaccccatagacggcagcccaccaggctcccccgtccctgggattctccaggcaagaacactggagtgggttgccatttccttctccaatgcatgaaagtggaaagtgagagtgaagtcgctcagttgtgtcccaccctcagcgaccccatggactgcagcctgccaagctcctccgtccatgggattttcaggcaagaagtgctggagtggggtgccgttgccatctgcgatggtatctcttacgtgcaatttaaaaacaatacaaatgattacacatgcaacacataaacaaactcaggttcaggggcttcgctcgtggctcactgataaagaacctgcctgccaag

SEQ ID NO: 34930 - DNA, 998 bp, Bovine  19866881117951
tcgtagacaaggacattttaaaagctattataactgcattctatgtgttcaagaagccagagaaaaagttggcacgttaagtggaaacatgaaagagatttaaaaaaacaaaaacctgagttgaacttctagagatgaaaaccacaatgtctgagatgaaaaatgcacaggatgagattaaacgtatgttttagtcaatgggcttccccgctggctcagacggtaaagaatctgcctgcaatttgggagactcatgttggatccctggattgggaagatccgctggagaaggaaatggcaacccactccagtattcttgcctggagaattccatggagggagaagcctggtaggctacaatccacgggttgcaaagagtcgggcatgactgagctacttaactttcatgccaagtacggaagaaaagggaggaagaataggtaaaactataaaattatagtttagaagtttattatactataaaaatacagtttagagggcattattgtcatgggccaggggtagatattgcccatactgtctttgtggtatgaaaattgcatcagattatactaaatggtgagcattactgaagtttgaatttcatataaattcttcacttgttttgaaaatttattctcttttttattttacccccaatcatttaaaaatataaacacatttcttagcttgtgggctgtacaaacacaggtggcagaccatagtttgctgagcccttacatagaacaataaagaagtactcggtatttttcaagagagaataattgagaaagagggtgatcccagtgctatgatctcttattttcatctgtctatatgataacacacaaaataataaagaaaatttgagatcttaacacaaatttgtattttttatgacctgtgaaacttgatcacgtgagaattatgaatatactaataagatacaagtacattctttaaacaagaaaaagtattccttgtctaaaaaagggatt

SEQ ID NO: 34931 - DNA, 1777 bp, Bovine  19866881128239
ttaaactatggatctttcccttctgtagtgtcttctacccacttttaggccttagaaaatcccccaaccagaggtcagatatgcattcatctttattttcttacagtttttaacatttcttattctatctagaatttatcttgatttggatgtgtggcataaggtgcgaaggcgttgtatttgagataattaatgctagctgctacaactgttaaactctgaaatctcaaagccttaacacaacaaagccttacttttcactgacgtcaagcccagtgatggtcaggtagcactctcgagcatgtgcctccaagtggtgactcaggaacccaggctgcttcagcctgcaattctaccatctcagtcttttgcttctagttctcagaccccatagaatttcaggtaagaactaagcgctgttgcctgaagacctaattcatttttcaaatagccaaccaattacctggtggcatttactgatcatgtatgaacttgttatgtatacagtggtctaaactacttattttgttctattgggcactatactagatttttttccaaactaccttatgttttagcatcctctcaagtgagttcctccctcgttgttttccattttcaaagttttcttggctgttaccggatagatgatattacaggttacatattatctcagctctgtgaacatatcagatgtattagtgcacatcagagactgcacctacccactggggttcaatgaacagctcgagtagaggatgtctgctatattctaaatgtttgcgtctctcctagacccttatgttgaagtcctaatgtgatggtgtttggaagtggggctttgtcatgagagaggaacccatgatgcgttagcgtccatgtaagaggaggaagggagttagccctctctctgccatataaggatacagagagaaagtggctgtgcctacaagccaggaattgggccctcaccagacacaggatctgccttgagcttggatttcccagcctccagaactgtgagaaataaatgcttattgttttagccacctaatctcgcatgtttctgttacagcagcccaaacggactaatacaatgtccaaatccttgtctccatctttaaacccttctccaaactccagacctacatttctatgttcctgatatatacttggaaatacctggaaatttggctagctcctcagggaagagctaggtcatgctgaagccgatggctgattttctttattagtcagaagtagaggtaagttgggaaaaggaaaagaactgatgcttcaaaatattccctcatcttcacacaaaacctggaggaataatccaagggtctctttacttgggagggcctgctcctccttgggaaaccttgagaaaaccatttcatgagtctacactatcctcactgtggctgaggttgagagtcaggaggagaggaagttcagcaagggctcaagggatggtgtggacgttagccctagttgccagcaagagggccttcaggatgagtggggcctttaggatgctttttcaccatcctcaatgaagaatggatgtcactaaaaccgtaataacagcaattgctctcaagacttccctggtggtccagtggttaagaatgtgccttgcaatgcaagggacacaggtttgatctctggtcggggaactaagattccacatgccacaaagtgagcccgtgtgctgcaaagagagagtctgtgcacctgaaagaaagcttgtgcatgatgcaggaagatcctg

SEQ ID NO: 34932 - DNA, 1815 bp, Bovine  19866881147872
actctgagagacagtaaaggacagggaagcctggtgtgctgcagtccatggagggcggggtcacagagtcagacacaacttagcaactgaaccacaacatttaataaacattttgcccctaaatcaaaggatagttttgtatgtagtgtagtcagtattttctggattccacaggaaccaacacatagaagaggaaacatttttagattatagcacatttcatttgcaattttgggttggtgttacatttacatgccctctcccttcatactaatctggattgtgatatatttttagaatttttcccataaaaggtagggataggatagccatggaaagttttagccacttcctttttagtatgagaatctaattattggcatggattaaaatgcactgtatttatactatcaaattttgtagaagctgcacaactcctccccccgaaaaagtacaaactcacttttttcagaaagattaattgctcaggcctggtaacagctccctctgtgatgttattttatcgaaatccaaacaggctttgagctctctgcttggacctgggcagctatttagatttgatttcccttaaacttcatagttctttgccacctactgtgaggtccatgggaacttaatgcttcagattaaactgtagcttggcacagtagtaccataggtttccattttgcctgttaaattagcacctgcatccatgtaagaatattgttgccaaaaggctccatgcagaaccaccactaggccattctgttgttacttatttcaaagggttggtacaaccaaaaggctgggagaccttggctccatcttcagtctaccatggcccaagttcaactggattcccctttccagtcttggattttgaacagattctctcttatatattgtgggcttttcaactttgtttttaatcctgataaaatacaaacacatgaaacttaccatcttcaccatttttaagcacacatgaaggacattgacattttgtgcagtcattgccagttcagcatatctccagaattcatcttgaaaaactgaaactctactcattcaataactccttatcgcccctctcccagcttagccctggcaacagacagtctactttctgtctctgaatgtgactgctttagttacctcatgtaagtagaatcatacagtgtttgtctttctgtgactggcttgtgtcactgagtacagggtcctcaagagtcatttagttacagtgtgtgtcagaatttccttcttttttaaggctgaataatcttccgttgcatgtatacaccacgcgttgtttatccattcttctgttgtggacaccaggtttgtttgcacctcttgcctgctgtgagtaatgctgctatgaacatgggtgtataatatctctttgagactgatttcagttattttgggtgtatacccagaagggttaatggaacatagggtaattctactttttgaggaactaccatacttttttcccacagtggctaccctattttacactcccatcaacagtgcacaaagattccagtatctctacatcctcactatggttgttattttcttggttttttaattgtagtatataattgacatatactattattagtttcaagcatacagtggttcgatatttgtgtacattgcaaaatgatcaccatagttatctagttaacatccatcgccttccatagttaacaaattttttttcttatgatgagaacttgtaagatctgtcctcttatagcaacttctgaatatgcacagatcttccttaatatgtgattatgt

SEQ ID NO: 34933 - DNA, 1742 bp, Bovine  19866881334854
aaactttggactctgtggtttcctgtgagaaatgaaatggtggttacagatgatgctctataaattatttcatagtacaggtattttgtctttttcattaagtatgggacttttgaaattaaaaatggtttggactgattagagctattcagtacataagatattagaaactttaattgatttacaatgtgttgatctggcagtctgttaaatctaattgcaaaaaagttcactttattagtgcctgatttaatacagtagtttttcatttaatttcttcttggcttattgtgaattctgctttagaatctcatagaagcgtgacattggtgtgacaaactatttgtaaatagtcttgatcttaaaattttgtattttcttaggggaataaagaaataccttaggaaaggtaatttgggtggggtgttatagaagagtaaattcaacctaaaaaattcactaaatgtcagtaagtgctattaccttaaaatgacttttttcccccccttctttagaatccagcaactatcacaagaatactccttagccacttcaattgggataaagagaagctaatggaaaggtaaggaactatattgtgagctttatacttagaagtaattatggaaagcctgttgaactgaatttatgagacacaagtaagggattgatttatatacttaccaaactcgtgtatgagtagtatttgctttgatatattcccatgtatgagtagtatttgctttgatatattccccatctgtaagttttgcaataaacctagtgttaagggaactcaggcttgtttcttcttttactttggaggtgaggtgtggtgactctgcctcaatatcttctataatacatccccttgagtactgagaactaaaagtaggtgtttttttgttttttaaggacttgatacagccttagaacacatgaataagatcttcctttaattacttaaaactttcttccccataaacttttaaatctactgtaggcacaataatgacatttcttcagtaaatataaagaagttgctcagggtatccttaccagcaaaacagctgtttggagtgattctctggtttcagtgcaggactaaatcccattgggcattttctcgctggaaatgtttctggttctaaaggcaagaaattacaaggactggagaatgatagtaatactgccgtcttgatctttttgtctttcttagattagaaatttgaagcacttggtaataggatgagagccgttatttattctatcagtctaaaattagcagttctaattttaaatgattttaaaattgcatacagtttttgttacaacctgagaatccaagtattatgagaaataaatggaaaatatttcctgtgtgactttaaaatcaaaaacgctttgcaaaacagatgttaattaataccaagaatattatgaagtttctcacatcttgcaccccgatacaatttaatagtaacaacaataattgttaattattgagccctctgtgccaggcattatttcattttatcttggtgatagctttatggagctacaaattattatccccacttaatagttgtagaacctaagacttagagcttgatatatttgtatgagttttgtaacacaaggagttagcacttaaactcagatttgttggactccaaagcttatgttcttagacacatactgtagaactttcccaggtgcttgaagaataaaatgctccttga

SEQ ID NO: 34934 - DNA, 949 bp, Bovine  19866881355800
ggccaacatgtggggtgacaggtgagagcagtccatgaggcaggttgacaagttaggagttgtaaaggagggaaagggaatacatccagcttgtctgtggccctaacaaaccagagctggtgacagtaatattcacaaaacttctaatagtaggaactgcaaaaatattccaaaggcccgctagtgacaagggcaggtgaagtaggtacctactctccattcctcctctcagtgtctgggcagagccccacctcttctagtaaattgctccttctccctttccaccatagggttcccgtgggagctgccattttgttacttggtccactggccatagctgagagctccagagacagtctgatgtcttttctgggactttttgaactggtactgagataaagacctcatctctttcaaggaggtaaggctgttagggatgaagctcaggaggtgtaggaagttgatctatagtcagatcggagcagagacaggaatgcagatgtaaggcccccgattcctggcagcattcaagacttgagctcagtgttcctgaggcccagtggtattcctgctccctctaggttgactgctcaatgcttcttcgggttggaatgttttgccagtatcccatatatgactccagccagcttttcatgagggacaacctgggaccagcccatctaccagcaaaatctcttttgtgcccaaggcggtatgacctgggttcccttgccaccagagacctgaccaatccatcccctcatccatcactacttgcatgaggaggacagagccagcatgttccagaaagctggggcagtgaagccaaccagagaggctcaggtgctcagtggtgacacagggccaagtccagagaaatctcagacctggaacagccggccccagttccgggctgcagccctggttggaagccaaacttgtgggctag

SEQ ID NO: 34935 - DNA, 1059 bp, Bovine  19866881416693
aaaaaaaaaaaaaaaaaaaaccgcaatacaagcacatcataggaaatttagaaaataaaggtaaatacaaagaaaaatcacccttgattccacacccagaaatacacactgctacctggtatatattcctacagtcttacatctgtccatagttagacctattacatattcttctcaaaaatcagattgtcgtgtttatactagtttctcaatgaacacatcctgaatattttttcattttatcaaatacattttttttcctaatatcattttgaatggctgcataccattctattacatgaacctgctttatcaagttggggtataaattagatgaacatttcataagcatttttcattaaccacttaagcccatctgaagtaaaaagaaatacagtatctctcttgagttcatcctccaccctgaattgctcaagcaaattccttgaaagggtggtacatccaaggccaggtgataagagcactggagcctctgattgcgtgactcctgttgctactcccaacctgtccctgtataacgtggtcctgtacagtctcagcatctttgtccaccaatgcagtgacatcctcactgtccagatttctaagagatctctaaggtaattctccaatggaggtaggcactctgtgtgccaaagcgcctaggagggaggggcttccagctctatacacacacaagccagaaccctgacaacttagcacttggctctgagtttggacagcctatcaattcccaccagcagtggacctcattcagaacaatccttatctagtagagagagtctgaccatgttgatctcgaaagggaagaagttagatgtttccagtcctttccttttggaggcttttgcatgtatgctcgcatgctaagtcacttcagtcatgtccagctatttgcaaccctatggactctagcccaccaggttcctctgtccatggggactctccaggcaagaatgctggagtgggttgtcatgcccttctctaggggatcttccccagtcagggatcaaacccgagtctcttacatctcctgct

SEQ ID NO: 34936 - DNA, 1271 bp, Bovine  19866881627190
ccctgggaactggtgctgcttctgcccgtgcagcatcgggggccgtgtggactgggcttggaagagcaggtagtgttcagtggatggagcctgggcttgggactcggggccaggattcagaattccgcccatcaggtctgtgtccttgggccatgcttaggctcccagcctctgatgtgttactatgaggattgaatgagctaatgaataataaagcacttagtgtggtgcctagctcagagtaagcacctggtaatctacaaagaaaaaagtcttatcagtcattcaagccccgtgttcagcactttttattcatcttcttaattaatcctcagtaaattatgtgttattcttcctatttttgtaggtgaagaaacagatttggttaccgccaagttcactcagctcataggaagagattaggattcaggtctatctgactccagagccagtgctttttgtaccccagcatgctgccttccagaacagctctgacgcctcttcacttattttgagatttttgtcatgtttttcccgagctgccccttcttcaggctattgtgcccctgttttttcctctggacgcccaaacacctcgtggcattatcttaaagccgtcggcagacctttggactttttggctgtccaggcctcacctgagctatggggctctggctctggggaggctggcgcagttgccagcgcgcatgcggggcctgtggcacggcctctcctgcagggaccaccaggcctcggggcagagctgctccttgtcaggcacccaggaggccttggtgatgtgttgtctgagaaaggctagtctcagaggctgtcagtcagtgaataaaattttaaattttcttgtttacatcttaacagacaacatatcaggaacctttatgtgtgttccatagtgagtactgagaagagctttaaatctgtaaaattgtgaccacttagctgtatgggtgaaaaaagtccagcatctggtggacagatactggggggactctgaaattagaccattcttacttagccttggcagtggtgccaatctgtgttcccttgaactagcattgacccgaagtgcttattgagccagtttcaggggccctcagaggtaggtagccagaaccccagaatgtgcatacgttcagtggtaaaataaatgctaacatttagactttcctgctgtagaatctgttcgaaacacccccagcactgacaccatgccagcctcctcgtctcaaacatgctgtaccgcatcatca

SEQ ID NO: 34937 - DNA, 1699 bp, Bovine  19866881753869
acacaaaagagcatgattctccctatctgtttatggcacaaaagagcaagtaaacaggattccttaacaaaagggtctctaaccaagggattcctggataatgctcattctcctcaggactcccaggcagctatcttaacaaaaaagagcactgggactctgcctgccttgcttaagaacactaggtataatctattaataccctcccttcccctaagaagggaaacaatgttacatggctagaaccagggacccaggctccagttggggatttgactagcattgcccattgtgacactgccatgcattaacaaagcttccagtggatgtttactgagggatattctgattatacttacaagtgggctgtatttgatattagggttgatggagggttgggctgctgcttatataaggttctctcatcctaggagaagttgggtgacctggaacgggcatccaggtggggcctacagggccttgctctccaaccacacctagccaacctgagagatggtacaaggagttcaacccctacattactctggcaacctcaaggcagttagaattgctcaaagcctgcccagtgtgctggccttgctccaaacacacaggaatatggaagcaaaacaccaactggtgcccgtcaaccatccattaggatcagcatgggaggtgggtggctaagagctgtctattttggacaagggcatgaagactgaggacagtttatagaaaattgtttgtggctcaatcccagaagcaaggatccacaattacctgaactcaggatgttgtgtgctgatgtgtgtgttcagatccattacccagcatgactttcccaattagacgttatgaaaactaagctgtcatggagttgaatacgctgagagatggagtgcacatctactattcaaatgaagcgagctcactaaacaggtgccaacctgaaggtgtgcttgtttgcattcagaattaaaattgcacccaaaaaagcacgttaaaaacttaacaaaacttcaaaccagaggtaaaaatattcaaactcagtgtgcgtttgagtgtaatcttacatatcaaatataaagaaatgtaagcaataatttagtgaggtgttactttatacatagtaaaatgcacaaggattaagagtagaccttgatgactttttgtaagtgtgtgaccttttgcatatgtggccacttcccagatcaaggcatagagttcttttttacccccagaaaattcacttatgccccttcccagtcaatcctactccctgataataaccacaccaattcttccaccatattttaactttgcctcttcttgaacttcatatgaatggaatcatacccatgcatttctggcttcttgtgttcaatatgtttttgagattaatccatgttgttgcatgatcagtggttaattcttttttttctttgctgagtagtaattcatagtatctatgtaactgggtttgttttttcttctgtgaatggattcttgtgttatttccaatgtttggttattacaaataaaacaggagtgaacttttttgcttatatgtgttgtacaggtcttttcgtgtggaaagatgctggcttcctctagagtctatacctaggtgtagaacactaacagaatctgccaagtgatatatgataagtttaaagataacttatagaaatgtgaaata

SEQ ID NO: 34938 - DNA, 1535 bp, Bovine  19866881775819
tttaacataggcttttaaatctacccatgagccacttctaagtgcatcaagtgggttggcatgctgactgcagtgcctgttgcaggaactgaatatgtctcagcatggttggttaagggcagcacttcagaggaagagaaatcttggttcttacaccagttgaaacaaataccttgagcaagttaactcccctgagctgcagctgtagtttgtcatctgtaaagtgagataatagaaactcctttgtaggattgttgtgaggattaaactacctgccatgtaggagcatgaagcagatcttagccgtgatggtggtggtgatgatgaaagagaagaagacagcaacaacaattatgttggtgcctctgcagctgagtcagaggttcttaaaaaggagatgactgaaaccatccacggacttttttcagaacacaaatggagaagtccttctccagaccctctgaatctctgggttgagagatctctatcctctctatcctccagaagactacaccacagtgggcactgagttatgtgtctggtcaccaggtatcagaatggaaggaagaaatttccatgtatggattaggagagaaaagactaaagtcagcattttgtggttggagaagaaactaattaggtttgcttaaattttttttctttctatagttactacaaaagaagacactagagggcatatgtacaataaactttgaaataccctgtcttatgttctaatatgtgagaaactagttatacagctgttttgtaactaatagtcccaaacctctcacatctgaatgagtatttcctgctatatagttgccttcagaagccaaatggttacttaactggacttccattgtttaacaactcttggctctcctcgaaactgccttcaaaaccagtttaggaaccccacaagaaagccaaggtcgttgatttgtgtacatcacactttggacttgtaatgatacccagccgattcacttcccatattcattaggctcatttccagaaattgtaccccaaaataaagatagctattcccaggaatattcagaagaatacattaaaggttcagaatataattgggctctagaaaagtttagagtcatcatcataatccttgaaataaggtatctgacttcccaaaggtatatcctgacttgggtatggatgtgtgtatatgtgaatgtgtctcattttaaatgacttatatatggccacaccttatccaaatactgctgtcaacatgaggacactggctcctgggttagcctttcaggttgcgtatctgtgtttgagatgctcatttgtataaggtctggccaagaacagtcacatgatgtaattgaaattaaaattttttttttcatttcctttctgttttttttttggtctgtgcagttcccagtgctgctcctcagaatctgtctttagaagtaagaaattcaaaggtaaaactttatcttgctgttgttcatttttactggtagacctgttaggcctcaggagggcttataaagagggag

SEQ ID NO: 34939 - DNA, 1176 bp, Bovine  19866881828280
tcatctagacctgaagcattagaacataagcccatagaagtataaaagtccatatcaaccagcaatactgaggagacacagacacccactccagtactcttgcctggaaaatcccacagacagaggagcctggcagggctacagtccagagggtcgcaaagagtcagacacaactgagcaacttgtcaagagacctaggaactaaaggagtaattgttctatcaactgaagcaaaatgtaacaggggcaataaatgcaaactgcacatgatgaaaaatgagacaagtgtgaaattttctcatagaacactaataagaatgatgatgaaacgggtattgcaataccccagcttccaggaatgacaacgtagatgattcgtatcaactcttccactaaaaagaaataaaaagctagacaaaatacaaaagatctgtgtgagggcaatcaaggtcatgaggaattatgggaccaagatccagaaaacgaggtatttgacgctgtattttttttacctagaggtatctgtggattctaaaggccaccactgctgaagagacggagaggatgagtgaagcttttgacagacgtaagccctgaggggacaaactggagtgagggactgccgaggaggagggtcaactccttaaactgtcaattaggacctcaaagggccacatacaagaaataaaggtaaacccaaaatatttcagctcataaattctgaagcccaattttaaatcatctcaatccctgagtggattacagtgatctgagattgttagtgacttcatataaccacataccagaagagaagcaaaggtacatcctttctgggagaagatagtagcattcagatttttcatacacaatccctgacactcaatcacaataaacaagcacataaaaacacgcaaaaatccctaaaccagaagaaataacaaatacaaaagcaaatcctcatgggaacacatgtgacagggtggattaaaggaataacaataaaatatggagaatttcagcagggccctagaaactataagacaaaatagacagtctagatttgaaaaatgcaataaatgaaattaagaaatcaataaatagagagctgtctctgtttagaatgtagaaagtcgtaagagacttgctcttacccaacagcccaaataggacagacca

SEQ ID NO: 34940 - DNA, 718 bp, Bovine  19866881832386
gtctctctctaaactttgaattacgctagtctaatgactgctccggctgttgacttacacaaatcaaaaatggtttaaaagaatttgtaatagttcagtcaacttctgacctgataaaaattgtaaaatatactcttacagattttgcctgttctgtggtgaaattattttaatgtattatccacgtaaacaaagctacataagcaaagaatcttactcagtctaggtggtagcagaggcctacaaaatgatttcttctaacactgacaccacttgggtatctgtgacctgaaacagttgtgaatggccacagccatgcaaggagaacgtttgtcctcaagggtatctttccattttcttatttcctcacttgaaccccgcagctctaagctgcaggagataaatacgactgcaggagtgttgctgagaaatctcaccaaaggagcattactgcagaactggtcatggatgtttttaaaagtcagtctgattatactccagacccaggtgaataacatttcccaaagatgaggcttttattttgaatatttaatagtaggtacttattatataccagttgcggttcttgtttctaataaataaaaatagatacagtccttgcccctgaggagactattcattttctcaatgaaacatttgatgtataagcaaaataccactttcttaataaaaagagcctttgtttatcaagaaaagt

SEQ ID NO: 34941 - DNA, 1787 bp, Bovine  19866881885754
actgagcacacacattgggtacacagcagataaagcacgtgtgataaaacgttaacctgtggggaacctgggtgaagaataaaaattgtactatttttgaaagctttctataaaaataaaatatacaataaaaagttagaaacaaatcacacccgcagttacttcctttacttagcatacatacccagattttcgatggtgtaatagcgttgtttatagtctacctttatggtctgggcatgagggctgccaatgccataaccaatggcataacctctgaccacaatgttttgattctctggaggcgtccagcttactacgatgctagtgaccagtgggcggacgtgaagagaactaggcacttctggaacacgagtttctgcgaaggagaggagagcaagatgagattcagatgcaccttcctttgtaatatttcattgtccttggggcaaggtgtttaggcttctgccaaatcatctggggctaagtttttttttccattatggccaagaattctcaaagagaatctgcatgtatagtgaagtacggccacagtttaactgcagcctaactcaacctgaaacacaagacactgcaggattattataatttggaaggaaagacaaagaggtccaagagccttcccaatggagaaaaataaactgtctttccactgctgcccactcctcttggtcccacagctgattaccacactccatcaggtggaatgagaaaggaacagcacactaaatagaagcctgctgtcaacaggtgatcacgtttcacatgacagtgatgatatcagttatttactccccaaactaatacggtaagtcagaaaatacgaaactcagaaccataaactgatttaaatggtgggagactaagaggctttaaaaggtggcaatttgcagtatcgttcacacacattatctcaaggcataaattcctacctctatttaaaaatcagtaaacaaagaattacattaagtactcaggtcttttgccttttaagcggagcacttgtctctgataaaggcaacatacacacactcatatggagtcactgaataaactggtgagaaaaacggcgaggtttctaggactaagggaaaagggaaacgtaactaaaacaaaggccagtctacagggtgcagccttaaattttagatcatctgcctacttaatggccttggtaaaaaagccagacttaaagcacctgcacatttttacttgttctggttctacttacagggacagttctcaaaaggccactataaaaaatacatttcaggagacttgctatattacaggaacgacagcagtataatccacaaaaattcataggttttagccacatacaccccaaaatctatgcctttatagtttgactcatttgacttcagttagtacccagactgttccaatcctgctgattgttgctcttaccatctaagtcactttcaaaagtttcagctgacagccagtcagtagctgggcctgtaccattgactgttagagcagccactcggaaattatattcagttccccgatcaagacctgcgatgcgaacaatttaaaaaaaacagatgaaacaagagttttggaaaaacaaaagattaaaacctcccattaaagccagtatctcacttaccatcttagtacaaagctactaccctggtggcttagtcggtaaagaacctgcctgctatggcaggagacccaggggtcgatccctgggtcaggaagaccccctggagaagggaacggctacccactccagtatt

SEQ ID NO: 34942 - DNA, 811 bp, Bovine  19866881998953
ctgctgctgctgctaccctactattactccttctactatttctgatactactactgctgctgctcctattactactgctactattgctgctactacagctgctgctgctactgctactagtagtgtagcactactactacaacaacaataataataatgaagacttgtctctggaattttccccacttttttttaaccctactaatctaatgacctggtgggtcttcttgggtcctttaaaagcatctaaaagtgaactattacagtttccctctgctttctcctcctgtagaggtctctgaaagctcttggggggaactgcatgaggtaatggatgcaaaagtgctttgtaaaatacaaagcattccccccgtgcaagctattattggaagaagcagaaggatgaatttaaatcgcaagatcccctgaaatactgtgaaaggtggccccgtttagatcgtcgtcctcctcgtgaatttacagaccatttagcaatttctccaagtgctcacacccgttccctcggtgacatccttgccctgtgctggggagagccgtctctcccaagtctggcctgttggacagcagcagcgcctgcagaggaaggggctcggttgctaggagaccagcaaaagtgggcagccagctcccaagcaggttagaattcggcaaaggattttaaaagcctatttctgtctgcttctgctagaattgaaattcttttcagggtccggccaccagtgatacaatctgcttacactactggtattgagaggcccttaaaggaaattattggtcatatcttgtgtct

SEQ ID NO: 34943 - DNA, 1517 bp, Bovine  19866880155696
catgtccattgagtcggtgatgccatccaaccatctcatcctctgtcatccccttctcctcccgccttcaatctttcccagcataagggtcttttccaatgagtcagctcttcacatcaggtggccaaaggattggagtttcagcttcagcatcagtccttccaatgaatattcaggactgatttcctttaggatggactggttggatcttcctgcagtccgagggactctcaagagtcttctccaacaccacagttcaaaagcatcaattcttcagtgctctgttttctttgtagtccaactctcacatccatacatgaccactggaaaaatcatagccttgactagccttaacttacctaactgtaaattatgccaaatctgagccatatattaatccttcattttacagcagagaaaaactgaggctcagagaaaggtaactgtctacaagttataatgctgcccaggcaatggcagtaaagaactgttctctcttccacacaccatgccatgaccatgccggctagaagatgcataaagatcatctttaccttagggaccacacttcttacattatcttcctcccttaactgtttatattaggaaaaagtcaaccttacatttgtccacctggtgttgattagcatgaatctgacatagataactgagataataattttcctctgacaactggctcccttttaatgtgcttatgcctttgtttgtttgaacattaagggagacaagccagctgtatagacttaagtccaaagcttcagtcttccatagaaaaccttttccatttcttaccttctgcatctgctgatcagacttggccatctctgcaaaataatccgtaggccgcttggtaggcactttgagctgatggaggcggggcaatactgcaagcactgctgcctgggcttgacggtagctgcagaagtaggacaaagtgtgaaataagctaaggcagagaggtcttattacatccttctgattgcctctcataaggtatccaaggtcggaagagcccgcaacacctgacctccaccagcaagaacacacacacaaacaaaatggtaataaaacctcattaactcaggagaaatttagatgtacacgcttttaaaaggggtgggggagtattgcttaaaatgaattagtagtttaatagaatgaccactttagaagtgctcactagcttacaaatgtgaattacacattcttacttagtcactaaaaaaagtccatataaggatcccacataagcaactttttgttctcataatcaactgcacaaaaaaatttaaaacttaatatttgaaaataaactggactttaaattgtgactgctggaccacggggcctttctctcaaccacggagcatctcctactctttagtccaaagaagctttcctccctactcccaggctcaggacacctcggaggaacacaggctcacggcttccaccctctccccactctctagcacagggacctacaacttttccca

SEQ ID NO: 34944 - DNA, 1399 bp, Bovine  19866880568612
tacagatagggctcagcctacttggatggagtctgcttagggcttaggactcttagggcttaggaccctgcttaggactctcacagtcctggcctcactcatccaccccttggggctgggcagtgttggcatggtggcgcactgttccatgtgcctccagggaaataaaccactgttttcctactgtgtgaagtcctaatggaattgggaccctggggatttagctagttgagaactccaggctaggcatttgccagggctgcaggccaagacttctctgaaccagcttttggaccctcttgtatgctctcttaggagtgttctcactctcctttcagtttatctgtgccctagggctgcctggcaaagtcttagtcctgctcagatttcacattggctttggtgccagcatctggagtgacctagggatgatcctgggggagctaaatggagctgttggagtagatgagagcagctgtgcctgggagggttggaggcggggggtggctcaggctgttccatgctcttctcaggcttagcttcttccttatggagccactccttccacctgggccttgccctttacctcaggtgcttttcctttggggaacttggcctcctcttttgctgcttccctgcagttcacgctcccaacccctaaggttttgctgtaaagagaagaggctatggtggagtgtgggcaagttcaggctctcaagatcccggccggaccccaggtccatgaagcactgctgagcctgagctctcccttcccgctcagccccctggtcagaaagagaggacagttttgcaggaccaagtcatggcctatgttgtgggctctggcaggatccagagtggccagcacctgctcagtcttgtgctgtcctgcaggcgctgcaccagctctactatgaccccaacattgagaacaagaacctggctcaaaagtggctgatgcaggcccaggcgtcccctcaggcctggcacttcagctggcagctcctgcagccggacaaggtgcctgagatccagtactttggggccagtgccctacacatcaagatctctcgctactggagtgacatccctactgaccagtatgagagcctaaaggcacagctcttcacccagatcacccgctttgccagtggctccaagattgtgctgactcggctgtgcgtggcactggcctcactggctctcagcatgatgcccgacgcttggccatgtgctgtggcagatatggtacggctgttccaggccgaggactcaccggtggatagccagggccgctgcctggccctgctggagctgctgacagtgctgcccgaggagttccagaccagccgcctgccccagtatcgcaaaagcctggtgcggaccaccctggcagtgg

SEQ ID NO: 34945 - DNA, 3502 bp, Bovine  19866880584236
tggatgaactgcagagagggaaggaaggggagtcagagctgaagaaagaggttctggctgcgactgtcccggcggctgcggtggagtcacgcagggagcctgggaggatgctgacctcccacgtcagctggcgtcagcttgcagttccgcacgagcatgaccgtgatgacgtctagtgtggcctcatccaggcgccgacgcagaacccgtacgagctcatccgtgatctcaggacctggacacggccacggtggggaggtggagacactggcagaagatccagccaccccatctcatcccttaaccccagactcaaacaggctgccatacatcagaagctgccagcactaatttctagttctgccaagctactcagcgtttgacaggcgagtcttacctctcaaagcctcggtgcccccctcaatacagtgggaataataatagcatctatctcatcagtaacattcttagcccaaggctagtatacatttattgagccataaataaatgagccagttgcctactggataccttgggttcagtgtatcccaaacccgccccagtatctggccagtgggaccaccatctatccacatattcagtcagtttagacgtctggctgcattttagccagctataggtcctacccttcaacatcccaggagcctgtcctttcccacccagctcctgctcgagagatgcccggagctagtgtaagaagtcccagacaactgtggaaccacatctggccactcccctcacctgcctgccccacgccatgcaccagcagctggatatgtctgtccacttggcccacaggacgagcagcatcggaactgcggctggacgccatgtccaggggagaacgaggaccctgcagggacactgtggtcagggcctggctccagggagcaaagtctgcaggagcacggggcaatcggggagtgggggatacatgccgaggcttcctcggaacagatgggctcctggcttcgggacagagcaagggacgggggcagggcatcactgtcccatggccgctcactgcaggacgtctccaggagcctgggagagagtggcacgggagggctttggaccacagctcctccactgccccaggctgtagcccggcttcccaggacccacataccgcaggtagtacacagcttttgttgctcgctcctgataaacaaacatgttcttccggttcaccacagagaaggcattaagcacagagcgtagggcctggatggctgtagggggaacctgggtttagaaaactctttttcccagattccccacccccacccctgaccccgctacactccacctgccctctcatgccaatcacataccccgagagacgcccatgctgggtcccattttgaggcgtgagtggactcgaatcacggttccccatacgacatcacaggagaaatggccagggacaaactgcatcgtggcggccaggtaccctcggggcccacagctctcatcggcagcataatctgggggacgggagatggtggatcagaaacaggacacagccctctgccctcagacttctcacctgtgaactggcctacctgtcctcaacccacgactcctctggccgatcgctctgtggggggaaagacggtcactttgggtattaagataagctcttaggaagacaggtcatagcacagaggttttcagaactatctcaggaagacatggagaaggagctaagaagaggtatcaggaaaggcaaagcatagtcctggggatgctgccaggacactctgagcctgtcggaatctaatatagaacatatcctactcatgtactcattgggcagtgcaataataatacacaccccactaaaacagaacgtgtgtgactgctcacatacccctacggcaggggcgacactacgccctttgctctggaggacagctagcccagaaaacccgaagggttgggtggctctttgcaagactgtggctgcagcccacagccttgaccgaccccttccaggttgatgaggaaccttccagtaggtcaaggtggcaatctggtttcccacagaagctgctctaagatgtgagcagcgtacaggacacccagggggctgcacagtctggactggaatgctggttactaagggtttcagcgaaaccatatggaaagactaaaatgaggaagggctgggtctgggctccgactagtctcacatcctgggctgctgggagccactgggaaggagtgctttggcggttgcagctcatactcaatttgcagaagatgtcttctaaaccctgggaagtccatcaattacggggattctgctttgatatggaacacatcccaggacgtgctgagagacgcgctctcccgtagctgttagcaacatttgtctacagacttgccaagcatgttaaagacaaggagtgatctgacatgacttttagaactgagggaaaacggcaaaggaatggcacaatctggctttttgctgtgagctggggtgagaggtcatgaggaataagagaagggagcagaagtgtggagattttgattcccatctcaagtagatgatcgtgtgttttctaaccccaaaggtttctgtgcctgcctgtctggagggacagccaatcagagggaaaatcctatgggcactcaggctccacccctccgggcttctcgtctgtgagctggcctacttgtccaccatcccctgccctttccttggccccggccatcacccagcaggggcgagatggtcatttcagaaaacaaggcagggccagtagagcatgcccttaggaagacaggccacagcggcgcctgctccgtgtcccttctctcctgtattcttcaacggtgccccctctgctggctctttcccatggaacagaaacatgttcaagtctctaccttattttaaattcctgccttgcctcccaccttcctttagtttctgccggatctatttgcttctcccttcactgccaggcgacttgaaagaggagtgcctcccggctcctccagcctaatatcctttcatgtttccactttctctggtttcctactcctgtctccactgaaagcactttcactagccactgatgaccccgtggcagccaaacctggtgatccttttcggtcctcttctccactgtattacctggcaccgaggaccaagtaatggtgagtgacttggtcctcccccagcttctcagcagtcttcggtaaaggaaggctcctgagtgggactcaccatcgctgggcagtggtacccgctgacgggagtggaagggggtctcgctacgccacaggtcttcttcgctctcagccaccagaagagagttgcacacatgactgtcgtgcaggtcctgaagaagcagccgctgagagaagaaggaaccagctctcagggaactgaaatactcccgcatacactgctggtggtggaggggggatcaaaggctagagagaatgcccattatcactgggggtc

SEQ ID NO: 34946 - DNA, 1210 bp, Bovine  19866880623526
tgggaaatgtttggacgaggccagggaaccagttgagacattaatgcaataatctggacagaagagctaaggcaggaaagacagtgaccatggggtgaggaagctaagcaggagcacaaaagctgtttgggataagatgggctgattttagatggcctggtcagacagactttgtttaaaccctggctgcatgtccttaagcaggtcattccatgtctctgagcctcagtttcttcattcttaagatagggatgatgagccctgcctgaaggcagttgtcagaattggaggccatgcacgtgaagcatctgggttgagcaggtgcttcatcacctgctactttttttttaattaagagagtgatgaatgatgggggaggggcagagagcagggtgacactaccttgggctttagccttctttgtcctcccccacattgtatggcggagtgccctcccccaaacccctgtctggccatgtcacttcctcacttaacatcttctgggacaccctcatctccttgtttccgagtccctatgccctgaattgtcctccctaggccctggccactttgatcatctgttgcacctggtctctccccagcccaggggggtccccaggcccaacctgagacccagagttatctttaatgcccagagcacagagtctgcctctgtgtctgagggctgggtgggctgtgtgggccacgccttaccctgagtctcctggcagtgccaccagtgcccctgactgccccgaggcttctggccaagcagagccgccagctcgtggtctccccgctggtctccttctctggggacggacccatcgcctccgttcgcctgcactacaggccccaggacagcaccatggcctggtctaccatcgtgggtgagggggcaagagctaggggcaggatggggtgccggacaatgagggggtcagaggaatggaagggagtggggagtgtgcggagaagagaggggctgagggagagcagaggcttctggacggagttgggactgaatgctgcgtgctgtgcaccccacccccagtggaccccagtgagaacgtgacgttaatgaacctgaggccgaagacgggatacagtgtccgtgtgcagctgagccggcccggggaagggggggagggggcctgggggcctcccaccctcatgaccacagactgtcctggtgagaggcccagagtca

SEQ ID NO: 34947 - DNA, 1007 bp, Bovine  19866880642383
acagacctcttcactggccatcatgcagaactgtccaggggggtatatggggccctgagccagaaggcagggtgatgaacaagacagtcatgggctctgccttcagggcacttgcagaggactcagactcaaccagaacccatcctccccaacccctcctccaggtccctacttcagcgacgagcaccaccatgaccagtcacccaagccagctgggcctcctcaaattctcccttttcctcatcccacctgtgcagctggtcaatacgtttgaatgcatcctgcctctaccccaacaaccaccacgttaggaagatctcatcagcacccatgtcttcagtgggcttcctgcctctggtcactcccttccagccccgcctgcacacaaaccaacgctcccttcagtttacagaaatgcatatccgatcaaggccctcagctttgcctgctgcttttagcccacagtagacatgcagataacgtttcatgaatgaacaaatgaatgggagaacaggcggatgaatgtgtggatgcaggttctctgagtaagaactttcagtgccttcatatcgtgctcaggagagtctttagtctgacatccaaggcctaacacacttcaactgcaaccaaaccctccaacttcatcccctgcaactacactctgggcttctagcagatagaagtcgatttcaaagagacgtggaagaatgggccccagatcttgtgaggatcctgctctttcttccacaacgtacagtcaacaggaacagtcttttctagagaaacatggtgaatgggaagcacagacatcctggtggaagtcctgcaatgttatcctgaagcctatttcacacctacagcagctgacaagctgtatatcattccccagccacctccaccacccactccagccagagactcgagagccatccgcgacacctccccccgccaccccccgcctcctgccccacattcaacccttcaccatgtcctgtctactcggcctc

SEQ ID NO: 34948 - DNA, 1404 bp, Bovine  19866880653134
tgtgtatctgtgtgtgtgtgtgtgtgtgtgtgtgtatgttagtcgttcagtcacatctgactctttgcaaccctacggactgtagcccgccaggctcctccatccatggcattctccaggcaagaatactggagtgggttaccatgcccttcaggggatcttcccgacccaggaattgaacccacgtctcttacatctccttcattggcaggtgggttctttaccactagtgcccacctaggaagactatatatgtatatatatcccctcttcttgaaatttccttcccatttaggtttccctgttctttagatctcagcttaaatgttgctgcctggaaaaactccctgaccctcgtacctccctgctgttacgtctggaattttgtcttttgttcatatttttttaagcggtatttttgctgctgctgctgctaagtcgcttcagctcacgccctatgtgccgcaggatacatcaatgagtgaaagaatggaggctctgccctcacagagcttcattctacaggttttcccgcattctctaggcacttcttaaaattcgtatataaaataattgattgtgagattctttttattctgcctcttcccacaacagtaagctctctgagggcaggatcaaatccaccggttaacagttgtggctctaggatataagacactgcctggtatgtgttcgacactcaataagtgtttgatgaatgaattaatgaattcatgctatttgtagaagtcaggactctcagttacaatccatctcaaactaacttcagcaaaaaaaaaaaaaaaaaaggaagtaaaagaaaaaaaaagagaaaaaatgaaaagaagaaaaaggggagctgtggcttaaaggctcaccgcagggggaggccacaggcagcgctagagcagtgtgcacggtggatccagcacctccctgatctcacagggctctctctgcttccctccacgtgttgatcttctcctctccggctctagacggatttcctccatgttgccaggggagataggtgctgacagctccaaagtcacatattctcagcttagcaacacaaaagaaaaaagcctttgtttctcacagcgtctgtacgtttgcagggcccagaaaaccagtgattggtccagcacagatcacatgccttctctggcctgatctctgtgtcctagggaatggggcattctgattggccaggcctgggtggcacacctctccctgagagtctggggggaagtcaggtgggcaggacactgtgaccttcacaccaagatatctcaaagttcaggagatagtcccccaaggaataacaggtgtcactgacaggaagaaagcagcatgccactagaacgaatgcaacaatggctccaaatcacagggacaggttct

SEQ ID NO: 34949 - DNA, 820 bp, Bovine  19866880706689
ttgtaacaaagcgtatcactctgctcttctaatggagttgaaaagctgatgaggattttggctcctagccaagcattatgagaatctatagttgacagcagctcaggagctgtaggcatataaaaataagggataataggtagtatttagcaagtacttgctatgtggcaggcactgtgctgcttgttatatggatcactcatttgatctgtaacatacctgcgaagtattattatccttatggtcagaatgaagaaactccagcacacataggctatattatgcttgctcaagatcccagttagtaagcagcagcgtcatacttagacatttctaatcatgggggtgggcatgttaagagaagggaggcccaccattctgacaaagaagatcggaggataaagaagaggtgaactgcatgagggaaacctcaggtggtacctacgtggaggctgtgaggccagcctggagcccagacttccagaattgctgttgagaattccatctttcctagttcccttcacgtttacttccccttgtccagtactccttcctttccctcctcttggtccttcctcccatgaccccctcccgcctctcccgccccactgcaattctgtgtctgatgtatcctccccaggagcctgattcgggaggatggggggccaggcaccgagtgtcgccacctgcagcagctcctggtgaggcgagttggggagatctgcagggaggtcaaccaggtaaggggcagggctctccaggcatgggatgcagcccagatgaggaaggagtttctaggaacttgactttcggaggctgt

SEQ ID NO: 34950 - DNA, 889 bp, Bovine  19866880708959
tgaggaccctagcaggccccagtaacacccagcactctgctcccaccccgtcccaccttgctcttgtaacacagcctggaagaccgggtgctgtgtttcaggcagaacctctcctccagagctaaagcaacagaaggcagccatgcaacaggagctgcaggcacccctgaggccttcctatgtctcccccagccacaggtaacccagagcagacagacagctgaatgaggcaggctgaggggcaggccatggcccccttgcagctactccctcccattcaggccacagcccttggagtcctccagccagggcactggactcctgccttgcctccatggggctactagagtttgggccaggcttctccagtgcttcctgcccgctccccgtctggagcgctgccccaaacttcgcagcctggctaccacctgccactggggacagaagattcagtgcctccctgggaaaaggccagcttctactctgatgtccagtgtagcaccccaggccccaacatgaagggctgctcaggaaggaggcttcagcttccattggaactcgtcctgtctactactgctttcagctgccagggtccagcccacttcagatctagtctaggatgagccctccccaggattccactgctgtctgtctgtctgtctggcccccaccctaccttcttaccagggcctcagtgtccggtcctgactgtcacagcctctggcctttctcctcccaggcatccccccaaaggcctggcaggaggaggtcttgtcccagccctgattcttgtccccctggaggacccagacaaagcacagcagcagctcagaaacaggaatagaaatttcattaaaacctatggactttaaaatcctagtggtacgca

SEQ ID NO: 34951 - DNA, 804 bp, Bovine  19866880712472
cccagttgcccgaatatctcaagttagtttttcgcgttccccatctggggcccactctggcttctgtgtgggtcctctacttctctcacccgtcgcctctctccttccttgagctcttctctccccttttcctgtctttgctccaccttctcaccaccccgtcttttccttctcctccactctctcctcacctcgcccccttcctctggccgccccgtcttgtctctgcctctcccacctcccgactcagtccgactcctttctggtgcctctcccatctcctcgccccagcgtctccctcctcttctcttcctctccctctgagttcttcctcatcactctgccgtatcgccgtacatcatgatcactccatccacatgctgggtgctgggatgatgaggtcacagagcctcccatggtgactggcgccttgagggcaggagcgctgtccagaggagggcctgcgggcggggcacaggctgaagcagcccagccccgtcccgtccgctggcctccacctgggcgtccggccctgacctgggaggagggccagccactcagcaccgtgtcacgtggccatgcccactcgtgcccacggcatacatacccccctgccctgtcccctcccgccccccggccgctgtgtgccctgccacccctgtcgccgcatgtgccgctgtctccatgccaccagtgccgagtgctccatggtcacacgtgttcacatgcgcacatacatgcatcgggctgtctccgccaccagctcaggccccacgctaactctgctcatgtacccccgctgct

SEQ ID NO: 34952 - DNA, 977 bp, Bovine  19866880721556
attggaggataatgggccatcagccccagggagcagggagaaaggatctctggagggcactgaccttgctccctccttctggcccctccctgactatttccccacccacttctgatacctgcaccccagagccatgctctccctcccaggtcaagccacctttcctcaatacccggtagaaggctctgggagaaccactcacctgccgcctaggcccagcccggaggggcagcacagaaaggcctccacgtccaggctccatctctgtcaacaccaggagctcccatcagctgtagccgacctgttcccccaccctcctcttgaggcagcttggaacatggagagatgagttatcctcagagcaggtcatccctctacttcagcttctccaggtgagggacaaggggcttgggcagctgggctcaacccaagagaagtggctgcatcgagaacctaactatgtggtggtgctttgcacctgtttcctttcagatctcataactccatgaggtaaatagtatgtatcatcgccgttttccagaccagcaaacaaggctgagagaagctcagcagttatctaaagtcacaagggtagacccacaagctgtgcggggaagggaacttcctgctctgtgctgcagggctggagaagggagcagctggacaccctgacctcacagagagcctgctgtccatactgcagaggaggaagttgtggcctggagaagaattagggtgcttgcgggttgccccgagttattggatgatagtgaggtccaggcttcagcctgtgctgcccacccaagtgctgctgcagcttgttcctctgtgatttctgtctggatgcagagccgcctgaccacagaagtctctcctgactacagacatccttcaagagtcagcaggtggtagaggctgaggagccctctaggaacaagggagggggtctgggccatggctctctatggccaccaggg

SEQ ID NO: 34953 - DNA, 4665 bp, Bovine  19866880731541
tcggaaaggtcagatggggaggaggggtatggggatacccatcacctgtccatccacccgttatgggtctgaccttcctgggagcccagtctcaacagaaaaggggcctgaacatggagcccctctgtcctctggggaggccacttgctgatggcatatgtgaggggtaggactaaggtgtgctatgtggctgggcttctggaagcaagactgactgggagggggtgggcaagaggccttgagatctagaggcctaggttcagctaatgtaagagtcaagcatacctggggtcttggggtccagggtactcatagggactgggttctggggcaggggccagggcaggatctaggggacatcagggaacgatcttgctgtccatattcagctcagttcagttcagtcgctcagtcgtgtccgattctttgcaaccccatgaattgcagcatgccaggcctccctgtccatcaccaactcccggagttcactcagtctcatatccatcgagtcagtgatgccatccagccatctcatcctctgtcgtccccttctcctcctgccccccatccctcccagcatcagagtcttttccaatgagtcaactcttcgcatgaggtgtttctcaacctcaggactgttgacattttggaccagataatccttaattttggggggctgacccgttaactgtaggatgtccagcagcatccctcgtttcttcctactatgccagtagcacttaccctcccccatcagacaatcagaactgtctctagacattgcctgatgtcccatcgtggggcgagatcaccctggattgagaagcactggtctgtgccactttttgctgccttctttgtgctgtacaaatctggaaaactgaggagggccactcagggaagattcgcactgatcggccactggagctgagttctggtgggtgagtagtggctgggccaggagaaggccttttttccagtggagagaaaaatgagtgcagaggcctggaggcaccacgttggtgaacattaacccaggggagcctccactccccagaggaaggaggccagagggctggtggcctaggagttatagctgtaggaaggtgcctctgctggccccttggtctcctgcccccagagctaagcctctgctggagctcgtgcctcccccagcgactctgggacagtcttcctaggatccccgtccgctcacacaggaacctgaattgctgagggctgccagggggtcagggtcccagcttcctgggtagggggggctgattctggctgtgccctagaccctgaccaactagctggaggagcaaaggcggcctgctgctggccacctcctttctcagggccgaggtcacggcacggctgagactgatttattccggtcttaatctggtggttggtttggtgagagttggaaacacgttggttttcccttcccaagtgtaacaaggcctgtttccgcctccgcggccgctgctgcagtgccacgcggtgaagtgtccgggacgtgacaaaagggctcggttagctgcccgccggtgagaagatgaacagctcgcagcgctgcctgccctcacattcctcttgcccaggcgctggcctctccccttggccggccgctccctggggccctgcatacccctctttttactaacatccattctggggccccaggccccactgggagccagggtcctggcccagggaggaagtggggaggaagctgtaggaacaggtggtatttggagactaattaatatttgtgaataataacacgtgcccaagggaaacaaatcaatctgtgtttgcatattcatgaggaggcctcggaatgatcccagctgttctccagccagggaaacacccccccacacaccatggctggcgtcacatggtttctctggggcagcccccattgaggctggcaggggtggatggctgcatggaggtggcctggcctctgtttacaggcctgtccgagatgtttgtgtttgaatcctatggcttggtgtggtgcctgttccttttttttcctcacagcagcgatccccaggctcttcaatttcacaaaccagtacaatttccagaaggacttggaggccagacttggggttagccatttttattttgccaaagtaaggacattattaaaaaataactggtatctgctatcccccatcacttcctataagaaaggacattttaacaccaaggacaaaatttcagaataaaggacagttcttcccaagaaagggcagttggcagctttatgctgatgtagtaaagaaaaaggatatatgaaaaccatcctgagtgtagaaaaatggcatccagtgatactgtacaatagcattcagtacggagttgttttcctacccaagtgtgtcagttggtagaaccgacggtccacagtgcaatccagagacgagccgagtgtgcaagtgctcaggctgtgttttcatctcggctgttgagagtccagactcacccagccatgggcagaagtggacactctgctcctaacaccatcgcactgaattcagaaggttctcggccaccccaggcaggagggtgtcagcccgcctccctactgccctcctgccgtctcctcccaggtgaccctgagcaccctggggctgggggcagggccagtgtctagacccggggcctgggactctgatgggacttcagcgtggggccctgaagctgggagcagcctgcaccgcctgacactggggtgggctttgtgcccagagtcggggcagaggcagcttgcttgtacccggagccgatgagggagaagccctggccaggacagctatgtgctggccagagtaattccctgagaacgtgtctgtattttgtgtccccgtgtttccccatcactctgggtgtccccatgtccatggaactgctgggagaagctgtactaggagggaacatcatcttttcaacctctttacctctgtctcctctttctgcatttgagcagtgaccttggcactccagacccagatacacagggcaagccaggagtccccaggtcagggccagttgtctttgtttcagtggcagtgggcttaccagaggcccagtttctctgacacccatggccagaatctcatccaagaggataccacacgatatctgctctggaataacaaccccccacgatggctgtactgggcttctctggtgactcagcagtaaagaatccacctgcaatgctggagactcaggttcaatccctgcatcaggaagatcccctggagaaggaaatggcaacccactccagtattctagcccgggaaatcccacggacagaggaacctggtaggctacagtccatggggtcaaagaagaatcagacatgaccaagtgacgctgtggctgtactggggactgaacaccccctgatattgataactggtgttatttatctgtgataatgtacctcggtgatgtccatcgggcagctgcacacccatgatgtctgtccacactcacatggcgtctggccaggatggctacacctccatgatggctctgcctgggagatgcactgtttgtgattactatgccaaggcagctacaggggattatggctcagtggccattatactggggagttacactccatgatggtcgtgctgtgctgttcctccacagtgtctctcccgtgtagcttcatcacctctacatccatgcagagagctgtgtgtgtctgcactggtggtagagggggcaggctcacacctggactgcttgtacaatacctgggggggaaacctctatgaataccgtattgctgcaccccgtgatgtctgtactagtcccctctgcctttgtcctttggtgcgacatgccactgatatgcataccaaggatgcagggtggttttatcaagggcccatacccccgtgacagcccggcccggcagctcaccacctgatgtctgctgggaagttgagtatcattggtcacggtgcagcatgacagtgccgtggtgaccaggcccagacagacagggccttagtgatgcgtgacctccatcccaacttggccatacaaggcatcacggtggggatgccttctctcctggtctcagctacctgaactctgatcattcagcagaaccccaggtgtggggtaaatggggctggatgcccaccaggctgcctcagtgttcttgcttttgctgctaagcccatctcagacttctggtaagatcttgagacaagagacagctccccccttcccctttgtggtcagcccctgcctcagttcacagtcctcctgctttgtcccagcaccttggctccctttctgccctctgcccttctgaactttgtcccggttgagactggggtccaagttccagggcagagcagagccatctttgagtcctgtctcttcctgttaccagccctgtcacctccttgcagattctctcaccctgtgggtctgccgggtctggtcccctctcccacccgagtctgtaggtaccaccgtggagccccgaggtgtgtccaccagcactctgtgccctgttgtgtccccagggcattaatgagggactttgtacaccagcactctgtgccctgttgtgtccccagggcattaatgagggactttgtacaccagccc

SEQ ID NO: 34954 - DNA, 741 bp, Bovine  19866880775492
atgctgctgctgctgctgctgctaagtcgcgtcagtcgtgtccgactctgtgcgaccccagagacgacagcccaccaggctcccccgtccctgggattctccaggcaagaacactggagtgggttgccatttccttctccatatacatatgcaaataccacaactatactccaataaaaattttaaaaacaaacaaaaactggtccttcttcccaggtagtttgagaagcatggactatagtggtaagagtacaggctttgaaagtgaataggactggttggcataatctctccagacctccctttcttcccctgtacccactgaccccaggattaagggaagcagcacctggacacacacagccaggtgtatgtgctctgggagaggcgaggacagcgggtcctgagtggaggcgcagaggaggcccctaagcagggctgggcgatgacagtttgacccagaggattcgtggggcaggggatgcgtgggctatccccgggaagatggggcttcagaagcaagtcagacaccctggtgggagcagcttttccccttgcagtcccagctccaggctgtgcctgagagcaggaagctttagaagtgcttagtagcccagcgcctggtgagagcagaccggcaggctgcattcttgtggtatttggagaattgatcttgtcaagattagcagctttgcttttcttagttcaggtacaagatcctcacgtgggtagctccgctgc

SEQ ID NO: 34955 - DNA, 1278 bp, Bovine  19866880781783
aaataggatgacaagcatacagcacttcagacagtgtctagaatattgcaagagctcagtgactgtgaactgctgtcatcactgttgtcgtctgtcacacgtttcaccattgcctctgtgtgtgtgtttgctgcctcatccatcatccatgaagccaggactctgagctgtattgtcatattcccaaggactagcatggtacctgggataagctggggcttagcaagtattggagagctggagggctgtcactggggctgggactgtgtccttgggctctgggttatgtggcccctgtagacaatctggccatcatccaagctctgactgggggaggtgctcttgcctcttgtgcttcccgtctcgtggtcctttcctcacctccccacgcttccctctccttaccaggatgccgggccccttcccttcctccttggtctgtgctgggtacagtctgtcagcagagtcgcggagccctgtcaacagcagtccaggcactgccccgttgagggcctccttcagcataggcctccctgcctgtcacacacatcatgcatgtggctccagcctgtctggacacagatgtggccagagtccctaaacagaaggaggggcagcagctggcagcatttccgagcaggaggggttttctaggaaacagtagggacgtcactggaagcctggacatcactttggagcagggggggtcaaagtgcccatgaggagctgcacaaagccgccctcagagctccataggtgagcaaactcagccttaactggcccatgggggcccacactgtggagccggtcaccccaaattcttttccctcttccagccagtggtcatttactgagcacctgctgcgtcctggccgtgtgctggggagggaacaggcatgttagtatgcagtcagtgccaggagggtgcacagagaacagtggggacctggagaggctccttcagccccatgtggctcagggaagacccgacctgtgcagaggcaaagacactggagtcaggctgaagaaggagcagagatccgattgaaggggaagagaattccaggcagagggcgcagcaggtggaaaggcatggaggtgttaaagagcctggcaggttctagaatctttaagttgttggacatggctaaagcttagggagaaggaggaaaggagagggagtatctgaagcagggagcttagcataaggaaatcagatcacagtctggggctttgtaaaccagactaaaaagcttaacttatcctcaagcagcagca

SEQ ID NO: 34956 - DNA, 1508 bp, Bovine  19866880783866
cttccctgtccttcactatctcccagagtttgctcaaactcatgtccattgagttggtgatgccatccaaccatctcatcctctgtcatccctttcttctgccctcagtctttcccagcatcagggtcttttccagtgagtcagctctttgcatcaggtggccaaagtattggagcttcagcttcagcatcaatccttccaatgaatattcagggttgactttctttaggattgacttctttgatctcctcacagtccaagggactctcaaaagtcttgtccagcaccacagttcgaaagaagccaaatgcaaagccagttcacattctttcctattagaaatcacactactacccaatccaggggcagtcatgccttcccttcttggacatgactaagatggctcatcacttaggtcactcatctgtgaccttgatggagcatggagcccaacctttcgaagtctgtgcagtcatgggaaactctggatccgccaggggaactggtctctggaggctctcacagcagctggtccttcctcacataagggatgggactggatcttcttgcccagaagcccacatcgcccatttggcctgggaaattcctgatagtcccaaattccgatgaggtgctcctaaaatcctcaggcagtggggaggaatggaggtgcgttcacaggctctggggttctctgctgttgctgtttgttcccctagttcagcagcctgcagaaggagattgaagagcgaaccaatgacattgagctcctgaagggggagcaggtgaagctgcaaggggtcatcaagtccctggagaaggacatcatgggcctcaagcgggagatccaggagagagacgagacgattcaagataaggtaaaggcacatcctctgtccctcctcaactccagcccagctggacacaggccatgaggacaaagctctaggcagactccctgccttttgacctcaatgggggatgagctgtcagtgaagtgcctactgtgtgggtggcacggggctaagtgctgtcaattcatcccattcaattcccctcaaaacgccagggaccgtgagcaacccagttatatagctcaggaagctggttcccagggtgaagtgtctcacccagggtcgtaacagtttataggtgacagacttgtggtaagaacctgagtgctgactgccaggccccagctcgcctctgtgccaggcatcccagggtgaccatctcatggactgggggcagctcgcccagcgcatcgcccgtgtggtcccccgatcagagaggaactcccctgcggtgagccctgtaaccactggggaccgcagaaagtgaaatcacttttctggatagctttctcacacaacagtaagagacacatcacctgttgtgaggtacaccacctccgtatccgacatcgcatgtcctcctcctgagcaaatccaggctcctcgccctcctctcgtcccctctgcccttgttgccttagctggatgcaactc

SEQ ID NO: 34957 - DNA, 2456 bp, Bovine  19866880809722
cagattttactgaggtgatggaaatattctgcaactggattggttgattgttacgcagttaccatcagccactacaactatgagttagtgcagtcaagaaagcagatgtttttctggaattcctttgttttttctatgatccaattttgagcattaccttgctagtatgtcaaatgagtacaattgtatggtagtttgagcattctttggcattgcctttctttgggattggaatgaaaactgaccttttccagtcctgtggccactgctgagttttccaaatttgctggcatattgagtgcaacactttcacagcatcatcttttagaatctgaaacagcccagctggaattctatcacctccacttgctttgttcatagtaatgcttcctaaggcccacttgactttgcactccaggatgtctggctctaggtgagtgatcacaccatcatggttatctgggtcattaagaccctttttgtatagttcatctctgtattcttgccacctcttcttaatctctcctgcttctgttaggtccttacaatttcttttattgtgcccattttggggtgaaatatttccttagtatctccattttcttggaagagatctctagtcttttgattctattgtttccctctatttctttgcattgatcacttaagaaggctttcttttctcccctttgctagattgtaaacaccacaaaagcagctaaaggtttgtccccctcattactggtaggtggaaagattctgagagactttttgctggatctgataagagtaacaggtgctgctgatactatctctttcctccatatccctatgaataggggcaggttgtctggagcttcagcaatctctttatggctatgaagtgcacacatgaaggtcaaagccaagttgtgaagtatgatggagaaagatgaaaggagactgtgtttttggtgactctgtggaacattgagccaatgccaataaatgcccctcttcccttcaaactttttattacatttgggaaaaataattttgtttaagttactgttgctagggttttgtgtttctggcaacagaacacattcctaaatgataccaccaataagacccaagtgatcctctcaagatttttgtctcatggaagacgatgggcatgtaaacaaatctaggcacttgtaaagcacttgctttgtgaactctgtgtgggtgaagtgatggaccatatcaaggaatccctagttgcaaactggtttctggcctttttttgaggggggcggggaagtgattggatggatggctgcctcactgagataggagtcctaggaggtggagctcatttctggagtgaatagattagttctttattgggcatatgggttttatataccatggcaccccactccagtactcttgcctggaaaatcccatggacggaggagcctggtgggctgcagtccatggggtcacaactgagagacttcactttcacttttcactttcatgcattggagaaggaaatggaaacccactccagtgttcttgcctggagaatcccagggacgggggagcctggtgggctgctgtctctggggtcgcaaagagttggacactactgaagtgacttagcagcagatacccaggtggtggagggggtggtgtccggaaataggaggatatatggatctgaactcaggggagactttattggaatacagaatgggtgtatcaatgtgcactcagtgtgcacatatgagtgaagcctgagagtgaaagtgcatcgagctcttgtttcaggctttatgctaaatgctttgtatcatcaccaccaccatcatcttccaccatcacagctaacatttactgagcacttaataccttccagcttgacttctaagtgctctgcctgcaatatctcatccagttctcacaacttagaaagggaagtgctattccaattttagctataactaaggattagagaaattaagtaacttgctctaggtcataatgctagagctgtaaaacacctatgtgggtttgtagaatgagaaaagaaagaaagaaaagaaagtgaagtcgcttagtcgtgtctgactctttgtgactccatggactgtagcctaccacactcctctgttcatgggattttccaggcaagaggtacggagtgggttgccatttccttctcccagaggatcttcccaacccaggaattaaacctgggtctcccgcattgtaggtagacgctttaccgtcggagccaccaggtaagtcctctggtgtagaatgagagaagaggacaaaggtcagagagccatgaagacttcaacattttttttcttttaaaaataatttgctttttaaaattaattttgtaatttaaatttaaaaattaacgtatcgtatacatggaatgttatgcataacttataagtgtatatagctcaaagcaa

SEQ ID NO: 34958 - DNA, 2454 bp, Bovine  19866880822169
tggtgtactttactgcccattcccctacgtggtgctgacctcctgttcatccgtggcgtgaccctggaaggagccttcacgggcatcatgtactacctgaccccacagtgggacaagatcctggaggccaaggtgggctgtgggtggaaggtaacctggagggatggggaggggcagagagacgccagcctctgagcgcagctcctcctgcaggtctggggggacgccgcctcccagatcttctactcgctgggctgcgcgtggggcggccttgtcaccatggcttcctacaacaagttccacaacaactgttaccggtgagagtctccctgccggcgctggggctgctcccttgctcctgccctctctgcagcctgaccctgcttcccccagacccaccagatccagtgcagcctcctggcctgccaggaccctcccttccgctcacagcctggagatcctggcagtgctgggtctgggtccagtcgttgcagaacagagaacacttaggcagaagagagaaggggtgccgacagtgatgccccaggggtctgtaaggactcagagcctcaagcccacttaaggaggcccagaacagaccagagatgagaatgggagtgcttttgttcctagaactttccccgtctccaagtctccgggcctggcccaaattgggcaggaggaactaagctgcatgtcctgaccacgtgcttccctccccattagagacagtgtcatcatcagcatcactaactgtgccaccagtgtctatgccggcttcgtcatcttctccatcctgggcttcatggccaatcacctgggtgtggatgtgtcccgcgtggcagaccacgggcccgggcctggccttcgtggcatacccagaggccctcacactgctgcccatctccccactctggtccctgctcttcttcttcatgctcatcttgctggggctgggcactcaggtacgaggtgcgggactcgggcctgtggctgggggcgggaggaggcggggccaagggtaggcccctgctctgatggccgaatcctgcagttttgcctcctagagacgttggtcacagccattgtggatgaggtagggaatgagtggatcctgcagaaaaagacttacgtgaccttgggcgtggctgtggctggcttccttctgggcatccctcttaccagccaagtaagaaccaagggaaaggctgggtgggagttgccagggtatggggggaagacaggggagagacggggaccgtagcctcaggcacccctgactcagctgcccactggcccataggcaggcatctactggctgctgctgatggacaactatgcggccagcttctccttggtcatcatctccttgtatcatgtgtgtgtccatcatgtacatttacggtaagtacccaagcttccacggcctcctgtgtcccagcccctggcctgctcacgctgttctgtgggctgctgacctccctctgtccagggcaccagaactactccgaggacgtccaagatgatgctggggttcccaccaccctgctttttccagatctgctggcgcttcatctcaccaaccatcatctttgtaagttccttgctggtcccgcccctgctgccccggtggcgagcatccttctcttgggaaccagccaaggaagagcacgagcccaaccattaggccagagctccccctggggctccacacccacagttcaggtcactggaagtctgagtgaagctgtacagagtcagacaggtgtggagactcagaaccacccaagccctggccttgggttaggaatggagcacagggccctgtatttgatggaagacagtgcacagcttcagaaggggaaaataggctggcagcagctgagagccggccctccctccctggtataaacctggcatccccccagaggagccttggaaatcataactgaccttggcgttggcctctgacagcttcactgagctcgtgtctctagtccctcatagccaaggtgcttggagtgctcagggtatgtggtgtgaatgcatgttccagaagcaggctgtgcaagtcaggtatcagctcaggatccggggacaccctcctaagccaccttggaataggctggcttgggaaggggagttctgggttttcaccagtattcaacacctgcaagacagaccccccagcagggagtagaagtggtggagggaaagcccaccatgaccaggaacaatatactaagtctcgtgatacaactctccatggtttcattattatccccactttacagatgaggaaactgaggccctgggatgttaagtaattgatccaaggttatatagcttctaagggtcagagccctcatgtaaagcaggtggtctgatctggagcgtgtgtgctgggcccatgctgcactagaaacaagtttaggaggaggagtggtctgtgga

SEQ ID NO: 34959 - DNA, 2255 bp, Bovine  19866880835106
ggaccactgcccagccagggctctgtctctctgccctcacctggatgaggctgtgaagagcatcatgggcctctcctctgagctggcagacatctgtcagagagatctccaggcccgggtctggatgcccagggacacgggtgctctgaaactcaggctcgcttaggtcctcggtctctatgctgagcagggtgggcggtagtgaagtgttaggaagcatcgcgtcctagaggagcctgcttcccaagtgggagcagcacacgatggtctgcctccgcctctcagaagggtgctgagcacaggacgctcgcaggagaggccaggagaacccacccacccgtctctgctctaaccgccatattgcttggtggctggacatttctgtgcaacagaatgagtaaggctgattcctggctttcagcaggtggagggagaggtcattcattgtggaagagagacccaggtggagaagcaaggtttggtgggaaaagtgcactcatctggggggcatgaaaggtgggagatgcagacctccagagagggaactgggcaccaccagtgtactcagtcctctgctccttccgttcccccagtgctgacccctgcagacaccagacacacagctgtctgcctgcctgcctctctcactcaacagtttctgtctgagactcagcagtttaggggatcatcactacaatctggatgtcctcggacaagcttctgctttctctgatggccactggcaactccccaccactaacctagctcaacactccacaccaaaacaggaaagctgggagaaccaggagagtaagatggggagactgctgcccatattgaatgggagacagaagcctgggcaggaggtgggaaaccagtgaccaagcatgcctggtcgcttccccagggcaagaggccccgggctataggggcttcgtctgtgtgcccccttatacatcattcaagaaccatcccaacctggactcagaagccaggacagctcgttcccgaggctcggggccctcctccatgctgctgctgaagagccctgggctgagaggaccagggcttgggggtgcatgaggcaaaccccgagtgtggccacacagtgcgagcagaaagggggtgatgtctatttcctgcagcagctcctcacaggcatccactgctatcagcaggtcctgcgaggtcacgctctgtgcttgctgcaagctccggaacagccctgggggaagcagaaggggccacgaggtcaagctctgcgaggacctctcccagtccccatggccgtcatctgcaaagtgggctcctccttgccgcagcgtcacgctcaccgcggacgtagcatcgctgtgcgtgctcctgtagcaaggcacagtggctggctgcccccttgtgcctgggctccatccaggctgaggagagggaaggctggtcgaggaactgagtcctaggaatggaaggaaagagagggcttggccagctcccctcagtgacagcccacactcaaccatccccaccttccagtggattgtccctaggtccctaccaaaggcagtgacggcccagagacttcagctgatgcactgaaggaagtctagcactgggcaggcaggacatggccaagaagctgagctcctgacactgatcatcaacttgtgtgtctctccccttgagccatggctgggggccatggttggctgggggcggggaaaggacccaggtcaacacagagggcactcaccggaagacgagatctcggggtggctgagggggctgcatgccaatcatctgctccctcaatgcttccagagaacagctatagatgtagacaggacaccgggtccggggcccatctgcaccctctgtctgtgaagcctggcgcccagggtaagctggtacgtcctgacggaagggtgggctcagctctcctggattctgggcactgtctgtgggcaagaggtagcgcatggcatccagccctctgttcccgttcccgctgctgcttagctgacttaagagtcagcagacttaccactggctggggtgacactgagggtggggacctgggactttgtcaccgtgaccccagttcctgccagatctttcgggctgggggcctcgttccaatcttcaaacttaggcctcatctcctcttgagggggtccctctaggccatatgaagccagatgtaggacatctgcagaagaaaagtgagacataactcagagccgcctggcgggccagtgagggag

SEQ ID NO: 34960 - DNA, 1020 bp, Bovine  19866880835955
accgctcacagggtctccagaccttgccccagtgtagcttgggggaatcctcctcccccaccattacgaaacactcttcagatggacagcctcactctggctcttgtctccatccatctctaactctcttctgccacgtccatggggcccgaagtcatgtctcctcctcggatttggctccagtgtccacctcacacccctcctctgtcccgcagactaggggccccctctctcagaccctaagtggctgcatttcataggcccgtgcgtgtagagctcccagcctggtgctgggcacgcagaaagtgctgggcaatcagtagccactgctgccgcggggaaaacaccatggggctgcaccacccagtttcgtctgactttgctcagttgcctgcagctccacccacggtctagcaggcccaggcatgccgggtggaccagcctctccatcccactacctcccccagtgactcactctctccttccatccacagcgtctctctcgtctagctcttaggacgcacagctgccagggaccagggaggggccacgctttccaccgagcctggcctgcttgcccccgcccttccccacttctctgcagggacctggccgctgggccgcaactgtctgtaaacggggcgacagctccgtggcttctccccacaggctccagaccagcttcctcacactctggggctgcgcagcatggggcttcctcaaggtggcggggttctagtggcccatgtgcctcggtgggtttgtgggctgggtgggccctgagctcagtgagtctgtttgagccttggggtgcgcgtgaggcatgggggcctgcctgtgccacactcccacccgtccctgtcccgccctttggcacccggcacctgccggcgggacccagccctgtccgcccgtgtcctccatgagtcctgagtcttttgtgagcggcgtggtccgcgcgcacctgtgggcacgtgtgtgtgcgtggggcacaagagtcttgtctcgttttcgtgctgt

SEQ ID NO: 34961 - DNA, 1564 bp, Bovine  19866880837442
tcttggtgcaggctccagaatcctcaggtattcagacccttcctcatgctgcacgcagaggtgatggcacctctccttgggccatagtcacccagagggaggctcacatgtctgtgggggtgtggctccctcagagccagagaagcccaccttctcgctgccgcttgagggttttttataaaggagagagtgatgcagggaatgggactggtgagggcaaggggcagtgtcgtcagtgtctcagccagaggacctgtcctcagcagttccccccacctggggctgtgtggggaagagaggaggaacgttcacggggggacctgctgtacgcaggtgttctgcgcatgctcagcacagcttttcccgagcctcatgtcggctctgtgaggcggggcgacgacatccctgactgcacttgatggaacaggttcggggccgtgaggtccccagtcttgggtggctccagagtgtgaagcaggctctggcggctcctgtcaggttgcgtggggatgtgtttgtgtaagcggatatacacactggctcttaaaaagcgtgtcctcctctttgcagcctggccaagcaccggatcgggacaaagaggcaccgcgtttgtcttgaaatcccgcaggaggtgagtcagagcgagctcttccccaaggaggagctgggctccggacagtacgacatggcggagtgccaggccgccctctctcccgtgaggcccacccacagctccgtgcgccaagtcgaggacagcctcaccttcccaggtgagttggttgtggtattttttcccccacagccctaactgttctgttctatgttggatgccacatcactgcaaggtcacaggcatgacatgagagaggtgggtctgtgagcagatggtgaccagggtgtgggaagcgctctgggtggggacacctagggtcacggagggacgtgggggaaggcccacagctgttgagggagctggccatggtatcctgtgatttgagcagggggcgggaaggggaggagacaggtgtgccacaggagcttctccctgagacgtgggatgagacagcatggggactgcctacctgccatctgagagcttgctcactgggggcccgaggggccattggtatttcaggaagggacggcgtggtccagcaccgtgtttgaaagccttcccacggacggttatcaagggtagatttatctggaaggagcaggtgtcagcctcgggtcaggcccagcttgggggacctctgcgtggacagaattgctccgggtgtgtgctgggagccatcagcactgtgggcacagcttcttccatggagcagacttcctggcctggctcgctgggtctctgctgagctgaggggacttctggggaagggacagctgccgtgtgctgtgtgctgggcttgggaagcagtagcatcctcacatcacagaggaggaaaccagaggcccagagaggctgaggcagctcgccccagatcgtgcaggggacccccgttaacggtggagccagagttggaaaccaggccttcctcagcacccatgttcttgtgtc

SEQ ID NO: 34962 - DNA, 791 bp, Bovine  19866880842936
aattctggaatgggggcggggggtggttctggtgtagactcttaatagatttgttttagatgcaatgacagtattgacagctgagactctggccttgacccttagtttcctcctctataaaatatcatcacctatcccaacgatgggtgaaagcacattgtaaagttaaaagtgccacataaatgcatgtgttaatggtaacaaggtgctgctgctttgagtctggaggaagtcctgcacagccactcacttcagctttttgtgctcaccctcacttggctggcagaattagaaatttcttcacactgagccagaatctgtcttcttgatattacattgacctgctctggaaatctgctctcttgaaaatacataaatcactttgggttttacctcctgaggccatagagggaaaatctgaccctctgccaaaggagaatctatcagatatctgatgatggttctgagtctttgctgctccacaataatcatctccaggttccttaagtgcatctctaacagcatggtttgagtttcctattttatatcttagatcacaagcccatgaacgaactctggctggtctacttttcaacttaaaatgtggacgccaaaatggagtataagacccaggtgaaggcacagattcagagtatcccacattctatttactttggggaaagctttaccatgctgttgacccaagaaatctctatgactttcttgcttctgctgcttagacacatcccctattctgtcctaatgcagctggctttttttggacacacaca

SEQ ID NO: 34963 - DNA, 660 bp, Bovine  19866880871409
tgagtgcctcacctcttctctgcatgcagtctcagggcaagggcatctgatcaagtccttccacctctcagtctcccgacagccttcccagctccccaccccactgcccccccagtgcaaagattgcttatatgttgttggagtggtcagatcgggtctgtgacttgggtctgtgctcgtactgtccaccctgggctgtccccctggttgcagatatgtggaggggactagtccctgctggtcactgggtgttggtaccaatgaatctggtttctgactttttgagactttggtccataccatatggctgatttgtgggggccatggcgctagaattcaggggtctctgtaagatttgcttgtcgctttgggaaagggtatttggagaggagctgcaggtctgctttctgactctgggtttaattttctcaccttggtgtccctgttaggttgctacggggtaccccctgcaaaggcttctgaagactggatgtgttctcggtgttcagccaatgccctggaagaggtgagcgcatccatgctgtcgctgtctccccgtgagacgctcttgctcagggccactgtgtttcatgtggaccctgccccagcggtctgagcaagacctggtacacagtgatgtgagagtgttgtcagaataaa

SEQ ID NO: 34964 - DNA, 2250 bp, Bovine  19866880884834
tgccccatgtacgccaaattctgggccggtgaggacccgggatatagtcagccctgagcaaggtgagcatatattgtgcacttggcactgtgctaggtgagtgcccaatgtgtgccacgtcatactggttgagcacttgtcacatgccgagactcatgctaggagaatgcctggtaagtgacaagccttctaccaagggagggcccggtatatgccaaaccctgtgcttgctgagctcccaggatgtgtcaagtccacactggttgagcacttgccacatgccaggacccgggctgggtgagcatccactgtgtaccaggctctgagatggctgctgcagacaagaagtatctaaacactcttgtcaaagcacaacagaacaggtcagggtggggcagccccaggcggcctgtggagctttcaaagccctctaggatgatttagatgctctggcacctggagccctagcctgggtgactctgctcttattcatcatgaggcttcccagtagcagagccacccaatgcagcagagatgtggggagagaccagtgaggctcaccaaggcctatctgcccaatgctgtatgagtggggagcaggcacaggggaagggactgagtgggactttgtgtgagaccgtgggattaaagctgagccactggggctctcctgtcttgggctcctcactaccagcttcctgtcctctgagccccaggcaacccggccctacatgtgtataaatagaggcactaggtctccatgaaagggaaccacccccacccccacccctggtgccgccaagcatcccagctgctcccaggcttggaagcaccccggccagctgggttgctgcatggccctgtcctaggagctgctgaggcatgagggaggcagctgagctggcctggcagagaccatctgggctgggagtcggggggaggaacatgtgtggcaggcagtgggcctaggcacaggctgggaagtggcttgccctccacggggcacctgctgcatgggaagaccaacagaggctccaaggatgacacatggtagacactgagaagccccaggggcccatgtcttcacacccaagcctggggcatagggggatggaagtgaggacctcgtggccagggccagctgcctgctcccgataccaggacacacatggtgacagaagtcacacacctggagggtccaagtgcccctggtttatacgcatggccctcagctccctctattctgccccaccgtggcctctaagagaaggagcatccttcatgatctgcccttaggggaccacgggcagctagtgaagtccagatacagctgcccaggttagcaaagaggaatggtgctcctcagagacaagggctacatggagtcagcactggttccaactgagtcctgagaatagtgtagcccagggtcataagcagaactgagaaagaacagactctcaagcaaccactgggggtacccaggggacctgctatggagcctcagatgcagcagcagtgggcacatgtcaaaggctaaagggcacgaaggaaactatgctctggctatctttaggcacatcctggtctgggaacaggcgtcccaaggcggcattcccttctacagatgcgctagccggcagagcctggggtctgggaagctcagccccggcaggggttctgggaccttgggattcaggctctctgtgctgcccacgtgggtcccacatcacccctgcttgcccgtcccagtcctttcagggtcactccagagaaagcagaccacccagtgagtcttcagagggtttcttaagtttcacggggctcagaatctccatggagggaggggcagagctgcactccactttctgctacaggcccatggcaattccaacacttctggcaagaaggaagccagtcttgatcctatcatggcatctactccccgctagcaagtatgtgggtctggagacctccatgtctgcccacatctgagcactcaagagctcaggctggctcaggaatactttgagaagcctaattcatttagacttgttccaatcaggagttggccagaccagagcggaactgagagctggatgctggaagttcaggaccaggcaggagacagggtcctcagcttggagcacaactgtttggctccctccccaacagcatgtctggaccgaggacaaaagagtcccagaaatccctggtgggacagggcttgtttggggagggctctgcaag

SEQ ID NO: 34965 - DNA, 1196 bp, Bovine  19866880885427
tggttgtaggcgtgagcagggatgagggtggcatggcctctgttgcttgtgtgtgtctgatgccgtgtgtgtttcgtatgagacggtggatgtgtgaggcactgcgttagaggcctgtgtgtgtgtgtgcgtgcgtgtgtggagagcctgtggtccggcgggagagccgggctgtctggtggccagtggcggcagcttgcctggaggggccccgggaataaccacgccaccccccccggggagtagcccgcctgggtgagtctctgtcctccgtgaccggttactgtgcctgtggccccccaccctccatctgcctgcttcccccccatttgtctcccccagccccctccgcacccccccagaaggtgacgtgtgtgagcgtgggctccaccaccgtccgggtaagttgggtcccgccgccggccgacagccgcaacggcgtcatcacccagtactcggtggcctacgaggcggtggacggcgaggaccgtgggcggcacgtggtggacggcatcggccgcgagcactccagctgggacctggtgggcctggagaagtggacggagtaccgggtgtgggtgcgggcgcacacggacgtgggccccggccccgagagcagcccggtgctggtccgcaccgacgaggacggtaggcagcgctggggataggcaaggggaggggcgggggacaggagagctgcctgctacgggtgaggatgcacgggacagcccagcaggatgctgcaggcaggagaggctgtgcctcggtctaggcaagaggtgtcccaaccggacacccagggctcagcctcccgagtgcctctgggggactccccatcttcccagtacaggcttaatggccccgcctggggagatggagctcgtgggacagcctgtgcctgaatcccagccccggagctccccaagcaggggagcctcaaaaggctgaggccaaagagggcaagaatcagagagactggttctggagacactagtgaggctcacctcactagatgtcagggtgacgcagggcccagaggagacagcacagattgtgctgacttgggcaggtcgaaggcctggtgccccacctcccaccttggtcctcctccccaccgagtgaggcagtcctgggcccaagggctgcagagtcccaggctcttccccatgcaggtggagggagccctccacgttcct

SEQ ID NO: 34966 - DNA, 1123 bp, Bovine  19866880901315
ttgcccagattgcgctacagctgggccgaatgctggaagccaggaaggtgaggagagcaccggggtgtggggagagctgggctcactgagctcacaggattgcccctcacagtgcccataggagccagaaggcagcagtctccatggccctgtccccaccaacagctgccccacagctaaactgggccctggggcgtaacgccctttctagctctcaccgagttggacactgggcctttctaaagccttccaagaccactgattagcttcagcagcaagtccctgtcccagatcccatgtccaggactccctgctttcctctgctggggtcatcagtcctttcttatcttatcttatggacacctcttctcacctggcacagagccagggtggaatgcacgaatggtcagctcaccaaatggatggatggatgagtaacacagtaactgaatgaatgaatgtatagaattagtggatgaatgatataataatcatacaaataaactaattaagggaattcctgaattccttgctggtccagtggttaggactccatgattccactacaggaggcacgggtttgatccctcgtctgggaactaagatcctgtaagccacatgacaaaaaaacgtgtaattaaataactaaatctaatataataatatcataagtaaatgataataataatataagtaaatgaattatcaaataaatctaagtgaagaagtacatgaaaatgagtaatgtgaaaagagttcttaaatatcaattaatgactaaatagttttgggaattattaaactatcttaagaatgaaggaataatcaaataaccatgaaagcaaaagttgctcagtcatgtcctactttttgcaatcccaaggactacattccatggaattctccaggctagaatcctggagtgagtagccatttccttcaccaggggatcttcccaacccagggatcgaaccaggtctcccacattgcaggtggattctttaccagctgagccaccagggaagcccaagaatactggagtgggtggcttatcccttctccaggggatcttcctgacccaggaattgaagtggggtctcctgcattgcacgcagattcttta

SEQ ID NO: 34967 - DNA, 886 bp, Bovine  19866880931291
cctccctccctcccacagcctgtagcccctgaaagcctgcttggcccacccagatcctcctgatccctgatgcttggtcccctgaggccccacctcaggtcaagctgtccctttctcttgcccaggatgagggcccccgggacacagtcgacagaaaagtcagtgacttggagttttcagaggctgagctcatgggagaggaaggtacataggccagtgggtacggggtaaaggctgcttccagccagcatccagggcctccgccgccagcctctcctgttgaccacgtgacatgtgtctccaggagatgcatctgcctgctgcgtggtcaccgagagtgacccagagctggaagtggagtaccgcgagagccgtgaaccagacctggggcctgctgggctggactgtgcctcgctgtcagatgcagacaccgtgaacccggacgaagactccttcagtatcctggggggcgactcccccacggggcctgagagcctggcgcatgacctaccgccgctcttcctgcacctcacgtgctccgtgcggctgcgtggccagcacagctcagtacctgtgtgcagcctgcccacctgcctgggtgagtctagaggtccccaggggagggccataggacctggtccagcctgcctgcctgtctgggggtgggagagagcctctgggtataactctttagccctagacacttggaatctgtgcttgtcccagggctccagtgacccctaacctcccccctctcccaggccaggtgctttctagcctagagggcccccctattggaggccgagttgctctgcgggacctcagtgtcactctggacgtactttgtgctgaccttgccccggaagtggagcttcccccgacctca

SEQ ID NO: 34968 - DNA, 1115 bp, Bovine  19866880943726
gatgctggtgagtacagggactagactgcagggagagggtgggggtcatgagcaccgtccatcccttctggggcctgctgtcagctgctggccttgacaggagggcctaggaggctccatggggccccaagtctggcactgccaggactcctgagtggtagggctgtctcaggcccaggcaggcagcccctcacccagcaggttagatattgccgctgtttggagcccacagcaggcagattctgctacagagcccaaaagtcatgctgggaggcaggaagcacactccccaccctcatcacaagataccctggaaagcaggctgctgttgatcctgccgggagggctgtcctatggctgacaccccagcacccccatcctgtgctctgcctgctgtggagagcattcagtaggtactgatcgaggagtcctcagagatggatgtttctagtcttccactagagaaatagcatagagcatttcatgttgaatcctcttgtgaggtctttcaggaaacatccctctcccctttccccaagtcacggctcttcactgcctgctgcctcagagcacagaagaggtggtacgaagcagcgggcaagagcagggccagctcatggacggatggctcatggatgggcggagcaggccagctctggaatcagaagccaggaaaataccccaagggcagtcgttgtattccttctctggggatattgcctcaagaaccagtgagactgggcagctgccctgaaggaagccagtggctaaacatggcccttcccttggcccctcccttccccacatggattctcctgttgctgttctcattcactgaaagactgattgacctagggtctcttgctgagccctccccaaacaagccctgtctctcaccagggatttctgggactcttaagtcccgggtccagagaaatgctgttggggagggagtcaaacagttgtgctccaggctcaggaccctctctcctgcctggtcctgcacttccagcatccagcccctcaggcccgctctggtctggcccactcctgattggaacaagtctgaatgaactaggcttctcaaagtattcctgagccagcctgaactcttg

SEQ ID NO: 34969 - DNA, 802 bp, Bovine  19866880964363
ctttgcggccccatggcactgtagcccaccaggctctcttctgtccatgggattctccaggcaagaatactggcatgggttgccattcccttctcgtctcctgtgaggttggtccccaattcctctgaagttggagacagtcactgggggaggggaaaggggtgcagagagtgccccactccagacccagcacttctacagaacagctagctatggtcctttagccgacatacacatatatttctggggaggtttctcaaagatgtctctgatcaaccccccagaggtaggaacccctggtttattccatatcctcctctcaaccacatctcttctgagctctgttcttggctcactgaattcccacccccactaccccagctccagagacctgctgtttggtgacaccatggggccaggttccatttttctccaaagaagaccttggccacagggttttcttggtgcctttggaggtctccacagtcaaaactccacttggggtctcaagggtctggaaatgccaagtgaccaaaatgggcagcttctgcaactgacatgacttgagtctcctttggggtagttttaagaagtggggaaggaagcccccatgtcctgcgttcccactgtgccaggcctggtggcagtcctttgccttctgcagcctcatgttattggccccatcgtgtaagtccgaaaccatgggctcagagagaagggaatggaccaacaccgcccaatgacagagctgtgaagttggacctgacccagatctgcttcctctgacagcatgctgccctct

SEQ ID NO: 34970 - DNA, 894 bp, Bovine  19866881021833
gtctggtacaaagtaggatcttagtaacctaagatcggcatgaattctgatgtaaaggacatcttccctgtgagtttggtaagtgtgctgactccaatgggaacatggcaggatgacactattttaaaatttgttgttattattattttaaaaatatttattgggctgcgttgggtctaagttgcagcgcacaggctctctagttgtggcatgcggggtcagcagttgtggtgtgacagtttagttgctccgtggcatgtgggatcttagttctctgaccagtggcatcgaacccacgtcccctgcactgcaaagtggattcctagcccctggactaccagggaagtcccaacatcattattttttaaaaggcaaagtctttagtcagacaggcctgggttcaaaccccagctccggtggacctccctctatgtatctccttaggcaagttactttacttgtctggtcttagtttctttatctctaaaatggggatcatatctacccatctttgaagctagtgagcattattaataatagcaatagatgatatatattaagtgcttactgtgagctagacgctgtcctaaacacttcatatgaatatatattaactcatttaatcctcccaacagccccttgaggtgggtatgctactatgcccattttgggagagaagatgggggagtaaccttggctcaagcaagtctcccaagagaacggcctcagaccctagcgactgagctgcttccaggccagcctcatgcagcccgggtccccagacacgctctgctgacttctgctgacttcctgcgagtccagactgagggccaagcccctggctaggccactggttccaggaaggcccagtcatccatgatgcccaaatgctca

SEQ ID NO: 34971 - DNA, 1615 bp, Bovine  19866881044104
ctgtgccgctgcttattattcagccgctagtcacttaaaggtgcgtaggaaacccacagaaactgagacacctcaagccctcccttctctgcatctgaggagatccaggacgcaggctgatcaggagtctggaagctgcaagtatccaagagcatcttaaagcccaaggacacctgacaatgcagaggcctgctgaccgctgtcctgtgtctcgggcagattcctgtggatccacagagcaatgacccaagtcagtcggacaaacaggacgtgctctgcatgtgcttcagcccctccgaggagacgctgatcgccagcaccagcaagaaccagctctacagcatcaccatgtccctgacggagatcagcaaggtgagtctcgccagcagcgcttcctgccagcctggggacgggtcaccactgggcaaattttaatccaattcctgagaataggcccatgcaccccttcataataaagcaaaagaaactctgatttcaaggtgtccttgtaggagcactccaacacctgcagggggccggggtgggggacaccagaatctgattgttgtagcttctttggatggcatcaccgactcaatggacatgagtttgagcaaactccagaagttggtgatggacagggaagcctggcgtgctacagtccatggggtcgcagaatcagacacgactgaatgactgaactgagcctctttgaagaacaccttgaaggtctctctcagatttaaattgtacctatcttttcctcagcaagcaagtgtacttcaggtatttaatgtactgcagtacctgctcctgtgcacaaagatgtttatgtgtaaagatttatcattgcttttgtttttaaataataaagccagtatgaatacactgtagatattgcagcaaaaaggataaaaaaaaagcactttgtacttagaaaaggttcattttatcaagcagacattacagttttaaatttgtatgcagataatagcatggactcaaaatatagcctgcaaactttggcagaacaacaaggaaaataaaccacctacaatcacaggaggttttaatatatctttctcagcaatgatggtttttaaaataataacactattgagttattcatacactatacaattcacctacttaaggtgtacaattcaatggtttttagtatattcatagagttatgcagccattaccaccatcaattttagagcatttcttcactcaaaaaaaaaaaacctgctattatgctcccatcatcccatctgcctccccccagctctgctgctgctgctgctaagtcgcttcagttgtgtccgagtctgtgtgaccccatagacggcagcccaccaggctccccgatccctgggattctccaggcaagaacactggagtgggttgccatttcctcctccaatgcatgaaagtgaaaagtgaaagtgaagtctctcagttgtgtccgacttttagcaaccccaaagactgcagcctaccaggttcctccatccatgggattctccaggcaagagtactggagtggggtgccattgccttctccaccccccagctctagccagtcactaatgtactgtgtctctatagattt

SEQ ID NO: 34972 - DNA, 1359 bp, Bovine  19866881067755
cagggcagcttagaagaggtatcacaatgcagaagaagaagttacagttgagtactaactaggactttcccctgagatcagagaggtaagtatctcaagaagccaatgctaacatcactccccctgccctcctttagacaggttttctctcaattgcagccttcatcaattcacccttgcaacacagaaaagcccctccttccccaccaggatggcggtctcactccctggacctcttctcttcccccattcagttccccaagataacttgtgagtcatatctgcagatttgatcaataatgcctgaatggacacctcctccccaaaattattcttgtgggaaatgtgttggcattctacttcccatttttcaaggtgggtttctttacttcaaggattttcttttcaatagtccatatccatactggtttccttaaatactgaagttgttaaacaaatacattcatacccttaaagactacttcttaggcctagtacattttaaagccaaactgagaaaggaaataattccttaactgcctcaaattagcatcgtgtcttcccttttccctgggaatcagtaaatccgattattgtggcaagggtaggatgtctgttcctttcttgatcccctttgggatttgtttgaataagaatatggtcctagtccctttaatgacttctcaatgattttcacaagagaggatttgatggcttgattttaggacgctggcaattacattcttgccaagagctaatatcaatttggggaaagagaaggggattggcctattctcccagttaacaaaaatggaaaaggatggaaaaaaacaaaacaaaacaaggacagtattcaagactatgtaggatagacctactaatcagtgaaacagactttagagcccagaaataaacctgtacacttatggtcaattgatttttgacaaaggtgccaaggcaattcaatggggaaagattgtcttttcaaccaacagttctgggaccactggatattcacatgcaaaaatattaatttagactcttatctcatgctgtactcaaaaagtaactcaaaacgggtcatatacccaaatctaagagctaaaactataaaacttttagaggaaaacataggagcaaatcttcaggactttgggttagaaagagtttttagatatgatactaaaagcacaagcaatgtaagaaaaaataataaattgggtttcacaaaaattaaaaacttttcaattcgaagaacaccattaagaaagtgaaaacaagttataagctaggagaaactatttacaaatcttacgcttaataaaaggatttgtatctagaatgtgtaaagaactttta

SEQ ID NO: 34973 - DNA, 3458 bp, Bovine  19866881077545
gcgacagcgactacgctatggcatctacgtcatcaaccaggtgcgcagccgcagcctccaggctggtcaccggccaccagggaacccccgagcacctgtggggaggggcccacgtgcctgttggtgcgtctgtgcggttgggggcattcctggatgcctggatagctgtgtggacatgcgatgtacgtgtgggtgtccgtgcatgtcacttcgtgcacatgtgggtttgcatgtgccttcaggggattgcatacgtgttagtggtggtggacacacggccaggtgtgcgtagcctctgttgtgggtgagtgccattgtttacctttggtaggccccaccccatggtggtggtagcttagggtacactggctatgagatattgagggtcctgagcagagagagagttagacctgaaagagagatcaagactgccttagggccaagtgctgagcacagctgagatccaggaattcagctcaggctccaagcccactgccatgggcctggctggggctggcttctggggcctggagaaggtctgatacaggccctcctccccacagagaatccccagacttgaacttggatccctttgactccaggacagtggtgtgtcactggagtaggagcagggagctgtgaagcgaccaagcggcccagtttagccccagggtgggaaagtaaccattgagatgggtcttgagggataaataggcatcagccagtgcagggactggggaaggcaagcattctaggcaagggacagaggagaccccaggccccagtgagagaactgatctcctgtgtttgggaactggcagctgaggtgagagatgccacatgcagggtgggtagcagaggtgaggttgggaggactagtggaggccacagccacaagggtcccaggaggcatctcaagcagctggattccagcgtgaaagtgatggggcaccgttttgtctttttttggctatgctgggtcttcactgggggcaacgcaggctctctagttatggtgtgggctctagagtgtgtgggctcggtagctgcaatgcacaggcttagttgggatccccatggcatgtgggatcttagttccccaaccagggatcaaacccatgtcccttacactggaaggcagattcttaacccctggaccaccaggggagttcccatagtgaggttttagggagagggtaatgtgtgtgtgtgcttcttagaaagattgctctgactacatgtggacaatggggtggaaggggagtgggaggtagggcgcctggttgggaagaggctactgtgttcagggtggaggtggtgaatgtgcctgtgagttgggcaggagtcgtgcagatgagaggagagatgtgatacaagtagctgagaggaaagggaggtgccaggacaccttgaggctctctgtcttgactgctggccccatgtatggttgcgcctgtgagatgggaacacaggatctgggccgggtctgggggagaatgtgtcttttttgcatgtgatgagtttgagtgcctgggggaagtataagaggaacggtcagcaggcatttggacaaatgaactgacctaggagtgaagtctgaggtggagagggatctgggagccaccagtatatagatggtccctaaaaccagccatgttcagcctgcctggggtggggcctgggacctgagaggagaaagccagcatgtaaggaatgggtggagaaagaccacagaggctgcaagggttggccagaaaggttcgaggagacccaagagaacttggtgtcccagcacccaggaataagcgtcaagaaggcagcgtggcagctgcgtgagcgctgctgggggagtaaggaaggatgtagaccgagaagcgtccagtggatttagcaacaaggtgggcccagcgagagccatttcaggggcatggtgggggcggaagcagattgcagtgggttgcagaaggaatcagatctgacaaaatgcaagtagccaattggagacaactctttattaaaaaaaaaaaaattctgctgagaagggaacgcaaaaggtagggtggggtctaaaggaagggctttctttgggtgagagagaaatgggcaggtttatgagccctgtgggagaaacctagggctccggggtggtgagagaggttaggaaggagtgcagatggagaaaacggactattgctccaagggctggtgggaaagaaggttcagggcaaggaggaaagagagcaggtggggccgggccgttcagggtccaggggagcagctcttgctctcttgggcccaggttggctggtagggaggaggggctactactcctctccttccaagagagcctacttgaagaccaggagcctctctggctccagcctggagatcatgggttggcacagggacttcaggggccagccagctccttccatgaaaccctccttcctctggccagaattcagagtttggggctgcatggccaggaggccaacctcaaggagacctgatcccacagccccatttcttgggggactccaggctcactatgcctctcattttattggggagacaagtgaattgagcctggtcccagaggctgcccagggagttggacgtggatctacaagagccagaggggacaggtggctcatcttagatgctggccatttggggacgttctttgttcatttcactccatgacatgctcagtagggaagcagtgtgctcagggccactcatctttaagatcctcactggcacagagaagatgcctggcaccaaggacagggccaaggggcacgattgaaggaatgaatgaaatgacagccctaaattgcaaccgtttgaatggacctggcataagtgaagcacaggggagggaatgagtaattatactggggcggggaggtttgctaacagaggcctttccagacatgaatttgaaaagtggagaaggagagcattccagacaggggcaactgctaacactgaggcctggaggcaggaaagtctggcatgttctggggttgtggagaaatatagtatagctgggcttgaggggtctgaggtcattggccagagaggagatggaaccaaattctaaaaggctttgcaaagctaggtctaagataaagagctggatttgatcccgagagtctggaggccccggtggaggatgagttgacgggtagtgctaggtctgcagggactactctggacagtggtcaagtggcagatgtttccaagtctcaggcccagagccgacctgtctcctccaccaaccccagcacggtgaggacaccttcaaccgggccaagctgctcaacgtgggtttcctagaggcactcaaggaggactccacctacaactgcttcatcttcagtgacgtggacctggtccccatggatgaccgcaacctgtaccgctgtggtaccagccccgccactttgccattg

SEQ ID NO: 34974 - DNA, 539 bp, Bovine  19866881119745
agtttccgcagaaattctttctctcgctgaatgttgtgtgtccaggactgaaagggaagacggagtggcagtcagttggacagcccaagtggctgcagggatggagccctgctagaatgctgcaggctcccagggttctgtgccctcttctgagaccaccaccctccgccactccagaagcgctgtggctcaccctcctcctttctcaggacctggagaaaataaccttctaactcgtttccctcattcaggaagactgtgcctcttaatttcttccaagccttagagatggaggctttccaaccacgttcccattccttcaacccctccttgcccggcggcttctccgggcccttaggccctcggcaccccaaggtcaagccatgtgagtcattaggtctggcccaagcctggggggtgggccctgctggaaagtgaaccacgtggggtggcttagtcattctctgacctgacgcaatccactttccaggcctaggggcagctgatgaaatcctgcctcttagattagaggagccgga

SEQ ID NO: 34975 - DNA, 1110 bp, Bovine  19866881126984
ggggtgaggggaggattagacctgggaggcccaagggagtgtatcaggcgtgtggagccacccatcaagcgtgtcatggtgagcacacacagtcctgggaccacaaaggcaaggggtgctgggaactcagggccctccgtcacttcccccacaatctcgctagctagccacacacccctccacaacagtcacacacacacacacacacacacacacacacacacacacacacagagctgcactttgccatggctagtttcacacaacacaaatgaccagtctaacaaaaatgaccagtctaactatggttacactcacacaatacaatcatatagccacgcaaaacgtctccatggtcaaacacccaacctcactgtgctcaaaaccaagtcacacgattttgatttcacagctgaagaatttcagtgagcgcacacccaagcatcgctgcattccaattatcagtacagcacataaaactttgactaggtcaccacatgaccgtgtgtgtatatggttcgcagggtgagagcataggttttggagactggccaacctgtgttcaggctcaggttctaccacttattagttctttccccttgggcaaattacttaccctgcctaagcctcagttctagatggggatagttcctacttggaaacatgatgtgaggaaggcataaagacagcactttgtctggacagatgtgccctaaggataggctgtaactgccatggatggattttgtcaccagagggcaccagggctccaagaagtcagtgcagggcactggaagaaactctgccaggaagcccaggattcctggggagtctggagtcaagtgcagactgggatggggtggggatggggctgcacagattctggaaaaccccgcaaggctcagaccagccgggagctgctcctgggccaggtagggccctgggaggatcctggccttccctaggaaggaggatgagcacttactatgtaccaggccctcttccgtgcctacttcaccctgtttaatccccacaacagcactgggattggtggccagtactgatagtcttctgttgaggaataccaaggaaagggaggttccggtttac

SEQ ID NO: 34976 - DNA, 3099 bp, Bovine  19866881129382
gtgtggaagcgaaaaaaatgggaagatgaaagggacagataattggacctccttcctgaaggagcaaacaggccccaactcaactctctgatggtcataaacaagccccttgtctggtgggctctgcacccctaactctctctgtagaattcacaggacttggtaagacctgcatgcaggagtggaggcaaaatgaaaatttgagggtaacattcaggttccaagcttacacacccaggttgcctatggggagatgcaaacctagaaagggaagataggagggaggtaggaatagctctgtttgggacccggtgagctggaagcacccatgggacaacaactcaagatgtctagtaagtaactgaaaacttgaagttcaagagtgttaagatttggaaagttactggtagattttataaatggaactgaagccatgaggctactcagaaactagtaacaaaaagggggaagcaaggagatctttagaacaataacatttaagagaaggagcaaagaaagaaagaaactggaagggaacattacaggagtgggaagaaacctggtgaatgtgacatattgcagaacccaaggaaggaaaggagtgccaagcattgcagaaaggttgagcatgatgagaattcaaatgagagatacaatgaggttactgtgaccaatacagagagaaggagacagtggtaggagataggatctaagtaggctgaggtcagatcagacaggatcttgtctttaggaggtatgctaagtgcagtaggaagcaataggggttttaagcaagggagtgaagaaatgtgatatgcatttggaacatctcacttcattctatggaagatttgctggagggattaatagtggaggcagtcaggaaacttatcagtgactcaaactgggactaaaatggtaggggtacaggtggtaaaaagcattcaggttcagggtacattttgaaagactttctggcaagagttgctaatgacttgaatgtagagtaaaaggaagataggaatcgaggagtactgagatttggtgcttaatcaactgagtagatggtgacaccacttacagagtaggtaagactagaggaaacaaaaaaaggtgtagggaggaagccagactcaagagttttattttggccatcataagtataagatgtccattagacgtggaagtagagattcgaagtaggcagttggtgatccaaatctggagcccaggagggggagtcacagctagagacattaattttgaaatcatcaacacatccgcagcatcaaagccatgggactccatgaacattacagttatttcccctctcacttgacccgacaaatttggtgccccttgcttgggggctgggagaggcatccaacgtcatctccattgggcagaggaagctggtcccatggaacctgagagatggatgggaatcagggcaaatctggcctcagggacttcttcagagaagtgatgccagagaagctaagacctcacaggtgaggctgaaggtttcacatcctacaatcctcctacccctccctacagcactctgttaataacattaattcaggaggaagaaagaaggatactcagtctgtaaagccaatgaggggagccccaggtgaggtcggcggggctaaatgtgggaagttaccatggcctgcactggccccacgcgctgccagagtcaaagctcctgagagtcggcgcaaaagccaccacagttacaatagtcgcaggaggggacttgggcttcagagaagggattccaccaactcttccaccacaaatgtgaagatgagctagagttggagagctgagaccaacccatcccttgattctgagccaaccagataaacgcactgaagcccagagcttctcaaactttaatatgtactcacatcatctggggatttggggacagtgcagattctgctttagaaggtctggggcggggcccaagagtctgcattttaataaacttccagggtagtgcatttgctgatggtccatggaccacactctgagtagcaacaggatgaaaggtagctgtggaggctccccacggtggagggggctgtccagttccaaggagaacatgtttatttgtgcacaaagtgacagaacctattaaagtggaaacagccaccatcttgtcaccactgcaaggcagacagtcatttcttggtggatttcaccttccagaggcactggcatggttgttaaacacttaggttctaagcttgatgtcctgagttttgcctcttaggaggtgcgtcaccttaggcaaatgtgcaattcatctgcgtctccagcttccccatcactgtaatggaaataataagactattatgaggataggctgaatcaggggataaaaagtgcctaacacgtgtcagcagtgaacaacactcagtaagtgtcgctctccgtgctcacaatacgccttcgccagcagtgaacgcggaccaacacagaggcttactctgcttctggtacgtggtcaaaaaaaaaccaacgcaatcccccatctctctcttgatgaaaggcctgtatcctccctttcaaattcccccttccctcctgcccactcccacgccccctcccctggcccccagccccagtgtggtctggatgggccccacaagggcagggacagggacaggacgtggggctgtatctgacaggaacctgaggggctggcctgggaggggactggggcccagcttcctgaagggaggatgggctgaggcaggcacacagtgccggagaagatgccctcctgggccctcttggcggtcatctcctacctcctcccggtcccccaatacctggcacaagtcaccagccaaggtgaggtgtgtggagggtagcaaacacccatacccaggaagatggagccctgggcgggcggagtggggagggaagtgcaaagtgggaggcccccactggtcccctactcttgcccacaaacatgccggggaggaccaggagcccaactcaccagctgttcctcagatgtctcctcgctggcctcggactcagagtccctgaactgtttctctcgaacctttgaggacctca

SEQ ID NO: 34977 - DNA, 1191 bp, Bovine  19866881212167
actgccggacggggcccgtcacccacagcagctcgggttcctcctgctgctgggctggtgtcacctggacccgatctcatcggagtaggggctgcaggcatagcgcttctgtgacccagtggaggaacagcagagcgggtgagccccgggataagactgcccatcctccaacccccactcctggagaaagggctctggaccgggtctcccggaactaagaggttgacctgggcctggtcagctcactgagcccctagggccaggtcggattggccttctgcatcccaggggttagtgccctgagacctcagtgcaggtctggggcctctggggtgtctgagacagtctgggggtgtctggtcaggcctggggtctcgggtagacctggtccacgggttccttcagggaggcgagcacaaagcactggtagctcaggtctggagacagcggccggttgtagaagccttgatagttcttcttgtcccccaaggtgaaggtctccgggagaacgtccacctgagcggccacgtatggcttcagccgctccgtctgccgccggcgccgcagccgctccccgccgccctgctcgatggcctccagcagctggcagcagagcacaggagtcacacaggggccttggagcacacgctcctgggctgaggctaggctcaccatccgtgttaggggcctgagcccggcctgattcactgtccatgtagaaccacgccggacaccagcaggcggtgccatttctcccagccaacctgctaagaaggggccctctgggtaacctgcccctcaccctcaccagagagggctggctgcccaccactgctggggttccactcgagcccgtctgtgacctctagacccctggagactgtgaggctcacagggcctgagagtcgttagatctgagagatgtctctgccacttcgcaccccaggggatcctccacaaacccctctggggaggtctctgtaagccctccaggagttctctgaaagctcccaggagccagctcagagtgcgtctcctcagagacgcgggcaggctgccaatcagagaataattccagtttggggggagtccccggggcacagccaaccagcgaaatgggactgccatcagggctgccctggccgggtccccaggcacctcgtccagctccagctcctcgggcgtgctcca

SEQ ID NO: 34978 - DNA, 1603 bp, Bovine  19866881216038
aggacttgcccagtgtccctcccaccatgaggttgaatgtgcaggaagaaactgggagaatcattgagatgcagcgcctggagatccagcgcctgagagaccagatccaagagcaagagcaggtccccggcttccaccccttggccgggatgcagctgccgtccctcagtggagaagatttaaaggcccagaccaagtgacaccctctggtgagacgtctccagcctctccagaaggtgttccatgtgcctgtcctggactgactctgggctgcaacccagaccacacgagcctctcccccaggccctggggaatctgggacacaggcagaataaaggtgttggcccacaagcacgtccaactctccgcttagccacggagccggggaggggggaagggaaagagggaccctgaggcccagggggcttctgctcacccaaagctgccgctgccaacccctgtccaggcaccttggctgcccacccctgcagagatcccatgcccctccccgcaccacgcctcaagggcagggctatctgttacttctgacctgctttttcctctgccagatgcatcagggtcagacaaaccttcctatgttttcttctcacttatgaaacttagcgaggttttctgaggattttcacatctgtgtgaaagagtagcattaggagcacggcgccgttggtagcgttccccaacgtcttccatcacctgcagaccccggtggtaggaccatacgcagagctctgcccttccttctcttaccccccatgcctctctgcacttgtcatcctcagtctgcagggccctgccccgctcctccatttctgggggatgccttttccccacaaccctacactggctggtccagccgcacgcaccaggaaaggtgggtttttgtgcactaagaacccatatgtcttctcccacctggagaagacaccctttctatacccaaataacaaatattaagcccccagtctctgctgccccactggttgtcttcaatctggcatctccaaggcatctccccatctttcccaatctgctttaccccaactctgggcactgctcttgagttagtttcctaagcaagagctgagacagaactgtgaagcttgccgaggctctcccgaaggttgagaacaacaaaaggagatgcagagcagaggccccaaagcaaagtctgcatggatctctctctctcctgagcgactccccacccccacccctagcccacaccgttttgcaggggccagcttattccctccagaccagggttcacccagcaatgtcccctgcccacagggagaccaggcccagaacattatcatgccgagtagatgggctcttctgggaactcagacttctccatcccaaactagctttaccctcttccaaagaaactgactcggaatgaggttggggaggtcagtagggccagatggtggggatcatgaaggcaccttacaggtcggggaccatccagaggccaccgctgagccactgagagtcactccccactgcttcccaagctttgccaaataggcctcctttcagtccctgccaaattctttcttgcctctgggtctttcttcca

SEQ ID NO: 34979 - DNA, 1427 bp, Bovine  19866881247633
ctgccatgagcatgctcacacactgaccaattatgtaacaagccctctactgggaatgcagcgagggttccacccagccttagggtgccccttctgcagggagtcaaagtgctaaagttttttgccaagtcccatggtaggtggtcttttattactttcctgttaagaacccctctcttaaaatagtggagtgcagtttgagtgtttcttcctggcagaacccttagaactgtcccttagacagttgaacggacatgagaaaggttcttgatgatggtagttgtcttctacatttattaaggttattatagctgctttttttgtcacctggaacagcagcagccagcagagatagcaggtagactaggacttaagcaggtctctcaaatggacctccctttcacccttcttcttactgttccctcagagtcaggactgtctccagctgggtcctcctgctgaaggggaagtagtccaggtgagatggacagatggccaagtctatggagccaagtttgtggcctcccaccccatccagatgtaccaggtaaccagaggctttgctggggatggggggaggctgctgtttggttagttaagtgtttcctcttgagccagaggcggggcaagtctttgctcttgggagaggagagcttaaggtattggtcacaacccttttcagagctggggctaccctgtgtccagtctgctgggtatggcttcagtgttctaaacccttcctgtgtctgcaggaaatggcaggaaatggccaatgtgcatggtggaccagggagtgacaggatagcttaaggcctttgtttccttggtaggtggagtttgaggatggctcacagcttgtggttaaaagagatgacgtgtacacgctggatgaagagcttcccaagagagtcaagtctagactggtgagtatgttttctgtgtgcccttggttcccctctgggaggaagggaacaaagcaaggacatgatcctttgtttttgcttcgggaggtgggggcattggccacaaagtgctcgtttatttggcttgcctattcttctatagtcagtagcctcagacatgcgcttcaatgagattttcacggagaaagaggttaagcaggagaagaaacggcaacgagttatcaactcaaggtaccgggaagattacatcgagcctgcactataccgggccatcatggagtaggggtgcttccggcagctgagagagtcccagtcatcaaggcgaaagcactctggggttccacagcacagcagacacttggaactctgaagtctctaaagtgaattgtaaaatgaaaaggaatgaactaaccgaccccatcatcttctcaccctgccctcattgcattccgctgtggtgcaaggatgagcccttctggacatgggcaagatgctagctcccag

SEQ ID NO: 34980 - DNA, 548 bp, Bovine  19866881269880
gccaggggagctgctgggagaggggagggacttggctaggtctcccaggccttcttcactctccaaactttcaccaaactcttggcccccgcctccccgaaaccaaaacacaacaaggacagggcggacaagcagcaccgtggggcgggcagactcgcggaggcacagagcctcaagaggctgatgcaacctttccctttaagaaagtctcctgggcgcaccgcggtgcggaccctgcccgcctgggccagggcctgcatcaaaggaagggggctaagggaagggcgcgctgcggccgagcctctctctatccggccttcggtctgggtgtttggtggctccaaggggctgagcctcaggaaaagcgagagagcgatcgagtatgtgtgtgtgatcgtggatgcatgcgggcatctgtggatcagggtgggtacacgcgtggggatatctgtctagccagaaaggctgggtagttgcctgtgtctgggtgtcaccgctgtcaccaaggagctgcagcgggcggaatggcggcggcaaggtgggaggtg

SEQ ID NO: 34981 - DNA, 1071 bp, Bovine  19866881302084
cctgcggcaaacagttgcagcagaaagcagaatccagacccagactgtgcccaagcacagcagcgacactgacagccaacacctactgatgtatcaatattgacttcccaagatcctctgctaagaacttttcctgtttgttctgtttaagaatctgcctgccagcgcaggagatgcaatagatgtggattcgatccctgggttgggaagatccccctagagcaggaaatggcaacccactcccagtattcttgcctggaagatcccatggacagaggagcctgctgggctacagtccatagggttgcaaagagtcagacctgactgagcacgcatgcacaagcacagtcttcccaacaatcctctgaaatagaacagttattgatacacttttagctctaaggaaatggaggcataaagaagttaagcaattggcctgaggtcacatggataggatgttttgaacctgagtactctgacctcagagcttacatgctcaactgccaccttctactgcctcttgctgctgctgtcttacggacagggtggctgggggccagatcacagaggtctaccagatgccctgtgggggctctagcggcattggtgtggaactgccctcttgcccagctctacagaggaaaacctcactcccttgagatgtttgttgccttgggaaggccagggtgtgtagtgtgtgtctataactgtgtgtgtctgtgattctcatactactaaggaatcatagctgtcatccaagctgaccaagttccccagagtgcaaaggatggcctgtgaaaccttgctgagatctctgaggcaggaaatggggaggaatgacagtcccagctgcctgtttggggaaccgtgcatgagaaggtgccggaggcccattgcactgccctgggggatttgaaaatttatagtcttctggccagggtgactgggtatcttgtatccccacattccaaagcccctccccctctgtccttcatggattctgggacttttatcacttcaacaccagggaggagggaaagagggaaaggcatccttgtaaagctctgtccc

SEQ ID NO: 34982 - DNA, 1859 bp, Bovine  19866881365961
tcaggtgggcactgggcaggaaattccagaagtaacaactactgagctgatcctctagggatgaggaggcaggtgttctcccaagaagaagggccctgttctcagagaagccctttctgctgtaaacacaggaagctgtcctctgcagatcgaggcagcagcccagaggagggacaggggcagactcactgaggaatctgcaatctccttgagagtctggtctgacccaacagcaaagatgattttgccgtcaggggagatggtgacgcagttgtagctgcaggacttgagcacgcactcggtctctctctttcctgtggacagactccattcgtacacagcaccgtctgtgccacaggaaatcagcttgctgtcatcggtattccacgcaactgaacgaatctacgggggatgaagatgcgcccagttgggagtgcgcatgtacactcacacacacacacacacacacacacacacctttcaaggagaggaggagaaccccttatgtgattcactatgctgaggcagagtgtcctttcctggaacatacccttcagtaaacacaaatcatagctttgtaggaaagttagcattctatttcctcagacgtttgcaaaatactgaagattaaatattctcatttctgtctcactttatgaatgtaaagactgaatcataataattcctataatgctgcaatcaatcactgctatgttttacaaaagttttttattttgaaataattatacatacatatatatatatatatatatatatatatattcaaagggagttgcaaaaattgcatagagagagtacttccaaatggcagagtaagaacttcagctggcctatcccttacataataggtaacttaaaaatcataaaaacagttatttagggacttccctggtagtcctgagaatccacgctttcactgcagggggtgcaggtttgatcgttggttggggaactaagatcctgcacgcctcgtggtgtggccaaaaagtttataaaaacagttatttaaagtctctggcaattgtcttaagggcatagagaaaatgcagaaacattcactcaagaaaatctactcaatctcaggaggaacagagactgggggagataagcactgatctgctgctttaccctcctcatcctcaaacactttattccagtgtactctgggcagctgtagccaaaaggtggggctccctctctgccccagagcttagtcattggctatggtttcatcctgggaaacctgctggcatttcttatccccacccagaagctctattccaggcaagtgtggccaagagggcctcatctcccttcccctagccggtccccacctgctggggaagctctactccaagtgcagaagcctgagaatactggtaccccagttgcccctgccccagttaactcaatgggtgggggttctacaccatgaggggagagctgaagagacgagggatcccaccccctttccacgcacagagtagggaggtcactcttgggaaagaaagtcgatacccctcaccctccactcggtgcagtggagcagaacttcttcccagggggatgttggtcataagacaatgagctccacagctctgctggaggagactgacttatttggaacagagcatggagaatttcatcctatggacatcatctaaattggtggagatctaggtggagggcagttaagagaaggctggaaactccctgacagaagcaaaatggcagagcagtaacagaattagaacaggaagaagaagggaaggggacagttgagagagcccttccgggatgagaggcaactgtggggatcgggaaggctgatgtgtgtg

SEQ ID NO: 34983 - DNA, 1672 bp, Bovine  19866881382208
atgttgaagtccccagtagatgggagcttcctcaggaagtggctctgccaggcagggctacatgagaaagggttttgtgagcatgtgaaaatatcccttgttctccagacctttttttttttctttcatattttggagggaaagaggaattgcacctcacaccgtctctcgtcatggttgagtcatcctcaaagtatgcctggttcctgggctcagttagcatggcttttctccagtccatagagccagtagttccaataagggtcaagtggatggtgggaggtggcagccgccagcacttttgcctgcttctataaagctggagaggagagtgggcttgggtcaccagcttaagctgcctttcttggctctcctttgcaagcaagggcaggagttgagtcagcagaagtggaccaaaggactgctctgaataaagttatttaagttgatgaccactgtgtcagggttatctacagcaggtaaattgagagagctatgtggggattggagactacatgtcagagactttcaaggttgctgcaaggcaatatttgtaaaaattttacttatttatttggctgtcctgggtcttagttgcagcctgcaggatttttggttgcagcaggtgaactcttaattgcagcatatcggatctagttccccaaccagggagcaaacccaggccccttacaatgggagctcaaagtcttaaccactggaccaccaagtcccaaggcaattcttgtttgttctccaataaaaagttttcttaggttttttgtttttttattctcttatctgtaggtttgatctaaaagtcctgagaggtaataaaatggcctgctcattcctcccagctgccttttttctgttctcttctgtcacgtattagtacttaggtatttgttcagtgccaggcaggactctgccaggctgtggcagcaaaggactggaaaagcagtcacagatgtcacatccattctagttccatcacgaccagaaatgtgtccacacagctcactgatcatagtacacagagcatggagagtcctgccgtcagctctgaggcagtgtcaggggttttccccactacagcagggctgccttagcgatctgtcagcctgctcacctgttccttctcctctcttccgtttgcactggaaatacccgagctcactgtcacattggataggattcaaggtgtgtgtctccaaaacccctggagtagcttggtgaccactgtcctttattccacccaaagattccttcctgttgaaagtttcttaaaaactttcaaacctattgaaaccaaccccaagtgtctttgttgtctcagactaatagcaatgtcattcccaaagtactatttgaaatggattccttgccctcccagagttgaagtgccctcctgtcccaagaggagcatactcgggaccccacctccatctcatgcccttaagcaaaccgtccttacgtctgtattccctctgagaggacatgctctcgttcccagcgtcccaaccccgggtcctctggagtgcacaaacctagcagcgtcaccaactgtggggctcatacagcccaacaagtgtctcagtggagagcatctcccacccctaacactcatccctaacgggagggtatagagagaatactacagagtttcaagaag

SEQ ID NO: 34984 - DNA, 1054 bp, Bovine  19866881396480
tttgcagacaggctggcaggctttgtacccactcttccattgacacatgtgcacacacagccaccatgctttcctctgtcacttttaataaagacataaaggagtgagcagcctccacaggctgtattcccaggcccctcacccaccctgacctttggccaagaagctcctacttcattgtggggtggagaagtggggagcctgggtccacagtgacagattattgctgacctctttcagtgtgaggaaaaaggccacaagaccctggtgggggccagccctgagtgctcctctcccaagtgtaaggcagggagggggaagtaagtgtccagccctttcagcccccggctctggagtggcagagggcaatgaggccacatccctggggctggccgggaaaagtcagggaggaacggaagcggtggtctctgtgtaccagctgtgggaagcagagagctgtctgctgctcagtcctgaccacatagccctggtcacaggtgtagctggggaggacaatgacagctgctgcctaaggtgcagtcctgaggcacttaggtgggcaccaagctaggccatgtttctcagttggccttgactttggtggtacctggaactccgttttgctgagatacacggggcagccgcttgcctttagtgtaagactgataccagaaattggagaagagcacgaagaagatggtgccgtacatccagatgaggtggatgatgactgggtactggtagttacaactgggcaggaagtagtattgggagatgtgcagcgagaccaggacaaactggatctgggaccaaaaggcatgggtcagaggacacagggagagaggactggagagcaaggggacagaacacagtggggagggctggggtcaaaggtgaggtaggctggataaaggtagggtccaaacccgaatgtcggggggacgactgtgggtcaggctcgggcccctcaccagctggatggctgtcatgtgctttttccaccaaaggtagggctgagccacaggcccaagggcagacaatccatagtacaggt

SEQ ID NO: 34985 - DNA, 1623 bp, Bovine  19866881396655
cttctctcctccggcagtggctcacgctccggccacatccaccaccatgacgttcgggtagcggaacaccatgtggccacgctgagtggccacagccaggaagtgtgtgggttgcgctgggccccggatggaaggcatctagccagtggcggcaacgacaatctggtcaacgtgtggcctagtgctcctggagagggcggctgggttcctctgcagaccttcacccagcatcaaggggctgtcaaggtgagagtggggctgggccgggcctctgcactctcacctagaacctggggactgttaagaggacatgggatggtgaaagtggactgagttaatctgtgtgcccgataactccttgtcttgctctagtacctgctgacttcacctttatcccacctaggctgtagcttggtgtccctggcagtccaacgtcctggcaactggcgggggcacaagtgaccgacacattcgtatctggaacgtctgctctggggcctgtctgagtgccgtggatgcccattcccaggtagttttcattattccagcctcactcccagatgtgttatcctgtatagctttcctgggcaacctcctcccctccaatggcttcaccgacgcaatactggcatgatctccaagctcagatgtcacccttgaactccagacacacattttcaacagtccacagccagtctgtctctaaccccatgttctataacgtggcaccacactagtatgtcccaaattaaactcgtcgcttccccttgcctccctgaaatgtgtgttcctcctctgctatttgaaaaggatactaagaaatcagaacaagtaagactctttcatcttcctcacctagtcaccaagataagtcagttttccctcagagtatcattcacatgtgtcccctcccctcggcctcatccttcttcctgtggagactcacagcactggtcttttatcgcttccagtctgtcctctatattggtctgggtagtctatttttgtcctccgcaagccctgcaagggctcccaattacctacagtgtataatccaaatgttttagaatgatatctgaggccctagctcaaaggtgggtctccctacaagtgctgcagcttcctctcctgacacccccctgcccagtacatgcagactttgctttattcgagcctcaggctctggagccagagttcaacttaatttgtgtgtgagcttagacaacgtactgaacgtccttccaactgattcctcatctgtaaaatggttaacaattctaactctcaaaagggttttgtaaggactacagtcattcaagtctgagtctgtagcttctgggagtgcctaacaccgcggtggatgcggttgtgatttgagtagtcctggctctgtgtgtgtcatgcccgtgccatttcctgtacgcaggtgtgctccatcctctggtctccccactacaaggagcttatctcaggccacggctttgcccagaaccagctggttatttggaagtacccaaccatggccaaggtggctgagctgaaaggtaggtgctaagtgacaaaactcaaaagggcacacactgtatgactatttgtatgaaatgtccagtagaagcaatgcag

SEQ ID NO: 34986 - DNA, 860 bp, Bovine  19866881397173
tggagagagtgacagagctggccccggcgtctgctgagctgaccgacagccgcaggccaggaggcttctggtccaagcagtgcccctccccgatgggcccgcagtgcgcaggaggacaagaagtgaagggggaggcgtgtgaagagagaaagaaggactcctacctttcttgtttactaggtcccgagagacaggcaaggacagaagaaaggaaccgtcactgtttccgccacacatgctcaggccctctcatgacacggggacactgcggaccgatctacggcacccacgtggccttcacagggaagggggtcacctctcctggcctacaccaggacccagacggcactggagggggcttggttgggtgtgggaagtcgctcctcaggtccccacccagggatcttccggccctgaaccaggcgagcttgtccctattcaccctgggaggaaggagctaacttcaggtagcaggcactgggtcaagggtcagggtccaaggccgggagagacggggcgctgggcacaggccccctcgggtgtgcacctgtgtgcagacacaaggaccaacaagtgtgcgctgacagccttgtgctgggtgctggaaacaggcccagcgatgttcccatgcgcagcaccatcagacagtgggggacggtgtgagcagggagtgggaggggcctggcagagcctcgtggcaccagagcccggaaaggcgtctccaaggaggggacaagagtgcagtggaggggcgcaggccaggccggccgggaactgcattagttcagcgatgacgtaggggtggcggcggcaggggccagagcagccaggcgtctgatgaccgtcaggctgcagacagg

SEQ ID NO: 34987 - DNA, 1069 bp, Bovine  19866881426218
aaagggctgttcagcaggttttgggaggcagggcgagacaccggccctgaaggggaggatgaaggagacttaccatagtcttctttacataaaccctcccttccccccgagaaaggccaaaatctgcaatcttggaggccaggttctctccgaccagcacgtttcgggcagccaagtccctgtggatgaactgcaggcatggttagaagtcagggacgatggaggatgatggagcctgggactccagggccagggagggggtccacctcatggctggcttcctgggccctctgggcctttagcagccctttactcttctgcccacctaccccaggcctcaacctgaggtaggttgagactcagagactcagagcgactcagagactcgtgcctgggaaaaaccacagtggggactgtcatcccttcctacttgtgatctgggccatggccaagttcaggctgtatccttctcctgggacaacggttgactttcccccagtgaccacactgcatcttctcctctttgaatgctccctgaccccgtctctccctgacctctccctgacccctgctccactgatgagagtggaaaggcccttctcttgcccaaagcgatctctcccttgagttccagatcctcctcactgggccctccaccttcctcagagaccttgctctatcatccctccctctgccctggccccctgccctctactttcaaagatactcaatacattaacaacttcaaaatgcctcccttagtctcacatcccttcctccaactgtcccctccctcctttcattcaagcggggtgtccttggacttgggctcaggcttcccgtctgttccacccttctcctggtgagtctcacccactccctggccaccagcacccctatttctgaagtgacagcttccagactgttgtccctggtccaggcctccctccttggttctaggctgacagttggaaaatgctaagccacatccccaaacacagacctgctttgggggtggtctcacccactcacccaggccagcaacttggggtcacatcctctctatcct

SEQ ID NO: 34988 - DNA, 905 bp, Bovine  19866881524328
gccctgacacaggctgcaccacaagacaatgggcaccttcaggccagactctggcacaatgagtaggggcagggccaaggccacggccgtgagctgcccagtagctgagatggcagcaggaggtagtgccctacccccacagcatcctcactgaattccagggctccctcacatcttcaaaattcatgtacacagtaggtaatcaatgttcttaatttgtctcatctctgcctcataacagggtaaatcaaggacagtatagcccagtagaactcagagcattactcaaggtcacagagcacacagtgacagattccaggttaagacagccccatgcactgctataggtctgcttctgtttcagggcccaacttgaatttcctcaaaggatctatgcagatctcagcatatatctcaaattctaactgatgggcgctcccatgagcctgtctaattcatcttttttcccttctccagcccaccagcaaaaagctttcccaggattaaaaacaaatctcaggaaacattttttttccaaaggagagagagccaggcaaaaagcagcagctgtggatagggtgggaaaatggtgacttgagtgcaagctcagccaaggagagagccaacgtcaggacacctggggaatggctggatgacccaaaatttaaagccactgaaggtgactttctcaagccaaagttaggaaatggactagacagagcaaagcccaaacactgactccaggctgggatgcagtccacccatagggggaagctcttgcattgatttcctaccacccagacacctatgcctgagacctgtgagcaaacagaatgtacctgaggcctcaaggtttctagggtctgggggagggagacagagaggatgcctttagaccaccacag

SEQ ID NO: 34989 - DNA, 1397 bp, Bovine  19866881596415
tgctgtgtttcaggagcaggaggggggctcactcaggcccacagctccatctcaaccgggccaggagcaggcctggggccgccatgcgctccccaatctcatcagacacctctcacacccagaagcatgaacacacccctgtcccctgctacagaaaccctcctccaagaaggcccctccagaactagcatgtagggactttgtggggacttttcctccaacactaataaggagtctctcttccctttaatgcgagggcctgagagatgccctctggggtgggagccacagtctggcccttcggccacctcccaaatgccagggcagggcagatggctcctgctggggcagcgagcaacagaagggacggcagtgctgaaatacttatcctgaggtcatgagtggggaaactgaggtcaggggtggcagggaggagctcgagagcacccaaccgtcagggatcctggtgcagggcctgtcctctgggcccccgcccctcaggggagtggacggtgggggctgcgtcacccagaggccaggcagcacagacaccaggcgcaggcagctcacgtgtgtggaccttagggtgtgtggctttcagccctacagcagcgaccattcaggccggaatccagcaaagtgcttaactgcatcccatttaatcctcccaaccagcttgggtggcaggcatcacatcccccgatttacagatggagtaaaatgaggctcagaggcacagctactcacccaaggtcacaaggaaaagagaataagcagtccagagcccctgatcctagccgctgcccctctaagctggagggccctgccctgcctcgcaggagacacacaggcacaaaggagttaccaaatggatatgaacgtgaacacataaagccacagtgtaaaaacggctaacacaaaaagatgttcaactgttcttgtaatcaaaaaaatgcaaattaaattgagatgccattttttgcctattaacttggcaaagatttttttaatggtaattcccactgctggtgaggatgtgcagaaaagaggccctctcatgccctgtttgatgggtgtgtaaactgacacagtcttctggaaatactgaaaaggctaagcatcgcatgtggccctttgaccaagcaattccacttccgtgcatctaggagataatcaggaaagtgaacacatctgtaaggaagcacacagtcccttatttatacaaccaaaatacaggaaacaacatgtgtgtccaacaataagggaatggctgaataaattagggtgcttgcatgtgacactcccccacagccattaaaaacaatgaagcagaaaaatacttaatcggcaggaagatgttcatatgtttttttaaaaagcagtctacaaatcattgg

SEQ ID NO: 34990 - DNA, 1100 bp, Bovine  19866881685055
aattggagagggttaggcggacaatgagatccgacaagagctcgagagttactgggcagggatagggacccatagaaggagagcaaatcatccaagtcgtgggacagatctgccgtggggcccaccttcttacgccccacctctgcccgaagctccaggctcagatccaccgtcgtctcccctagaattctcttcacttcgggccgctccgggagcggaacgtgctcttccaccagttcccacagcgacggggagtccccaggcatggcccgcccgcgccgccgccccccagactcggggccgcacgcttggacctgcgggacccccagtccgagcgctgggttactgggataccgctagtcgcccagggccgggcacgcccactcacgcctcgcccgcttccgggtctcacaggccacgcccccagcctgtcactcggaccggcctctcccaagccccattctattctgcctcccgtccccacgactagagttgctcggtccagagccgctggcctctggcgctcttctgccctactactgatcgactctcggaggccacggtttcaggtcgcggccccgggagccaggcggcgggactggggccctagctccgcctcttccgcatggccgtcacccgggaaacggggccagctagccccaagccccgcccccagagagtcccgggcccgcccattccaggcggtgccggctaacaaagcccaacccacagccgtggtaggtggtttccaagtctcaaccatgcacatcaatctgaccccaagcacctttcatccccgggcacctttagacgccagggcaggtgaaagaaccgagaaatttgagcccggtgggtttattacttccttgccttttccggccaggaggcagcggcagggtaaaatttgtccttccagcccgcgtaagtctagtgaacccctgcgcttctagggatttggggaaccaggacagtccggaccagacagattgggccaggcgcccttccccaaacacaccaggatccgagattagggatccagatccccatccccaaacagacaaagggcttatccattcacgttttttactaaagcacccaca

SEQ ID NO: 34991 - DNA, 1610 bp, Bovine  19866881827914
tatggtcactacaagcgagtcaggcacttcttttgggcggtactttacacacctgtacagtgaagcgctgggtccagatcagtggtttccaaacccgacctcccagcacagtctgatggggggtaattttgtttgaccagggaacatctggcaatgtctggaggcatttttggttgtcacaccttggtggggagtgtgcagttggcagcttgtgggtggagagcagggaggcttctaaacatcctgcagtgcgtaggacaggccatgctcccccctgacaaaggatgatcctgtccaaactgtcatagtgctgggatgcagaaaccctgccttagagttaaagcatctcttgttatccttaaaggttgttttggtttgttttttggggagattgttttctctgttggtattttcatgcctagcaacagtggtttaggtatttaatctgcccagatataatcagggagagaattggatgttgacataaacatgatttgtgcagttttgtagcaggttgtgtcataggtaagaatgcagactgcttgggtgtgaatctcaggtccacgcttgctgtgtgacttcggcaaattatagcgtctctctgtgcttcgttttggggtcataagaatttctgcttcactgggttgttgggatgagaaattgagaatatacttagggccttgacgtggttgtggcacacagtcagtgttcaaggatggtcacagcctggtcactgagagacacttagacatttggagtgctggtttggagtaggtgtaacagtcctgtgtccacatccaggtgcaaacagaggttcttcagaagcggcagaaggagaagtcacacatgatgagcgccattaagaaatatcagaaaggtgagtgtgttctctcataaggctgcggggagcaggggcacctgctgctcccatcaaacacacctgaaggcttgattgatttggaactgttggacctcccatttgggaacggcacggggagcgagatgtgcctctcaataccaactccataagtaacacctcacatttgggaatggcacggggagcgaagatgtgcctctcaataccaactccataagtaacacctcccatttgggaacggcacggggagcgagatgtgcctctcaataccagctccataagtaacacctcccatttgggaacggcacggggagcgagatgtgcctcttaataccagctccataagtaacatccttcttttgaagttgaatctttcttttaaagcaccgtggtgctgatcgaagtgcttcactcccaggtttctctgataaactggacttcctcgagggagatcagaagcctgctgcacggagcacaaaagaaggagccaaaggccagcaaatgaggaaggggtgagtgctgcgttcgttttggtggtggtgcatgcagggccgcagttcctggtgtggcctcggtgcatgcagtgcggctgtgctgcggccagaactgtgggccacgtgatgggcctgttcaaccacatcggtctttgaaggttcaagtgaggtgatttcagtgaatacgcagtagaagttgattcctcgcgtgtgagggttgtgtgcagacctagggttct

SEQ ID NO: 34992 - DNA, 849 bp, Bovine  19866881901039
atactggaagagaattgcgttctccacttgtcagacgtaaggtgctctgtttttcagctagttcaaatttatttattcattgttctgttcaggtcatctgctttctcactgactgtgagcctggtttttcagtggtctgtgagtttcccattatgatgacaggagacccattgtgtcgttctccttgtaattcttttaattttgctgatagagacattattaggtacatacacactttagtgcatggcctccttttgtctatgtccaatttctgaaccttctaggagtttatatgagttcagaacaccaacttactgctttgaaatggcaatggaagagttaatggttaatttcaagacttgaagcatttgaacaggcactttatgcattcacaagtctgacttggtacaggggcaggaagagaagaacagagacttgcatcgttcatgccactacacacctggagccaggcaagggacacacgtgcactccttggttaggggtttttataatgctgggctctccagcctggctgaggcaggcagcctaaaccaccagactaaacatttctccttcactgtgcagctgtggtattgctgctctgacacctgcgagagaggaccttcagctgtgtatgcacatcagcatgtgttgtgtctggtgacttgagagtcccaggatcttccattcttattacagatttggcatcagttgactgccagtgagaactgggctttattgccagcttccccagaggtgaattttccctgaagagttggtgcactcaaaatagcatttctattgtataagctgaattcacatgctacttcaggaacacgtttgtataca

SEQ ID NO: 34993 - DNA, 1109 bp, Bovine  19866881988590
cagtcccccaggcttgggcctccaaggggcacagccagcagggcggaactgttgagcgcaaggctcagtagtgtgctgctcgtgaatgcgaccactgactcctgagggctcattcagcctgtgactcgctgctggccaccctcccagggccctccacgccaggggaggagcagagacctcagaggcccaagtctggtcctgctgcacttggtcaggccttgaacatcaaaccttaggaccttggtctctgcaagatgccttgccctggctccacccgtgaggccactctggaccctcagttgtctctcttacagctgtaactgctgcttcgtgaccccacccatgtactctgcagctgccacaatcctccattgtgcccctaagtaaacaagcctctgacagaataaaactgttattgtaggatcaacatataggaggcctatttggctgggctttgtttgggaatggataaactaccccaggcagggctcacgccctctgaaaaaatgccccccgaagccccaagctattgctaggcctgtccccaaaaaaggccctaggagatggagacaggcttagccaggattctgtagggacctgtagatctgggagctgcccccccgccctgacccaaggtggccttcaagcctcttcgtcagggcagccttctgtgacctcaccctgctcccacccccaccctagtcatcctttcacgctctcgtgatttgagaaattcccctttgtggtcacgttgaagttgcatgtaaaaattatgtgtttatctcatcaatggcttacttccccctggacttctagctctgagtgagtcggggtgtgttttgttcacttctgaattccctgagcctgaggtagggcttggcacatagtaggtgcttgtaaacttccgaggctgcaaatgaatgcacacaggctgtcctctgggcagtgctgggtgggaggtgacacctttgtgcagaacaagggtgtctgtgcagtagtgctcatgtgctgtgcaagcctggagcagccccccagatgcgcccactgagagcaaagggtgcgtggctacgagggccaccatcaggtgctggggcctctgggcctgcctt

SEQ ID NO: 34994 - DNA, 1050 bp, Bovine  19866882018124
gttggctgcgtagctggagccagtaggagttaccaggctggagtcctgagatgaggcagctgccacccttcgttgtcagagatggagccttgggagaagaatcccagcctcacaatctaggtctgcctctcagccaagatagcctccatctcttatatttgaagccccacaacatgcctgtggagagacactcagttcttcactggatatgatacgtgcacagactgggggccaggtctgtgggtttcaggtggagttcagggttttttaggtttccctagtggctcagacagtaaagaatctgcctgcaaggtgggagactcaagtttgatccctgggtcagggaagatccgctggagaaggaaatggcagcccattccagtattcttgcctggagaattccacagacagtggagcctggtcggctatagcccacagggttgcaaagagtcagatacgactgagtgactgatactttcactttcagggctttttagggaaacccccactaacttggggacctgaagcgctcagttgtgttggtctgaatgacctaaagtgggagattcctaaataaacatggcttctgagaactaatcggagcctatgctagctctccaagggccaacccagtctggaatgcccaaagcatggcctgtcctttcttggggcaaaattgagggtaagagataggaggtggagcagaagaaggccagggtacctctctagttggggaggtctgctccggtccagtctgttgaggcatcatgggctgtgaacatggagacgggtccagggctgccgctaggtttggcctccgctgagctgggcagcaggtttctgcagacagcagctgtgtgactgtggcgccacttggagttcctggggtccttggggccatagcggagttcatgcctcagaaattcatttgatttcgggagctggggcctcccagctatcctgaagttcccctggctggctcccacccatggccttgatgaactggggggggagtttggcaggcctaagggagaagacagagcacatcag

SEQ ID NO: 34995 - DNA, 799 bp, Bovine  19866880602605
ttttctgaacagataagaaacgtgaaccttggtaatggcttgtcccttttctacccatttcctgggtctacaagccggaggtgaatgctcctggacagaaggcaggacactgaccttaggaagcgtcctgggatggagcagcagggtcctggctttcaggctctggaggcggtgctggcacggcttcttttttctgggctgccaggaactcatgaattgctcgttctatctgtggtctgaagatgtggttcagtttgggatccaccacctgggaaataattctgtccactccagcttccaacatccctgaccttgagaagacaaacagattattgcattatttagcctgcaagtgtcatgggagagagcaagaagtatccacctggtccaagatacagccccatgagagagtgctttcaaaggacggtgcacacagggttcaagccatgatgtctttagagggcaagtcattattcctaattcacaatctcagtcactcccaatgcaaccttgtacaaaagaaccaaacaaaactctaccaacgacaaacagtaacagtatggttgaaagaatcgacgccatgggtagatttgaaaacctcaatctagcaaagccagcatgcctcccacttgactccacttccctcagtatctattcttctacacgtcaaagcaaaagtgggccccagcagcaacctggctgctgctgctgctaagtcgcttcagtcatctccgactctgtgtgaccgcatagacggcagcccatcaagctcccccgtccctgggattctccaggcaag

SEQ ID NO: 34996 - DNA, 2810 bp, Bovine  19866880668563
catgccatgaaaagagaaaagtgttgtctgttgctaatagctttaattaatccacatgtgaaacttgggagtctaatatgaaacaaaatctgaaaatttttctacaatttaaaaccaaatacaaggattttttaaattgtaaattgcttcacttaaaatttcagtgtgttcctgtttagggaagaaaggtagggatggagaccggcaaggaggaggtgaaaattaactttgatatttcaatttcttcctaaaaattggctttgttacttaatgtttatatacacaaccaaggagctaaatccagtgaattccagcttaactgctttaactgcaagcccagatcatatgacctgtcacaagaatatctttaaaaaagcatagacttgagatgctggaacaagaacatgaccttaactgttaaaaacttgggagggagggaatagtgtttctaaatcacttaactcagagtagcagctgattttctgtgatggaacacttggattacttttgtagctgtaaaaccttatagtcagtgaactaatagttatcactcataccatttttatcataaaacacattttaaaaagatgttataaatcaacacaggaacaaaaaatatttaatgatattaactgaagttaagtttctactatttcgaagaagatactgttaatttttttaaaaggtaacattaatgaaaccaagggctgttctatatgaactataatgcctcttattcgatactaaaaaaggataaataacaatgagaatccaaagataaattcccaaactagctggcccaatttaactagtcaagttccaccttatcagaaactgacttttggggtaccttttaaggagaaagagataagaacagttcaacaaaacaggcacaaaaataccccctcactcagttctctcagtctgcctcgacacacacgtcctgagatgccaccctgcactcacaaagtaggtatcctttgagactttttctgttcctcagacttctaaatactgtaattctatcctttagctaagacaatagggcactgacaaaatttgcagtttaactctgaaagtgatacttgtttttattttttgacctgttcttatgataagtcctgttggtctgaaatccgttatgccctctgtatggtaaatacacctgttaaatattttgttaaacaaatagcaatgctttctatttcaattttaaaatattagcagtgacatgagaaaacttttggaaaaaactttcataatgcttccccatcctacctgccctatcctataaattctttctataattaaaatatttagagtcatccattcatgacatctaatatgaagaacacagactccttcctttctgcaagtcctctgaaagctcccgttataagttccatgttactctaaagtcttctacaagcctttcacattctccttgtgccccttttatttctgctctacagatgccaattttcaccaggagttttgcattttctagtccatggctagattactgacaaccccctccgtcccttcaagacctctttgtttccaatggagaatattttcaaatcttttttgtttgtttacttgtctttttttcaattattttccctagggcacctttcccaaaaaagaacccccctttttagattaactcaccaaattttatttctatctatactgcaatagacaaccatcttaggtaatcatctcagctacttgctaactgtcttatctcttaagtaacagcccccctctttaagatctaaagcttcattgctgttgttgctgccattgaacctaggtatcttgagtttcctgtttgggcaccaaataagtattcaatgagtttactccactgaacttaaaacaccatcatttcacaaatgaatacactgaagtaaaataaaaatcactgagatacctaaatatgaatataacccagtgtttttgagttttgttttttgctttttgataactcatttacctataaacataacccaggctttggtacatttagaattgaattcctcaagggagaagaagagcattaggacttctggcaagtgaatctatttcgtggataaaattcagtctttgagggtcttagtattgattatgttataaacacaaagaaatactgccagatcagcagtcctaaccttaagggacgctatgacaggaaaagtagttgtccctggaggccagctgtggcatttggagccagaagcctggcatgcatcttgcagaaggcatagactatatttggtgacatgactcaacctagccaaatataggcaactgatacagtgtgactctggggaactacactaccaaattctacagcctagaaaagattcagattccaagcaggcatttgcgagttggaaagaaccaatatttaccaaccagaatgactaagaattactggggggaggaggtgctcaaaagaacagtatgcactatcataactctcatattaagacactagctaaagtaaccgagttaataagatcaaaggagggaaaaaactagaaggaaatactctaataaattagtatctcttactttcagaattaggtaaaataagttattttctaaaaactaacccagatagtattgctactgatgactcagcaggaaatgatataataaatgctgccatttcaaacacacaagcaataaaaaatatcaaatgttctctagtgctattagatttcatgctatggccttctctttcctcagtcatgcagtattggtgggggcatggtagggcaaggaatgataacaggggacag

SEQ ID NO: 34997 - DNA, 966 bp, Bovine  19866880668949
tctttactctgaaaagtttgtttctgtgctgaagactcttggacatcaggcttgggcttctaatttggaaatgtggaaaagtcatatgatttcaaatattttccatgaagtgctgtaaatttttaggcccaggtaattgtgctgtctcagggtgatgaaatggaaaaacccgctggtgtgaaagactttgttttgccacaagccacagctgtatgattttggagaaatccttcatttccctgggtcttcatttcacgatgatactaatgatggtgatggtggtggaggagaactcttaccacacagtgagagaggcatgtgccaggctcttgacctctaatatcttacaggaaaacccaaatgtactttttggccaacccaatattatttaatactcacagcaaccatatggtggtggtaatattagccccgttttacagatgagcaaactaaggtcctaagacaatagcccagcttgctgaagaccatacaaatatcaaagtaaatgtcaaagtcaagttcaaacccagggctatttagctaaaaaaatcagtgatcctcaccactccctccctatgtttttccttctgggaaaatgaagagatttggtgagatgacctcaaaggatgctttaaactctaaaatccactgtggagacgtgcccatcctcatccaaaggttgttgatgttattgaatataaggtgggatctttgttccaaacaggttattctagcccacctggcagagcagggcaggacagagtacgtggagggtggaaagttggtgtcatgagcatctatatttattctgcctcagagtagcaagcgtgggaggggtgggtcttgtccatgctttctgatgccaggtgggattaaattcatcatttgatttgggaggttttgtcattggctggtctcagccacaccttctgagctagttgctttttatagacaagggagctgggg

SEQ ID NO: 34998 - DNA, 1519 bp, Bovine  19866880704987
cctggactcccaccgcctgcctcctgaccctcagctctagcctctctgcacctcctgcagttcttcgaatctgcttagcaagctcctgccccagggcccttgtacttgcactcccagaacccagaaccctcttcctgccgatatcactatagtgtgtgccctccactttttcatatcacaactcataggtcgtcttaccagtgaggcctttctgcctcccttacgaagagaaatgtccctccagcaactgcccttccccctcaatgcccttcaccttgttatatttttcaccatagcatctattaccacctggcatgctatatttctcacttattaatcctgattatcatcaatactcttccccccatgaaatgtcagctccatgagagccaggatgcttcatgacctactgtcctcccagagcccttctcaaggacctggtgggtcctcagtacatatgtgccctgtgagtaaatgaatgaactcagtgtgcccacctgcagaggtggtgacttgcagggttctcaagctgcaaaagtctaaaatggctgagattcactgtgatgtatctttcttaggagaaagagcatcactgtcttaatcacttcaagctaaccgttccttgagagtttactggataacccgtggcccagaccaacctgaagaatgagacagactgggttcccctccccttgcctccactgtttctgcagtaacctcttccagactctgtgtaaaagcagcccctctaacaggcacctttactaaaagggatgctgtgtgcctgcggtactagggtggacttctgggtcctctggggtgaggacagaagaaatgcaaatactcctccctgggggcctgagtttgctggtgacatgtagcagaatacacagcaaattctttacaggcagagcgcaagcctccctcccgaccctctccactcaagctgggacttctccttcctgtgctctgtggcaagcctgccctggtcacggcatctggcaacttgtccccgagtccctggctttctctgcacgttgccatggaaatgggttcctggctctccagaaagacatattccagtgacattcactggcacttccgagggccccaaaatgggcacacacacatgcacggtgacctggtgcagtggctctagctgcccggcgaccccaccaacatgagaaggagagagtcacatggcagggacttaagactcacgtgggcggctcgtgtggctcatgttcaaagaagaggggaaatcagctggcttcacaaatgcgataatctttgcgggaatctctcgctctctcccccttgcattcagtctagaggcaaaaccagaaggggagcgttttgctctaaggtaaataaaattgtggttctaggccccctcagtgaggcaggcgggaatgccaatgcctcactctactggagagtgactgtgactgctgttccctggcagggtgcccacctgtaagaagggttagtccgcctctgagactggtgagggcccaca

SEQ ID NO: 34999 - DNA, 2083 bp, Bovine  19866880731546
gaaaactctgcagtatagtaaaatgagattttttgcagaaaaatattattttgtggggtagttttcataacatcagagatagaatggcccttaaagaacacctaatctgtcattctcatctctggctacacatgaacatcacctgagatattaaaaaaaatcataagcttcaccccacacctggaatggggcccaggcatctgtgtttttcaagttccccattattaagtcccttattataagagtggttctaagtactttattaaaaatgaagaaattgaggcctagtcaaactgcaatatcttattcagtacaagaatttataccagaatccaagtgggaatagcatgacttttttaacataatatataaaaaggatttcaagaactacaaagcttcgttttaactttgaaactgttggcaattaaaaaaaaaaatgtgaaactaggccgaaagctctatcaacatttgaactcttcctagtgtatggttattgtcattggtgagcagacatacaggtgagcaatactaagcaggttttgcctgaaagattaaaaaaaaatgagaagtatggttcccatctttccagttaactgccctcccttagcaatcagtactcttgtagttcccttaattggtactgtaaagggcttacagtggatgtctatcaagtaagtttgatttttgaacaaaatgagatacatgtataaaatagatggaactggatacaaaatgtgaacctataatattcgccatattgctcatcaagttactcagataataatacacattttacactatttactaaaatcaaacagttatatttggaaaattacctttaattgaatcattttcagctctcattatgtcaatgagtgaactctccaatgagtgcatgtcaaaagtcctggggcgatcctgtaaacacaaacagccacaaaccacttttaaaatagcatataattataaaagaaaataataagctgcatctgatgagacacagatcaaaaagcaggaattttcttccctctccatgtaaggcacattattactacattttatttttaacacttgcaaaatatcaaaatcacaagtacccagggctcagcaaagactgacttgatttccaataataattttcaataaaagcattactttcaaaaacaaagcaaaaactaatttccatatggttaagaatattaaacatatataaaaacagaattcataatctttttctgtcacttaagatttcagtaatgtggcaaagcttcccaaacttgtttcagcagtattctgttaaggtgacatctacatgttctattcagaatagctatatttacttataagccaagatctgaaaatagtcatcaaatgtctacaagaccactaagtagcaaagtagtcttgatttttctgccattagaataaaaggaagacaggatatggagaacactgctggtctcaaccctggcttaacaaaatggacttcatgaatgggtgaggaatctgaaaatacacaaccatgctgatgctgcggcattcttcagggtattagacatcattaaaaccaaagtttagctcgacagtgaaaaggaaatgaaaacattttcaaattaaatactaaagggaaagcagtgtaatacctgtttctgacccaccttgagaataaatatatacttacaaagaccacagcaaggttattaaagaaaagggggaggtgaagagcgagcgagaaccgagttctgtgtagttgtttccaaggggcagcaagggggaagggttaaccatgttgtctttggtcagaaagataatcagcaccacgaaagcccccgcggccactggtccctacagtcaggctgtgttagtcgacaggaccatttacatttcagcacagctaggcatggaccctgcaagtggacagcttgtgccaggaggggtggcagaagaggctaaacaggctcttacaaacataggtgaaattctgaaagcagcaggctatgacttcacgaatgtggtaaaagcaactgttttgctggctgacataaatgacttcagtactgtcaacgatgtctacaaactatat

SEQ ID NO: 35000 - DNA, 1855 bp, Bovine  19866880780954
acccaaagtctgacagtatcaacattaagttcaatttggtattatcttgaaacctcttttagagtaaaatcaaatttgaattaaaagtatatattaagtagaaattttaaaaacacatttgggaaaatgttagtttagcaacaaacagttgtacactgaaggcaaacacttatgaaaaaaatataaggataaactacacatgtatttgaatccttagaaattacctttaggaggaaaataggatttgctctctgctttatgaggccaatccacaatcaaagggccaaagcgacgaaaactggctgtgatctcatctaatgaacaacaaaccaaaaaagtagatgtaaatattcttatgaccattttgggaaacagtttagaaaaaacagtctcaaatctactatttacaagaacagtacaccaagaacccctgcatctcttcatctggatccccccactgttaacatctgtgcatttgtcttccccctcttcccttttctccttctactgatgcacgagtctaccaactggtctaccatctttttctgatgtgatgctctagtaccacaaaatacaactactggtacctgctcaaagcaaggtcactcccttatgtaccaacatacaactcccctccaataaggaaatcaacagtgatacaacattctcccaattcacagactccatccaaatttttaactgtcacagtaatacttctcttttcctttctgatccagaatcctatctagaaccatgctacatttagatgtcatgttctgagggtatctatttttttcagtttacaatagttcttcattctttcctgtcttttctataactgatagcttcaaaatatacaggtcattccttctgtaggatggctctcaacctaggtctgtacttgtttcctcatgacctatgtattccaaccaggaatactatcataatgatgctatgtcatcctgtcctttcacaagatgtgttaatcttgatctgctagtcgagttgataagtgtctgtatttttccaccaaaaggaaaccatttccctttggatatgatcaatattttgtgggggaatactgtgttaaccatcaatatcctgtttcctcattaggcctggcatttactgaagattcctgcctatatcaactaccacaatgataactgccaaatgctggttatctatttctatcaacccttctacatttactagttagtataattcagtaaggaagagtgttcccctctcctccatttatttagtcatgcatttatttatatcagtgtggacctattttattcaatggactataacctgattctggagaaggaagtggcaccccactccagtactcttgcctggaaaatcccatgggcagaggagcctggtaggctacagtctatggcgtcgcgaagagtcagacacgactgagcgacttcccgttcccttctcactttcatgcactggagaaggaaatggcaacccactccagtgttcttgcctggaggatcccagggacaggggagcctggtgggctgccgtctatggggttgcacagagttggacacgactgacgcgactcagaagcagcagcagcagaacttgattctctttcatttattcagtttgtcctcaaaactgcccctgattcagccagtgggaggggttcctgtgtcctttgacttaccccctccccccatcattcttcaagtgcttccatactatctgacccaagaagataccccaggctttcatcttgttctttctctgccctagccccagaatcagcctttttccccctccaagatatcctggttcctttcagtgacaaaagatacttagaaactccgat

SEQ ID NO: 35001 - DNA, 1167 bp, Bovine  19866880845969
ctgcttactatccattgtatgtatgtactatattttgcttatctgttcatatgttgatggattgtttccacttttccactgttgtgactaatgctgctttgaccactggtgtgcaaccaatggtccctgctttcacttcttttggatgtatgcccagatgtagaattgccaggtagagggtaccaatatatattttttttaattggaagctaattactttacaatattgtagtggtttttgagggtaccaatattaaatgtacaccttgatgatggtttagatatgtttacacttgaagagccactacccagatcaaaatataaaatatttgcattactgcagaagttcccctcatgccttcttacaggcaaacctgcccctcccctgaccatgattgttccatgttctcagcctcagggtccctcaatggttggacttagagactcatcagggctaactaggtgaatggattaaagaatcacacacacatacacacggatacacacacatgcacacacgctcataactggtctctctgtaatcttataggttaaaaaaaaaacaaacacactttcaatccatcttttcatttgggcttttttggtttcttgtcctctgagatgttttgagaggacacggtgatgctcagcatctcttgagctttttgaggtgggaggataggcttggagggccaaaaagtcatctctctgggatggattgtgtatttctgggtctgaaactgtaaagtcggtaagaagtgagccactgagatgaagaagccccacccggtaggaggcaagacgtcacagggccctctcctatagcacgtggtctgtctgcagtggctgaggtggggggcatctttggctaatctggtgacccatgaagatccctcgaaggagagggtgggttgtggagaatacaaagggcagaggggcaccaggaaagctttgggagctgaggtggctctgagactgtgaccctccctctctctctctttaaaaatatttatttatttggtcttagttggctttatttgtagcacatgggatctggttccctgactggggctggaacctgagcccctgcactgggatcgaggagtcctagctgctgcgcccccggggaagtccctccctgtctctcctgaggtcgccgcacccaca

SEQ ID NO: 35002 - DNA, 1785 bp, Bovine  19866880872440
ctctcctctgtcagcattctacttactcatctggagcccccattacatgatgtgttctttgaaagaaggacagtgccctccttaccttggcgttctcagagcctggagcctggcacatcgaaggcccatgtgaagtttgtgagcaatttaacaacaacagtcactgtttgttgaatgctcactgggtatccccattttatgaatgagggcttggagctcagaggtgttaagcgtcttgctgaaggacacacagcaaatgagagaactgaaagctgaatcacagcagcctctggagcccacattcctctggcatgtggcagccattctggctgtccctctctccatacacgcaccacagaacacggcgaggcggaggggctggtgcaaggttcccctgctcttcctgctcctccccatcgttttgctgtttgctaacccagtctctcagagaaggcaatggcaacccactccagtactcttgcctggaaaatcccatggatggaggggcctggtaggctgcagtccatggggttgctaggagtcggatacgacttcacttcctcactttcacttttcactttcatgcattggagaaggaaatggcaacccactccagtgttcttgcctggagaatcccagggacggggagcctggtgggctgccatctatggggtcgcacagagtcggatacgactgaagtgacttaacagcagcagcagcaacctggtctctgtcccttctggaaccctgactccggctgcctgtgtgtgcagccgccctcaccaggcagactggccaggcagcccaccaaggcctggctgcccaccgggagcccattagtcaagccgtcctctggcaggattatgccttcgcctcggcgatctcaggcccagctgccaggcccatgtgcaaatttgtactgatttgattagcttgtttagtcatcgctgctgatgagcgcgggctgcggcccccaaatgacattctgctgcctgcaactctgtaatcgcttttggaggggatattatgttaatatctcacacaagagcctccgatcaggcagaacgtcagggcggccaggcccaggccatatggtgcatccgaggtcctcctttgtaatcctgggtaattgaaatcctcttcctcattcggacgtggaaagccttcctcggtgggtagcagagggcccttgggtaatttactcaccgctcctcaggggaacatcattggggggatgatggcagggtggctgggaattcacgccagaggactttaccctttttgagaacaaaaatcccttgtacctacttaagaggaaaactggcaacagtaatagacccaccaattaccgagctcctgtgatgctccaggcactgagataattacatctgctgcctatgacaaactgccagacatgcattacgcccatttcaaagatgagaaaactgaggctcagagcaagcagcttgcccaaggtcagcagcttggagtagaggcaccaggactttccccaggtctggctggctagggctgcagtccgactgggagctggaaggggttttgagattgttgataacccccagacagcttaatgcggtgccttgaaattgtgagtgtcagaaagccctggaggtctcgttaaaattcacaaattgctgggccccgttcccagaagtatgattcagtagatctggggcaggatccgagaatttgcatttctagcaaatccccaggtgccgctgctacccaaggaccccactttgagaaccactggtttaggcaata

SEQ ID NO: 35003 - DNA, 1151 bp, Bovine  19866880874096
taactttaaatctaaaagtaagccaatcggagccaatttgaatattggttttgtcttccagttttggctacacatggtagtctaacaaaatcaaaaatgatatccttgaggtatctcttgatctgtttgcttgcttttttttaatgtcaaaatggagagcaaaggctgacacctgatgagtgttaggaaattaggatatagagtttatatataacatcaaaaataaaatttatacatttgttctttaggagaggaaatgctagttttcccaccagttgtcgttaactctagctttggtaggtttcctggggctgtgaccggataagtaaaagtttaaaaataaataagtgcactcccctcagaaataaatgtacccaacttttacattctaaatttaaaaacctgtttaaaagaaaataaatctagctctgcctactttactttttttttctgatgtggtagtaactttgaggcataatgaaatgatattctgcctctaaacccttaaaattagttataatgctgcttcaatcttgctcatgcatttgtgtttgctttaacatgctctttcctgttaataattgttaacttcctccactgctgttgaaagaacagaaaggggatggggaaaaaaggcaaaaaagatgaaagaaaagaaagagaaaggcaaaagcacttccctgggggaaaccccgcatcaggagagactgatagtgttattgttacgtggttattttaataaaagtattcttatctgttatattatcaacaataatttaattaaaaacccaaaatactctattgtttcatttttcttttaataattctctctctcctctaagaaaatgctgcaggaagtttggatcctcttagtctccagcgaaacaagagaatgaaacttccatgcaacatgatggcaatacaaaaaaggagttcatacatcttgttttcagtgacacgggaatctacaaaacacctatattatagggtcattctctcttttagacctactgttaagttacagactgcacaaaaggacatgccagcgtgaaagaggttgaggaagggggcagaattaacagaaagagtgcacttattctgaggcctgaaaatgagcacttgtagttatccttttagttccagcggaatga

SEQ ID NO: 35004 - DNA, 948 bp, Bovine  19866880905730
acagaaggtaaaactgtggagccacacaccaaccgtaagctgtctatctctagactacttttatgtaaaagagaaataaatatctgccttcttttaagtcactgttttcccaggggactggaagggggagttctgttgtatccgtgaaacagatacggccataactctacctttctaggctagacaggtggtaccctgagaagtaaaattctggacatctgaggtcagagtagatgcatggcggcctcggggtggtgacacgttctcttgactggctcaggctgctgctctccatggccttgctgtcctcctccttttttggccaaagcagtgaaagagatggacataggatggtggggaagggaagctatgactggtcccagcgaggctgggctgccaagtgtcttattctgaaaagggaataggtttcacatggacaagatggaaggactgcttgttccctctggaaagttctattaaaatgaccaacccagacacactttaatattaatgggaaattcctcctgttgtttatgaaatcattttagagttgattttaaaaagagaggagagagagagagaagaaaaaaagccgtttgttagctaaacgaagcccagacaattatttatagatgcatctgagtggcttgttttaacacggagcaactgtctgaaaagactccactttgacaccggtaagcacccctggcactaagaataaatttatgaatgtcttttatgagagtcaacaaactagacaaataaccccacagaccgtccttcatgtcgagaaccagaacaaagacagtcgtattcgtcactcaccccggacgggagtggtgccaagctgcgcgccctccctggggccggatgctcctctccagctaatgtgatttctttgggcactgccactgggcaggcagatgccggtttatttccattcctcca

SEQ ID NO: 35005 - DNA, 1456 bp, Bovine  19866880953672
aaaaaaaaaaaatctgttacagagactattccaatgaatagagtcatgattgggaagcaagagaatgtctttggtcttccctggtgcctcagatggtaaagactatgaaacataccccagcagctgtgtgcagttgagaaagatccctgcagtgcaggagacctgaatttgatccctgggtcaggaagatccccttgagaaggaaatggcaacacattccagtattcttgcctggagaatttcacggacagaggagcttggcaggctacagtccatggggttgcaaagactgagactaatactttcacttcttttttgccccccctcccaggatgatttaactaaaaaaagtcttaaaaaccacctgtgtcatgttagggttcaagctaccagaaatagaatctcccccgctgtcagatgcctctgttctgctcattcacctggcaaagctgtgagtgagtatggagccttcttgcagggggagcggggctgcctggcatgcctgatgggtcactgcagcctgccctggccccctgcatgcaaggtgccactgtctttagacatttgtattttcctttgtgtggaaaggtaattatggcctccataccctgtggctgttaccattttgcatggccctgaatagaggcagaaatctttcataaaattcttttttttcagggaaattgttgggggatggggttgtggtggggatttgagtctgttttcgaagcaaggctggtgcaagtgcagcaacctttcaggatttgcaaaatgcttaatgtgcgccatcaattactgccgaatgcggctgtcatgcaaagtagcttaattggcccacaggtgggttgaatttgaaacccttggattgtaccaatgcaagagagaggaaaacagatttgacagatccaggctggggctctttcgtttacaaacagaggaaaaacatctgaggacagaatgggccttaaatggaaaatggtcaggtcatagaaggacagatcgacggatggatgctggctgagagggaccaaggaaaaatgcagacgtcaggagtttgggattgtatatttaaaaaaatgtaaccatggccatatgggagatattccagacagatgctatatactgagacgtccagggattgaagacgacaattcactctaaagagttagtccatggtgtaactaagacagagctggctgtagacatcatcagttgagttgtgtcaccaagggaaaatatttactcatggagtctagagttaggttcagtaatcagattcccaactttgagctgccaccctcaggaaaccagataaccttggtaaactgcttctttggacctcagtttcctcatctacaaaatgaatgcctgtcacggacagcatggaatgctgtaaaagacatgcctgacatacaattagagctggtccaggtgcaattatattttcaccttccag

SEQ ID NO: 35006 - DNA, 1852 bp, Bovine  19866880990695
catgggattttccaggcaagagtactggagtggggtgccatggtcttctcccatttacattgcttacaagttaaaatgatagtattttgcgtatgttgggttaaataaaatggattactaaaattaatttgacctgattctttaaactctttttttccttatgtgatctaggagtaaattttaaattccacatgtggctggcgcttgtagctcctgttttatttctattagatagcacctttctagatcacactctaagcacacatacttagggaccatggaaaccttgcccaaagggctaagagcccaagtctagaacctgcatagactttcccctgtttgtcctcccaaaggctgagcgagctgcccttgtgcacacctgaaggcccagtggaggccgaagtgcagctattggaggggagagggagtagatggtggggcttagacatgaggctggggtgccctcgtgcaggtacaaggtctatctcagaacaggacagggcccaggatgggggcaggaaccagtcctggggctggggactagctctcctatgtcacagaattctgaggcatctgagatttctcaattccatcttagccttccagattgttaggcagatatatttgtaaggtgtgcggacgggccttattttatttaacagtttgttagcttaatttataattttcaatatttagacctatgatatgtgtcgctatttgtgctctcgccctgggcaagtaaggtaattactacagaactttgtaaaggctgatgcgggatgtctgcagtgcagtggaagcccagaggaggacggtgctctgtctgcttcacagggaccttgagtaacgtcaaatttcagaggaaaaagtcacagcccaaggacctctggtaagtacagtgggaagaacttgaacctgcttatttttccgtgacagaaaaataggaggaatgtgctgggcatctagctactgagctagggatcccagtgagcaacccagccaacctgctttgctcgtctccactgactcacatttgtagtcacggagcatctgagtcctgtttgtcctcccaaaggctgagcgagctgcccttgtgcaaacctgaaggcccagtggaggccaaagtgcagctattggatgggagttcctttctcccaaggaagcatccatctgcttccttgggagaaaaagataattgactaagtactgtgaggacccagtctgggaacttagttcttttaagcctcctgaaaccaacatcacgtggaagatgcaggactgctgggattgggatgccagatcccatgctctgagtttcagtttcttcatcagtataaaatgggcttgacaatacagacaacctcagagacactgaaggttcgcttccagactgccacgataaagcaaatattgcaataagcaagtcgcacagtcaattctaaaggaaatccacactgaatattcattggaaggactgatgctgaagctgaagctccaatattttggccacttgatgtgaagggctgactcactgaaaaagacctgatcctgggaacaattgaaggcgaaaggaaaaagggtcagcagaaggtgatgtggttagatagcagcactgactcaatggacatgaatttgagcaaattccaggagatagtggaagactgaggagcctggcatgctgcggtccatggggtctcaaagagtcagacatgactaagttactgaacaacaacaagatgaatttttgtttgtttgtttttcagagcatataaaagttctatttacgctatgctgtactctattaagcaggcaatagctttctgtctaaaatagcaatttacacactttaaaa

SEQ ID NO: 35007 - DNA, 749 bp, Bovine  19866880998349
ggcggcggcggggccggcgggagcggcggccccatcaacccggcgtcactgcccccgggcgacccgcagctcatcgcgctcatcgtggagcagctcaagagccggggtctgtttgacagcttccgccgggactgcctggccgacgtggacaccaaggtcagcagaggcggcttgggctcacggggggcgggtgggcgtgaggctgctatggctgcagcttcgcatttccaaatcctagagaaaaacaaaaggtacttttcaaatctcagcagcgaggagaccgcttggggcagtataggaagctttctgagggatgtccacgtgcgttcggcttcccgccccatccttgctctgtgctgcttagcccaacagcatctctgaacttggggacccagtacgggttttacaacctcgaccctgtatttcccaagatgagactcctttaagcacaacagtaacaaatctcagtatgttaacaacactggagaaaaccgggtaagtaagcaggaatggtttgaatgcacaaacatcagcctttcttccttttctccagctcagtgatttgcaggcttgagtatgcagttaattaaggtacgttttcgtagaagcagcacccgtattttgtattccatcattggttgaaagattctccgttagatcctaatgccataggtcaaccgactaatactgtttcacttgaccttgcccagattcattttgggttcagtgaagtcaccggtgttaagtgt

SEQ ID NO: 35008 - DNA, 681 bp, Bovine  19866881056779
ccatcatgatgttcttgtttttttctgggccctatgactcagcacacagcgccagatggcttcctgcgtttccagccttattggctggggtgcccaggtcctggtacagtaaactaaaaccgaaaaaacagttacagctaagaacagaaaacgctctcttctctgccctctaatgtgaagaccacaggatccacagctcatgctggttggtccctctatggccttagcttgcattgttcatcccttctggccccaagatacccacactccaccccagcacatccttgatgccttaaagatgacacccaggggtgaacccaggggccaggttccgccaccaccttggttgattgaccttaggcaattttctttgtgagcctcagcgatcagacagggacactgatactgcctgcctctgaagagtgtggggttagggttgccagacaaaatacagagcacccagtgctatggactaaatcctatatctcaccaaaactcctttgctaaatcctactgccctaggtgatggtattaggaagtgggaccactgggaggtacataggtcacacgatcagaggcttcctgaatgcctgagtggtgatgcaagagaccccacggagctccctcatccttcctcccatacaaggacccatctgtaaatccgcagaagggctctctcca

SEQ ID NO: 35009 - DNA, 793 bp, Bovine  19866881082689
tctgtcactgtttccactgtttccccatttatttgccatgaagtgatgagaccgatgccatgatcttagttttctgaatgttgagttttaagccaactttttcactctcctctttcactttcctctttcacttttaaactagttactacttttcaagtcaggtatggagatggcctggctgcctctgggcttcattattttgtctgatttgtctgacagacttagtctgagctcagtcccacatcagtgcactccgttctaaaagcagggctcttttttattctgcttattacctggtaaccattaaattaagaacattagtgaaactctgaacggaaagtagttccataatctctttggtatccggttgagctgatgccagttgctgtactttgggaaagagaaggaggaatcaaccaattagaggaaccttttttaattcttgagaaccagcactgaagcgcagatcttctgaagagcagccatgattaattactcttaatttgtataaagaatctaaaaaaaagtcttaacttccactggctataatatgccaaataataaatgtctgtcatggttaattaaatggagatacttcaattggccacttgatgtctttattgtaaaagatcagaagttgttagcttataatagactttcccaaagtgtaagaaataaagagaagcattgaggagtgtattaagacctggttttgccattagcagttacatggcttaagttggtcacttctctctagatcttggtgtcttcatttaaaagaggaagtgcaggg

SEQ ID NO: 35010 - DNA, 728 bp, Bovine  19866881085373
acaaaaggtccctgcccagttcccaccctgagctgtttcccctgtgaaggcaggagtgcagctccatccgtctctgggtccctagcgtctggtgtgtaaccgggatttgataaggcgcccacttactgaattgggcagtatcacagacggcttctcatctcctcttcatattgagtccaggacagaagtataacttgatcatttcttatcacttttgagatttcagaaccaggctccgccaggttagggaactagctttatgtcccgcagctaacccagagtagagctgagagtcaaagccagtctaccctgttcgtgctccttttgtgttataacgcggcagatttattgagatgtaattcacatactatacagtctgccttttaaagcatacaagttaatggttttcagtttagtcacagagttgtgaaaacatcagaacaatcaattttagaacattttagtcacccccccccacccaacaacaactgaattcctacagccagggcccagccttgtaggaggacttgaacttcagaagttggctgcagttgtaaatttggagctgaggggttctgtgtgggatggctgcctctctcttggcatagcaataatgagcttttgctttttggcattttaaatgtatattcctgacttctctgaattaagaccctgattctctactgcgaatctcaaaacaacctacggacaaataagccaaattccaa

SEQ ID NO: 35011 - DNA, 1297 bp, Bovine  19866881092697
ccattccccacccatgcagttagacacacaaggggccacttggcttttccctccaatgacaggtgaattatgcctcgattcggtaaaataagagggctcaggtctttcctggattctatctaaaacattatactgcttcactgacgtatcactgccagttctcttcctggtaacaagttaaagacgcttgagtttggtggggatccttcgtggatatgtttggttcttttcttgtgtcttttggtgttgggggtggggctagagaaatgttgaaaatagtctttttaaaaatggtgacatctgcttgacctgcattgacattttgatggtgttaaggccctgcttactgaaatagaacgccaatgaaaaggatgaagcaggcggaggctgaatttctggcatggtattcacttgactcaccacactctacttcccacctatccacaagcaggtttttacttgacacttagtcagattgtatgcaatagaaaatactgtgtgtttgggcacacactggatttcaatgctgctgttcatttttaacttctttgagacaaactgtacttgtccaactctggtcaccataatgaatcacagtgacacttttttttcccccagccagccaacgacacctgatttgactagaaaaagattcgaagttaagaaacaccaaaaaagactcaggcatgccaaaacaaaatgttctctaataaaagaggctggatgagtgctgccagataaggagttcatagtggggcacaaatgtgcgtgttctgatttctcatttatctgaagcttgtggtccctattctgagcatggggtgggagtatgtgctgacggaagttggcaaaggacatttttaaaggagagaagtgataggctttcccagaaaggcagacagcatcccacagaaggccgattcagagcacaggttttgtgggtgacgtggtatttgtggcactcatgagacataagacttgatctgagccagagaggagcataatcaaaatagctttgcaagctgatagttcatgctgcagactaatctcctctttttctcctggggtgggaacagggggagaaggggagaaggaactcaactgggaatgggacaggggttagaggttaggcaagtacgtcgagtcccagttaagttcagtgcagaagtgtggtaacaggcgaggataagactcggccagggcaggaacaggaacccttgtagaacgccaaagtggggttcgaaggctgatgccagcaaacataataacatgtaaagcagggacccccaaaacccaa

SEQ ID NO: 35012 - DNA, 2518 bp, Bovine  19866881113848
gttgctgggccgtcgtcgtcgccgccgctttaccccggtcccgcagtccccgctgtcgtagctgcgaactccgcctggctcttcttcttctctccttcttcctcctcttcctcttctgctgtcgccgccgccgccgccgccgccgctgctgctgctgccgccgccgccgcctcccggtgcccgggtccagcagccgcggctgagtccttctcctcaggacctagccgagtgaaatgacaaccagctggaaagaccgagagacacttccggttcgaaaagggaggggtgggttagggcagacaccccgcccacctgcctaaaggccaataagctgctagaattcagataaggccacgcccacaacccaggtcccctcccaggaaggtcgaaaagttacgtcgagagacgccccttccgtctgcgcctcgcccagtgaggcctggagcctggaactcgctctactacccagagggagcccagcgagtcgccatctttagtgtgggcaaaggactactgcgctgtttatttcgcttaaccgcgctctgcaggtggagcgtacagggacgcgcggaagagaacggatttccctagtactgtgaaaaagagtccaggagtaggagatcggagtggctacccatgaaaccgcggatgaacaggaggactgcccagagtaaacgtggttccccaggcatctcttgctttggctcgagctccgccccagagggatctggaagaggaggcgggttttactagctgctgtaaggtgtctagaattgcgtatgtgcttgtcctgaaaatggatcttaaacgggactctcccttcaccttccatccccccacccccactcctgcttggtttaggctcccgtccggtgcagtgtttcaggcacaaaaatacagctcctgtcggcgtccgtggccgagccctccttgtccctatccgctctaatgtaccctacccgcttattagggggacatttccgaaacgaagaatcttaaccaggatcctcacctgttctgctctctctacgactgcccactacctccttgaaaaagaccaaactttttatcctgatattcaagggttttgcactctgggggcagtatatcttaacatctcatctcctccaaacgtcccacaccaagctcctccaaatataatctcaggtcctttttaccttccgtttcctctctcctccaccaggtaaactcttatttagttttaggaatcggttcaaaagctaccaactctgtcttctgaaattcctcttgaatgaatatccatggcccagtatatttctcatgcttgtcaccctctttgtaatggtaacttatgtctcctggacctgtggtcacctgtgggctctttgaggagaggaccttgtattgatagataggaatcattagcgaatggatgctgaaaaaaaagagtgaacaaaccaaccagaatgatatctttcctgaatcctcttttcaggtctgccatttggtttggggctaatgtctctcaaactttcatcatttaggttattcctttgctactcaagggttccttgtcttgttcatatttgtacatgaccaccatcaggacctagattaacgccttgctctcagcaaaggttctaaatatgttgaatagtgagtgttttcctttagtagaaaatgaaaaatgaagaaatcagagtagatccacaagtgactatggcaaaagtagtgagtaaaaaggagagattacagacttttaagaaagatctcatgaaaagaaatgacttccacttcctttccctagcctttcctcaatggccccaacttctgctgcctcagtttatcaatcctcccatacttccatgtagaacacccgtttgggatcttagtgattttatttatttatttattgtcttatgtcctgaacatgagtctttgtaactcttctttgagttccttgagtgatagggattgggtcttactctgttgtttattccccaaaactggtcataccttgagactgagctggtttaattaggtgtcctttcctccagaatggtttccctgactctcctttttgtagcatcttgtagattcttctcatttggttactgctggttgtcagttagtttcttttcacaggcagagattttgtctggtttatctgtgtgtcgctagtggccatcagagtatttggcacagagtggactcagaatacgtttattgaatgaatgaatgaatgttcagtgttcagtagatggttgagaatcttttggggctgccaattcttagtggctgaaatggctgccatgcttgaaggaaagagggttatctttagaaccaaactgattatttgaatcccagatcttctactgcctgattgtagagctctgggcaggaatcacctctacaataccctggttccttatcaataaaatatgaatgatagttcctccctggctagaaagtagtaaattacagtgaagtgctgggctcataggaggttttcaaaaatgtcagtttcttatgacat

SEQ ID NO: 35013 - DNA, 826 bp, Bovine  19866881276257
aaatctatttggggagtagttaggtgaaaggtgaccccctacagaaatgggagcaaatgacatccggtgaggacaaacccctctttggaacccggtttcctcctggctgcatcagaacatctgccacattatatcttacgaacagagaaactgagacagaaagatgtaacgagacctgccgcaggccacggaatgctccacaaatatcaaagttggcagcagcgtcttcaccgtctcagccagggagcctgcttcacgcagcacacccgctccagagaacagggagccggaaggtgggagcggatgtgctcggctgaggtggcgaggccaccaccaaactgcgtgcatggcttccctggggacactcatttcaccccaccactttcaggggagcaagcacccctctgatgctctgccattgctctccaggtgtggggagaggaaggaacaaagccagggatactccatcatttccatccaccgctaatcctaaggcgcttcttactgccaccacgttcaccatctcctgcctgaggaagaagctgcaggtgtggtggcattgcgggagagacccctgaatgaggaccagaacttctccatgtgacccgctgaagatgcgctgatgcgaagccagcgtggagaccataattcctgaaaatgctagtcgaagcgcctcttaagttggctagtgactcaagcgtataattactcagaacatctttgcccattaaactgcccccactttttttttcaaaatctggctgctcctcccaaaatgttttgactagaaatttttgaaatgtcttgaatatatttatggtgaagt

SEQ ID NO: 35014 - DNA, 1894 bp, Bovine  19866881368158
taaaaacctacagaaacattcagcatggtaatatatgtattaggacatgcatgtgaaggaaagaaaatcacttatgattaagcaattcatgtggcattgttacataaattgtatccagcttaactgtttgagaatccagaacttccaattactttaataaacatactagattacatctaattttgctctgaccacaacatcaactgatgtagttttaaatatggtttaaattatgaattgttttccaggaatgaaataatgacatcaaggctataactcaagggaagagtttgctaaatgcattaaattggactgcagcatcatgaaaacgaagtgactgtatgaagtaacacagaatgtacactataatatagttaaaatgcttttctccatctatatggatgagttttgtgacccggctttcctggaggctcagacagtaaagaatccatctgcaatgcaggatacctgggtttgatctctgagttgggaagatcccctggaaaagggaagatcccctggagaagggaagatcacctggaggaggaaatggatacccactccagtattctgacctggagaattccatggacagaggagcctggcaggctacagtccatggagtatcgaagagttggacaagactgaacaactttcactcacttactcgctcattcaaattcagatttaacaaaaatatttcagatttaagagacaaacatgtttccttggctcaggaagctcagtcaacattcactttctgcactcctccacacatagctacacctgcggtctattctacactcagtgctttacaatgctctgtacttttaattatgatgaacagtgatacaatggtagcctcgaatctacagtgctatgcactgaatgtgacaatgaggaaaactactggtctaatgtgatccaagagaaataaagtattagagaagccagctctctttaatacaatgaaaattgtgtttacttactttctctagacaactgttggcatttcagcctaagtctatatttctcattttcttcaagcatttttgaaatgattttgtacactccattccatactaaaaccttcaaaagataagcacagttaaggaacactaagcagagaatgtggactacagtgtgatgcagacaactagaagtaagtcaaccgtgatgactgaaagtcactcagtcgtgtccgactctttgcaaccccatggactatacagtccatggaattctctaggccagaatactggagtgggtagcctttcccttctccaggggatcttcccaacacagggatcgaacccaggtctcccgcattgcaggtggatgctttatcagctgagccacaagggaagccccaagtcaactgtggtgcatgtcaatttgatatcattacaaagcactcagagatctaaaaattaaacaaaattgctttcccatattcactgaattctctggtatctttttctcacttcctagtatttcctctctgtagtatttaaactaactgtcctggggacttccctggtggtctaatggttaagactccacaggaggcggtttgttccttggttggggaactaagatcatacatgctgcatgccatagccaaaaaattaaaaataaataattggggaaatttataataaataaataaactttcctggatgaaggcaaggtctttcaaaggcaatgtccagtaagtcctatggtttcaacatactcaattttgttttgaaaggtagtaaaaataataatttctattcctatgtataaaccactgggccatgatatgattttttagtgtattttattattctagttaatacttaaacatttctcctaggacataccaaagcaaacttaccagagagcatgaata

SEQ ID NO: 35015 - DNA, 862 bp, Bovine  19866881428538
aattattttagatatatgctttatgggcttccctggtagctcagctggtaaagaatccggctgcaattccagagaccccagttcaattcctgggtcgggaagatcccctggagaaggaataggctaccccactccagtattcttgggcttcagtagtggctcagctggtaacgaatcccacctgcaatgcaggagacctgggttcgatccctgggttgggaagatcccctggagaagggaacggctacccactccagtattctggcctggagaatttcatggactatacagtccatggggttgcaaagagtcggacacaactgagcaactttcactttcatacgatttatagaatttcctatgtcacattggcttgtgtttatactagcttgctatactacttcaaagaatgttgacaagatataatacagatatgagaggattgtttaaattgccttacagaagggcagagattgaatgtaattcagtttctgtatttcacaaaccctgtttattatttataaaaatgcaaaaatgaataacaaaagataccacacatatatatgatggtctgacaggtgctcagtaaataataattttcttccttcctcaaaagtaacctcatatgtatatattcttaggctgatcttcaacagttactttcagctcttcattactactcccaggataacaactgtagaccactttatagagtttacaataggttttcatattgtctttttcatgaaaggatctttcagcatgctctttcctgtagcaactatgaaccatattacatacattttcagcaaggactatatctacatttctccgggtaattatgccctcccttttctttccg

SEQ ID NO: 35016 - DNA, 1167 bp, Bovine  19866882041110
ccttcttccccggaagctgtgtgctgcaatgaagaggcgtcaggcagcacccgtgggcctgacctgtgctcacggaagctccaggggcagcagagaagggcaaggagggacatggcccatggcaggtcagagataagacaagtgggggccgggtattggggcctggggagttgttacattcacaacagcagtaggaatgtcagcctggggactttgtgaaagagatcctgtcctgaaggaagtccttgaaggccgagaccaagataggtactggccacgtggaaagcttggacttgtcatcatagatggtccagcagaagcctttccagaaaacctgggtgcgaaactgtcaacctcaaacatctgtgagactcagagaggggaacaccagtctttcaacacaccagaccgttgagaattttcctatcccttcactttccttctctgtccccacgtgatccttacagggaccagaaatcaggttagtcagctaggggaggagcagatagacctaacccaaaagatcctgctggcaccaggccctggcagaaaaaggagagaagtaatgaattaaggcagttgccctgacttgaagtgaccacaggagctttttgttacctaacagtgattagaaaactcataagactgctcataatctgattctagagtgaggaacagattgcataccctgaatatgtttaaaggaaaattggagacaaaaatcaagttacttttataagaatcctgcttgttcaatgtattagatacgttgtttttacttagctagcactaaccatgggctaaggactgtgcaaaacactttctattttcagactaacccacaatgaagtaggtcccattataatgtccattttgcaggggaagaaacaggttcaggaaagttagataatctgatgcaggttgcaggatggatggggaggagccagggctgggagccaggcagtcaggctctagagtgccatcacgccttcccacctccctgtctcaggaggcagatcagacaaaggctaaggttgtccaagtatctgcagctaaaaatacttcaagagttcacaggaattttcacaaatccttttggggaaggacttcaaggggacgtgatgtttgggttagaatgactggttttaaatatcaagacccactcaa

SEQ ID NO: 35017 - DNA, 809 bp, Bovine  19866880409855
gaggggggttcgggatggggaacgcatgtatacctgtggtggattcattttgatatttggcaaaactaatacaattatgtaaagtttaaaaataaaataaaattagaaaaaaataaataaaataaaatatgtaggtgaggaaaattgaacaagtgaccaatatgtttaatttaggactttgatataactaagaagtaagtcttaatgtttcaccagttttatagaacttatcttaagaaaaaatgtattcatgaaagaaggatgctcagatgtgtaaaaggggaaccaaagatcaagactttgaccaagtgtttctagcacaattttatagaagaaaagactctgatacttccagaaccgtagtctccagggaaaaaccttctacttagggtcacagatagttcattatcagtttccgtggctcagatgtcaaattatttagggctcttcttcaatatcctttgagaacaactctaatcagtatcctgaatattattaaagttatagcataagcagtgttgacagtggcagttgaaaggctgagaacatgcgggatttgaattaatctccaaaatggattttgtcactgatttaagtgatcacgtgactgagcaactaaacaacaacgctgattaagtaaggttgatgattcagaggtaggcctaagccatgctttcagcagatcataaaacgttatttttttaaatatttacttgactaaatctcagttagaaggaactaactacctgacttattgacgattactaaaatgatagccactccggaagaagttaattttctaaatttta

SEQ ID NO: 35018 - DNA, 2670 bp, Bovine  19866880604340
atgagattgaaattaataatcatgtattaagattttgtttgatgacttactaagtgaaaaaagtgacctttacctgttggaaaaaattggggtgtcataatttaggatggaaaattttccttatccttgataaaagtagcaatcaatttagatagaaggcaattcagaagagtaaaaagatgatttctaattcttgttaaatgacttcatttatttcttcattcctttggtattttgagtatctttataatagctgcttaaaatatttgctagataattccaacatctgtgtcacgtcagcacagcttctgttgattgtctttctccatgcaagtccaaattctcatggctattcgtatgctgaatagttttggattgtcttctggacatttttaataaatattttgttaggagattcttgtttaaatatctgacgcatatccacatttttggtttgagcagacaatcactttggctaggttcaggccttctgtgggctctggttccagttcagttttcagagcccttgtagtgttatttggatatttgttgcaagtgaatcaaccaacggccaatctggaatgtgggcaatgttctgctatgaagagtttaggtctcagtgtctttggtacgttagagccacgtgtaggcatgcacagctcatgtgtctgaggacaggggaaatacaggaatttgctaccctctaatcacatggtggtggttttttctggtgaccagacactcccttgaaactatacagaaccttcacaatgagtgatcactagcataacaaagttacttctatgactcaagaaatggacaaaattataatgatttttgaagctccttgccaggaatcagaggtaaagatcaaatatatctattgcaacacagttttcagtcacccaggtggtgctagtggtaaagaatccccctgccaatgcaggagatgcaagagatgcaggttcaatccctgggtggggaagatcccctgaggtaggcaatggcaccctgccccagtattcttgcctgaaaaattccatgggtagaggagcctggtaggctatagcccacagcactgcagagggtcacatatggttaagcacagaaaacaaaagcaataagttaagcacagtttgaaaagtatcagaacttagatatggcagaaatattagaatcatcacactggaaactttttaaaaactctgactgacatgctaatgactccaatgcaaaatatagacaccatgaagaataaataagtagtgtaaggagaacatagaaattataagaaaggaaaaaagaaatgtcagagaatcaaaacacttaccaaaatagagtgtctgatgatgtcattaatacatggctgaggagagaatctctgagtttaggacatagcaacagaaacatccaaaactgaaatgttaaaacaaaacaacagaaaaaacagaaaagaaaacccaaaacaatatccaagagctgtgggataactactaaaagtgtaacatgtaatgggcacaccaaaaggagaagaaagaagtagaagcaatattttaaggaacggtgactgagaatttaccccaaattaatatcagactctaaagcacagatctaggaagcttggagaaaaccaagcagcataaaactgcgcgcacacacaacatcaaatacatctgggtataccatagtcaaattgcagaaagccaaacaaaaattgagaaaaaatttggaaagaagcaagaagaaaaaaaattaccttgccaccttttgtttccaaagaagccaggtaaacaagcagagtggagtgaaatgttcaaattgttgagacaaaaagaaattatcaacataaaattatatattctctgaaatcctgttcacagtgaaggggaaataaagattttttcctggaaaaaaatcttcagggaatttgtagcccaggagaccttccttgtaagaatgttaaaataaggaaagaatagaaagagggaaggaaagtaatataggtcaaaaactaggacctactttgaggaataaatgagaaaattttaaatgtatctttcctattcttagttgatcacactggtaacagcttgttcaaaataatgactgtattagtttcttgtagtttatgcataagtggaatgaatgacagtaacaatgtaagggacaagagtataattaggattattttgttgttataagatattgcactattcttttgaggtttacagtattaattgaaagcatatttgagctagttgtaattttgtattacaagcttcagggcaatcactaaaaatatttttttaaaaagaaagaagtgcaatggatacaagataggagagaaaatgcaataatctaagctacccaactaaaactacataaggctgaaaaaatagaagacaaaatggaaacaaagaacaatagcaacaaatagaaaacattaacatacatggcagatattaattcatctgtttaaataatcatcttcatgtcaatggtttaaatataccagctaaaagaaattgacagagtgaaacaaaaacaagatccaattttgtattttctataaaaaatccactttaaagcatgaagatacatgtagtcaaaaaaagaaaaaggaaacgaatgggagaaagatattccttgtgaatactaatcaaaagaaag

SEQ ID NO: 35019 - DNA, 1823 bp, Bovine  19866880654251
tgcgacccaattaatcgcagcacgccaagtctccctgtccatcaccaactcctggagttcactcactagacagcatattaaaaagcagagacattactttgccaacaaaggtccatctagtcaagcctatggcttttccagtagtcatgtgtgaatgtgagagttggactataaagaaagctgaacactgaagaattgatgcttttgaattgcagttttggagaagactcttaagggtcccttgaactgcaaggagatccaaccagtccatcctaaaggaaatcagtcctgaatattcattggaaggactcacgttgaagctgaaactccaatactttgtccacctgatgtgaagagctgactcatttgaaagaccctgatgctgggaaagattgaaggtgggaggagaaggggacaacagaggatgagatggttggatggcatcaccgactcaatgggcatgagtctgagtaaactccaggagttggtgatggacagggagggcctggcatgctgcggcccatggggtcacaaagagtcggatatggctgagcaactgatcagaactgaaactgcaaaagtgtaattctaaaatgacacaattacataagttggttaaaaggagatatttaataataaatcttgttcatgctcattcgctccagtcttgtctgactctgtgtgaccccaccgactgtagctcactaggtttctctatccatgggatttcccaggcgagaatcctggagtggattgccattcctttctccagaggatctttctgacccaggggtcaaacccacatttcttatgtttcctgcattgcagacggtttctttaacactgggccactgggaagcccaataaatcttgcaaaggggctgcataataaatagacaatataggcaacatcttactttcaatgttggagtaacttttcaatttgccaggttttaagaaaactcatttttcactaaaatctcagaattttttgtactcaaataaagatgtaactcccacacatctgtttcctgtacatgtttctcttgatttcatcacaaaagctatgcaatttataggaagttaattgaacttcttttcttagaaacaggaagttacacatttcaagggtattttttaaaggtaatggaagtttacaatttcaatcaaatcttaagaaaaagaggtaactaaggtcatagcttgatactctaaatataacttattataatgagtctggtttataacacttctataggaaaaccctaatacaaaacataggtcaaaaaagcaaacaactgagttaattaaaaaggataaaatgagaatattaataaggagtagaaatatagaacctgatgtacctttaaattcagtgatgcctatatatatatattttttttttttctctttaaatgtttgtttctggaggagcacaaatgagattgtaaatttcttttagtaacagcagaatcactatttcatgtttcttgtcacagctatgtgagttaacaaatacaatttggttattcctctataatttaatccacttttgtgtctaccttatatctgaaactgaatagatctatctagctggagaataacacaaagatttgtttaaacgtctttttttaaagtatatgtaactctagattttttttctttcccgcactatgtgacatgtgggatcttagttccttgaccagggattgaacccacatcccccacattggaatgcagagtcttggccattggactgccaggggggttcctataactctagatttctttattttttccctccctccatctctcctctctct

SEQ ID NO: 35020 - DNA, 1249 bp, Bovine  19866880677137
tgcagatgagccatgactcaagtactcaaaagcctcacagggctacctattcagaagtaagagttacaggatctaagcctaaatttgttattcaaagagatgaagttttaaaatatataagcacatcttttagttacagaatagctactaaatattcatcccctaactctcatttccatagttccaaacataatttttaaaaaaatagatcagtttctaatattacatcccagctcaagccttgctttttaatagccttgctttttaatttagttttctaaaatcagaatgcatttctttttctccaaaaaaaaaaaaaaaaaaatggagaaataaagactctaggctatttagagatttgcagagtctgggtgtaattctgactaagaagagatggtatgcatgtgggagtcctgagaggtgaaccgagttaagaattgtagaaatattaatatcttttctcaggcataactcactgattagatatactatatttcctaggtccttgtccccaagactggctctggcatgaagaaaactgttaccaattttcctctggctcttttaattgggaaaaaagccaggagaactgcttgtctttggatgcccacttgctgaagattaatagcacagatgaactggtgagtgttcaacagatgtatgggatgtgtgtcgggctggaatattgggtcataggtaagtagatcttgtttagaccctcagtagaggagtgcttgcttaagaatcagaacatgtacatgatttctagccttgtgtggccactggatatgtgcatgaccttggatggacaggttactaagcatttctaggctccactagacatcgctgtaaagccatggagaagatgtcaaagttctttttgagttctttagttttgtgactctaatctaaaaagtccacatccactcattcatcgacacagaaatgttactccccacaggaattcatccagcaaacaattgcccattccagtttccccttctggatggggttgtcaatgaggaaacccaattactcgtggctttgggaagatggtactcctttgacgccccactttgtaagtttgatgctcttttttagttttggttatttatttatttctatctttgactgcaccgggtcttttttgctttgtgtaggctttccctagttgtcacgcgcatgggctgctccctcatatgatgtgtgggcttctcactgcaggggcttctcttattgccaggcatgg

SEQ ID NO: 35021 - DNA, 1141 bp, Bovine  19866880686280
taaaagtttatgcgcaaatataaatgaaggctattgctaagcaacagtcataaacaggcatatcaaaggaactgtagctgaaaatattatcaccaaataaatcatgatcccttcatgttaaaagttctataaataaatcatatgaaagtgatttaaatatatataaatatacaaagtacatgagagaaaattactatataactttcataataatatttccaaccactgaatatagtgttcttcagtggtatatctgaatcctcagtatatgctggaggtggaggaaaagaagagaataagaaaaattaacagagtttatgccaggttacactggcttggccaaataaattacctcattttctgcctaaactaagccatcaagaaaggatgaaaaagattattttagtagatgagagagactgcagagtttcattcatcataatcatagatttcaggaagtggaaaggaattaagatgcaactagaaagatgttcttccccagtggctcagcgggtaaagaatccacctgcaatgcaggaggagacccgagttcaatccccgggtctggaagatcccctagagaaggatatggcaacccactccagtcttcttgcctagaaaatcccatggacagaggaaccctggcagtctaaagtccttggggtcgcaaagagtcggacacgactgagcatgatgcacagagacaagtttacagaaagatgttaagagtttgcagacttagttgagtattaattttaattaaataactctgttgataaactactctgtgccatgaccctgctgaaacaatgataggtaaacaatggtcatactgcttgaggaatttaattcaaagtcaataacaaatgtaagagaaaagggaacaaccacagcattttaatagtgaatttgaattgtatgtacctatcaataaatgccaattttattttcatatttttcttgaccactctatgttagggttataaacttccagaaggcaagatatttatttgcagattatggaaatgatttaattgcatggttttcaatcaaaagttttgtcactttcacagaaaggcaggaagtgcaattttcgttcctctggtatggcaccaatattgctccctcttacataagccaa

SEQ ID NO: 35022 - DNA, 1646 bp, Bovine  19866880731589
ttttctaaattttatgtgtaagtgtacgagtgtgtgttcagttgtacccgactctttgtgaacccatggactgcatgcagctcaccaggctcctctgtctgtagaattctccaggcaagaatactggagacacacaaaaatttgaatgattggataaaacataaaatgcattttttgtttaatcttacctactcatctcactcattacattttgacatttgactgtatattttcctttttttctatttcttggaacctcagtattttccacatactattaatgtaatgtgggcttaccaggtggcattagtggtaaagaatcagcctacaatgcaagagatgcagaagaagtgagttccatcgctgagtcaggaagattcccctggaggggggattggcaacccactccagtattcttgcctggagaatcccatggacagaggagtctggcgggctacagtccatacagtcacaaagagttggacaccactaaagtgacttagcattgatgtatgtataaatgacattgaactaaagagcagatcaagagtatctctatcctattttttatgaaatcctgactataatttacagagaaatatgcgttgctgtgggttttttgttttgctgttgttgttttgaggaactggtgtatacattgttatctgtacagtgaaaattgattttatatcaattacctgaactgagagacttctgcattaaggtttggcaatatgtcatctgtaggttggggtttctcttccactgtgtgaagttgagcagtgctctctcctgttggatgagtttttcttgctgcttcattatagtagtggacatctgaaacacttcaaacaataacaaccattcctgataaaatactgacacataacaaaataagccttcaatctagactgaagagaactacatattactcattatatttgtgattaaaagctacaaaggatatctatctaggtgttctgccctttttttttattgtgttgttcgcttttttatattgagctacatgagctattagtatattttgaagatcaatcctcttattggttgcttgatttgaaaatattttctcccatccttagggttgtcttttagtctcatttatgtatttctttgctttgcaaaatcttttaagtctcctctgtttattttttttttttcattactctagaaggtgggttaaaaaagatcttgtgatttatgtcaaagagtgttcttgcctatgtcttcctttaagttttacattgtccagccttacatttatgtctttaatccattttgagtttatttttgtgtatggtgttagagaatgctcttatttcattcttttacatatagttgtctggttttcccagtgccactttttgaagaggctgtcttttttctaatgtatatttttgaccataggttcatgggtttatctctgggctttctatccattgacctatatttctgtttttgtgcccataccatactgtattgatgactgaagctttgcagtatagtctgaagtcagggagtctgattcctccagctccgttttactttctcaagcttgctttggctacctagggtcttttgtatttccatacaaattgtaattttttctaatcatggaaaaatgc

SEQ ID NO: 35023 - DNA, 1898 bp, Bovine  19866880781361
ggaagcccactggatacccttacaatctcacaattttgtacagatttgtttgttgaggacacatgaaactggagtgagctccatacatatgtgctggggtgctgacactctgaatctaaaccccgagattcctccatatacatgacgttgggcaaggcagcaaatagaatctttggttgtgttttgattattgttttgttgtgtcctgcttgtttttttccatcagatagaaatagtatggtaggaatatgggtcataaagatactgcagctccatctttgtcagtctgcaataatagcacagaacaggggatatgcttagttgctcagtcctgtccaactctttgtgatcccatggactatagcccgccaggctcctccagccatgggaattcttcaggcaagaatactggactgggttgccatgccctcctctgaacaggggatacgatttgcacaaaggagagaaagatgtatattctaaaggtctcatttggagtgaaattctagaagtaaaggtagtgtgagcataaagggacagtatagatgtaatcttgtttcaaaagctagagtttccttgtgtttatttgtaattattgctaatgggaaagtaaactataatgggatggaaaatgcagtggctatttcaaatcacaagaaataatatagaaatagaaatatatcctagtatatgtatataatacacttttatatgtatcatgtacatataatatatgtaattttttttaatctttgatgttattttgggatttgttcctggaaatgagctaggattaatataatctgtgttatgctacttcaaatagaaaattaaagttatttgaggaacttatttattaataatcgttagttattaatccaagtggtgatgctacatttttttcccgaagataatgtattcagtttacaagtttgtctttgatctctagtctctcaacagtcatcttgtgttaggacctggcagtcattcagggcttcatcataaaatttctggaaaatggctgagggaaatgtcacttggagatgatgctgagcttaaggtatcacagatgaggttaatttctgattttggtgattatgaaaaatatttgaggaggacagcctcaaaatttattacttgtccagttttcctgaagaatctaatggaattgcattactttattcatactagttgctgtggaagggaggtgctaggtctggaagaaaaggacaacaaatactccagctgtgagaaactaggaaagcctgagagaaatcaggcagtgtgtggcattgcacatttgtccataaaaataagtaacatggacacttgccattctaaataataattaaaattcattttagacaacacagaccataggagaagtgatatgttggaaaagtgatttttttttctgggactgtgtttcaaatgtttgacttgccaagtgtaattctttattttctctttcaggtttacaagaaatacaagtgtcataaatgatcagatgtattgtggatatgtatattatgcaaacttttattatattaagtgcactgaaactaaaaatattatatgtgagaagcttgcccaaccagtgaagactgagagtatactaatgagtgaaatattggatggaagaaaatagttagtgcaattattttgttccaagtattatcttgcacttaaaggacactttggggaccatacatcttattgaccacatctatagaataaagatacagtacgactacatttctgcctccctcctaacaatttacattttcaaactttcttctttttcttcatttgctgagtgaatggagcctaacgtcatagttatattttatgtttcattcacttaatccagatactgcgaatataaatacagtattttg

SEQ ID NO: 35024 - DNA, 2106 bp, Bovine  19866880785309
ttgtaaggaatttaccaggctttaagtttgttcagctgcaaagtgagcactaagcactttgccccgcctgtggcattgtgctagggttcttatctcacatacaccactcaacctcagttcacttcaagcacagtccttgatctcactcagctccagagatgaataaccaaggagcaacctatgcagaactgaagggagtcaagaactcaaagaggcagaaaagaaaacctaaggtttctaaaagttccatttcaatgactgagcaggaattaacatatgtagaattaaatcttcaaaatgctcctcagaatcttcatgggaacgacaggaatcaccgctccaaaggtaaacacttactagacacacatggagctgttctaggaagtgcagtggggtgcagaggtgtggaggaagagtaggggataagctcgcgtatttttcactttgaggaacagaacttaaagctggatatgggattctgatgtgaaatcggaggattacttttattctggcattactataatttgaagtctttgatcaacaactcatgtagtcttatatttgctgaaaacacaatggtatattctgagagaaagactacagtggtcaaaatgggttggggtccaagtttatatccataattctgtgttcatgtgggttcttgtgtatgtaaactctgaacaactgtccccatcactgctttctcagtttccttttctgtccctgcaggttcaccagtcacctccagagaagttcattgctgggatcctgggaatcatctgccttgtcttgatgtccactgtggtgagaatgatcgttgttactccctgtaagtacatttttgaaaaactgtaagggaacttatcactttactgagggtcagtgctgctaaacatttcataatattatagaatgtacctatcattaaaatgcatgcaattagaacaaatgcagtatgtctaatttgtcagaaatatacaacacaggagaattacagagagcatgtatatgtatattctgatttcataactcaaaagcatgctttaggaggtttaaagatctttttgaaaaatacaaattaattcttgagattagttaaagcaaatactgtaagacgtggtgaagtttgttccgttaggtttttgaaatattttttccatcaagtcttcattacctaattaatttttcttgctaaatcagttttatttcagattactctatttctaaacaataaactgaattctcaagctcataatctaaaatcattatgattcatttaaagcaatattaactttttaatgattaattttgtagctactgtaatacgggaacagaattactcctctcttataacaaggctccagaaaggtacataatgattttcaaagttgtaatatgaatacaattcatttttgtctctatcttaggctagtgaaaataagaatagatttggggatagaacataattcataaaatcaggcaataaacattcataaataaatgattatagggagagtgcttctccctatgcaataatatgatctccatatccattgttggcaattggctgtaatttcgtcctgctataatatgaataagagacaaataattttgttattctaaaagagaagtttcatttcttgattttcacgacatgtaaagagtagatatttctatgtgtttcctttatatggggacatgtattaaagacagaccctctctatgaatgcatgaatgagatttgttttatatgtaccaggcttgaggatgcatagatatgttattttatatatatatatatatatatatgtgtgtgtgtgtgtatacatatgtttatatctatgcatatatgtaagttaatttttattttccaaattcaaattgtttttgaatactaattcataatctttcttcagaatgtcattgtggtcattgtccaaaagactggattacatattccaacaactgctattatactagtttggaaaaaaaatcgtggaatgagagtttgatatcctgtgctactaagaattctaccctgctttatatagataagaagaggaaaggtaagctattaaagtttccaacacttgctaaaggcttcat

SEQ ID NO: 35025 - DNA, 814 bp, Bovine  19866881005091
tagcttatctaatactcacatattagaatttaaaaaggaaccctttatccacttccagctcttccctgataatgtaaaatttaatccaatccaaaacagaattccttctttgtttatcaggttttgcatgagtctctgtaaatgaaacagaagaaatgactgagtattgaatccctttatctattgctggtttgcattcttctattcatcctctgaaacccagttcaagtattactttctctatgatgcctttcctatacccattggagttaattattccttacttgtaatatttctattccgttcatttatatacccaaatatttatatttatatttttgtattcattaaataatatttatttttcttatatgtccatttagtctctcagattgtgagctccttgaagtcaaggttaatacttctatctgcatagaaccttcaagactagagcacaaaaatcttgatatggttagaagccagtgctgaattgtattaaaatattttacttattaattatttaccaattcttcctgatcttgaataagcagtagactggattctcttgtggaacagtcagctagactatcattccaaggtttggaagtttcactaaaatataagcatttatctcggattcgtttccagtgcattggacacgttaacagaactggtctctctaaagtaagataagaagagggaaaataaaaataaaataagaaagaggaagaaaagaaatgaatgttatatttctaacctgtccccaccctactaacactaataacacatacacaattcagttcagttcagtcgc

SEQ ID NO: 35026 - DNA, 1547 bp, Bovine  19866881355616
cactagtgtgttgatgaaacaattggttagcaaagccaagctgtgtaattcttcacttaaacaaacattcacagttcacactcatatttttgctaaaacagtggtggaatggattcttgatttatagcaattagaagtcattatttccaatagttcgtaacctattttttaaatttagttctgacttgtatttatgaaaacatcatggcacaagggaatgttgcataaaataacttcttgatactgattagagaaaaagcatgaaacattcaattctggaatgatgctttttcatatttatccctccctgccaatttccttaaagcttgaaaacaatggccaagtaatgaagagtgaattcaagaatgaccatgttcttttctacctggaaaatgtaagttgacaataatttttttatccacggctttctttttcttctgagggtaactgaatgcttcaaattctcctaaatatacatgatagggtttgtcaaaactatgtgagatgttaaaggtgatcagtgtacttccaccccactaattatcttttccctcttaaatactatgctatttcatacataccttggctaactggatgattctcaagtttagaagcatcatttccccattcttttattcctcacagcatctaacatagtctagtcaaagatgtacaattcttttataatttgacttgaactccagcagaggctgggatgagtttcagactcatcctttctgtgtatacatcattaatatccacacaaatgcctacatttttgtaacgttttcaactttcttgtacttcaatataatcggtgaaacaacattttacacaatttaatgttacttaactcattattttggagaaggcaatggcaccccactccagtactcttgcgtggaaaatcccaaggagcctggtgggctgcagtccatggggtcgctatgggtcagacacgactgagagacttcactttcacttttcactttcctgcattggagaaggaaatggcaacccactccagtgttcttgcctggaatcccagggacaggggagcccggtgggctgccatctatgggtcacacagagtcggacacgactgaagtgacttagcagcagcagcagcaactcattattttgccattatgtaagatcatgacaccctggatttatcataaacttctggaaataatttgctctgtggttttattttttgcaggcctgctctggtgtatttataatctgtatctttacaggtttcagatacagcaaagagtttcaccttctctgttgaggaaatcaaccatgtggcaaacattcagccagccccagtcattgtctacgattattatgaaaaaggtaggtgggcaacaaccatgctttaaaactactggaagttatatctgtatctaggattccctgaactacttaattttcgaaaatcatccttggtcttcatatctgggtttactttacatattggtttttttattccattttatatatatatatatataaacttcttactgggcctttttctattt

SEQ ID NO: 35027 - DNA, 1155 bp, Bovine  19866881894332
gctgtggttgtagccctaatttaaatataacaaagatgctgctgctgctgctgctaagtcgcttcagtcatgtctgactcttagcgaccccatggtctgcagcctaccaggctcctccgtccctgggattttccaggcaagagtactggaatggggtgccactgccttctatgtttgggattaagaagcagtacataaactgagagacatatccccaaaatagatcagattagggcaatttcctccaaatctaaagtttaggaagacaagttgccaacgtctggaagaattagagacagaaatagtagaagtgactgaacaatgactcataggccctgtcagcttggctaaacaagatagctctgtcatcaactttgaaatttctataccagacacagaggcaagaaattcatcttccaatcttgaccagatttttccccccgccccgaagatcctttcaggtaaacatgtttttgttcagagataccagtagttccaacagaaagagaaactaaagtccctacttagaaaatccttctcttggacatttgcctagagccaaatggaataacaaatgctgtgccaactataaattgacacttgccatctacctcaacaaggtttaaatcatgagccactgcagctgctgaccttcaacaccccctggaaggaattcagggtggagatccagaaaaaggcactctgtgttctgggtgaaactggcagaacaggtcaggagaagattttatgacccccattcttgcatctccttgtatttagaaagacactaaaatcattaatggtgacatctgttcttcgtgactagcagcaagcatctgccataatgtgtgcttgactgcacacactcctcttctctaaaatcatacataacactgatcttcaccccctacctctttgaagcagtttctcagagctacctgaactgctgcctcctaggctatagtcctcattttgccccaaatagaacttaagtcacaactctcatgttgcgtaatttttttcagttgacaacaggatttaccttccaacctgatagatacaaacaaaacagacaaaatgcacgaatcagcagtttttaaaacatggctatcaaatataaagaaggacaggatccatagagtggaaacaaacaag

SEQ ID NO: 35028 - DNA, 1163 bp, Bovine  19866880342177
gggaagcctggtgggctgccgtctatggggtcgcacagagtcagacatgactgaagcgacttagcagcagcagcagcagcatgaacactagatgcaggaggaggggggtttggtagcatttgtcaagagcaacatagggcactgaaaagtcagtttcttaatcatgaaacagcaaacataatattatccatttggcaacaacatcacaattgcccaaaacagtgctgaaatacgttgtacttgtagatttagccacaaaatgtaacttggttaactgaatttgttatgggaaaatgatataaaagatttgccatgctgagacatttctagatatcgctgactcatgccatgagggagaggtggctggacttacacatggggagaccacacagatacactgaggtgactaatgatgctaaacaagactattccctgcagattctttggcttcctgtctgttctttcatactattccacattgcgtttaaaatttgtgatctgatattcacaaggagttcaggtcagctcagagcattcaagttgcaaagcttatataacaaaacatacataatggcagttgcctagggttcctaatgactatgttctgggggctccatccaaatgttatgaatgcactgttgtgagaacagttaccaaagtctgtgattccccatggcctagcagcaccagaaaaggacaggctccatttgatgcagttcagataatatacttcatcatgatgtgtcctgtcaagagatatgtgcttgcagagtataggaaacttgagtaattttggtggaatttattttggagtgatttattccatcactagtcttgtagaagaagtgacttcatgtttagcattcagcccttcattttgtatgagtcccagaatatcaacagacgagctgaatgagtgcatcctaaactcaatactttttgaatggacaaaaagaaaaaaaaataataataacaaaacaggaaatgggaaaggggggaaaataaaagctccatgctgggtctgattactcattttccatattggtgtttctaagcatcagagtagtcagtgttccatttccatcatttttgctattttttaaaaaatgaacttgatgaacaaaaaaacaaataaacatgactttcagttcagtttagttcag

SEQ ID NO: 35029 - DNA, 1914 bp, Bovine  19866880370232
caatgaacacccaggactgatctcctttaggagctactggttggaactccttgcagtctaagggactctcaagaggcttctccaaaaccacaatcaaaagcatcagttcttcagcactcagttttctttatagtccaacactcacattcacacatggccactggaaaaatcaatgctttcagtggatggacctttgttgacaaggtaatgtctctgctttctaatgtgctgtctaggttggtcatagctttccttccaaggagcatgtgtcttttaatttcatggctgtagtcacccattctgcagtgattttgcagccccccaaaaataaagtctgtcactgtttccattgtttgcccatgaagtgatgggatcagatgccatgatcttagttttctgaatgctgagttttaagccaactttttcactctcctttttcactttcatcaagaggcttttgagttcctcttcactttctgccatagggtggtgttatctgcatatctgaggttattgatatttctcctggcaatcttgattccatcttgtgcttcttccagcccagcgtttctcatgatgtactctgcatataagttaaataagcagggtgacaaaatacagccttgatgtactcctttcccaatttagaaccagtctgttcttccacccagttctgttgctttaaaaaaaagaaaaagaaaaaagaaaatgtctaggttaaacttttaaaaattctcctcatattaaaatatatatttctataaattagggttgtgtctgcttacttatggagaaggcaatggcaaccccactccagtactcttgcctggaaaattccgtggacggaggagcccggtaggctgcagtccacagggtcgctaagagtcggacacgactgagtgatttcactttcacttttcactttcatgcattggagaaggaaatggcaacccactccagtgttcctgcctggagaatcccagggacggtggggcctggtaggctgctgtctatggggtcgcacagagtcggacatgactgaaggtgcttagcagcagcagcagctgcttacttacatcatgaaataaaatgagtacattataaagtgctatgtgaagacagtatttggttgtatgtgtatatatatataaaatatagataatatatgtatataatccttaaatatgaccaaatttggtggcatatggtgctctgcaacacatgtacacccgtggcagatgcatgttgatgtatggaaaaaccatacaatattgtaaagtaaaaaataataataataataaaatttttttttaattagagagcattttccttagtagtggacagtctttggtggacacactcattccatttattgcaagatgtttcctgtcaatcaggtgtatttcattagtgaaagagtgaatgaaacttgaacaattaaaagtaaactgtgttagtaaatatatactgtctgtgtattgtatgtatatttacaatttagagaggtaagtgtaaaaagaagggaggaaagagtaaataaagtgatagaatttagattctctacagaggagcaataacttgttcacactgtaagtgatttagagatgtggaattctgtggtgagcaaaaagagtaagtaattggcatagggaatttggagagcagacatgggacttcagacttttattacttattcattgcatttactcatttattcaacaaatgcataatgaataacactacagtatgtgcaaagtgcattgagaggtgctggaatataaataaatctatgtctagagtaaaacaggacagattgtaatggcataaagatctttggagaaatactaatgggggggggatccttgattacaactaaatattgataaataaaggaattagaaatggggaaaatat

SEQ ID NO: 35030 - DNA, 1462 bp, Bovine  19866880488710
acctcccaaagcactgtcatgctgtatgaaaaagggttggttttcttctgttcaaattgcctctgactttatatacacatcattgtgtcatgatctctgctatgctttgagaataaaaggtcaatgccaaccaagaaagaaggaaagggagctagtcttaatttgaaataatttcagggccaagtttagaatattaaaatgttcagtcatgccatataaagtgaagttgctgaagttttacaaaaatgatacagataaaagaaaattctgagaagtgtggaagatatgtgaacatggacacgtgtgcttactgaggctgcaagcaacagattgcagtgttatagttagtgctttttaaccacattagaaataaatttaggcccaactgaaatcaagaatacacacatttaacataagcaaaataaatgtgaagaaatcagcaaaacagagaatcatttctttgtaagccacttgtgcccagtctccaacatgttcctcaaggaaaaccttagccccagtaactaaacggcatacatgtgtagaaacaaaacaagttagttcttaaatcttgacagcctcaatctaagccattatgagtgatttagcgctgacttcctaacttaatcctcaggtaagctacaattccattatacatatatccatatgttccatgatttgaaacttccagtgtaatatatcactactatgtataaaaattagactctccttagagtgctatgtctggatatcaggtcaaatgctttcattagttatataatttccatttatgtggaatgtatctaagcaacagtggggtggttggactaaataatttaaagttccttccaaacctggttttctgtgatgctaatggggatgatatttataaaccagaatgtacctaaaagaggttacttgactctcaatttagttattcatagcctaataggaatggaatcttacagagacaaattgtatgtgtaggacattttatttttataaactctattaacatacagtttcctttcattattaccctatgaaataaataatacatgtattacaagaatctctccatggagagcctctttgctgttcatatagatgactagtggcagacaagagagaaaactcatgtttcctaaataaaattttcatatttttcttttaaaatatgctgtcattcttatctatgctactttcagcagctttatggtctcagtcatctctctgtgacccactcagaggacagaagaccatgaggatggaaaattaggtgcaattagaataaaaaagaaactaggagttgaattctgtggctgtacccataaggcacaaagtgaaataatcagacatgggtcctctcaacatgatcatcagagtcccccaaactcagtgccctcctctgaaggtgaccttgaccagagagcagtatactgggttccaataccatctgcaggac

SEQ ID NO: 35031 - DNA, 1414 bp, Bovine  19866880492576
aaaataatacagtatcatgttttttaaatcggaatatacttgatttacagtatcatgttattttaaagaataacacagtgtctttatgcctatcagttcagttcagttcagtcactcagtcatgtttgagtcttcgtgaccccagggactacagcacaccaggcttccctgtccatcaccaaatcccagagcttacccaaactcatgcccatcaagtcggtgatgccatccaaccatctcatcctgtgtcatccccttctcctcttgtcttcagtctttcttagcatcagggtcttttccgatgagtcagttcttcccaccaggtagccaaagtatttgagcttcagcatcagttcttccaatgaatattcaggcctgatttccttgaggattgactggtttgatctccttgcagtccaagggactctcaagagtcttctccaacaccacagttcaaaagcatcaattcttcagcactcagctttctttatggtccaactctcacatctatacatgactactggaaaaaccatagctttgactagacacacctttgttggcaaggtaatgtctctgcttttcagtatgctatctaggttggtcatatcttttcttctaaggagcaagtgtcttttagtttcatggctgcagtcaccatcttcagtggttttggagccccccaaaatacagtctgtcactgtttccatagtttccccatctatttgccatgaagtgatgggactggatgcctatacaagaaaaaattattattattattactcattcttatccataaaaaaaatatttgtttcctgtcccctgaaatttgctcagttctactgaatttgagaagcagaaatgaaaagacaccctgactgttctacccataggactgatacacaatttctctggtgtgggtactttctggtttaaagcctgaaaaccctgagttattgtaattgaatttgagagtatagaaatctactctgtcacagtcactttcgatgaaaacgacaatttatgatgagtttcataaaacctgcttaattcaacatttatgagagacactgaagataaatggaaggtgtagaaatggaaaaatttctaatcagtcattttgtcaagaaaaagggactagagtgataggcataaaaaggagctggatgtgcatataaataatctactagagataaatgattaaatatttttataaattttaccaaaatattcttagttctataataaaaagcttagtttgtgtgcacccttgaaagattaagtgcatttgcctacatcatgcacctgagccagggcccaggttaggtttggggaaacaagttctacaaacgtatattccaacaagcgtaaaagaagctacaagaaagcgatttcacaagcctggtgcaaatgcctg

SEQ ID NO: 35032 - DNA, 2644 bp, Bovine  19866880506349
aactgaacgacagcatagcacattatgaagggtattttaaagaacacaaatggacagccagataaacaggtgaacagcacagggactggaagagccccaagaacaggagcctctattgtcatggagttggggtataataccctcctagatgtggatgttaccaacctgccagcttttcagactctccctggatcaggaagatgccctggagaaggaaatggcaccccactccagtattcttgcctggagaatcccatagacggaggagcctggtaggctacagtccacggggtcgcaaagagtcggacatgactgagtgacttcacttcacatagcatgattgataattataccaatctccatttcttccccagaggatagagggtgaagcttaaagttctaagcttctaatcaggcttagcatttctggggaccagcttccatcatgaagctatccaggagcccaccaagtgtttcttcattagaacaaaagacattcctaccaccacgcaaattccaaggaatttaggagatatatgttaggaactgggttaaagatcaaatgttagaacaaacgttgcttttagcacttttaccactttggaaattacaaaggatttaaaagctctggctaggagctgaggaagaacaccaaagtatatgtttcttattatatcaccatatcacggtgaatatatatttgtatatttccaaaccataaatcttcttgtatctctatctccgtaactggacatttattaactcaaactctccgctgacttctatgctactcttattggttagcaagatgcccctggagtctttgtgcctgagcttttcccaaaactgtgattccctccatgtgtaacttagaacaaattacataacctgtctgaaatttcagtcttgccatctgtaaaattgggatggcagttacactgacctcataggattgctgggagatgttgagcgcctactacaggactggcatcatataaatagtcattgactattaggtcttaaagcacacaccatacacatacatatatatgttattaagcagtagaaaaggaaggacattctgccatttgtaataacaagaatgacccttaagaatattatgctaagtgaaataaatcagagaaatataaatacagtatgatctcacttttatgtaaaacctgaaagcacttagctcacagaaacagagaagaatggtggttgcaggggctgtgaggtgatgctggtcaatgagtacagatttacagttataagatgaataaggtctgggaatctaatgagtagtgtgatgactacaggtaacaatattgtattgtgcacttgaaactgccctgagactagagctttaatgttctcaccataacaacagcaaagcaacaaaagtgagattatgcgaactaaaagatgtgttaactaagctcattgtggtaaatatttcacaatagatacatatatcaaattatcacattattcacctttaacttgcacaatgatatatgttaattatatctatataaagctggaaaaataaatattaactcctattactctcctttgcaaagagttgactcattggaaaagactctgatgctgggagggattgggggcagaaggagaaggggacgacagaggatgagatggctggatggcatcactgactcgatggacgtgagtctgagtgaactccaggagttggtgatggacagggaggcctggcgtgctgcgattcatggggtcgcaaagagttggacacgactgagcgactgaactgaactgaactgaatcttcttttggttttaccatttgtatattcatttaatttcctcatctatattgtaaatgtctaaagaacaaagattttatcttgcctgactttgttttctaatgactattcccttatacaatgagtagtacttagaaatacacatgggctttgtggtcagaaagatatgtgttcatgtgtgaattcacatctaggttccaatacttgagaacaagtttcattgtttcatgtgtatatttcaagtaataaaaacaccaagatcataggtactcctggttttctataatgtaaaaatcatgaagaacttagctcagtatctgtcacatagtattaagacaatattaatggtagttttcttattgttatcacttggaaaacgaaacatcacacaaaaacttatgtaagttttgaaaattaacgaactgtctaaaatctactaaaattctttcccatgcatacagcgaaattatttgcactttttataaatggggcagagtcttattctggagtctacagcattttagagacagcaaattttcccctcagtcaagcagatcagaaaatggagatgtaggaaggagaattagtttgtaaaagagagcacaaatctttaatgatgctatattgtgacctcttttaatatttcttggccttcatttcttccaaaggtaatctctagccaacatgaaagtaataatttggaaaagatttctaacttaccttatctgctcttttatgttttttatccttctctttcttttcctcatatctgggacaggagatctagctcatcatttaatttgagcttcaaaatagccctgtattgtatataggacaggt

SEQ ID NO: 35033 - DNA, 1097 bp, Bovine  19866880601553
aatagaggatcaattcaaaagaagagatctgaagataggcaagggtatgcgttgactcctacaagtcattatcatgcttgttccccagaatcttaattacatcttccaggagttcatgatttatttcagagagaataataaggtttccttccaagtcgttaggcttggaatctaacttttaggccttcattttctcttttatctttggcgtatggaacagagcttggattaaagagggagaaatggataatgatggcaagcctgaattagtggatatggagctgcttagattttaagagcagggtctcagggaccaggctgggttcaagtttactttagtcccatactgtgtatgagaactcatttaattttgggacctcattactcccctccgtaaaatgggattaaaatgataagattctcttctcatttatgtaatacttctcaaaccatagcaaccagcacaaaaataatgtcatggtccttatgtgagttttagatgtttgtgagaaccgggatttttttggtttggggttcttttttaatatttatttatttggctgcatcaggtcttggttgcggcatgcaggatctagttctctaaccagggatacaacctgggtgtcctgcattgggaacatggagtcttagccactggaccaccagggaagtcctaagaagtattttttaaatagactataagagtcagaaatattcttcccatgagaaagggggatacctgtttcctgtcatgtaactcgtaaactcttactttattaagcagcatgttaatttcccaaattaattcaacctattgattcagtgacaatatgagggtgacttaaatttagtctttctgcaaatatatctgattccataggtttgtctgtaaattatctatttgaacatacaattgttgaaagataaggctcaataattaaaattatattttatatgccttaatttcttctaacaataacttgcatagaaagtcacttgcttcatgttcacagactggatccaaactgaaaaattaatcagttgtttaggaaaagtgccaggagtatatatattgatctttaatatggaaaattgtg

SEQ ID NO: 35034 - DNA, 1239 bp, Bovine  19866880610355
tgaatgtttttcatatcagaatcaagactgatggcatcttttgtatgattaatttcttttcctctagaaaagtcatctttctttattctctgtgcccagagtgtttttttttaaataggttttgaatcacaacaaatctcacctgaaaacaatgaggggctaaaaagcagaaggaaataaacaatgtaagaatcaagctacacaattaagcaccaaagaagggcaggaatgggcacgttttctgagtgtttgtgttttaccacacttagctggttctgtagcaaaggccaacctcttattgttgtggtagtaaactttttatgtaggacatatatgacaagagcaatcatttttgctttcactgctaagcaatattttagaataagatttacagaatggccataaagaaaaacgtaaaccttcctctctccaataacatattgctgcttattggtacaatatactagctggagaatttttattttctagaaatattttcacatattttccatcacttttggggatgattctcttctgaacatttttggtgtgatttaatgagacagtagaatcaccatgattaggatggcttaacgtagaggattttttgctggtatgtatgaaaaatattctcagaagtccatcatctttttgaacttaatactgtacatggtgaatgtgtctttttagaagtgagtatatgggtgttctttggaataactgatgctaaagctgaaactccaatactttgggcacctcatgagaagcattgactcatcggaaaagactctgatgctgggagggattgggggcaggaggagaaggggatgacagaggatgagatggctggatggcatcaccgattcaatggacatgagtttgagtgaactccgggagttggtgatggacagggaggcctggcctgctgcggttcatggggtcacaaagagtcggacatgagtgagcgactgaactgaactgaactgatattctaataaagcttattttatttggtatattccatacagggcttccctggtggctcagatgatgaagaaatcttcctacaatgcaggagactaggattcaatccctggggtcaggaagatcccctggagaagggaatggctacccactattacccagtatggttagtcccatcatgactggtattgttcttaatgttacctaaatgaggttgatcacattttaataataaccagattcctactcctttaa

SEQ ID NO: 35035 - DNA, 4203 bp, Bovine  19866880698260
tcctgggagaaaaatcccctttacatagtgttttagagaatggtattttagactttagcctgttttgcaaagtgtagtaagcaggattgcaaggtggccccaagactcctgagcctctgctttattatatcatctaattgaatatggatggagctctgtgaatataatgagatctcactctatgctactggtaccttataggacaaagagatattatccacgttgacctgatctaatcaggcaagccctctaaaagcagagcagtttctccagctggctgtagagagatgtgcttctcttggcttggaaggaaatagccgtttgtgttctggactgtcctggatatgtgtcaaggactcaggtgtgaactctaggagcagagagtggtctttggttgatagctaacaggctaccaagaacctagttctacaacttcaagcgattaattctgccaccatccaagtcactgtgaaagaagtctcagagtctcaggtgaggtcacatccccagctgataccttgaggtcagccctggtgagaccctgagcagaggccacagccaaaacgtgcctggactcctgactcacagactctatgagagcctaaatttgtattactataaccagtgaatgtgtggtcatttgttatgcagctacagaaaattaatacataaataatttaaagttgctcagtcgtgtccaagtctttgcgaccccatggactatggggtccatggaattctccaggccagaatactggagtgggtagcctttcccttctccaggggatcttcctaacccagggattgaacccaggtcttccgcattgcaggtgtattcttgaccagctgagccacaagggaagcccatggaaaactagtatgccaagtgaaaaaaagtgcagtgatagtagctctgattagtaggtcttatttatcttacccactagatatgtccattttcactccatccagccctgagtggagtgtgggtttatcttctgacgtgtcatctctcgtgatgttgtacattttcactttccggcccccacagccatcctactgcctcagtgtctcctggggaagattttttctgcatcttctcctgcaaacttcctctaagctgatcctaggactgcaggctgctgttgatgctactggagcttgtacctcaggagctattgaaaaccagtacttctgtttgaagactttattttgaagttctatttatttctccatcatgttccgtcagggttcagaccttacttactcacccacctcaaaggtcatagttaggtcatcacttagtaactgagtgatttgaaagctcttctttcttgagtccgtggaccagcaaaaggccttcagtctcagtcttactacgacttcctgcctgcggcccagaatacagaatggtttctagggctcttagtgcagctgtcctaggactggcgctctcgttctgtgtggcaagtggagcaatgctattaaacattgtaaaaattgttgtgcctctcaaagcctacaaaatgcctttcttttgctcagtaaaatcctgaccgcaaccttgcctgaagatagcggtgtcttcttagtcaactgcagcagccagcccttgaggcttgaagctacccacctctcctggttggagactgtgctgctttcccacccccgcccccccaagcccctgcagtcaaccgcctcactgctgtcagacttggcttacctgcatctgtacttgtgcttaaggcctaggctgtgctttagttcctgtcaccgtgtacacagctactcacttgggccaaagctctgatgtctctcaggctggacaccccaacgctgacccctaggtgaggactttcgtattagtgagtttttgaggaaaagcttccagaaggggctggtagacaagtaaggatcagagtaggaaaggggaagcagccaagccgtgggcagatccaggccaagtcctggctgatcttgctcttgcagggaacttggggtgtaaattacccccttgaagtctgtcccatgttaactggggaaagctgggccttttttctcccatgcattcacctcttggctttgggttatgccatgtgatgtaattcccagccattttttgttttgtgcttagaaaggtgatccatctctaggatacaaggagaggtctttaatggaggttacaggtaagaggaatgaatgtttataaacacaaagcatatagaaactgggagttagatacacagggatacactgtcaaatggatataagcggatcttagtagaatatcagctattttccctaagtcctccaagttcaagataccacaagccccagacatgaatcctcgttctcaaggcatggctgtttaaccccctcttggccttacataaggtttatccatctattaatttttttttttaacccatactctaaagtttaagactcagccatcaaaatttatttcctttacccacacgataaaatgcaagactaaaagccacaggttttagtgtctgagagcaccatgtgcttcaccaactttgacactttgatgtgtccttcatagtacccgagatcgttccccgaagcctgaagacattgagagggtcctcaataaatagaaccccattcacctacttacattctgaaacagtggaaaataaagacgtctatggaagctaaatttttacatttgttactggcagaggccaagtcggagagcagttttagtgctgtgggctaagtgggcttgttaaggctgaaccctacgagtagcgcagtgtgtctgcactcttataagcaaagatggacagggtctcactgctcagactctcgttccagaaaagagcaggagaatgagcatggaatcataggatagcagtgtggaatgagctgagcatgttcaatttattgtttccaactggatcaggcacttgaatcactccacctctccgcgagcaggggaataagaaggtgcagtggtaggttagtaagactgtgtccacatagaaggagtggaggaaattgttttccccaaacacatatacatatgcttccattcaagtgcaaacacatgtgtttagaatctgtattagactttctgtacatgcagatgagaatatttccatttgccatcatcaaatcatgtaggaatcactattcaaatgtcacataacattttttttaattgttagatacatgagttctttattggacagcactgagagaatattgcctttcagtcattaagaattgatattgatgattactaaaatgcttaacagtttctttctactttggtttagaaagttacagggctgccgtgaggaatgtccctgagaacagtcaccaagtgggcttcaattagtaactcccagtttacagagaaagactgagaactacaagaactgttccaattttgctaatgcaaatattcctctagttattttccatagattgacaatttcaaggagagaaaatccagtaaattataaccaacaatgtactgaacccagctaattgttctctcatttgtattctcttagctcttttacatactcttaaatttcccatcaaattgtttttgtttagctgtgtgtctcctccatgcaactctaagcatcttgaaaacagatacccggaagcaattgtcaggctatcagcagaggaaaattatcttgtgaaaaaagcctgcaccctttatcttctcaagattcaaaagggtctacttcttggaagataggcaggtgccttctgtttcccaccaacaaggtcgctgtaggtgctgtatttcagattttgtcattgctctagtgcttatcatggtatgtgttgtacagcatgctgaattgatttctactaatacacatttatcagaggttcagaagccacttgaggtgctgtgttgctgaaggtccctttggcagagactgtaagtgccccctaatgtagattctgtttccttcttcatcctgctctccagtctgctctatgccctgagggattaactagtatggattggtctaatggactttcttgctgctcattcccccatttcagttgacaccagttagtcagttgatgacagagcatcagagggtgaggagaatgtagtcacagtggtcgttccatcatctgtatccatgtttttttttttttttttttttttaaattttattttatttttaaactttacataat

SEQ ID NO: 35036 - DNA, 762 bp, Bovine  19866880728767
cctgggattctccaggcaagaatactggagtgggttgccatttccttcaccaatgcatgcatgcatgctaagtcgcctcagtcgtgtccgactctgtgcgaccctatggacagcaggcccaccaggcttctccctccacaggattctctaggcaagaatactggagtgggctgccatttatactaaagaataaagtacagaagactcaccatttagaaataaacaatgtcttatggaacattaagaaacctaacaataaatgactgtcctaatgactgcagtacaattacccactccattctcttctctggagacatattctgttccttacctatctactttattttaccctgaaatactcagctctcccaatacttcatcattccttccatagctgttcattgcacatttttcatgggtatcacttagagtgaatgtaatgggatatttttggacacttaacagaaatgggtaacataattgtatttactttgcaacttccactggaaattcatattcaaagcacatttcacaatattctgtcctacccataatccacaaagattggggcagtgaagctacaatagcaaagattcaacatttcagctattccctgtgatctatgaaacagtgggctacacaattctcttgcggcttgtgatagctatgtccctaaattaactacactggtgttttacaccagagattattaatgagggactatgtttatatacatttcaagtaggatgtacatataaagtt

SEQ ID NO: 35037 - DNA, 1822 bp, Bovine  19866880732058
gtagaaacagtaagagaactagaattagaagtggggcttgaagatgtgactgagttgctgcaatctcgtgataaaactttaacaaatgaagagttgcttcttatggccaagaaaagaaagtcatttcttgagacaaaacctactcatggtaaagatgctgtaaagtttgttaaaacaacaataaaagatttagaatattacatactttaatatgtaatatttgagaactttgccttttcagaagatttcagaagattctctaatcctgaaggttctactgtgggtaaaatgctatcaaacagtactgactgctacaaaaaatcatccttgaaaggaaaagcccattgatgaggcaaacgtcgttgttgtcttattttaagaaattgctgcagtcataccagcctccaccaaccaccaccctgatcagtcaggaggcatcaacaccaaggcaagtccttcaccagccaaaagactgcagctccctgaagcctcatagatcggttagaattttttagcaataaggtatttatttatgtatttatttttggccacactgctcagctcgtgggatcttagctcaacaatcagggactaaacctgagttcgcggaacgaaagccccaggttgtaaccactgggccactagggaactccctgcaataatttttaattaaggttaagacgctcatttcaaaaaataaagttatttcacactcaataaactacagtctagtataaacgaatcttttatatgtactggaaagacaaaaacatcatgggattcaccttactgcaggatttgcttattgtggtctggactgaacctgcaatctctgaagttcgccgctagtggtactactgacaattgtctccaaaacgtagtaaattttatgtttactattttaattaatttcttccctttcacttttttcaaacaagaaacaattataataaaagctttaagagcaactgaccctttttgtggctcaatatatttaacggaaacaatacaaagaaatgcaaaacaaaaccaccacctgctcactctttcaaacattccattgcaaaatgtttctaataaaggagagaggtttccttttcaaaagaaacagcagcaatcatgtaagctattcttcagctggtatgatgaaatgtttgtttgtttgtttgtttccaagaagcaaatatgcagatctacagtataagagtattagatctggccttgatccaagtcaagaataaatatatctagaaattttaatctgtttgacataaatgttcactgatcctctttcactgaggatactgagtttcattcctttaacttctaattcaatattatgtcttctatttatttccctaacaatattacattttttattttcagaataaattcataataaacaagttgtcctgctgctttaccctgctttctttgattcttttcctttcacattacctgaggtgatataaagatttcttctgtcaattattttttcagcagttaatactctattataagcaagagtagtacatttattttagttaccctgtaggactctagtcctctgcttctagataggtttgctgtcttttttgagaccatctgtttaaggctctgggaattattgaaacagcttatatttgttttataccacattatatttcaacaacatatcttctgggaaatttataagaatgcttatttctctcactcctttattgtattaattcaattagttgaccttcagctggcatgcaatgaaggactgtcctagcttccaatgtgcaatgtgttaaatcaaatgggtcagagctatatt

SEQ ID NO: 35038 - DNA, 1011 bp, Bovine  19866880756866
acaagggccagcatgaatgcagggtacataatcatagaagagttgatgctatttcagacaagggtgaggcagtggagatgatgagaagctgactgattacagcgatatatgtaaaaccaataggactcagcgagggaatggatgggagctatgcaagtaagcaacacattaagaatgagtcctgtgtttctggttgctcagcaggatagataggtaactggctaatcctgggaataaaataatcctagctgttgatatcactaaatccaatgtaactttttttttccttaaattacttttaaatcctggaattaaacccaagaacaaattgactaactgttttttgtcacctttagaaatgctgtttttctcctgacacagccccagatgctgccatcagctttgcattcctggcatctaccttaaatcttcagtatttttaaatttattgattgcagatttcagcaagaaacatatttctggaggtatttaaagataatatctgttgtacatgcgtatgaagtagatcaatcgcaatcacccactcactatctactgatcaatttgaatgctactgagatattgttatgaatttcttctcatttcatctcctacctttagacacactctgaatttgttctgggtttagtttgttatcataaacctaatgaaaacattttatctacatggagctgtcaaagagatgtctctgagtgttttgtttcaatatagcagtaggtaagaagtacttaactggatatatctttcttcataaacaaaaatggctctaaattatacatctgtaatttgagattcatttagtacataccttgtcatatttaagctgtgagtgatttatatattgttctagtcagattatgttttggataactaaagagtgtttttaaaaagctatgatagaaattcttgagaaaagagttaaacatatattttattttcctctccccaactccattttgctttcaaattaattatgcatatcactgccac

SEQ ID NO: 35039 - DNA, 3869 bp, Bovine  19866880777396
tgtgaatttatggcataaagttgtttgcagtatcttcctttattatcattttaatatttgcaggatctgttgtgatactgttcatttcatgtcatgaaattgaactttgtgttttctctttttttcatgtgttgaattactggtgacttgtcaatgttattaatatagtcaaagaaacagtgttttactttgctgattttcactgttgttcgtgccttaaaatttcatttatttatggtcttttaaaaacattttctttgttacgttcattttgaacttcagttgctcctctatttttgcttcttaaagtaggctctcagatgattaattttgaatctttcttcttctctattgagacttaaaactatgagcgacttagcagtagcagcagcagcagtctggctatatttaactgttgatgtggttagagaagagtgtcatatgttggtatacgtgaattcactcctgattcctgttgaggaaggggacaaagtcaccattttaattctcaaaatttacttatttaatttattaactttgttgaaatataattgacaaacttgagatttttaaattaaagctgctgctgctgctaagtcgcttcagttgtgtctgactctgcgaccccatagaaggcagctcaccaggctcccctgtccctgggattctccaggcaagaacactggagttggttgccatttccttctccagtgcatggaagtgaaaagtgaaagtgaagtcgctcagtcgtgtccgactcttagcgaccccatggactgcagcctaccaggctcctctgtccatgggattttccaggcaagagtactggagtggggcgccattgccttggtagcccttttaaaaccagataaagcttttgcaactagtgattaaaaccttgtgatttttctcccctcccctgtcttttccagaacacatagaaaatgtaatgagtcctgtggccctttatggaagggccctacattttaacctttgtggagcatgctactttagccaactatgaattgttaatgattcctgatttcttgatggaatactctgagggttaatgaatgcacttgtaaatgaagttgcagcacgggcttgtagagaacagatgtccgtattccactttgtagaagaacggtactttgatttaactctagatgacctgccagcctttcatagaacatgatttcattaattcactactggaagtgatgcattgcatgagaatctcttttgtgtgtgatttgtaattttttatatgaatttccaacagtggagaaacctttgactgtggtatctggtagtttgatactgaattttattttatgtaatgttttctgtagtgtttttatagtttcaactttttcttttatattttacagcctctggttatagggctgtttgatattctacctctgttgataacttgcttaacacaaatgggaattttaagtatacagtcatttaggctttctttaagaggaagttcataaatagcattaactttaccttataaggaagttgctatttttgttgtttaatttgcaaattggtatggattcatcagaagtttattgtagtggaaatatggaaaatttaaataaatatatccttttcttaaaaaactctaaaatgaaacttccatcagttaggcattcattagtaaagttaacaaatgtgtgtaaaattcctgccttgggccaagcatgtttcaagattctgcaaactgcatatatattggtaacgtaattaatattaaaatatctaatcataggtttctgtcagtaacatccatcagtggttcaggagaaaacttttgcctgaaattaatgctagcatgtgaccaggtcttcagcttttgccaatgttataatgcttattttttgaaatactcaaccttcttttattgtaaagaaaggtgatgggttacaaatgctactaatcaagaatggaaatggcttttcttttttgggtgagtgggaacatatggatggtactgggaaggagtgatcatgaataatttagaataacttgagctcttgtatggtagtaaaaatgaaatatgcattggttaaatgagagagaactatgctatttgggtttgaggtcgttgcagtaacatacacgtaactataattcttttttttcccctccactgttgaaaatgtgtaatagaataagtaatgctgtgaagccaatcgaggaatgaagccagatgcattttaatgcaatcacttgggaagtttgagcagttagaaatcacaacttccaaagaaagaaattgctgatatcccttagattaacaatctgttttagtgaaggatctcttcatttttatagtgcatggaagcatttgatactcattcgatattagtttatccattcatctaaaacatctttggcatggctccctgcatggcttttctcctgactttaggtcatgaggacttgactttgtattctgactgtagtgactacattgttttctaggaagcagtgtgctttgttttccttcctgaatgaagtagggacacaataaacttccaggaggtgttcatttacgatactctcaggtatagtaggaagtctgcttacaatttctctcctgcttctccttagaaggccaaggatggtcactgagattcttcaggaattgttggttaatctgaaaagtaacatcaccttaaacatgggagttacgatttaaggctttctttgaatttgtttcattaaaaacatgaggatgagatggttagatagcatcacagactcaatggacatgaatttgagcaaactctgggaggtaggaaagcctggtgtgctgcagtctatggggtgacagtcggacacgacttagcaactaaacaacaacattaaaaacatacgcttgttaaaggagttccctggtggtccagtggttaggactccatgctttctttcgggggacctagattcaatccctggtcaggaactggaaggatcctgcaagctgcacaccgtggccaaaaaaacccacacacgctcacacacacacaaatgcaaaaaaccatacacttgtttaaagccagtactgtgtaggattgctttttatcttttctaaataggaaaaagcatcattaagcattgcagtatgttcccccaccccccgttacttttttacttagtataagtttatatcatcaggaaaaaaatttttaaagaataagtacagtttaaggatgtcagtttaaggatgttttgatagaataatgtatgattagcttaatttttatctcagccattaaaaggccttttttgttttacaataaatgattaatgtaatttcaatttctatagatttatgaaattgtttcctccttgcttgtggctaggttaatgattattggttttgcacattcagaatatggtgttttgtctggttaggtttcggggataaatttttcttgttctattcaactagacatattgtatgtgatattgaatttttttcttttttaaatgggaaggatgaggctaggcaggttagctctccagcttctttcattttattgatggaaatattggaagcttatttgatatgcttagatcagagacctgtgtttattttcacatacctggatggcaggataatttctgaagacacagatttgtgtgtgatattcctactgttcctttgcattgcctctcagggaaaatgtcagattctggcaatgagggaaggacgaaaagaagagagaagagaggagggaggggaatgagttgataacaagcaggagaaggaagcttaacattagaaggaggtggaggtctggggtgttggaaggagcggtgcctgggccagtcctgcacaggggtagagt

SEQ ID NO: 35040 - DNA, 1511 bp, Bovine  19866880818193
gttgtcatggggaaaatttatgctaaaaatcctgggttgagggagacattttattaataagttatctactgaaaaacctggagctatagatttttaggaaacattttcagtgtatacattaaaacaaatttaataatatgagaagttagttaccattaaaaaatgtgaacttgataaagtcacaatcaagatactatggataaaaaagatacactaaagaaatgaatattacctgttgacattaaaccattaacatattagtgtttttgagaagggatacaaattcagtgtgaaagtcacagacagcattgttaatcaaaatctgcacataaagaaagagaaactgattaatgttcacagtaggaaatttctatcaatagctttaccaaatcaaataactgaagttataaaataataaattttataaagtactatcctttgagattttgaaataaaacactcttaagcatgatctataagccaatagaattttttaaaagatataatgaactcttgaatagcatatttcttccctctatcacagaaaaattagggcagaaaattcacaaaacaaaaagaataatgtgtttcacaaatcaaatcatttaaaaactgacaaacaggagatgatttaccaaactagaataataaaaagatgtacaggggaagtattatatgcttataaaagctattttgatttttaaagtcgtaactcccaaattgaacaaaaataaaggaaaggaggaagaagagaaaaatcctccaaaacagatcattactctgaaaattacaggatttcaggtgtgattttaaagacatttttcaacatttgcaaaatagaatcacagcagtataatggatgagcattaaaccagaactcaattaaatagatgctcctgtagaagaagaaattatagaatatttttagcatgctgcagcaaggaaatacaacagtctaaaaaattatggtacacgatatactacgaaacaccatacacatataatagtgccttatcctaaattaaatgcttgagttcaattccagccttttcacaagccatttggtttcaactttaaatacaccacccaagcagctgcttccttcaccaggcaacactttctttcacagacaagccataacagttctactatagacaggaaattgctttcagagtccttaagaagaagtgattaaaaaaaaaaaaatcccaacagagtagcaataaaggaacactcctacagtgaccaaagagggaaagtaaaacaaaacaacaggcagatgatttctaagcaagaacttctctgaggttcaaggaaataaaactgatctatccagagaaatatccaatctactcctactgtatgaacagaaaaaaatccatatgaaagaatgccagttaatccaatggccaaatgggctgatgatattgccagctttgagaaatttccaagtttctgggatactgcattcgacaagacaggatttcatatgcatatgtacatatattaca

SEQ ID NO: 35041 - DNA, 1770 bp, Bovine  19866880821523
ttagcttttgggttttggtcctcggtaaagggggcagaaaaaaaaaaaaaaaagatgttgctacagagtgtgtaaatcccatgccatctggttatgctgctgacagttctcacctctgtcacaccaggatttacaaagcaatttttaggatgaagttgcttcaacctccactacttgttgtttggcatctcacactctccttttcacatctcagaggctgtgttgttgtaagtggatggcagtgtccagggctgttattggaagaagaatattcacagagcacagacatgggaaactgaatcagacaccaaagtcatctgcttatgaaacactgcgaaacactcaggtctattatttactcagaataaatctcattagccatccttggacaaaaatcaagtctttgttcacatgtgtgtatgcaataacttgattaacctatgaattcctgtctaattagtacttatcatgaaggactcataatccagtgttgtatctttatttatactaggatatttttttgtatgcatttgaatttctaatgatcttgtagcgaaatcagtaactgactggtaattatactaattcccagcttttcacactactggtaactagaataataattaagccacagataatccctggctggtaccttttttttggcttgctaattcctgatcttccaactaattttcaagagtatacaaatccttttcaccttaaagaagtactggattattctgcagagatgatgatgaataggaagtggcagaaaggtcacagaatgcgtgagagataagactcttgtcaaatgacagtagcctgcattgcttaggaattatgcggacccccaagaaacatttctaattgtcacttatcatgaaacaatttttctttcttatggcatcaaataaatgggaactgctcttcagcaaagcagccccaggtggctgctactttcctataaattatctgcatacatgaattaattaagggagtaggaggaacatatgcagtgtccatactctgggactcctgttgaggctctctccttgcatatctatctcccttgtcacttatccggttcctctccatacttttaatcaaaagaatctcctagaagttgatttatttccaccaagagcaagcatactgcttagcaactaagtagcactcagtaaatagagggtactattatttgttgttgttattattactgtcattacttctattattattttgcccctgtgtctactctgtcaggctattagagcatatgacagatgaataaaatatgagggtatcttcagtaatcagaaagtaacaatgacattaaacatttctgaccaatgaaaagagaccaagtagaatggaagaaacatggcaaagtgaataaaaataacacagtggcgaagacagaaaagggaaactcatgtcctggagggacgatgggactttgtgggaagaagacaaaataggtcacagcagggcggccagtgccccacatcacgcctgctgataaaccctgaggtcatggctttggctgctctatgctgcctcatatcctcccctgaattagaagtctcccagtccacaagaaaatgaagaagggcagataaagttgctgtggtcagagttcaccatgatctggccgtgtctgcacctgtcttcttggtgcccagggcatatcaactgttaaatgcgtctatgtctagaaacaggatttccagtacattctcaaaaagcatttatcatggccaaatctaagaa

SEQ ID NO: 35042 - DNA, 933 bp, Bovine  19866880829921
gattctggaagccccttgctcagccggtcattagttttttaggtgatgcatctcggtttgtgggctagggtcctggtccagcctgggaggcaaggtgatagttgatgggaaaaggtccagacaatggctactcaccagcctacttaccaactgaaggccatactaagtcttttgtgtatacctggaaaatttctttctgtcttcaccttgcaacacatatacaatctgattatatcatatcatattttcttttcttccattttccgttcacttcagaggagcttcccctgaccttcctgatgaaggttattctcactgaggttttcattagaaactcctgtctcttcacattgtacctttcacattctctctcacagtggtcagtttacaaataaactttataagtaattgaatcatatgtcactcccgttagtttgtataatccaggagggcaggggtcatcagttaactgacagtcccatttccaccttcctccagaattgaaatttcaacacctaataggaggtaaatattattgaatgaatgctcaaaaagactttagaacttctttgagcatgtttatattttgcaaatgcagctgatatgcatgttacttgtgggatgcattgttgagtagattactttttttttttaagtggccatattcttaatgccttcttaaacaattttctgaaataaatttttaagtagtggtgggtgtatcccatgctgttatttttctttccagtagaaatgcttctcactcacttgatgtccagtgaaatgatttaatcttcagagctgatttattcattttccttaaacctcagcaagaaaaattacttaaaagcctacaataatgtacagggtgttgggaacattggaacagccagtggtggataatctgtggtcctaccttcagagacacttcag

SEQ ID NO: 35043 - DNA, 1874 bp, Bovine  19866880851839
ctttatcttgtgggagatatggctggagtgggtctggggattttctcaagcgagaagccagaagagagcagtgcggtttcaaacagcagcaccaccaggtccctgacaggcttgccgtttatgcctgcctcttgccttctgctgcagagtctccacaatggggtgatcaggactgatctccaggtgcttttggccatcatttagtccatggtcgagttgccccaaagtgcctgagctttcatgatgcactgcatgttggctgtccagctgtggtgctcatcacagtgcagcagggtgaagacatgagcctgtcttcaggatattgtcaccttctccaccttcttatccaagatctttttcgtgagtttgtagaggttctcaaacttggccttgctctcctccaccttcttcttctcctccttgtactcaggcagctccaggccctccttggtcatggagaccagactcttcccatcaaactccttgagctgctgcacacagtgctcatcaatggggctccatcacatacaccacctcaaagccctgcttccacatgcactccacaaaggaagagttcgcaacctgctctttgctctcaccagtgatgcaacagacggacttctgggtctccttcatgagagacatgtattctgagagagaagtcatctcatctccagactgggacgtgtgatagcacagcagctcagaaaggtatcgccggttagtggagtcctcacagattccaagcttcaggtttttagagaatgcctcatagaattccttatatttctccttgtcttctgccagctcagaaaagagttcaaggtacttcttaacaatgttcttatgaataaccttcagaattttgctctgctggagcacttctcaggagatgttcaggtgaaggtcttcagagtcaaccaccccacggaagaagttgagatattcaggaatcaactcatcacagctttccatgatggacacatggcggacatacagtttggtgttcttctttttgttctcgaagaggtcaaaaggagcccaatgagggatgaacagcagtgctctgaattctaattgaccttctacagagaagtgctttactgcaaagtgatcttcccagtaattggtaaaactcttgtagaactcaccatattcctccagggtgatgtcatcagggtctctggtccaaatgggcttggtcttgttcagttcttcctgagcaatgtacttctcctttatcttctttgtcttctttttcttatctttgccactatcatcctcctcatctgaacccacatcttcaatcttaggcttctcttcatcatctttatcttcctcttctttctcacctttctcttcttcagcctcatcatcactgatttccttctcacgttctttctccagctagaaggatcaaagatgacagtttcagagtgcaaaaaaaaaaaaacacaaaaaaaccccaaagtccatgcaattctctaaagcagcagttacctgcacttgagttaccagtccatactcacataaagtgtgatgggatagcctatgaactgagagtgcttcttcaccacttctttgacccgcctctcttccaagtactctgtctggtcttccttcaggtggagaatcactttggtaccgcggccaataggctcacctagaaaaaattaatcagaacaatataaaaaactaaataaacacagaactataactgctttacacatacaatactcaagatcttcattactgtttccccagaattctaatccagacaccttaacaggaaagccaacttaccatggtcagcacggacagtgaaggaacctccagcagaagactcccaagcatactgttcatcatcgttatgc

SEQ ID NO: 35044 - DNA, 1912 bp, Bovine  19866880861672
ttgaaaataattatttagattgtttctctcagtatgatgcactaaagaaagcacattggctgctggtgaattctaccaacttcagagtcatacatgcattccgtctaccactggtctacagtgccaaagataaaagagtagaattagaaatattggaaatatatgaaaaatgagaaaatactctcttaagccaaagagtgtgtagggaaagagttgctgagttattataaggagccacagttattcactagcattcacagcaaatagaccaaattttccttaagaagcaatgacagcgttatgctataaaaaccacctcaaattctttttttaggtaaagcacatttttttttttaattacataaacattctcagtaagtctaaaatgctggggattaaaggtgttttggttgaggtttttgcttatcctatttattctatttgaaaaaaaaaaatccagtcgtcttaataatccctttcattatatagctccctagagtttagagcacactattgtatacagtatctcatttatatttttgttactgtccacacagcatataattattgtagaattactgaaaaatacagaggagtaaaaagcagtataacagattataggtaatcctagtaacaagagaaatatttcaggaggcatattttattttaccttcttagtattccatcctcccgaaaggcccgctgttttttctgtagaaaattcaatctctctcttcattcaatctgtgtgggtatgacttatcctaattttcactcaaaaaagtatgtttgtcttagcctaactaatcaaatctcaaaatcattgattaagggaactatacatgaggcaagacaggtcaatgaattctgggacacttgaggccagcagttaaagatttgttttttccagctggtgatgctaacctagtaggcaacagatttacatgtgaccattttggccaacatacatggtgatcctaccagaagctaaagctaatacaaaggaggcagagtacaggtgaagactttgagttcatttaagcctttgaatccagttgtgctcaaatctcttttgaacttttctgtttggatgagctaagacagtctcttttttcttaagcctgtttgaatttcacttgcattacttacaactgaaagagctctaataatacataactgttcatgatttgcttattatttttcctgattatatttagatagatatattcagtttaataaacaacagaaaaacaacaaaatttggaagtattttgtctttatgcataaaaccatccagcacagcagacaaggcaaatattattaattcaattttacatatgaacaaacaaagaacaagggacaaagttaataggtctgatttggactggaatctatgactttttaatatctgatatttttaatattctttgacgttgcccttccaaatgtctcataagtctaagaatttatttcctgaatgttaataaagattacctcccatcttagagtaaaagtgaaggaagaaatcgtgagttcataaagaaccttatcagtcctcaaaatgagaaatctaaaatataatgagagctaggaccttcccttccactggagaagggaatggcaaaccacttcagtattcttgcctcgagaaccccatgaacagtatgaaaaggcaaaatgataggatactgaaagaggaactccccaggtcagtaggtgcccaaattactactggagataagtggaaaaataactccagaaagaatgaagggatggagccaaagcaaaaacaataccccagttgtggatgtgactggtgataaagcaaggtccgatgccgtaaagggaaatattgcataggaacctggaatgtcaggtccatgaatcaagggaattgggaagtagtcaaaca

SEQ ID NO: 35045 - DNA, 3581 bp, Bovine  19866880945181
gcagcagcagcactgacttttaaacttatgaagatgtgtattgttgtcaactcctcaggatgggtatggacacatggcccatgtatttaacctacaatttcaaaatgctaaaaagagttaacagaaattgccaccaaaagaagggtggggtagattcttatattaggaatttcttatagaaaattgtatctatccataagcatcaaaagaactgatcttctttgaagaacttccaattatggcaggataatgaagatatttcactcatttttcttgtacctaatacttataccagtcacctttatctacttgcactttcattttttatgttaatatatgaatatttcaagtttgcagttgatgtagagaaatcactgaattgttttctttcttttatgagccttcatggaggcttcctgggtggctcagatgataaagaatttgcctgtagtgtgagagacccgggtttaatacctgggttgggaagatcccctggagaagagaatgtctatccactctagtattcttgcctggagaattccacagacagaggagcctggtgggctatagttgatgagggtgcaaagagttggatacggctgagtacctaaacatgcacacatgcaagatgctctgggggttaaaattcctccattgagaatacagttcagttcaatctctcagtcatgtccgactctttgtgaccccatggactgcagcatgccaggcctccctgtccatcaccaactcctggattttacccaaactcatgtccattgagtcggtgatgccatacaaccatctcatcctctgtcgtccccttctcctaatgccctcaatctttcccaacatcagggtcttttcaaatgagtcggctcttctcgtcaggtggccggagtattggagtttcagcttcagtatcagttcttccaatgaacacccagggctgatctcctttaggatggactagttggatctccttgcagtccaagggactctcaagagtcttctcccacaccacagctcaaaagcatcgattcatctgcactcagctttctttatagtctaactctcacatccacacatgactactggaaaaaccatagccttgactattcagacctttgtttgcaaagtaatgtctctgtattttaatatgctgtataggtcggtcataactttccttccaaggaataagcgtcttttaatttcaggaatgtaatcaccatctgcagtgattttggagcccagaaaaataaagtcagccactgtttccactgtttccccatctacttgccatgaagtgatgggaccagatgccattatcttagttttctgaatgttaagctttaagccaagttcttcactctcctctttcagtttcatcaagaggctctttagttcttccttttctgccagaagagtggtgttatctgcgtatctgaggttactgatctttctcccagcaatcttgattccagcttgtacttcatccagcccagcatttctcatgatgtactctgcatataagttaaataagcaggatgacaatatacagccttgatgtactcctttcctgatttggaaccagtccgttgttccatgtccagttcaaactgttgcttcctgacctgcatacagatttctcaggaggcaggtcaggtggtctggtattcccatctctttcagaattttccacaatttattgtgatccacacagtcaaaggctttggcatagtcaataaagcagaagtagatgtttttctggaactcccttgtttttttgatgatccagcatatgttggcaatttgatctctggttcctctgccttttcgaaaaccagcttgaacatcaggaagttcacggttcacatattgctgaagcctggcctggagaattttgagcattactttactagtgtgtgagatgagtgcaattgtgcggtcgtttgagcattctttggcattgcctttctttgggattggaatgaattcaagccctaggttatatgttccttcagagaatgggcagttttctttcatccctgtcttttctgctaatcaacatgaacccctttttttgtgatctttatctttgttctgtagtttgtgtatgggtcacttgcctacatttattgccctgaatgaatgagcagtttcacctccaaagcagaatacatttcacagtacatttggtcaacagtacattttcagcaaaatattagaaaacagtcctgcccagcttccctcagccactcatccctctttcctacaagtgtaagaagttggcatttttaatttaaagctatgatctaccaaaagatttgccattggagagctttaaaaattcctttttgagaagacttaattcagccctatttcctgaagaaaaaaaaatatatttctctttttgatgctgaaataccatctaaagattctccaaggaacttgaattgggttttcacagatttttgagagagttttttcccacagcctctagagaaaattgcctcccatttctttaagtaaaaggaaacagttagaggggagaagagtaattttttctattcaaatttttttgtgctgtgatgttacttggtacccctgtgagaaaacagctgctgctatcttatttctacttttgtatctgtttctaaattaatttatgatcaatgctgcctttgttttatgactaccactgaaagatgaattatgaattaatagggaactgctaatttcagtacaatcaagaacatctttaataagtgaggactgcccataaagaaccaatagatcattatggtaagcattaataacttacactaaactcaatgtgaccgatatataaaagaaatttattataagtatctagaaataaacttatgctcaccttagtatgagttatacttgttgacttgaatcaatatgataataagagatattttcaaggccttgggagcaggtttttatgtcggagactagagagtaaatttaattgacacttccctgatattcagacttgccttatctatatagccttcacatgaattttcaatttgattttgacttcaaatgggagttcccacaaatccaaacaccttgttgaagcagcagaaaaatgaattatgtggataacaatatttcatcaagcttgaaactccactgtgttatgtccaaagcagtaaaactgtgtaaataaattgctaagtcacagtgaaattgatgacttgtatctcatgttttaaaaccaagatgactagttaaaaagagagagagaaggaaaatcattcctttgacttggcacattttattgttattttcaagttcaaatgaatgttggagcaaaaagctatcctattagacctaaataccttcaaattaagttctgtgactctctctctctctctctggggtgtgtgtgtgtgtgtgtgtgtgtgtgtgtgtgcgtgtgtgcgcatgtgtgcattttcttggctgcttttttttttttaactgagattttcctactcaaagattaaaaaaaataataactaagtgattgcagtattactatgtaggaggagtaaagtttgccacgacac

SEQ ID NO: 35046 - DNA, 871 bp, Bovine  19866880979812
atcctcaaacacaaagtaaaatttaattagatcatgtaaacatgatcaaaaaagaaaatagaaacatctattttaaaatcaccttcaacaataaatcttaacgttaaaagaaacttcatgttaagcaagttaaactaaacaatctgttttcattaaatatagattgagatttattgaaggtaaatataaaagatttttgtattacaccctctcaagctttataattgctgaaatagttaagtaagagatggaaacattttgagataagaagacaaacaaatcaacatgatgcaataatgtactcactatttaaaaaaaatatatttaagcacattgatcagtaattggtgaaatggacacttatggcatttgaaccatctagaaaaactgaaaaattcctcactcttttaaagatccttgagctacaaaatccacaaagtaatgaaagctggagataagatgtgaagtcttttgggtatttttccaacaacaaatccaatattgaagtggaagatgccatatatgtcattgagtcttacaccctgaggtaaggtagctacgagcaaaaatgtacgtatgcataattctgaactcaagaagtaataaactggatcaggaaatggattttgagtagcaaattctctgggcagccaaagatgaaagacgttcctgtttacaaacagaggcaccagagcaaagaacggcttcactgaggcgagagctaattaaatcttgaggaaattgttccaaggcatggaagatggagagcgaatatcaaagggactcgtgtaagaggactgccctaaagatgaaggaaataaagcaaaatgaaaacttcttggaggaaaaaaaaaaaaaggaaaacaaagag

SEQ ID NO: 35047 - DNA, 1413 bp, Bovine  19866881027474
gtttgatcgctgatctgggaagatccccacatgctgtggagcaagtaagtccacatgcacgactattgagcctatgctctagagactccaagccacaattgatgagtccacatgctgtgagtacttaaggcccacgcgccctagagcctttgctccacagcaagaaaagctactgcagtgagaaccctgcccactgagactagagaacagctggccctcgccgcaactagaaaaaagcctacgcacaacgaagaccacacacagccaaaaataagtagataaataaagaaaattagttttttaatgtgaataacctggactctaaaaataacctggcttttaatttttgctcctgttgtcttcaattaattttgacaaaattctgagtttcactattttcttagataactgtctatatacacaaagggcatgaggaatgttttttaaaaatggctaagtatgttttatataacaaagtacagaaaatatatttcttgcaaagagctaactgtgagagacattttcccccgtggaccaacagtcttttcttcagagtataggcaatgctgatctctgaattaaaacttaaactttcataataagtatataatttgaaatatctctaatagtttatatattaacaatgttccagagaaatttttcttacacacatctcagcaattaacctagagtagacagaatatacatagtattatatgtgactgaagtatgggtttatcactacactatgggcctggcagggttaaattttgaaaatttaaccttgcagaatttaagcttgcagaaaataatcaggattcatacttttttttttatattcctcttgtattcattgtgaacaaaatttcaaatacacacaacaaattcttcaaatatataaaaatgttgtaaatagtcatttttctaacacatcctcaaattagactcttggccataaatgggaactgttgttttcttttttcttttttaatgaaaaatgattataagggttaatctcacagacaacaggcttttgactcaagggtaatttaataaaggtattgctcgatttgccaacgatgcagtgaattttgcctgtgatgttagtcctatctttttatttaagaattgctgtcaagggacaactcataaaaatagaatctcattactactaatcttaataattcactcagcaagctcctatgtccaattctgcctgactcttgtccatgtcacaaaatgactttcttggtctgattttcataataaagctttaaccaagtcatctcccagttagattattctgcatacagaatgggatttaatgtatttagaatgagaatgatactactggaaggtgcactagtgattaaaagtcctacccacggttttatagatgatgaaacagaattt

SEQ ID NO: 35048 - DNA, 1463 bp, Bovine  19866881033801
tgatggaaatttgggttgtttcctaaatacatttacttttaagagactgcaaataactgattcatgcattctttccaggttttacacttgcttccggtaggagacacagggttgagtgtccttactctatatcatctgcaactggaacccacttagaagtttcattttaatatgcaaccaggatactcattataagcataacagaaacttccctatagcattcgatttgaaggatagcatacatccaaatagatctctttcagctaccgctgtctagagatgctttgtttaaatgaaaatatctccccctttacacattgtatttgaagatgcaaaccaccttggaaagagtaatacaattttctttgtacagtattagccattgatattttaatgtgacagtttatggcttgtttttttctttataattagttgaaaagtgggacagtgagcaacttatgaataaataacaactcagtatgcaaaaacataatgtttccactccctctacttattgcctcccattatcctcaaataacatgtattaactgtctattttatttgagataattatatatgatcataaaaaatctttatgaaaagtatatttctatcaagagaaccccttaactcccatcaccatgctgaagacactcaaagcaacttttagattttccttaggccttatttaaattttcacaaaataaactcaaggcagaaattttccacagatgttccctgatgattatgaattggagattacactcttaggacagaagaaatgattgagcatcttagtaaatgcattctagttactagtgagcaaatagtcaattcaactgtagttcagttgctaagtcgtggccgactcttcctgaccacgtgaactgaaggacaccaggcttacttgtccttcactgtctcctggagttttctcaaacttatgtccattgagtccatgataccatccaaccatctcttcctctattgcccctttctctttctgtcctcaatctttcccagcatcagagtcttttccaatcagttggttctttgcatcaggtggccaaaatatctgagcttcagcttcagcatcaatctttccagtgaatattcagggttgatttccctttaggactgactggtttgatctcaatccaattacctaggtcctaagaagtttaaattaagcctctccaaatgtggggaaggttttaattgctaataagataattgtacctggtttcaaagtagaggctatagttttcttttttaaaaaactcatttttgggaaatagagcaattccctgagaggaaggatgataaaaaaaacaataactgagtttccctcatggactacatccctcatggatggatttacaaattagcagtaaatttctaacttacataattaataataagcagatgtgtcctttttcttttttactttcatgtgttcccat

SEQ ID NO: 35049 - DNA, 1253 bp, Bovine  19866881087301
cccaattctggcaccaaatttaatagaatatcacaaaacagattctaataagaaatgcatatattcaagtcattgtgttagtatattagttaggggacgtgtgtaggaattttaagtagtttctcctacgactttaagtaatttcttaaaacagaggggatagttaaaaaatttaccaatgatacaattactcatggagcacagtcaatgaactagagtaagtcaagaaatatttacacatatttgagcactccctatgtgccagacattatgtagactgaagacagaatggcagatagatgactgcagtgaataactcagcgactagtggttgcttaagcatttttaattctaccgttctccaccatccaccaatcattttgggcagcaagtataagtcccagaccacaaactaagaaatgtaagaattgggaatatttttagtttttagaacttaatgtctattataagattctgtttttctaaaagctaaaaaaattaatttcggtgaattcagggatctgcttttccttctctttctctctacatttgggtctataatctagtgagtttatgtaatatcagggcatattagcttagagtgggggtgaacacaagcttatttgggtcaacaccgtctattaacattggcatttgctgataagttctcatttgtatctggatgtggtcactggtccatgtggctattgaattcagccttgattccagctgtcaacatcttcagatccttctgctctctgtcacgtgcaggcacatggtaaatcatctcccactcctgcactactgaatgggacctactgcccacttcctgtgcttcccaaactctgctgtagccatgggaactctctgaggtcatcacagtctcatctgcctacacacatcttgcagaaatttctgctatattccccaccatgctgggtggaaaaatcaatatctggtcattttcagggctttatccagtatattaggatagtaactgagctcttttattttgagacagcaaataataatgtcacttaaataaaatagaagtttatttcttcctcacagaaaaatattggaaagtggtcctgtgctgatacaatgctttaaatgtgtcattatccaggtttctttcacctcattgctctacttcaacctatggtccagttttcactatttcttttcattatagtcaagagaaagaaggaaatgagggtatacttggtcacatgatcaaatttagctgcaca

SEQ ID NO: 35050 - DNA, 1491 bp, Bovine  19866881119667
agaagctatttaaaatcttgccaaccatctgatctctttgttgattacatctgtttgtgaatttttttttcatgtcatattttttgtttcagcttgtcatgggtgagatgagagattaaaaatgcatgtgaacattcactaaacagaagttttgatacatcatgtgatgtttagaaacataaacaggtttcaattagtggaaaatacactttgaattcaaaggagtctttatttatctgttctttcatccaatcatccatatatttattcaataaagatatatccaacatattttaaggagccagatattagtgatctcatggtaaacaagataggcatggcatctgcttttggagcgataaggttagaaagaaattaacacaatttaatacactacattatatgcctctgtgtatgtctgtgagtaccttaatacaatacactctatatacctgtgtgtgtatatgcatgtgtgtactgagggtaaaataacatcagaatacttgtttaatgtcctgcctatgagagtataaaatgacattagaactaaaatttagtgaagagaagaagccagcctgcaaaaatttgggagaaaggctgtttcagtttggagaaggaacaagttaagaagctatgtcatgagtttggcatgcttgaggaatcaaaagaaatccaaagtgaataaagtagagagagggttgcaaaatgtggtataagatgaaagtggaaacataagcagaggttagattattgtgggtttatttctattaggagctcttcatttctggtattacagatctaaggattccaaagattcacaaaactctaaatttttagcatacatttggtttttgttatgcatctgtgcatttttacagtagtcttgactcaaggcagtctaagaattaagacatgatctgttaattttatagttttaatccagcattggcctaatgtgcttttaattaaaatgttgggtagacacatcataaattgaggattagcttccttcaaagtctcatgaccccttccattagtgactgtaatattttggtacttacacattctaatcctaaatggttcaactagctgttatttgaggttttttttttttttttttttcgtgcaggaaaaaggaagtatttcattaaatcatgccaagggttatagtgttaaacctgcttgagaagaaggataaaattggattaggagttgttttattcgtcttgaaatgtgcattacaccaacatattctgaaattggtacaataggcaatttttagcccttgataataactaaaaatgtaaacttcttacattctcatttttcacaagtgtttggcaactattgtatgagaacaatggaagcagatatatgattctatattcaatatcccaaagagatgatgaatgataacacttacagtttaaaagaaaaatggccctatttcaagtgtcctttctgggaagttctatggctgttttgggaaaa

SEQ ID NO: 35051 - DNA, 1065 bp, Bovine  19866881191308
ttggttctctataagataaaataaattagctaatctctgattaaaaattatctttcccacaaatgatgcaatagttttcatggaggaattttacaaacagggtgtttgacctaggatgtagttttctctgaaataagggtgtgtctgcatattctggatcactaatttcagttgttttcaaaataaattgttttgaccttacatgctttgtaggaccctagaattgtgtttgtttcctttttaattatattatcactttaagctgttggaaaccctctaaatcttcaaaatatgtgcatctaagccaattgttagttttttggatttattggcacttccacagttaacataaaattaataggaagccagatgtacataaaatatatatttggattttaaaaaatcatctaaatatgtcttggaatttgacaagaaaatatcattttccatttaacttaatgttcagaaattttactgtctacataactaaattttatataaaagggaatatattagcaaactcaagtactcttctatttttctcatttgttttcattctctacatggacaaattaactttaaacgtctataaatttatctttaccaagccctcatgggaacagattgttgtcctgtggttaatgctgcacatttcttactcttcatcaaggacctttctttaatgtcttatggtccagtgtgattatccatcatcacatttaaacctcagaaactgaactctagcaaattccctatatcattgttcgtcttgggcctggtggggtttgtcaattttatcacatatgaaggataactaacttgccatttatctcagagtagagaagataatttaaagaaaaactatggattaaattccaaagactctaagctcatttagaaaatagccagtctttcctcacttaaaccctggctagtttttaaatacatatgtattttagtatacacattttcatatgtgtattatatattatgtatatatatggactatatcttatatatatgtgggggggggggatatatatatggatatatggatatatatat

SEQ ID NO: 35052 - DNA, 1216 bp, Bovine  19866881218820
tattttggttccctacttaaaaaaagattcaacttaatctattcttgaagctcaatcactacccaggatgagttctttaatcacaactttttaaactgcttatactaaaaaagggattcaaactgtccttattgtaaccaaattagttttcataaaagcttgtgctcaagataataggaaaccagtatttaaagaatttttttttttttttttaaccaatttacctgtaagccacaggtcattaatccatctagctaaattcgaatgctttaatcttataccccagatatttgaaacaagctgatttaggagcctaattaaacattacagtatttgtaagaaccattctaaaatgcatgacatgcttctctctcttagtatactgagtctgaggcacacaactctcatagcaaaagcattagttaacataatgtaataaactgatgctaagagatgctccagggagccatagggacagagttgaagtctctgtaatgaatgctcccaatgctccctcagcctcttgtgtccctcatcctgtcatatccacacagcccacaactctgctactcagcgagttatttttccagacgagcccactcttctaaccatgctcatggttaagctttcgtatcatctttctacggtgagggacaggaaagcctggtgtgctgcagtccatggggtcacaaagagttggacatgaattggtgatggaacaacaagaagaaatcagcattctatatttacttttaagcaacaggctgtggttacaaagcaagctcatctcctaaggataaactctgcaaaagatataagatcttttatgtttcttagactgaagggtatgctcctcagaagcagaagcttggcttctggggatatgaggctctggggcacacactgcacatcttccaagggtatctattttaccatgtggatacaccgtggggcaggaagcaaaaactgcaagaatattcaaagtaagatctgagacttcaaaggattcttgggtttatgtttgctttcccatggctatgtcccagaacccctaaggtctgtgctttttttcctctcctcttttcagaaagagagagagagagagagagagagagagagagagagacagatgaacattacaggcagaaagaatagccctaaatgctggagggtctgaggagtaaaggacagcaggtctaggcagaaggaaacactg

SEQ ID NO: 35053 - DNA, 1837 bp, Bovine  19866881267149
cggatggtgactgcagcctgaaattaaaagacacttgctgcttggaagaaaagctatgacaaaataccagacagtgtattaaaaaggagagacatcactttgccaacaaaggttcatctagtcaaagctatggtttttccattagtcacgtatggatgtgagagttggaccataaagaaggctgagagccagagaactgatgcttttgaactgtggtgttggagaagacgcttgagagtcccttggactgcaaggagaccaaaccagtccatcctaaaggatattggtcctgaatattcattggaaggactgatgctgaagctgaagctccaatattttggctacctgatgcaaaaggctgacacactggaaaagactctgatgctgggaaagactgaaggcaggaggagaagcagacaacagaggatgagatggttaggtggcatcaccaactcgatggacatgagtttgagcaagcttcgggagttggtgatggacagggaagcctggtgtgctgcaaacagtggggttgcaaagagccggacacaactgagagactgaacataacaataactagagaaacaacccacatgtccatatccaactgagaatggataaacaaactatggaatatttatacagggatattattcacaataaagagaaatgaagtacggatgcagcctacaatgtctaagtgatagaagccagttataaaagaatacacattaactgaacccacttatatgaaatgtcctgaacagacaaatctacaaatataaaaaatgaaataggggttaccttaggttaagaagagagggaatatacttgaaggaaaatgcagattgactgctaatgagtatggatgcttttgcgggggagggcaatgaaagtattcacaattgattatggctatcattgcacaattctgtgaatatactgaaaatcactgaattttacaatttaaataggaaaattgtataatgtgaattacatttcaataaattaatttaaaaaaatagggttagaacatcaatccgagaattttggatttaattctgtacttttttgggctatacctggcaagccatcacttactaagcctcccctcgcatcactagttagctctccttattggttcttcttcttttcctaatcagtgtaataaaccactgctgggcaagaacggcatagtaattatctttgttgcatcagatccccaaatgccaattctggtattgttattcccaaagtcagctcaatacattttttgtttgttgaacgattaaaataaaatacttccaattgaggtgattctaggcttatagaataggactgttcctgaaaagcggaataaggttttaatgtaaatgtctaaatattcttgtgtgctcaatatttggaaaaaatcattatcaccatgtcactatctcggtcttagagtgaacagccatctgtctatttttatttttggaaatctgatttttggaagtcatactcatggccccttaaagcaggtacattttaaatcttcttctctttttcaagttgatttggttcactggtataacactggagactctacatggaaaaatgcaaatgtattacaaatgtttttgacatatagtgtcataatattctaagtgggtttaacttttacatttccattagctggtggtaataacataataaaaagtaacaaatgattggaacattcaaaaggaggataaacagctgtaaagctgtgtgagagtaattctgcaacagtttccatggatttgtgctatcagagaatcacatatagtcgaatgcagtaaactactattttttaatgttc

SEQ ID NO: 35054 - DNA, 1561 bp, Bovine  19866881404945
atgttacttaaataggttcaagtgtttccctgggaaagaattatcctcaggagtcagaagctttgcatatttgattatcagatatgcatttcctgtttggtgtctttctattttctacaaaacctcagatggatggaaacaataaatgtttgttcagcagcagctggtcccagactcttattctgtcttgaacatattttctttattcatcttcatttttcaacctctttcagtagcctttccttttctctaggcattacatgtgaaataaaaatgtgtagcacttaatgtgttcactctcacatttctcctgctgaattaagtacacttgtatttatacaaaaggccttaggatatccactgtgcaaactgacaatttaaataagaacctgagaaatgaagaaaaagatccttcaacattgcataacatcagagcaaatgcttcactttttaaaatatctttgggggggaggtctttaatgttgacttgagagaatcagttgcttcaaaagaattaatctagtgttctatgtgaaagaatctagagaaagaatgaaagaagacccatatccataaaacctactattgtaccaatactgttatcttgtactaagtgaaatgaattttttaacaggagcaacgacaccttcattccctgggattgtgccgcatttatcttaaaagctagaaggagcacatggaacctttcctgtgcttaacatctctctgacttccccttctgcagactctccctgacttccttctttcagttctactagttagtgctcatgtgattatattggtgtcctctggataattcaggctaccatagctgttttaaggtcaactgagcagtagcgttcattacatctgccaacgatactgtgccatgtacacattcacggaggtaacaccaggggcagttgtgggggctacaaatctgtctaccacagtttgtaacatacttagcacaccctgcttgaaatggaatgaatgttgactattggtgtttacagcaacagtgaagacactacattaccatgtgggaatctatgcattctaaacgaacatgctaccctgaagtaacttccaagggacatgagaaactatgattgtatttaagatgccttgttataaagttggacgatatcacagtatctcagtagcagcttcatttgcctgaaaatgaggaactaaaatcagagaggaagtattaatgtttataccttttctgaggtttagaagagctggaaactgtgaggactgatgattagacagcattctgctcacagggaaggggacttgtgttcctgaagggagcccttatgttagaaatcactagataaaacatgacaggaggcaccaggatggtgacagcaattttagctgtatacagcaaagaaagataagggatttctgcaagagcatgttgtctcccttaagagaaaaggacattccaaggacagtagtctaagagcagtgaaaaggaagcttactgagtgcaactgtcttatcagagtgaaaagacataaagcaaacaacagtatatgcatgtaatctg

SEQ ID NO: 35055 - DNA, 827 bp, Bovine  19866881461721
cccttttgaccagccacacagttctcacagaggaaagcgggctgtctgaggcactgtttactggactgttatgctcccagggaaagttaatagaccaagtttaaaggctgtctgtaaagttggtggccttttgaagtaatcaaaacaaggggaaaagaaaaaaaataataatgtaccttaacaaggtctaaaatcgactttatcaggaatttccaatgggtgaaacaaacttgctgtgttttttgaactttgtctgcctctgaaccaatgaagctgagctctagaatgaattcattgattcctggaatcttaagcactcattcttctcctgcaatattgtcagatgcaatccatgacagaaaataaactgtttacttcctaggtcacagataagagtctgaagaaggatgagacaaatattttgtactttctcttcaagtcaccccctggtcccctcagcacccatcacaggtggcctcatgttactcctttatcaatttgctctttttccctcttctgtcttccatctcctttctacaacacttctggcttcctgatctattttgattctctgtcacccaacagacttaagtctttcatatattttatagtgaagcagctacaatagtaatgacacttctacaaataattgactgtattttataacataactttgatttgtttgaatgaaaaacaaagttattctattccctgttttaccagttaatccctcggatcagggaagaatgaacggatgagaagattctgagggaagaaagatccaattcatgcaacacatgagcattgctgtggcagatgcctgcctg

SEQ ID NO: 35056 - DNA, 1217 bp, Bovine  19866881773378
tgaaaaaactgtagagctgacattcaactgatacatctagcatggctaaattggtgttaaagaattaaaatgctttggtagtgattcctgtgtaaccactgctacaaattctccaagtgagaagagtctcaccagtgccctcccatgagacctctgtgagacttggaaacttctccagaatctcgacttgatccatcaactaaaatatttacacctggcaaaacctaggtttccatgaccattttaatttgttctgattggtcaaacccactgatcatcacatccatcacttctggaaagacacaaaagacagtcactacaaaagcccaattctaaacttggtctatcttttctcaagaattaaaacctgagatatatcagcttagccatagcatgataagagataaagtaattttccattttatctcatcaaatgcttgttataaatttcaacttaataaaaaaaagaaaaggacaggcgatagtggagggtaattgtgaactattaattgaactggcaaacctaaagtgtcctgaaaaggatttaggattctataagggaccataataatcattttcccttcaactttagcttttaattatctttttgtcccaggcctcccatttgtattgagtgcttaagggtaatctgatgaataagaaacagggtaagaactatcttctggtaacagaaatggccaacatttattggatatttaccccatgttgggaattatgctcaatatattatatatgcatcatgcatttattcaaatgtcaacctatcagacatcagcctcataacacaattttgtaaggtagacagtatcatacttcttttacagaggagagagctgagcattgcagacatttgtaacttgccctgggttttttaaccactatggattggcatccaaatgtgagccatggtctccctgatgcagagtaagatctctaaaccactttgcagaactgtctccaaagcaaaagtcaagcttgactggttctccaagtttctagtcaacagctcagccaagagaaccaaaagaaaatattcagtttgtctggaagttcctgttaaaatgaaatgattaactcctttgaatttaagcaagcagtgcagcgatgattatctgtttttgctttaaaatttttccatatgtttcttttccatggcatatggtaacacgaattgagtttcccctccaatcttccag

SEQ ID NO: 35057 - DNA, 2082 bp, Bovine  19866880420338
atgaagcacaagctagaatcggttgctgggagaaatatcaataacctcagatatgcagatgacaccacgcttatggcagaaagtgaagaagaactaaagagcctcttgatgaaagtgaaaaaagagagtgaaaaagctagcttaaaactcaacattcaaaaagcgaagatcatggcatccagtcccatcacttcatggcagatagatgaggaaacaatggaaacagtgagagacttcatttttttagactccaaaatcactgcagatggtgactgcagccatgaatttaaaagacgcttgttccttggaagaaaagctctgaccaacctagatagcatattaaaaagcacagacatttctttgccaacaaaggtccgtctagtcaaagctatgtttttttccagtggtcatgtatggatgtgagagttggaccacaaagaaggctgagcacggaagaattgatgcttttgaactgtggtgttggagaagactcctgagagtcccttggactgcaaggagatcaaaccagtcagtcctaaaggaaatcagtcctgaatgttcattggaaggactgatgctgaagctgaaactccaatatcttggccacatgatgcgaagcactgactccttggaaaagaccctgatgctgggaaagattgaaggcaggaggagaagcagatgacagaggatgagatggttggatggcaccactgacttgatggacatgagtttgagcaagctctgtgagttggtgatggacagggaagcctggcatggctgcagttcatgggggtcacaaagagttggacatgattgagcaactcaactgaactgatttctgaaccccaacagggtgagacaatgtcagtgattccttttggctgcaataaaagttggaggcaaagtggagccctgcaaggccttaaaattagtttttatttttttttaaaaatcatttattttggttgaaggcaagttgctttacaatgttgtattggtttctgctacacatccacatgaatcagccataggtatacatatgctccctccctcttgaagctctctcccaccttccttcccatcctgcaaggctgtaacattgggaaacacttttttttttcagaagggagagaatctgcagcagaatgcccatgcctgtggtcaggccttgggctggcaggtcacggtctcatgtggctttctatgcttttcctcttaggaccattactcttttcagtgctgatttgggaatgaaattaaggtccagttatttcacgaatgccatcgacaaactcatcagcagcattaaaccacctgagcacccaaggacaaagacctctccatgagtctccgtcattggttcttatctttgcatggaaatcactaattgcatctgaattgctgatgtaaaaactcagtagaaatcaactaatggcattcatttgctgggtcaagaaagtagtgactatcttatgcttctatgaaatagcataatccttttagtctgcctgttccagaattcacctaatatttgtctgtaattcttgttagtaaaacagggggttttcatgaatacagaaagagaactacggcgtcaggcaaagtaacattttcctaagtgttggactgaatttcaggacataagttttaaattctaacaaacagacaattagaacaatcaaaatttagatagatctcaactgcctaaataaaaaaaaaatgctactgaataacatattaccaataaggcagaataggataatacaagcattatcatctagtctatcacaaaattttgtttagtaggtatctttttacctaactatccagtcttcatttcaaaggaaagtatgtcttttccttgtcatccaaactgtccttctacattgtacagctatacacctgaaagtaccctcttcaagagtctctatgcatcatgttttaaaatccactgtaaataagtctgtaaaataaatccttatgtacttgaacagaggtgccaatacaagtagacgctgagataatatcaaaggattgaagtaacatgttgaattaagaagtccgtaacaaactaggagggtg

SEQ ID NO: 35058 - DNA, 3012 bp, Bovine  19866880572556
ctcttttattgaacggtggccattatttcttttattcttttaacagatggagaaaatgcaggtttgtgtcccatgagttaaatcacctctaaaataatacaagcttgcacaaaatgatgcattctaccaatattagaataacacttaatatcaataaaggcaaaggcaaactttattcctttttacaacccttttagtgcaaataacctatatgagcattttctaaataattagaaaatgtctattataacatattacacatataatgactaatatggagttcttgaacatatttttattaatgctactatagatttccatcacatgcaataatgaatgaatgagtggtaggaaacacaaaaatatcctttacacattaagtatattaattggaaaaaacatttggataattattgaaatccaaattcatttttaatttctcttaaataatggagttaattcagcttgctacatctgcagcagccacgttataagattaaaagtgaaaggaaaaaaataaaacatgaaacaaaagaattcacatgaaaatgcacaataaggtcaagttcctcttcacagcacaagagaacgatgagacattttcatacctgaaacacgtctgcttcgttctttaataaactgatctccatctgctcatgcccttggaaatctttcagcagtacaacccgctgtgctcaagtcccgtataactttgtatttctctgctcataattaactaattattctctaatcaatagtgtagatcttgattttacaacataaattaggtaaatgacagaatggctgggggtcaatctcattttatttacaaagcccagcatgagcatccaacttcattgtatcttatgtacctgaacagcaatgaatcttattagcagacctacagaaagtcttaagactgagtactgggagaaagaggcctacatgtttattaaattaaaaaaaaaaaaaaaaaaaaagtagtatttgcaaagcatgtccagatcagaaatattttaaatcacaatccttagtgttatgtaaactggcaaagtgctgactcaggcaagtaggaaaaaatttctgccttcatatatcatgcaactctaaagctgagtctcttaaacaagttttaattgttgaaatgatttcagaaaacttaaagaaaaattaatgatgtcaatatatcattctgctgcagagtccttctgaatttcttgaaaagattttggtgaaatattaataaaaatattcccatactgagaaacaagtgaaacagtggtaagttttgtcaaataaagaatattaagtatttaaaaataatgatctctttaagtgtatgggagaaggcaatggcaccccactccagtactcttgcctggaaaatcccatggagagaggagcctggtgggctacagtccatggggtcgctaagagtcggacacgactgagcgacttcactttcacttttcactttcatgcattggaggaggaaatggcaacccactccagtgttcttcctggagaatcccagggatgggggagcctggtgggctgcagtccatggggtcgctaagagtcggacacaactgagtgacttcacccttcacttttaagtgtatgatgtaaaaacagggaaataggatagtgagtgtgaatattcttattatttatcatcaatctatttttactattaaaaacgtaaaatcagataaacaaacacatgaataatgatatataaatgataaaaaaatttcatttacaaacttaaaatggattaaggttaaggctaatctctgctttcatgttaaacataatcctaatttcaaattttaacaaagttactatggacaaaggctatgcgccttgattcatttctgtgcctaaaatacggctatctctgtaacaggtataaaataaacacctatttaattgaacttatgtataataaagaagttatactgcatgtgttgtaaatagaattaccacaatcccttttacctagaaataaatatttttgcaaatttaagggccttttaatgagattaaagccacattcaatcaatcgatgtcaagcacaacaccatgattcttttaaaaaatattatatacaaatggttgtcaaaggatgtccctggccagcagcagcatcatcacttgggaacttgttagaaaagcaaaatttctggcctcatcccagagccacttattcaggaactgcagggagaaggaggagggagtaaaatgtagaggactaaaagaagactggtggtatgtgagcagtctgcttttaaacaaattcttcctgtgattctgatacactacaaagtttcagaaccactgctatatactgtcatgttattcttcttgtatctccgagttatttattttaccccttgatatttcagtgttttctttcctttccctattagtgtgacaatgaaccatcattcacttgtttggctgttttctcttatatatgtctgtaaaatatgaacagtttagtgtatatccccgtaagtatacactaatatctcctttgaataacaactggaccaatttcagaaaagggttaattctgttccctggaaatataagagtgtctaggagattattaggaaaaagtgttttatttgtgatctatgaccaagattcttagggctagcaccaaatatggaacaggatatctaccacagaagtattaaagtaagacagagaatgaagacagtatgttattacaaacagaaaaaggtggaaaggattttgattgacagtgacatcaaaagcataagacttaattattttttcaaaatgaaaagtctaaaataaaatgaccactggtaatttctcatcatgtatcaaaggaggatcaggtcccaatgaattagccatctcttttttaaggaaatggaaatctgccatttctcttaaattcagcaacagtactcattaccaactttttcttaagacttatacagcaataacaggagtccttctcctaaggaaaaaaaa

SEQ ID NO: 35059 - DNA, 1952 bp, Bovine  19866880826402
gacttcccatcttcttgagaatgctcacaaagcatctcttctcttctggaaagccttgctctatttttccctacttgcttaaacctacccattcttttacaaatccattggctttactggctaccactgtttcttttttttacaattatcttattgggtaatcctatactaccagttcctattatctgagaattttcagaaaactgattatttctacataagaaatttctgtggctttccagtcataatgatggagagttggcaggaagaaaggaggaaggaagaggggaaagtgaaggagggtaagagggagggaaaaaaaaaaaaggaaggaagaaagtgaaaaaaaaaaaggaaagcaaaagaaaggtacttgttcagtaaggcatactttaattatatcactaacaaaatgccaaatcatttttagttgaaaatatagggatttatatccacactgcatattattctaattagttcttttgatctatataatcatctgaagacaaagaactgttgaactcaatgtaaatcctcccattctgagacatttgcaagaaagagcagcagaattaaagtccgtcaggcaactaaatacaatcgacaatagagttcataaagagtgatggtctcatattaaagccagctgggaaaacgggcagattgagaaatttcaagttaaatttccatttctttagttgaaattgcaccttttatgaatattcctattatcccggggattcaggggaaccaaagtagtgtttagtcaaatactatctgatgtatcttttttcaaaagtgagctattaagagatatgtatgtgcaaaatacacttccaaggttttcggttttgttttttaaattattgtgtgatggggcccatatccaggcactccatatcaactctaaaacagagtccaatgctgtacaagtgttacaaactatattttagtaaattactttccttttctcagcatgtttccacagggcaaaaaagttttacgtgggacaactttatgacttcattcccaacagaaatgtgccctctcaaagttaacaggcattgatctttagaccagtgagcctataaaatcagctctaataatacacatttaagtgacaataaaaagtaggatactttctggttacatgtaataggtaaggtctatgtaattactaaacaaagctgccctgatttactgacatgtcatttctgaccaagagttactaggaagaaaaaaggagaggggaggacaaatggacaaaaaaaattaacttgaaagaataaaaacactgctttaaagatataatagaactaaatgatttgtgtatcacagttaacataaaatgtaaaggggtaatagtcatgttactaaaaaaaatttaacttatttattttgaaaacagattcctataatagaattcagtgcttggtcactcttcccctacattcccatcctaaactttggtttctttttaatgaaaaaaaggagtcagcaaaacaaaatgccaccattaaatcattctgcaacattttgtgtcaaaaatgtaatgggaaatgcacacatcaagggaaaggttacctgttcttccagaacatcttttcacttggttcacggctcatccttctacataaccgtgcaggcactgctgacggttttctctctcggtttaatgtggcatttgaaggattatggcattttcagaaaccacagtgcagtgattttagtggttatctgactgaaagtgatactgcgactcagaataactgcgctgtttatgtgcagtggtaaaagtcagctaccaactcttttcacattatcaacctagttcctgattgcgtattttcttaataatacacgaggtcagtctagaaactaaagccagaattagagaaaactccatttaaatgggagcctgctgtatacaggcatactatatttaattttaa

SEQ ID NO: 35060 - DNA, 857 bp, Bovine  19866880871138
ttcagctttctgcctttgctgtggatatccagaggccacaaagctatttaaactgtgtggattaaactacagtgttacttcttaaaagatcatcattaaggaaggagtgaaaatcacagtgccattggatataccaagtcaggactacttacatcgaaaccatcagccctgagaattctaggagatttagttgatacatgatgcattctgagtcttatgtgatcttttctgaaatctaccaactgataattcactttcatctctaaaaacacgatggtgggactgaccaatttaggatgcctgatgcaagcctctgtctgcagtgttaacccctagtaacattttcgcatgaagagtttaataccaaaatctctacactactatattcaaacataacaacatgcctactcaattgaatgatacacattattatgtcagattatatacttgttaataagcaattttaatggtggctaaaactaagctctaaactgagcagaaaacccattgagtaaattcagcatcttggtggttgataatagtttcattgagttgcatttcagaggcaaagacccttttgtaagacttcttgcctctctccaaagtgcgaatgctggacatgtactagtaccttagaagagtcctcaagttcagtattttacaatggttgttgtctggaaaactaatttgcttgtgttaatacagtacatttctactttccctaattttcaaactggttgcctggatctttttttgctatatggaaggcacatttttgcactatattagtgcagcatgataggcgcttaaccagtattgccatagcaactgcctcttttcatatgggatgaagacat

SEQ ID NO: 35061 - DNA, 1613 bp, Bovine  19866881286839
atcttttttattgtgaatcttaaaaaatttgtttttgaaagcaatgtttctagtcttctaattcccagtagtttatctgtaacttctaaagacatttaacactttaaatcttataattatatttatacgcgtgttatctatcctaccagaacataactttttaagggccacatttatgtctgattattttagtatgtctcaggtacctgggagagcatgtggcataccttctgaatattacacagatttttattcaacaaaatgaggttcttattgcagacttattggtaggtccatcaagacaaagagcatatctatataaataaaagagttactgtttcttatcaaatgttacacttcttatcaaatatttatacaaaatactgaaatggacattttctttcagattgtctttaaaatctcagagaactctggtgttcttcattctggaggagacagtttctttttaactaaaaactgttatctctatttcaagtcaatttaccattatcaataggcactttaaaatgttaacagaaatgttgactgacctagacagaaacaattctaagaaaggacagtattttaaacatgctgaagagacattctcttatgtgtcttattctaggtcttttctgcatatttgggtcatcactggaagaaatttatgtttcagacatccatttattgctcaaaaaaatagccttgggcatctaaggcaaaacttagaatctgtaccacttctgttgccattcagtaaaatgaaagtttaaaaaataatttcaatgacaacaaataggaaacaagctagcagttaagcactaccaggagtgcttttaaatctatctttggaaaaatcatgtgtaacattcaggttccggtcttaaaacaattatgaaaaaaacagtctctaagagtttgcaatgtagctggtaaggagagccaagacataaaaagatgaataacaatacaaagaaacatctaccaaatgtcaaatgaacagtctagcaaaatgcaaaagaattttagtttagtcctaaagactacttggaaaatcaggatttagctgaatatatcactaaacaaacaaacaaacatgacactctgatgatctctgtaaaagggagagggaagggagtgggcagaggggagagagacagtgagacaggaacagatatatctggaatattagcatgaggccagatgatagacagccttgaaagtccaggataaaactctgacgtctgtcagttttcaccgtccaccacagagcagtgggcaatgaagagcttctttgagttttgcaacttggaaggacaggtgacaagtgatctttcaaaggaatgattggaaaaaccttgtagggggacttggtgaaaacggaaacttagattttgaagagaaagatttttggaataaagaacaaaagtaagtgacatatgtatttttcttctgaaaagaaaagaaataagagattgaggtattttgaaagtaacaaaagactttctaaggttgggatgtgataagataaggttatggcccctttttccctcagtaaagtaagagacagagttatctagaataaaatgagggtgctgtaaataaaactgaga

SEQ ID NO: 35062 - DNA, 3021 bp, Bovine  19866881400872
tgggccattcttcctctccttgtgctgcttgaggctacttatcctttttatggttcaccctgttcttttcacaggccagtatatcttggtgtggatgggggctgaattcagccctggtggaccccacattacatgataatatttgcaacatgcctagcatgaaatacttaatcaacgttaatttctttactcgttcgctctgccattcctccctttttcattcactctgctcagagcaaccgattactgtcaacaagctttagggcaagaagatttcgcccccaaacactagtcccttatcctcactgtcataaaatttcatagtttccactctaagtactgcctttacgtttttaacagaagtctgttctttgagtatccaccattaatcatagaatgatttactttctctcgtgtggctcaccctgcaggttgttctctattgaaattgaacgtgcttgttcctgtcctatgggtggaggttgcatcagtgtgggcatgaaacaggagtggtgttttgttctaatcccttcaacccaaagaacaacttcatggctgaggtcaagctgagcatggtgtcctccccctgggcagagacgtggctaccaggacactttctgtgtgacatcattaaagcctacccctgacagcagaaacccaaggttttccctttcctatttcatgccccctatggtgtgggcaggctaaaaaatcacactttaagcactgcaggaaatctgaaacatgaggacaagtatctttattttgtaggggggaaagcagattctcaaagagactaggtcagttttcccaaggtcatatggctagtgagtggagggggcgagtcccacgctggctgacggtggagtccatgtgctttcagtatacattccagtacctgtgatgccaggcatttgcttaagatcttgctaaggaaagtacaggctgcagatcagcatcactgatgtctcctgggaacttgatggctgtgtggaatctcaggtgccactccacaatgctgaatcaggatcttcctttttactaaggtccccaaatgatttgtatatgaatcaaatcaaagtttgagaagcatagacacagggcataataggtagctattaaataaaggcatgatgagtataaaagtaatttttcaaatatgtaggagaggtcaagcagttctgaaatcagtcacttgggagttctagaagaaaccaaaataatggatggaaggcaacatgcaaagagtaaaagagaagagcgttattcactgcaactgctgctgctaagttgcttcagtcgtgtccgactctgtgcaaccccacagacggcagcccaccaggctcccccgtccctgggattctccaggcaagaacactggagtgggttgccatttccttctccaatgcatgaaagtgaaaagtgaaagtgaagtcgctcagtcgtgtcccgtgtccgactcttcgtgaccccatggactgcagcctaccaggctcctctgtccatgggagtttccaggcaagagtactggagtggggtgccattgccttctccattcactgcaaagggtgctccatgtcagagcatcaatacaatggaactctaggcactaggattataggtagtttcactttttacagtttgcttatctataacttctaatttttctttaaggacatgaattacttgtattaatttttcaagtcaaggaaagtgaactttatcagttgtattcagtgtgaaattccccttctagagctgactgagaaaagattaggcagagacactcatttaaaaattgtcggatcaaacttttcctttatgcactaatcttttattcaacagaccatctagcacacaggttttgtgacaggaaatcgtggctagaaaaaggacatagccctacactcatggagtttactgagcggtcactagatgcttgtgaagcacacaggtcatttcccgttactctggcaaagtagaatgctgactttcttctctagtctatggccataccaccctgaatgcacttgaccttgtctgactttctgctctggatgtggtggtttttccattggaaggatccaaatggcacacgtgctaggcaagcataaaggaatccttgaactttcagctgggagagcctggtggacagatgcagagacgagaggcagttccacctgggctcccatcctggttctgtcagtgactcccatgtgaccttgggctaattacttagtctttcttatctctaggtgtgtgtactcagtcctgtctgactctttgtgaccccatggactgtacacctccaggctcctctgtccatggggattctccaggcaagaaaactggagaaatctgaaaactctgtgccttcctccgggggatctttatgacccagggatctagcctgcatctctgacatctcctgctttggtaggttaccgctagtaccacctgggaagccccagggaaccataataaacacttatcttgaagagatgatgaaaactatgtggtacaatgtagttttccataaagagtgttagtacccacattgctgtctcttggatacccctgtttatataagggctggattgagcctacctccttcctcctcaaatctttctctggtaggttttggaaaagcagaacttgagctctgtgtactcctgagttggcccataccacagcttgcttctctgctgtctcctcgcaattgctttccttgctatcatctcctgaaagcttcatgcactgggtacccctttcctcacacctcagagcatccttaatgtaaaatccttatgtctgacagatgttcactgatgatgtgagtaacataagggggagcccagcaacccagcacaatctgaatacatgacattgctctttaaaaaaaattcccaggtctcatggagattaatgatttctttctgtcatttttgtctgtagggtctgctgctgccatgctaccagtctttttgactaagaccctttcctatcaccccagccgcctga

SEQ ID NO: 35063 - DNA, 805 bp, Bovine  19866881854968
aaaacatgatggatgcgaatactgtttttccagcttaaaaaatacgtgtatgatttctttgagagcttgcttccaatacaaatattttattacaatgttttaatcttcattaagtactgaagatgtgctaggttctataattcataccaaaaataaagtggagggtactaataatataagaaccaggtttcattatttttaaattttaattcataagaggaacattacagtgttgcagtgggcatgtttcccaagttggtagaaattgttcagaccccacaaaattaatgtgataaaaatagcaaagtcttatttactctatagcctacttgggcactttgcaatttaagtaattatgatttaatgaaacatctaagaacctagaagtaaaaccctctggtttattttaccctctttaactttgaagcagatttgttttgttgggttttgtttttgctttaaattctctggagcttgggttgttttcccagagtgaattatttactaatatatatcgtcctcaaagtagaatatcttccatcaaacgattggcatccactaaacactagtaacctaagaattcagctgtgcagaaaagcaatctggagtgtctgggaatggactgcttgtttcacagagtaatcccgcctctgcaccaaagaaacgggggtgaggagccacattgttcttttgagtaacacatggtagagcccctccccgtggagcccctccctggctgtctcctttccctgctctgctccggaatgaaggtgggactgtaactcaaagtgtcttgctttctgct

SEQ ID NO: 35064 - DNA, 1380 bp, Bovine  19866880194900
ggtggtgtcatctgcatatctgaggttattgatatttctcctggcaatcttgattccagcttgtgcttcctcccagcccagcatttctcatgatgtattctgcatagaagttaaataagcaaggtgacaatatacagccttgacgtactccttttcctatttggaaccagtctgttgttccatgttcagttctaactgttgcttcctgacctgcatacaggtttctcaagaggcaggttaggtgatctggtattcctatctccttcagaattttccacggtttattgtgatccacacagtcaaaggctttggcatagtcattaaagcagaaatagatgtttttctgaaactctcttgctttttcgataatcctgactttctaggtatatccgaagtttctaggtatctggctaatattagcatcaatttaattaataatgcggtttgcctggtgttggatagcaaattgggaacctgacctactgactgaaattactattttaaagtatctgaaagtcaggggacacctaaaatgttggagttgagagttgttaccctttgtctaattccccattttctgggtgaagagattcaggtccagagggatgagatatatggctcagcttcactagctggtcaggttgggagcaaggactatgaacttgaagctcttagcctatagttaggtgctctttctgtttcactccttgcctctcagaaggtatattgtgaaatagcacataacttgagatttcacttgttctatttgggccaagtcctaaaaactcctttagttatttaaaccccaatgcttaagtcctaattaccattcagtaattactttacagtgaacagatgtgtgttattttctaagaaaaaagttgaaatgatctacacctgtaccttcagcagtgtttctccactgagaagtagcagtcagtgttaatgaatacgctcaagttgccaaggtctcagattcagctgatgctgatgtgtagtgcagtgtaagggtttctgttgccaacagatcaagtgttcaccaggctcacagcagctttgccaactgccaatcacccaattccactttctccctgaaaagtagcttttgtttttctgaagttaagtagtccattggtgaaatgagatagtgttttctcattggaaataatttccctggcagcataaagtaacaaaatagcaaagtgaatcagttgaagatgtgtttttgctgtgagtgacttaggtgtacacatgtaagattacagaagctgggatgaggttagcaacaactatatcagtggacttaatttttgttggtattgttggaatggactgattgccattctgtaatccttattgtgttcagaaatgagggtagaa

SEQ ID NO: 35065 - DNA, 2237 bp, Bovine  19866880366621
cggagtgccagcaatgcatcaaatgtactgttaatttcactcacagcagaggttctgcgctttgatgaggaccacttaaatttaatagaggagcaagctgtcccatgcctattctaaaacaggaaagtgacccaaaagccaggagatagatttatcttacatgcccagaacgtgatgtgtgccttttggcacagagtagatttttggcaagaaacctataaggtgaaatggtaattgtggggacaggacctcccagggtgatatgcaggagcagacaggcttgcttctttcatacaaggctcagataaagaatggccctcatattagagagcctttaaacgtgtaaaatattatttcatccaagaaagtagccctctgtagacaccaaggctataaggagaattggagtgagcatgcaagctgccaaggcaattgtcagcaatggctgccagagaatcagatgccgtggctgcagagatgttatctgtggcttaccctagaagttcaaagagaagcagcaatgactgaaccaactctcaggggatcacaagagctatattatctataatttatagaactttaaagacaaatcttgatttttgagggggtatacaagcagcgatgtttcctctgtaagggaaattgccttagagcatgtgtactgcagatttctctgcagaagagcatgcaaattggaatgatgaaggaagcttactatgaactgtcttgattaggtaaattctggttatatttgagtcaagccatggcagtataagcgtaactctaaaggggaaaatcctagtaagttcactggaattctaacaactgtgtaaggattcccagccaccatatttaatgacgtgaacaatagaactgctcaacaaataatgtggaagcgtaggaagtattccatcagagtctacacagaaacttttgaaatgtttgtctccaaattgcagtcagagtaagggtgaattagacaaatgacagtggctagaactttgtgtcacatcaaaatgtaggactatattcatctagctagtatcctccagcattgtataaggactgatattacttcttatgtattatgattcatcaatttgttattaggtatagtggatgaattgacccatttattccagattgactcatttattcagtaagtaattattaagtgcatgctatgtatcaagactggatctagttgttgggaatttagaagtgaaagtaacagacaagtttctgctctataaactagaaaccacaccaggaggctttgagatggaaagaaaaaaacaaaatggggaagaaagacattaatggagattctttaaaaatttattttactgaagtatagttgatttacaatgttgttgttactttctgttttatagcaaagtgattcagttatacgtatatataatactttacatttgctaatttcaaactcccaattcaacccctcccaccttggcaacaagtccattatctctgtttctgttttgtgaataagtacacccgtgttgtattttagattccacatataagtgatatcatatggcatgtctttttttgacttccttcatttagtatgaaaatctctaagaacatctgcgctgctgcaaacagcatcatttcattccttcttatggttgaatagtattccattgcctaaatataccacatcttcatccattgatatgcaattttaaatagtgtgttcatggaatacctcaataaggtggtaacatttgaggaaagaaatgaagaactgagtcatgtggatatctgaggaaagaacaaactgtagatagcaccaagtatagaagtcctgatgctgctgtgtgccaggggagttcaaggagtagtaaaaatccagtatataaggctataatgaaataggtaaggggatgagaaacataaggggacagggacccagtgatagaccatggaggagattgtgaggaccttggttgttaccccaagtggatgcggaaccagtggagggttttgagcaaaggaaggaaatgattgatctcatgattttaaaacatcactctgctgttaattaaaacccagtgggacaaggacagaacaaggggtccagtgaggaagcacttggaataatttggacagggaaggacaatggctttacagaagccatagacaccttgatgatgaattcaacctaggtgttactgagtcttctttaaaatccattgggaatgtacaaaatg

SEQ ID NO: 35066 - DNA, 3803 bp, Bovine  19866880425245
taaattgccaacattcattgtcattgaaaaaacaagagtcttccagaaaaatatctacttctgttttattgactatactaaagccttggactgtgtggatcacatgaactgtggaaaattcttatagatgggaatatcagaccgctggagctacctcctgagaaatctatatacaggtcaagaagcaacaatcagaacctgacatggaacaacagactggttccaaatagggaaaggagtacttcaaggtggaatattgtcaccctgcttatttaacttatttgcagaatacattatgtgaaatactgggctggatgaagcataagctggagtcaaaattgctgggagaaaaatcaatcaactcagatacacaaataatactacccttgcgaagaagaactaaaaagcctcttgatgaaagtgaaagaggagagtgaaaatgttgatttaaaactcaacattcaaaaaactaagatcctggcatctagtcccatcacatcatggtaaatagatgaggaaacaatggaaacagtgagagactttatttccttgggctccaaaatcactgcagtatggtgactgcagccatgaaattaaaagatgcttgcttcttggaaaaaaatctatgactaacctagacagcatattaaaaaacagagagataactttgccaaccaaaggtctgcctagtcaaagctatggtttttccagtagtcatgtatgaatgtgagagttggactataaagaaagctaagcacccaaagaattaatgctgttgaactctggtgttggagaagactcttgagagtctcttggactgcaaggagattcatccagtccattctaaaagaaatcagtcctgaatattcattggaaggactgatgctgaggctgaaactgcaatctttggccacctgatgtgaagaactgactcactgaaaagcccctgatgctgggaaagattgaaggcaggaggagaaggggatggcagaggatgagatggttgcatggcatcactgactcgatggacatgagtatgaataaactctgggactttgtgatggacagggaagtctggcgtgctgcagtccatgggatcgcaaagatttgttcatgactgagtgactgaactaacttgaaaatttgaatttctgtagcccaacctgactcagaaggactgtctgcaagtgaagttaatttaacctaatggagttatgttaggaagaaggataaagtgtatatatcagatagtctgtcatagtagccattagatacagatttttgtcatcgtgctcaaaattccacttcaggatactccctttttaatttttttttttttttaacatctggaaacattgatcttggtttgtcgttagttcatttaaaggttggtggtttatatcatttatcttaattcaccctgctggtctcagtaaccactcttgaacattatttatcttcatttgattcacatttgctcagcagtcgctttctgacatggctcttccttatacacttttcatttattaagcggcagatgtatgacatggtttggtttagtctttccaatccaattcagcagtagttgcctcaaatcatctttcttcattgatgcatctttgtcctatggcattctccttctctcacttgtgtactttagcaatgatcatataatgggaaccaatttctcttatctcccatgcattcagaagtcatctgacataatttgcttctatcctttttgggtttattcagagactatttatttttatttcttttctctcattaagaaattatgtagttagtgtcacatgctagccttttctgtagaacactatttctgatcaagaggttggtcatttatttatgaacactactgagacgtctcagcttcagttgagccagtgatgcattttcatcacatcagacacatcctacaaaaatactttaatgctaaaaagtggaaatgaagtgaacaaagacatccttgggatagattacttaagctgtatttttaaaaatatgtttcctgggcaattctctgtatatgaccgccctaatatttgtagaatcgcttcttaatcctttacctcaaaaaagaaaacaaagtagaatattttgtgagattctacaaattgtttaaaccttcataatggcttttgccttcagtttaaaacatccgtaagtacaaaatgtagatttgccctcccacaagtattgaaattttctgctcatgagatatcttaccacattttctctccaatttcataaagtttaatgccggaaggcttgtaggcagagtgagtgatagctttatggttacaagatggaaacaatatattcatttaatagtgaatgtacatagtcctttgtcaatttttaccaaaaccagttcatgtaattcatcacagaattcagaaattaatatttcaaagcctatttgacacagtttcaaaaagtgttaatgtatttttgactaaagcaaccatttgctcaaatctttttctctcctggagtttaacttaaaattcagttgcatacttaaataatctgtataactacatgttatccaatagtaattttcaactaaaacttagaatgttgcaggagaatctaccaagcaacctagattttctgaaatatatacattcacatatatcagctctaagattaggctttcaaattaagtaaacttagatatgaaaattatatataagattcttagatataagaattttgacacttctatttctgactgcttttggtgtcatcaagacctctctcccttagtaatataatggcatgttatgatgcttacctggctagatatgaaaataatggtcatatggatatcagattttttcttctagccctcatcaaagtctttagacaactgacaaagcactgaaataataaaaccttttctggttcactgaccttaggtaaatccttgatgttataatgcatgagagcatatcatgagcacagaatatattactttgctttcatagactgatacagccaatataaaaatgaaatatttgaatattgcaaatgcaaaatatcttcaacagtctcctcccggttgtatttctcttgtttctccataacaagatttgttccattacatcctttaacaaaaaaagaaattgaggcaataggaatatttctggtacttttagggcaatgtatcattgttcaacaattcagtctaccacactgaaaattaagtgatattatctagattctagagtgccctaacttttaagggaacaaaccaaggtgtctagattcaaaattaacgttcacactgtattctccatgttccccaggggagggggatatattcccatagcatataatatgaacatggctcctagagttgtggtttttttgttgttgttgctgttgttgttcagtggtgctgatcttaaggtctaggtgcattcttacactgtctgacattcataaatacctggttagttgtgtgtcataaatgagggagcagcaagccttgtcctcaacaagatggaaaataaaatgtgaaatatgggagaaaaaactcttcagcagtagaatccctaaatccagacccagtagagtcagagattgatggcaaaaagaaaaataagcacacttcagtgaaagtttacccatacagctaaatctgttgaatttaaagaagtgcttttaattttcagattatgtctctacctgactatatatttttttttcttttatagacaatagaccttgtctagttggtttgggctgttttattcagcctgtcataacagtatcat

SEQ ID NO: 35067 - DNA, 1300 bp, Bovine  19866880437688
tcagaaaggaataaactttctaaagaattttcagagaataaccacataccccctataaatgtgtatccaatcatggtgtcttttctggatagcagaaacattaagtgcccttggatacatatagattttgaaatacttaggaaaaaatcactagcatctttctattaaagtgtggggcaaggatcagcagacactgcaacattgttagaatgtagactctcagaccccatctgatgactagtgaatcagaatttcgacttcgaaaaatatctccaaatacttcaggcacactttcaatttgataagtactactcaaaccatacgagattctaaattctaggatgtgaatatcatttttaaaatattaaccatgtatttgcccaattttgaagtcaactcaaaataatctgaaatgaaaaaattatgcaccaagatactccttcatagaatgtttatcatgcaaattgagaaaaacaattccagcattaggagaagtgatgtacagtcatcaaaattttacttatgaaaattatgatgtatggttgaacattggttttgtcataccgaatggtaaagcacaaaacagaagagtgtaggcaataacatatcaagcccagaaacaaataataatcacagacaaaatattgggtgaaaaatttgttgaaatgagtagtgatatttccccctcatttattcatatattttgtacttaccaaatattcatgcatcttgaaataagagactatattttgcataattgaagtgatatcggtggagatttaccaaagacagatagtgtgaagatattttattaagccatttacttcatgcagattgtatcattctgccttagatgctattttctccctttctagcccaaggacagtacataagtgactcagttttacacaaaataatcagtgaaagctagtaactaagaacattctatgcattttgtaattgctttgtgataaaagagtaaattctacaagcactctgtgtggcatttctaatgtttaggtaataataaagtttgatatgtacagcacaggcacattataaaaattaattagccagggacccatgaaactcttggagctcaaaaatgaaaaagagctgtgtgaactagtgccaaaaccgtgacagaagtgccagtgttgtagagatttttcctgtttaaaatcatttctaaattctctccaaaacgaataaatttgtgctgtcccagagagacattactttgccaacaaagtccatctagtcaaagatatggtttttccggtagtcatgtgtggatgtg

SEQ ID NO: 35068 - DNA, 1088 bp, Bovine  19866880490923
gtggttccctgggaacctgtggacgtagtataagagcaaaacagatcacagacaatcattggagtctctactgaaagcacatttggcaaaatacttcattggccatttctgtatgagcaatcctgtactacttataaacttaagatctgaggaagtgaaagtgtatttagttgttgctgaatcctcatcccaaataaaaatcatggaacttcttctgttttaaaaaagttattttgcacacaaactcagtcaaggacactacaccagaaactgcctctaaagtcatttgagcaaaataggccagtgtcactcaagtggttcagacggaatggaattttaaaaagagaaaaacggccatatccatttctccatagacaacagaaattattattttgtaaaagagcagaatgtaaattttataaattaaccaatataacatcacattgcttcaaattggcattattcattattcataaagtatagctggagataaactataaaaaataattctcatgttccttggtgattttcattcaattacaaaaacttgctaaaagtttgtaagctagaatcccacaccacggtctaaatagcatttcctcctggtaaaatttatgcatggctttccacatctcccgtgctacaactctagcagaagccaacataatctctcaccagggaaactgaaatggcctcttaactgttctccccacttttcactccagacccttctctacacaccagccagaacaatacttataaaggcaaacggatcactatttcaaccctccactatctccaacctcactcagaataaaatccaacacctttaccataggttacctctttgtgaaaaggccacatttaatctcatttttatctcctttctaaaatagtcctcaaaaacttattttatttgttatatcaaatttctctcctcccatattcacatttaaacacacttgtctgcacctccaccaggcctgtgaaacttctttcatcaaggtcaacagtgaaccctttcccactaaataaataagatacaaggacataatgtacagcacaaggaatataatattttatagtaa

SEQ ID NO: 35069 - DNA, 751 bp, Bovine  19866880518136
attgaaaccctggactatttaagttatggtaaaaaccttaccgtgttcatgccaaatagattactatatgcagttctttcctgtcacaggcatccttgttaccaagaaaacagagcacagttctaagctgtatgggtgaagaacacatgaggctgaaactcgttatttttggtctctttctctttttctttaaacaaaactccacacaaatatatttccctcttgatctctctcccaattccctttagttaaagagccatcactttttaccttctaatgaattgtaggccttgtcttcagaaaaatccaaggagcttttaaactggtaggttttgtacttgagtcatgatagccacaagctaaagatgtgtatagattgcagaaacaaactctagatgaactttctgaagttaatagtgaggatgagttaatagtgaggtttcaaactcaaaacctgttgccaagccctttttctaaaatacattctgatgataaggagtctgttttgaaagccttaggaaggatataggaagtgaattttggcattaattccaagatattatttcttaaacaccagaatcacctgtagtacgtgctaaaagttaaaatgtgcaggtttctccagacaaatgaatcatgatttgtggggaagttttgcatttcagtgcatactccgatttgagctccattgcactgaaagttgatgcacattattaacacagctttttgtcaacagtggataccatatttg

SEQ ID NO: 35070 - DNA, 1040 bp, Bovine  19866880562341
gtgtctgactctgtgcgaccccatagacagcagcccaccaggctcccccgtccctggggttctccaggcaggaacactggagtgggttgccatttccttctccaatgcatgaaagtgaaaagtgaaagtgaagtcactcagccgtgtctgactcctagcaaccccatggactgcagcccaccaggctcctccgtccatgagatttgccaggcaagagtactggagtgagttagattatagtaactggtgaaagagaccttgaaatatgctaaagaaaataaaaggaacttctttacagagcgaagatcatgttctcagagtacagacttttgaatgaattttatagtactacaggtaagcaagccaaccttccacaactgtaacacagaaatcttcacaaacaggctgctgctgcaaagtgtatcacaaatacatgtgacaatattgtcaaggcaggttattttctatttctactgtacctctcactacctcggtcaggaagtaggggaagctgagaagagtgaaaatgaataggagacatccatgctcctgctgctactggctgctgctaagttgcttcagtcgtgtccaactttgtgcgaccccatagatggcagcccatcaggctccctcgtccctgggattctccaagcaagaacactggcgtgggttgccatttccttttccaatgcatgaaagtgaaaagtgaaagtgaagttgcccagtagtgcccgactcttcacgaccccatggactgcagcccaccaggcccctccatccatgggattttccagacaggagtactggagtggggtgccattgccttctccgagctcctggtctctcacaaaacgaggggtgtgaaaggcccctcacagcctcattcagaactatttaaattactaaatatagtctgaatggctcgtaaatttgtttttgttttttccaggagacaagcgggaagaaacagcacatagaaatgggtagttcaccaaagcaaggaaacatataatatatgagcatctgaaaagcagcagaaa

SEQ ID NO: 35071 - DNA, 1790 bp, Bovine  19866880594928
tgtccccatgtgcccgatgctagttttggcagctaattaatagaactgtagaaatattggaaataatcccagaaactaatgattgaagtatttattagaaagacaagggtaaagaagcttaaaaatgctgatcagaccaataatttaatatgaaaaacagacaatccaagacacaaggcagagaatggtatgaatcttattagcagaatagaaaagaatgtatcagaaagatttagctgagaacatttcacactaagttagaaatgcaatgcactcctcactacctgtagcaacataatatataaatataagttgaaatataaatgttaagtgccatctattcacatatatcaaacttacctcattccttatttattttctgcctaataattgagacagtgtcaggaattccatcaatatttgatgtattttaataataagaagactacagtcaagatggagaattgatctgacataaaaagcctccactcccactacaaacttttttaattgataaagtataccttttttctgagtatgtaaatgtatatttaaattcaaacctataatatggaatatctagattttagaaaaaaaaggagggtcccttccatagtaagggaaattgaatccgatgaatgccacttagctatgttttgagagtctccctatgtaaggctgagagacaaggttgtgtatttacagtcagaggaaggcagagaactgtattttctgcataaataatcctcaggatgtgaatggaaagaagtatccatgaaaaggcagaccccttggacttcacctttctacatgtggaaaatcttgtactatgagattgatacctaatgaaaaaacctgctggagacttctagctttaaataaaaaaggacttaagactatttgcttatttatttttctattccctccacgaaaattcactgaagtgactggatgtatgtatatgtacatccacgtgcgtcactgtcataaggcatggaatcacaaaaacaaaaagagaaactaaatggtaatgaaggagcgaattcataatttgaaggagcgattgatggttctatcttatggaaggaacggagggacggaggaaagaaggagagaaggagggaaagaagagaggaagatgactcacgttagttgtaaggcaggatgacaacctggtttgtaacacagatactcagacacactcaggaatttgcagcaccagtttcctactccttctgttccaaaacagtatataagagctctctaaaagtgtgtttgcatcatgaatgtctggtatcatcagttcagttcagttcagtctctcagtcgtttccaactctttgcaaccctatggaccgcagtacaccaggcttccctgtccaccaccaattcctggagcttgctcaccctcattttctagaatgctgtgagtcaggcaggagactgaaagatttttctcttgtgactctgatgaatcaaatgaatacacctaaggcaatatacattttgagggctccagcaaaatgtctcagccagatcatcatcctatctagatgctccaaatgggcaacagtaaattccctgcagagtcgccaaagaactagtaagtgcttcatctcaaatatgagtaggcaaacaagaattgtcacatcccagaggaaaactgctaacactcaaagacaaaatagacaagcagaaaactgagactagggagaaaaagtatataataaatagcagacagaggaaaattgtaaatactataattaatatactaataaagtaaaacaata

SEQ ID NO: 35072 - DNA, 1237 bp, Bovine  19866880618072
actgttatttgtgaaaagtgaaagtgttagtggctcggtcgtgtcagactctttgagaccccatggactgcagcctgccaggttcctctgtccatgggattctccaggcaagaatattggagtggggagccattcccttctccaggggatcttcctgacccagtgatcaagctcaggtttcttgcattgcatgcagatcctttaccatttgagtcaccagggaacctcatttatttaattccaagaattccacttaaccacatttttgctgtaatttttacaaggaattagaaacatgacttaagtaaatattctctctttaagaatgtcattcacctaattaaatatagtaaaagtactgtctacactcccaattaatttgctaatctacaagaaatctagaatcaatagctagctaatagctactcaaatgagtcactaaagacaaaaatattcatatttgtatttggtagttgaagagcaatcataatacagatgacaatatacatttgtgcaactcaaaatgatggcaatgtgtctagaatcaagccctataaaacttactcggggatttgaatcatgccatttgtttttttattgtttgactttcttctccttcaaattggacccatgtcagcataagcacactggctgacaccggtcctcactggacatttccatgacaaacctaaaagtcacaggcaacataaattgtcaaggttttatgagtacagctctgctaagtgcaaagtattttctagacaaaagtttagcgcaaaggtagaagggtcattttagtgtagtaaaaacagaggagtcctggatgcatttttttagaacctcaaattaattatgaaatcaggagtgctgccctcctaacccttactttctcatgaaccaaagtgtttttcccagaaatgctcaacctttatttaattaatggaaaaaaaaataagggttttaagtattatgagctgaaattgaccctgcctaaacatggaaaatattttcactttccaaaccatgaaaactattgatcctggctttaaatatgaaagaaaaataaacctctgacaagaaaaagaaaacaaatgaaccttgcagccaactcttgctttttcaagtttcaaacaccagaagttctttctcaaatatttcctaatcactctcactgacttatttctccctttatcccaaacacctgtaagatcattaatgctccatgaacacatattat

SEQ ID NO: 35073 - DNA, 1452 bp, Bovine  19866880620555
gcagacctgtttacagcttttgatattagcaatcagcttttcccgactcctgtgacaatgtgacaggttgattcagggatgatagattgagtgcattcgttcggatttcacacataaatcctctaaatgtaaagtttaccaattcattttttgaatagaggatggtttgagcatttttaatgtgtttgtgcatttttgagagtttctagtacttttgattccatcaggggatgttctgaactggacatcagtgtttattaggtgaactctgacttttcattgttgttgtttttattctttttaaacataacttaaaagaagtgagatgtgaggtagatcatgttagcagttgcaagtcacaattgctttctacttcctttacttataaggccaaatatatatttttaagtaaatatatatatatatatatatatacacatatatatatatatacatatatttaaaaatactggtatacaggaggagtaaatactggaaatagtgttctttaaagaagaatatgattatcattattgatctgagctaggtaaatttatccatagaatcttactctctccaaactctgaaaggccatttattcttaagaaaaatcagttgtcagagacttttatccctccaagagaagctagcttcacagcctgaagggagaattgtgcaagatctggaaaaatgagacccatggtgtctttgtgtctctctgttccagcttctaacattgctggcaacttacagggaagaatagaaaagcagacttgatcaggctctaggaacagagaaaatattcatagctgtaagatgagaaagatagaattgaaaacacatctctttgacatttaaaaaaattatcttactctggcgttggtctttacagtgtttcctctttgttatctcatcttgtacttgatctcagtctgtgtttatcaggttctaagctttatacactgagaaaggcagaaaaatggctccacataggcatctgtgtcttaatgccagaggctgtgaatgtcctttgctacatggcaaaagggtttcacatgtgattaaattaagaaccttgttttggggagactagctgggattatcaacctgggcccagtataatcacatgagtcctcaaaatcacagaacctttcctggctgtgatcagagggagatgtgaccatgggaaaatggtcagagacatgcagcttttgctagctttaaatatggaaattaggaatcatgagtcaaagaaagtgcaaaaggtagattctcttctaaaggctccagaaaggaaccagctttgtgaaatcttgattctaacccagagatctgtatcagatatctaacctacagaactatcatataataagatttttctatttcagccatacttacttcatactttgttacattagcagtagcaaactaatgcaataccacaaagtgggc

SEQ ID NO: 35074 - DNA, 2947 bp, Bovine  19866880694325
tagctttgaggtaattcagcactggagtcatcaggcaggtattattagagctattaataccaataatagcaataagtttaatgctattgtcatcttggcaaatggcctgaaccctgaggagctgaaaatgacaactgccgatctataggtttgaaaaaaatggtttagatcacattcacactagagtgtcttaggatgctgggaaattttgctgcaggacattcagcttttacatgcaaaacactgttgtcagattccccagatggctcacttaaaacacatgccacagtctaaaaagaaaaacaacaacactacacaggaatctcattataacaaggtcattgtcatatgtagatacacaacagatctatgttggatagtacctaatgcaagcttttccattacaaggaaaaatattacagatattcacaagcaaatacataaatgattatagttagaatatatttaaaattttaactgtggcttctatgtgtcagcaagactcattcctcacttattagtttatacattgattatattattcaacctttctcagtgtttaactctgagacttgtgcatgttttcaggtttctgaaaatgcttttccctttctccagattgcttctccatcagattgttttgtgaatggctccttcttatcatgcaaaattcaactcaagggtcatcttctcaaaaaagccttcactgatcatgaaatctagagtcagcctttgctacaaccacataattatttcctttcttttccacagtatttattaccatctgaaattatcttatttttgatgtatcttccaccctggctgctagactactagactgtaagagcaggaaattcatctgttttgctcaacatatgagagagcttctatcaaaaattaggtacttgataattataatagctaattctgtctagacccaaaagccagatacacaatgtcctcactgtttcatgtgtattattattatatttattcctcacaacaacactgtgagttaggtactgctataggctgaatatttgtgtccccatacaattcatatgttgaattcctaaccctcaacgggattgttttaggaggtggaaactttggatggtgattagctctgatgggaggaccctcttgcttgggattagtgctttatgaaagagaccccagagagctatcttgtcccttctgccactcctgcttacagtgaggatagctgtctatgattaagcaggccctcaccatacacggaaactgctggtgccttgatgttgaacttctcaggctctgaaactgttagcaacaaacttttgttttccataagccatctagtaggtgctattatgttgtagtggctcaaatggaccaaaaaaggtactaatattgtcactaatttgcagatgagaaaactgaggactggagaggctaggcatttacttaatgttatacaactggtaacaggactaagacttgaaacccagactcataaagtctgggttttacaacagcacaatgaatgtaggctgaagaaatcaatgaaataattaacacagacaaatactgtatataatgtgttcatacatttataggaacacttacacagccatgtatttacagaagtgcattgcttttttcagaaattaaaacagacttgtgctgatgcatctacatggtacataccttatcaggtcatctagttggaattatccgtattaactgggtgtgtgggaggaaccaaagaaagaaatatctctcaagatgtcaatatcaaccacatggtcataaagttctaatataattggcaagatacctaggtgcttcaaagatggcataaggtggagacatttataaagcaaacactaatatgcaaattattttaaagttacagaaaataatctatttaaaagtaaagttctaagaataacaagcatagtaacaataatatacattttatagaagaaactaaattttaaaggaccttaagaagaatctcattcaatatcccaaagagtttcacaatttgttgtgatactattaagagcattttcatatgtatgcgcgcacacacacacacacacacacgactttatatgttcctgtgttctcttttcttatttgaacccctatatcagatagaatgaaatagggcaaaggctaacagagttttgtcaagagaacactttcgtcatagcaaacacactttccaacaacacaactctacgtacggacaactctacatacgaaaatcactaaatgttcaatattgaaagcagattgattatattctttgcagctgaagatggagaagttctatacagtcaacaaacacaagacatgcagctgactgtggctcagatcatcagctacttattaaaaattcaggtttaaattgaagaaagtacagaaaaccactaggccattgagacatgacctaattcaaataccttatgattatacagtagaggtggcaaatagattctagagattagatctgatagagtgcttgaaaaatgatggacagaagttcataatactgtacaggaggcattgaccaaaaccattcccaagaaaaagaaatgcaagaaggcaaagtggctgtctgaggaggcttatttacaaataactgagggaaaaagagaagcaaaaagcaagagagaaagggaatgataaatccaactgaatgtggagctccagagaataacaaggagagataagaaggccttattcaatgaacaatgcaaagaaatagaggcaaacatagaatgggaaagactagagatctcttcaagaagattatagataccaagggaaaatgtcatacaaagatgagcacaagaaaagacagaaatggcaaggacctaaatgaggaagaagcaattaagaggtggaaagaatatacagaagaactatacaaaaaagatcttaattacccatataa

SEQ ID NO: 35075 - DNA, 1723 bp, Bovine  19866880701221
caagggaggccagttggaaccttggtctgggaactaagataccacaagatggtgctgcgaggcgaaaaaaaaaaaaaatcaaataatcaaattccctacagttgtcattttgatcagagtactggtttgttgtggtttgaaaccacaggagcttctcctgtgaaacctgaaactggcaactggtacacggagggcagcaagagacaaaagaaagtggcagaacatcccagattgatagagggcagttttaataagcaaggaacttaatggcttgtcttggaccacagcagaatgagtacttctctgcaccgacctgacagaaccttgggagtttatgcagaggacttcactacgtttggtcgtgtgtaccagccagatagttttagcaacacatcactgtctccatgctgagttcttctagtgcagggaaggcaagtgggatgcacattttggaggacaaggtagggcgggggctgtggggcacctcaagttgtctgggttcatcacatgtcaatagagagtcacattctctccatgacctcttccaacatggttgcacaaaattacaagtattttcttgtgcatttatttttctctctcaggttgtaaggagctctgcaaacgggtgccttattcaaatttgcatagttcaatacctgtaactgcagatcttgcttttcaaacatttttgtatattttagaactgtattagaacctgtaggctgttggtaaatagtaactactcattaacacttactaaataaataaaattagaacacaagccaacagttactgagtgctaacttgttccctcaatgaatgaaagttacggaatttaaataacttattctaaacattaaaggatacattagcattccagtagccctctaacctgataattgcactataagaatttccatttttatcaagaggaacacaggaaaaaaaaatgtagcacaaaggactcaagacataagagaatttctgaagagagaaaaacaattaaaagttactgagctaagaactttcttttatagggatattcagtcagtcatttgaaataattgtatgtcagcatagaaacaagaccattgttgctcactattatctttatcctttggttgtattattatcatctaatactttctacttacagttttcactccaacaagttaatgaagagaagcactgatgtttcccgtgacttgcagtgtggattgcctcattggaatataatcatttgcaattatgcaaaaaaaattgaaaagcaagatctacactctaatgtactgtacaaattccatttaatatgtaattgcttatattggcagtctctgtattgactttccccaagcagggctcaaattaaatgaatctgtctttcttataaaatgatcattcaactcatttaaaacagttttatagtcaacattcatttgtatgatattcataacaaatatcttattacagtacaactgtgggtttttatccgatagcaattatttctctatctggcactgctttgcaaaaagtcaacatattgcaacaactgtatccattttgcaaagggaaaggggggataaattagtcaaaattctcagctaactaaaattcaattcaagttaccccaggggatattcctgataaatttttctcaatctctcgtataaggtttctaacaagataaagaacagcacttagctcataaagttctgcaaaagct

SEQ ID NO: 35076 - DNA, 2228 bp, Bovine  19866880710756
atagaaaaattacttatatctaaagatcaagcttgcaaatataactgtaaatatgctttattccttgggaacagatttttagagaaaacataagcaaagctactacttgaaaatgtacatattgaattattcaactaaataacccacatacttttcaataaacacagcagaactttccagagtacttcacagagtcttgcttgtaatcacctttgcatctgcctttgaacaactttcaagagcacatgaacacgaatcttttttttttttttttaagttttaattgttgaaactttagatacacaagagcatatttatatagagtagtcattttctttggactatggttcatgaaaatcactttgcccagtgatttatttttaaaatggaagtagcaccatagttttagtttattataaaagacaatatacttataaaaatcagaccaactcccagaaatataaaggaaaatggtaaaaccatttgtatcacataattcagaaatcaccactaatattaacatcttggggcatatccttctaaagttacttccatgcataactgtgttagttgctcagttgtatctgactctttgtgactccatggactgtagcccaccaggctcctctgtccatggaattttcctggcaagaatactggagcgggttcccattcctcctccaggggattttcccaacccagggatccaacctgtgtctctgaaagactgtaaaatgtacctggaacagttctttgctcaaaaagattcaaaatttggggaagatgggattatgaagttgcccaagaaatggcagaatgtagtggaacaaaatggtgaatattttgttgaataaaattcttagtgaaaatgaaaaatgtgtcttttgtttttacttagaaactgaaggaaatttttggccaacccattatttgcttaattgcttttaagcaattaggtagcttctgagggggcagagaccacggtaccagtctgtcttatcccctcccattgtacctccagcatattgaacagggcctggcacacagtaggtgctcaagatcagcattgttattgatgggtggaaactactttcttaggatagattcctgaggtggaatttctgggtcaaatgatgtgcttgtttctacagcctccaatggtgtattttagtcctggtgagaggctgccatacctctgctgggtgcagtaaggcaatgaaggagagagacgttttcaagagctgaggcacccaagagggctccagacccaggaggaggctctgctaagcagaggagatgggatggaggggacatttccacatgtttccagaaacaccatcaagggtgttcgctgagcccctattccgggcaggccctatacaacggttcactcagttaatcctccctattcataaacaagacaaaactagtaagcaagacaaaacacagtcccactttacagatgaggaagctgaggttcaaaaaagtgaaaggactggcctaagaccgggcaatgaaaaaggggagatgcttggattttagcccagctctgctgctccttcagcaggccagagaaaatggcaattcttttttttttaatatatatgtttacttattttattatttatttttctatttgacagcactgggtcttaattgcagcatatgggatctagttccctaaccagggattgaacctgggtcccctgcatttggagcacagagtctcagctactaaacccccagagaagtcccgaaaacagcagttcatctctccgctgttggttcaggggaccacataacgtaagtctgacagatttctgcacagcccagtcttgcctaggattgcaggagaggtcagtgaataaaaaaataggctttggagatacagctggacttgaatcctagctccatcgcttagctgtgtgatcttgggcaagttcctaacctctcggagtcagtcccttctgtacagtggggactggcaatgggagcattggtgaaaatgaaggtggaacacaggcaaatgggcgcctgccaagtgcttgccgttatcactctcgtttcccaagggcctcttgtatctgagacatttctcagagacctcagctctcatttccttctcccaacctcctgctttctatttttgaaaatgagattctgactggaaaactgttctttgctgttacacaatatgcaaatggaggatctggaatttgaagccaggc

SEQ ID NO: 35077 - DNA, 1090 bp, Bovine  19866880732388
gcatctgtaacataggatggatataagaagtaggaatgactctctaactgtacaggagcactcacatttattcaataagacattttaactgccctttcccctcattccttcatatctttccttttttcccctcttcctgcaacaaattattacttaaaaatttattgtgtacaaatccctatgctagatacaatggaatttgacaaaaatggtttagataagttccttgatatgaaggaatttatgtaaaaatatttttttcccgccaggacactgttttctttctattccaaagccctgtcatgatgttacagttaagtccttggaattacacagaggtttccatttaaagctggattttgaaaatagtaaaacaaacaaaaaacaagtaagtttttctctggctgtttttgttttggcagttcaaagtgtagggtttgagaaaatgtttgctttatggacctatgtttctgcaaagaatctatggtgtctatattccgtgaacattttgaaacatgtgttttgctttgcaattaaagaccactgctaggcatttattttctttttttccctccctgaatactcttaaacaatcttgacttttaattcatacatcatagaagaagttactcacttggaataaaaagtgattaatgacataaatggtcaataaacattctatagtcatccctagggaaagaacacattcaggacactttccttctattttcctcacttgaaaagattgacatactgtgaaagtctagttaatagttgttagcatttctgaaagtcaacgaagtgaattagagatatgtggaattatttggcagaatttcagactctctgatccactaaataacacagagtttattgtagcaagaccttgtttaagaatcatgtcattttcttcctcctggaaggcttgctttctttagccattcttttctttttttaaagaacttaagaacttattaaaactgaagtcagtgttgtgacacatgttggattagtcacgccaagtttagggaagctgtatgatggaatatgacaacttcagaaacttgacaagaaatgcaaaatgaaagat

SEQ ID NO: 35078 - DNA, 761 bp, Bovine  19866880753710
atatacacacacacatacatgactgtgctaagttgcttcagtcgtgtccgattctttgtgaccccatggactgtagcctgccaggctcctctgctcatggaattctccaggcaagaatactagagtgggttgccattcccttctccaatatacatacatatgtgtgtgtgtatatatatagatatatatagaaatatatataagcctgaagtcaagcaaatttccatacagaggcaatatttagattctataggatataaattaatggatggaagtctatcaaagaattaagattctgatgtgagttagtttagtagatagtagagggggatgtaaaacacaaagagaaacaatacttaatttctcactgtatatgttagaaataaaccaaataaaaaagtaattatagcatttaagtaatgaggttaagtgacaaagaagtgttatttgaattctgcaaacccacatggtaaatcccaaacaaggaggaagtggagaaacgttcaaaataaacttactaaaactgtttcattctttaaaggctatacaaacacatggaaaagaaaataacattatcttgttcctcttcaattatgtaaaaatccttcacagcaagcatattaataatatattagtcattacagttatactcgctaagttttgacactcaaagcacctataaggagactatgtgtagaatatgtaaactgatattctcccaagtaaacagaaattcattcccaaatacgattagtatcaaa

SEQ ID NO: 35079 - DNA, 1415 bp, Bovine  19866880970408
gacgggggagcctggtgggctgccgtctatggggtcacacagagtcggacacgactgaagcgacttagcagcagcagcagcagtttcctttttagagacacacaaagattattcaatattttatttacatgcttaaaatggattagcattgtcaaaaaagcaggtttgctgtacagtgacttttcaggagcacttttaatatcattttttcaattacacaagtgtatattataagcacttactgtatgtaacaaacatgcaataataatatgagaagaaggaaagaaaagtcataaagatgaacaagacctagcaccaatcccaacataaagaatgttttaaaactaggatagttttaagaagaactaccatggttgcaaactcaattcttctcatgaattagaatttcacagtgtaaattcattttcctttaagctgtatgtgtgcttaaaaatttgtgaagaactctgttagctctgtagcttgttagctaactttcttgaaatgaagactttgttgaagcatatttgggctttctctttattctctgcggcgcttcccatgatatatggagtgaaagtattcatccagaagtgggggtgcttgcaacacatatttattgagtaccaactgtgttccagaaatgcggtgttcagttttcaattaggtcatttgcaattagttttggcattaattgcaatttgcaattaattagtggaatctaccactaattaatctgaaattaaaaataagtcagcacacacaggatatcctgttgtcgcttgtttcattgtctctaaattaatgaatatttgaatatagctagatatcctgaaataataaattccagttcttatgctattgcaaattacatcatttgatcactaatctttggaggaaatatgaattaaagtaagctggggaatgcatctgtttgcagtaggtggctcaggattatttgaatacattactgatgttgtttccgatcaaatagttgtgatgattacacagggcagttggaacagttccatagatgttatcttataaacttcactgtgtccaaattgagttactctccaatattttccttaatagactatatgtatcttttcctcattttcagcatctatgttttgtcccagtgtgaatatgatctaaggatcaatttcattaatctagcccttttcccattttaaccacttaattaaatcatcatgaagtgtactcctttcctctgagaataagatccctttcctagcctttctcctcaacatactaaatctctgaaatagtcaccttcatggtatttgctaaatggtatattttccaaatctattttcttttccttaaggaattccataatgactaatccaatacttcctctaggtcaggtcaaattataacaatgccctaaa

SEQ ID NO: 35080 - DNA, 1363 bp, Bovine  19866880972383
cttggtaggatcactcagaatcagctgaggaaaggatgcattggagaaggcatgcctgcagccagtaggttttaagttgcccaaggactggtgcataaacatcatcagaggagcttgtaaaactgcagactctcatgggtacaacaaataggaaaggaatcttgatatattttgcacatataaattgggcattacctctacaaagtgaaaattaaaaatgaacaacctctggtgtaatttctagtttcaaacccatctttattgcttactacctgggtaacttgggcttcccttgtagctcagttggttaagaatctgcctgcagtgcaggagactcgggttcggttcctgggtcggggaagatcccctggagaaagaagtggcaacccactccagtattcttgcttggaaaatctcatggacagaggagcctggtgggaggcagtccatggggtcacaaagagtcaggcatgactgagcgactaacacttacttacttccttgggtgacttgagataagtttttaaagatttaagcctatttcctcatttataaaaattgatttttgagatgataaagtgaaatatccagtgagatgtcttaggataatgctggcttataagaggtgtccaataaatgttaattttatatattaaaatatattcatgccacattgtggtaactgacttagctatagttttagatgaatgttttcagttaatcttgaaatactgttgctggcataatcttttcccttcaaattttctcagaaattaattgtctttcatgagtaggtgcagaataaatcattgttttcattcaagagacatggctgaataagcacacatttgcataaaatcactcccaggagtctatcaaaatgaatgaaaagaaccccaaattagagaggatgatttcatttatactgaaattagagtggagcctcatactcataccctaaattacaaggactagtgtttggattcaatttagtataagttgccaggacttaattcacaggttctttaatcttggacatactgcttgccctacatgggaaatggaaacgttcgaagggttttttaacaaccctggtaaataggacagagcggcaaagttacacatcaaattttatgttccagaaaatacagcttataacacaaagacagacaaagggggagatgtcattttctaaaagtaataatatgaaaagtttaggtatgcttccaaaagtctgctgtccttcattatttgtgcattaatatttcagtacatacatactcaatgttttttaaaatgcatttcataaataatagagaataaaagcttttatttaacagtttcttaccctacaaatgtgatt

SEQ ID NO: 35081 - DNA, 1395 bp, Bovine  19866880978960
atttacttaaaataatatgttgtaaagtccaatggaggctttaaattctatatgaagttttattggtgccacaattttacagtatctattggagcaaagacaacaaattcttacagtcaagtgatcacaacaatctcttctcttctgaatgaatgaatatggttcattttgaatatggtactttgtgcagtagtccccagcagccttcagtagagtagcaggaaagaaatggaaaaaaaaaaaattgcttccagatttattctgactccacaatagccaccattttaaattgttttgcagaatgactgattataaaattcactgaaaatgagttggaaagtatacttttatctttaaaagaaaatggtaggtgggagaacatgagacttgaggggcattgtgagacctttccccctgagaaatgtcaagggaattaaagaagctggatagtgagaccagaggcagcagcatgttctccatgccttccttctccagcagtgagcatccaccccacgctttgctgtgtaccaagctcttgttagtaacctcccacaggacagggcagctccctcccagacattatgcctcaaaatgagggaaacaagcagctattcttgtgattaagaacacttcctacaatgaaagaaaggttaaaaaaaaacctgcctcaatgagttcttaattgggtataagataatgttggtaaaagcttaaaatatttaactagccataaatattcagggcagtcatttgaagtaatcaatggctaggtgaatgcatacattagctggcagagcatcacttaatcaacaattcaaataaacaagaggagaattaaaaatgcaaaacttcaaatatagagaattaattagcaaagttgctaattacctccaggttctttcttcctctacccattgactacttaaacttttgtcagagcattgctaaaaataaccagttgtcaagagattcatttcttttcagaaggcctgcttactcagaatgatggccaggtcaagcagatagcttagaaatacccaagatttaagtgttaggaagtgatctcagaatgtaaagcttgagaatccttcagctgacatatactgctggcaagaaaagaacatccccccctccccatttttagtctttatcgcttaaaagctctagacttttatatctgcatccaaatattgtatgagagaatctatcaggtagagagaaacattcatgatagtttactgatactgaaaaattacatgattttcttcatttgacaaatccttagtatcttcctgtttcaatcctctcaagttattatacactctgctatatataaattatattaaagtggtttaaatagatagaggaggctactttcaggtcttcaactagaag

SEQ ID NO: 35082 - DNA, 732 bp, Bovine  19866881025804
cattggagaaggaaatggcaacccactccagtacccttgcctggagaatcccagggacggaggagcctgcatgggctgcggtctatggggtcacacagagttggacacgactgaagcgacttagcagcagcagtatgctttagaaaagtaaattgaaaaacaaatattaaaaaaaaaaaaaaaaactggttagatttccaggtgtcccagttgaatttaagtcacataagacctatattagatttaacagaggagatttttgtaagtaatttctacaatggtgaactctcaaatgtattgcatttgcctaaaagaattcatgttatgtgattgctggagaggatagagatgcttaaaaaaaaagatgttttgatgttttaccatacactggagatttttgtaattcatcacaattgtatgttcttactgacacttttaaataaatgggatctatgttatattttcctgaccgttgctccgtcatggtttatagacccatatgagtatttaatgctgaacactaatatttaaaaacaaacatgattttctatttacatggcaagtattcttgctagttatgatctgctatttattttaggtactgcattgtgaaaaccacatgtagccaatggagctttcttattatgggtatatcaattcagcaatgcagcttatatagaaagtggcaaaatatgtatcattgggactttgcctatgcatagcaataaattg

SEQ ID NO: 35083 - DNA, 1323 bp, Bovine  19866881057742
catcaaattaaggggaaataaagagttgtaagtttctctggatctgaggaattgtataaatgcactgtcattgtataaaagaatcacactgtcttctctcgaaatttcctatttatagaatataggttattcccaggttattaaagagtttctgagtcctcattatcaacacttttatctgaccccaagcctgtagctaccatgtaagaaagaagtgatcactgcacggtattcactaatgaattgaccatttgtaaaattaacctccactcaaacattcttctcagcttattactgtgtatctgcggccaccatcagtgcctttgtaggtcatgcagtattaacatgcagtaagcaattgcaaatcttgtacaagatgcaagatatcaagaagtcattgaagataattatggagaactaatcaattccaggcaaatccactgatggtatgacagagatagacctgttaaaattgaaggaaaaatcaatgtggacagagagacaatagacaattcaagtggaatgctctgtgacccaaaggattaagaggagcccttgaagaaatttctgaaaatttgagatgtctccaaactattcttcagaaacagaccttcattatgatttccctggaatagttagctgagaagtaaggaataacatactgtattatcagtattgttgttagaaattttgtaggagaaaagattattatgtaatatttgatgtatttttgtccttggtaaaaagttagttatataattgaaaatagaacctatactttattaaatgaggcaaactaattttttcataaattttagttttatttttcattataacatttcagtcacactttattttttatccctaaatccaatgaaatatcaacctgtcttttaaatagacttctttcaatatgctttctgtagtatctgttatgaactttttgtcaggcaattgatagatctctatgttttggtggtcagttattagaaaattattgctttcctttgaatatatcactttcttaatttttcatgtttcgtctatctttgtatcaatatctgtgcatttgaagagcagtcacctttttcagactttatggatgggctttggtaaggaaaatcttcatctttagaggggtgtgatagcctgctggttggggtgcaatgtttccgctctgtggttggagtggtgcagctgtgtagactctgggtagctccatcacccggggctagcctttgaggggagtaggacttagggatccttggtgtggggctacagatgtgcatggcaacagcaaaggctgctgggatcctgctctgt

SEQ ID NO: 35084 - DNA, 1032 bp, Bovine  19866881107752
cttcttaaggttcctcctcttcattgttttaggtgactgatggatgcttgagtttcaaactaagggcttcagaacaataatggccacatagcgggataatgataattaacagacaaaagtacagttaattgccatgaaggttttgatacagattgacagtcagagtaagctggaagcctgaaaccccagccaagactactttataaacatggcagtgagactcccattgtatttaagcattaggaatcagtcagctgtgctcccctccacacttttccagatttcattagattctttatacagaatgcaaaaataaaagtttcagaggactttgaagaagtatttacagttggtttttgttgtctgcagtaattatggtttgtgaaagtgaagctgctcagtcgtatctgactctgcgatcccatggattgtagcctgccaggttccttcgtccatgggatttttcaggcaagagtactggagtgggttgccatttccttctccagggaatcttcccaacccagggattgaacctgggtctcctgcattgaaggcagacactttaccttctgagccaccagggaagtctttatgatctgcaaaggctctgggaaagattgaaggcaaaaggagaacagggcggcagaggatgcgatggttggatgccatcaccaagtcaatggccatgaacttaggcagactccaggagatagtgaaggacagggaagcctggcatgctgcagtctatggggtcactaagagtcagacacgactgagcaactaaacagcaacaacaacaaagtctcggggaagcctgagttagtgaacactaaaaccactgctcctatgagaaatgaagagttaggttcctgtgagcctctggtgacattttcattaagcaatcagtagaaaaaaccttatgtgcacttctgcctaaaggcattgtacttaatgcatattgttgattcgttaacattgtactcacagtcagcatccctataactcattcttgaacaaagcttgttgaacaca

SEQ ID NO: 35085 - DNA, 1279 bp, Bovine  19866881119767
ttggaattctgaaaaagcttcacaactgtggtatacctggaccttacctagggaggaaagtctaggaagttcaggactagaagtttgtatgggatctctttttgatacttacctgattaggagtgttgactatttatggatccctagttgactgttgcagttatatgattcacctactctttctttctcatgattgtggtctgtggacttctttttccccctcattcccaatgaattgcttgcacttttttcatgcggctgctgctgctaaattggttcggttgtgtccgactctgtgcgaccccatagacggcagcccaccaggctcccccgtccttgggattctccaggcaagaacactggagcgggttgccatttccttctccaatgcacgaaagtgaaaagtgaaagtgaagtcgctcagttgtgtcccactcttagcaacctcatggactgcagcccaccaggctcctctgtccataggattttccaggcaagagtactggagtggggtgccattgccttctctgacttttttcatgagaagagactaaattggttaagtcaccatctcctcagtttgagggcagagccctagctaggggctgcctagtggactgctggcttccctgtgatgagctgcctgtgatcagctgtcctttccaggtgtccaacacagtcccactccgtgttgctaatgggatggcttcctgatctgagataagaagtacatcagagaactctgagatgtacctttctgtgagtcatctttcagaacctagtgggttcctttccttttcctcttagtctttcttttttaatttaggaaagaactcaatatttgatcaaattaagtggagaacagtatcatgatcctaaaatagtgggatctgatgctccatagtcatttgagaacaagcaccatgattgaaactagtctgttttctctattcactttttaaattgattgctaggaatcaagaacattcctaaaatatctaagaaattgcttaaaagataatttgagtctcttcagtccttatactactgccaagagctctcctcaactccaccaatcatagaaggatcagaatccatactagaaatatatgccaagttcagttcagctgctccataggtgcttgcacctataagatgctagagggtttgggcctcagtggagccccattcatcattactgtacaactctgccagtgtttacaaaggtgctacaggggacctataagtcatgcgccaatttaaacgattgcaagctcaa

SEQ ID NO: 35086 - DNA, 696 bp, Bovine  19866881144935
atatcctgcaacaagtacccagtagtagtctgaggttttcatactaaaatattaaaaaaaaattataaagaatatggttttgcatgggcttctcaggtggctcagtggtaaataatttgtctgcaatgcaggagacagaagtgagttcgatccctgggttgggaagatcccctggaggaggaaatggcaacctactccagtattcttgcctggagaattccatggataaaggagcttggcgaactacagtccacagggtcacaaagaattggacacaactgaagagactgagcatgcacgcatggttttgcatatcacccgaggtttcttggaagctattttctcctggtgaactcttcaaaaaaagaaagaaaagatacatggaattcatcgagtttatttctgcactttgggcagagcaatcagccattagtttactttagcagtatgactcaaatgaatctgtttatgtatacttatacccagcatttgaatggaagagtattaagagcttaagctctagggacaattgcttagcttcaaaacctgttcctactccctgctagctgcagcatgtgtaagctatagaacccctctgaggccaagctgccacacctgtgatacaaaagtaatgatgataataagagaacaattcctgggctaagaaggggaagtaaacagaagagagctgcatag

SEQ ID NO: 35087 - DNA, 2303 bp, Bovine  19866881268035
gaaaagatttggacctgtctaaaggaaaataacccttttattagaaacatattaaggcggaggaaatcaatcttgtgagatcatgaaaatctggaagagtctaaagttgatttatttatttaagatttatacccagtccacttccataaaggattcaaagtggcagcagactgggctaaactcattttcttgtaatatgtctcagactggaattagaagttcgttttctagcagatgaagttaagctgattatagcaaatgagctattgaaaatcaataccataaaactgttccattagtacctgtacaatcatcccaggattataagtaatatttatactctcagacactgacattttcaggaaatgatatgcagaacatttacacgggccacagccacctgtggttacttggctttgatgattaaagcatgttgctaatgaggccaaggtcatgggctcgctctctccatagcccaattatctcctttctgttctgcaactatgaatggaatcatattccttcagcagctgctttactataatgtgcaagggggtcattgaagttagagaacactcttgggtgacgacatatgcatccccactgttagaaggacaccaccaaaaatgtggcacgttgtctgtgccttttctttggacaagattgactgggagaaatgttctctcttaaatatacacacacagtgcacttacaacacacacccacattcacatacatacacacacctctttgggtaagggagggtaattcagagcaacagtaacaaggaggaaacttttcaactttgcagtcaaaaggagttagatcaagtcccagtttccacatatagtagcagcaaggtcttagataaagtccctcacttttcaaaataatttttaaaaagtacaatatttttaccttacagagatgggggagtactgatgatataatatgtgtatagcacttgcaagagacacatcagtgatcttaaaaaatcatcattatttaggcattagtatgtaccaggtattttagtaagttctttacacatattatctcatttaatcttcatagttccttatggcatgggtgtcattgttatcctttttattcatgatgaattaaagtgagatttagagagtctaagtaattttcccagttccacacaatgagaagacaactaatatacaagcttaagctgatctcactccagggtccacatgttcttgtactgtgctgtattcttgctgcttttcctaaaacacaagctgctgtggttattctagccctctgttaactggcctttaataatgtggtccattctctaacacagaaatacgatttcatctcctgtgcgctgcctgctcctttagcacaaatcccttcagttggcatcattgccgtcatacttcaggagcctgctagagtcattttagattgtgtattccctcagggacctatgtgaacataaattctctatctccggagacccttacaagaaatctaatgttaagtatataaagcaaagcaaacaaggaccacaaattacttacctctctatttgtatgcatctatttttacccctgagggtcctacaagatggatttctaaagcagatattctgggaagccacataaactctaggccctggttcattatacagcaataccagtgactcgaaatttccactcttgaaggctaaataagttacatccatttgataatgttgaaatatgcttccactattataaccttcatcttttattctctggaagaagaaattatatcttcagaaaaccttttatagagtggaaatccagagattaccaagttaacagtgtctgtgcttgaggtctattattggctggcttttaaactaaaatttcaatctctgagacagtttgatgaagtggaaagagcatgaatgttggaggaagtgaagacctaagtttaattctgctatttactagcaatatactgaagcaattattctacctttttttattttctcctttcttgcctgtaaaatgaggctaaaaatacctaattctagttttgcaatgacagttattacaagtaatacaagcaatataattgctaccaagtatctattgcatgtaactattaattattttaattaggaattcctagagaaatatttctattgattcaggagcatggggagaaagaacctaggttagttttctcccaaagcagtctttcattgaactgtaatggtaggagcatcagccagggtctgtactcaaaatgggaagaatatgtccatggcatactcaaaatca

SEQ ID NO: 35088 - DNA, 3555 bp, Bovine  19866881354217
aaaagaccctgatgctgggaaagattgagggcaggaggagaaggggacgacagaggatgagatggctggttggtatcaccgactcaatggacttgagtttgagtaaactccgggagttggtgatggacagggaggcctggcatgctgcagtccatggggttgcaaagagtcagacatgactgagcgactgaactggactgaaccaacctatctaataaagagaaataagtgcagagaattagggaaaatgaagagatagaggaatatgtttcaaatggaggagcaagacaaaacctcagagaaagaaccaagtgaagataagcaatctacctgatgcagagcttggcattcttatttcccaaaataagctgagtagtgtctatctgtgtttcaagcatcttgcaatgaatgtagtagatttcaaacttattttgttatgaccctaaataaatactgttcctttaaatatacacagacaaatgcatatatatgaaccaatattcttaaaatatttgttacccttattatagtaagtgctaatattttgcattttatcccatttcaaattatatgctgatcctgacccacaataaggttgtaatctgcagtttaatcccatggacagaggagcctggcaggttacagtccatagggtcacaaacagttgaacatgactgaagcggcatagcacaccatatgttgtgtaaaaaatgagatgtttttgtagtcagaagactctggttttgtccctacctagtatgtgagttatcacctaaccagtgaaatagcaaatacttccccagaaggtgtgaggctgagtacttggtaggtattcagtaaatgtccatttctttgtctttaaaattcacacttaagccattcattgttattccacagtatggtagaaaatatctagttttttgggtatacctgcattctattggattcttagactacttagactattatgattttaactatgtctgtttttcttatcttgggctaaaaaaaacactcaataaaaacaaataacagcaaaaaaaaaaatcttatagtaatttttacagggctttattgagtgttccaagaatcagaacagaatctagaaacttgttaacttttatgtgtcactcatggaaatgactacttgtatttgttaattattttctatgaccaccttttgtattaataacatcttctaagacatcttttctccagcctccactcttcaactttcctggcccatttttgtagcagtgccaacaagatctttctcagtcaaggcatatgtttcaaggcacgtccagtctttctcaagacgaaatgttttatggcttctatatagctgattggtggtgggattttattcctgaaaaagtaatagtaacaaaagaatacaggtttacaatttgagctttaaacataaactgtttcctgggctgtggcaatagggtaaaatgatccagtggttgaaatcttatgaggcttcataaatgcacttaataattatcaactgatgacaaattaattgagtcaatgaatattaatgtctctcctttcatataactcgatgcctgggacagtttcaatatgtgacaaatacattgtactatgatgtattaataacatgtggatcagagagaagcaaaaatcaaggacaaatgtaactttctgtgagatatatatttaacactttttaacatttagtttattacctttggatgccagttaaactttacatccttcagtggtttttgtgtgttgtctattgactgagtctattatttgtcattgcagtctcaaatactaaaatattgcagattttctttaattatattgagctggtttgtcttattgattctgctctaatctgagaaatcggttttgtagtttagagcaagccaggcaggcttcacattatgttaagccttcaggttgactattagattcttgtatctttctgaaatgttccatctgctttatggtggtcctcaagttgggtcaagtgatagtgaaagtgaaagtcactcagtcgtatctgactctttgcaaccccatggactgtatagtccatagaattctccaggccagaatactggagtgggtagcctttcccttctccaggggatcctcccaacccagggattgaaccaggtctcctgaattgcaggtggattctttaccagctcagccacaaggaaagcccaagaatattggagtgggtagcctatgccttctccagaggatctccccaacccagaaatcgaaccaaggtctcctgcattgcaactgagctatcagagaagattcttgtattgatggagcaatacaaagtgtactgatgttgtagaaacctcaggacagtggacagtggttttattttgttctgagaggcatacaacttctatttggttgtttttaggcagatcatagaacacctgtgggggtgagtgaaatggccaccttcagtctgtggaggtatacagtgagacatgtgtcatgggaccactaattaccaatttgagattaatgcctacttcagaggcctcactggctcgtagctatggctctaccctaaaagcaccttcaggtctatgtgcttaaaggtggtgactttcacagttagaaaacgcattgccctagaaactccaactgaaattctgtatttgatgtcattgaaacaccctgctacttagatgctaacctaagttatgtgtattttcatctatccgtatgaaggtagttaacctcatggttttttaaaataatatagctaatatttatgcaagttgatgcaatgagttttccctagagtataaaattatttcaatgcttagtaaagtgataagggccagctgccttgtgtgttttcattgtactgttactgataacagaagcagggagttgatggcccatgctaaaatgatatccacaaggttgtcaagcatacctttgggtctcagtgcaaactgaatagggaacagagtggttatagctttcattcatttattttttcatgttgtaaggtaggtggacatgcaggattggaattaagaaaataatgattaggttggttcacatacatttataagccagtatgtatgaagggcttattagcaccatactcagcttcttgtaagcattctttaaattgagaataccttttaagaaatttttactacaggagttaatagcatatactctgcagcaaaattctctgggtttaagctaagtaacttcaggcaagttgcttattaaactacctgtgtttttctttcctcatgtctaaactttatgatagaagtatttacttcatgaggtgactgtgggaagtaaaagatgttacgtgcatggaaagcattggtaacattgattttagtaagaaagagaatcataagtaaaaatgccagttaaagtattagttatattagttatcattatttgtaatgcattctaaaattaactccagcatcgctgcatagtattaacattctggaaaaggaatatctcttcatttccttgccttttcggaaatggaaagtgcaagtagttcca

SEQ ID NO: 35089 - DNA, 865 bp, Bovine  19866881385850
attagattactcaagaagaaaagcttaataactctgaaatgtgaagtttaagtttctcgattttccacatgaaataatttcctgagttatttaaatataagctaagatagtccagggagttatttgaaataaatattgagaaagagaattcatttaaatggagttaatcctcccagaaatggatagcaacaagatatttaatcactgtatatccagttaaatcacattcagaaactgctggaaatagagactagacaactttcttaatttagaagatagtgtaatacttaaggctttaatccccttatgatagatattggacataggactttggcatagttttcatgataaaactcttgctcttattaagatgttttatacatgagtcagtacaagtcatttgtgaatcaactaaattcactacaatagtcctctagtctctttttgaggaaacatgagtgctgacattttatactggatatgactttttttttttattatctgtttcttggagagttgttttctaagactgatttaaaaaaaattaaaagagcagtggcccctttaacacaaggtcagaaatgtccttactataaaatttatttatatttgttttttgtgctgaagaagagagaaaaaaaagagagagcacatcatatagcagtcagactagcacatagaaaccatatggcttggtcttttactaaatgaaatgggaatagtaaatttttatctgacatatgtcatgtaaaagttaaaaaaccttccccatcaaaagctcagaaaattaaattaaaatcatatattttatccacgttccagtagataacataagcatcaatagtaaagcacagtccatgaacag

SEQ ID NO: 35090 - DNA, 1699 bp, Bovine  19866881409624
tggatggaatggaggaggcagagattatcaattgaaaaataaaagggggctgtttagaaattcttcttagagagagaaagagaaccacaaatgaagtcagtggcagatgcaatgaattttaagaactgaatagattattacaaatcactattcaaggaatacttaattaactaggtcacactatgttaacctgttagattcctcatggaaaaaatccctttattttcttaagcctctaaaatagagtctaactttttctgactttcacctttttaggtagaacaaaaatcctaaggcaaacatggatgagagaatgggctacatggaccacagtcccacaagtttcaactttctgttgggaataaaaagtgagttagatgaagaatagagagggttgaaatacaaatttggatgaaaatagcatagcaattaaaagcaaatgatgactaaagattaatgcatgaataattacaatttgaaactagaataaatccaacaataatcatgaagcatgttatcaaaaatcttgaaaactgcttatgagagcataagtttgcaatactactaaaagaagaaagaaaaaagtcccccataaactctagtgagttatgaattttagttaatcaatatatttcaataattctcatcattcactcaaagactactagacagtgacccttagccataagtaattatgtaatgataacaaccacaaccagtatttaatgagtaactgttatggttcagacattgaactataagtaccctatatttatgatctcacataatcttcataaaatctctaagaggtgggtactatacttttttcccattttgcaaaagaggaaacaaagatggggaaattaaatacatttttcagagtcatgtgtatagtaagtgttggtggtactagttttcagatctggtaatctcatggcagccttatccttaatcagtgctctattttacgtattttgtctatgtgaattaaggtattgggtggtttttgtttttggaggggggcggttctgggtttttgttttgttttgttttcaactggcatagatagcagtttcagttcagttcagttcagtcgctcagtcatgtccaactctttgcgaccccatgaaccggatccaccaagaggagtctagtacctgttgtccttgttttggaaagaacttaaagtctctgctttcccgtcacatatgttaatcagtccctttcagagaccttgaattcttgtcagaattccaatctttgccactaagggaatcctcattgaaatttacctgacaaataatgactcctgcttaatttttatctaaaatacttatgaattcttgataaagtatattaaattttctaacaggcttcattttaagattattttataatgtgtgtagctagactgaaaaaaaataatcaccaatattactgtcatttcttcaacttcctgcagctgatctactagaagtcatccagaggaataaatgcagccatttttatatctgtatgattattgcttttatactttccagcaggaaacagataagctatttattgctctctggaacttaaacatttaaaaggaacctatgctatatttatcatgctttacaggaagtgcaaagctgttcaagacagacaagaacagataggtttataaaagacattgcaaatttaataagctacacta

SEQ ID NO: 35091 - DNA, 1297 bp, Bovine  19866881638417
atagatacagatgaatgaatggaagcctgtgaacttctcaaaaattctagcaagcgcaggaaatctagcaagcacaggatactgagccactgggacacctctcttaggaacaattatatgactattcaatagagatctcattgtttggtcattgttgccaggaagacaaaagattgttgaatctgggacctcaggtaagaactataatgtgtacaaaattcatctataatcgtactgacagatactgatagtgaggcttgctgaccattggacagattaaccaataatgggaactgatactaaatatatttattatattgttaatcaattttctaataattccacaaaacattagccctccgagcttaataataatattgctgttgaacctagtaagtagtgtgtcttgttttcaacattcttcagactagtagatttttatacttatttttgtattggtaatagactctagtcaaaacaaccatcactaagaaataaataagccattgatttgatcatagataccaacacagtcacaattacattcaaatataaaatataaatattatccccagatacttatagagatccattcaggcccctcggatgtcaaaagaaacccagaacgttatcattttctaacacccttggcatgttaaattaggaaatgttaaaaaggatgaccaaaatcataagatgtttcaaatgtttacatttaactaatgaatgcctgatagaagtctttttccctttctgtcactctttctgtaatattatattatatattatctttttttgaagattacatcaaaaatctaaatttgaaccactgcctgattgtgattgccaggctttcgttgtgatatgagatttgatttgcaaatataagtataagggaaagaataatagacaaatactttatgcaaataccattatagaggaatgaataatagacaaatagaaaatactgtttgaaagtcagaaaaagccaaaggtggagaagaggaataaatatttaaagtattgaaagtataaatatttgaaagtgacttctaattttcagtgattcactaaaagagtaccctttttttttttggttgcactgtgtgtcatgtggggtcttagttccctagtcaggaaatgaacttgtgccccctacaagggaagtgcagagtcttaacccctggaccatcaggaaagttcccctaacggaatattttacattgtagtcattggaatacaagtccagcgcctagaggcaaagatagtgttgttaagcacataaaaccagtcagta

SEQ ID NO: 35092 - DNA, 1604 bp, Bovine  19866880369389
aactcccacttcagtgcaaatccccatcttccaggagccatgactcaaaagaaaagggtgcttggacttttgttatacacatttgctttgtgtaaataaatgtttacaattttatattaaagatggaataagcattagagcttctgactgtatattttttacttttatagatttaaaaactatgatcctttatatatgtgttttggggggctataagttttatgacaaacagttggtattgttaactttttactgtcatcaaagtacataaaaattctattaattcccttattcttttacttccttaactctggtatacaccaaaaagaagtctttactttcctgttttatcactataaaataataaaagtattttgctagtatggaaaaaataaataaataaaataaaataaaaagatgataaaattctgcaggaaaagctacttatgaaaagctttagttttcatctactaattttacagaagagcagacatgctatactgcctatgatgtcttatgattgttaagagcctcattccacctttgtgagaaaaaagcaaaaaaccaaaagtaagagtatttaatcccaatggaaatacatacccaagagatacatacacccaaaaaattaaaacataggtacacaaaaaaacttgcgtataaatgattatacattatttaaaaatagaaaaagcagagcagaaataatcaaatattcatcaaatggtagataaatgtgtacatgtatactcacatacgcacaaaatgaagtattcattgtcaacaaaaggaatgaaatactgatgcatgccacaacataaatgaatcttgaaaatatttgctgagtcaagccaatctttaatgtcacattatactgattccatttatatgacacgttcagaatatcttaatctacaggaaaacaaagtagactggggtttggggaaaactagaccctgtaattggaatctgaaaacgtgtagggcatgttttatgtccaatgtggagtttacagcatagtatgtgtatgtatatatatgtatacatacgtggaagtgaatgtattagtcacatcaagggagagactgctaatggctatggggtttcttcttgggatagtgaaactattctaaaatttactatgctgaagatcatacaattctgaaatactaaaaaaactttcaattatgtgaattaaatgggtgaattatatgttttatgaattgctgctgctactgctgctaagtcgcttcagtcatgtccaactctgtgcaaccccatagatggcagcccaccaggctccccagtccctgggattctcaaggcaagaacactggagtgggttgccatttccttctccaatgcatgagagtgaaaaatgaaagtgaaatcgctcagtcgtgtcagactcttagcgaccccatggactgtagcccaccaggctcctccatccatgggattttccaggcaaaagtcctggagtggggtgccattgccttctccggttttatgaattatgtgccaataaagtttttaacaacacactttttccaaattgggaaaggagtatgtcaagggttgtatattgtcaccctgcttattta

SEQ ID NO: 35093 - DNA, 898 bp, Bovine  19866880587874
tcttgaaattcttctagagttttttgtggtgtaacacatttaacaaactaattatctgaaaagagaaaattaaacctcagtatgtcaaacaagtctacttgactataaaaattaagtttaacattaaaatgtattaaaaactaggaaaaaaatcacagcagagctttgaaattttattattgttactgcttttaccagaatattctatcatacagcatttcaaaagttaaatgattaggattctcgccttggaaataagatgcacttttaatcaaatcacttttatgtgtccctggtaacttattattacagaattttgacacataatgctttccagctttgaacataaaaaagtatcaattataagtagaaaaacactaaataaagcaatatgttaactctgaaaacttaaatacaatgtgcaaatttcaagaaagttttgaaatatgagggctaagcttatattttggtacaataaagatgaaatgcctcacagtattatgtatttacctaaagagggttcaaaaactgaccccatcgcaggctttggtcctggtactccaatgttaaacaatgaattctgctacttgagcattaaaaacacatcctcaatcatttcaaatgactgagggaaagttgaattattcagtataaaagactgaagattggagtggctggatagccaaggggcaaaaagaaaactgaattcatactttaacctttataccaagatagacttaaaatggaacagaaacttaaatctaaggcatgaaaccatgaaacatgaaaatatggataaacattcagacaactctggtgtagaaaagtctgttctaagaatgacaagaaacctacaagacttgagacattcaacgacaaaaatctagggcaaaaacaa

SEQ ID NO: 35094 - DNA, 1297 bp, Bovine  19866880714386
cccagtgtcaacaagaggctcccctcgacctggaggcccctacctccagcccagccatgtgagcctccaccaagccgccaagtaacttgaaatcaaaaccccgtggctagccaaggctcggtgctggactatggcaacaccaaggcccctttctcactacaaagcagactgtggacaaggcggccctggggctggccagagcaagccggccctgatggcttatcttccccagcagctgcctcatcttagcagtgagcagagctccttatttctgataaaaccaaagccaggaaatatgcccttccgatcactggttgcacctaaccaggtgagcacgggtctttgctctgatactctgcattcacatccacccaccgagtggtttttcaggtcccagatagttggggaacaaagggagtaagtgagcagctactttttgacttccagctcccttgggaatgaaaatcaatcaagcaaaccaggattgactctcagtagaataggatagaaccccttgcacttggcctgatgtctctctcatgccacacaacttaaatcattcgtggccgtgttttaaaggtaaagatcacgtttaatgtccttacaggctctgttttttttcttttttaaacaaactttcagatatgtatgtccaaaatgccctaagttttagtaagcttatagcatttaggtgaatgctgctttctaacaggtctcaattacatggttatttacttaaggctctcaagcctggcagaatcactgggtctgaagggtggaggatggtcgagaaccgttttatcacgatcattgtctgcatttctactcacattcacgttctaaagtgtcccccagccccggaagagtaaacaaacagcattcccagccttcctcagagctagcgctggcttctgtccaccgcggtgtgtcctgcactgccctccacactgtccacatagagggacccactgacactgagctgacagtcatgtgactttataacagttgtatgacagttgttttgtcacggtgcagtgaggtatctccttcctttcgctgctgtaagtaaaaggctgcagtgaatgaacctttgtgtatttgtaacactaacattttaaactcatcagatttcctgtacagatattgctagataaattaaaattatttccaaaaataaataaactcatcagtggccacaggactggaaaacgtcagttttcattccagtcccaaagaaatgcaatgccaaagaatgttcaaactactgcacaattgcactcatctcacacacagcaaa

SEQ ID NO: 35095 - DNA, 959 bp, Bovine  19866880732432
catgagcagtttggaagtggtgaagtctggcttgtaaccaggagggctggctggcttttccacggggtaaggggcgtttaagggactgtgggcgggacctgtctgctgccacgtggacatctgggcctggagcgggtgctggggcagcctgctgcgggttctggagcatctgctcacgcttctgcttggcagcgatctgctggagttggtgggcagaggacagctctgagcctccgcctgggccctggctaggcagcaccacactggagagggctctctgtgcattctgagcctgggctgatgccggcatcaggctgggactggggctatccactccaggctgaccagcggtgaggaagaggggctgggagcccccgaaggctgggtgaatctgtggtcacagggccagatgaaggccccataaaggtctgtcctgcagacccagccctcacttgtggagagcctaactgttcctgttcaaaggccgctggagagaattccgtcttaatattaatgtcctgtgccaagggggtctgtgtggcagaaccagaagactctgggtccttcttctcttcaaagtcctcattgaacagatccttcatgtcttcatcaggaactgacctgttcagctcctcgatgagctccttccactcctgctcattgagattgaggtcaggcatgaggttgccttgagagatggagcctccggcccctgcgatcatgcaaggcaggtcatccatgggctcctgtttcagttctttattcaggctcaggggaaatgactcactagtgttgctgcctccgttcaggtggaggctcgagtctgccagacacttcttgctgatggagtccagccccagtgcatgcttcccagtggcctgcagggcttcagggccaggcttgtcgggctggccgagcggggaagccgggggcaggccgttggaagagacgacggctcc

SEQ ID NO: 35096 - DNA, 2984 bp, Bovine  19866880740100
acatattttcttccttagggcacatgtcagcctccgtgtgcttaggaacatgagacagcatggcagcgctgtgctggagggttccatctctgtgcttggggccactctgaccagtgaagtcaccaacaaacatcacgaaaacgcaaaaaataacactaagtagattaggaaaaggacacttgtttacagtacagaagccgaaaccagaagtcagggcatcagctcaacctcagctgggaactcacaggcgtgctgggtgacaaacatcttgccgctctgtgcatgtccacagatgaccaagaattgatgtgagtgtgaatttggaggttacaaatgaaatgaaattttaggaagcaaacacgaaatttatgagtaatgagcattaactgtgtgtaggggtatatgatatatacatacattaagttacatctttaggtgtatagaaaatataactagaaggatatgtcaaatcactgatatttgtggatggttttgaggttttgacgtttctgagatcgtctataatgatgatggctgacttttaaaaagttattcatgttcaaaaagttacagacaaaaagtctgagtgtgattcttgtgtctttcctagccttgtttcagtgacaagactaacaacctggaagcttacgtgaaatggttcaacagactgtgctacctcgtggctacggagatctgcatggtgcgtagaccctgagctggcatggccaaagttggccggggctggagaggagtccccctgggagggaaccagaaggccatgatgagcccatctgtctcctagcccagagccaggctgggcaccctctgggacaccaggtgttacctggcttttgcctgtagagacatttccccctgagtagagcctggcatgaatccacctgccggtcccagagggagtcagagagatgcttactgagggagaggggagtaggctatccacttctcccacctgtgcctggggcggcctggcctgcagctgaattctgtgtggctcactcaggacttggtagaaataatccaactttaagaagtgggagatcgccctttgaagtccaggtccctggcatctcccagaaagcagggagattcggcaacaccgagctggacgtgctggccactggatctcagccctgccgagccagaccctgccgagcctcctccacggcagcggggccctctccccagtccattcctccactgtgaggtgaagcccagggccccctgtctcagggacagtttggagggagcatatgtgctggggtgggctctctggaagcagacagagcttggggggtaaggggtttgtttatggggtcaacgcctgcaatcgagaaagtgggagaggctcaagtggctcccgtcaggacgcccacaccctgccgtggtcgagcctgctcgtccgccttgcttgctcactgtcgccatcgctgtgggggctgccctccaaagcacagcaggacctcaggtggcagctccctgaagggttcaggtgccacagctccaccagtagcacaacacacttctcagcggcagtaaagaccacgccacacgtctgggaagcaggcgatctccttagagaggacactgtggggttccgtgagccctgcctcttctgacttcgcatccctggcctgggagccaagagagatggggctttacctgagcaaaacctggaccgagctcaccccagagccgggcatcactcagccagagaaggacatggtctggtcctgagtcctcaaagaagtcaaagtctcacacagtcagctggcattgggggtgaggtcgcacagtcatttgacagaaagcagtggtggggctgctaggggacagggcctcggggtcaccgtgtggccaccacaccccatgcagagtgaaggctgtttggtgctgggaagagaggtgaggtggctctgcttcctgcacccaagggaagagatgctggcactgagcctgagaggagggggacatgagaggcccccagtgccccccatgttgcaggtggctcatgtgtccccacagaagtcccaccaccctccacttgaccctctgtgcaatggactctgtgctgcctccccccggggcgtggtgagaccctgagtcctcaggctgcagatcaccctggtccaaagcatctcagctggaaagtttaatgaggggcaagatgcctaagcaggtcagcgcagggtggggacccctcgtcactgaggctcgggtaccctgtccccagccagccaagaagaaacagagggcccaggtgattgagttcttcatcgacgtggctcgggagtgcttcaacatcggcaacttcaattccctaatggccatcatctgtgagtgggccggccaggcctggggcccccagggcaagtgctcccagagagggtgggggcgggcgcggccaggcagtggggcgccagccaggatgtgcctctgagcaggaggtgggtgctggctgggccccaattcccccaccctaccctgaagtcctggggaggtgcccctttagaggcaagcccagccctttcaatgtgcttggtgagagcttggcagcgtgtacccagattcagagcgagtggggacccaaagcaggctcctggtcacagtataggcccatgttgtgggcatggggacaggggtctgcacatacagaagccaggccagcctggacacagcgtccattggcgcccacccacccctcatctggcaggctgaggctcccccaaatgtcagccctcatcagggtgcagcctgaaaggattaggggatcacccagctgggggcttcccagaggagctgtgtagcaataaaactatgcagcccagactacccctgccagcctggccctgtgcccagcttagccatccctcttccagctggcatgaacatgagcccggtctccaggctgaagaagacttgggccaaagtgaagacagctaagtttttcatcctcgaggtaagca

SEQ ID NO: 35097 - DNA, 1729 bp, Bovine  19866880841885
gctttgttttgttttattttgattcctcttaccatgttaaaaataaccaggatatattggcagaggtttttctttgtagcagctcagtaatgactgggccacatttggtgctgacttctgaaaccctgttattttcagtggccatttattgtgcccagatggaagtaggattgttagcccctcagttgctagtctagtgtattgctctccttcgtatttggcagcagctttctgaaagaaaagaagggggaaaaaaaaacttagatatgaaactgacccatctgggcacaaactagattttcctgctggcatacctgtttctgttcatatacttcataattcaatctttgatttctcattatccatttctcttttcaatattccccctttcccccgaacaccacatacaggagtaatacagcctttattgtagtttttcttgtttagtctttgttatatggaattaaaaaaagaagaagaaaattttgtttaggccctctacttctgcttaagaagacttgtgcttcatactgcattcaagacgttttgtaacctgatccccaatcttcttttccagctttatcctctgccactattctgcatatttgttagctcagtcacctttgactagctagacttacacattcctgcctgacccctttgcttctactgttccttctacttgaaccacacatgctcactggagaggaagctctcaggcaggaattccttcttacacatttctttgtacctgctccagcataccacttgtacagaactttgctcataggcattcaataattacatggtaatataatacataaaatatgaacaaacctgttgtgctttgggggaatatttcagaaacaggccagccctgtggaatacaaaaagactgatgctcctcagccagatgtgaaggaagatgaagaagaaaaggaagaggagaaggaaaagggagatgaagaggaggacggtgaagagaaacttggtaagaagtagaccccaaaatatctgctctgagccagcaccctaagatgttgcttcaaactcttatacgcacgttactgtcaggattgttttagactctagaagcgtgttctaatgctaattttctagttaccaaaaaataagtgtaagattttgctcagttgttttactttgacttcttagaagagaagcagaaaagtgatgttgaagaagatggtgacactgtcagtcaagaggaggacgacaggaagcctaaagcagaggtaatggaaagtggcagctcaggggaaggcacacgtacggagagtgttttcataagatagttttcagtggctacgacagtaaagattctgttatagccaattttgtaaaagtgggattcttagcattaaaaaattcaattttttaattttaaattatatctgaatctcaaaaatactttctgtgctgaaaatggttttctgtaataaggagaaggcaaggaagactagtaaagtgctttctagtaatggtagcttcagttgtttacagttctgtttcatcaactatctctcctcactgtgcccttaaaactgttccttggacagatcactgcattctaaaatttttgtccctcttgctgatgaattcatttgttcattcattcagtaaatatgtctggagtaattgttagtgaacaagacaaaaatactctacctttgaggagcttaattctagggaaggaaacagtaagcaaggg

SEQ ID NO: 35098 - DNA, 1757 bp, Bovine  19866881009141
ttgatccctgagtcaggaagatctcttggaagaaatggcaaccctctccagtatctttgtcctgggaaatcccacggacagagtagcttggcaggccacagtccatggggtctccaagtgtcaagacaggactgagcgaccaacatgttcatggatggaaggaagggagggtgggggagagggagaaaagatgggtgtaagcgaatgaagcttgtagcccagtacactccaattccaggtgaggaccctgaagttctctctctcctagcccttgctggtaacaacccacagagagagtttcaaaagcaggcagctcaaggttctggctgcatggctgcaggactctggaaaagtgccccaacctctccgtgctttagtgttgccctcaataagatggggcagtagcaatgctcccttcagaggtcgtcaggccagtgggagaatccatgaggagacttcaccacggctcccagccaaaggcagcccctgaaaaacgctggctttgctcctcgtgtctcttccacgccctgcgcccctctgttcccctgaagaccacaggaaagcattcacttctgctccggccctcagtctgttcccaggcaggtgggagggatggccgtggcagaagagaagctggaatacccactccccaggcagcaccttgcctggcctaagaggctggggcctcaggctcccgggagcctgcccaccctccgcagcccaggactgaaatcagctctgtgttcagggccagtggccctcaaaccaggccctgtgctcctcctgaggaagaggctgcccttgagcaagagctgcagtgaggggcaggacaggacggtgtctgaccccacaagctagggcgcgaacgccaagctaacaagcttgaccttgccccaaacagggcaggagcaccagaagggtctggtccaggagagtgcagtgactaagaggtttctcccacacattccagggctgtggagggtgtggcctgggccgcgtctgggggttcaggagcatggccaggtgctgagcacaggagccctgcggggagacaggatgcagggctggggacaggattctcaggggccagggacaaaggaggacggaggtccctggagccctgggctgcccaggcaggatctccaggtcctgcatgctcaaggtgggacttgcttttaaggaaagacgtctcaaggcagcctttgcccggcgaacactgtgggagtcctaggcctgcctggcacggagccacccactcaggcaccctccttctgctgtgcattattaaattattcctggggagattagggtagaggcatgaataattcaaagtcagagataaagtcaaatctaatcaactctgtctgccggcttgaactttggcatgatgaccagctcaagtcaatagagcctgctgggagcccgaaatgagaatccaggtctgggattcgccctcagatatttcagaggaagctctgctgtgaagtcctaaatcgtggctgcagcagcagcttctccatctcagcctccccgttcatgctggcccttgttatccgttacagggcagcttggtggctgaggttgggccccagcactctttagccaagtgacctcagagaggtgcctaaccctgccaggcctcaatttctttgtctacagaatgggaatggaaatggcatctgcctcacaaagctgctttaggcatttggtgaatagcatagagacagcatcgtgtgctacaccaaatgcaggtatag

SEQ ID NO: 35099 - DNA, 1319 bp, Bovine  19866881054252
cttctgagtggcaatgactctagctaaggaaactggacccggtgattataaaaacaggaaaagactccaagctaggaaatgctatttggaatatggggaaccccatcacctaatagaacaatcctgttcctaaacaagaggagatgttggtccaagtcctaggccacataggtcacaattgtttttttaccttcagtagcttttatactcacgttaaagttagcgctttcatatttcggccattcaaagagctcagtgcctcttcctctgagtttctgcaaactatgcacagcatctcagagggtggcatacaaaactatttttctaactatagcacaggaagtttggggtgggggaggcttgggatatacctacatgtagccaacgacttattttcccaccttgagggatgaaagggagactgtatacctgagtttaattcgccattggatctcttgtaccagaaaaaacacatatcaaatatccaagaagtaaaattgatcactagcttaatctggggactcactataaggaagggtcactttgactagaacacagatacctacaaatacaatgtgagctgatttcttggcaacctttaaaatgttctgggcagcacaacttctaggtctgtacagttgatgtaagtataattaagtagtgaaattgtatggtatatacctatatgccaatagtgtatacctgtatgtgcaggatttgctaatataaccatttcaataaaaacttattgaaaaagatgcattggccacatggagtgctgttggtggaaacctgtatcagtgaggactctcttggttgcaaacgactgaaaccccaacccaaactggcataagtaaaaaaatagtgtggtgttgcccaaatgctaagtccaaaaaaagtgtagtgtctcccaaaagctaaaatgccatgagtgtgcgtatatcacttacggaatgttttggccctcaaatactgaaaccaagacacatctgctagttatagcctcgttcgcacaagagctggtctgcctccccaggagaccagagtggtatctccttgaccctgattggcttggttggaagcacatggccatcaccgaacgagccactgtggttacagaggtaaaatgtgccattagccaaggccagaattggctcttctttggcagccacgagcgcattcagcttcacctgaaagacaggagctgagagttgaaagacatggttgctacagcaaaatcatgatggaaggaagaaatggatgttggggcaaaaacagcaaatgtccaatacatgtagaaaagagtggaaccaggaagg

SEQ ID NO: 35100 - DNA, 2497 bp, Bovine  19866881358776
cccttagcagtaatgaaacatagttttgactgatgtaaatttaaatgttgttctacttatcccagtaacctttggcagctgtcactcaaggcacacctatgcccattggtgacgcatcaattggaaagtttcagccaggtgctggtcctaaaacatcatttactgtgtgatgtgacttggcaatttgacattgtagctacacgttggaaggcacttgtcaaaataatagattgtttagaagtcatagtttctaggatgagttttcaggccaaagttccaggcaagaatcaaattcctgtagcctgaggaagggtctaggatgtaggggatcaccataaagaaaggccctagagtaacaacgaaaaaagctgcagaagttgtgatgagttgtgttgagagtgtggtggagtgtgatgtgtacattcacctgcaaacattttctgagaatctgctgtgccagactccagatgctgggagcacagagagaccttgaggcctcctctcacagagcgctcactgggaagggtgaagaagggacttgaagagtagtgtgtgtgccggggaatggcaggtcccaggggatgggaagttcgtgttggtaatcgtgggattcttcttccaaagaaagaagaagcctttgggagattctagggcctgagaattctagccctgtgctgtccagtatcatagccactggccacatgaagctattaagtactcagaatgtggctataattataaataaatactggatttcaaagacagtaccaaaaaatgtaaaatacctctataatgtttatatgttggttacattttagaaatgaatactatggaaatacactattggattaaagaaaatattattaaaattaaatcttcccttttctagtcactttttttaatgtggctgctagaaaatgtaagttacacatagggcttgaattgtgcttctgatgggtagcagggaagaaccggaatgttgggaactgaaggatgaccgggcgtggcaggagggagggcaggagggagggcaggagggaggacaggatattgtagagactctcaaggatttaagcagagcagtgtcacaaaggcttccacacggaggatgagggcacccgtctggcctctctagactgctctttgtggtttccatttgagagttaggttttccaacatgattctaaaatcccagggttcaattctgactttcttccttctcccagcgctctcacatacttcagtggtcactgacctcacaaatctttaaccaacgtgagattgtttacttagcatgctttggttcactgtattaattttaaccttctctgtcctaggatctgaagcctagtaacattgtagtaaagtcagactgcaccctgaagatcctcgactttggcctggctcgtacagcgtgcaccaactttatgatgactccctatgtggtcacacggtattaccgggcacctgaagtcatcctgggcatgggctacaaagagaacggtgagtacagacaggactggaagaggccgcaatgtttaaaattagtgctattagtcatcacgagctttcttctctttcctgtgaactgtatgaaatataatatggagactgtgttatgcatagattatcatggttcacagatgagaaataattttatatttccattggttaaaattattcacttttgaaatgaatattttgaacatttatcaaagtataatatgcttacaaaaaaaaaaatatgtgaatcccaggtgtgcagctcagttggagcacacccatgtaaccagcagcataactgaggcctccccaggacccctctgggtctcaactcccaagggaagccattatcctgatttccagtaccatagattgatttttcttatttttgaactagatataaatggaataatacagcatgtgctttttgtgtgtaaaattggtgtgttttttttttttaacagcaaaacttattctagcaatatcagagctctttgaaacttagcttttgaaaaatttgtcaaaaagaactaaatcacacttacttattaaaaaaaaaaaaaaaaggagtctgaaagtttgcctaagtcatctgaaatgagctgagcttcaagtttatccagatgttttagaacttgtgctcccattcagagagacacgagtctgtggccttccagtcctctatggccatgggaggaaattcggtcccgttagcgtctctaaccccacctacaccagcactgaagagctctctgtctgggcttcagaggccttgattcagctgggccccgcagaggagggggaacagccagaagctgaggcgcccctggccctcgcctggaacccaaacaagcctggccctgtggggccccgctgccttgacagtttagaaatggatcattctggagacatggtgttcatatttcacacgagtcctactaacaagctgggtctgtctgtgtttgggaggggatttgagagaagacatgcatgg

SEQ ID NO: 35101 - DNA, 767 bp, Bovine  19866881815184
cagtctttgagaaagtaacatgatgcccaaagtttatttggattttcaacattgacaaattttttaaaaatgtttttttgtatctgaagattacaataacaaaatgattttgattaaaaggaaaaaaaccaacacagtatcactacttactctatgaattataccagctgaatgtagatgtttaataccacagagcatctggtaaagaaggtaggacattctttcatggtccagctccatgtgaataacctgacataagttagcatccattaattccataaccaaatacctgaggaaataaatgatcagccatgtacacatgaaaattatccaaattccttcatggtatcaaatcagaatctttataaaaaagaaataacttcatacctagtcactgtactggctaaagtaaaaagataacttgctttcattaggtatcttgatttataagctatcttgaaaagaagcaatttttatatcatagtaaatagaatctccaacatgcaaagtctcctatatttaaaattttttgctactgggtcattcttaccaatacagaaaccatgccgttactgcttgcatcttaagaaaacttttgaccttacctcccctaccagctacgatcctgtatttttggtcttcctgcaagcaaaactccccaaagaggtatctacactcatcatcttcaatttttttctcccatttttccttattctcactttaattaggcttttgcccctaccactttcgctggaaactgtctttaa

SEQ ID NO: 35102 - DNA, 858 bp, Bovine  19866880429634
ttttccagcagtcaggtatgggtgtggccataaagaaggatgagcacgaagaactgatgcttttgaactgtggtgttggagaagactcttgagaagtcccttggactgcaaggagaaccaactagtcccatcctaaaagaaatcaaccctgaatgttagtggaaggacttatgctggagctgaaactccaatactttggccatctgatgcgaagagccaacttactgtaaagaccctgatgctgggaaagactgaggacgggaagagaaggggcaacagcggatgagatcgttggatggcatcatcaactcaacggacatgagtctgagcaaactcaggaagatagtgaaggacggggggcctggtgtgctgcagtccatggagtcacaaagagtcggacgttacttagcaactgaacaacaacatttacaggtataaacagacacgtgtggacgatcatgggctaaatggttaacatcagttaccacaagggaggcagtatcacttttttgcatgcatctcttttctatgccataattctggttttctccctcccaccatgaaacaaacagagccctacaaacccctgtgttttctggtgccagtcctcgcggatgaggttggacgtgtgtatgacgacccggaggccttcctcatacagcagaagcatcattttcctttaaaaacagaaaaaggaacaagcagcgttaagagtactctcgaaacacctttccggcacaaacgcaacaggtaagagaactctcacatcacccagactgcaaagtttatagtctccgtttcttccagacattctcaacgtctgctcgagtgacaggcagaaagccaccttccaagacg

SEQ ID NO: 35103 - DNA, 1554 bp, Bovine  19866880468139
gaaccgaggctttggcctttcttggctgtttccaatgagtccaccttcccattgttcatgtaggtcagtaagttacgtagtgtgacctacgtaaagttagggttgatctcttccagaatacaacttgggctttcttcttatgatgaagttaagggaggctgatgcatgccttgcaagcgagcagaaggaccttttcagcaaagcacttgctcaattagggagctgctaattgaacgtcggtttggggctgtgatcaaatccgcagctttcccaagtgcctcctggcctgctgggggctctaggaaagctgtcttcagctgttactgccgtgttccgttggtggggtcactcgatagctgcgtctcaccttaccgacttgcagttccagatgagcccagtgcttgctgggatcgggtattttcagatctttgctcttgtcctgtgagacgggcttctgggctcacttgaccgactgcttaatcagctgctgtccacgctgtgtaaagcagatgagttcagggacagtgttttattagctgtgtaattctaggcaactgacagagtacagcaggtgagcaaacaccacgggcttccctggcggctcagacggtaaagaatccgcctgtaatgcaggagacccgagttcgatccctgggtcgggaagatcccctggaggagggaatctaacccactccagtattcttacctggagaatcccacaggcagaggagcctggtgggctacaatccatggggttgcaaaaagttggaagcgactgagcaactaacatgcacacacagacatcacgttcacagccagcaccaagactcccttgggcacgccacacctctgatcacgttcaggctgcagggaaaagatgcgaccgtcacaacttaaccaggcagaggccgtgcaggggaccgagtcatagaccaggcatcccttccagcccttggtcacacccccctttatgtggtttctttgtgggggacggagatcattcgagacctctaggattcctggaggcctgtcaaggagcagagtgcttcgtgacaaggtcttgtcaggtttggaagctgctgggatacatgtgggttagatctaggagctctagaaggattgggggattgggaagtggtaacactgggattgggaagtgggtcttgagggccatggttgccttgacagggaggttagcctggtcatatcctaagctgtcatcctgtttgtttatcactttggccgtgctgggtctgctttgctgcacctgggctttctccagttacagcaagcgggggccgctctcccgttgctgagtacgggttccagagctcagctgccccacagcatgtggggtcatcctggactagggatcgaaccgctgtccctgctttgcaaggcaggtccttgaccactggaccgtcagggcatcccaaggtgtcatctgaagaagagtttacaccgagaagagggtcttgccaaggaacatgaagcccctccttggagatttcccccagacttggggctctgattgggagaacggtggcaggggag

SEQ ID NO: 35104 - DNA, 1291 bp, Bovine  19866880492497
agtgaaggagttcaatatatggacattccttcaaagaagatacagagaaggtcaacaaacatgtgaaaagaagctcaagtcactgctgctgctgctgctgctaagttgcttcagtcgtgtccgactctgtgcgaccccatagacggcagcccaccaggctcccccatccctgggattctccaggcaagaacactggagtgggttgccatttctaaggaaatgcaaatcaaagctactttacacccattaatatggccattattttaaaatttaaaaaaaccccgaaagtaaacactggtgaaggtgtgagggaattgaaccattgtgggaacgcaaaacaggataaccgctaagggacacggtggggcactcccccaaacaattatacacaggtttaccccgtggcccagcagccccacttctggggcgcacagccagatggactggaatcagggactcaggcattgtacacccatgttcggaggagtgcttgctcccaacagccaaaaggtgggggcagcccaagtgagcatcgacagataagtgggtagcagaacatggcccatacaacaaaacagcaccaatctttaaaaaggaggagattcagacacaggccgcaacacaaacattgaaacgctgtgccagtgcaataatcccatcgcaggctgaagacactgtgtgactccattcctgtgagagacccggagcagccaaactcagacagacggacggccgggcggcgtgagcagaggctggggaggcggaagggaagtcggcgttcagcggggacggcttcagaagccgagaaacccctggaggcggacggtgccgatggctgcacagtgtgaatactctcagtgccactgaactccacactttagaagtgtcagtatggtacaatttatatctatatgtaaccatgtaaccacaatatttttttttaaagatgaggagaggaaggaggaagaagagactgaggagaaagatacaggatttgggaagaaaagctcaaagcatttttgactgagatgactggcggtccttttcttttttccacagcagagggaatttctgatattgcagtctggcccacctccccagttctcctctcagagaacccctgtgctctagaaatccgtggacaagtgggcctgtgggtctgtacgctggcatgggaactagttttttcttacttcccagtttaatttaggggaaggcacttcaccaaagcactcaaacaggaaggagaaattaccaacgctgtcattttctcttcaacagcctcagattc

SEQ ID NO: 35105 - DNA, 943 bp, Bovine  19866880557549
acacatcacagcttgatggaaagcgagcctgagtggggaattgggcagagagtcagaaagaagcggaagcaagcgggagtgggagccggcttaagaccatgacccagttttcaggcccagggcgaccaacagtccgcctcttgcgccgtgatctttcatttgcgttaagctggtcttcagcttgcgccataaaagctcattgcttctgtgcctctgcccaatttgctttcctctgtcaggatgcccttccatccctctgaattccactgattttttaaggccaggatgaagccccacctcctccaagaagccttccacgattcctccagtcccagttaagctccattttcgtgatacacttacagtatttgtatcacagaatctagtccttgatgatgttttctggaagggaactgtctcagactctccagccctcagtctgaagagaaagaaaaaaaagggttccttttgacacaggttgaataagaaagagacttgttaggtgcctggggtcagaggcgccccagagtggccctgcgcccaccctcacaagggcagccggaggggagcttggcaggcacacgagattatacagcagctgcgaaggggaatcaccagccattgtgtaaaaacatgcccaagtatacacacatctccgctgctgccagctgcaaagacccacccgcccatctgagaagcggctcaattgaaaaccagcgtctgcagttgcaagtgtctgccgttagaattgtggacttgtcttaaattcctatttcttgtcttgtacgtggctttcaacacatgtgatgaacacaattggaggggctctctctgatgccctcaaaattctttttccatttctggatgctctacccctggcttctgtgtttgcatccaacggccagcactatgaccgtcttcagaagattggaatttagattcg

SEQ ID NO: 35106 - DNA, 2747 bp, Bovine  19866880593653
tggcaggacagggaagtgagtgggctgtcgttgggcagctgataccctgaagcagggacccagaacttctcagtctcatcactctgctctcttgctgtgtgtttcctacaactgcatgggctaattagcttactaccacgttcttctccccgccttaatcagaagccagaaggaaagagaactcaaaaggttcgctcctcctccctaacggcaaagttcagagggtgttttcatcgttcccacgttcattcaccagccagaactcggtcatgtggccatcctagccgacggtgttcagctaacactctggggttctgctgttgaaagcaaaaaagcgggaatggatactggtgaacaagtacccaccaggacttttgggtttaaagacactaaacagatgaatggacacaaatatatattagtaaaagtttacaaacacgcacggaaatgatcagcaccaaatccaagacggtggttacacggggaacaagggcgggctgggtcctgggtctataagcgtgtctgtcgtgtcctgtttttacatatttgaagcaacaatggcacaatgctgagccctgccaaagatgggtaacagttacatgggtgtctcagctttttatgttagaaataaattataatgaaatctacaaaatttaagaaagcttccctggtgggttcagttggtaaagaatccacctgtaatgcaggagatctgggtttgatccccaggtgaggaatatcccctgaagaagaaaatggcaacccactccagtgttcttgcctagaaaatcccatggacagaggagcctggtgggcaacactccatggggtcaaagagagtcggacccaactgagcaactaaaccagcatcactacaaaatttagccttgtctcaacaacccgactgcaactcagctcataactgaatcatatttcatcatattcatttcatagtatcatagtatcatcatattcatttcacagtatcacaatatgaaatgaatcatattcatttcatagttctaaaaaagcacatttttctacatgtgaactctgaaatgactacatctcattatattaggcagcattttctcttagtagggtataaagtcctacctgacaatgaatagtaacggagatttgaagatgtctaacatataaattctacggcatgtggactgcggtgcattttaacaggtttgacagcgggggtgggggtcgtttccacaagcagacgtagccaagctcacgagcctcgtcggccccgcgccggagctctctccgttgggtggttttctgatccacgagccagtgctctttcccgcgatagtgcctctgacgctgatgaaagttatgcaaaactcatacactggactcattttccctgcgactagcctgcgataaaatccttcctttattaaaccgctcgagaatctcctacctggtaaacaacagaagtataaacggcacctacaactgaaactcttcgaaatgggagaaaccagaatcaggtaactgctggaccaaaattttggacaggccgagaggacacagccatctgagggtagcaaaggcttctccttcgacccagagtgagctccatgcaccagacctacagaggtgatgggcaagcccacccgtggtcccgctgcctttgatatgtgctacagtagatgtgtcttgtagaaaatcagtgaaggatacacaggcaacattgttcctgccaacattatcaagatacaaatataaaaacaaaaactaaaaaaaagttttttaaagatgcaaataaaccaaaatggagggaaaataaattcgtacagctcgtttatttgaacacagaaaaataaatcaccaatttctttcctaatttatgaaagttttcttcatttctcacattcagttagtacacagttggcattttcaaaattcaaacctgatgtgaagcacactggaagacatgtgagtgaaaaaatagaagtcctagccatatgccactggtgcatgaatttgaatatctgaaaggtaatctagaaacgagcgtgtttccaactctccttaccaacaacagtaattcatagcaaccacacgttttgtagatggagccacttccccacgtgagagacaacaggagcacagacggagtccggggcgggagtctgctcagcctggtgagttacgagcctgtgaccttccccgggtctcagcctctccgaagctcagcttgggcatggataaggacgcaataatgattcattcctccctggacctattaacccataaatgtttcaagtttggttaacaattggatgaaaaaatcagaagaccatgcacaacggctccttccgaaagacatatgtcacaccatgaaacaagctctaattctaagcccattggattttcacttctttctatttacccacatagccggaaaggaaatgacccagggccaagccagcagcaggggctccctcccttcttgtgtgtgcccatggccggacggcaggagcctccagccccagcagggacggtttcctgacagtgcccagcgagcgttgctcattctgtccctgggccaggcctctaagtgggtcactcagccaggaaacacacaagctaagaatcacgtgatcactaatccactcacatgcattcaggggatgccaatccccgcaagactgaaatccaaggtgctatgttagcccacttccacaactatgtgtcaagaatccaactcatatgtttgcaag

SEQ ID NO: 35107 - DNA, 846 bp, Bovine  19866880600516
aagaaaagtgaagctgctcagcgtgtccgactctttgcagccccgtggactgcagcccaccaggctccatcatccatggaattttccaggcaagaatactggagtgggctgccattgccttctctgtgggatcttccccacccagggatcgaacccggggttctctgcattgcgggcagatgctttacggtctgagccaccagggaagccccaaagaaaggcaagtcgtatctccccactaggtgtcagacaccctagggttccatccctgatttatactccacagtctctcccagccccctgcatgccccggtgggcaggaagctccggaacgccatcacccccatgggtgctcccttttcactgaaccaaacattcacggtgaagaagaatgtgcggcagatgccggggccagttccctgtgcccacatgagacagtcccacagatccaagagctctgtttctcataccactttttgtaaaagtccacctatggtcagaaaataaatcctcctcaaatggatagattagcttaaatttccatgccattttacattttctctcctgatacatgaatcataaaactgtaaggtaaatgcaggcttacactgaataatgggcataaataaaaatattttgacttgaaaaacagtataaattgaactaccacgtacttgaaagctcccgcaatcataatgtgcacatcaaaacccattaacctaatacctaggctgctattcaaaagcagaggtctagcctgtaaataaatacccatttgaacacttctcctaaattactgtacaatttgattgcaaagtcacacacttacaaagtctatcatcttta

SEQ ID NO: 35108 - DNA, 3980 bp, Bovine  19866880618070
gggtcgcaaagagtatgacacaactgagtgactaacacttcactttcactttttcacataaactactctacacttgggaagtgcctaccaaaaaactaaattacctaagaatatttgagggacatccctggtggtccagtggttaagaaaccgcctgccaatgcgggggagagaggttcgatccctggtccaggaagatgccctggggcagctaagcaccacggttactgaatccacgctctagagcgtgcgagacagaaatacagaaataataccctagagcacgtgctctgccacgggaacagccgccgcaatgagcagcctgcgcctgacaatgatgagagcggcccctgcttcccgcggtcagggcgcatctgttcacggcctgggaagacccagcaccaccatgaacaaacacacacaaagatgtttaaggaatatgtgaactgcagccactttttccccatcaataactaaataccagagctgactgcctactacagacacttccagatcacgagattaaaaccatatctgtctttgtacaagacgatgtgttcttatcacctgtagaagagaggctctcttccctccagatcactgtgaaaccagatttactgaagcatttcaagtttacctttagatatgggccattcaaaacacaaactcttgccagaacctttattaatttctataaaatcaaattactcatgaaagtcaaaggagtctcattaaaaaaaatctcaaggacggcaaagaaactgaccatgcttaaacaattttccagttcctaaggaggaagagggagaagggctctacagaccaccgggcatggtctcagcgctccttgtattcaagaaccctgtggccatgcggcctatttcactccacacggcaggaggaggagggagagaaggccgccgagctgaggtctacaggagaagagttgcacagcgccaggtagcatcagtgagagatgctgtgaacacaagcccaggactgggagttagccaccctgaaatcacctagcaacagcagtcaagatgcagcgtctcaaaagctgccgtgagaatggagtggggtgtgcatattcccagagactttttacttcaacaataagcccatcctgagaagggctgtgtagctgaattcgtatcgcaaagctccaagggctatttggagagcattccgtttctacccagaaggagaagagagactcggccccttcagaggcctcagagctgtcttctttcccttccctactcatcctttccagacaatctggaagcagggcagcttggaaagaggcagacgtgctgggctcttgtgatgggctaatgcctagaagggtccaggtctgctggcacccaagtgacagaaagaaagagctggatggagcacccgagtagatgttagcctttgcatctgcccacctgcaaaggagaagcaagagaggacatgagaggaagcgtcgagaaagcaaggaggcagagcactgccgtgactggggaggcgggcgtcgtcacccagtcagtgtgccgaagtaaactaaagatgtaaactcatgagttctggcctcaaagaggtaaccgaacccacaaggacaaaagggatgagagaggtgagagcggtcaagcaaagtctagaagacagaggcgtgacggctgaatttaggcacgatgaagaaagctgagacagactcccccagagggaagactgaccagatgccaaaggattagcctcacagaagcccgctgaggctctgggactgggggcaccaaacacagtggatggtgggagtgaggtgtggaggttagttacagactctacagtggaacattagatcttcatgttctcgaagtttcctgggcataaccaggcaattcctcctccctccatcccacacaagtcaggattaatgctggataaatcgaaaggaagagcacagagatgagacgccagactacaagcagaaggctaaacggacatcaagagcctgcttccctctacccagctggctatcagaataccagcacccaggcttacccctcatacagacccttctctaaagaaaagcaacggccccagaaggaaacctccggagagatgccaaattgaaaagcaactgggtccccagccagccacccacaggaagccccctcaagcacacaacttcaataaactctcctgaacttcacatttcaatatgaaagggcatccgaggaaaacctgtgctataagacacccggggcttagccactcagtcatgtctgactctgtgcaaccccatggactatagcctgccaggctcctctgttcatggggatgctccaggcaagaatattggagtgggtcatcatgccctcctccagggaatcttcccaacccaggtctcctgcattgcaggcagattctttaccatctgagcccccagggaagccctaagcaaccaggaaaagcaagaaagtctgaggaaacagagagaatgcaggaaacagaagaaaatatcgaaaccctaatgaatatactgtgtaagatacgagacagcattgctttctttcttttttcaaaagaaaagaacaggatgttgcaagaagaagcaagggaaaatgtaaagttcttggcaattaaaaatatgcgggacaaaacttaagaattcaacagatgatttggaaatgaggtaggtgaaatcatccagaaagtaaggcaataagacaaagagatgatcaagacaaaaggggaaaaaataagaaaatttaaaaatcagtccaaagttcaactattagagtttctaaatgttcaaagaaaatggtgagaagaaaatgattaaaaacaacacataaacaaacagatacaaacccataccttccctaaaacaggagcataagtctttcggttgaaaggttttataaagacacaacaaaattctaaaagcttccagaaaggaaaacaagtgtgtttacatagaaaagatgaacaatcaaaatggcacatgacttctcaacaacagaagctggaagtcaatccggtgttaccttcataatatggagggaagataactttcaatctagaatcatatatgtacccaaaccactgaccaagaaagaggataaagacatttctcaagattaagttctctgaaaacgtatctcccatgtttgttttttagtaaactattagcagatacgctccaacagaagcagcaaaccaaaaaggaagaaacacgggacccaggaagtaggaacgatacagaacacagatgagaaagaaatccctgcacaaaacctgttccagaacagactccagagcagtcagagcagataacaccagggaagacaaagcagaggggcacgtgatctgatacgtttgaccacgagcaaaacgggactgagagatgctattaggaagcataagaagaacaagagacaaaggaaaaaagaagggagggagagaagaaagtgtatatctccaaatgcgtccacaatcaaaaagaagcaatgtttattaacagggaaaagactaaaaggggcacaagaaagaagtctgtagtcacggtatgtcgctggtctcactgatgcacgcagcgttcatgtaatagtacagacagtgtgaattcaaaagcagggaagggggacaggtctcaatcatcacaataccaagtcaaagggtaatattttaaattgattaaaaatcaagaagatgaggggaagggtacactgaatgtgcatgcttagtcaagtccaactctttgccactctatgaactatagccccccaggctcttctgtccatgggattctccgagcaagaatactggagtgggttgccatttccttctccaggggatcttcccgacccagagattgaacctccgtctcttgcatctcctgcatgggcaagtgggctctttaccactgggaagcccaaagacacattactatttttaaaacatttccatcataattataacagcaatacaca

SEQ ID NO: 35109 - DNA, 1734 bp, Bovine  19866880635225
tggttaagagtccgcctgccaatgtgggggacacaggatcaatccctggtccaggaagattccacgtgcagcacatcaactcagcctgggcaccgtagctgctgagcttgcgtggcacagcttctgaagcctgtgagtctggagcctatgctctgcagcaagaggagccccggcaatgagcaaccccagcatcgcaactagagaggagcccccgctcagcgatgaagagcccgtgctctgcaacagaggctcagcacagccacatgtcagttaaattttagaaacccccccttagccacgaaggccgtgctatgcacagattccgcctcctctcgtggtcttcaggcctggccaggagagccgtgtctgaggggcccctatgtcctgtcccccagagcttgtctgcaaggcatctggctcattgcttggctgggaatgagagctccactgacgtccgtgctgtttgcagcagggcccacaggcaagctttcctccccatgcaatttacaaattgctagtggaccaactccgtggatggagggtccattcccttctttgacagaatatttggaaaagcaagcagtgcccctggtcttctctaaacgccgccttattggcatttggcttcttgtaatatatttttaatatactatatatgctgtatcggagtaaatcagtaggtatgttttgaaattaaatatttgctaagggctaggttctcccgatgttaaattattgataacaaacttcacggacgctgtatgagacttgatgatatatgagttttgagtgacctgccatttattagactttatctgcccatgaaatccatttccaattcagaccgtatctactgcaggattgcttgccagaaatctattcccaggtttctccttatttcagtgaaatatctctggctcagcacctttcccaaggtggctgatctaatcggggcccaatcgcttatcacttctcatttcctttggcaggtctgtccaactgggaagtgcatctcggggacgcttgggagcagtagtcgacctccctgctttgccctttccccctgcttagaggaaggtgagctccctgacccgcagccccgctctgggggtccgtaaacagcaagaggaccgcttgcgtggtcaggaaagcgggggtggcctcgctgtcttccctggtgttggggactgtcgggggcctccctgtacccggcagtgttcagtgaccccacgcaatcggaacccgcttgctggcacagcggccacggggccccatccttctgctcccctccccgccgacttccgtgtggacaggtgtgtgcttctggccgctgcaaggcccagctggcaggagggctccaacttgtcatcacagaaataaaatttgtcacctccgtgttccccacctctgtcctttcatgtttaaccagcattcagaatgtttacaaacatgtcaggggtcctgtttttctttcctaattaattcagaaaaggagcagaagacgtcgctaatgacataaaagagaaagggacagatagcgctgggagcggcttctttgtttttcagttggaaacggcagttgaacgaatatgggcatctggtaattggagaaattacttggggcctctcagtgcctcggtgattcctgggctagtcctggactgatcagaatttatgaacaggtctaaactgaccaaatccgatggcaaactttcctgctcataaacgaacgga

SEQ ID NO: 35110 - DNA, 1225 bp, Bovine  19866880646147
agagcaaaggcgtggccagaggagtcgcctcttcagccccacagctgggttttgtctggatgtttccctcatcccccttgtgcccctgatggaagtgaaggaagcagtagatctctgccctacagggcttccaccaaaattgatgcttgctgttcacagattatttcctttctacttaggtacaaatctgacagagaaaagaaaggaaagaggggagaaatggtctaagatgcatgtgtgggcggagggatccacgtgaagaagccagatttgtgggcctggcaaaggccactccatctttcccagaatcaagtaaggaggcttttagtctgctaatggagccacacatttttttatggaggctgaatatttcaaaaatacatttgtctagagtggtagctatttttttagttttctgtttgcacatggagtcgttctgttccagcagacagagtttgccaccattatgcaacaagtctttcacttcttcagaaacacagcctctgtttttacagttcccactctcggggtggatgtgaaaagtcccagaaggcacgtgcacagacagtcaggccttgtgtggccgccccgctgccgctcagggcctcctgcggcgcttccttcttcctggttttgaggtagaaggctatttagcttctgcttgaccacagtttcccaattagagcgacttttgtctcattaaggtgggcgttctttagggctgaaggcatgatagcttgcatttctatgtagtagaaaaagaaaaaccccgtctcccatcctttcttttctatacatgttgaaatgaagcttttttcctactggctgcagcctttgccctccatgagatgctgtcaatgacagattcaggagcccagcctccttctggaaaacagaccgtgaaatgcgtgtttgacatcaagtgcattgggatgaccatgtcgtgtttcttaaaccctcttgagaaaggagagaactgagactcacgtgatgcaatctgagtcccatgtggcctcggccatcctgcagatttcctgagggtgctccgccttcatctgcgccgtatgctttcaaatctgagagagaggtgctgcatttcaaggtgggtgatgatctggcataaattccgaagcacagcagtgttctttctcatgttgggggctggaagtaggacacgttattgggaagcagggctgaaaacttgaacctggcttctcacagcatt

SEQ ID NO: 35111 - DNA, 4788 bp, Bovine  19866880708350
ccctcactcggcggggcgcgcggggccgcccctggacgcgccccgacgacgacccaccccgtctctgggttttgtcagactttctccctcagcccagtggggaccaaggaaagcgaaagccttctagctaagcagagtattttcttaaaaaaaaaaaaaacaaaagacagcacacaggctacaactcgctccttgggagcatcacagctccattttctgatcccgatcagagggccagacgctgttcccaccgtaaaactgttcatcaggcgaggtgagccaagccgagcccttctacaaaagcaagagaattaaaagaatgtatcttcggatggctaacaaaaatgggataaaggacggcgagggcagtgcggcctatggaaaaccattttgcgaggcctctaaaccagaggaaacaggattggtgggttaattatgtaattaaactgcagtcagcagtgggcagggtcttctatctttcaaaattgaaactagttattcaagctttcactgaatacactttatagagattctctttggggactgcgcccaatttttcctgtttggattagacttttttttttttaaagggctgctttgccaatttggcttttagtctccaggataaaataatcaaaccccccttccccttcctcagatacattttttttgctttatttcttcagagttagaagaacagattattttggggggtgggggcagacagccaaagaaatatcgcagcaaggtatctgacttctttacagacacacacacgtttcctgtttgattttggttttcaaaagcagaacaatttttacatcattatataaaggccttccactatttaaaatgtcggtgctaaattaattttatacccgcaaggcacactgcatctgaccacactggattctatccacttaataacatgagagaagatcttggacaagaatttagtgaaaggaacagtaaaaacaaaaaaaccaaaaactctcagtctagaacaagaattttaaagtccattgtttgtggaagcttggctttgttttttcatagggcaagcccccagctgttcaccgtcagcccaagtgcagaaggaaagtggcctctgctacacggcagtcaagagcatctgctggactgaggcctacagtgacgtgtgatacacgggctggctggtggcggcgagacggctgaaaaacccagcgaccgctgtcttaaaatttcagcagctgggcagacgtggatgtcgtaatgcagtgggtccctgtatctaaaactgttcattcaccctgaagacaggcttcttaagaagtaagaagcagaagaaagaaagaagtaggatcttcttaagaaaaagctatctcagttcctcttgaaaacgtttgtaatttgctgagagttgctgcagaagcaacatgagcagtgggacatgtttgacaacgagcaggaagctcaggggggcggccagcgccttctgtcatcaggcacaccggggcggactcgcctccgctgatacgcaagttggttaacaggcatttacacaggatttggtgtgaacagatgctcgagtagtttacaagtggtgtgcgtgcgtagcgggcaccagagaaaacataacaaaaggcattatgtcttgatggggtataagctttctgtcatcccaaatggataaaaaacaaaaccaaaattctttaaaacgccaacattttacccaggggagataggccaacgggaaaaccatcttggcacataaggtatttcttacatacattgcaaatacatttcgaatgtattcaggacaccacttctcacccataaccctgtgttcaccagcttctgcgagaacctcaggaatgaccttcaaccaggtcatcgccttgagctcacccctggctaaggccactgtccacgtggcaccagtctcaagaaccccttttccttccgcacctctgccaacctctgccagcgcttctccaccctgtaagaagcggcccaaccttccctccaggcacttacagccaaatgcactgtccctgtcaccgaggctgccagcctgggaacccccccatccttccttcctaggaaaactacccaccccttaatgctgttccctgtcgtgtagagtcgtcagtaggatctgctagcaccgtggggctttcaatcttcatgaactgcaatcaagccagacacttcctgagggccaggggggctcaagaggcgtcttactatcttttctatttatccttctccaggcttgatcttttctgtgctagttttaagagaacaccttcagttagctgagaaaataagatgtgcaagtcctggaaactgctcaaagggagagagtgtttcaggaaaaggacaagaaagagtgtgagacctcccacatggactattgtcttctccttacccccaagggccggtgagaagggcgctagaaagtctgagtcctggcgccgacacacgtgggttctccttcaccactgctgtgtgactctgggcaagtcaccccacctctctgagcctcactttcccttccaaagggaaccctataccctagttcatggagtggctgctaagaattaaatgaaaactacggaacaaaaacacattaaactttttgtgtagttgctttaggaatccgagctttccatttccaccagtccatcccaacaaactatccatggaaacaaagcccagccctgtaagctctgaagtgacctgtatcccctcccctgggtgaatctctcccctgagctgagctggtagccacaccgcgggtctggctcactaagctggtggctccccaaggtgccaatgcactcaggcaaaatgaagcaaacacctgtattctatttgctaatgagcaatcatcatttgtacctttctccagcctgggattcagctgcctggaatactaatgccattaagcattgcagtcttttttttttttggcaacatacatactcattcagcaaaacctggtttaacccactgacacgggtttggttcctgggattccctaactgtgtctggttggtcccacggctcttgttccctctctgccccgcctccccgtgcctgaatgtttgggtgtttgagtgtggcttgggagccaggaaacctgagcggtcccagacttgccttttcaactgcctcagtggaaacaatgagacacgaccatggacctttctctttgaacttaatttttaatcacacgattaatacaagaatggagctgcttatttttgaaatcaggccattctgaaaaagataacccgatcttacagcctcgccccttcactgaatgtgacatttccttggtgtgttatctgtctagaacttttcctctgcagacaagcagacaagaatctgtgtctctcaaaatgatagtggttgctgtcttagataaatgcagacaggcttacaaatcgctctgcaacgtgcttcttccattcactcactagtgagtcctggcccctttccacctaggatacagagggatgcagtgcgtgcctttcgctgctgcagagcttatttcaacacgtccctggaaatggacatttatttagattgtttccaatttggggcttttataaggaaagccgcagtaaacacaggagggacaggtcctccggggaatgcgtcctaaagaaactttctgggcctcactttcctgtctgtaaaacaagaaggcaggactgaacagtctgttgtgactgtacttgcagccgacgtcatgtgtcattaggggcaatcataacaaggctgtgtttctaacatgaaggtgattctcaatccagcccccggctaagactccgccaaggtcttccatagtctgagctcactcctccgccaaggtcttccatagtctgagctcactctttcttattttctgcttttatctaacacatccagttgctcctaatcctacacctttgctgactccttctcatgactaagaaattcctgcccctccttaatacttgacacgtatcattggaggagctcagagcttattatttgcacggacctgcacctctgggtgaacgccagcccccagggaaaggttgtgtctgtctgtccatcaccacagcccaggagccgggagccattcccctcacccagtgggctctcatcaaacagctggtggacggatgactgtttttaatactttgggcttcagctaggactttgaagtcccaagctaggggcttcccttgtggctcagacagtaaagaatctgcctgcaatgtgggagacccaggttcaatccctgcgttgggaagatccccaggagaaggaaatggcaacccactctagtgttctagactgggaggcctggcgagctgcagtccagggggttgcaaagagttggacaggctgagcgatttcttttccacatgagctaggagtgtagtctggggcggggtgacttagcctctcttcacctttgtctcctcagctggaaaacgtgaaatagcacctcccttccctacagggctgcggtaacttgggtaactgatgttccttctgatcaatgggctatttgggccgcccctgagagtgcaggcggggcagtgctgggatgtcagagctggatatgccggggctgagtgaggcagaggctgggctggggcccgtgtcacttaccgtgctgaagctctgtggacagcctactctcccgtgtgttacgacgacggataatcccatactggtaacaacttaggagtaaacgtttggcctgcttatttcgctttttgcaaacaaagcttcctcatctag

SEQ ID NO: 35112 - DNA, 1226 bp, Bovine  19866880732719
ccccaccccccgcctcaccctcattgggatgacttttccatcctttccatcatgtgtccataacagttgggcttcaaattgtagcacttatttcactatattaggatgagttgtatcttttcttaattgtgatgtaaatatatcaaagacacaggacctgatttaggtacttctgtagctttggccagatctagaacagtatttcaaacttgtatttcactgaatccttaaacactcgcaaagatacgcatcaccgaacaatgaaggctcgagacgctgaccactgtcttctgctcagacagtctgttggacattgagattcctacatctgtgtctgtcacagcaccaagcatcaggactaattcagccacttgcagatgcttccaagcttttggctgttcggcatcatccaaacacagaaaccaggtggatggctgataattttttttttaccttcatggaatcaaagattttagagccagaaggaacctcagggagttaaactcatgttacagaggagaaaactgtgacttctcccaaggcgcacggctgatcagccacccaggcgagtagacccagctgacccctccctccgcggccctgcctcccgagcggtggcattggattgcactgaagaccaacccagtcaattcctttctgccccaagccggaccggctggccttatgatatcaccaggatagaattaaaaacaaaagtagactgagagttgagctcagggggatggagagcaatgctaacagttcattcgccatcgcttgctgcagctacagcaacttctggattccgtcaagttcagacccttaaaaagagtggaaaaaagaaagcacatactttccagggcccgggtgctgcactgcaggccagctgggcgtagcaccatggcaaaaaggtctcttcagtttcagaaattcgagacccagagcttgcatacagggctgtggctgcacccgggcctgatctggcatcgcttctgcctgcggttctctcagacgcagctcctgtgggaagcccattagtgtctaaagaaagaaccagccctccaagttgacacaaggagcaggctgatgtgtgcgtgtgtgtgtgtttaaaggcctgtgtccgaggtcaacagcctttttaagagaactcttggttttctatgtaaacgtgtacttcctctggcccagagttagcctgttaagggaataaagcacaattcagattt

SEQ ID NO: 35113 - DNA, 958 bp, Bovine  19866880776398
ttttaagaaaatgtcagttttcccagggggttcttggctgattttgcttcatgaacaaaaatcatacccttgcatttgaagatgctctctttttaccagtaactttgagaattggtgatgctggtgatgcaggaactgatgcccagaaacaggaccaggaaaccagtggagaagagcgatgacttcattgcatagattttcaagtagaaggtgttggtttggtttcttcaattaagctgattagttcatgttacaaggatgtactatttgattggaaggaacatttaatctctttcacattctggatatccagattctgtagccctctctcatgttaaacccatccagatgcaaatcctgctcttccttccaggcccagatgttaagctacttcttatcttgaaacctgaccccaccaacagcctacccaccacctcttaacccaggaaagaatttgtctccttttctcattggagtataatagctttataacgttgagttactttctgctgtacagtgaagtagctcagttatatgtgtacatgtatcccttccctcttggacctgcccccatcaccgcacctcccaccctgccggtacctctgggtcatcgcagagcacgaagctgagctccctgtgctaaactgcaggttctccttggctacctgatttacacgtggtcatgcatttgcttccctggtggctcagatggtgaaggatctgcctgcaacacaggaaacctgggttcgatccctgggttgggaatatcccctggagaagaaactggcaacctgatccagtgctcctgcctggagactcccgtggacagaggggcctggagggctgctgcagttcatggggtcacagagagttggacacgaccaagcgactggcacgcacacagtgtatttttgtcaaacctaatctcccaattcatcccaccctcctcttacctctg

SEQ ID NO: 35114 - DNA, 1247 bp, Bovine  19866880778310
ctctagcagcctctgccacattttttaggggtagcttccctttacgccgagtggagcttctttaagtggtccattcaaatctacaaagaaacccctggcatcttttattgatatgataccggccacacaactgaagcctcttgaatctttctcgaatagctctactggagtcagaggcaaaggtgcagacggggagcgagtctccgcacgttagaaggaggacctttacaatgttgtattggttttgccacacatcaacatgaaaccaacacaatattgtaaagtaattaacctccaattaaaataaatatatttatattaaacaaaaaaagaaggagggcctttaagtcgtccccagttgctgttgctgtttggccgctacgtcatgccggaccctgcaaccccacagaccgcagcgcaccaggctcctctgtccttcaccatctaccagagtttgctcagattcatgtccattgagtcggtgatgctatctaagcatctcatcctctgccacccccagtaaaaaaaaaaataattatggaagtgacatcattttgatagttcatcttcttcctccttcctcctgtcttcctccaagtgcgagagagaagggtcattattcttcctcctctgctctctcaggcttggaagccctgatgcagaccttcaggagacactctcagctcaagaaaaaagcaacaagcctttgtgaagtcatagcaacttagtgggaggagaacgaaatgttctcagctatctcttgctactgaagatgtgaagggaatgtaaataaatgtagacagtacagtttgctttactgaaacacaaaaattacagggtttcaatctacagaaaaagactgaagttttctgacagtaggcaagtacattttgtgcatttagctcccgattctctcagatatgaacctccctgggggacagacttgaaatccagaggaggagggtggtcctccctcctggggtgcccaggacacccgcagggtacggctgctctcccagtgtggtcactcactacaccttcacgcgcggcagcagctcggtgagatgaagtgttacagggccacgtgtgaggatacagagggagtttctttgcgtctgacatcactgtggcaaaatgacacttttacatgacgagaagaaggttaagcaaatcatggcttatcagtaaggagaaagccaccaaatcacgactatgtacaagatctaagactctgcagacccacggtg

SEQ ID NO: 35115 - DNA, 1561 bp, Bovine  19866880846117
ttagatttataagaattgcttaagtgctctgggaggcctgtttgttgagtcaggcagttgagtacttacaaatttaatatgttcgatttcctttacaaatgcagtttaaaatgtttaaaggagtttaattagctaagtttgcaaatcaaaccaaacattaataataaaaggtccccttaaaagtgattgttaaaaattgttagcttataagtaaaataatgagatgtctgaatagttcttaaaagcctgaggaaaggtaaggttacagattttctaactaataaaaattaattttaaaaagagataccagaataatcttcttttgctcaaaatactttgaaactccaccctgcctgaaattactaggcacctgaattatcttacctaattactgtccacctaaaaaattaccttttttagttacccaggcttccacaagaatttaagtaggtgtgcctactgtgtgtcggctataatgttaggcataactgggtatgtctgggctcttccaagcatctggtaggagagactgagataagtacacaaggtggaaggaggcttcccagctgacgtgagtggtaaacaatctgcctggccatgtaggagaccccagagattcgggttcgatccctgcgtcggggagatcccccgaagcaggaaacggtagccccctccagtcttcttgcctggagaatcccatggacagaggagcctggtgggcttttgtccacggggtcacaaagagtcagacacagttgagtgactaaaccaccaacatggtggacgaggtagaacgcgtacacggatggttagaagacagatgacaactgaccggtgaaggtatgaagcaacagtggaattcagcggaaggtatcgatgaaggggggagacccagattccagccctgcgtcaggaagatcccttggaggccggcatggcagcccactccaggattcttgcctggagagtcccatggacagaggagcctggcgggctacaatccatggggttgcaaagagtcggacacgactgagcgactaacgcatccatggagggatcgtgacaggagtgatgtttgcgctgactttagtttggacttcccctgttaaggtctgcgcgccccccgccgccctgcgtccgtcacgcacacactgacgcttaggtctgtgcagcccccgccggcccgccgcgccctgcgtccatcacgcacgcactgacgcttctgctgccctgtgaaccggaaactcaggttccgaaagccccgcagaattctgtgtaaagtgaaggtcagcaggacgcgagtgcaagtgcacaggagactcccaggaggatctgtgacatgactatggcgggccgtctttgctcagctcctgttttctctgtgagcctggttccctatcccccactcaccctacaggtgaagctggcagataactgacttctggacaggatcctacccccagaaacagggtgaccatggaccaattttagatgtgaaatgagggctgctttattttttaaattaagtccaaaaggcaaggatgcgattctagtgagaaaa

SEQ ID NO: 35116 - DNA, 1179 bp, Bovine  19866880909374
tgtttccccatctatttcccatgaagtgataggaccggatgccatgatcttagttttctgaatgctgagctttaagccaactttttcactctcctctttcactttcatcaagaggctttttctttttagttcctcttcactttctgccataagggtggatcatggaaaaaggaagagagttccagaaaaacatctattgctgctttaaggactatgccaaagcctttgactgtgtggatcacaagaaactgtggaaaattctgaaagagatgagaataccagaccacgtgacctgcctcttgagaaacctgtatacaggtcaggacgaaacagttagaactggacatggaacaacagactggttccaaataggaaaaggagtacgtcaaggctgtatattgtcaccctgcttatttaacttatatgcagagtacatcatgagaaacgctggactggaagaaacacaagctggaatcaagattgccgggagaaatatcaataacctcagatatgctgatgataccacccttatggcagaaagtgaagacgaactaaactactcacctaaagtctaaataccatgtattgttggcagactaaacagtagtaaataagacatgcacatgagacaatgaagagaagattctctttttctggctgtccttggcatttcaattgcttgaaacttcaaacttcagagctcttctgaaaggcaatatttaatttggtctgaaagtcagttcccgaagagaagaagctgatgtgtttcaatagtgagttccctttacctgaacgagactctgctgtgacatgctaccgccgatggcaatttaaatgcccgtgagaacttcatctctcaaactttgctccatgtcagcctgagatcttcctgaaggcagagctttagatgagggcttcgcgcaggttgcttgtttggggtacaacctcggggagcaagcgtggaccggtgagtgagggcaagcctgaggtgaaggagggcttccctgagtccagagagccaccccggaaggaccaaaggacagtgactatccactgacacctgtcccctcacgggtcaagaatcagctgggggcgttaacgcctctcttcatactcgcgactgtgcgggcgagggccgccccgggttggagccacggtgggcgcctggaagcacgtggg

SEQ ID NO: 35117 - DNA, 1524 bp, Bovine  19866880950811
atgaaagaaggaagataattcagagtcagtcacagcacactcttgctcttaactggaggggcaggatatcgatgaggtaaattaactccagtgcatttagagtttatttacaactaaaccgcaaagcctccatctcatccatattcaatcagacaaaattgtggctcatccaagacaagacatgagccaaatttggggcgaggcaaagggtgacgacatctgaaagggctggaaatgaagtgcagatttgaatatcatctgcatataagtgataattaaagctgtgagactcagtgtgcgccaagagagaaagtcaataaaaatgaggaaaacagagtcccaagctacgtggtgcttctgaaatggaggttttacaaaataagctggtaggggcaagattgtctttcctcttgaatgatctgaagacaaatacaggtcacttgtgaggaagactccttttcttgcagagagtcactgaatcacttgattgttaaagcagaggagctttcttgtaagacttaacatttcaaggaaatgttacttcatttagtttaacgtaaaccattctttctccccagagagatcattttggtaagtaataacaaagagaatgacccattcgagctcacatatgcttgtccttttcaagattggcattacatttgggctgggaacatgttgctttatctggtttttcagtgatttcattcatgcagtgaagaaatagcttctcttttcctaactgggtctgatcattataacagcagcataactaaagtaaatgttaacaggaataagtccataagaggactagctcagaaagaattattcatgatgaagagggcagcttttgccctaatcatccctctaaagatctatgacttagggctctcttctctctctttttaacttttttttttttagaccaccagctctccagaccatagacacttccaaaccacttgttcctcagtagcatgggcacggagggacactcaccctgagccacaggcgttacgggttgaatagtgtgtgtgttagtcactcagtcatgcctgactctctgcgaccccatggactatagcccaccaggctcctctgcccatggaactttccaggaaatactggagtggatagccattccttctccaggggaatcttcctgacccagggattgaacatgggtctcctgaattgcaggcagattcttttccatatgaggtaccaggtaaggctaaatagggtctccttaaattcctatgtggaagttctaacccctaggtcaggaagcaacagttagaactggacatggaacaacagactggttccaaataggaaaagcaatacgtcaaggctgtatattgcctccctgcttatttaacttatatgcagagtacatcatgagaaacgctgggctggaggaagcacaagctgaaatcaagattgccgggagaaatatcaataacctcagatatgcagatgacaccacccttatggcagaaagtaagaagaactaaagagcct

SEQ ID NO: 35118 - DNA, 3114 bp, Bovine  19866881092281
agactcgtggggtccggttcgtattttggcttctgtaatggttttcctctaaagaagagtgtagtcctaaaaccaagcaagaaaaaaaaaaatgtgcgttttgaagaatgagttattttggcaattcgcagcgagtggagcccactgccgttagcgcacgatgtcttcttagtcctccccctggggactcaggccgtcagcaggggaggggcgtggaagaaagcttcgggagcacctggggcccgtactgtatcctagagtaatacccagagtaatccggtaatccagtgaggcagtctcagattaccctcacatgtaaaatcaactgtagactactgcttttctcctggttaaatattaaagtctcaggcagatattatggctgaaatagcagttcacaggacttttagtggtgcatgaatgttatgtcttctgctttcaaatagatcgtggatatttaactctggaagatttcaagaaagcatttaagcaggtggctcccaagttatcagaaaggattatcctcgaggtattcaggtaaggcatcagtctttatgcatacacgcccttgttttaccgttggcttgtgcaagttttcggtttcacggagaacactcatttatggttatttttcactagtggatggtttcatgtcgcaggatagtgtcatggtccagcggagaattttatagttagctgtcagtccatccacagccttggcagtgagccctgaagtgggtgcagtgcttgcataccaggaaggtgcaaaaatcatttgttcgtaggggtggagagaagcagagagaaagtagagcttctttgtgtagtgacgtgttggccagacctgccccctcaaagctccgttaatattaccgtggatgctggcgttctcctgtggtctgcatttcatcagacgcgggttgcaccctgtgcgccgtgtggagagtagagctgggttaatcggtggcagcccctccttcgtttgtgttcaaagtggtagacccaggctgcagttcacgcacacccgagagagacgacgtaaagactgtattcacactgtctctataaactaatcctgacaaaacgggcagatgcttaaaagcagtttctgtcaggagactgcagatggaaaggagtgtaagccgtgtcagcacacgctgctgtgagaactgacacagctgcctctgttcagactgctaacacgagctcctcatcaacctgttgccaagggtgttagttagggttcagtccagcaccaaaagccagaaaactcaaaataacaaagctcgcaaaagacagccagtccagggctgatctgagggcagcacagtggtgaagaacccagattcctgcccttttattctggctgcctcagcacctggcctctccctcctgcttccagatggctgccgaagttccagccatcacacctgagttccaaataggtaggcagaaagataggcccctctttttaaggctatccattatttcttcatacatccctgtgaccgaagctaagttccaaggccatgagtagctataaggcagaggtgggtctggaaaatgtagtctctgctttgggcagtcgtgtgagctcaaatggaatttctgctatgaggaagaaagagagaagagacattggtggacatctggcaggtgttcccatttggattaaagtaatttcatgaaatctgaccagaagccagtcctcagtagaaattatcaagcaggttatttgaagtaagaatctacactcactgccatcaatagtgacatatatgaaattcctttgctgcgtcatttgcaagcagattactgagcaaggtattgaagagcaaaggagttcaagccaggtgcagacaaggtgccccaagccagtatgacacagtttactccagaatttcatggcctttcagatgctgtggtatctgtgtgtgcgttctgggatgagtaatgagactcagggtatttctgccacacggtggtgctttttcacaaaaagaatgaagaattacttcattttacttttacaaaaagacaggtgtccacatttgctgacctttgggtgttgaacggttttaggagctgtctcctcgtgctacaaatgtaattttgaaaaatccacttaagtacagcctttcaaggtagaagccgtgttttaacagtgaatgggaaagtaactgcttctccaaagaaacctatgctatagggagaacatttttgagaatgggtgtttggaaatgtgattctatttttaaaaatatgtgtcacccactaaaacctttatatttgcatgctcaataagtcggaaacagagtattctaatctgtggaaaaaaggaagcattgtgattggacagcacaattttttaaaagtatcagtgtaaaaatttaatagttttgataagttaggagcaactaactgaaatcaggagagatgaatatttatgagctgaatctcaattaccaataccaagaaaatggttaacaaaataaaacaaaccccttaagtttttttataatcagcggatagaattaaaaactgagagattcagtgtcacgatgcccatttcctgtttagatctgtctaactaagacctagtattaaaacaagttgaacttgggatttccctggtggttccgtggttaagaatccgccttgcggtgcaggggccataggtttgattcctcgttggggagctgacgtcccgtgtgcactggagcaactaagcctgtgcccctcaaccactgagcctctgagccgcaaccagagacagtgtgtgtgcgcctcaaaagacccgcgtgccgaagcgaagacccaacacagccaaataaataataaataaagtattaaaaaaaactggaatcactcagtcacaaagaattcaaccgagatgttcagaaatcataaattatgtgaaaatcacattgttcttgttaaatgttcttaattttgagtgatggcaaaaactcatttgccatgaataagtgaaatatttttatcttttttttacaaatttctgtattttataacgaacataaagtatgaatattgtagcacatgtccacatcatctatgcataaacatgtactcatgcccacaaatcctgtactt

SEQ ID NO: 35119 - DNA, 472 bp, Bovine  19866881143732
tcctccgttgcccagcaggcggcttcctgtcagaattcatttcccacttggaaagtatctctctgacccgctgacttctggacacaattcacccttcacgtatttgagtctgccccgcgtcacccgtccttagcacctcagacgccaaaagaccctcttgtaatcagagtgataaaaatcaccataaacgtcaggaggcggaaagctaagaagaaggtttgaagactttcgttcccttgatctttctaatttaaaaaatgcttttagcatgtatctatttctattacgatagtttaagaaattaatgacttatggttgaagccagatgttttctcagttccttcagtctttggatgattcagttaagctttggcagagttgcagtaaattcagttcagtttagcaaacagggtgaccctttggctggccctcctgttactgtggtctctacacgaaccgtgctttagttgca

SEQ ID NO: 35120 - DNA, 688 bp, Bovine  19866881144456
cctccgaggcgcaggcgcccgttcacagcgctccctcacctggtaggtcgtggaaaatggcagaactagggttgtcgggggtaattctttgaagcactgttactgtggttgacgttgatcacttgctacttcagttgcattccatgatgtcaggttgaccacattcacctgcggaagaaggaaaacaagccctctcagagaagagaagggcagcgttgtgtgtgcgtgaagtcataacacagcctcattgtctaccgctgcggccatcaaggatatactcttaaaataacccaacaaggctgatgcttcgacgttatgaaagaacctacaggggctgtcaaaactctatctgggttaaaaacggttgctctgctcccagccctcctgaacagaggctatttataatacagcgcgggtatttgtgctgctggcattgtatgcatcctgaatgaagagtcagctctttaaaaagaacattaaaaatgaaactcgtgttgtagaaatctgacttcgcccaatgagatggcaggtgtcataaacggctgcttatttcccaaggtggtcagagctgtcctcttggtcctgaggtatgttgacctggccttcagaccttgccctctttttttttttttttttttaagcaatgttctcatatgaaaatacatacatacttcctaaccgtcacttg

SEQ ID NO: 35121 - DNA, 870 bp, Bovine  19866881152012
actgtatagcacagggagctctagtcagtgctctagtgacctctgtggggaaaagaatctaaaaaagagtggatgtgtgtgtaactgacccccctctgcagtgcacctgacgctaacacagcatggcatagcagctgtacgccagcaaaagtttaaaaacaaaacttttcccaaagaagaaaagctgtacgtgggcatgaaactgagcattaaccattttcagcatttccttgtgaagtcggcgatccgaggacagaaaaccatgttctgagctgtcacggcttttctctccatgtggtcggactgagtagctttcgtttttgttctctcacagcttctaaaagagcacgcctcacccatgccgaaagcagagtcttggccggtcataggtcagttctccagcattggctccatgggggcagacgaatcaaaatggttgtgttctgagtttaaagagagcctggtgaccctgggcaaggagagcaggaccctaggaagtgctgctcctctccatctggtgagtgccctcctccctgaggtcactgttctcagcctctggtccaggagaagagtcaggtctgtcctccttccacagaaaggggtttcgttctgtgggtgggggatggaagacgctgaatgcagcgcggtggcactgccgtttgtgagcaagtttcctaatagcgtctgctgccggggccactggttttgtccaagctctggctcagccacagactagcctgcagattccccattctttcctttaggtggtcaagccaaggcaaaaatttttgataaagcattgccagcagaattacaggcattattaattatttagagacatttgaagtaagaattattttacattcagtt

SEQ ID NO: 35122 - DNA, 1576 bp, Bovine  19866881198945
ccatgaagctgggccgggctgacccctggcgggtctgctgagctgcgggacaccggggagactcatgggctgccgggggcggtgctgggccctgacctctcagggaagaacaggccatttcttgcagtcaggttgaagatttaattgatgtttttcttctctctctctcttgtttttaacctttctcactagtcagttctttctgcgatataggttctcctggtctactgtcatgtactgatgtttttattgctaacaagggattgtctgttaattctctaggtgctttttaattaaaccaatttggcttcttccatgtttttactccttttttccttttgctttgcacattagttttctcaaaccatgtgcgtacgtgtttgtgtgcataagaaagctcttccttgacagactttgttttgtcctaaatatatattttatatgaaatatatatcatatataaaaatggttttatatatttatatttacgttatatttatataaatatcaatataaatatgttgctgctactgtgctcaattgtatccaactctgtgcgaccccatgggccgtagcccgccaggctcctctgtccatggaattctccagacaggaatcctggagtgggtcgccatttcctactctaggggatcttccctatccagggattgagcccacgtctcttgcatctgctgcactggccggcagattctttaccgctgtaaatataaatatatttataaatacatacaaatatttttaaggatgtaaatggatctatgaatagagatctttcttcacttattgttttgaattccttaacatttaatggtgcacctccctctgttatgataaaaaaaaaatccatattcttaagatgagatgcatataattctaaaaactctgatcctcaaacttattacacaactctaatcaaattacatccttttctctcagtgaggggcattaaatgtaatttttcctggctgaataaacttgagcgttctctgctctgcatatttccatgttaaaagttttcaagtcaacctttttactattctgagctgttacatgagaccaaggaggatgcttgcaaatcagacgcggggccagtgtcccccggctcccgccaagctctgcctgtggttccctctctggtggaaaagccctagaggggtccaagggatcctcggcctccccgtgggtgtgtcctgaagacgctttttaggcttatttctttcctctctgagaattctgcgtgtaagatattgaaattagcgtctggtctgtggaaacctatccccgttcccagccgtgctcactgtaaaatgcggaactgatcaaggtaggggctgtgatggcccaggagcaggcctgcagtgaacagatgctgtgaacacgtgctgaccaagcttggaggtaaaccttagcctgatgaccatcgtgcagagacccgggcgaacggaggcttctggtcgggggtcagactggcctgcagagcagagacaagtaacaaggagtgaggggtggtgaaatgaaggaggtcttagaaagtgggaacgccctccagagggcc

SEQ ID NO: 35123 - DNA, 1934 bp, Bovine  19866881220546
ccaagtgcacccttgaaagggattttgaatctctttatcagtcagctctactacaatttatggatttcaaaggaatcattttatttaagggccttttgcggttcaatttcaatagaataaagatctagacaacacataaattttcagtgaaaaacagagctctgtaatctacggctgtaaccctttccatgaacctgtacaagctaactggtacatcctttttgtgaaattccctgatttctgacatttagtcataaaatcttttgataaaaaatataaaaacctcatactgcaatactataaaatgtggctgcattaatagcaaaaaaaaaaaaaccctctgtattttagactgtcatgaattgtttaagcatcataatgagaaacatgtatggcttaaataattgaagtgcgtgtttctcagaatccatctactcatctcaaccttttgttagaccttcagacaaatcgtgaggctgactggcttgagtttctccgcaactctttctcctccatcacagggtgatgggactcgcacagggctgtcagctagctgttcaggctccgctctcacgttatggggaattgactgaggcaagtctgttaaccttcctggacctcagtttctttcctagctttagataccttcattctctgttttcgtacctttcgtttaattactctttaaagacagtttccatgaatggcacagtgaggtcatcgccacagtgaacaaaaggacaaacagatagtctggtcatcagggtcatcagtcaccatcaatttcatcatcagtttcatccagcaatatttaacaaacgtttactaagctcttactgtgtgcagggtaaatgtttgtgtttcactctccagcgttactaataacgacagtgttaaattctgatttacttggaatttaccttctctcagtttccccactgctgatgtatccttcatggctacatcattactacagaatcttactctctttaatcttattttcttatacccccaacaaacaaagcaaagacaaaaacattcatctcaacaggatctttagtatgttgcaaattattattagaccatatacaatacttttctttcaatttttttcagtgtaaagaagcccccttgtcaacctgctgcttcttagggaaacccatagccatcaaaatattcacatctaatccagatggatcagctgacatactaggtttaatggtttgtagtggtgaatttgtcatagatttgaagacctctccaggttgtaaattgcccagactcagatgctctggaaattttacaaggactgcaattagaatagaagtgttttggcttatctcagttgtattgggggaaaaaaaaaacccaaaaaatcctgatgagaggggtatcaagatagtcataagttcacgtaacaacaaagatttattgggcagtttgtcagatatgagatggacactaacagtggccaaaatatgttacttttccagtgctttagtgggtgctggcatcgccgcgattccacgcaatcctcacagtaacttagtgagtcacgtgttatcgttgctcccgttttacagatgagaaaactgagcttagtctcaaagttgcgcagttaacacgcagctgaacatgattcgggttgcttattgtcgccttcagttcatcgtgttcaaatcgaatgtctttatccttgtcctcaagtcagctctttcttactattcctgtcagtgataccacagtttcttcagattcactctcacagtcactgatttttccttttttgtccttgttgtaaatccattcggtcaccaagtccttttgctagttcaatgtctgtcagccctcttcccgtcaccctgcccagggctctaggactcacatctaaagtgtagaggctgaaggcccattttttcctttttttattgaag

SEQ ID NO: 35124 - DNA, 1672 bp, Bovine  19866881300793
agacaaagggaagagctgcatgtcaagtgcaaaggcagcctgttagggagctgggaagagctggtccgcagaggaggccacaggcactctgctggcagaccctcttcttgctcagggagaggccagcattctggtcttttcaggccttcaactgattgggtgaggatcccccagcacgatggagggcaatctgctttgctcaaagtccactgatctaaatgtaaatctcatccaaaaaacacccttcaagaaacatccaagaataatgtttgccaaatatctgggcactgtggcccagccaagttgacacgcaaaagcaaccatcgtaaggaagttaatctcccagggccttggtgctctcatctataaaatggagataacagaagagcctgtcatattgggtgaacataaaggataaatgaatcaatgcatgtgtttagaacagtgtctgcacagtgcttggtgagagtttgctcttgactatttttattattaattactattgtcagaggctttagttgtatgctgctgctctctgatgaaagtgctaagaaaaattataagcagaaccaccaagagtacaggagcatttggttgggaacaccactaatgtgatgagcgacttcacacattagaattctcataatgtagaaaatggagccttgcagagtcacaatttacaggctgtattggccagtgctccattaatcagtggctatttttttcttgttattccatgaataaattttaatatattcaattttccccataaactgcttatttactgttcatattaatgcaatatagcaaaaaaacatttacatgaccagagtcttttgcaatctaccagagcatttctcttgcatttctttcccttcattcttggtgagaaaattcagttttgctctgtatgtttctgaattaactgtcacctctcaggaatacaatatcagcatatatcaagagcctggcggcgagtagagtggtgtagaatctggttcgctcggcatgaacctttctggccctcagcttcctcacacagtgctgtcgtgaggatgggatagtgagtctcggcacagtgcccggcactcaggaagcacgtgaccagtgggaatagaatgatcccttcagtaggaaatctccatgttgttacaatgtcccaccttgtaccggcctgccttgtatcctgggtccctgaatgactgtgtggaagaagtcacccagcaagaaggatcaccagtgtcaaactgttacagacgggaggagtaaagaactctggttaatcttttaaattggtgtgtgtgtgtgtgcgcgcgcacgtgcctgctcggttgtgtccaactcttttcgacctcgtggacccgtagcccgatagactcctctgtccatggaatttttccaggcaagaatactggaacaggttgccatttcctacgtcaggggaccttcccgacccagggagcaaacccacatctgttgcgcctcctgcattgacaggaggattctttagcactagggccaccttattacagcaatcagcttgttaggcattgtgcaccaccttaaccaatatggtcagttaatattacagcaatcagcttcttaggcattgtgtaccaccttaaccaacatggtcagttaatattacaagatcactgggcattcatgatgc

SEQ ID NO: 35125 - DNA, 1881 bp, Bovine  19866881327877
tgtgctttctatttgagatgaaagataaaaaaccctgtgtgcatgattaattgtcatgatgaaagactactaggcagttgcttaagagacgagaacaacaatagggataaaccactgcaggcgtccccaggactggagcgacaccgcttctgtgtactcggcttccatggcaaccagcgatgggaagatgaatgtttcatagtcactccgctccgcggtacacatctataaatcaaacttacataaagagcacaagatttctgctgtgggctcaacgcagagccggtttattttcctgttactgtataattatggaaaagaagcagaaaacaatgaggtcatcctgagtggggaacaaactcaggaatcgctaacacacctgcagaacgccattcatcccgcaggaagcaagaggcggcagggcggtcggtggacggaaacgctgccgtctcgggcgcaggcttccaggcaccgacctgctccggctgggggctgcgagtgacgcgcctgggctgggctcccgacccctgctcggctcgaaaacagacacggggcaacttcatcaactgcctgccacgctctacaggttttcattctgatagaccgggcagaaacggcactccctgtttagcatggaagtttactgaggctgaacaagcatgcacttgcttttatttacacccaaaatggctcgtcttgtagacgtggggatagaaaaataacgctttggcattgaatcgggagccaggagacccgaacttgacccaggtctgtgtaaccttgggtaagccatgaagttcctgcagcctccattttcttagcgatggtgtaaatgatttttagtctctgccaacatctgcttccatgattctgtatctcaaaaactcaaagatctgactcagtcagatctaaccagagttattagctgtgcgtgttcctaaatatacacacagcctaggccagcagtccccagcctgtctgcaccagcggctggtttcacggaagacagctcttcttccgtggaccagggaaggcagagggacgctctcaggataattcaagcacactacatctatgtgtactttatttctattactgacgcatcagctccacctcaaatcgtcaggcattagattctggagactggagacccctgctttacagttacactttttaattccatactggctaaaacacctaagtaatagcattttaggattaccattgcagtgaagctctcttctgacttctatcaatctttcaaacacagaatatgctctggaaaactgaatgatatcatcagagttttaaatgcataagaaaattgttacagatgatcctaggactgattttcttaatattataaacaacatttacaatttaatcatcttcctgtcacctagataagggctgcctatcaattcctgccccttgaagtctgcagctctgagagacagggtgaggctttcctggacttcatctctgaagagtcatgctcaatacaatctgtggaacaaataaatggatggatgagcagactcttagtaacacctttgctgcacctttcagaaatcgctccccagtcttaattaggcagattcagaccaacacataaatattcccgggacagacaggcacgtatctgaaaaccagatataactatacgagtctctcctttgtgggtctgtgagcctacaaaatccttgtgacactttataaccgggaaatagctttgctttagtggagcacgaggcagtggcagacacagagacctcgtgtcctgaggctctggctaaagtgcgggggtatcgtgggggctcagaagcaactgactcacagtctctgcctcaagggaggaaagtgtagggaaaacaacaccca

SEQ ID NO: 35126 - DNA, 1106 bp, Bovine  19866881372281
gatgtactctgcatataaattaaataagcctgcctgcctgccaagtcgcttcagccgtgtctgactctttgtgaccccatggggttctccaggcaagaacactagcctgggctgccacttcctcctcccaggtaaataagcagagggacagcctaccgcctgagggcctcctttcccgggtttgtataagtcagttccattctggttctaactgtggcttcctgacctgcacacaggtttctcaggagacgggtgaggtggtctggttaaccctacctccctttgttttaccagctttaactcatctcagactccatgtagttaacacattcgcaggatggtttagcttcagagtaaccaggaggaaatgcaacagatagcaagagtacagactgagagaaaactgttaatatatgaaaaagcctctcattcatgtgaatgtaatgggggaaaaacatgttacatgtaagtaaatatgtaatatgtgcaatgtaagacttttctcattctgcggagcccctaaaactttcttaaaggacagtgaggaaatgtacatcttcctcaacacctggggacccagctcatcaagttggtcacttcctaaagccttcctgagtcgggagccgcgtccacaggcctgtcaggaagcccttgccccggcagtctcgggtcttcggccctagacacacagtaacagggcatcttccccctggcctttctgaaaaataagtacaaattgcaagaaatgcagtacaggttgtgagccatcagtacattagctgtgacaccaggagatctgatgggagtcaggaggaaaaggtgtaaattgcaggataatatcaaggggaggtcagtctgttagtaattcagggactctgatggacttaaagaaaaggcatgaattacagggtaatataaagcagaggtcagtacattagtaacacgagaaaactggcagctttgggaagaaaaggtgcaaaccgcgggatagtgtaaagcaggcgcttcgctttacagacgcacttacatctggtcaaggaagcacgctggccgtacctaccaggcggaagcttcaggattttgtccttccatttcgcagcagatct

SEQ ID NO: 35127 - DNA, 1458 bp, Bovine  19866881394163
tccctggtggctcagagcataaagcgtctgcttacagtgcgggagactcgggttcgatccctgggtcgggaagatcccctggagaaggaaatggcaacccactccagtactcttgcctggaaaataccatggactgagaagcctggtaggctacagtccatgtggttgcaaagagtcggacatgactgagtgacttcacttcacttctgacctccccaaactgcctttaaaaaagctgagctcatcccattggcccctgggcagagaactctggggcagactctggggagtcctgggctactcccgagattaagctggaaccgaactggccctgaggccagccgacttcacaaagatacttgggccccctgatgcaaagaactgattcattggaaaagaccctgatgctgggaaggattgagggcaggacaagaaaggggcgacagagaatgagatgactggatggcatcattgactcaatggacgtgagtttgagtaaactccgggagatggtgatggacagggaggcctggcgggctgcaggccatggggtcgcagagagctgggcacgaccgagcgactaatcaacagcaaactggcccgagagtggtagctcttggaacagctgctcagctttcctcaactccaccattttaattgtgattagtaggttcatttgcatctaaaaggagccgttttcttatcagcaccattgagttgggaaccagtgtgctccatttatacagagtggcccattttaaccaggcccattaagcagtaaaagtaaatggtgtgggtgtttacaaatgcaaatatgtcatgcaaataatgtactttatgctgaatgatgccttggttttcatatgtaaaattagaaactgtgtagcacaaagataatgacagcacctttgcatctgttcctgagacgcatctcgagctggtgcctctcaaactgcagcccaggtttccagcagcctttcttcagtctactcaaacaggtattccatagtatcaaaaatgtgcgtgtacttatctagttatttatgtattcctaagtaatcaagaaatcacagaaaaggggagctccaattaccaaatgtattacttacaatcaaagatgagatttgtaattttgtttccatttttaaagatttttaagtttttatctgagatgatggtagcggaagaagacgtgttacttactgtataggctagttcatttgtaagagaattgtgtctaccaagagatttttttaagaaatcttactgtgtgaaatgattctgttttctactatttgacaccagcccttgtgtgcaatgaacatggctaaattctaagggtccctacctccatggggttcctgggctttggaaaggtgcacatctatgggaagagatttcaaggtataaggcatcaagtcgggaaccaccagaggatgggttgccaaactgagtata

SEQ ID NO: 35128 - DNA, 1237 bp, Bovine  19866881407304
aggagcctgatgggctacagttcacggggtcacaaagagtcagacacggctgagcgactaacacacagggtggggaggtagctccattttctagagaaaaccagcatgcactccaggcccttcttagaaagcgaggagaaagaatgaagctaaattatcctattgatgactacatgttacattcagctccctggagtccatgcttggaagagaattacaaggcatcacatttagcttgttggccaagtgggacttgctgcatacttgagcaaacacaggtttcctaatggtctctttcttagggcttcccctgtggctcagctggtaaagaatgtgcccgaaatgcgggagacctgggttcagtccctgggtttggaagatcccctggagaaggaaaaggctacccactccagtattctggcctggagaatctcatggactgtatagtccatggggtctcaaagagtcggtcacgactgagtgcgtttcactttcacttagaagaatggagtaccaaaatccttgagttcaggagaatttaaatatcttagggaggcaggaacggaaaaggcgatggcaccccactccagtactctcgcctggaaaaccccatggacggaggaacctggtgggcctgcagtccatggggtcgagaagagtcagacacgactgagcacttcactttcacttttcactttcatgcattggagaaggaaatggcaacccactccagtgttcttgcctggagaatcccagggacgggaaagcctggtgggctgccgtctctggggtcgcacagagtcggacacgactgaagtgacgtagcagcagggaggcagaaaaagggatcaacttgtagaaacatagaggaaggaagaaaaccttactgcaccttatagcagatagctaagggagtgtgaaaaattattgggttggccaaaaagttcattcgggcttttcatcccatcttacggaaaaactcaaatgaatttttttggccaaaccaatacactgcagaaaattaccttgcagctgccaattgaagctctagcttgcaaagttgcctggcccctcgaataggctgaatcagttacaaactctacttgcttgacttgaagcagtctgtgaccttcattcccatgtaactgatgtgtttggccagtgtgaccctggacccgtgccgagcacgacaggtgaacaaagagccgtgagacgtggccttgggctcggaaggtaa

SEQ ID NO: 35129 - DNA, 1689 bp, Bovine  19866881408527
tcaaacatacgcttgaagtaagcactgctttccccggtagcagctgagcgtattgttacaccacgattttctccctctgccgtgtgttatgttaactagggggactgagcaccatttctctgctccctgttcaaaggagcaatgcccctgtctcagtggccctagggacaaggcacaacccagctgaggccacccacaccctcagccgaccagtcagaggctcacgccttcacctctcttcctaggattcagaaaagcttatcgggtgtttgtgaggaattaacagagcttccgaggccacgaatgaagtcaatgaaaacttctggagcttgagttagctgtgtggtaattgcaacacaactacttccatctggaacatcctatttacatagagagatgtgtggaatagagtgtaaagcccacatttgggaatttaaccatcctgacttgagtttcatgtctgttaccaagtgatcctaccagcacattgaacatcagtgtctgcagaatgggcccgtcctgcgtctgcacagattcagtgagatgaaggcagtgcgaggcaagatgcccgccactatagttatttactcccaaaatgtttttccttttgtaaaatatttattcatttggctgcttcaggtcttagttacggcctgtggaatcttccttgttgagcgtgagatctcttttttttaactgtggcctgcatgatcttttttagcagtagcatgcagggtcttttagttttggcatttaggatctagttccctgaccagggcccctgcactgggagcagggaatcagccactggaccaccagataagtcccccaaaaggtttttcttacctcttaattgtctacgacacacttctgttgtgcaatgtatgacgggaaaaatcaaaatggtggtgttgctaagagccctctgccatggggccaggagatcagtaaggaagtgtgacttacggacatcaaggtcctttgtcatccaaaacaccttccagaaactcaagatacttactggactcttaccctgaaacaacttgtgagtcctcaaggacaaatactttctggcttgagtcagagtcaatcacagttgtcaccgggcagcttttaacaaccctggtggcttttcatctcttcttcaggacactttcagggttacccaagtttgtatttcctgaattgcaattcttccagaatccaaataaactctcctcttctttgcagcctcctgccttgcttttttggttgccagatgcatgtatgtttattgacatatcacagaaaaaatttgcaggatggctagaaaaaccattactcctgccttttttaatataaaaaatataacttgtgcatttggtgacattcctttaaatgtattgaatatatcatttctgtagattttaataaatactttttcctttccttctctccttaggtattatcaatgcaaggaaaaaaaaaaaggatagccattgacctcagccttcccacagataagatagagaaatgcagtgcggaagtaggatgaaactcactgtaaatcactttctgtttcattttccagggaagtagatcaagactcagagggtcatgtcagctttaaagacttcgaatatgccatgaactctggacaaaagcaagcgtaattacggtgtgctgcttgtatgcaacttctgcggagac

SEQ ID NO: 35130 - DNA, 780 bp, Bovine  19866881455280
gccccccctcctattacagttaccactagaattccttgccttcttctctttctgttcttaatctctttgtcttagtatttatcggagttttataagtctctctaaactgtgaactgcttcaaatgtgcgtgtgctcagtcgctcagttgtgtctgttgctttgcggccccgtgggcgatagcccagcaggctcctctgtctgtggaattttccaggcaagaatgctggagtgggttgcggtttcctattccaggggatcttcctgacccagggatcgaacccacgtctcttgtgtctccaggactggcaggtggattcttcaccactgatgccccctgggaagccctgcttcaaagtagcatctatgttttattcatctttatatttctagcaacttggaagtgctccttttactatatgagaatacaataaatttcattctgtaaacattttcatgaatgcagagtgatttattacacaaaagtgacttacagcttcatgacctgcattcaggagttatttcatttgctcaaaagcaatatttaaaaacaaaatcccaaacctcaacctaatataagagtaaaaacctgtgagatttcagaggaaatacattttcacctgaatgttcatgatggttacaaatgattcttaagtgtataggtgatttgttacgtcagtattttactgtttagcagcctgtagtcaacaagcatttcctttgattaaaaagtaaacttcaatggtgactttttacatgccctctatcccaagactaggcca

SEQ ID NO: 35131 - DNA, 1090 bp, Bovine  19866881504716
ctagcttgcatcacacctacccccttgaagttaaaactgcataagtgaattgcaaagaggctaatgggaaaacatacattaagttgcctttttcgtgccttttttttttttccaatttaaaaagcaaactgacttaaagttggtaggagggaagataaaattcaccattcaatacactgagagaaacaaaaattcggttattttaaaagttcaaaacccaggaaagaattctcacacacacactatgaagaagggaggagccgagagccagcgccagctctggagtgaacctgcgctcttcctggtccttctactttttaaaagggattcaaactctacaaatgacgatcaacgcagtaacgttttattggggtgacaagcgcccacgtgggtctgacaagagacacccttggctgcattccaactggcccatgagggcagctttatcttctggttgtccacagttactcatctatttttaaatgttccagtatgatcttatcgaggaggcacacataatttgatcaccttatttccataactagaagttgttgaatgtgcccagccaggtaggagttacggttacagggtgtctgtggactaggctggagcttaacggttgtggtcttttatttttaaaaaacaatcgcaaagacccgctcagtagaaagtgcacgctgggctggtcgttggtctgctggctttgtgcagagtgaccgttggccttgggaccaatgagacacccactctcctttgctgttcaggcactgagtcgtgtctctctgccaccccgtggactgcagcacgccaggctcccctgtccttccctgcctcctggagtttgctcagattcatgtcgagtcagtgatgctatctaaccatctcatcctctgtggcccccttctctgcctggtggtcctgaaggggcctgggggtggggggcagttcctaggctgggagtccaggtttcaccacagtgagttgctataagcaactcggcccacttggaaggagaaattgcctttacggtgcctctaaattctcacacacgcctcccaaatgcaaaggccgctggcgcgggggcatcagt

SEQ ID NO: 35132 - DNA, 1356 bp, Bovine  19866881995729
actggcctcctcttagcacagagcggacagaagccagctccaggagaccagagtcttccttccccgccctgttctccacccgactcttccagaaccttcaacagaggccttgttctccagggctggagaccacagtttcccagcctctcgaggggaaatgagtggaggaaaccagcccagggtttttattgccaaatagttctttcccgaggaggacaacgcagtcgactcgccaagtggggattggagtgggtccagcctaaaccaacttaatgaacactaacagagaactgcaattattgttgacttcaaaacgcacacaagaactttagacactgattcctatcagccggtcgggccggtacagatgctgcgcactgttttcgccgttgcttagcaacgggagagaaacttctctctcttatcactggaggtggaggtaggacaaagcactttattgaactgaaattagtttattctctctctcttggagaaggcaattggcagccaagagtcacttggacaatgggcagtttcgaggttgggaggtggccttcctttcctgttatctcagtaaatcctgacggctgtgtttctctacagataaagttttgaacttttgtcaggagtgtccttccaaaactatcattagagaaaatagcttcacatagagactcacagaccagggcaggaatgaaggtgaggaggaaagtgaagtcaagtaggcaaaatttaagggagttctccccccaagtcagcaatcaaaataattcatattttaatgctgtattttattgaaaaatatctttttctggctgcacagactggtttttggggtctttcctgactaggtatggaaccagggtccctgcagtgaaagctctgggtgctaatcaccggactaccagggaattcccttaatgcaatatttttaaaaaatacacattactgagtaaagttccacgatgactgaaatatccaaattttaaataaagacagaatcagtatccgtgatttttttcctttggcctcaggttccaacatggcagcatggctcagcactgccacagaccttgttcctgcctcacacgtgttcacaacacaggagacttctggagcatctttttcctcacaagaatgattgcactggggggtagagcatcatgcagctgggcagagggcttcccttccccagtgggaagaggatctttctgcagtcctttcgggagcttcttccaagactgaagtggtttgccagggtgcatcatgcgaaatgctgggttgaatgaatcacaagctggaatcaagattgcagggagaaatatcaacaacctcagatatgcagatgcatgcatg

SEQ ID NO: 35133 - DNA, 1179 bp, Bovine  19866880492656
cacagtctattaagaaattttttataaaaattttaggtaaacctggaaaagactcttgacttttattggcctcagtgtccatatctatgaaatagaactactactagtaatttattacagtatattatgtatgtacttctacatgaatataatagtataggtaatttatataaataattggcattatatataccaataaatagtacaattactataaagcagaatataaaacttcaatgtatttttatggaattcaaatttttaaaatatcttgctttcataaattattatggaaaatattttccaaaaattattatatgaaatataattaatatttcaataaattatttgtatgcaaaatcttatgttacaatggggacataaggaggaaatgaacaaggttctgttcccaagaaatgtcgagatgatgggttcaggtgacaaactctccatccatactgatccaatgtgatgatccagacataataactatgaaatttacataagccatgcagttctgaataatgtttccaatcatttctacaaaatcaaagacaaaaggtgtctttgattttgatgtgtgcttctgtgtatcctcttaaaacaagaaagaggagcaaaaatttcagctctttaaatctgtttgggggtgaagaaaatgcttgtgttttttctttttttcctagcagaggaaacttacagagaatttgttacgatgtttaagtgctttgaaatgtgagttagaaggataagtactgaaggaggctagatctctgtgaccttttcagtgtacatccaaaccaaactttctccgggtctttcatcagagcttcaaagtcccccaagacacaatcacatcctaataattcttgataaaagtctgaatgctcagcctctgatgcaaaatgaggagaaaaaaactctgtcttctagcactttatcaccaaaaagcaagcacaggtggtctgttgggaaagggcgatgaaaagatgcagagaaatccttcccttcttcccatcctttgagcccagagctgatgacattttcaacccagctccctttcctctgtctaaacacctggttgataactccctactcacatcaggatccagggattctgtgcccatatggcaagttatagaattgctagtcacattaaacacaaaaacccaggatttt

SEQ ID NO: 35134 - DNA, 1491 bp, Bovine  19866880503367
cagctacgaatgtgtaattcatggcagaaacttgaatttggaaaagaagtaataaaaccaggaagaaatgaagtgagaatcccagagccttcctcgcatgccagaataaagtagacgtgtgctgcactctttccttctgtgggtcccttccacacctgttgttgctttcctggggaactggccaaagtgatcctatttctaagccctaatggagagaaatgattctgtcccaacaacaggaagccaaggttcacattttccatcttttcctcctttttaaaaaatagtctttgatatgggaatattgacttagtgcaatggaatattgatttaggaatattgattttgcttttaggaaaagcaaaacgacaccatcagatgcaagcagcgtaggaaagtcggtaaatagatggaattttagcatcagggtgactcagagctcttttgtttgtttttggttgcttggttggttataggttgcttggttttgtggacatgttttgttagagaaatgacccctaagaggtgagtgggctctgcctcttgatgatttcatatataattgggtattgttaacctctctgtttgtgatcccatggactgtcacctgccaggcttctctgttcatggaattctccaggcgagaatactacagtgggtagccattcccttctccagggaatattccctacccggggactgaacctgggcctcctgcgttgcaggcagattctttaccatctgagccattagggaagctgatttcatgcatatttcattgaaaatgactgctctcttggacacattgtccccaaacaaagtgcaggctctaattttattacactgaaaaattcttctgcaaaaatcacagcccatttattaaggtttataagaagaatatttcatgtgtatagtcatttttaaactctgttttgcatgcttacgtggccagcgctgagctttaccaaaaaattggaaacacagaaattatccccagaaattctaaaagctagcatgaaaggaagtaaagcaatggtggtctacttgaaatcattttcacacattcttgataaaacagtatcacacattcttgccaacaaaattgctgtcacaagcacacgtaagtttgtttgtattcaagcaaagttgaatttttttcactgtcacatgatatttgaaagcacaatcattcattcatcccagtttataactcagtattgtcacctttaccaagctacttagcctcaccaagccttggctttctcatcatctaatgataatacttacttcctggagttgatatgagaagcaaatggaataataaagtatgtcttttcaggaatcaaatagcatagttctttccaactgtggaagtatatctccattactaaatcacagatattggcacaaaatgaaatataattctagccatcagaggtttccaagagagaaggaaaggcactggggcagtcacgattgctgcaactggga

SEQ ID NO: 35135 - DNA, 915 bp, Bovine  19866880592321
tttgtcctgaactcccttgcctccaaacctcttccttttctaagagtccaagattcattaaacatgatgtccaataaaatttgtgtatgaaagagccaacttataagacaggagaagggctcatctccaggactgtggaagacttccttgcagttctaacattgtcaaaatgctagtaaacatgagacattcttaaataataaggaatctcatgagaggtgaatgacttgtcccagatgacactctaggtcacaggaaagacccgggatagaacccaagtcagatattagaatttagaatcctgctgtaactgccggaacttactatccctgatatattagccatcaacataaaagcagctggaatccattgatatttggactctgtttggaattcctttgtttctaatgtattctaaaagtattttttcaaagctttcttagtaatgcaggacactgaaagtgttttctgtgggctgtttgtaaatgtgggttgggtgatatacatctgcaaactacacgatgaagtattttgtattctatgcttcatatttatcattttatcaatctgatgttttggaaaaaagaactgtgtactgaggtctcatgtgtttgctggtggtgctcagcttgtttaaattatcagatgtttttactaaattataattattttttattgagaccaaaacactatttggcttgcagcaagtctcatctgactggtgaatcatgaggaaatgtttttgtttcaacagattacagagaaagcattcatttatacacatcataactaactaacccttttggtatttcctaaaagtaaaatttgcagcaaccagcaaggtgttgatttaaccaaattctgactagttctaaattcaaattatactgtttaaaaaaatctaatatttttaga

SEQ ID NO: 35136 - DNA, 1456 bp, Bovine  19866880612624
actgtctagctatttctacacaatctttccagttttcatacaggtattaggaaaacagatctcgttttaaaaaattttagatcttatttcatttactcaagttataaaaatagcacatactcacagccagaagtatggtacagtggttaagatttgcggtcagactgcctgtgctcaaattcttcatagttgtgggagctggaaaaaattagctcacctctttcagtcttatcagcccccacttttgcccctcattgttttaagcattgtacagatcatttaggttctctatatattagctttccacttttggaaaatcatcataaaaatttcaactaacaaaactgttgagaatagtagatatgttatccttatttttaattacctgaataatctttttttttcttttgctatatatctgcatcacaatacattctaatgagttcaaagagtccatttatctctaagattgaacatttacctctagcttacttgcttctagattgtcttagtcccaggtctggagacgcctgattgccttgtgcctctctctcttgtcgccgagacttactgtaaaggccacagcccagtcagtcctgggagggtgtggcgaaagtgaaaagtgaaagtgaaagtcactcagtcttgtccaactctttgtgaccccatggactggacagtccatggaattctccaggccagaacactggagtgggtagcctttcccttctccagggcatcttcccaatgcctgtttttttgggttcctactggggttctccagactaggggctatacagggcctcctcctttaacctaatgcctcctagagcctcaggctctgccttttcaaggcattatttacaccaaagatcctcaaccaatggtgattttgccctccaggatctacttttttggttgttataactgggaggagatagtcaccgacatctataggtagaagttgggagagggggcgctactaaacattcgacaacatgaaggacagtatccctgcccccctcaacaaagaattatccagcctaacctgagaagtggtgctaagactgagaagtgcagatttatgtaaatactactgatcccaacaatttagtcaaagaatatctgcttattcaaaaattgaaagtgggacagtgaagttgtataagagataaatctaccttcatccaatcacactgtgactacttttcctatgaggcacttaagctctgggagaaaaaaatgatcaaccagttggcaacaaaaatttattgattagtttgcaactttagatacaacatatatttcatcacatggttataattcagtatttgtgctttgtaggataagtaaacatttgagcacaacagaagtctacacacaatattacaatcttttgggggtgtttaaaaaataaacatatccttttccatctagtatcacaaaagaactttca

SEQ ID NO: 35137 - DNA, 1343 bp, Bovine  19866880617665
attggagaaaagccccagatccattaagatattattaaattgttgtattttccatggcttcccttagaactgccccttaatagagtcattgccaactcatggcctaactgttgatttatttcaatgattggagtctaattttcaattcctaaaacagaatgctataacttatattccctagatacactttaggctatgactttatttgatattcatgaattttattgatgttttaaaacatgaggcaattttcaactgctgtgtaaatttttaaaatctgtaattttagtggaaatgaaaagaaattacttttagtattggaattcaaataggttttagaacagagtgttacagatctatattagagatgactaaaaactgttcctatctacatttgccaaatctgaaccattcctaaagtttaagttcataatttttcaattggagattttataaaagtaattgatataatattgttgaattatgaggtcattagtacagtaagctgttatatagtaacagcaaaaattattattataaatcatgaaactacagaaaactttggatttacagagttcaaaccagaactttaagagattattcttctgagtacaaagatattatcatggaaaatatttctttttatccaagtaatctaaaaaagattttgttttgcccttgactacttcttcatgttaaaagaaagcaatatacaattattgcacggctactatgtgttaggtgttaatccagcttcacagtgcattttacacttttgcctcaataaaatccttataaaattgctacaaactgcatagtacttgtaattttgatgcgggaaggagatgatagtgtgttgttgaatgcatttgcttgtgtgctcggttgctcagtcatgtcagactctttgcaacatcatggactacagtcaggcttctctgtccatggggtttttcccagcaagaatactggagtgggttgccatttcctcctctggggcatttgccttgacaaatggaatgggggtggggggttgaaattttaagcttacttccagcatttttttaaaaaattggactccaaattgcttcatagattacacctctgaacacaacagacatacagaatgtatctgtaacacatatataccttatagatatgacatgtaactatgtgacaactatgcttaaacagtgtacatattttcagtgtacaagtgtacatgttataggatgccctagcagaggcttctgatttaatttataagtctaatctcggcactcaatgtctccttgtcagcttccatactgaacgaattcaaaatagattgattgatgtttttt

SEQ ID NO: 35138 - DNA, 1384 bp, Bovine  19866880684571
ctgctgatggacatctaggttgcttccatgttctggctattataaacagtgctgcgatgaacattggggtacacgtgtctctttcaattcttgtttcctcagtgatcttgacatcatcctttggaatgtactgccatcttggggccacctggtttctataaatgatgagatgtttatgccagactgtttaaataatattcttttctacctttcaattttctgttttacaacactacaaggctctctttgaacccattgatttttagattttatgaacatattccttcttaagttaactgacataagagtaaagttcttagttttgacatctaattatatatccccatcagtcttatagatctttctcacctatttttttacctagcacaaatagcaaggcttggtttatgaactggaaaagaccaagatgacttcagtagagtattttatactgagaaataatggtgactatgattagttcaataacttcaaccaaattgaggtcagtcttgaatgactggcatgaagtgaagtgaagtcactcagtcgtgtccgactctttgtgaccctgtggactgtaacctatcaggctcctctgtccatgggattttccaagaaagagtactggagtgggaagccatctgtttctccaggggatcttcccaacccagggatcgaacccaggtctcccgcattgtaggaagatgctttaccctctgagctactagggaagtcctggcataggagtccaaaatttatcctggaggaaattatgatgacagcatgaaaccaaagctttagaaagagtggcctacctgtctgacacaagagagcagtataacacatgggagagatcaggaaaaatactgggtgatttaggtatttagtccatattccctaaatgtgattttgaagaaaacatttctgttttttttgtgtgcccaaatctctaaaattaaagagtctgcatcagatttatttcttaggtattttaagaatccagtgactgtgttgtattttatcctcaataaagtcataatagaaatcatcaagctcatgatttcaactggatggaaatgtctgtgtaagtaaacagtgtgactggaaggaagggcagaagaaatcttaaaaaaataagtagagaaaaacataaaacccattgtgatgaaatactttgttgatggatttacctgatgtaataatttctgcatccaaaatcatcacctctgagttggtttaacttcaggagaattttataagcaaaaaccaatgcattattgtaggaacagtgactactcacaatagcttcttcaggaatgagtcactataatttgcaggtcctatgggctttctggctgaatctgagctgcagaaaatgagtttt

SEQ ID NO: 35139 - DNA, 826 bp, Bovine  19866880732781
cttttctgttagaagcataattgtaggcactcaaggaagccatggatcaattcaaaacagttaacattagaatgaatttgcaagcaggacttgataactaaatatactagcatatacttcctctttatttaatatcatttcccaacatatgtttttaaattctcttgcatatttaaaaatacagtgttctgtacaaattctactccttattaaatgtttaaactcatacacaatgtcacccttgatcaatctgttcaatctgtttctcactttttcagggtgtgaaagcacaaacacattttataagcttccagagagttcaaattgaaacactgcctgaaaccataacaaaaatgcaataaaaagaaagaaaaagacatgtttgttttatgtcccatcccccaatcctcagggttttttttttttttttttccattttagatgtgttgcctttgtaattggacttattccctctaaactccaggcatttctggccagtctagcatgttgttttgttattttactttggagcaccatttttctgaatataagtgtaattgtcttttgtagaaactttggacaatatgggaaagtaaaaacagaaacaagctgatattccttctaacctttaagtaccattcaaaaagttctccttttcctgaggtaattggtgctacaaaaatgatgcaaacaaaattcaactaaaatgggaactagtatattattgtattgaggcccacagatttagtcaatataaatagaggatgctaagataaattagaatgtcagaaaaacaacaaatattatttgtagaatcagcgtgtcc

SEQ ID NO: 35140 - DNA, 1180 bp, Bovine  19866880807680
ggacaaagaattaagaaagaaagtcaaccagttttatgtccgaatgtgagttccttgagattggggcgggggttgtgagtagaactttcctacgcttagggagatctaagatccaatggtaatcttaactttggctataaatctatcatttctaattgtaggtcttcaatacagattcccaaaatataaagtttagaaaaggcctccttgccctttattatgcaattgttagtgcctcaacttttgtgcctgctgcaaatgacagattcctttagataggagctgccaggatgaagcctttgactgaagtgtagatgctgatagcttttcctctccatttctctcccttttgcaattcatagctgtataattagagattagtatcagcaaatgtctgaatttttctaccgcatcttagacctgaatttccaaagagggtatcgctgttaaaaaactcaccacctaatcctttttgttttcaccaaagatttttagccatcaactggttttctggacaagggattaaaaagtccccaaaatagcacaatcaaatcattttgcctaaacaaagagattgaattaagtgtgttgaatggactctgttttccttgggctatgagactctgcagtgtgaaatgttttacattctctgtctgccaattctggttctgctcattatatttaaaaagcttctccatcccattttcagcttcttctttttctttttttttcttttaacataaatgctggcatgcaacttacttctaggaatagctctgagctgatgctctcaacttagtcatgagaactacatttctctcctctttggaaatattctcccccaatttctgtaattatgaccccataagagctaggtaatttcagttaaaatgaaacatatagctttgtagaacatacaggaagcagactacttcataaaggaaggagagatcacagtgttgatttctcataccaacaatacgcctttacaatctaagccacaagaaacatttatctataagaacatctcttcccttgaaaaggagggtttttatacgtaaagctcagatacagtacagaatattaaaattcatggttgtaatttcttatgtgaaaggttttcaaataatgatgataacatagaaagtggtagaacattttaccgttttcacgtgcaaaa

SEQ ID NO: 35141 - DNA, 1045 bp, Bovine  19866880871612
gaagtatcttagtctctggaggtatacccaagaagcctgttgctgatggataagtatcctcactgctactagaatgaggaagaaaggggttatgctgattgtcacccaccaggtgtgatccaccaagtctgagcccactgcagaaattacaaaatactgatgatgaggatgatggtggtgagtcagaagagtcttttattgtgttttctcctgatttggtcagaaataaacctcagtttaggggtcctagacacaaagcaatattctcctggggatcaaaggaaggacctcttaggatggtggaacgtcggtgtcggcagtgtggccaggtggcggagactggcattaatatgtaaacttttgctttgtcagcaatggcaacagtagtgccactagcagtcttggcattatggacctggacatttatcaggaaagcatgccatcttctcccatgattaagtaagtagccactgagatgcagtgattgtgagcctgctactctgattccatctggcaatccattttgatcattcaggttgtgcccgaccaccggcttcatcatgtctgtcctaccaaggttcccggagacgtgtggtttcatgtcactggagtaagaactcaggcgtgccgtagcctcaccctaccatcaaccgctttctatatttcaagtctatcccttatactataatcgttttggataaagcttatccatgtgttcagacatatatgtcattttacctagatggatacagagaaccaaaaacccatttaaaatgtaccatgacaaccaacaaaaactattgttcagtagaatatagtgtgagaggcttttccttttcttgtagacacctgggactattgccattaatgaatccaataccaaatggcactatgatggagatacatcacctgctccccacattatgaggcccttctaaaataccaagggaaaaaagtacaatcagtaaggcatgaaatatggtatataaagggagagcaacatgaggtcaggacttcatctagaatttgtgattgttctggaaaa

SEQ ID NO: 35142 - DNA, 1165 bp, Bovine  19866880893149
ctaacaattcccaataaaatgaaaaaaaaaaagaaaaatttcaactaattgagatattttgttgtacaacttaagatctaaagtttgtgattgtgtttttcctcatttcaggtcaaagaaccagataatatgtagaaaaatattttcccagactaaaatgcaaatttatgttgctatcatggtatagaaaaataatcagtcttgagatggaaatacaagatcctttaaatgacaaataaaatgcagaagaaggataaatcctccaatcggatctagttacctactaaatattttcttgactattcaaacctgtgagggtttgtagaaggaaggttgagaagaattgaaaattgcatctctcagagtctcccacaccagtcatctcaaccaaaaccatgcagtttatgtggccttttttttaggggcaagaatatctatttcagacccagtagtcatgcatcggagaaggaaatggcaacccactccatgttcttgcctggagaatcccagggacaggggagcctggtgggctgctgtctatggggtcgcacagagttggacacgactgaagtgacttagcagcagtccaatgtaatagccatgttagtacttctctagtattcgtttactccacaaaaaccataaatatatttcaagagcttttatatcaataagacccatcacttcatcttccatttacagcttgttcttcctaaacattaccaaccatatactgttgttttctcccaaagtgaattggtagaagaaaaggagattcttaaaggacaggcagaaaccatggagggtaagccactttcccataattttgagatgcaatttgcctatgatattcccatggaaagcgtagtaaggtggttatgtctgtgttcagaacgtgcctctggaacgccggttggaacagccagccgccaggggagcctgctggtgatcaactttgacctggagccagagtgtcctgacacggagctgcgagccactctgcagtggatagctgcatctgaactcggtatccccaccatctactttaagaaatctcaagaaaacagaatcgaaaaggtaccttgacccctgcttcgatatcataaggcttttgtgtttttatccctgcttgaaactgagtaaatgttcagttggcccctttgaa

SEQ ID NO: 35143 - DNA, 1700 bp, Bovine  19866881053822
cagagtatcaatgtatatatatgtgttttaagtaaagaaaccataatttctcggcaactgagttgcgagattattctctctttgtcctcctctccctctcccttcccattcaactcatcttcctttctcccctaggtttattatctggagaaaatcatgagaggctcttttaaaatggtaacttttagttctagagagatagaactctggttatatttttaattattgttgcttcagagatcctcacgagccatttagcccacttcatagtaaatgaatgaagaaaacaggtagaaagcctgttagtggacagagcaattctgaacgtacagacacagcagagacctggtgacagatggaagtgcttcaggcagcaattgccttacacgttcctccatccgcacctccatctgtcagcagaagtatgttactattttgggactcaatttatccctttggtgaatcattttcaggcttgtttctaaggttaaaatgaagtctgtaactcattaggcctttcccttttcccttctcgttttcattagaagtaagaactattggggtgaggagataaatatacatggggaaagggtgtgcttaaagaggatggtaggatattaaaatttgacaccaatgcagaataagtcactgaaaagaggattgactatatcatgccttcttcagggaacatattatactaatttgaaaatgtaatttaagaataatccatgagtaggagagtccagattcaaaactaaaggatccattttcaccatatttataaagtcattgtgaacctaattcctgaacttaaaaggaatatttaatgagtgaatttttaaccaaatgacccctttttcctcttaaacctgaagagcctagaagttagaccagccattgtctaatttcagtagaaagagatgaacaaaataatgttttgtctgcaccctataagagtgaagtatgtaagtctgtaagagtaaagactcactctaagattatttagaaaaggagtttcaaagaacactatattctgtgcttcactcaaggtttaacaactaagaatggttgtctcacttttgcctgaaaacaaactcaggtgtgcttcctcttttgaattaacaaagaaaacaaaagactgtgataaatacaagggaagtaaatcttacgtatttagactttaagttgaacccataaagatgctcttagaccaacatgtcttaacagacatcttggacactggcatcagggttcacatatcacttatgatgaagacttttcacttctaacttttgaaagtgaaaatctctgaggaagaaggatcttcctcttgtcctaaggataccttatatttgcctgaactttccttgtgctcctttcgccaaacttgacctgtcttctctctgctgcttgtgaaaatcccataaagcctctgaatacacatccaacttctccttccaccaagttctaccaaatttctccattctatgtttttctctcctgaatcacataaagtccagtggtcattgggtgctcctagtataatgtttcatgacagttcaccaagaactcagatggagttagaaattgagaggtttatggggagaaggtgcctgggaaagataatggagaaagggctcaagatgtggcaggaaaaggcttccaattgtgatgtagacctgacatctgtgaaaggaaag

SEQ ID NO: 35144 - DNA, 1515 bp, Bovine  19866881244654
taataatacttcatgtttggtatgctatagccaaaagcagggaatcagaggtcagaaattgtgatttgttctatcaataattagcttatgactttgggccaatattttgaactctgtagacttcaatttcccatctgaaaatgaagagaactggtctctttccaattctatgagtcagattgcatctattgcgtataaaattattacacatttaaggatatgtgaatatataaagggaaaactcctatagcatattttttaaatttctgaaaaatcttaagccaaaattgtatattcatgacattctttgtactgatttatcactcataaactctgtgtctttcaaagactaacaaactgttcttggcaaagttaccaggtaccttgttctttcattttctaggaaatacctaagagcaactgatcactctaacagaataaaatgctgctacactctataaaaggttgattagttccattgaaactaactcactggcattttctgggcttgatttcaaaaaagagccttaaaataatttattgttttacatctacttatatgcaactcccatccatcctatttagagatctttttttgaacgaagatgagtgttatcaagctacaatatgtagcttaaggatttttatcctcacttcaggcaaaatttcaggcttacctagattcacccattattagagtttacatgaatatgtatgaataaatataaataaatttctgcagcaccatctaatttaaagtctgcttgctagatgaaagtgagatatgtaagaataacacttggtgtctgtctcaagcagtttgcagttcattgaaaattcaaaacacttttcaaataagtattttgtaaatctgatagtatggtatcatgaaaagaataaagtagacttcccagaaagatgccagggtcatggtaaacatcccaacctcatttcccaggtatcaactctgagaaatatcttccagtttaaataaatggaataaaaattgaagaaaagcatcagagcaacaacatatcaaggtggtaaaaaaaatttccaagttttatatttatatttatatacaattagatcagttttcccactttatatccctgatattagtagcaatttatataaatattctacgtctgacccacatctgtaaagtgagaataatacgtaccttcttcattgggttattggcaagtagtgttgttgagaaaacacctgcatcctagttaacctaatgtttagaacatggtactttatacctattacctaccaggaagataatgttgacaaaatttctaaatgatgagaattaacctgtggtaatatctgccgtacataggcaatcactagccacctgtcttaggctatccataaataatcatattatacagacaaaccaaggtctctgtttaaccagtcaattatgaaatagtgatgattgctttctggagtcatcacttgacggattggtagaagattttctttcacagtcagaaaactagt

SEQ ID NO: 35145 - DNA, 1708 bp, Bovine  19866881275289
atctgtttcctagttcaaataatcttgggttctatatatacatatatataatatagctgacaccagatttttcataaatactccatttactgtaaatatcagtttctctgagttgttttagaaaatttagcataatgtattaaaatcatgtgttaggaaatttcatggtctcacctacaataacttttattttgaaattgaactattattttattaaattgtatctaactctggactacagttcaattatactcaatgcttcttaaggtttcataaactaatttttctaaccttaaaaaaaagagagagaggatgaaaggaaacacatggatatggagttataacaattacattcaaagatttgttcattcagtaagggcataaaaatgtgatggtgaccagagaaaaaatgaaattaagggacattgtgtgtgtggatgtgtgtacttaggaagttcataagcatgtttttatgcaggtgagaatgttatgcagagagatatttgaggactaatttcgaaagcagtttcctgagagaatctggaaccaagttcaatgttgaagagttgatgcattagggcgaagaagagaaaatggacacacatgtgaatagatcagtcagttttgtgttggaaacacgtggaaagtttctcctcactgtttctgttttctctgtgaaataagaagaatggtcatcatctgagaatgaaggggggcaagaggtcttggggattgcaattagaagagcatgtggagtagttttatgacatagtgagagaataaagaagtatgaaaatatagtaggatggtaagacatcagtgaatacctctgaagatggtagttatgagtgggattcgctttatgtcccacaaatagaaaaccctgaacagcagaggttgtatattctaaattagcagtgggtcacaagattcttttctcttttctagatgaaattatgctgtttggacgcttgtctggggtcatctattgcatgtctcaatttagtgctaattgctagaccatcatttttgtgtctattgtaaatttcctgaagattttggaaaccaattaatgctcaatcctgagtgttgtaaagtgttggtttttattttgtttctgtaggcagtcaggaaggactgagcaggggattttaacagatggcattttcgaaccgaaagaagtgagaagactgatttattagccacctgataacacagtcctttgttgctgtttagttgctaaatcatgtccgactctgaaaccccatggaaggtagctctctaggctcctctacccatgggatttcccaggcaaaaatagtggagtagattgccatttccttctccaagggatcttaccaacccagggatccaatccccatctcctgctttggcaggtgaattctttaccactgagccactagggaagccctggcacattcctaagttatacaaatgcctttgtatcttacagaagtctcacacacagaccatcattttctgttttgtaacttcttgcatccttttcactgaatgtttaaataccagtgggattgtgactcttccaaagctgctgtccaatggactcagttggtacttttccacatctcagggtcatctaaaagtcagtgctccttcatgatcagataggtttatttttgtgctcacttaaagtgtcttaaaactaatttatgtgatagattaaagt

SEQ ID NO: 35146 - DNA, 970 bp, Bovine  19866881356151
aaaatgaaagtttatattttatataatttaatatacaaggagattttctctccaaagactctctttagtaggaaagctttcccatagggtaagagttctgtaaccatgtcactcatgtaataaacagatggaaataagacaatcttccacctttctctctctcagctgaacaccaagagtcttttgattagctgggaactcaagacattgctggggagatatgaaatatttatcagtgggctagagtgaacaaaggaaatcacctctataggaaacactgagatatccttgcatctctgttaatatccactgataatggtctaaaactgaaaaagcttttatatcaaaattttggaaatttctcacccatatcttaactatttacctgggctgaaagacactttaatctgctcaaaaaaataaaataaagattacagcagagtttataaaatgattttgaccagtgatgctgtttccagttgattcatgttggagatattacatgacattttatgttattaaaaatatgcaagtgcaactctcctggagtttaggcctagcctgaagttttccatttgggcccattacaatttctgtttctccagccattctaacacaagctcttttaaactcccctacaggttgtgttgatttgtacagacctatattttgctttccttcagatttattccatgtgcagcagacttgaggagcagattttttcctagctcggataatgtgatgtgatgttttgagaaagtttagagcgtttagagcaaaccactgtaatctaagctggaaagaaggaaagggatactctgcaggagactgctgccttatcccagttccaagagccaatcaaagagactcggggtcccatccctccgttcctcatgtatcttgcagtactgaaccactgcatggaagatatcccccaccttccaggacttcgaggaccagccgcacgaca

SEQ ID NO: 35147 - DNA, 1097 bp, Bovine  19866881421824
catctccaacattgcaggcagattctttagcaccgagccaccaaggaagcctcactgaaattttttactgtgttttaaatacttggaatgtcaattttaaccatatctacaaagactttcaaagctaactggctaatgaaatttgatttcaatatcaccttagaatatttacaactaatttgccacacttttccaagagaaaaatagtatcagaaataagcaaatttggggtgactccactttaaaattttttactcttattacataaaggtatttttgcatccaaaatatgcaaaaggttaataaaaagtttaaaaaatacatttattttaggagcaggaatcagagaaggtgtagcatttaggtttgtgaacttcatgattcctttgcattttgcagtaggcattggtaagaagataccttttctgagaggcttatcacgaagtcagataatctggctacataacataaaaatatttcaaaaatggaaaactcattaaagtacaataaataaatttcacgtagtaaaagcaagcaagaattgaaagggaacaaatatatcctcaagctgggaaaaatcattttaaactctcaaacatttatttgatactatctttccaagaataatggagcagaaataatcacattccttttcctttacatacttttgttcagagaaaccagatgcagaatgaagctttgcttccctgccaaactgtcaactttgtttaatatttaagtttcatgcaacataaacaaaagatgcgaaattattgttagtgtggagggttctgaatttgaatcgtttttgactgatcactgtgtgttctgaaaatagacacccatctccatatggcctagatctttcgagtgtttcttgctgtaattccagtggtgatgaaaagtgaagtggttttataaatgtgggcatgagtacatgctttatatatatttcaagtggtatggtttcccactattgaaatgtcttcgtgttgttttgaaggaatatctctttcagagagaatttaaaagctctcaaaaaaaccgtcttgatcaagagcagtttgatagaatcaggattgagtggcttcttacct

SEQ ID NO: 35148 - DNA, 1481 bp, Bovine  19866880372445
cttgggatttcccaggtaagagtattggagtgggtcaccctttcattctccagtggctcccgtcagtgggctcaaattggctgctcatagctcctgccatcatgtctgcctcccagtcagtaggaagaaggaaaggataagaggagcacatacccatttcttttaatagcaaaacttaaaagtggtctacagctgacctcctcatagctatcagaattcccttcccttcccttacccacctcagctgcaaggatgttgggaagtataatcttcagctatgtgaccacatgccagctaaaactcaggtgtgataaagaaagaaggggctcatggaattttgtagaaaactagcattttcttcattcctgggggcagccaatcttcctcatatagagcccctgaggaagacagtgacagagggagggatgagagggagcctgagggaaaaaagtcatagaggggtcacttaagaaggaaggtccctgagggaattcccaggtggcactagtggtaaagagcttgcctgccaatgtgggagacttaagagatgcaggtttgatccctgggttgggaagatcccctggaggagggcatggcaacccactccagtattctttcctggaaaatccccatggacagaggaacctggtgggttatagtccctagggtcacaaagagttggacacgactgaagcaacttagtactcatacatgcagtggttaggactttaccccgggttcaacccctggtcaggaacttagatccctcaagcaaagaaggaaagtccttgagacagggataaggatatgggagggcagaaaccaagaccagcttgatggccaggatctgggatcagggagatgtcctggggacagcagggacagtctttatccatttggatcttcccctccctctgggttctgagttaaggtctgtggacttctgtgctggggaaaggtgtattattcttttgtgctagctcgagcccaagaggaggaagactaatgccggagggtgcctggggagtcctgagtagtgggagtggaatcagccacaggccagtgagaagtggcccagggtttccaccccagagggacgatgcactgagattcccagggcccaggagaagccaccaacaggaggcactggctgggcaggtgtatgggctacagacctgacctgcaggatagtgtgaagggtggcgttgtgtgaccactgatggagctggggacttgggggcatagggacaatgtgatgacactgaaacccgggctttcctcacacccaccccctcagcctgtcatctggctgtgttctgcatggatccctaagctgacaagagcctctggacccggcattctttacccagtgcccagaatcccctgcagctgtgcttgagcgtgtttttctgggtgatgacgcatcgtgcgctgttagcagattcctaaagggcctgtgagtcagcagaaatcaacaactg

SEQ ID NO: 35149 - DNA, 1182 bp, Bovine  19866880486427
tcatggtggtttccatgggtcaaaaatggctggggtgctctgagggtttttcctcctggaaacaaggaggctgccctcctaatttcttgggactcaactttgagcccctccatccttgcagagggtggcccagcagagggacaggtcctgtagagggtttgtgaagcacagaacagccccctatccataaatatcaacaccacctcctctacccaaataccctgaaatcctttgggctgaagttctgtgtcttagttgtcagtgattccaacagatagagtcaaggagtgagggggtggaggagtagaacagggtcatgctcaagtgaggggagataggtacaaaaagtactgtatgaatagcagggaatgagcccctgggtcagatggggtcaggggtcacctgtagttctgcacgatgttccgggaagcttccagctgtgccccagacagcagcagatttcgggggtccgtcacggtgaagaagtgccgggctctgcctaggaaagttctttggtcccagcgaggttcctggatattgatatctaagggcaactcacccattttctgcagggcagggaccaaagtcagaggactccaaggaaggggtccaagggctccacatgggggaaacttcggtggtgctgccctggtccctgggcctattgccaatcctctggagctcaaggtaactccagataggtaagcaagtgggggaggagctgctctctaggcaatgttccagcccagggacctacagccactggaggaggggacaggagagaacagggccaggaaagcagatgtccttgtgctctggcctgctgcagattttcatgagtgaggatttacacgtgtgtggttgacgcatgagcggcaactaatcccatgcagctactcttgtgctctgtatgcacaaaaatgcagattatatgcatcacacatccacattcatgtcagctttaggccccagttgctttgagatctacatgcaaacacccgaggctgtttggaaaaatggcataagctgtaccacactccaggccctaaatggaggagagcaagggctcaacagcttcagggcttacctattccggtctcaaacaggggactgatgccagccagccagtgtgctcgcaggcatccacaagttgcctctccagacccatctccctcaaccaca

SEQ ID NO: 35150 - DNA, 1235 bp, Bovine  19866880522283
ctgcagaatcttctgctccgactgccagaggcccagatcacagtcattccctcacccccaggataaggtgaatgtccatcaggccccttcctggaacacattgatgggacctaaggtcagctgctaccacaggtgtggaaaagtggaagtgaaagtgttagtccctcagttgtgtccaactctttgcgaccctatggacctgtccaaagcccccagccaagcccagagacagcacttaccttctctgggggaacagggcacagcacaggggggtggcaaataccaggctgagggagaagagtgttagagaggtttgtgaagcgctgatctaagagtgttccctcccagtcccccaccctatctctggagacagcccctacgggtggaaactgattaaagccaacgatgacagatgacagtatgttctggctgaggaaagagcctccagagcagtgatccggagcgccacagccagtgacagaaccaggaattaaatgtgcatcaaactctaagatggcaccaaaaggcttatttccatggtggatgcgggacccctttgactagactcttgaccttcaagaacagacctcaccccttaacacacacagtatgctttacaggtgtccaagacccctaccagctgactgtatgaatgaatgacatatacaaacatcttaaaagcaataatacccacccacattcaccacagaaaggacactcacacacactctagctgtcttcctgcatacttaccagaagcccaccaggcccatctgcagtggggcccccagccaggggcggcgctacgggtagagagagaatataacagtgtgtgtcccctgcccccctcacccgtaaacccataccatggcagcggttctatcccatcagctctacctttaagcctctgaaatatggcccttttctttcccctaatcccataacagcgattggccgccttccatcccagccaggcatgcttgccaacacccttcctagcataccatcctaacccttacctctcagaatcacttcctacagttcctccaggagcatttctccaggaagccttctctaaccctccactccctccctcccatctcactgcatcaatctgtccatttccaaacacacctcctgctctgcacacccttcttgatttgttccagccatacagaccaccaatctgttgcctaccgtgtgtgtgtgtgtgtgtgtgtgtgtgtgtagcggca

SEQ ID NO: 35151 - DNA, 736 bp, Bovine  19866880572631
tggtataagatatggtgctgccctcacggagtttctagaatgacagaaaaattagacatgaccaaatgcccatcttactgcactgagctaaataaactgtgctctatcaggctctcctggacagcagagggcaaacaccaaacacttagtaaatgaactgggatttatgagagggaaatttcctagaaggtgagttttgaggaagggtaaactgaggttaggcaaagattgtgctctaggaaaataagagcaggatctatgcagaaaagcagtcagaagactggttgagcagtgttggagggagggctgctaaaaagaagtggacgagcctggtgtttgcatgcctttgtctagcttggctcctccccacccacccagccacccacccacctagcctacagaccagcaggcaactgttacggtctgcctagttggtccacacaagaggctgtcctggccagagtatctccttcataggcccctttgcatcccacctctcctagtttctggctctcttcttatccgcctccaatttttgtctttcctatcaccatcacatctctcccactaaaggcattaaatccatctgtgaaggggccctgctctgcctttccagatattttcaagagtgggaatgaaaactaccctcactcacccacccccacgggccacagctctgcacctagtagtaatcttcaccctcttcactctcagcctcctcctcaggagccaggtg

SEQ ID NO: 35152 - DNA, 1246 bp, Bovine  19866880573189
tctccttctgtgagtaacttttatcccatctagttctgaggtgctggtctccccacatctggagtttttgagtacactttaacttcagcatttgtcccccactgagatagttgctgaggggccagggttattctctcagtcccatctctgcctaggaagatgaaacaaaagggtgaggattcactgggctttgcccccaccacacctcccagtgttagctgagcacaatgctataggttggcaagtgttctgaaatggaggaggagactcacacagagcttatagccagtgcagcttcagtgtttccacagcgcttttccataccttgcaggatagtccttttaggaaagggccccacaaagcacaggtgatgtcctatgcatctgcagtcacaattacctcatctcatctttcaataatcctgtgatgtggcttttattatctccattttacagatgagaaaactgactcactgaaacctggaaaggggcagagactggactcaaatgcagcttttctgactgcattcattactagctgctttctcaacaccaaagttggcagaggtggtctatgccttgcaggagtaccctgcacacatctaggtgcctttaagcccttaggccccctggtaataacacccccaaccccaccgccatcccagaccccctccccttgcctgcaggataataagtacctccaattaaaagaagagcagctgggactgaggctggggcagggggaggagaaaagggagggctcagccataggcagaggcctctttggatcccacccggctccctccctgctcagggagagacccctgggccagaggttgtcctttagcttaggggtgtttgtgataacttaattactttgtgtttgtgggactgcaaccacaaggggaaagcgggtatgaaagtgcatggcagtgagggtagctgtgcatacataccgggcatgtcttttaggactaatttgttaatttatccaacagatacatattgtctattatgtatcagtgttagactgttgggatagtaccctattaggctgcaagaaaaacacttcagtaagagtgctgtaagagatgaaaggtgtctaggtcatttttacaactggatttgtttgtgtgaggctggatgtcagtgagaaggcaggtaatgtgttttctgtaacaggataagaatgtgtttctgtaactggtcctctataatgggcacatttgatagggcaagactatatt

SEQ ID NO: 35153 - DNA, 3776 bp, Bovine  19866880591466
ttagctgtcctccttctcctcctgtaacaacagtttaatgaacattaatgaggagagacaaacagataaaagaagacccagtggggtgccttttcaccttaccatgagggagaagtcagtgccaagagctgcctggggccattgcttccacagaaagaccttcctttttcttttaaacttgagggaatctgtttcttgtaaacagaaggactcctgccgagtactcctgtctttctctcgggtctggacttgagctcctcacagtcttggatgatactcctgcctgggccttgaacacaactcatggtcaatgcttggtgaacaaatgaataagattccaagtcatttctaaggaacctacaaaaaagctgttcttcagggacttagaaacgccaggggtacacatctgggagagagtcagccccctggttcatggcctcaaccctcaagctagggaagaaggcaggccaggaccaggatcactctggaggaccgatgctgaggggtgtcctgagttcctgtcttgcctgcatgctgctaggcctggcctcttcctttcctcactccctctgggctcaggaggaggagctgcagggtcacaggaggggcaactgggggaagagagtcactgggtcacgttgccagtctgctgaaacagggccaagacatcagctaccagccctcatcccctcccctcccaaccccgtacccaactccagcacactcaaatctattctgacccttcccttcaccatgctctttcttactatgtcattgcacatgctgttcctgccctctcagatacccttccctgcctgtaccttgaccaaagcctcctaccagtcttttaacactcagttcagagctggcctcctgctggaatcttcccctggatctcccagatagagttaaatgctcctgctctgtgcttctgtggtccttgtggagacttttatgagccaaggctcatcactccagttatccatgtacttgtgtgtctttccccaagaaggtctcaaggacaggaattttgtcctattcattgttgtgtctagcaaaggatctggcacatagtaggctttcaccaagtgttgactggatgaatgtatgaacagggtaacggtttcttccagctggatcctgttttctcttcttccctggatatcttgacatcatctgcagttctgtgaactgtttctcccaaaggtacttctatctacccacagtcccaagcgacatctggtgtctacaaggtaggacacagcagggttaagggtctggagtgtttgggggttagagatctggggcttagggatgaagcagggaccacaggagaatgagggcaaagtggggtgggctgggcgcttgaacgtcttcactggccatttgggtcctgatgggtaggcccagactctctctcccagacaggcctctgactgggctcccaggcatggctgccactctcctgccctcctacctccccaggcccacggctgagcggctggcagaggcaggactgggccagcccgagcagacagccttgcgcgattgctggctccaggcctcccagcccagcttgtagctccccccagagtggcgggattgattggctgcagccggaatgggcaccagtctccctggcttggacagaaacggggccatctgttacacctctagttaaaagtacataaagttgagcatttgtgcgccgacaataccacccctgacaccctccacgcggcacagcgctccggctccttggcaggcttgtgctccatgacaggccggcacagcaacgcctacacgctggctggcatcacggctccaccccccagcggcctagcccagctgggtccaacctagaagccctagattctacctatatcagaggatggaggaaggaaaggggacgggtggaagggtgtatactggtgggtgactcttggcccaagctcggggctcctgagtggcagatgatgccagacttaaggtctgatttgggagaacctggtacagctactcatgccagtcctagggcatggggcttcaggtgggcctaggctggctctgagcccataccaggccttgcatttcctgggccaagccaaacagaagagtccatcttgtgacccaggtcactcatgcctcttgagtttggagcccatgatggcatctcacatcaacccagaagacagttctgttcaaggccgagttctggactgtggctttgggctcagaattctagactctgatttctgaaccccaacttctggtctctgactttgggtcaggacactcaaggcattccacggacatcttttccacttatgtcctctggtgctctagccaggccagcctactgtctcccaaaactgttacaaggagtcccgcctgcctctgtctttttgcccatgcttcccctctctctaacctggaatactcgatttcttccctctagcctctcagtccttcccatcttccgagactgagctctagtcccagctctgccaggcaggcttctctggctacagggcctctgcctgctctgatctcccagaggcctcctccccaacccaaatggtttcttccgaggcttgttcagtatgagactggactcctctgcacaggtggaagctgggctggcctttgccttgcccacagactagaaaagagctgggagcgtgagtggggaggaggctttataagtgccagcctgaactcagctcagtttcagggaaagggggacaatgactgcagaggtggtactggctctcccaggggccacttcatagctctgatgggcacagcatggaaagcgaatggccaggtagacagacagcttttgattactcatgtgttttttttagtacacatttattaaacatgtgctacatgcttagttctgtgtggatcatggaggagaaggaatagttttaaaaaaaaatgagattagacacagtgcctgccctcaatgagcttactcattaggaaaggccacaagacaagttcaaataataactataatttgaactataattaactaaccaaaatcaacagaagtgtcctttatcttaagcaacaatagacagtcagagatggaaaggatccagaaggtcagagactttaatacccatcctcagccaaaagacatttaatacattgcttgagataatgtgggtaaagctcttacttggcacaaaacacacgatggaattgagttggccaaagtttgttggggtttttccgtaagatgttatgggaaaactggatgaactttttgcccaacccaataaaatgatgcagaatatgatgatggcaataagactgattattagccttccagctggttcgaagcatactctacctgttgggaaagctcactgccctccccccacccctggcagttcattccattgtttacacttctacatattcattcataagggtaaggcgaaatcattctctgtccccactgcaattgtggtaattccagccctggggccaccaaaagaggctggggactaggatgagacaagtgagaagcccaagcacaaaatttcaggggttgtacacagcactgagaacaagtacttccttaaactgtgtgccctaagcaccttatttgcctcatcctagtcccagccctaccacacagtgagtgggtacccttccccagccagccccaggctgggaactgtcagatttctcaagtacccttagccttcaaagaagctcctaccagaagcctacaggagcgggtgataggggcagatggg

SEQ ID NO: 35154 - DNA, 1554 bp, Bovine  19866880671146
tattttgatgccgccttgagtctacacacacccatgcacacatacactcatatatacacccagcctggctgatgtccaaacaactcctttctcaaagcagggatgtggaaacacacacagctctcaaacacagccctgtccaggacgcagacattcttccagcctgtccaagagctcctcagagcgggatgtccaagtcgagggcctctgcccaagcttgtccagagtgagggatgggagagccaggaatcagggaagacatctccccaacgaagccacaccttcgccacacccccggcccttcccctgctttggctgatggtttcaaatgtttattcagcacctacaacgtgctagacacagtctgaggccctctctgccatctctcttgagcatcaccccaaaccaaggaagtaggcattatttctcccattttacagatgaggaaatggaggcccagaaagacaaccagttttttgaaacagatcttctacatgatttgccttaaaagatctctcctttccttgcccagcaccccacctttccccagcctaaggcagaaggagcagagatcatggagataattctgttaccctccggcggaaaactatggcacagagaatgttccaaggaccattgtggtaatcacagcaagacagcccttggtgatctgatcccgcattcacccagatagggtgagagaattagaaatcagagaacatccccattctgacacaaaaggcccctgaattggatttccctggtggcccagtggttgagaatccacctggcaatgcaggggacatgagtttgattccttggcccaggaatattcctcacacctcagggaaactaagtctgtgtgccgcaacgactgagcctgtgctctagagcccctgagctgcaaccactgaagcctgtaccctctagagcccgtgctctgcaacaggagaagccagcacaatgaaaagcccttgcaccacagcgagagagcagtccctgctggccccaactagagaaagcccgtgcataacaaggaagacccattgcagttataaataaataaattaatttaaaaaaaagaggcccctgaattactagatcccagggtgcagattcagggtctggcgtgaaggcaaagactgatgggggtggggagtaaagagtacatgaaagcagcaggtaagtcctcagccatgccagtgatcaaaaccttaagacttggggattctggtcctgagggtctatggcaggggtctccatccacccccaccccaagcacaagaatggcctcaagatgcggtggggtggcacagaaagttctgtggccttaggtccctccactggccttggccccggaaaaccggtagggagtaaacactgccaagactgacagggtggaatcaatggctgccctgagcaagggggcgggggctcaggaagggagacccttgaacctttgcttggaaacaggctccctgttcccttcccccctccccctggctggcccagcctggaagcagccacttgaaatgggtcccagggagcctggga

SEQ ID NO: 35155 - DNA, 1160 bp, Bovine  19866880809608
aacccacccaggatcaggctcccagctcccccaggtctgctgacctctgcccaggacctcattggcacaggcgcacagtctagggaggcatccagttaccacacaaaccaaccatccatagttctacagcctaaccatcaccacccagcacacccacagacacctcccacagccgaccagggtcctctccaccttactactgccgcttccgacctgctgaccctcgtgaccccagtttgctcagattccgggtcccctcacccacatatcgtgcagcccccacccctgtccactctggaccccttatctaaccactccccctacacttgcgctcccttaggcccctttcccagaggtgtgtgtgtgtgtgtgtgtgaggggaacatctgtattctcagcacaaactactttctgcgccccagaaaaagggttggttattggggtagggagcaaaatcaaggtgcccctgggttctagctgttggagacatgcagggcggggtgagtggacttccttggacctggaggctcagaagggtggggaggagggggtccccgcagcgactggcaggggcggaggggaggcgcgcggccccagcccgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaataaggaactgcgcctcctggtctcacccggcgccgcccgctggccccccgggccggggaaggcggagcggggaaagcagagctagccggatagcgcagaggggcccagcctgtccgcgcgccggcggggtcccgggccggagagcagaacctgcccgcgtcccgggacttggcaagcagggccgaggccccagacccagccgtgaaggaagaggcagagccaggtcgcttctccagggcagcggggaagcgaaagtgggtccgcagagaggccagaatcctgagtacgcaggcccgcgacggcccggggcggtaaagtaactcgggcaacagggctggcggcctggagggtcccaaaccttaacgaacctcgccccga

SEQ ID NO: 35156 - DNA, 2107 bp, Bovine  19866880885778
tccatttctccccaggccttagcgaaccctctgctccctggcgtcactgcagggccattctgaggctcctggacactttccaggtgtgggtggtgtaactccaaatgtcaaatattagctccaggtcctcttttgtcttctggttctcgcccacaattcctttccactcaacctcccactgagtgttctcaggagaagggagcccaggcccagggctgcctgaacccaggggaggtagggaggtgctttgagattgttgaagctgttcagagtgaccaggagtggcctgcaccctcagaagccctggacactcacttctaagggcaataagaggtgaggggagacagagtattgacttccagcatgactagggttgagggtgagcccaaagcaaaatttcctctccaattctctgtgcttggtgtgtgtggggagtggtaagtgggtttggcagggtccagagctaaaggacccccagaaggggtctgagaatccctgtgacccagcctagtcctcttcttgcccccagagaggtcccaagccccttcctagaaaagttaccacagttataattgcacagaccatgtattaggacctcttgaaaactggggagtgaagaggggattatggttggaggagacaggagcttgtagactttatgctaacccatacccactaaaatcagattttcaaggaactttaaattgcacaaagaatattcacaggagatgatgataagcaaaaaaatagaatacaaagtattaggtacagaataatcccatttatgcagcaaaaaaaattttatagattaaacaaaatgatgagaataaaacaagcaaaagtagagacggtgatggtttctaggtggtaagaatacgtgtgatttgattttctttatatttctctatagtttccaaatttctaccaccaacatatacatttataattcagaagttacgaaaaagattaagaagatgactctgaagtcaagctggcaccccaaatgcagacccagaatttggcagccctttgcctgctccctgggtcttctttggtgatcctgggctggcttcttttatggcagcccatgggggaggggctgaggcccagcagctgggagtcagctgtgcttggagacaatcccgtgtccaatgggatagggtggagtggggaaggggggctcatttccgagctggacaggagccaggttttagggaccaaacttgccaatcagctacctgaggcaccagtaattcataactccttttcagcctttgcccaagggtctccactccctactccagtgcctggctttcagctatatgagaagggattaaaggagcttcatctgtggttctgaggttcagtgagaacctggatttatggacatacattcaggcctatattcacccctttccctggcttcagctccctcctgcttctggattcccaaggccatggactctgtctggggaaaagaatggcaggttaaagctgggagggggccccacagaatctggctgaggggttttggaccaaagagtctcagttaatccaagcctgggggattagtaaaaatatggctaagaaattctagcctaccttcaactattcagttgtgttaaagaaaaaaaaaaaaaaaaacccacataaaaaaggctttttagaccatttatttatgagcatgtgtcaaagttttatttcagtcttgctgcaagtgaggagacctttaagaggccaattcaaggattacctcttggtagacatatttagaggaaagaagagtggttagcatcattgtttaaatggacatacaaaaatgatgtcgtggataaaatgcatcaaactctcactgacaaccgtagaggtagatgggaaactgacttctaagaagaaatctgcatctgcttaaaatctatcagaaaagtttgagtatttttattcagaatgctggtttttctccccacccccacccccgcccctgcaaatggattatattgagcaaaaaggctctcttacagaaaggtttggtgtcttttcatcttacagttggaaacattgacctggctccttctccaaggctggaggctcaagcatgaagcaatca

SEQ ID NO: 35157 - DNA, 2215 bp, Bovine  19866880971904
tggcctggtcacccggtgggtctggggttggggtagcccctccactttggaagtcctttggactcagaatcctcctctcctgcccagatcctggctcaaagaggagcacagataagggtggacaagcagtgccccttccatcactcagccaaatttcctcctgggcctccttgggttggaggttgccgtgctttgtcctgtgatatggcagagccaagagggcagtctaggccaggatgagtactctgatggtttccataactctcctgccctcaaccccagtctgggtgaacacagctctgcatacacgaacaagtcccacaacctactctcttccagtttttagccataaagttctctcactcttccaccctaaagaaagagccccctatgtccccactctactaccccaggatggcatgtttcctaaagcctttaccatctggcttcttccagaaaagcaggcttaagtcagttttgtatgtcctgacattggtctggtaggtgggggactaaatgttatggggagtgttgtgtactgtggctgctgtcctggctagagtggtctggggcctccctgaaggtcctgggaagtcagtttttcagatccctcctaggccaggctagtctggaagctgggaagtcttggcttcaagcaccacagaagatcctggtccaattactcatagaatgctccaatctctgcagcttgctgggtaaggtcctagaaccccaaacttctagcagatgtgtatacccctacaatggatctgcacaccccaccatcatgtactccaccagtgtacaattaattatacccactaacacagcaccatacacactcactgcagggacatgtcatccacaatgatacatattccccattaattcactcccccaattatatacaatcctagacaagtatcactcatacaatgaaatacacctctaacacatgattacatacatacaattatagatgatatacagccataaacattcatacatttaacacaaaaatagattcataatgaaaaactaatacgtactctcacaaatattagcccctgattcactaataatcacggatgttggtgggtgattatacaactacccaaaaagccacatttacatatgatcacacacataccaatacaagtctgtatataaatggtagtttcgattcacaactgaagcaaaataagcacacacaactgcatacaaaatcacacacttgaacacttattatacaaacactcattgtcagtataacatcccgactgcccacaccatcacaaacacagagtgcacacacgtaactctcactcccaaagacaaatcttgagcactaactgttccgggagacactggctctcccaacttgtctcactgctgccttctcttcatttctcctcctccttctttcctctttccagaacctgacagtcctgaccccaagatgtccttcaaacttaagtatgaggggctgccctggctgcaccagctcacaccagacccaagtagctgcaaggtgctgggctcagcaaggagcaagcagccttgattccggattcagagggttttattattatttttcacataaattacacaagcactttataaaaaggttacacagaaaacaccttataagtgcataacttaaaccccaccccccccctacgaacaggatctggagaaataggctttttgtgtggaaacctgcctgtgcgtacctgggtgcggctagggtgtgtgataggggtctggcaggccaagtgacgctgttgtggctgttgtgtgtgcgatggtgtgtcacagtgtgactgtggccttgtatttgtgagaagtgccatgctgttcagaatgaatctgggccctgatcgtaagggccaagggagtgaaggctatgaccctgtgtgtgcaagacactctgccatagggcccctgtgactgtggggagacactaggagggacagtgaaatcacgtccgtgtgggccggctactaccaggagtggagaacagagagggtggtcttcccaaggcaagttcaaacgacagctcatgctgtcctctagggaccccaccagctcttcttccaccacctcttctgcctttctcagtcccacgttaaaaatcataataaaataaaatagacgctaacggaggactctgaacagttccagcaggcgcgggaccgcgtaggcatctgggaga

SEQ ID NO: 35158 - DNA, 1825 bp, Bovine  19866881128403
cctgtcatttctttttaatcttcacttaaatcttattcattttttaaggccaagatcacaccccagttcttacacaaagccttccctgaccattccagcactcactgagctcccatggcctatacctctgtatatccagaatatcagaaactatcagccttagaagagccacagagatcacaggttcaaccaaactctgatcaacctctaaaatcatattttccaagcttcagcattcaagtaccagcttcacaattcactccatatccgtatacccccaataatgttatttacttgatatttttctttaaatcaatttatgatttttttacttgagtatgtttattaaaaaaaaaaaaccctagagcactataacaactggaaaaccaatcattagttgtcaaaaatagaaagtaattataaaaattagtaaaataaaaaacaatgaaattcaattctagctggctaccactgcctgccgagaactcttaagcctagggtctcctctctctttgttaaaaaggaagggagagaaacacatgtcacagaggtattgaagacacaccagcaccaaactgagactttctctttgatacaactggaataatcagacaacccaaatgtccatcaatgggaaagcagtatctttgtgtgtgtgtgtgctaaaatgtatgtaatataaagcattatttttgttgttgttgttttggctgtgcagcgcagtttatgggattttagttccccaaccagggatcaaacccaggcccttggcaacgggagtgaggagttctaaccactggactgccagggaattgccaaaacattaccattaagaacatggctataaggagagtgatatcttcacaacaatctatagtatcctcacattatggaatgttattattttttaacttttttgcctgtactgcatgacttgtgggatcttagttcgctgaccagggattgaacctgggcccagggcagtgcaagcaccgagtcttaaccactgaaccctcatggaattcccacagagagtggaattttatactgtagccaaaacaaaggaacttaagtgacatgaaacagttggtatagatgactcattcaatacaatatgtaagatggtccaagaaaattatatagtatatagtctgatactattttttaataaaattaaaaacagtttaaaatttaaatatacttttcaggaatacatttaggtataaatatattaaactatatttactatactaaaagggaagcaagaaatgatgaatatgggattcagaatgtcatttgcctcaggtcagaggcagggaagggaacacaagggtcatttagttagtactgtcaaggcttgagattttgttttgagtgaaaaattcatggggtgtctatattattatttaaaagcaactaattaaaaagctaactaaatatatataatatggtggtctatgcaaggactaagatgagattgtgtcatgaacagaggaatgtgattaacctagttctgtgaacccaggatctaatggaaaagagaggaaaagaaagtaactctctcactatgggattcagtatgatttaatgtcttgtcaatgcaccattgaaagcacctggcattccaccagaggtctactttctgcacttgcagaaacagctctagaatatctctatcatgaggctgcttgcttcctctgcccttttgcttacctccagcatgagggagcttcatggacttccagagagacttacctggacagatccttttgtctggaaatattccctggtaggagagaattcagcctccctgcaatcctgccca

SEQ ID NO: 35159 - DNA, 1190 bp, Bovine  19866881149650
cagagacgacagctgccttatcccagcccaccgctgagaactggaccagtcctcccccagattccaaagccccccttcttctccgcagccacattgttctactgttacatcatcagcctgcaggggcaggacaggtgctggatagatcatggccatccctccagctgccccacacacatcctagacacttccacatggcatctgggagctccagtccaactctaggatgggagtactctggggtaactgcacttcctgtctgacttctattagcctctttcctctctcctgtggattacattcactctgacagccttgagtcagacacccttcccagctatcaggaagccaggctgctcccacttaccagcattacttatacctcctcctcacctctggtctcagagaaccacacgaactcatgtctccaccccgcagatctgatcctggttttgtcttcccttgcttgtgactcatttgacaaaagattctgtgtcctgagattctggtcttactcctagtctagaaacccttgaataggttggtgatgagaatatgagggtgtgtgtgtgtgcatgtacctgtgctcacttggtcattgcatgcccagggcacaggggacattattcatggagcaggacttggtaccaccctgccttccaaattagggaactgacatgcataaggaaaatgaaggagcaaccagggaagtaacctcccacagcaggaaggatgcctctcagtcctgcatgccttattcaaatgagattctgggaagtcattcttccatgatcatttactcagtaagccatcagagaggacccagtgacatggggtggagggagggaagaaggtactggaaatagccatgtaagactcagccactcattgtgattcagagcctgtccattccttctccctatgtgagaaggcagctggagacagggctcaaaggagaatggaccttcgaaaaagagaaagcctgtttccagggggcaaaggaagccattaggagctggaaggaggaggtctggttggagaagccaggcttcacaaaagtgcgtttccagccttagcaacaaagccagtgttagctatgcgactgtgatgagaatcacctaaaccctctggaattcagatctcccattggttaaaaaaaaaaaaaatgggggtgtccttttcagctataa

SEQ ID NO: 35160 - DNA, 908 bp, Bovine  19866881149898
taaatgtgcatgctcaactttgaaaatgttgactcagtttgaccagaccatgcaaaactgttgagtcacaggaaaaggatcctttttttttttaactggaagataattattttacaatattgtgatggtttctgccatacatcagcataaatcagccacaggcttatccttaaacctcctccttaaaccttcccgataccacccctctaggttgtcacagagctttgggttccttgcatcatacagcaaattcccactggctgtctattttacatatgatagtgtatatgtttcgatactactctctcaagtcatctcactctttccctcccccactgtgaccaaaagtctgttctttatgtctgcatctcttttgctgccttgcaagtaggacgatcagtaccatctctgtagattccatatatatgtgttattatgtgatgtttgtctttctggaaggattgttttaattcagatgatgtggctacagcaaaggatgctgggtgacagcatccttttgcatcagcatgagggagactagttcagatgaggagggttaagttaaaatttgttgaagaacagataatcctgcttcttacccctcctcactttttcctgtagatgcttgtactaaagaaggaatgagttatagaatatagtgtgctttccactgtgaatcacagcttggagctcacaggttatcatacctttccttttttcagccactgacccatgagataatttttaaatataatgacagtatgaaatgggtcctagatagatgagcaacataagatgaaacaaggcataaaggatcaataaggtaagaaatttcttggtaagaaattacgtaggaggactcacacattctaacctgtcacttcttgaaccctgttttgacatgactg

SEQ ID NO: 35161 - DNA, 770 bp, Bovine  19866881160979
aagaaacaggacaggtgacctgggaagctttgcagcagaaaggcgctttagaaaataatccccagggggaaaagactagaagcccagagcacaggaagctaggagccagcaggcaggggaggagagagaagaggggaggaaagatatccctttccacggatgtgccttggccccagcccaggcaaaggggggcagattttctgtctagtcccaagcccctgcatctgccaccttgtttacctcgtgcctatttatagttgcaggctccaagcccggcatgggactctgcaatttatgtgactataaacctccaaagggcactggatgctggcagggcatggataaagacaggggcaggcctctcaaggtcaaaatggccaccctcccaaccctgttgaccttacactccactaaagagcaagaggtcataagactaggctcaggcaaagaagccatgcgtggaaagacacagtcacctctttgcctcttcctaccctgagctggttcagtttaggattgcaagcaagttagagaggacctgtttggtttggttttccctttgggaggtcgttgggaagctctggataggagggtggatctcatcaggggatgactgattttggagagagtggctgaatctagctttctgggagggaggggagaaaggagctctgccacccaactctcacctgcccatcctcttaacatcagaagagaagaaaaatcctgatggctcagacagtaaagaatttgcctgaaatgtgagttcg

SEQ ID NO: 35162 - DNA, 943 bp, Bovine  19866881308379
gcggcccattatccggcgtcgttaaagagcaattagatggaaattaagccgagaacaagtattgattatctcattaaggccgggggagccctgtctgtcggcgagagtttactgcggctcaccccattatctgcaaggtgaaagcctgcggtcatcaacacctagtgaagtatcgatctggtcccaaacccagtcccgccccttccccctagagtaagggttctaagaggtgacactaggggtgtgacaaggtggaggaagaactcgggccccccactctctctgtcttagctgttctctgtagctgccttcctttcttgctcccaaatcatttcacaccctggtgctggccaggggcggggctgtaggtgtagggactggagaggaaggtcagaggtagttcacaaccctccaggcctggagagatgagactcccctagttttacatccaaagaagagaaactagagttgagatttaatggaaagaatttgccccagctgacacagcgcatagggcacctccggaccccaagcccctggagggagggggaaaggcttcgtctggttgactaccatcaccaaaggcagagacacctgggaccaccccacagatttcccaatgcttagtaacctcagaattcagaagacgtttcctcaggatcccagatgatgtgacatttggagaaaaatcacagtgtgttggagatgagtttttttcatcccagctttgcttctagtttggttgtgtgaccttggacaagtcactttgcttctccgggtcacagaatcctctaaagaatggagtcgaaagagctctatggctcttgagtcctcagacaccataatctgaccgactaactgctgagctcctgcctggtaggggcttcccaggtgactcagtggtaaagaatccacttgccaatgcaggagactcaggttcaat

SEQ ID NO: 35163 - DNA, 775 bp, Bovine  19866881391762
gggtactctgggggagctgtagggagatccgctaggcccaagcagttggggctctctggctccaggcagggcccacaccctcactggccttggaaggcacaagcagggctagggtggcattttgcctctccccagactcgaggaagaccaggagccttcccaagtctgagcggtctcaccctccccatcagtccagggcagaggcagggaccagtggatgtgagctgccacgatggacctcttcaccccctttctctctgagaatctctcccagacttcagacctcctgtgccaagccctgtgccggccgggattcccgccggaccaactggcttcctccgaggcggtccagggaggcgatgactcacttattccatttaatgcctcccctccacccagtcaactgagatcaaacgtctgtctctaaggtggacagacctaatgggagtccctggggcctccagaagcaatttgtaggcgatcgatgaaggcgagcgaagccagcgagagggcctctcccagcagcagacgccgaccttcttctcgccgccctttcttgccttttcgctctgtctctcgtctgcccgttctttcctgaatttcaaactatttctcttctttaggctttgtgtctttttctctggtttttctctcaccccacccctttccttctctcagaatttaagggaatttgtttgaaacgaaaatgaaggtttccctaatctattgctttcctttattatacataagacttcttcgcctccagggaagtcca

SEQ ID NO: 35164 - DNA, 716 bp, Bovine  19866881557260
ctccccgtgtctcggtgtggaaggcagggtttgcctgcaggcctctgacctttaatgtctttctgttattgttagcatttgacagaactttgctgaagacttggggatgacagaaatcaacacagagaggagcttataattgctgctagaagggctactcactcttaagaccctccctagaacagaagtcagtccaacctgggatcttccaggtctaatgcctgggccagggacactgggccaggtacaaacatttcccccataaactgacctcctgtggccgcagtggcccctgtgagccaaggtctactctccccagtttcccccagagtgtaagcaagggtccaagagccagggggctgggtccaggcagagtaggtcatagtgggaaactaaagttacagggagaacaagaacacaggaaaccaaagggcttctggcagaacgattaagatctgcaaagacaaggatccgagggagagtgatcagaaaatggaaggggaggatctgaatccatcaccacaacccagctttccctgatgcttaccgaccatacccctggcccctgacggggttgggtgtcacactgcagaccgaggacagtggaccctcctaaccagctctattctttaaggagccccctcccttccatgggggcattgaggagctgtcttcacactatccttgcactccggctacaggatcaaccaaaggaa

SEQ ID NO: 35165 - DNA, 1985 bp, Bovine  19866881710307
ttgctggatactgttagcctttttaataaatgttaagagagagaaatattctctcaccttcctgcttgcacccaactgttgggtgctatgctctgacaacaccccatctcccccagtgaaaataataataataaaaggaaaggaaattcccaatcctactttgaagttctggctcccatgacattctccaggcataattcatgaggccctcgtgggatcgatagtatgtgtattttaaaaattaccttttctgttgttgttattcacttggagtcacggaggcatggagtgaagtctcatctgcactgctttacaaatgtgaattggaacagattcatgaacttctctggcccatgcttttttcaggcacagtggactctgccttcaatttcaacaagctactgtcagagtcagtataaagatgaaacattgtaagtgtcctaattcatccagtgtatctctgctttaccatctttcttattgcattgacacttacatgaaatgtttgtcatcgctacgggtctgggagtcattgaaactgaatatttgtcaaacccgcctcagtttcccagtcccagcaggtgaactcctcagacatactggatgccttctccttgcctccctaactcccctcctcttgagtcttcttcagagtccagctgagagggtatgaccaaggcattagaggtaagttctggaaaaatagaacatcgaacacagcagaaaagtgtggacagggtttcaggtgaggcaaacccgggacttccctggtggtccagtggttaagaatctgccttccagttcaggggtttggtccctggtcagggagctaagattccaccagctgcagggcaactgagccagtgtacggcagctactgagcccacgtgctctggagcccgtgtgccaccactagagagaagcctgtgcacctcagtgaagactccacatgcggcagctaagacccaacacagccagtaaatagataaataaaatagaaaagagaggcagccccttgcttcaggccttgccctggtacaggctggtcattaacacagccctggattcttcttggccttcaactcaaaagacattcatgcccaaagacctcagtaataagggaccagggaagggctgggcagcctgcacgctcagcataagtttcccggcctcagaggcctcccctcctttctccttcctccaccatccctctgaagtcagcgaaaccattgagcagcttctggaagaaggcctttgcctttggagaaggcagaagggcaaggggagctggcaagaccccctcctaggcctcctggagcctctctcccctcccccaacctctccaccaaggcctaatagtctttagctcaaaaggccattaggtctgggggcccggggcctgaaggatgggagaggggagccatgcttaaccatattctccagtccccttaaaactagggttacccctggccagaccagcacatacttatcaccaactttgacctgccattcttgccctgggctgcaagtgactttgctgaattctgcaaattggtctgaatctggagcacttcggacttcccacagcatcccttcacttggtttcaaagcctcagacttgattgtctttcctcttttcactttctgtccaccctacctctcttgtcccgccttcccgctgcttcttttcttcgtgttcttggtacaggaaatcttcctcagcagaccttctgcccactttgtacatgtgtgcacacaaacacacacaaattcaggggtacatgtagacgttcactctcaaaaacacaaacacaaacctttgagcttaagacatcaggctgtcattgaagccccgggttcacctactcacacatgcatctctggtatcttccacccaaaaagcatgcactcagagatgtatccaaccacacacattggcctgttcacaccaaaggacacacaaacacaaatatgcatccactcaa

SEQ ID NO: 35166 - DNA, 904 bp, Bovine  19866882052535
aggtggggatagcgtcaagtatatgtgtgtgtgttcaccacacagatgctcagggacacagcaggtgctcagatgtacagacacacgccaccttggagccagatactcaccagacacagatttcatactcacacaggctaacacacagaggctcacgctgttgtgactcagaagtgcttccctggaagctgcgggctctgcaaggatggggacttgggggagatgaaccagagactctctctccagccagaaaccctggtctgcccctgccagcctcccctgatgcccgtccaccttgaccagggcaatgatgttccttttcccttttctttgagcaactcctcctgccccagggctgagatttggaagcattggcctgtggttagaatgacttacagcaggctcccagccaggctgggagagagaggggagttcttatgccacagcccctagtcctccagaaggtctctgtgcccagccgtcagctcagctccccgaagaaccccccacccccacccttggcctcctgacaagcccttgggttctgaggggaggcatggccacaagcacagaggtcacggaagaggaggaggaggaaagggaggaaggagctgataggagccagggctgggaggagcagggcagggcgaaatcacttaaccccgaagccgccactggtccttggaacccccggtactgatgggggccagctggagctggctgaggacgagaggcctcagtgtgggaatccagggagggggttactggggtcagctgggagggggacaccccaagccttcgtcccctgcctgcctggctgccaccatcactgcggaggatctggagccagaacctggctccccagactctgttgctgacagggaactttttctagccttcatca

SEQ ID NO: 35167 - DNA, 1501 bp, Bovine  19866880406664
tggtgggaggtgggaatggaccgccccaggcagtctgtcctgccgtgaagagccgcggacaggagctgcagggccaggccttcctggcctcgggcactggccggcctgggcctgccctggcagcacagtgtcctgaaggcaggggcggggatggtcaggctgccagtctcagcgtggtcactcgatctccaggatgaggtcgtcaccctccagcgtcatgtccttagtcacgtggaccttgcggacagtgccctccacaggcgaggtcactacagtctccatcttcatggcactgagcacacacaggggttggcccttggtcaccttggcccctgctgccaccttgatgtctatcaccttcccgggcatgggtgccccaatctggcccttgacgtccttcagggccttggggtggaagtgcatctcctgcaggcagggcggacagcacgtgaggcctcagccctgcccgtccccaccacctggctggcccggggcagctgtaccttcatggcctgggtgtccttgaccaggatggaccgcagctgtccgttgagctcgaagaagacctgcctctggcccgcccggttgaggtcacttatggccaaggctttgatgtgcagcgtcttgcctcgctccagctccacctgcagggaggccgccgggaggctcagagctgggcagggcgaggggcaggcggggagagcagcccctgacccagtcccaggcaggccacccacctccccgagtctcagctccacacttgtaaagacctagctccccagtctcttaagggtactgtgtgaacccccagctcacgaggccaagggacaggcacatcagagccctggcaccctggaagtgctggggtccctaggggtggccgctgtgcagcgcaggtaggtgccagagccactgacctcaaactcctctgcaatcttgggtccctgcaggaagaggcgtgtattgaggctgtccagggggccgaaggtggcagtgaagtccttgaagtgggcaaagacgtcggggtacatggcggctgagagcacgtcctccggggtcacctcctccccgtgccgttccgtcagctccttctccagcgcctgcaggtccaggggtgggagggaggctcctggccggccctccaaccctcggcaggtctttcagcacctgggatgcagagcggatggtcaggcctggctcccagacgcccttgcactgcgccgccccccatggagccgggccttcctgaccttggagcgaaggggctctgggaagcccccgtgggggatgccgatgtagccctgcaggaactccaccaccgagcgggggaaggacagctcctctgcctgcgcttcggcctcagctcgggtcagcccgttctgcaccatgaactgggccaggtcccccacgatcttggaggagggcgtcacctgaggagaggggacccctgggtttagggggccaggcaccttacggagaccccgtggcaagggtgggcgca

SEQ ID NO: 35168 - DNA, 863 bp, Bovine  19866880509406
cccacctgccgtgtcccagatttggaggtggacgggtttgcccttcacctgcagattcacgccgagccgctcaaacaccgtgggggtgtagctctggggaagaaggggttgggggtggttaagagggcagcttctgaagggcggtggtcctggcaaccaggtcagagcccacaaatgcgcgcggcacagcccctttggcagtcagcagagcggatggtttctgggagggagctggctggtggcgttgcagccactttgcagctgtgtgccccctgccccgtcgaggcactgaacctccctgggcccctccgagactgtagagtgggtctcctggagcacccaccgcaggtgctgctgtaaggagcttcacatggagccccgagcccagggcctggtacagactaacattctacaggtgccaggaccgctatttttatctttgtcctcatccagactgtcccatttctgagccttccttcctgctgtccccgcctcctagaatgacattaacctacgtttgttcattcacttattcattcattcattcattcacgagcaccttctccgggtctgattttggacattcaggaacaagtaatagagactcactgcctagcctggggagctcctagctttcgggggtgggggagtcccctcttttgcctctcaacctctcataatccaaccaggatgctcccatttctgtctctcttacctgccctgcctggccccaggtggaggtcacccggccaggggcccctccaccccaggcccgctaagcctgagcttgccccctctccacaaaggccagatgagtgggagcaggaggggcttttacacaagtgcaggaaggaagaggggag

SEQ ID NO: 35169 - DNA, 1357 bp, Bovine  19866880537998
cggggtgcggtgccacgtgggaccaggctccgtcccgctcccaatctccctggggtgagaaattcaggtccattcaaaatgtgtgctaggcagtgcgagttcccctcccccacttcgcactgctgccgcggagtaggactctgcccatttcctccgcccctagagcactgaactgtccacaaacagggactttccactttcagcaaaacagactgcacagaaagatccacaattgttcaagagtagaacagggacctaactatcaccaaaagcagtctacctgctagatttctgtgggggacaaggaagggtaggtgggtaaattgtgtctgtgttggggcgggggtggagggtgtggggtgtgggggcagctgttcacagaggcacgactcagttactagggtctgcgtgggtgtggagggaaatgcagatttccttccaagccctatttcactggggccatacaaccaagcacgccctgctttcatcaaaaaaggcagactccagctgaggcccttcaagaaaccatataaagaagccaccacccttcaccagagggggtttgggacagggagtgggggtggagtgcggaaaggcttacgcctatctagcctcctggcatgagagaatgttcaagcgcaagcccacacccgccacagcccaggaaggcgacgagaaccgcgggcgcctgggcggagaaggggaagagactcccaaaggcaaacgacccaattcgaaagcacatcccaccgggagagggaacaagtgcagtgacgacggcaccaccgatacctcagcactatcccggactcgccgccaggcagttctcctgcctctctgccgccgagactggtccctgcagttccacacaccacacaccccagaccaagagggctctgccgcccgcccgcccgtctgaccttgtgtttcccgtcctctggagctgccgaggctcttggatgaagtttccccagcgtctttgttttgctttctgtattggaagttgtgctgaaggagttaggtgttctgcctctagtaaaaatcccagtttattgaaaaaaaatctgaaatctcccagggcacttaaggcagggcaatcgggcgatcacctttcaggctacccggagggagcggcgcgcagcgccctgcgctccttctcgagccccagagctcagccgcggcttcctgtgcctgcgaacaatgctgctgcgtcacccacatgcagctcccagaaatgctttgcaacggaagatggcaggaggggagccgagctcgagtgagcgagccagcagagggcccagcgtcctgcggcagagtcaggaggggggcgtgctgggcagcgctcccggcgcggcga

SEQ ID NO: 35170 - DNA, 838 bp, Bovine  19866880556634
aaaaaaggccagcagtccgatttttggaaaatataagcagtctttgtctgttcccagcgctcttggttttcacaagaccgtggtgtctggctccctgctggccccagttggcagctagcctgcctcagcaggaggcccaacttctggaagggtgtggcttgggaggcctgtcatggggagacgggtgtggctcctcaggacctcaggaagcccccctgtagggccaggcagcctctgaggagaccccttgagtccatgtggagggcaggcagctgggcagagggacctggggaggctgcagccgagcacaggggtggctctgttggctggctgaagcagcaccggacgcgtgtccccaaaacgatgcaggcgggggcagtggacttgcccccttcccccggtggccctccgtgtggcagcgcagcccttgacagcctcctgctcttgaggttgccccccctgcaggaaacgccactgattgcaccgaccctggcgcctctcctcagcctgaattccgaggcccctgatggtctgagagcgcgccctggccgggcatggtcctggctccgtgcagcggcccgcctgcatttcagacgttgatatgcctccctgctccacccagaggccggccagccgctgcccccgtttcgcagccaggttcctggctcagggactgcgttgcccagagctcaggccagtgctcagcatggggattcctttgcccggggatttttctcagatgacccttcaagacccataagctcttctccatcctgagatttttccatgtcctcacatatcctaggtcttgggccagcagggctgttttccaccccga

SEQ ID NO: 35171 - DNA, 1721 bp, Bovine  19866880580343
aatgttccttatctgacactttgggagtgattctgacactaacaaagagaagagctgatagagagcccagtataattggattttaatccatcaagccagatgaggagggaaaaaaagaacctgtataaataaaacttcatttgtagtttttactgatatttgtaataattactgagtaaaaagttttgaataactcacctacaaggcatataaagctagattaaaatagagacagttctttaaaaatgttttcatatagtcctgtattatgtaatgttatgttcttactaattctcatcattgttgcctaccttttattctgaatgaaaaggagaaaaagaatgggccttatttataatgtgtgatttgggaacttacttgaaatgagtttcctagtgccctgatttttgttctttcctggtggcctctagaatttgtgcttgctacaacttagacttgtgtttagttttggagtaacttgtttctcttaagtatttgagcatactgtatcatccctctaggttagatagcactaagacctaaataagcattttccaagaggacctctcacaatgttaaggaaggtttttctaacataataggctaattacagagagtccttgaatcgtaaaagtacaagtttaggattagaatgaccattcacacatttccaggaagagctccacagaacagtacaaaagtctctccttcccttggtaaactaatgtcagaagcaaacgtgctgcccctggcaccagagccccaggcctcagagagcctactcggccatttgactgtgcaggagaaactcaccgaaacagctgtcctggaataagctagaataaataagcatgtttccattggtaagagctaggttctcagtggcctgaggtgtttatttcagagccacttctgtaatttcccaaaaagccaagttacatttattagagtctaaaagttacataaatctggccccaatatactgaatgctgaagcctgagaaaagagtgctccttcagtctgagtttaaccctgactgtggatcggtgagtgcagagtaggtgacacgtgtcacctgagtggctgtcaaaagtggcaccaagatgtgtgaccttatgggagattggttgcttcatcaggcaatgtcaaacgacaagaataggaagagtgcgggggtgctggtatcctgaggatggagtggtgagaggcagagtccgcgctgttaactgaggccccaggagagcggcaggtgtggagtcggaggcggtgctggtcctaggttcccgggttaggttcccggtgcctgatgccaagcaggggagtgaagctcctgagggtgcacctcagccggtctcacttgatcacgagggagcctcccgcagcggggcggctctcacggtgtgggctggggcagaggccgccgcagttgtggaagtagctgagatgaacagacggatggtatcgggtcccctccgtgttggtgggtatgcgtcatgcccaaggtgtttctggaaacgtgtgctggttctgaattccggcctaggggaggggcagcgggggcaggtgaggctggccggcggtggggagagaacgcaactccagaggcgctcggctccgggccgggctctgctgcagaggctgaacttcaggcgactcgctgtctgcccgggcacggggagagccctgtgcgcagcccgggggagcgcggccgtgacggggag

SEQ ID NO: 35172 - DNA, 1313 bp, Bovine  19866880617686
gggagccataggcctagaactgaggagggtcccactggtatcagcactagccctttattcttttttttttaaatttatttatttggctgtgctgggtcttagttttggcatgcaggatcttttagtcgtgggatccttagcagtaagaaggatctttagttgtggcatgtaaactcagtttaggcacgtggatctagttccctgaccagggattgaacccaggcccctgcactgggagcgtggagtcttagccactggaccgctggggaagcccctggtctcgagttcttacctgcatgaagagcttgccactgccatggcccagcagctcgtgcagccccacctgcacgtcaaaggagggtcccttccagcggatgtacaggtcctgccaagacaagcagagacccacgctgcccactgccccaccacggtcacacagcctgcccacagcccccgtgccagcccgagggcccattgtgaggcacacatctgctaaaggtctaccacctgccagtcctactctgggcactgcagagcccatctcatcctggcaacaacccacgaggaaggggcttcctccaccaccggctggggaaacaggctccaaggacccgaggtcacaccgcggggaagcagcagagccgggcctgaagccccgtccttttccctgttctggcctgttccgccctcctgcgtcagctgaggtcaggccaggccccacgccagtgcgcaccttgtcctcctcctccaggaaggtgagtttctcccgctgcgtggcgtaggccacggccagcacattccccagggacacgttcttaaagccttctgtctgcctcaggtcatcatctggagaaggtgggaaggagaccagggagaaaagggcaagggcaaaggtcaagggtcacaggcaaggagtctaaccagagggacaggctgggaatgtaagtggagcagggtgctatgtggccagggcgagtgtgtggagggggagggggtgactctcagtggcgtctcctagggggtttggggagcccctgtcttgttcaggtggggatagggggcgggcaggaccctccggggaagctcacagttggggatgttgatgccggcgggaatgccggagccagcgaaggtgagaacatccagggaggtgaagtcgggggtgaggaacttgtccttctcgaaggctgggggccagggcagctccttcagcagctgctccgcacttgccaccagccactcaaacttggcactcatggccttgttcaccatggccacgaagcctgtgggggaaagagtgggctgtgagtggg

SEQ ID NO: 35173 - DNA, 777 bp, Bovine  19866880671955
gtgtctgagacacagaggatcaagtccgcctccggatctgtggtctgccacagactgtacgtggcattggacaggtccccttgcctgacttggccctctctgtaaaatggccgtaacggcattttcctgttgggcctgattgaagcagaattagatctggtgtgggggccagattgttgtacagaacaatctaagtgtgttaagagtgtcggcatgggccctcatttacagccaggaaatgagcagagagaggctgagtgacctgctcagagcttgccccctccgcagagccccaggctcagagtaaggagccctgtgaggggctggagccctcccctcactcctgagctgcccctgacaccacccaccctccctccaggtccgaaagctggtacccagccgtgaccagatgctgcaggaggagctgacgcggcagcaggtgaacgagaggctccggcggcagtttgcagcccaggccaacgccatcgggccctggatccaggggaaggtggaggtaaggcttggatcagggagccaacctgggagacgggggccgggggccaccaggggctggaagccttcatcctgcccggtccccctgtaggaagtggggcgcctagccgcggggatggccggctctctggaggagcagatggcgggcctgcggcagcaggagcagaatatcatcaactacaagagcaacatcgaccggctggagggagaccaccagctgctgcaggagagtctggtgtttgacaacaagcacacggtctacag

SEQ ID NO: 35174 - DNA, 3215 bp, Bovine  19866880703296
tctgtgtacagactttggcagagcttaactaatggacaatgactagaaaggcagcctactatagaggctgaccactcagtgagccccattaccgccagtacaagggtagcagccccagacccaccccagacgatctgaaacaaggtccgaacctcagagaacagactgatgaggtgagaagactttagtcttgttccaggaataaatcatttaaaacttctccaatgaaggtcaagttagagctgacagatcaagctacaaggacctgaaggatattgtgagcccatattcccacccccttttcccaaaacacacattaaatgtctatcctcccattcactcaacccaaccgtcttcaagttataggaccctggaaatcagaaacccacaaaaagcaaagtaggagaagctggctataggattaacacaggtagcataatttaaataaaaaaggggaagagaattttaaaacaatctgcaaggaagaggaaaatgacaagtgatttggctttagagctcttcagagcttaaaccagaagcctggcagcagaggcagcaagggcatcagtacctagagatgacaagttggggtgatcatctcggccaggttgctctgaagaactaaagctgtaataaagaaatatcaatactggccctgagagcacattaggctatttttcacacgaactgtgggactgggacagtggctgaacgctcactgtagagaaagatgacagaaaatcacactgacaaagaaagaagtaattacaaatacacaggccacaatcacagcactacaattaaacaacccttgatttcccagggaaataaccagagctaagtctgttaggttggccctgtgataactcccactctcactgcagaaaactgacaagaaacctattagattccccctcttcccagtccttaaaagaaacggaaagcagcagcaaagcagtgagcagaaagaaaagtgagagccatggcctcagcaccccttgagatcactccagtttgcatccgcaagtagttcatacttaacacagagcctgtgcttttggcccactgggcagagggaagagaacacctggggcaaactactgtgtcataagcaagttcgcaagaaaccagtggaggcagaagagaaccaacctgaactccacttgacaacacacctcccccaaatcaccgtgcccaaagactcccaaatcaaatctctaaagcccctttcccaaaggaatgttaggaggtttcccgttaccaccctacccaaccagtcttccattcacccatcaggaaggccaagcttccatcttgtcatggctagaatcatcttattttgtgcccaggtcctctgaacccctagtcccagagtaaaagtataggaagactcaattccttaccctgtcccagcacccttcttagttatgtttgcaccttgcccccttcccatggtctaccgtaacaccttcaaatataaacccagccagaaaacatctggaaaccctaacagatggagagaaggaatttgcagtcgccggtgactatgatggcaggggttggcaggacgcaggcaggacactccaggatgatgttcaacaggcaaaataccaggtctatggccagaatccccccatattggcttccaaatgtcccaaccacagagacaccgccacagttaacgtgaccgcctgaacccaactgacccttttccaggtcccagccccagtactcactggagcccactgcctgaaggccctactagtcttctaagcaccaaaggagcccattccccacttctcacctgagaagtcaaaccccagaaccaccctgctggagtccaggttgtttctgaactggagacaagtcaaggaaacagccaagcatgggtgaggaaaatgggcaataaatttactgcattttggtgtgattaacccaagtcgaagcaactttgtccagattctccagtccttaagatggcagactagcagagaaaggagttaaatccctctggcagcagggaaatcattctaattcccaggttcagacccctttcctcatctgccctgggtcctctggccaccttcccttcagctgtcatgtattcctggatgtcaaactggcttctctgaaactgagtgcaatcaagacaatgacaaccaggtttccaaactgcaaatcgccccaagttttatttgtagtccatacaaaagggaaaaaaaattaaggttttctaacaccacctacttggggagatggggaagtgcactgtggcgcacagcatcagctagaacgtcaggggtcagtagggactggacatgtaccaaccgactgtcccaacaggaactcagtctcaacacagtctatagagggacacagtcagggccccctggacacctggcacagcttggcgcataggaaatggttaagctaaccctttcctggcctccctcacatctaaaaagaaaaaggcgccgccgacctcagctgcaggttgcttccccatccagacgaccttaaatatcgcgcacaaaaataaaagggagccaggaaaaaaaatcaaaacataaaagagattcccatcctagggagatggggcaggggagaggggaaccgcagatctagagccagtagcaagatttgctgctgaggcgaaggaacaaagtaggttactgccgaacactcaaaaggatagtctcctggggaaggcccacatggtagaggggatgaaaaaccaccaacaggagaggtatgggccagcagttataacctggatctgcacccgaccccatctctcctctccttccctccctgtggtgccccatcgcaggacggccctacatgcggcgctggtagccagagtgcatctgagctgcccgcaggtaatcattataggagcccgaatagcgtgcgtaatcggaatgggcatcgggcaggcgacggtaatccagcgaggactttgtcggcgagcggcggaacgaaagctgcgactctgataaacggcggtaatcagagagctcggctaaacgccggtcggaaccatacctagtcgagagaagaagacagttggtgaatgagacaatcgaggggagggctccaggtgggcactggggaaatgccaatgggggcagggagggcgtaatcagactggtctccaacaaacaagatttttcagaaggctcatcaccttatccaggccaagaaatcaagcctgg

SEQ ID NO: 35175 - DNA, 2298 bp, Bovine  19866880733669
atttaattgacaatcaaagctggaacacattagagacacagaaaaaataagccttgtcaacacagaaatgacagttaaagccttaaaactagaagattatctgaagtaaacgtagaataatgacgaagaataataaagggaagaaaggcatattggtgactaaactttaggcaataccctctgtgttaccaaagaagaactacatagtacttatcacacaatattttattttcacactgtattttgttataatgtccttgtggcaaggcagagattcaataaaggtttactggacaaaagtacagatcattagggacagagaagaaagaaaattttaaaagaacataaactattagagaggtaggaaccagggagattatcttggtcatagtttattgctgttgctgttgctcagtcactaagctgcgtccgattctttgcaaccccatggactgcagcatatcaggctcctctgtcttccactatctcctggagcttgctcaaattcatgtccattgagtcagtgatgctatctaatcatctcatctgttgtttattaatccagcataaagaaaacacccagaaataggagccctgtttgtataggaattgatctaatgtattcaagagccagagaaaaagttcccctagagagaggggagaccttatttttggacactgaaagaaatcatctgagcaatgaaaaggatttaacagctaacaaattgaattcggaggcatactattaattttgtacaggtatgtgattctttatcaccaggaaatctgatggttaatccatcagccaccagagacatactgatgaagttaattaatagtgaaaagatctgtgaaaggaccaatttaaagcagtttgctaatgttatagtaatgttaaataacaatagtaataaaggcataattaatggtacataaaccagagagctaagggattcaaatcttaatcttagaccatttcctttgtgagcttcactgagttatttttgttactaattagtaagaataaatagcattatcgagtggaagctaatattatgaggcctaacagctgcagagaagacaggctacagttggccactaaatgtgatgacggtgagcaaatgactcaacttttattgtgtacttgatgtgcagtgcttcctttttatacaaacgttagccacctcaactttatcacaaggatatgaaaatagtttaaataaatatgcacaaaatttgttaaaataacaaatttaaataaaaaagacacaaactgtctaaagtttgtattagcataataaatagatggttattccataaactatactcaacaccttctcccgaatgttaacaattaccataaaaccatttccttgtacttagatggctcttcacttttttcaaagcactttcacaaatattagtcaaagattagtcaaagatcatacattatgtatgatctaaccactcgttgtgccattcaggtttatgttgcaggaaacagtctttctcctctctggtgttaatgacatattctcttttatttttatgaattttcatttctttcaaagcactttcacacacttaaatggagcagcagcattaagaatgatctttccactctttgcatcatctcaatggcataatccaaaaaagcagagaactaaaagactgataaatggactggatgattttgaggcagtcaattcatgattcttaaagttgaatttagatttcctaaaagtcttagaattgcagcaaactctccaggacagtaagccaatcctctctttcttccaggcattggctttggaaggcagtataattaaataattaagatatcttaaatgtgggattaaggggagaaaccaaatatatcatgtttaccagtgtaacccctctatgtcaagcacatagctaagtaaacagtaagtactcaataaatcatcattttgattgtcactacagggagaaaaatctacccaagctcccacagaatatctcctatagagtgaagaacaaaaatctcaatttatttttttattacatttccttaataattactgcttttaaatgtgtgcacatcaagcagaatataaacaaattaaaaccacagagcaaaaagctgaagtctatttagagatcccagggtacagacaggtgggaaaatatcaatagattcagagggccaagaaaatttcaaagggcaagtgggaatacaccctgatgaccctgaaattaacaaacaagcactttaaaatccccatggttaaactaaaaattacttcaaaaaagaat

SEQ ID NO: 35176 - DNA, 1761 bp, Bovine  19866880769197
atcagcaggttgctctctctataacagaccttgttctggatgcagctatgcggtaggaggcctcgtgctccaccatcctgttggaaacagcccgattcaggacggcagccagaacagcgccatgcactgaccctgagaggggagcgggttagtgcggtaacatcactttagtcaaactcagttctgcccgacgtccaacattcccaccaccccagtttctagtagctgctgcctcaaacttaaaaccctttctttagcagaaacaaaggtgctcaggtttttacttccagctgctagtagagaggcagcacccaccataaacactcataagtcagcaagataccaaacagcaatttaatatgaaagcagcatttagccatcccattattttcagagatacagatactcccattcttagaagttattacaggtcaaatgctaactgtgcttagaacagaagcacacggagttttgccccaacttatatcccaaatgtagaactccctataatttgtactggagggattacaagctacttggctttcaaacatgcatggtgacattaaacttgtgtgatagacacaaactgtttcaattctgaagtcagtgtaaccatgccaatctaaaaagcagccaatccagagacctagaagtacattttcaaggaaaatatgtaacttagtcctttacagattatgggtccattttttttgagaaacaaaacccagtgatttttcccccttgatgtttctattactacatacaatctccaccactgcttttagagtggaattcagaagtttataaacatctgtagtagctgtaaaaaggattcaggtaaaccactctttaaaaaagatctacaacagaagtgatagatttttttcacatgatctttccaaaggtggtaaccaggcatttaatttaaatttcctaaaattcttatgataattgaaatatactgtgcttctttatttccttaaggaactaatgcaaagaaaactgaaagaagattaaattctactactctactacacttggagaggccaaaagcttaaaaattttctgaaatctccaaaaaaattactgagggtatgttgcccacatttcccagaaaaccagcctccaccgcccacaagtgttttcttttgaaagaaagaggtgggcaacctgagatcctcaatgctgagctcctaccaagtaacaggacccagagattagggatatagcttgatatacaactgtactccaatttaatgtttatttacacattggttaaaaacaaaacacataaactcatataaccagcttcccagctcagctgcctgagttattacttgggaatagcttcttcagggtctttcaatgcaaactgcttgctaagtcagtagcggttcagttcactgctgtttatggggaggaaacagatccccagagactcaggtaaactcagattttgctcctttctttttaagtcgtacaagtcaggacgcctcagtagcagccattaacatataaaggttcaaaagatgaccaaagtggcactcttaagaggtcccctttattaggagatgagtaaaaaggctttatgaaaaaaatgtgacaaattggtatctagattgtattttctgtaagactgcaacttattatccaatgctaaactttctcttgtcatctggaaaaaaaacagagctggttataaaaatgtctgtacgtaaaacataacgaaaagttgggtgctttctctagagagcccaggct

SEQ ID NO: 35177 - DNA, 1462 bp, Bovine  19866880781874
tgggcacattactttctctttcacaagtcacggtgttgactgagacaccacgtgtaagatgccgcatgaaatgtctcctggatgagttactgttattcaggcatgatctaacccgaaggaaagagtaagagttgctccggtcggtccagcaggagctatggctgttcccatttggtagtgggcaaaggagagggtatggacttcaattacagcagcagctcttccaagtggtcattagaaggatgtgacattatagagcctgcgggtctcctgagtcagcttgccctcctgggataatttaaagaaaagacgggctcctctatttctgggctggttcattcaactggttgcaagaggatcctgtcccaggacaccaacattccaaagtcaagagtgaatacatcatcgtggaagttggaaacaggtaaaaagtgaacccgggaaacacagggtggggcaggggaaagccaggcagagttcagtgccaatctcacaaaaagtgacgagatgcccactgcctgtccacagggggagctgctgctgagagacgggatgctgttacatttcccagaaaaacaaaaattgaaattattataaatgacatagagaataccactgaccctgacacattggagacgtttacaaaggtttgttgaattggacaggagcgttaagccttggacccgacatttttatagcctgggtttcagtatatgagtattcagtatactcttgcctcattatttatggtaatatccacgactgataaattaatttcttccagtaaaaaaaaaagaaaaaatacaaatgacaaagtgagggaagaggctcagcccattggaagctgctctggccactgggatttcctcatgtcccccctggagaggcccagtgcaaggacccaacccaagtggccagggctgaagactcacttgtcttttcttagcaccagcatctcagaaaccgaaaagactcaccccttaatctcacattcctatgcacctcacccataaaacacagcgacacacccatgtctgttcctgtctttcttacctccaacaggggacctgggacaacctcagcgtcctaccaagtgctcagagggcctgatgccttgtgggcctcctcttaggatccacaggccctgcgggagccagggaccacctgatcaccagccacgactggatccagggagtctgccctcatgccagacacacgaggctgaggccattttggctcacaggcagcataaaaggggtaagacgtggaaacagggggcagctaggaaaaaaaaaaaagtgcaaagccgaccaccagagacagagcgtaactttaccaggtgtccaaaacatccgcaggcacacagaacaccacggcccccaggagaaacacactggcctatgcgtgctagagtgaacacagccgcctcagacccatacttaacccgtctgcaccagatccc

SEQ ID NO: 35178 - DNA, 2808 bp, Bovine  19866880848408
actcagattattaggatattgttctttaatcaaatgtaagcagatccaggttacaggaaatatagttgaagagcacacttgagtactctttgcacatacatcgtccaatgatacagcgaggttttaagacacttccttttatggagaaaggaacctaaggcccaaagaggttaagtgctttgtcctgatgtcatctggtgattgagaggtaaagccagaattcatagtcaggcctacctgagtccaaaaccactttctctttccaccacaagtcactgtgatgtacgtggaagagtacaggttcagaagttaatgtcaccaatgaggatttaaagtaacttcagatttccaatttgctaataaaactactacttagctcatgagcctttatcagaaaaaactcttctaatatataagccaaataaaatcctctgagttttaggcatttagttccaagacacttgctggaaagcaatgttttgatgccactgtctgctctggattccgtgggtcccttccttaatagtaagcatcttgttctccatgggcacttagctgtatttctgcatggcttatgatgctactctcaagagcctgacacttcccattgcttccagcaaatttgggggatttttttgtttgagaacatgtaaagagctagattaaacaagtaattttctgaagtgtatgaaatcccattgatggtaaccctggcagtttaatttttcctccttcaggtaatgtaagcaaagatgttggaatgtcaagaataattggagtatctagagattgatacttagtaccttgaaattgagcatcagcagaactggaggcccagtaggaaagttaaactgagttaccaccgagtttccagggttcttaacagacctctttgatgtatgagtagaagaaaaccaagtgacaggaattttcccttttgcttagtgagaagcaaatgtatgaacctgtgatgttatatcctgtgtgactgtgacaagacagggatgcgctgtgactcctgtgtagcagtgagtgtccatgtgcaccaagtagatagtcttaacaactagtgtagtctgccattcatctcttaatgctgctggtcttccatgaagtgaggatatgcctctagagtaaggtggtgtcttctagataactgtacatttctctcaactgtgttccaaagttgaacattaaatagtatatattgtggtctgtaaagtattactaaggtatgtttacgtggtttttgactgctagcagtggttgttcaactaacctctttttagtgatgactgttaaagaaacttaccttccaggtatgaacctcatatggactgaataaccctgagttggttgcagtcccaggagcctgatgttaatgaggctgccaggatgaaatactccagaactgttggggatccaaattcgggtctcaccctagcagaactgattcaagaacgtcacaacttttgaagtcgattggcacagatcaagaccaagatttggccctttgtctgtaataagtagaggaacttggtgtgagttaactttttttttcccccagccattggtgtctggcgttcccatcaccaatggaagaattagagaatttaggatttcttctcttgttttggtaagggagatttggtcaactaaaggaactgctgtaactgtgactctaaatctgtgacagtgtgataatgcaggtgtgttggaggatgaatgaaccactccttgaaaccctttatgattgttacttctgaaaacgtgtttatatgaaagattaaaatgagacatatttagaatagtataactgaccatatttgagacctagcatcttctgattttttgaaaccaaaaattaaattatggttcttggtatctgtatgcccttggtttcagtgacagtagttttacctaaaagatgggtaaacaaatgagaaagatacatttctcaccaatacagcagtcttccagacagattgcttcttgttctgtatataagtagactcctatatatagccatagtagaaaggtaattacatgagatgtaactttgacccagtctgacttggttttgttttgttctgttctttttccccctggaatacaggacgggaccagggcccttgtactcggagccaagctgctctccaggcattgtgtaagcctcttgtgttgtgctctctttcaggtaggataattgcggactgaaccctcgggctgcggtcatatatgagaacttgctccgcgcggtcccctttgccgggatgtttccattgcttcatgtttcagtaaacaaaggagtttgtgaccaactatgttttctttcttaatttaattcttctacattcacttttctctcctcctggtactagtctctgtagcctttctgttcctctcgttcccagcctctgagcagccctaggtaaggattatgttggcgtcccctttctcctgtacagtgggatccctcttatcttgctttccttaggagttgaccccttctccctgtctacctgcaacatctcctttcccttccacgtagaggcaagcaaccttttactcttctctgttagctcttctctgttagctctggactcttaacactgaagctaatcttctgaaattgctaggaccattggggttttggttgttgttttgtttgttttgttttgttttatgtctgacctgtgatcgtggtacagcagtagctgaaatttagccttgttttactccacttctcccactttttttttttttatatatatattttgacaaataaacgtttctaacacttaagta

SEQ ID NO: 35179 - DNA, 692 bp, Bovine  19866880857806
gacccggatgtgggggcgccgcgcagccctgacccgggccggacaaccccggtaagcgtacagtcccgtactcgggatcgaggctgcgccgcacggcgcgggcggggcgcactcactattcggggttcatggcggcggcggcggcccgctcggtcgctcccagtcggctctgctccgcctcccgttccaagatggtggccgctccgccccagagaccccgcccgcgacgcgcaggcgcaaacgttcccgactggggcctcgacgcattgcttctcggaacttgtagtccccgtacgttgtccagctcactcccgccgcgcaggcgtagaccggagagcccgaatctcctagcccacgccccccccatcgccgcgcagtgccttctggagcttgtagttcgcttcccagacgcacctgggcttaaggaccgcgctctgcagcctcaccgcgtcccggcgttgggatgctcagtttagtgctgggattggcgtttcacgtctgacagaggcattcatccttacactccccgcttccgggaatattagtaaaagttcacttatcaagggtttttggttaggcacttctaactcccagccacaaccccaggaagaaggtatcacccacattttataggtgaaaaaaatcgagtctcagtaattcggccaaggtcaaatagctggtcagggataaaa

SEQ ID NO: 35180 - DNA, 1838 bp, Bovine  19866880900671
ctgaaacgccctttgtagataacagcaaacttgggcaggacagttcttcagagtgaggggagaacccaggacctggagtgaaactaacaagtctcagtgatggagaggccagtggctctcggctccctggggacagcagatgattcacgcccatgtcacctgcagccaggtgggaatgtgggccggagacgggaggtgaaagggtggagcagagaccaggcatttctccctgggggtgtggatgcaggggccgcagagctgatggccactgctcttcctgcctgagctggtgagcaagaggacgttttaatcgtcggatgaagcagttgtgttttgaatgaaaatacatctctctatagccgcctctttgtccttcttatcattattttgtttatttagatttcaagccccaaagcctatttctgtcctctcccctctgagttaaattaatactgtctgaggtcctttttcttcagaaagtctgttctggggttgtagatgctgggtgggctttatgcagacgaaaggacccccagcctcattcacaagcacagagaaattataattaagaagacggtgggtctctttttttcctatttaactgagctgggggttagggaacagccccatttgtgagtgatgtagaggcgggtaactttctctttgtggagccttgtcaggctaaaactctcagggagagttcctaagtgtgggcaaaatgaggtcagaattcttgggtgatttgtatctgcgggtttattgtttttcctcatttagaacttaatttatataaaagaatacaacagtgaaatagtaatggcaactccattcattccgctctgctctgctctattctggaggtagaaggtgttaccttcaggaaactggggctccagggggtgaactacttgcccaaagttgtccagccacgaagcggcagagcccaggttcagactcgcctctctgcccgttacccaagccgtgccctggcgctgggcactgccagcaggacacagcactccctgccgcagcgtgctgcgcgtggtatgttccccttgatcgttgctgtgctttgagtccttcgcaaagcctgtggcttccttttattttccctcccccaatgccccagcctctgagtgatgcctggggtcctaaagcagggttctctgctcacgcatcttggttctcatctcttttacaagatcatccttggcctctgttctcttttgcttttgtctcctttctggaatacttcttttaggccataacaaagataaagataatcctgcccaagggcttgaagaaatggaggggagaaattttcttagcaagcagctgaggtttccagctaggttcgtggtggccacagtcctcgatgccctgggggtcgtcttcctcagaagcagaggagacaggtgtataaatggacgcaggtgggggccagtcgtgccaaggactcagtacgaggcatcctgcccacacttcctctatctcatttctctgcactgagcaaagcaaatgtgagcccaaggctgttccctgaggaggtcagaattctgacccaggtagaaggaagacagccagttgggcgaggctacctacaggacggtgggatgaagacaggaggggctctgagaggcccgggattgacaggaagccgtcgcttagagcagccctgtgccttttctgaagttgggagacaggccttctggtgactgccacttttgtgcacgcggttttaggtccgtgccatttctgccaggcccttgtacttgtcccagccccatattcccagagctggggctgacggccctgctggtgtgcagctgggcacctct

SEQ ID NO: 35181 - DNA, 1892 bp, Bovine  19866880917340
atgatatggacatacctatgatgtcatcagaagcccagggtctttttttgtttggttgttttttttggccacaccatgcagcacgcaggatcctagttccccagccagggaagcttgaaatcctaaccactggacaaccagataattattgtcttcccagggtcttttatcttgctgttctattagcctcagcacatggctacaattctcaaggtcacctcctgatccaaagtagctactggagttccaacgatcacatctgccttccaggctgaaggcaggatgaagcagagaggacagaactagccttcaccaatattgtttccattttgaggaacatttttagaaattccttccaagaccttctccttatatctcataccctaaaattaagccacacagccataccatatgtgcaagggaggctggaaatgttgccttttagctgagctcatcgccatctaaagtaaaactggggttctggtgttgaggaggggaggagaatggatagtgactggtgggctggtggttgatggctgatgtgttagagcaggacaatggaagaggggtcttcccatgtgggggagctggagctacacgttggctcccaacctgctgcagcctccttgaatgtttggggaccacggaattttccatctaagttgcttctgaataaaggatggacttcaatccctgcaaggcagtgggctgacgtatgagaaaagctctggtctctaacttcaccctccccaggtgaacagcaggtagctggacttttgctaaaaatctaatgtgcagcactgagcttatcacttcctgctcgaccaccttccatggctgccccagtttaccggcaaattcttggcattgatgttgaaggcctcagccacctcttccacagctctgctttgacccctacttcatgcctggcacctaagcctttgtgtgggtagctcccactgtccagaacaccctccacccatctctgcctgggagaatcccacccacctttagcaccctcatggtgcctttgcatggactagaaaagactgtcctttatccgggcttcccaggtggctcagtgataaagaatccacctgccagtccaggagatacaggagacatgggtttgatccctgggtggagaagattcccctggaggaggaaatggcaacccactccagtattcttgcctgggaaatcctgtggacagaagagcctggtggactacagtccaaggggttgccaaagagtccgacgtgactgactgagcatgcacatacaccctttatccaggtggatgcagctcccagggcttgaggagtggtgcacaggtaggattccaagcacacatgccccttgcccagcaaacatcctgcatagctgtacagggagatgtcactttaaggacctccctagggagggagggagggaggtccttcctttacccgctctgtcctccgaccctactccctgatccggggctggctggttccagctttgcgtcctctgatctgctcagtgcccattcccccagacccatgacaccaacagccgttaggagaactgagtttgtgccacaggccatacctctctcttcccactctggagaccagtcacccctcccttgggcttcccagtggcactagtggtaaagaagctgcctgccagtgcaggagacataagagatgccgattcaatccctgagtcgggcagatcccctggaggagggtatggcaacccactgcagtattcttgcctggagaatcccatggacagaggagcctggtgggctatagtacatggggtcacaaagagtcggacacgactgagcaactaagcacagcacccctcccttagtcttcagcacacccagcagcagaaggacaccc

SEQ ID NO: 35182 - DNA, 1766 bp, Bovine  19866880928175
caggtgcagcaaaaagtgccaggtgtcggcaacagaggtcccccagggaaacaagataaagcagaggtggctcttctcgccgcttgctcatcagccccatcacgtggcaacatcctttgtgaccagcccaaggcaaggccatgagtaccagtccatgctggcagggatccttctgcccaaagtgtcaggttggggacggtttatttgcacagatcctactgtgactctccagtagtcttgtcacagggaagcacactcactgttgtaaccctgtgctttgcagccactagtctgctccatgtctggctccccacagtgttccagacccctgagggtgtttgaccacgtacgcatccccaacccccaaatcccacctggcagagggtgtctgacgtaggaggtggtcagtagctgtgttgttgttattttagtcactaagtcgagaccgactctttgtacaaactgtagcccgctaggctcctctgtccatgggatttcccaggcaagaatactggaatcagttgccatttccttctccaggagatcttgccaacccaaggatcgaacccatttctccttcactgggaggcggattcttcaccactgagccaccagggaagcccccagtagctgtgttagcacatttttataccttcaagaggaaaggtgggcagaaacagtcttgggggcaggatatgccctctgctcctgtgtttcttctctctgttcctggaggctggacatcagggaagggatgctggctgcctctgatggtcaagaagccaagcttggccaacttaagtgcaggggaactgcagactgccaggggctgacagagtcatcgggaggctggagaactgggcttacaaagaagcaggaagcattctgaggctgggatgcacaatgggcagatgcctcctaggggaaagcaggctgggtagtggcgtgacttcctaggaagagggccactggctatgtccagtgtgccatcacccgacccaggattttagttccagggggagagagtccagttgccttctgtgtgtcctgggctgtcccttcgtcctaccagactgaacctgtaggaggacactggtaccctggggacggggaatcagacactgggaagccagaagtcagctgccgtgtcccacatgccctcttcccccggctctcactgcagcaccgcggagacctggggaatgtccgtgccgatgaggatggccgagctgtcttcaggattgaggacgagcagctgaaggtgaggtggaggagaaggcagggacctttcctaacagatccaatgtctgaggctgttgtctcccctcaaaggtgtgggatgtgattggccgaagcctggtcatcgatgagggagaagatgacctgggccggggcgggcatcccttgtccaggatcacaggaaactcaggagagaggtgagtgctctgcccgcggtgtacacagagacctggagggtcctggtgggtgctcagttcgaccccacgctcttctgcaggttggcctgtggcatcatcgcacgctctgctggcctcttccagaaccccaagcagatctgctcctgtgatggcctcaccatctgggaggagcggggccggcccatcgctggccagggacggaaggagcctgcccagccccctgcccacctctgagcgcagcctctgcctcgggtctgtcaccgtcctccctgctgagcaccgtccacttccagagggaggccctgctcacccagtcctggagaaccagtg

SEQ ID NO: 35183 - DNA, 3482 bp, Bovine  19866880936077
atataattccacttcgagaaactttaaacctagaaacagctgcacatagtgaataaacgaacaaggatttttttagagcattgtctgtgtgtgtaagatcttagttctctgatcaggaataaaacctgcgccccttgcattggaagctcagtctgaatcactggacagccaaagaagcccatgtctttgtttgtaataaggggctgattaagcaaaataaaaatacacacagtaggatattctatagcaaccaaaacaaataaagcagctctatgtgtatcaatgtggaatgagcttggggcaaattaggataaaattgaaaggggcgaaacaggagacaatgctactgctggtgccgctgcggacacaaggatgaacaatatattcacgcgtgttcatacacacatcggctctctctaaaataattttcacataatccaacctgccccccttccttgccatgacccctctgactcatgtctttctcctcctcgctctgctccacccacactggccactttgcctttctggaacaccccaagcatccgcctgccttagctggcgggaacactgttgtcccggatgtccacagggctcacttcttcccctccttcaagcctctgctcaaatctccccttcccggcgaggcctgcgtggactaccccagtaaaatcacatccttcaccctgtttcctcttgccctcctctgccttttcttttttccagagtacgtatcatcatcctccattctattattcaatgtgcttccgtactgtgtttatggtctacagtctgtgttccctcaggagaatgtaaactttacaaagggtaagggtcttggttttgttcagtgataaagacccagcatgagtacctagctggtattcagtaaatatctgcttttgaataagggaatggaaagatacacaagcaactggcaacagttgtcaccacaaggagaaccggggttactgaagggaaggatgggaagaaacactttttcagtgcacacccttgtgtactttgtaccaggtgcttgtatgaattggtaaataaatttaatggaaaattttagctctgccaacggtgtgctagacctggaagaagtgacagccaactcctttatctgacacaggaaggtccagatgtacagcagttaggtactttgcccaaggttacacaggcaggacttaaacccacatctactaacccagagcattagctcttagttatcatgccattgagcctcttggcttggtgttctaatcagtcaatctaatggctcgtgatagaaacgctgagctgaggtgttccacggggcatggtttctgtctgtctaacatttcctattacaatgaacttcaagggatagtcttagttcttttgatacatgagactttggctgtaatgtgcatggtttgacagaaatgggactactgggcttggggcttcttttatgagaacttcttggtcaaaatacagtgttaatgtcagtcccttggtagctggaatgcaggtttcctgaactctaccctcccagatacttcttctttcaaaggagtcaagaggtctggatgagctgctgtgtgtatgggggtgacagagagatccgagggcgcttgatccggtcaaagagtaatgggagtattccctggggctactaaaggctggctgctgagcttcctggacaggactgactgatgggaggcccttttggcccgggttaggtggcggacccgccgctgctgctgcagccagtagagcatctccactttgtcgtgcttcatcttgtccaggtagcgccgccccttgaaggtcaccggctcaccaaagactaactcgatctcctccaggaggggaaccaaaggagcctccaccatactgagcttcctttggagacggccgcggatctgattctcctccaggaagcgactcaggcccacatcagtcttttggaagaagcggttagggtcagaggcttgccgctcaaaccactccagtctccccagcagtatctcccgcagctggatgggctgcaaggcccgctcccaggcactcaccagtgccggcagctgcctcaggcgggcgttggagctgtatttgatggccatgtccagccggtccttctctggaacgtcaagcatggaccaaacccgctccagacgcttctgcaggctcaggattttgtgagaatcttccaggaggctgctcttagtttctagcctgtgttccagcaccgtgtcccaatcccactctcctggcacaaaatctggttcgtcatcttctagcaaggggggtgggtgttggatctttatggactctttgataggggccacggtctccacaggaccctcctcttcatacatttggaagatgacatggaggaaatctgtctcctgggtggtgaggtacttaaagtagtcacccacagacaaagtgcttttccaccagttcagccatctggccctgtttgaccacctgtcccagcttttacttgcttggagtgatgtgaaggaggatatcttatctgcattggactgtaaagtgcttgatttttggggataaagttcagccagcttggtgttgatgatacgatgctgtttttcttgacgtaggaaggctgaggacaggaaggctgaccagtctttattggctgcaggctcaaccaggggcccctggtcaaaagtgaagtggttgttagagacacggctcatcagctccttgtagacttccctgatgctactgccaaaagtgcgatctatatccatttgctcgataagtttgggttccagttcaccagccaggtggttgtatagcacaccggccggctcaatgtggaaggaatccaaaaaatttcttcctgagacctgtacagcagctatctggaccatctgattttttagcttcaaagtaacagtcactggctgtggttcaagtggagggggtttaggggattggaggccccgatgttccgaggcctcttgctcctcgaggctgttcaactttctctgcagctcttctaggtgatgggtagtagctgggcggtaggtcagagcccccaggagtgggggcagccctgagtccagcggtgagtactgagaccaccccagctgcatatgcttcatcatctgcttcaggtcctcagccaccgtgtcccttgccagctctggtttgctctctgccaccaggaccagtggggttaaggggcgaggactgagtggaggaaggcccagctcatctgctagcctccaaccctcacgcagagagggcatggactggcccctctggagctgggagtagaggggcaagtgcgaggtggggggagcccggctgcggggagccacagaggtcccaggcagtgatgcaatctgtgaagtgaaggtgctttctctcctcttttgcatggaggacagccagcgcagaggcttcttcttcttcagctggggaatggacttcaattccttcattggatccttttcagg

SEQ ID NO: 35184 - DNA, 3477 bp, Bovine  19866880974487
agcccaaatggcctgagggtcaagtgaagaaaggcaaagtgttctccgggacaagcgtgaacagcagatacaagtggctagcaaactgttgacagtcccacctcaccagaaatcaccacgttcaaaggggaacagggggtgttgcttgtgcctatgaaactagcaacagagctgtgaacaatcagatttagtgctgctaaggcctctgggccttattttcttgggcttcaagaaatcactgtggacagtgactgcagccatgaaattaaaagatgcctgcttctcggaaggaaagctgtgacaaacctacaaagtgtattaaaaacagagacactactttgccaacaaaggtccatctactcaaaactatgctttttccaagagtcatgtacggacgtgagagttgggccataaagaaggctgagtgatgaagaatcgatgctttcaaactatggtggggagaagactcttgagagtcccttggactgcaaggagatcaaaccactcaatcctaaaggaaatcaaccctgaatattcattggaaggactgacgtcgaagttgaagctccaatactttggccacctgattcgaagagctgactcactggaaaagaccctgatgctgggaaagactgaaggcaggaagagaaggggacgacaggatgagatggttagatagcatcactgactcaatggacacaaatctgagcaaactctgggagatagtggaggagaaaaaggagtctggtgtgctgccgtccacggggtagcaaagagtcggacacaacttagcagctgaacaacaacaacagcccactgggaagcaggcccacaggcgaggtctagagatcagggcagctctctgaaagcaattcacgaaacctaccaagagcctttaaaatatgtatgccccttggtcaggccattaccaatctaggaatccaaccccaaaatattctaaaatgggaaccaagatggatgcagaaagatgttcagatcagcattatttacaatagcaaatgactagaagccacttaaagagccaatattagggcatcaatacaaacggacattatataaccatggaaaatggtggcagagttttgatgacatgggaaatgcttatgatataatatgatgcttttaaaaaaagacaaataatacaatctcatgaagttttatttagagcaagaaaaataactagcagaaactcagcattcactcactcctatgttctagaattggcaaggtatttcttttcttccttattccttctctttctctacatgttctatgctacagtttttccagtagtcatataaggatgcaagctgctgctgctaagtcgcttcagtcatgtccgactctgtgcgaccccatagacggcagcccaccaaggctcccccgtccctgcgactctccgggcaggaacactggagtgggttgccatgtccttctgcaatgcatgaaagtgaaaggtgaaagtgaagtcgctaagtcatgtctgactcttctcggcctcatggactgcagccttccaggctcctccatccatgggattttccaggcaagagtactggagtggggtgccattgtcttctccgaaggatgcaagagttggaccataaagaaggctgagtgctaaagaatcaatgcttttgaactgtggtgttggagaagactcttgagagtcctttggactgtaaggagatcaaaccagtcaatcctaaaggaaatcagtcctgaacactcattgaaaggactgatgctgaagctaaagctcaaatactttggtcacctgatgcgaagagccgactcactggaaaagaccctgatgctgggaaagactgaaagcaggaggagaaggggacagcagaggatgagatggttggatggcatcactgattcaacggacgtgagtttgagcaaactccaggagatagtggacagggaagcccggcgtgctgtagtccatggggtcgcaaagagttggacacgacttaagaactgaaccgaactgatacgttctgtattttctccagtggggattattatttataatcagaaaagaaagaaatatatagaggaaacagaagacctttacagaaaaaagccaagaaggagttcctgaagcatccctctcagtgaggtgactggctttggcttccatcctgtgaaacaaccccttctgggggggctggcctcccagaaggctcatcccaccgcccactgcatcttcctcaccggttggccagggaagcctgctacaggtcttcctccctgtctgcaggtgagcagcctcacagcgggttccactggcacggagactctccacccccagggacatgtcatcctgggcagggaggcctgctcttttcttccacgtgggtgggtttatccctccggaccatcaggcacttacgcatgtcttctgagtaaataggtcatattctctccccacccctaccacacacacttcctgatccctttcccaatgaaaagagagatccctagaggctctggtcagagggtgggggtggggagggaggaccaagagcctccccagctcagtcaggaaacaagaaccatccagcccaagactctcagactctttgcatttgaccctcacacgtgctctagacagcaaggatttccttggcgtcctgctttacaaatcaagaacctgggttctgggcactggaggtggggggcctctgaacgccctggcgccccgtgtcccgtgcagagggaagcaagcacaggcctggacttgacctggggttcgggggcaggcaggcagatgtttgcagaaggggaaaggtcatgatcgttcgctgaagtcagagtggtggttgagagtgggcagggggcagccacgtccaccggcggcaacccagcgtgaacccggggtcagcgagctgggcctgcccccgcgccatctgaccttgggagacccaggcaccccaattcgtcctctgtgaaagagggcgacaccacccccaaactgggcaggtcgacctgggggtcactgacaggggctaccatcaccatctcccccctggtccttcctcccagacaagtgtggggtgcgtgaaggaaggccctctgttgcccaccctgcagggtgctcattcccatccagaccagcaaggcagcaccggcccagggggtctcgctggacaagggcatacatgcagacacatggaagaccgtcagccgacaagggggcccggagcactcacccctcaccagccaggacctggtgctgcttctgctctgcctgaggtggtcactggcccagaatacaaagttctcccgcccaggctgccggaggctggggcagctgccaaggctgaaactgggggaaggggcgcccagagcaggggtgtcagatgcctgggagcgcaggggaggtagggaggctgggtcacgcgggcagcaggagcttcgcagcccaaggcccagctcctctatccc

SEQ ID NO: 35185 - DNA, 1371 bp, Bovine  19866880984397
gaccgagggtgtccgccgttctgggcctccatctgaggaccgggacttctcacggccctgcctgaggctcagcgcccggcgcagtcggccttccgtgggcctcccccagggctcctggagcttgccgtaggagggccgtggtcctcgcaaggactgactgcgtagccctgtccccatggttctggaggctgcaggtgcgtctgcttcacccttcggcgagccactggccttctgagatggcctggtgcccccacccacctgacgggagctcccttggggacaaaggttggtgctggtgaggtggctgtcgtaatccaaagggcaggccaccagggtcaagcatccctgagtcacccacgcagcacactctccacctcccagggaagcgggtacaggcttcctctcctccttccccctctatctcctccaggcagcctttcctgactaacccatcctaaagatcttagcctctcccgaactcttgtagccctggctgtccaaacattttgttgacagtgagaacagatggcccaacagcaaaacagacacgggcttttaagaaacaggacagctccaacctagaatggtcaaattcacagagacagaaagtagcatggtggtcgccagggcctggtggggtggggaggtgggaggattgggggaatgggggccggtggttaggttgtttaatggctccagggcatcagttttgctaggtgagaaacttccggagtttggctgtacagcaatctgaatgaatataacactccccgaattgtacatgtaaaaatctaaggtggtacattttatgtttctgtatatttttactacaatcagaaatttaaaaaaagaaagaaaaaaaagaggctagttctggggctgaaagttcggagtgtgaggtgttttccaggtctaactctgcccataattttctacgagagaatagggttaacagctcaggctctgaggaccagctgctcctaggaaaacactggttccatcacccacagctgtgcaacgctgggcgccttcccccgcctggtttccttgtctgtaacagggacggataactcatgtgttgtcaggaggactaaatgcaatgacgctgtgccaagcccagggcttggcctgcagcaagtgctcaataaaagtaagccagtgttagtcagtactcgaggcaaatcctttcccctctttgtcagtcttctcatctgtaaagtgggttgttgtgaacagtaaatgaaatcgtgaatgcaggtccctccaagggccagactaccaggagcagctctttctcctaaggttggtggggaggagaaaggtacttgggctgggccagccaatccttcgcatcctagaatttcagggttg

SEQ ID NO: 35186 - DNA, 857 bp, Bovine  19866881009301
caggagcgcgtggatggtgccaatgcactggccaacgggctcatcgctgggggccatgccgcccgggccacggtggccgagtggaaggacagcctcaacgaaggcctgggctgacctgctggagctgctggacacgcggggccaggtgctggcggctgcacacgagctgcagcgcttcctgcacggggcgcgccaagcactggcgcgcgtgcagcacaagcagcagcagcttcccgatgggaccggccgggacctcaaacgccgccgaggccctgcagcgccgacactgtgccttcgagcacgacatccaaggccctcagcgcccaggtctgacccaagcgtgggtgggggcgacggtgtctgaggacactcagtggggaatgcagcggggggactggagggtgggcatgccctgcagggccacataagcatgcacttagagtgcttccagggaaccatctctggccaggggacatctagccactgtgtccacacccagaatgacaaggctctttgagggcccgtgacattttcttaagtttatttttattttgggctgcactgggtcttggttgctgcgtgcgggctttctctagttgtggcaaatgggggctgctcttcgttgcagagcacggcatgtggggccttcccagaccaggggtggaacccaggtggattcttaaccaccagggaagtccggccccatgacattttcaagtggttccaggagctagaagattcttccctttgtactaaaatccatctgttgctcccactcagacattagccctacgaaaaataagcatagttccttcttccagccatttaaacccaggagggcccccccaccctagtcc

SEQ ID NO: 35187 - DNA, 944 bp, Bovine  19866881041389
cccgagctctctcgtcgggctctggtggacagcagaaggattgatggccagagcccgggctaggaagtgacactgagggtaagacaggcttttgcccctgacctactgagatgccaagaacaaaccgcctgggttctcaggcctcagttttgccatcaggaaatgggctagcactcactttccgctgctgcttctcccaggccgggtccaacagcaggtcgcggtcccagtcctcctcctgttccatgtattcgccgcccccacggccggcccgcgaagggcccctccccggtccccagaccctcgggctgcagaaccatcatcatcttgttcgggctcctggctccgctctgctcggcgcgctccagaacacgggggctgcgttaagtatcgcccggcccagccccggatcggattcgcgctaaatatgggggaggagggtggggccggatcggggcgagggcgctcgggtcgggaccaggcagaagtttggcctggggctaagagactgccgaattttgaggctctgggatggatcccgtggcggagatccgggattcgcgttctggctccgccgcttgggcgctgtgttgactttgagaaagccacgggccctttctgagtctctttccctatgtgtacaatgaagatgacgagaataatcgtggttgcagatcgctctagaagctgccttttggacctcctcctgacccttttcctgagccgcgctggttgggaaacagggaccactattcccatttcacagtcagaaacaccgaagcgccgagctgttttgaatgttttctggggtgatgaagggagacaactcgagcatgaagagggattccaagccagctggatgggccgaggcagggctattaatatcggggctactgggggaagagggggaatgtgctagccgggaatccccgacgccaccaatg

SEQ ID NO: 35188 - DNA, 1510 bp, Bovine  19866881074154
ttatcagagatgtcctggagttatcagagatgctcagaagctccttagactccttaaattaggggcctagggatacagcctagggcctttcttctcggactaatgaccacagaactccagggtaaaaggatttgaggcagcagaaaggggtaggaattcagaagaggaagtgccttgaaggcaaagatgctggttcttgctgaggggaaaactacaggtggagaagtgaacatttcctgagagctgggcttcaaaggtgaagctgatggagctctgcttagggctggaaggagcagggagttacactcagggtgtaagcaggcgatcaggagagctgtgatggcattaggaccctgaactggcgatgctcagagcataagaaggagctgggtggctattcttttgacagaggcgagcagagtttgaggtagaggagtggactggtaaccagaccccaaatgcagttctaacactctctgtggttttttgtgcccccaaatgtggtcctccagtggaccaggcaatggtgcccgactccagtcctcttgcctggaaaatcccctgggcggaggagcctggtaggctgcagtccacggggtcgctaagagtcagacacgactgagcgacttcactttcacttttcactttcacgcaccggagaagaaaatggcaacccactccagtgttcttgcctggagaatcccaggaacgggggagcctggtgggctgccgtctatggcatcgcagagtcggacacgactgaagcgacttagcagcagcagcagcagcatcggaccaggccacagggaatttgccatagcagtttgacaacacccacgctggcctctgtcctgtttaatgatgagggtcccctgccccagtgtgtgaggttctgggccccccatgtgtgcagtgaccatgggagatgctgcactggtgtgcagggcacacgccagttgacaccatgcgggtacctggaatcgaaggatgatggtccacaccagcccaagggtcaggcggtggttcccgtccacgatgtcatgtgagccccatgttttccaaatgcactttttgctccttcaggaactgcagcgccttgtccacattctccaggcagtggatccgcatgcggcccttcgtgggctttggctatggagggaggggacacaaagccgtgggcctgtgggcctcctcctcctcctttcctcctagctttcccggggccctgcttcctacggcttccccatgacctccctcaggaacacaggcaccgcccagggaagctaaagctgagttgcagatgatgcttggagcagattaagattcccaagggaattaattgcacccagagtgagtgggggaaaaaaatgttttcaatggggccactgttcctgtctccctgaagcaatgttcctggtttaatccacacagcaaagcctctcaaactgaaaccatcctctgagcagaaggcagccactgctttctgctccgtggtgtcactcttctcgct

SEQ ID NO: 35189 - DNA, 1343 bp, Bovine  19866881125058
tccacttcactttcccagccacatataaacaactatttctgttgaaacacttccatctgccttccaaggcagtatcaaggccaccaactccaggaagacctccttggagaaaagtggtggtccctgtcccctggccaatgcaaagaccgagaagtgttagcaaatcacccccacaagccccagaaacaagggtcaaacagaatcaaggaaatcgaatcttcaatgtatggaaaaatcagtgccagcagggatgggggtcaccggaccagatggaaagtcagccagtatatgataaggggctgaaaggctgcagctcccagtgtcaggtagagctggagacgttgtcggggggccgggcccccccaatgtgtcaggtcccagggctgctgttcgcaaagagcgcacctggaagaaaggagagagctgaagctgggccgggaggaggaggcctgtctgcagctccgaccccaggcaaagaggagccagccccggactcacaatgaagtacatgagtgcggacgaagtccaggccagcgccacgtagtagccatcgctgccgaagagcaggcccgtgaggacactgaggatcatcctacagggggcgggggcaggagggaggaagaaaagactggaggcccctgagggtccaggcctgagactgccccagagcccagcctagaccccagctaccatcactggggccctttacccacaatctgcaccccaccccctgccagggacctagactcagaatgaattgggaaggccaggactcggtcctcggacctggatccaagacccccttcaccaccccagctcacccttctcccctgaggtcccgggtgactctagcacattcctgacctcctgagcaacactaccggctcctgaggaggctgctgagaacaggcactccctctaacaaagaagagctgggtgggcagagggggtccagagtcacagttcgaggctaccactgggcaggccaggaaccccgggcagcaggcagcctcccactcggcccacaggtgctcaccccacatatttgtagccgctgtaggccagcaggtggaaggtactcaggtcgctgcgcacggtggccaggtagatgcccaggagcagggccagcacttccatcacaacccacaccagcgctgtgcttgcacacaggcccagcacctccggggagaacctgtggccatgtggggtgggggtgaagggagtcccaaaccagccgtcctaaggcaggggtgagactaggggcatggacggacttgggagttggcacagatcccccagggaggtggggagaggagtcaggaatggggggaagtggtgggaat

SEQ ID NO: 35190 - DNA, 2630 bp, Bovine  19866881136290
agcctggtgtgctgcagtccatgaggctgctgagagtcggacacgactgagcgacttcactttcacttttcactttcatgcattggagaaggaaatggcaacccactccagtgttcttgcctggagaatcccagggacgggggagcctggtgggctgccgcctatggagtcgcaaagagtcagacacgactgaagcgacttagcagcagcagtagcagcaggcacttggacagagagaagaggtccctgccatcatgaaactgacacttcattccagtcaggagaccaaatacacaaacaagattgttccagatccatccagattagtaagtactgacggcctcatctctgattcctcctcatgacaggcgtctcttcgagttgcctgaccaagaataaagtcagaggaaccacatccctgcatccctggtccaggacactagggagaaaaggcacattccttattcacttctgctcctgggaagttcgggacaaaacaaagggagctgcctgcccgtccccttcatctattccttgaaacacaaacacaccacacacagccagtgtctcccttctccatgagtctttaccctgtgacctggaggagagtttggcctgtttgcagttgaagataagaaccagaagccatctggggcccgtttctgtttttcctccccgtaaactgagggaaaggttttcttctaagcaaatgggagaagtcctccctgcttacacctaaactgtgagtctgctcaaacgccagaaagctggcctcccaggaggcggtgccacctgctttccattcactgctgtctaggatacaatcacagactcacgtccagaggagagctgatctttcccaggctcctaagggagagccaggccttccggctcggggctccagcgctcttcatccagacccgagtgagccaaggacgtgcatctcagcacgtgtctgcttcaggcccctggcctggtgctgtgctcagagcggacgctccccctgactgccgccagctgcaccatctccgcaagggacacaggcaaaggaaccaggtggcctttcccctaaatgcagccaccacacaaaggcgttctagcccagagctccagggcccatggtccatcttcctctgtccctaggtcttgggcagaaccccttctgaccgtcggtagggtttgtcttcctcgggctcctcggttttgcccacccctgaccagtgtccccaccggtccagcccagccctcccgggttcctgccccagaacccacctgccgtctcctttcccaagtatgagaaggctgccaacttctagagaggagagaaacggcggccacagtgcatgcacgcccccccaggagagcaacctggaggtgctgagggtggtccccttaccgcagcagctggtccgcagggcccagggaggccacactgtcctcggtgccggagcgaacacccaagtctgggccctctgcccgctgcctgtttataagtgacgttctgggttaagcctctgtcaatgactttccagaattgccccctcccttacagctcaggggagagagaggctgcttatgagccaacctccagctcacgactagaccttgaacagactgtttgagaaaaggcaaaaaacacaaaatcaggtcaggggtgagctgggaggaggcggtgaaaagccgctgcccgagggttctggcggaaggattaaagggcagtgtgtttgggttttacagggggcagaggagcaggccagggatggagagctgggcaggagagggaccttctggcctaagaaaagaggcagaggatcccccgggagaagaaaaactgaggcatctaatgtccttctcctcctgctgagtcctcgggatgtctcatgctgtcccctgggaacaggtgacatcatgtggccaggagactggatttctcgcaagggcatatgtcaacctcgtggctcttacgggctgttgacctggtgtgagcaagggttttaatttttaaatttaatttttggccacaccgtgcagcttgcccccgaccagggattgaacctgggcaacagcagtgaaagcaccaaatcctaaccactaggcaaccagggaactcccttagcaaggttttaaaatgcttgcccacactactgagcccacccaggccagtccatttaaggtactattctcccaagactaggccaatcaagaacaggaacagagcgcccaccccctgggcgccacccgctaccaccaaaacaacagacaaaccggcctcagccctgccgcgttcttggaggaagcagagtcaataactcactgtcctaacactttgcttagtgtccagaacccaaggttaattagtcagagagggctttctctgactccacgtgtcatggcgagtggtgcccagctaacgtggtgtgctgagtctgctaatgaaatgggggcacgctggcccctacgtcaggcagaggtccacatcgcaggagcctccaggagcccacaaattaagtgaaagcacagagaggcagggagcttgctcactcctctaggatccagatcctgacccacacagggtacttctgtttccacctcttctccatcttttctccagagctgacaacaagtagcct

SEQ ID NO: 35191 - DNA, 781 bp, Bovine  19866881225070
tgatttagtgaattttcaatttgtgtaaaattgaaaacatgagattaaatgtcttacccccataaagtaattctaaatgttcaatcaatttgctgattcatagccatttccagttgtatttaaaattctgcagataatcttttcatcagggaaaagcctacttggctcatcagtttaacggacaactccagaaactctggtgcttatccaaactgcttgttctctgttgttgccatttcttctcatacagatatgcaatccgtactgcctggattctttgcgaacctgaactggacttcagaggaggccagccattctcaggacacatcagggctaagacccttccagatgatttttgaggcaagttttgctgtggttctataaattaatgatgttttgattcttatttttctacaaatgtaataacagaaaataaaagcataggtcctttatagaataaagttgaaataaggtattggttcccagacttccctgaacagattttaaatcacttggaagctttgaaaatagtgatgtttgtgttttactctaagaggttgtcatttaattggtcttgggtgttggattagtctgcttgggctgccataaaaaaaaaaaaaaataccacatgttgggtggcttaaacaacagaaacttattttctcatgcttctttatgaagttagaagtccaagttcaaggtatcttgtcaccatttgctcacatgatctttcctctgtatgtatgggagagagagctttcggtatctcttcctcttctta

SEQ ID NO: 35192 - DNA, 765 bp, Bovine  19866881255065
tgacaacccaggaatcctgaggtccagtgtctggctaccttaggggcttcatttcaccccagtgtcagggaggcagaacttctccacccagaagctctgcaaccacttggttcctccttctctaggtttggtcagctcctgacccccgtctgtggatctgagtgctgtgttcatcccgttttcacctggttccctttagggccccccacctgcccaccgtcctcacggtacctcctctccaccgagtctgccttctcctggatcttctctgcatggacgttgccttctgacaccagctggcgtccggcttccagaagaccacggatccgctcaccgtttgcctccatggtgctcatgaagtcttccagttttttaatggtggcatcggctgcctggagggtccctggcatctccgtgtgagacaagacatattcctgtgggaggggagacactgagctcactgcccagcttcccagaaggaatcttcgaagggcggccatctgagacatggacgctgcccagggtgggacaggagactctggctcagagacagagggatggtactgactatgtggaaatctcaggttaaaagggagctgggcttggagtgccttcaatgctccaaatcctgccccatcttatttatagctgctgtttacatttccttaatagttatgacaagctaggttttctatttcttcttatgtcaagtttgggtcaagttacatttacatctctctttttttttttcattccttttttttt

SEQ ID NO: 35193 - DNA, 1188 bp, Bovine  19866881309887
caccgaccacggtcacttgtgggagcgctcttcctggggatgacaaagccccggtgcctgcagtgggccaggactcgggctccaccaggcagctagctgggtgacagacagaaggatcttgtccccagagagggctgagcccacagcagggcctgagctacacacgtgaacgtgcctcagtctagtgtgggaaacaggcttggacataactggggggggggggtgcaacacatgagcatgccaggggcacagcctctccaacaccgaggcttgaagagggtctctggtgaaagttgagtgtgcccaaaacgtgagggcattggagaaggttttgttggcagaaagagcagcaggagcagaggccctggggaatagaccataaggaacactgggcacgaggcagtgagggcgggacgtggggggagtctggctcataccccagcactgcgtgtgcttctgcgcagagccccccaagccggagggcaggggctgaccacgtttcccagggccctgggtcatacccgcatcatgctcactcatcagaacaggcaggagtgaccccagggatctgggaccactaggaggagggctgtgggctggaggacacattcgtcagctcgcacctgcccctagggaccagaacaagtacaaggaggctgcccacctgctcaatgatgccctggccatccgcgagaagactctgggcaaggaccacccggctgtgagtgaggcttcctccccgcccccctgaagctcccaggtcccagcagggcccaggtgcagagcctccgttctcccccctctaggtggctgcgacactgaataatctggcggtcctgtatggcaagcggggcaagtacaaggaggctgagcctctgtgcaagcgggcactggagatccgggagaaggtgggagcaggcagggcagggccagccaggtgggctgggggcccctaggccggccccgagcccagccactggctcctctggtcccaggtcctgggcaagtttcatccagacgtggccaagcagctgagcaacctggccctgctgtgccagaaccagggcaaagccgaggaggtggaatactactaccggcgggcgctggagatctatgccacacgccttgggcctgacgaccccaatgtggccaagaccaagaacaacctggtgtcctgggccggagggg

SEQ ID NO: 35194 - DNA, 1607 bp, Bovine  19866881345029
cacgtagatcaggagccgctttcgtagcctctgattgttcaggtgactcatgccaagttcggtggggggctcctgccagccgcactttagctcgtccaggatgacctcggtgaaacggagccgtaccttgtgaggcgcccgcgcctccaggccgcttttggtcagccgctcggctacctggcggcagaccaactccgccgtcagccgtggaaccggtaaaggcagtagcatcgggacctcctgcgagaggtgctcctgagacgctgtgcgtgtcgtcctgcgggggaagagcgacaacggacgcagcaaccggtggtaaatccgctggaattcggggtccagcttatacggctccatcttaagacgaggcggtgccgacagcgccggctgctctagcggttactaaggtaacgaggggccagcgggcccaagtgcgcctgcgcaatccctgcccaccgtcgcgtggatgcgggaaggagcagagccttgcgtgcgcgcgcaccggaaggcggggcaaggagtggcttccggggctccgcctccccctcccgcggcgcggctccgggctggctcttcagttcctgccctcgggcgatagctggatcctggatggcttcggactcggaggaccgcgggactgcctgcacggtgagggtcgaggcctcgtgtgggagcctcgcagggcagagaacttcggcccctggagagcgatcgttaacttgagaatgagggaaggagcagacacctgggctggggcctggggccagggctggactgtgagagtaggaggacgcttggcgttaatgttacggggtgttgctcctggaatgatcgtgagcgacagtgaagaaggcgcttgaggaggggtcacatggggcgttactataggcctttaggggttgtcctaggggaggtagtgaaacaggatcacgcaagaagtttccccagctcctatcagcccgtccctgccacccttgcagctggagttcgcggtgcagatgacctgtcagagctgcgtggacgcggtgcgcacgtccctgcaagggatcgcaggtaagaaccagatgaacttttgtgaaagcaaaccggagacctcggggaggggctggcaaatctcttaggcctaccccgctcccgtttacagaaacagaaatgaaaacctggagagaggaaagaatgttctcagagtcacactgagacccagaaatggagtctagtatgcaggtctcaggcctgctctgccagatttttctactggccctaacttcctgcctttctggtgtcttaacctcaggtgcctgaaaagtaaggaggtaggcagagagtagtccccctacagggtgttccctggaaaacagacagttagttcttgcttgagaagcagcataatcttgacaaagcaaacagcagccctggccatgttctatccaggtagccctggattttttttttcccccacactgcccggtatgtggaactttcccaatcaggtatcaaacctgtgttaccagcagtggaagtgcggagtctcaaccactggaccatgaggaaggtccttgatctggcatgatcagcaagctctgagaaggcaaggccaccaacatggc

SEQ ID NO: 35195 - DNA, 1049 bp, Bovine  19866881403206
gggaaggtggaaccccttgctaaccttcttgcagtggcagggctggccctgcagtcgcctggagagccaaggcttcagaagggcttgcccaatgccaggaaggtggttctttcaaggtttccatctgtgaagtgtagagattcatcccctttctcaggggaggaaagtcaacacggggccgttcatccttccattggctcaggcccaaagccttgagatcatccttgactcctctttctcccacaccccacgtgcaatctctcagcaatcctgttggcttcaccttcaaaatagatccagaatctgattgcttctcactacttcctctgccacccatgtctggcccaagccactacacttgtccatctagattcttgcaacagcctctcctctggtccctctcttgccttctccctcctgtcagggagatctttttaaaacccaagtcacatccaatcactctcctgctcagaactgtcacggcccccatctcactcagaaggaaggccaaagtcctcactaaatacggccccaggcccttgtgatctccctgcaaactccctctctcacccgtcttccttcccctcattcctgctgcgccagccactctggcctgtggctgttcctcaagctcaccaggccacgtgtctacctcagggcctttgcactgactgtttttctgcctagaacactcttcctgcaagagatgaagtctctgcttctttactttctgcagtctcagctcaagtatcatcatcccacattcccctggccccaccataccttggtcttgttccatttttctcctttgcacttaccattatttgacatagtataggtttgctttttggcctgatggctcagatggtaaagaatctgcctgcaatgcaggcagcctggctttgatccctggattgggaagatcccctggagaagggaatggctacccactccaatattcttgcctgggaaatcccacagaccgaggaatctggcgggctacagtccataggtcacaaagagttggacacagctgagcgactaatagt

SEQ ID NO: 35196 - DNA, 1274 bp, Bovine  19866881418982
tgctgctcttggggctctttacccagggcaccaagctggtgggattgagagagggacccctcccctactgcatggcaccctccccacctcccacagggtgtggtccggccttggaaggaggaccagaggttgcctgtcaaatgtagcaacaaacgcattccctcattccagaccgaagaaatcattctgtggtggtagcgcttagagggtcccagtggactagaatgagcagatcctttgcttcaatattggctcagatggtaaagaatctgcctgcaaggcaggaggcctgggttcgatccgtgggtcaggaagaccccctggagaagggagtggcaacccacaccagtattcttgtctggagaatttcatggacagaggagcctggcgggctacagtcgatggggtcgcaaaaactgagcgacgaacgctatcgcattcacttgcttgaataacagtgatgctcaccaagcactgctacacttaggaagttgaacttcagcttggcctgcgtctgaaataactcactggagggccagagagctacttcccaaacagaacctctacacgagtagagcttcttaaggtttggtggtaggagcagcagaagagctgtaagcagtggtcagggagccattcatgtgcacgcagtaacctgagtttctttgaatgttgctctctttctctaatctcctaaaagtgaaagtctctcagtcgtgtccaactctttccgatcccacggactatatagtccatggaattctcttggccagaatactggagtgggtagcctttcccttctgcaggggatcttcccaacccagggatcgaatccaggtctcccgcactgcgggcaaattctttaccagctgagccacaagggaagcccaagaatactggagtgggtaacctatcccttctccagcggatcttcctgacctaggaattgaactggggtctcctgtgttgcaggcagattctttaccaactgacctaatctcctaaagatgctggccactcaggctgttttgaggacagtggattccctcatctaaagtatacacccgtgacgccatcctggcacatgcaggtgggcagaccaaccttgttctggtcctgcaggtagagccagccgctgaagggctgtagcgggaggtcgaggacagacagcttcagctccaccacccccgtgctcacattcctctcatcttcatcgatgccaaacaccgaaaaccgcaggctcttctcctccagggctgcggggtccaacggga

SEQ ID NO: 35197 - DNA, 755 bp, Bovine  19866881624366
ggacagctagctgcaggagtttggcttccgggccagcccggcccgagctgtttctccaggcctcactggtgccccgccgtcaggccaggagctgaggagcgggggactcggctgggaggttcctacctagtaaggcagcccaggccgattctggggcctccactctgggcctcagtttccccctctgtgagcaagcaggttgcactgtcattccttagggcccagctactctcccacattctcagttgcaggggacccaaggttgaggtcacaagcagagttcctgggctgctcaccctggggacaagggagcgtagaggggacaggaagaccaggtaggggacattttgccaagaaggaaggcaggggcatctggatcccaggggcgggagagacgtctgtgtccagtggccccattttacagatcaggaaactggagtccagagggaagggcctcattatagtggcccggaagttgggccagcccagaccagaaatcatccgtcctgttgttagaggggcataggacatggggctgggtccagggtgggccccacatttttctcagagctcctctcctgtctgttccaggcaggtgctgccacaggagagggaggtgaccggcaccctcatgaccttcttcctggcgctggggctctcttgtggcgcctccctttccttcctcttcaaggcgctgctctgaagcactctgtcgagggctctcccagcgtctctcttcagagctaggcccagcg

SEQ ID NO: 35198 - DNA, 922 bp, Bovine  19866881641067
aaaatcgaaagttttagcatgttctgtgtagaactgcccaacagtcaagccacacttcaacagtcgactgctaaaatacataaatgataagaagctgtgcagcgcggaagtgacaagccacacacctgtattgccagcagtgaccacctgtcaggtccaatgccctgtccttaaactaggattgggttgttgcaacacccaagaccaatcttatctgagcggactgcaccagctctatgtactacagcaatcatttccatagcatgatttcgtgtaatggataattatttttttttaaaaattgctttggtgctgctcctggcactctgagctgggggaatgagcagccactgaatttctgtgctgccaaatttctctcccaaaaggcccccctaatttaggcttcctgtgtgtgagcacagctcagggcaggccagccgaggctgggtgatgcccagggacacctacttgggtggcttttccacggtgcggtaggaattaaaggactggagctggttctggactccgctcagggagttggccagctgccggtcattgagggtcacgatggtctgctcgatccactggagcagctcggaggccagggattcatacttctccaccaggcgctctgcctccatggcgtggtccagcacctgtgagaccgcgatgtggggtcaccggcccagtcctcccctgcccctgcttcaggggaacaggaccccaggtcaggcctcctctggactgtacgcccatcaaccccatgctggagtgtaccttgccaattcttttgccttccacggccagggctttcatcttggagaagtagtggtagtaagtagccacataggtaataattatttctcatctggttggtccacattcacatctgagaaaaaggatcactcaggtcagacaaaga

SEQ ID NO: 35199 - DNA, 789 bp, Bovine  19866881845569
ccagcctggggaaggggcggtggtttgggcttatgcttggtgttcctgtcacctgcaaacccacaggctccaagcacagggcccgggcagctccggatcccccctcccctcttcgaatgacacaagcggtggttactccagccagccagggggctacccagccccaggagccgacgtggccttcaatgtcaaccacttgcttggggaccctatggccaacatggctatggcctatggcagctccatcgcatcccatgggaaggacatgatgaacaaggaggtgtggcccacccccagggcaagggtggcaggatttctggccagggctggggcatcacgggatcccacctaatctgcacagcggccctcagggaagagcagacaggagcaccctgaggttctgggtgcagctcgtccacagcctcctctcttccctcttagctgcaccgttttgtgtccgtgaacaaactcaagtattttttcgctgtggacacagcctatgtggccaagaagctagggctgctggtcttcccctacacacaccaggtgagctgcctaacagaggagctggtgggcccccttgcctcctgcctcctgccccagagcctggcccccagatctcagccccctcctttgctctcttgtctgcttttcctcacctggccgctgctgccacctccagaactgggaagtgcagtacagtcgtgatgtgcctctgcccccacggcaagacctcaacgcccccgatctctatatccccagtgagtctttgatctgggctgtgggatg

SEQ ID NO: 35200 - DNA, 861 bp, Bovine  19866880428343
tgtagagatgcataatatgacaatgtgatttcaaaattgatttagctctacttagtggagcgtaaaataaaatgcatgacctgctaaagagacatagtaagcctgcagcatatagtacatcactgacaaagctaaaaaaggctttcaaagaccattcaactgaggatgtagtttgctatctgttgcataagcctaaccagacttttccttgaccttgaaaacactaaaagcataatcaatgatcatctaatagcagttgctcagggactgtgtgtatacggtgcgtgcttcctgctgaaccacagatgatgtttacctcatctgaagaagtcatactgtcagacagtccgtaaacagagatttatctctctggaaatgccacagactatagatatcaaactggtcacctatggctactttagagtccattcacattaaaaatatcatactctaactggaaatgtaatatatttatgattctgcagatattagtagggttaagatttttgggaaaaaaaataaaacatgatttgctaagttgaagtaatttaagaccacatccaaaactgtgtatagttgccaaaaaggtcattctgaagtaaaaataccaacttttgtgctttaccaactgattcaaaaaggtagaacttttggaatcaatgtacagtgattttgcatcaagctgaacagagtacttatatacatattggtgattaagataagtacagtatgatgaaatcaggcagaaaaaaaataaaaacccaagattatctgatccaagactgtcctccaattaagtgactgtgaaacccacatgatggacagggtgttaattggtgataaactcattcatcaagtcag

SEQ ID NO: 35201 - DNA, 870 bp, Bovine  19866880510093
tatggatgtgagagttggactgtgaagaaagctgagcgcccaagaattgatgcttttgaactgtggtattggagaagactcttgagattcccttggactgcaaggagatgcaaccagtccattctgaaggagatcagccctgggatttctttggaaggaatgatgctaaagctgaaactccagtactttggccacctcacatgaagagttgactcattggaaaagactctgatgctgggagggattgggggcaggaggaaaaggggatgacagaggatgagatggctggatggcatcactgactcgatggatgtgagtctgagtgaaccctgggagttggtgatggacagggaggcctggcgtgctacaattcatgaggtcacaaagagtcggacacgactgagcgacctaactgacctgaactgaatttttttaaaaaaaagactattaactctccttccttcctttttctgccatctgctcccagttctttttaccaatattgctacaaaaattaaggaaaacacattctcactgagatcaagcagggctctcttgtagttcacttttattgtcttgataacacagttcgagaatgtaccatgtgtttttgctcttcagttactttgaagcaaggcacaattggtgaattggctgtcaagtggttttcgaaggagccacttcttgtgctctgatagagagatgagagcacaagacccaaatggtaaatatttaacaatggggagttctccttcccttgcttgtactctggcagagatttgtaatactaataatcagctttaattaataggtggttgtgcctgaagtcacaagtctcccaacaacaacaaattacatacacatcttatt

SEQ ID NO: 35202 - DNA, 2106 bp, Bovine  19866880664769
atgtaaagacttgtctggctagtgaggtatggcccctctgctgaggtgagtaccactgcagatatctagcagactgtaaagccaaggttaaggaaaaaaagatacaaatcagttttagtatcgaaaacagctcttactacccaaaggggactgagcagaatatataaacatgaagcagcactgctgtgccatctttcctgtatggagtgaggtacctaattaagacagtaggcaccagtcaggatgaaaagaggtagttaagcagagaaaatgcatttggttgccatgtgagtccttatccttactcttagtgttcaaagtaccaaacctcactctttccgcagattcccacgtttatttttttcatcctccttgttgaactgtgagaccacacagggctgctcacagcaaaaggctcctgctgctcttcagaaggcagcttgctgctgccccaggccctccatgtctttataattaggttgatgcccacaatgatttgggtacaatgtttctccaaatgccttaccttccaggatacttagaggattctaatcgttcccttttatcacacctaaaatttcctttccatgggcacaactccaggtttctccctaataaatgatagcatgactgtgccagcaatcactacagcaggtgacgtgaaaagcaaagggagggggttgttttgatgaggggtgaagggttgaacacttgctgtcagtgtaaggcagtgtgatcctggcagctaggaaaaagaatctggatgttttaaaagcaaaaagagtaatgttggcccctcttttgtctagatagatgctgcctgttaaagccgagacgtgcaggtataaacagacacatgtagacacccacagtcaccaccactgaacatcccacatgccctgtttctgcctaagtggaggaaatttataaaacagagactaataaattattcattccctatactttggagtccagtttagagatactgtaacctcatctttcacatttagtttattttttcatcttgccttgtagaattttccaaacatttatttttttgcatgagtatgaaaaatcatttatagatgaaaacaatttggtttctgcttggagttttgactggcttacagaaatggcacattcctcaacatttatagaaagtattttcaggggaaactactagtgttggaatgaccttgaaggtgaaacatgtctttgacaccagagagctgcttttagatgagtgagtgtcctttaactgcgttcgccagagtctctgctctaccaaattcccaaattgctattttcattgggtttttaatgttacaatccagtccattaggagctgcctcagtatttacaatttataactgccaagcacttgctacttaaccctgaccttgccataagccttcattgtgaagcacttttttcagagaccaatgaacttaaatcttccaagctgtttcagtccttggcaactctattaaaaatgtcattgatgatgacagcagctgcctgttatggtcactgccatcacaacatatttcaattggtcatcgacaatattcatatatcattgatttttctgaagccctgataatgctgagctgaagtattgagatattgaggtattgaacttctgacctacaaaactgttagatgtatgttatatttggacatcacttgtacaaaaaaatagaaatgttcaagggacacagtagtttctagcaaatatttaagaaatgttaaatacatgagttacatcatgagtttatctttagtataactttatgtatttatttagttttggctgtgctgaatctttgctgctggctgagcttttcctctagttgctgtgagtgggggctactctctagttgtagtgcacgggcttctcgttgccgtgacttctcgcatggagcatggactctagggcatgtgggcttcaggagttgcagcacgtgggcttcagtaactgtggctcctggactctagagctcagactcaacagttgtggtgcagaggcttagttgctccgaggcatgtgggatcctcctggctcagggatcgaacccatatctcttctgcatcggtaggtgaatt

SEQ ID NO: 35203 - DNA, 1545 bp, Bovine  19866880888977
agtctttatttagatcagatttatattttctgcaaaatttagagctacctgtcaaaacaagcttcagccactttttcaccatttaatctgatacgttatgcaagtcttcttcaatttctaaccaagaggaaggacatgataatatcagcttttagttggactttagacagcagggagagttttgtattatttcctcctttatagcaatgcttgtaaaacttttaagagtagaaatattcagtatttatcttttgctgaaatagctacaaatatcttttaggctaagcacaaaaaccaatccttagttacaaagaaagtctatatgcaaacctaggcatttcggattacaggtgctaagctttgtgtatttatattcatgtgtgtgctaagcttaccaaaaaaggctttagagacatacacggtcaaacttgtgagtccttgtgtgtattttggcagaatgatattatcacactaacctagaatgcctagtgacaattaaaggagaagttattaacaactctatatgttctaaagcacagtgtgaaagtaatggttgttactatttttaattattgtattattttctatgatccctgatgggcatcatgtttttgtaaactattattaatgaaaatagggtgataatagggttcttggaggaaagagactactactgttccttgtataaaaatacctttatatcttatagaaactatttactctttaatatatattccattcaataagacatttaaacagtttgtttcttagctgaatataaatgagggtggtttttcagcaatatttaatgagtgataagaatctgaagcaattaaaaacagtaaacatgaggaaaaactatagaagcaacatagggtaattctgtaaataagataatatgtaaagtaaaattaagatctgagaaaaaatgaaaaattaaatgtaaagctaataaagagagcaaatttacattactattgttattcttgataaaccaaaataatttgcttgtgactagaaatttccccatggagaaggcaatggcaccccactccagtactcttgcctggaaaatcccatggctggaggagcctggtaggctgcagtccatggggtagtgaagagtcggacacgaatgagcaacttgactttcacttttcactttcatgcattggaggaggaaatggcaacccactccagtgttcttgcctggagaatcccagggatgggggatcctggtgggctgccatctatggggttgtacagagtcggacacgactgaagcgacttagcagcagcagcagcagcagaaatttccccaagtttcaaacttaagaaaaattatctgccaatggcaaagagaaattatattaaatctctagagagactaatcaggaaagagagatagagaaagagatgcaaagaattaacatcaaatatgagagctgaaatcactgcagattctgtagtatgtattttcaatgggggtaataaaattgatctgactaagcaaaaaaaatttactctttttatgtacaaagcata

SEQ ID NO: 35204 - DNA, 767 bp, Bovine  19866880925282
tgacattatgatgttcggatattttgccttctgttaaacctttgagctacagacatcgattaaatcatctcctttttcagaacccatgggtatttagattatgatatctttggagtcttgttctggcattcaatcaatgcatgcaagagaatatgttgtatcatatttagcagactaagctctctgaggaaaggattagtgaatagttactgagtacattttaaaagcagattttctctgtaatatctatgtctattcttgaaacataaaaccggatacgttcaaaatacagatgtaaaaaggagagatgttctaaataaagtgtattcatctgatctgcatattttgaaagacctgatttttcctttctttcacattttatttttatattttaatttgaattttgcatgatttaaaagtgaaatagataatcaatacaaagattaattcagcacaaaatctattcatgagatcaccaagattttcttggcaaaatgctgtaagaactagttcagtctatggccataccaccctgaacgcacccgatctcgtctgatctcggaagctaagcagggtcgggcctggtttagtacttggatgggagaactagttcagtgtctccaattaatgtaatctattaaaatatattttaatatatgcaaggaagtattatgaatgcatgatattgaaggaaaataagaggaagaacaatgcagtcttatgtgaaactaaaatgtgataattttacatagtaacccctgggattt

SEQ ID NO: 35205 - DNA, 1097 bp, Bovine  19866881598300
ttttcttttgctttttattttcctttggggcctttctttcttttcccctgaatggaattttggtcaagtctcattaattttgaatcactaccagatgataaaaagtcctctagtcagtaatttaaatgtctaatcgaggtatttaaatgcctaaaggaatcaatatgttagattttatcaaaatttactcctctaaccagtttgcacaagacataggccagcccccagcagagagagggcgtggtggcttctgctgcctttctctgccttgtgtgtgtgtgtgtgtgtgtctttgtgtgttttctattctccatcatgctaataatggttatcaatttttccagacagttttacctttaaacaggaatacaagctcttaccctggattccatgctttagggtgtctcctattgactatcttctagtcttgcccagctacatgggatgcagagattatgcaaaacaaagaggaatactttttatgaatctgcattctctagcctcactatgctagaaatatgccagaccctgccactctttgcccaaatgatgccaaccctgaatctttggtctattcagggcacttccctaggggttgccttcctaagagggctgatctgctggagtgatcacgccttggattgggggttggccaagggccagacgccttggattgggggttggccaagggccagttgtctgtaataatgaggatgaaatgtgagcatatggtctcaggtatttgtatgtgtgtttgtgagtttctcacagtgctgaaaggagctggggcaaaaagagaagagagacaggctgcaggctttcccaaatttcaggagaccaatggtgggttttctacatgctgacagtttccagcactggaccaaaatgatgttaagaattctaaatttaactctggtctcttggatatttagggatgtatatttttcaggtaaaaaaaacagagcatattttatctaagagttttttactttaattcatagaactatttaaatgtatgatgtttcttggatacctcaaatattataggtgaatctagctccaagatcaggtgaggtacagatgcttgacaaaagaag

SEQ ID NO: 35206 - DNA, 1270 bp, Bovine  19866881718843
cagttataggttatcataggttaatgctctgaaatcaggtgctcggatatcccatcatcactgactcccctctaaaaggacttttctttgtgaaattttacaaccatgacagaggcatgagatctcagatttgctttgaactagaaacttttcttacagctctaattaaaaggaagtttcaaacctacgaattaacagttttaatatgctattcctggtgattaactgcttcgttttagctggcattcactgttaacactgcaactgttaattttaatggcttgatttttaaattctaagaggagtaaaactagttcaaaatgattcctatcatttttaccattgacctaacagtctctatttagaaaatctcctttaataacatttgctccttttaagagttttatcttctttagctagaattgaatagacacttagaagaaatctgttttttttttttttttcttttcttggactatactttaaaattaaccttgcatgttactatgcctctgatggttgggtaaggagaagatgttttaatgaaaatattctttctaaatcaagcacttacatgtgtagtttttacataatacattatcatttttagaaataaacttaaaaaactgagctacaatataactaatttataacaatagatataaaaacgtgataaatctctcaaaaaatctaaaataaacacataaggccagctttatagaagctgacttttaactaacagaattttgcttgttcatttatatcttgagaggatgcatagttcctgattatcaaggatatcaagtccacagataatccaaaaaattcgttgtcatctctaattataaagatttccttcttcaaagctgttaatcagtagtcagagtgactgatttaaaatgcatgtcagataataacatcttacatatttataccaaatgtcactcatctagtatccattctttcacattttaatgtctccatcatttttaacctatttccacccacatcctacacaaaaccaatctcattaatttctagtttattctttctgtttatttctgtttactctctgtttctctttactcttcatgttcatttctttacacaaaaatgagcaaatatatatttacatatactatgcattcatgcatatgcaatatacatgtatgtatacttatataattatacatgtgcatgtgtgctaagtcttcagtgtgttcaagtctttggattcctatggactatagctccaccaggctcctctgtc

SEQ ID NO: 35207 - DNA, 772 bp, Bovine  19866881816365
tgtggtatatgaacatcgatgtagaaaatcacatctagatacctgaagaaaaggatactgcaggttgcaaaattgaatctgaaattaatttcctggtttgccactgtcataaatccaagctttcaacatggggaagacagcacatgaaagcttattaagtaagattggattcatggcatcagtattaaaaaattactctgggagagaacaagatggtggaggagtaggtggacctggagtacatctctctccatggatacatcaggaatgtaccttcagacacaagtgcatgcagaacaccagctgagagctgacaggagtacctgatcagaggaaaagaatatatagaactacgcaaaactcagtaggatgaaggaagtagggggaaaaacaggagtgttagtaggactggacctgcctttggtgggtgggggaactgaagcaggtgtccaatccccacattggggcaattgtctgagttagaggagaaaggctgagagtgtaacagccgatctgtggcagcctaaatagaatgagaatcagacagtctttgcggcagccatacacaccctggacagggatgatggtcccctggaaggtgcagcagctgggagtttgagtttagggattgtggagtaatcccagggcaagggctgctgtagactgtgagagactgattgaggggatgtaagggaggagactctaaggggaaatgcctgtggaggaaagctgagcagccatggaagcaaggcaatactgctgagtcacgtgt

SEQ ID NO: 35208 - DNA, 4790 bp, Bovine  19866880356127
tgtgctctataaagtggaaaaatcaggaaatagattcttcccaggaactggggagaaagaatatagtcctgctgacctatttttggatttctgagctccttaatgataagatactgaatttatgttgctgtaagtcactaaatttgtggcaatttcttatagaagcaataggaaattaatacacagggtggggatgagggtggggaatgtagtatcctatgctttaaaaaccttaaaggtaattctgatggtaaagtttgagtaacactgtttggaccatttggtaaaaatttaaacatgccaataagattcataaccaatgaggaagaatttctcaatagaattaatgctagaaaaaaactgtaaagagaatgaagctaaggccagtaagaagaaactgagaacccatttagcaaatagaggttaaacagatgaagacctcctatatgtgtgaagatttttaaaaaagcttatccatgtcaatgcaagagtgagatgctcgagataaaataacttagtcattttatcatatgaaaaaaatacataaataaatcaaactcatggcctctaaaacatccattcagtcaaatcactgttctttcttaacttagaatccatgaaaagaggtctggagacatagatgaaaaaaaaaaaaaactttatttttactaaattctaattgaagtctagcattcccttcagttgtgaatgtaactaataaaccacatagtaatggcagaaattgttacttagtcatcaatagaaaccacatatacttttctattacaactgttgcagatgtctgttaatatcatttatactctttactactgtaaagttatgatagagatgagatgcactactgaatccttgttaaacaatgtggtcaatgtggtgatacagaaacatatgtattattttatcacaaatttatctttttatattgaaaagataactgtcttccaaaaacttatttttaaaaattatatatatgcatatatattatttttgcatatatatattatatttaaaatcttattctgaaaaaggtttcataggatacttcagaccatccaaaggattaatgacaataattaattaagtattatgagacataatgtgtgtgatgtaaataagacaagtgttgttatagcatatttataagtaatgaaaagaaactaaaatcttgtttaatatcacataaatcagactaaatgtattataaggccagagcccttttctttgttttctcaggtgtccatctgagcatctccaatactttcagatgccaaattggtggtgatttccacctaatcacagagctttaaagttccaccttacttttgaattatactgattggggcatctcaaaaacttgagggagatagtctaaataccctgagaactaggctatgccaactttctgttttccctctgttgcactggcttccaaatcagttaatggttgacatgcctcccaaagaatgacctcaactctccgctaaggacctgggaaagagcgaaaaagcaaaacctgacatagacaataaaacagctgaaaagatggctttgaaataagctatggtccactgaacagcttcctagagtatattttgttcatacctactatatgatttaaagggactttgaagttcactttcaaactgcaactgtttgaatgcagtgcatcaagatattctatgatatgaggataggtggatatcttagcctcatggatactcaatgctagatgaaccatgaatatttgggagttcagagttaattcaaatgatcctccaaaatgttatttgttcatccagagcttatccaaatgatctgaatagtttcaccatccaaaatcagctgacactcaagtaagaattaattttcctatgagatttttctttctcctttctgccagaaatattccatgcactttctcaaggttatgcagctggcaggtcccaaaaggtctgggaagtaaaaacaaacaaaaaagtaaatagcaattaattcaatgtgaaaccctaggtacagaaaattaacttcctaagtaaatactgcaggtctttacacattgtactctgttagcatctgaaaaggatactatagacagtaaaaaaaaaaaaatctgcctgcagtgtaggagaccccaggtttattctctgaattggggaagatcccctagagaagggagttgttaccaactccagtattcttgtctggagaattccatggacagaagagcctggtgagctacagtccatgggatcacaaagagttggacacaactgactgactaacactttcacacttttcacttcatagatatagttacttacatgtactagtacaggaaaataataaagccttattcattctcactgcttgtccaaaatctagattctaccatgaagtagcaaatttggagagttgcaaaggttagaagaaagagctgtaaagatgattacgccttgagaattcaaatctagaaggaaagactcaaaaaacaagaactatttattatggaagaaaaggcagagtaacatgatacataagaataaatgcaataaagaaagatggaaaaaatatcctagataaagatagagatcaactgtggttcctttattctgagatcaaaaccaaaggaaaacatggtaagctgctctgagaaataggctgatcttcaacttgttcaatttcaaggtgaattaccattggaaagtgtgtaatcaccactctctaaaattttgattgaaataatattttctcttgcatcacttaattttggtctatcttgaattggacttccctggtgtctcagatggtaaagtgtctgcctacaatatgggagacctgagttcaatccctgggtcaggaagacctcctggagaaagaaatggcaacccacagtattcttgcctggaaaatcccatggatggaggagcctgttagaccacagtccatggggtcgcaaagagtaggacacgactgaggaacttcattcactcactcactcatcatgaattaagagaatggacaagaagatttttcaaggaccattcctgtaaatgtatcctgatatattgtgtattatcctgtgacaagaacaaatgagatcaccaagaagacttgcttatagagacttccatgttcaaagaggtactctactgaaaaaaaatcaagacatattatgggtatcccagttagcaatggctggaggaaattctgcaccaagaaagaggcatagtggcccccaaataattcctcagtcccacctaccaactcctggaagtctgcataacttttggttttaaaatgagttatatatccttctttaattaagtttaatgtaattcattgatagagttttaaatgacattggatatgatgttgtatagtttcccagatgtccatgaggtttctcacactttgtagcaacttgctttttcatgggagcatgtggctgattctggccaattaactgtaagaggaagaaacatgtctcactttcaggtcaaaatgtagaacatgaggagcaatttcttcgtgtgtctcttccagaaggctttacttcacatatggcccatgtgttgagaagatagcatcatgagaagaatgctgattgcatctccagattgccagacctgtactgttcttgtcatgaacaataaatagaatttgaagagagaatgcactgtcagtctatcttgactgatagctatgataattcttaaaataccaattgagataaaaatatttctactgcattttcagttctcactatagacacctttaaaagtaacagcgtcactgtgttttggctaaggacaaggagctgcagttttatccctattgattcatgaaaatacgaaatcatctgtcagttattattgttaatcattaatcatctgttctacatattaattacatttacaacagagatattctttaaaattatgaacatcatataatgtatttatatattatttttaaaggagtccatataaaaacatgctgttaatgttgctgttcagtcactaaattgtgtccaactttttgagacctcatggacagtagtgcaccaggctcctgtgttctccactatctcccagaatttgctcaaagtcatgtccattacatcattaatgctatctaaccatcatcctctgccacccccttctccttttgacttcaatctttcccaacaacggtgtcttttttaatgagtcggctcttctcattaggtgaccaaaatattggagcttcaacttcagcatcagtccttccaatgaatattcagggttgatttcctttagggttgatggtttgatctccttgcagcccaagggactctcaagagtcttctctagaaccacaatttgaaagcatcagttcctcggtgctcaaccttctttacggttcaactctcatatctatacatgactactggaaaaaccatagttctgactaaatagacctttgttggcaatgtgatgtgtttttaatatactgtctaggtttttcatagatttccttccaagaagcaagcatcttttaacttcatggctgcagctaacatctcagtaattttggagctcaagaaaataaaatctgcttccactttccccccttcaatttgccatgaagtgatgtgactggatcccatgatcttagtttttgaaatgttgagtctcaggccagctttttcactctcctttttcaccctcatcaagaggctccttagttcctcttcactttatgccattagagtggtataatcgacatat

SEQ ID NO: 35209 - DNA, 940 bp, Bovine  19866880360859
acactgtttccactgtttccccatctatttgccatgaagtgttgggaacagatgccatgattttagttttctgaatgttgagctttaagccaactttttcactctcctctttcactttcatcaagaggcttcttagatcccttcactttctgccataagggtggtgtctagaatgacttgaattatcattagtgctagagacaggcctgcaatttgaatgtaaactgttcttatttgtgaccagttctgatacaatttttttttttttttatcttttaccatatcaaagagctgatagaacagggaaaatccagattcttttctctgagttactggcctcatgacaagctatattagacaggcccttgtggtgaaagattaaagtattaccagctttgttttgaaactgtgacacagagtgcttttttggaaactttctgaggtggtttgggcccttaacttgcctggtaaccacagcttctggactaatccaactcaccgtttgggaatttccaatttgggaattactaataggggcactggtttatgcaatgctttctcttctggtttgcaggtgagtagactctttcttattaaagaagagtctaattacagcaggtgaggggaattttttacactctacctccagacagcagagtttggagggattctcttagaccagagcatctccaactataatgtgcatgccaataatggaatcttctggacatcttgctgaataattaagtctctggggtgaggcatttccagccaggtgatgatgccactaaatagttcgtaaaccacaatctgcacagcaagatcttagagaaaagtcaagtgtgcctgtggtggcaggagaggaccatgtgctttcaggacactttgaatttatgtctcaggacttctctggtggtacagtggttaagtctctgtgctc

SEQ ID NO: 35210 - DNA, 1586 bp, Bovine  19866880376931
gaggagcctggtaggctgcagtccatggggtcactaagagtcagacatgactaagcgacttcactttcacttttcactttcaggcattggagaaggaaatggcaacccactccagtgttcttgcctggagaatcccagggacgggggagcctggtggctgccatctatggggtcacacagaatcggacacgactgaagtgacttagcagcagcagcagcagcaggaaacactgatagtggaatagggaactgacacagagtgggaaatcaggcaataaagtttacatcatcaaataagttactactgtgggtaactgtttctttagtgtagctggggaactcttggagacagcgtagaatacatattagaattatgccaacagagcggcaagggagattgtgcatctgtcttccaatctctgtgccaacatcagttggactttgcatccagaacattatcctccctctggcatttctggcttgccaagagcatgggccagaatgaaagctaacaggcagagagcagcaggtgtttgcactaaatagctttcctagtgtagagttgagtaccatgggagaaaaagcaggctctcaacagcttccagctaccataaatcaagcaggaatgtggccttccttcaagtgtccttcccagttaaattatctttagagtctatttaagctaccaatcttttccagctgctattgaatgaattgcttcaccacatttggtgtatgacttcaattggttagtaatgtagttgggaaaagctgtaggattccaagatgcattgcagctgtctgaggcttgttattaacaaggacaagttcattgaatagtctgatctggattactattgtataaattttcatcctaaagaagcaaaatcatcgacatgtctaggcaaacatcacatgtgttttgtctgttttaaaaaatagttgtgggtatttattaccattctgttgataattcattttttactctctatcatgtttttcagagcatgattatgttattgttttccatttccattttctggaagtgacatgttttacacaggaaacatgactacagaaaaactcattagactttctcctaaatagcatactttttctatcagccttaatcaataatataatttgctttatcccaataacagttgatgacagagatatgaaatcttatcattatcaagaaactattacaggggaatttccaaacccaactgaaaatcatgctaaaatgctcagaacaggggaggtattcaagtgtgctttagccatcattagcagaaattttatagagattctcaaacatttaatggggcatggagctagttgattttaaagtattttcctatcccaagattctggatactttacaatacccacagaattttccattgtgaggtggcctgtattggttacctatgctgaataacaaattacccccaatttaggtaacaagtctttaggcaataaacctttattatctcacagattctgtgggtcaggaatctgtgtgtggcttaattggtcttccatcttaagggtttctcacagggctgcaatcctgttatgag

SEQ ID NO: 35211 - DNA, 906 bp, Bovine  19866880550143
taattaaactagctatacttttgaatgagcaaatgtggtttcaaaaatgattttatataattatattatatcttaaacttcttttatggatgcaaagcagatatcatcttggtaaattatgacaacatgtcattttttattaatttgtagaaattatttctttattgacacattagcccagcagggaaaccggagacaatgaggtcatatgcaggggtgataggaagctgtgatataatcagttctaaataatatatttaagtggtaaaaatccgtatttctcccataagaatatttggtttttacttcagtcttcaatatgcattgttatgagaaagattttgcatgagatttctctttagtgttgtgcatggtgaacaatgcacctggtgaagtgaatgcctcaatgaaaagttttatggggcagaaccagttgctatgctaagaaactaagtgttgtgctgatatacataatggattctatttttagatgaacatatgttcctatagcctggcttccttatggaagaggccagcagtttcagccccacattgtgaatattgagacttagatgatcagaggagatgggactttaggttgtgaaattttcatctattttagccctaacatatttcatgactaggggaaaaattaaaaacaaaatagattaacatataaaccctactatatataaaatagataaccaaccaagacctactgtatagcacagggagctatattcaatattctctaaaacctataaagaagaagaatctgtaaaaatatatattttaacttaatcacttttgctgtacacctgaaactaacacaacattgtaaatcaactatacttcaataaacaaaacagaaatctaaacaaaattctaaaacagtttcagcttttt

SEQ ID NO: 35212 - DNA, 944 bp, Bovine  19866880570543
atttcttgagtgtacttgcaaaatttatgaatgtgcaaagattatacatgatttcattatgtcatatttgttatttttaaatatatggctgatttaatatgtataatttattgaataatttaatattcagaacaattcagctaggcttttatatccccattttatatatgaggtaactgataatcagaaagattaagtcacttttctaaggacacaaagctagtaagtggagaatttagttttttaacccaggttgcatgtctttacagcctattctttcagccaccatacagttcttagtattatataagccagaaaactccagtttaacacatcgaaaataagcaagttttatgtcagtgactggagagtattgggtaaataaagatggttaaaattttattttaaaaaatagtaaacgtgattcagtaatgggagcgattttacttatgtggttgtagtaagatcaaggctgcttgttcttaaaacctaagttagatgcttctgttagtctgagtttggcttataacttttttgtttctgcttcttgtaggtttgagtggccgcttctttgtcactaccctcccagcatttttccagtaagttcaaataattttctggtcctgtaatgattagaaattagtaggtgcgtgtgtaaaaagtctgtcccgggattcttttgttgttgtccataaccttcatttgttcagcttagcgtttgaagggagaaagactagtctgcactgaacgatagtgattagaagagaggggtgtccaggtgctacagagaatctaattttaggccagcaaataggtgaggaggtcaaagagggttttttgacaatatgaaagatgggatgattcttaatagataacaggtgtatgtgaagcaggtaaagtagagaagatctttccaaatagaggatgtatcaggaaaagcccag

SEQ ID NO: 35213 - DNA, 825 bp, Bovine  19866880593263
agggattgctttttgctggagaagaatgacaccctttgtatcgaagtggggaattacaggctgtggtcactctctgcacagtgtctctttgtcaagtaacacatgccaaaaaaaaaaaaaatacagatgggaaaatattgtgcactgtcagatcttggaaacagccaaaggatttttcctcaccaatgtcttgtcgatgactttcacattctggcaccctgaaaaaataatgcatacatttaatatgaaatgaatgcaataataatcaggcaggtaatcgttttcccaaggaatgtaaaacttgacaaatgtaaggtttatgattcaaggtaagcttgccaaatcttatgtggcatgagaccatttttattacctaaacagtccttaacacaaaatgactggcacatatttttattaacacaaagagtatattcttttctgccacatttaatacagagtcagtggctaaaagttctcttttaggatatgtctgtagcaaattaaaaggcagagtgaggattcaaagaatggcatccttctcacggatgctgtgtctacccggcctcagctcagaaatgcatagatcactgagctctggaattctatctgtggggatggtctgggtgatacagatcacagaaaaggaagcccttgctaccttcaaaaggaggggaggggatgattgactcaagatgattcaatgcaattagaggtccattctgagtcaaattcaaaacagtcactaggaataatgattatttatttgttcattcattcagcaaatatttattatttacatgctatgctctatccagacactagaga

SEQ ID NO: 35214 - DNA, 1795 bp, Bovine  19866880639528
tatttaaaagagaatattgaatgaataaaatgaattgcccaagaattctaaggatgctaacatatgtgtacatttttaaagtgcatggaaaatacagaccagacatacgttgtaaagtataaaagcctaaatgggattgatattcatgaatttcagtatagaagtctagaaagaaatggagatataaatctgatgatggcatctaatttatctataacattgtatgatttaagagatcagaaggtgacatgaaagcaaatgtgtccaaatgtcagcatcatttattatatctgggggttaggtgtatgatgttgacaatattggtctctgcattcacctgtttaatggcacaatcatgaaaacatacaaataaaatatttttttaaaaagctttgaaaaaccttcagttgccttaaattctttctggactatgggcatgtcggtggggggggggcatgtttgcatttactacatatgcaattgttgttcagtcgctaagtcatgtccagatctttgccatcccatagactgctgcatgctgggcttcactgtccttcactgtctcccagagtttgttcaaactcatgtctattgagttggtgatgccatccaacacgtgcagtatgattgtagaaaggatgtgaaatacacaggcacacatggtatgcatatatatgccatatatattatgtatgcatgtgtaatacacataggacactcaaactattcataccatatgtacgatgaattgtgccctgcacttccctctaactgccaattactttgaagttttacaaaaggcaaacttagattaatttagagaagtctttggtcttattcttggcataacaaaatcacttaattcttttaacagattttattgactttcctttcatagtgttatacttttttatccagccactggccaatgcaggtctatgattatgcttcagtctgctttgcttcattattttctgtaaaaataggctagatacactttaataacatttgctattaacatattttaacttaaatctgttaattaagatatagtgtattcaggatatacttgagccataaaaagaccagaaatctgcctttacatgtcatggaaatgtcttatgaaatgtctaaagtacacccatctaattgcaatttcctgtaacttagggtgcttttagtaaatcttattctttttatattttattatagcttgacttctggattctgtgattttacatcagaaataacttagatgagattatttccttgaattttaactctcaggatatgtgcaatcacattctttttcataatgaaaaattaataaaaacctcaaggaacaagtggaacacaattccatcaattcaaaataattacaaggagaattggtctgaatctggaaacaaagcaaattttaaaagagacaccatatgcttactttcagctaggggcagtaatgggaacccacttacaacaacgtgcctaagcagagctcctgctgagcccattataatgaacagaaaatgctttcatagaactctgttaattattgatggtacagctgaggtttttaaagtgtgtaagaacagtgggttactaagcaagttaaagactcctttcctgccccctaaatctgatttaaaccaagggtgtctttaaaaagtacatttctcctccagatgttatgaattctgaaacatttttgtcagatatataaaatcacctatgttcaagaatccacatggaatgtttggggtacttttctctaaatctaaaagtaccaggttaggcc

SEQ ID NO: 35215 - DNA, 2080 bp, Bovine  19866880643688
tatgagttgctacacagctgctcgtcagctcaatatttgcagcatattagttatgagagataacattgaattattaatataaataatgtgttaatactgccccacctgtatgtataaagggtcttggaaaatagcctccatacctagcagaaaatgacttttaggatcaaattttcctagaagagggcacactcatgaccaccagactcaagtaagttcatttttccctttccagtggttctgatgagatgtacctttcagtatttctctgtgtccattctgaatatctgaatgtcaacctttctgcagacagatctaccctagagaaacacaccaaacaaaagaatccatggttcattatttgagcattacagatcttagctgacaactttggtttaggaatctaaagggatagaagctatccatcatgcagcaaacaataagaaaatctggtaggaaatagaaaatactgcaaaaaaaaaaaaaacctcattagatcaaaaagttgaggaaagacccacctaatgaactacgacttacagatgacttcggtgagatcccccttgagagtctaaattagcctctgaaaggggtcacctaaaacagaatgaaatattttctaaagtccataattatgggaactgtaatatagttccaattaaaccatgagaactcaatgtctgctgaagtcctattatacactgttctacgttatctctctgaattcagactgagagaacactgaaatggacacagttcatgcaaaaataagaactctcaaataatccgaattctttatttgcactttttaaaattcactaaagaggacagtccccagaaatatatttttttttaagaaaaataattcattttctgctctcatccattgatttaagtagagaccaccaaagcactttcttcaaaagagcaaaagcgtattcccctctaaacctccagacattcattccctctttcctacttcaccactccatcacattaatatgatagttgattgccttttgctaatcctttccctcctcctgtccgcattcaagtcctggtcctcttgtcatgctggtcctcatcacaaataccaggactggtcagaccctcctcattcagcagaactgaaggaaccaggggcctgttcagcacgcagtggctgtaaaagactgaacatgacttagcagccagtgagtctctgatactatctaaccatctcactcctctgctgccttcttctccttttgcattcaatctttacataatggcatattgtgtgcccttagaaatcagatgaagcacatgtagtacatgccaaaggatcttcagagtagaagtcctaaatactgatgaattactgtgaaaagttgtacactgaagcagcctatacaacatttgatgaaaattaatgcactagagctatatgcatcaatgtgtgtgattctcatgcatatatattcctttcccctctagtactctgtctttttaacaccttggtctccccagactttcagctctctctccccctagtcatcatccaccaagctcttcctgggttctacctccatgcttctctcaagacagtaaactgggcgaatcacaggtttcaccacattcattttctatctctcaggtatcactgtcctacactgccagatgactaatgccttaaaaactcatcttttgatttatttcatctgttgttatttcatttgttgttgttatttcagctaaattggcaaatataattattccatcttagtaaaaaggagaggttctaccagctgcagattaaatagaaactcagactgtatttgatgaattaaattactaatgatccatagcttcagactcataatgccccttctgccactaaaacaagatctcaaaaaagatccaacatacttcattatgctttgtacttttacaacattatacgacctctcccagggtattttaggttctgcagtggcaccccactccagtactcttgcctagaaaatcccatggacagaggagcctggtgggctatagtccatgggggttgctaggagtcggacatgactaagcaacttca

SEQ ID NO: 35216 - DNA, 1717 bp, Bovine  19866880708482
tgacgactaactttccatttcagttttagatgtcttttcattacatttttgaagtaagatttgaagaaaaaaatcttagtgtttttgctttggagtgtctctattttcctttcattcttgaataatacttttcctggatatagaattctagggtgaccattttttttttcctttcaacactttaaagatgtttgtccaactcttgtccccatgatagtaattcaaatcattgttcatgtgtaggtagtatcttgttttactcttttagcatcaaggttgtttttttttttttccccctctatctctgcttttcagctttttaaaaatgaagagtctagatgtatctttctttgtattaattctactgaggttttgttgagtgtctaactgcaaattcataacttcaccaaatttggcaaattttagcctttttttttaaatatatattttgatattgattctttcttctctctcactcctttccttctggggctccaataaatgtatgttagactttttttatattgccccatcttacattattttaagtattttttttaacttatatcttcaatactgtaatcagatacaaaaaaatggtctttctcaaccttggttactctggccttcttggtgaaataagtccagtgctttcactgtattcttttcacgttgggtcattatttgtttgttttaaaaaatactgttcaactgtccaacaagtatgcatgaccagtcatttatataaaccagctaaattaccactttactcatgagcaatatatataactcaatatttattgactttctcaagcagctttactcaattacatgatcaagcttccactaataggtaaatgttccaatctcactggagcactgagcagtggttcttttaagtggcattctctttgactccatctttattaagcttttttgtttatgttccatatacagagttagttgcatttctactgtagaaaacatagggcaattctcaggagacttacccttttaggatacttgtcagtcaagtcaaatgtcttctttgaacatttgtgttgtctcacagctctattacagctctattggagaaggcaatggcaccccactccagtactcttgcctggaaaatcccatggatggaggagcctggtaggctgcaatccatggggtcgctaagagttggacacaactgagcgacttcactttcacttttcactttcatgcattggagaaggaaatggcaacccactccagtgttcttgcctggagaatcccggggatgggggagcatggtgggctgccgtctatggggtcacacagagtcggacacgactgaagtgacttagcagcagcagcagcacagctctatttagaaggaggctataagactgtcctgaacaagacttacagattcattcttactgtcacattggcaaataccctggaggccagccatttggaggaacccgagttgagctttcaagcctgaaggcttggtaaagtcccaacactgaccttccagtctttcttttcttaaggaaatagaagaatgactgcttacaattgattataatgtgtatcaacttttaaaattcagcagttgagcattaaacttgttttactgtgcacatttgcttttgttgaattacgtccaggtctcttcatttcccagggcataaaatctggttaaattccagggaaaggattaagt

SEQ ID NO: 35217 - DNA, 1835 bp, Bovine  19866880734155
aagctcttggttcttttatttctttttttatttatggctaaggcatgtgggatcttagttcctccccaggaatcaaacctgggccccctgcagtgaatgttcagagtcctaaccactggaccaccagggaattccctaaactcctagttctaattgctgtgattgactgggtaatgaccatcttgggctgagttagtacatccctgaagtgaggggcttcaataaggtagggataaagccatgacaaatgagaaagctcttgtatcattcattttcatattacaattacaaaaggagaaaagaagagaaaagaaaaggaaaaagaaatctacctagaaaaaagtctgcaagtaacacatgctcatggtacaaaaattaatatccccaatccaactaaagcaaagcagaatgacacaacattcaattgtacagtgtcacaatgtcaggatggaagttcccctctgcaccttcaggatccacactcccattcatttctcagaggtagttagtgttaatttcttgtatatctttcccaaaatgttcttaggacattgcattagctaaggttcttttggtttcaggccacagaaataaactatagctgacttaagccacaaaaaagagtttactggaaggatgctggggtattttgcagaactgaagcaggattaaacccctaaatctttgaaggagtatactagaggaaagttataagacatcccagtgccatatgtcagaagattgcctgctaatatgactttgctacagagattctcagcctctgatactactgtttaaatttcaaatctgattggtcaaactacattaagcaaatgagctataatgtggctggatgtgtgggggcagaaaaattaggaaatgggcaaatctcaaagtgtaggtagttggggaaattttctggactagttaaatagtaacttgcaagaccaaaaccatgaagaatctttgaaacatcatgtgaacataagtacgtttacatttactcacatataaatcatacacccacactgtgtatttgattgtaagacaactatgtttcacattttagttagctatgaagtcagaggtgtagtttataactgataactatgttagcattagaggatagttttaatacaaaccatttctttgttgtttctctgtgtcatataaaataatgaaacatttccagtttggcattttagtaacttatgcacagtgcaaaaaatactatttgttcctgaacctagtgtcacttatggatacattgcatatctggaactattttggagaatccctaccttaaaaactaatacaaaaattatctttgtagagaagcctcttggccattataattaaactttatgtaaacactgtagagtttattttagaagaaaagtacaaagctaggtactgtgggtaaaatgtgactctatttttgctctcaagataattacaaattgacatccttattttgaaattctagcttccagaactgtgagggaataaatttctgttcttttaaggcatcatgtttatgatcatctgttttggtcatcctgctgctgctgctgctgctgctaagtcatttcagtcgtgtccgactctgtgcgaccccatagatggcagcccaccaggctcccccgtccctgggattctccaggcaagaacactggagtgggttgccatttccttctccaatgcatgaaagtgaaatgtgaaagtgaagttgcttagtcatgtccgactatagcccaccaggctcctctgtccatgggattttctaggcaagagtactggagtggggtgccactgcagaacctaaaataccctgg

SEQ ID NO: 35218 - DNA, 1016 bp, Bovine  19866880767037
gcaggggatgggagagacacttgtgttaaatgaatattgtagccctcaaattgccttacttgacaacatatctgcgcttagagtgtactcatgacagacagtccaaagcaccgttacaagcctatgaatgatgtcttagatgcaggagccttttatcatccctttgtttgggtgcccatgggataataccttttagtaagattctgactggatgaggggcaggctttgcttggtaaacagtgcatttctttcggaaaatgttgatgtgttcacatgtcaggagagttggttattaagaggaaaatgccaatgatgagccttaacatattttcttgaagttgaactttcagattccctgcacataattatattcaaatgaaatagtcagggggtgtggactggtctatgctgttgctgccgctgctaagtcgcttcagttgtgtccgactctgtgcgaccccatagatggcagcccaccaggctcctccgtccctgggattctccaggcaagaacactggagtggttttccatttccttctccaatacgtgaaagtaaaaagtgaaagggaagtcgctcagtcatgtctgactcttagcaaccccatggcctgcactcctccatgggacccaggctcctccatccatgggattttccaagcaagagtactggagtgggttgccataaaagtcttcaaaacaggaatagatgcagaactgtgaatactaatgatgaaataaattaggaaaatattgaccaagttgtctttgcttgctgaaattctttacgtttttcttaagtttgtattttatagtggtagatatgtttattccagttcttactgaaatctatttgcagttcttccatgaattattattgggaaacattgaaaaatctcttgtatcaattttcctaaaataaattattcaaagcagttcattatctataattctatcctgagttaaaataaaaatctgctttctaagtcaatcttcattaagctattaatatcctttt

SEQ ID NO: 35219 - DNA, 1860 bp, Bovine  19866880847480
ccatgcaaccaccaccacccagatcaagatttggaagttttccattgtccccaaaccactctgtctaccagaagtaaacttacgctacttccatcaccgttggttagttctagctgttcttgaacttcatgtaactgggatcaaataatatgtgctactgtttctagttttgtacatgaagtccattcatgttgttgagtatatcagtaatcctttctgtttattgctctatagtaacccaatgcatgaatataccacagtttattgattcactgggttgtttgcagttttttctgctggaagctgattcccaccaatttaagtgaaaatgcaagttcagtgttattttcttatttttcaaggaaagctagacatccccattattatgtgaagatttttaagagctggcaaatatttaacagtttaaacatggagcaggtcatgttaaacatggtgtggccagtctagtgcatgagtcatgggttctcaacacctgtgacatcttggcctcacagatgttcccctcatggctaaaatcactctcatgtccccacacagaacatgcttgatatatgtagcagtgatgggtgcctgctaatagaactcatcagaatctttttttgttaaactcacttatattctgctatttagaagaatgtgggtgtgaaataaacttccttctctctaccatgcttggggagcccaggatcccagacctgtaagaatgaatcaagtagtactgatgcttcttagcgtgctgtctgcaagctgcatctgtgtcattgctgtgctattcattcatttgtttatcttgccaaaacattagcgtttgtgaaacagctttagagagctgtggtggattagtatagcatgaaaggaagtggtggcttgttctcaaacagggagaaaagacctttcattgtaaaattcattatttatttattgtccaaaggactgtattgcacatctgttgcatagcaacaaaataaagtttgtctgtttaggaaaatctgaaggcgtcttataacataaagataaagaatgctttctgaactctcatttgcttcaatgtgtgctttgtcacatgccaattatagaagaacatcaggatgagagtttattttaggtgatacaaatgttaacataaatgatagagggtattattttatgtttatgtgatgggaaatcttatctatttaaaaagatgcaatttcctgtccttatccaatcttactggagtagtcagtatcttgtttcttccctaagaattttttgggagagtttatttttagccagttatttgtttctatttctattcatatttttctgaatatcatttcagataatgcccataggttcaactgaaaaatttccaggatcttctgaaaaccaaaaactgtgttaccctgaatgatgccaatacaatgggtgaaattcaagtgtgcaatatatttgtttgttcatttgttcagcctcattggggaaaagattctggctcagtttcctacttgtgttctctggttagatcatctgcctttcaagttgattcatttttcattatagtcaaaatcctaagtttaacagtatggggatcttcttattgatggggtagtttatagtaatatgcttcacattatgtattagagttttattactaacgtcactagttgaaggtcaaagccaacccaccccaaagtattggactagaatcctgaagatctgagtaactagccatgtgaaacattatttaaccctaggacgctcagaatctcagctgtgaaatgaagacacagcacggtgatatatgtgagaatgtattgcgaattataaattgaacatcaaagtcttatttataataat

SEQ ID NO: 35220 - DNA, 801 bp, Bovine  19866880901737
atactcataagtactcatggtttttcttgtagccttataagaatatttactaaagtggtcaacttcaaaaaccattttattattattcagtttgtgactctatgttatttgtggtacaaataacattctttattcagttcccggactgttacattttattccccactgttaataatagaagctctgaagtgagtttacccagctccgcaattccaggaatctactgtttgtaaatatcaaacagacagggagaaagtagtcctatccacttcggccttacgtgttggagggatgctggctgtcagtagaagttccaacttccaattttgaagcaagcatgattggtggggttacacttccgtgctacattttcctcaagattgaactgagctcctgctgggaggattggtgtccttattcaaacattttctccaggtgtcattagactcagaatattggagagagacttgctctttgatgaagaccctaggaaaccctactgagagtaagcacatggataatttatgtgcaactcacaaatcaaacatggtttgtaggcctacaaggattctttaaataagagtttcaggacagaatttatcagaagcagccttattgcatacttggaagagataaccaaggttagtcagcttctggcttttacatttgaaataattcagatgactgtgattttgccaaagttataaataaccaacagaaccttgacacattttatcatgaagtgtaagttttatgtcttctactttggtaaattttacaaatgccaactagaagcagcca

SEQ ID NO: 35221 - DNA, 912 bp, Bovine  19866880943568
catttctctataaatgtagctgagaagatcacattaagcaaaattccaaagctaatggcccactgtgcttagtcactcagtcatgtcaggcttttgtgaccccatagactgtaacctgccaggctcttctgtccacgggcttctccaggcaaaaatactggagtggtttgccatttccttctccaggggatgtctccaacccaggaatcgaacgtggatctcatgcattgcagccagatttttactgactgagctacaaggccattagtcacaatggctcgttagtcacagtaaactgatggtccaccaaaatgactgaccagataactcggttaactagctcaagggcctagtttaccaaaccaagaaaatattttactggatcatcaaggagccttgcctcaccccttcccagaacacatatccaaaagatgtgtgcatttggtagtgctgaccacatcattccctaaaatgagaagaggtctcgctttcccaaaagcaagtaccccagcatccgcctccatctacaagcacaagatgtggtgccaggagccttgcagtgtgaatttctcatggaaagatgcacacgtgaaaggaacacaaggagtacaccctcttcctaggactgaagttcagattccttctaagaaaacattattacaatgtcaccagtctacttctcatgtctaaaaataaagcatcacatcacttcttaagatacatattacatatgattagaactttattctatttttcccatctcttagctggcattcctcaggagcaggaaaaaaaaaaaaaacaaaggcattttccacacaaaagtcccattgaagtatgtttaagcgtcagattaaaactaacaaaagacaggaaacaggggagtgaagaccttactcagtcttgaactca

SEQ ID NO: 35222 - DNA, 1729 bp, Bovine  19866880956303
ccggggattctccaggcaagaacactggagtgggttgccatttccttctccaatgcatgaaagtgaaaagtgaaagtgaagtcgctcagtcgtatccaactcttcgcgaccccatggactgtagcccaccaggctcctcccattcatgggatcttccaggcaagagtactggaatggggtgccatcgccttctccgaaagtcgctcagttgtgtccaactctttgcaaccccatggactataaagtccatggaattctccaggccagaatactggagtgggtagcctttcccttctccagaggattttcccaacccagggattgaacccaggtcttccacattgcaggcagattctttaccagctgagttacaagggaagccctgtctaaggctaaatgattctataaacctcaaacagaatcgcattgttgtaaaagattaaaataagaagataacaaagaattccagcttggccactttattcataagcaggtatctccaaactaacatttagactgagattgaatctgtaatctgttactaacactgtagtgtcatttgtcattaagggcaattatttcgaacaactaacttaagccattctcacatttaagttggggtcatctgatgtttgactaccatatctccaatacttagattagaacccaggatatataatgtttgatagaaacgtgttgaataaacagaggttgggacagtgtgatgttgtcaaggtacaaacatacacacaggttttaatgcttcaaagcatggaaaaccagtttgcattcattatattccagggacaaattttacttccagcctcctgaagtcacttttgggtaagggatatgggacaatgcattttccaatgtgacttcatagaccaagcttaattaggcagaaataactttctcaaacagtgtcaatccccctaacacttggctttacagctgtctgctgacatgacgctcacatggcaccttggtttgttacctgagacttgactgaattcgttttgatcctgaatgaaggacttcattccaggtatgaactttgtctccactatcttagatgatagactgtcaagtatttctatttctgccatttctgaaataccttttatcaaatatgttgacatggttggacagaggtttcatcagtcctgtgtcatcaagactgcttgcatgtggctcaactgcttgcaaaataacttttggaggactcactccagcaggtctagctgctctatctccatgtaagtaatatttgccatcacctggcatttcagattataagtgttatgtgactcccttggtgctgaaaggaggtttggaagcatctgtgtagatcctgttagtcatgtgtttctatggttatttataaatattatgaccagtcttattcaatatatgatgattacaaattattcattttaaattgccaggagctgttttctttcagaggtcatttagaagggttttcagattcagttcactctgacgaatgtaatttgccagactgagatattcatggagccaagattttggcaataagattgaaatttggaacacagcttaatttgaagaatgagaagagaatagataagtgcaaaaagaggaatctttggttgactatgtgtttgaagaaagtttttatttacaagcatgggaaaataactctaatgaaaaactcatcattgctttgtggatccagggaaagtctatt

SEQ ID NO: 35223 - DNA, 1205 bp, Bovine  19866881135126
catggcaataaaaaagcgctcatgacatgtactttagactcgtcatctagctccagttagattctcccctttagtccagctcccacctgcgggtttggtttcagtcctgctcctcagagttcacaaccatggtttctttcctggtcagcacagataattaaaataagacacctactcttttgcaacaaattgcataataagacatttcaagacaatggacagtatgcttttaccctgcatacactagaattttcattgtacaaaaacgcttgcttggacgttcttgccttttctttaataaatagcaaaattcaaaggtaagacatatttgcttttcttaatcagcatattcttaaccctttcctatttgtagctttacacaggaaccattcagagttgttttactgcttaacatcaaagctaagactatccagggagcaaagactatttattttcatagtttctatatttagagtcttggctttgtttatagttttctctcctccaccccacaaacacttgaaaattcccttttctcttttaatcctgtatcttccctctgtctctctcactggccagctttttaccaagctgtgcatttcctttttgaattctcttccagatgattcttgcctttcctctttgatttctctctggagaggacagaagttgccttttggaactgaagaagtgttccaaggacacaaattctactgttgtttgtctctctgggagaaggaacacattccaaagtgcaatttgagctcccaagaaagaatacttttcaccccccaaatcagtggatatgtttaatggctcatttaaaaagtgaacatcagttttattttaaagcaggttaggatgtggggacaaaattttgcttgttactgccttgattaatgtaacaacataatactaaatgacagaggtgcgtgcttaacagttcaaataataactaatgattaccttgggaaaaggcacgatgtgggcagtgcagaccaaaaagaacaccaggaaacagtataaactgaatctttattatgcaaagggtcttcctctgatgcatatctcttacatctaattttcactactgagtaaagtacaaggtcaacatcacagtcttaaaatgtcaaattcatagtaattaattattcaagccttgaaaatcagattggcttaattatctctaccacgtgtaggccttc

SEQ ID NO: 35224 - DNA, 762 bp, Bovine  19866881229416
tcatttctcccctgttttgtaagtgggttgtaggatatgtaagcccatagcagtggcaacagtgttaagtcgctcagtcgcgtctgactctgtgggatcctgcaaactgcagcccgccaggctccgctgtccatgggattctccaggcaggaacaccgcagtggattgccattcctttctccagaggatcgtcctaacccagggaccgaactcaggtttcctgaactgcaggcgaattctttaccatctgagccaccagggaagatctacttaagcccatacacctacattaatattagttttatttctgtcctttgattccaaggctttcaagctctaattttacacttttaaggacaactttctttgaatacaagacactctgccctgcctctttttctattaatcaaacaattcataagccaagctctcttatgccccagctattttatatgctacttaaataatcttacgcagaaatgtctctaccttagatcaaatgagtccggaagtaataacaatgtaagaaacaaggactgaccacagtttaaggcaacagcatcattttaaaataatttaacctaattttcaagttttaattaagtttagaatatggttaattctctcaagggtggcaataaaacaacatgattttgtgattatactggggagggatgtagcaaaatcttcatgaaagctcaagaaatatacaacagatggccagaaatttcaatcatataacctgctattgaatgccttaaa

SEQ ID NO: 35225 - DNA, 1705 bp, Bovine  19866881292602
atgtgtcacacacaattttagttgctgtagacatttactaattcttccccatttaacagaggacggaatcaagtcttagagattaacttgttcaaggtcctcaggtagtcaatttacgactgtatgatgtatatgattggaatgctgactctattatttctatgctgcattagaaccagaaatacaggggaacataagaaattcacaaaataaaactgggcttctaggtatctaagagcatcagttacagcaagggttttccaataattggaggcaattctaaatttgattctcttctgctcagttctgtgctctaaactgtcttcctgtttccttcactgaggttttcataaagcaaggacctcatggttatgcattccccactctttctttcctccaggtgtctgggtatttcttctgataagaaaggaaggaaaagatccagctgctatcaagaagagagcaaccaagagcaccctgtcagtgactgtaattaataatgcatcactgtacacttgaagggtgctgggtagatcccaagcattctccccacacccacagagttccctgtcagaggtctctgggtctgccaggatgaccaaggcatagagacttgtgtgtttgatagaatatatctcactgataattaacattagtactaattagaatactcataccctctgcttaagaaggaaagtgagttgtgtgccttcatctgttagggtccagcaattcattagactttgtcctttcaattattccagggtaacaagtaaccaaatggtcaagattcacttttccccactacctccttaagtgaacagagggagttggttattctcccactcctagatgaaaacttaggcagactccatggatttttcagctacactttccaagggcacccaatcagtacctcagatcataaaaatgtcatgttgatttcatgtcaaggcttcacctcccatggtacaaggccagtgacaaaactggaatcttggaggaaggaaaggttcgtaatgctctccttccctgagcagcttggtcaggtactgccttcttgcctttccatcacggttcctgacaactgagaaacagtgaagacttgggggaggcaggacagctcttccctcactgctatggtagtaagctgaaattaacttctgtaagctgcacatgttcaaaacacacaatccacatctgtctgtctctctcattctcactttctctttcctgcttttgtggattcttcagagatcccgattgtaggttaggtgctctagatgtagagtctgagacagggattcttgtgcacaagatttttgagagagagctctcaaaagaaacctctaaacaagatgagtaagatgagacagaagaaagaggttggtaaagagcttgttttagctgaagtttattatccgcctggtccctggagagctctggagcacggctctaatgccttgaggcaaagatgctgagtttttacactgttgtatttttcagtcaatggccatgggcagcctccagattgatgggagccataaaccacaaggcacttctgggcaaggaggctcctgtcagccagggcggtccttcagagaataagagcaactatgaattgctagcagctggcacccacagtcgcctgccgatgcatgcagctcctcaggtacagatgaggccagagcaccatcacatgcta

SEQ ID NO: 35226 - DNA, 940 bp, Bovine  19866881397681
gaagcggctctatgctgttggccccacagcacccacaggggttcatgattctatctttctgctctgctggcttagcgtatggtttctgatttcaaggtcatctcactgcccaagatgtctgttgaggctctggacaccaaacctatatttaggaagaaaaaggcaagggagaaagaccctccctcatggataaagagatccatgtaaaaatactaacatgtacacagcaactctaagatatctcactagtcacagaaccacacctagctgcaagggaagctaggaaaacatttttttaaccctagaggacaatgttctgatttaaaatcaaaacaatcagaatagatgtttggacggaaaatccgcagtttctgccattcctataagaatccaatagtcctctttttaattttttctcaataactagtatgtgaacacagttcaaaaatttgaaagtataagaaggtttacacagtggagactttcacacccacccctggctccatctgccagtttccacctaccacacaacacttttattcattttttatatttacttccagtttcttcatgcaagtacatgcaaatgagattatccctgccttccctctaggagctatttcaaaatcagtacataatacatgtcttcatttcttccctttgaaatttttcttttacaacctcatagtattgcatggctggatcgaccagggttgatttgttcagtcctcattttcaaactttaacttagtttgagctgttatctttttctgttacaatggactacagtgcagtttttctacactgtgcataagtgaatctgcaagaaaaattatagaagctagacttccagcacaaagggcatatttgtaattttgatggatatcaccaagggggttctccatatgtttcattatgattcactcctactagcaacatg

SEQ ID NO: 35227 - DNA, 1764 bp, Bovine  19866881423431
taaaagtttccctgttacagtaatcacacacggggtggggcgggggaactgtccttctttgagggtctaaaatcaaatgcagctgaaacggaccgcgtgactataaacgaaagacagagtgaattccacatctgcttggctcttcctgtgtaacttggaaaagtcactccacgtaacataatagccatataatagaatagatccacttagtaagatgagagacgtacagaatatattcagccaatggctatattttccctacattgttttccccacccgagaccaggttatttctgatccagtcctgaattttagagtgaactttaatatgcacccaagtttttctcactttctggggcccgtcctctgagcccagagaccccaccaccagctgccctgttcctccacacaagtctgagtggcaggcccacaggacccctcctccaagtgcaattcaccagcatcttctatgtagagacccgaggttcaggtctacagaaccccttctttaaatgtctagttttgattagtccaacactttcccttttcttctcttagccttatgagtgctagttgtttcctgcaattttaagttgagaaatagttttttttttttttcttttctctctgctgcattaatcattctttgtactgatttctcactgacaacaaaactggcatgatttctgttccttgaatagacactgaccaataacccttttgtcacttggaagcatatttcaaatcttccctgttgaaaatttggtaaatttctcatccagggtaatgagacatgaattaacacttagcaaactttcatctgtattctaaaatgaaattgagagatattgcttatggcaatatagaaaaaaaatccaaagaggcatctagcaaagatgctatttttgcaaaatatatgcttggattctacaacaaaagtatctttgaaaattcaattattacttaaactgactgggaagttacagttcaacaacttcaaaaatggggaacatactttgaccctgaaacagaaacatcagtatccataaaacagtaaaagaaaactggacatgtttgtaatcctggcttttacattgtctacaaagttacttcaacccattgtgttttttacatcttcttgcttctcagagtcaaaagaaaccattcaaatatttcattttcattcaacagcatgcctttctcaaagggcagccccagtttaattgggaaggaattctgtcaaaggaaagttaaatgagctggattaagatgcaaggattatgatttctcatctgttttgatagcttttgtttatctgtaacatttcccagatagcggactaggagagctggctcagttttgtttagttttcttaatgagatgtcctggcttgcttttcttattacagtatgtgttaccatggctactatatttttgaagatttaaggtttttctcaagcagatacctttattgagctttccccccagattacataaataatgctacatatagaaaagtaaagatcatctgaaatctcaccactctgcctcactattaatttacatacttttatgtaaaatctatgataaaaacttttaaaataccactttataaaattatttgtcattatcttgtaaagctaaccatatgcatagcctggcaattcaagccttaggtatatacatgatgggggaaattcagcagacatagattgagatgattgtaatagactcccaaaggagagtaagcagcacaattgtgca

SEQ ID NO: 35228 - DNA, 786 bp, Bovine  19866881468711
gaattaacttaaaacctagttggaatgtgaaataaagtcatgaacgggtctctcacgagttctcagacacttaaatttcttgtgatagatgcagaaatacttttaagccgttgcttgcagtactaataatactctttcatagtgtcaccatcaacgggtgtaagacataggggaccaatttagagagttttacaaatgagccggtaatgggcatggagacattggagattgtgccaaaggtaatttgcaaaagtcttacattttgcctccagtaagttgtacttagttttactaaatagtgcttcagttttctataattgtgtttcctctctctaatacttggggaagaaagataaagtcaagttaggtatattctgagatgaatcttgagaaaaaaatattgattggattattgagttgattggttaatacttttgaaagatatgatgtgttatagcagtcttttttactaaacacaaaatagcatttcattctctgtgttagtaatttgttacagaattagcaacaccagtgtactttgatctctttcagtccagaagagcccaacactgtagccactaatatgctataaagtgggtcctttgttgatgctgacttggaaactgtggtaaaaatcctgcccaaggctctaagaatttggttacaaatctataaaactatttcacatttatgtcacttccttttgaaatgataagtaactatctgcaactatttgcttataaatcagatatggttttacaaaatactagactaacagatattaaa

SEQ ID NO: 35229 - DNA, 2655 bp, Bovine  19866881543313
aagctgaagttgaatggttctgtgaagacctataagacctcctagaactaacaccaaagaaatgatgtccttttcatcataggggactggaatgaaaaagtaggaagtcaagatatcatacctgaattagttgttaattgtagttgctcaattctatttggaatcagtccttatcctcaaaatataggacccaaatttacaaaccattgcaaatttggatgaagtccttgaaataaatgttaccaaaaatcagctatcttttacagatcaatcctataaactcagtggaaaatattttgtttttaaaaagaaatagcatacacagaaattctattattcttttcagtgtcccttatatatgtaaagggcttcactggtgtctcagacggtaaagaatctgcctgcagtgcgggagacctggttcagtccctgggctgggaagatcccctggataaggaaatggaacccactccagcattcttgctggaaaatccacaagacagtggagcttggcagtggggtcataaagagtcagacacgagtgagtgacttcactgtctttcttttgtatatgtatatgattggcaaaatattttttttcttaaaaatagaatctgatattaggaaattactattaattttgttgggtgtgataatagtgttatgactatattttataaagtctttattagttacagatagtaaattatttatgagtaaaatgatacgatgtctagaattcactttaaagtacagcagaaataaaatttggggggttagaaggaagatgcatgaaacaaaagtggcaccacatcaatcaaagctgaatctaagttcatttttgctattctctctacctttgtgcaggctggaaaatttgcaaagtgaaagagagtatcatggctgaagctctttcttatttctaacacaaatggccttcagactagagttagtaggaaggtgtctagcaagaatgtgtgggcaagtgaatgtggtggggtggcatacgtgagggatggcactggcctgacccttcttacctttgtgacttggggctaaaatcatttaacaccagttttctgtttaaatgcaggtaataatagagcctactgcagatggtggctttaagattaaatgagataaataaaatgccagtgttcaatccttctttgcgtttaaagcatgggatcacagtttatagaagattggtacatggtaatgggaaaaagagtttttgtccctagggtagtttccaatgatggcactatgaggcagctatggttatacaaaagtgcatggttcctaataggaaaagaaagtgaggtaacaaatagtccaatggtagaaagttcaaatacatggtaatgaacaaagaccttggtaaaaggtaaaattggtaatatagggcttaatattatgaagataatcaacgagggttgaggagattgtatttaggttgtaaactctgaaataatagggcatagaagtaacgcacaatggttttcacaagaggatggggaaactggtatggaaatattaaataagctacacagagctgtaaaaattagtccataaagtaataatagcacaggaattgaattacacaaacagatttgctaaatgtcttataggaacaagagggagaattattaaataggacacttcctggaacagatggtagaagaagccatagatgattcaaataagctgagttgtcccaagctagtgactagaaatgaacccataaggagccttgctaggcctctaagaaacagcaactcctggatgacctcttgggaaaatcaattaatttttttcagaactaataagtgagttcagtgaaagctgcatacaacagaaatagacacagatcaattctcttcttctataccagtaagaattagttttaaaatataatatggacaaacatctcaacaaaatctataaaactacctaaagaaagaaggagagaaacatgcaagacatatgaagaaagctagaggattttgtatggttatgtcaattttcccaaattaatctataaatccaatgcaataggattcaaaatgcaaccaagttcttttacctagcattctaaaaatttattttaaaaagctgatgcttaagtcaagctaacagaattaaaaaaaaaaaaaaaaaaaaaacccagtgatgtaggtcttgcctgagtattaaatctgctataaagttacagtaaagcagggaggtatttgtataagaacaagcaaatagatggatggatcaaagtaaagactcaagaaatgaaactatatgtatgtggatatttatatatgttaaaggtggtatagttaacaagataaggtagatttaggttgcattaacaaataacaaacctcccaaaattggaggtttgactcagaaagctcctttctatgtcatgtaaaatccacttctgtctaagatactctggggaaactgaacattacgcaggctctacacaatccaggctgcttcattctcacaactctgccatctcaatgcaaggccttctccgtgattacagcagggaaagggaaaagaaaagggctgcaaggggcttcaggcttccttagtccagaagtagcacatccggttcagctcagattcgcggccagaattaattagactgcctca

SEQ ID NO: 35230 - DNA, 929 bp, Bovine  19866881661456
tgttacaatattaaggtcaaagaactcatatcattcctgtttcttttttagtgagaatatcaccagaaaaaaatttaatttataaggagaccgacaaagttagcacacatccaaacacatccaaaaacatagagtgccaaatgaaagttgaatatcagctaaacaacaaaattgttttagcataagtatatctcaaatgttgtatgggatatacttacaataaaattttttgttgttgttatttctacagaggacacctcttgtttgataatcaaccaaattttcttactctggacataccagtgtcctttcctggcccttaggattcacagttgtcccatattcatattataccgcttctcccttaccatgtttaatggatcaaggggtttataagttagcattctagtctctagcaatcgcagactgaagctggaatataattcttggtggcagagccaggtgatgggaatccagggaggcttgtagccaagtgacctaccgagttgaagttgcccatctgcagtgagaaagcaataaagccaacattctgggagaaccaaagggggtgaataaagcaaaacacatccttggtacttttaaaaccctggaaccaagtttcataagccccaactgcatttatgttcttcctgaggtttggcagttcaacacttcctatgatttaatgagacactaaaaacctctctgactgcttgagctaattcaacttgtgtttgttctttccaataaaacatcatgagttataaaatttcaatgaaacattgtttaaggtgcttaagcaaaaattaattatctcagaaagactaaagaaatattaattgctcaccatttttagggacaaacttgaataatggagatgtgccatacccacattacccaactgtgtggccaagacccattatgcaggg

SEQ ID NO: 35231 - DNA, 1139 bp, Bovine  19866880734383
agaaatattagtggatctggaaaaagcccagagaagagcaattaaaataatcaaaggggtgcagcaactgatgttttacaaaagactaaaaggataaagaacctcttcagtctggaaaaacagctaagaagagtcaatagcagcatcaacaacaatcacaatggctaaaatttactgagtgcttcctgtgtgtgagattattttataaacaatttgtaagtatcatcttgctcaatcctgacaacaatcttatcaggtaagtactattattattcccactttacagatgaggaaacagaggcacagtgaagttaagtaacttgtccaatctgccagtatttaaacccaacctgtttctgggggtgtggccctaaactcacctcttccataagcacaccgaaattacaactatttgtgtggcaactattgatgagaaagaccagaaggctaatagaaaagatcttctacaactaaagatataaagaaggagccccaacgagacaggtaggaggagcagagatgcagtatagtcaagaccataccactgggtgggcaacccacaaacaaggataattacaactgcaaaggaagaagcaatgagtctgagccccacatcaggctccccagcctgggggttctgcacctagaagataagctctcagaatgtttgtctttgaaggctagtaggcttacttttgggagagcaagaaggctgtgggaaatagagatccactctgaaagggtgcatgaaaaatctcacatactctggcacccagggcagaagcagtaatgtgcgagaagtccgggtcagatccacctgctgatcttggagcgcttcccacagaaggaagaggtaactggagatcacccgagggacacagaccctggcagcagccattttgggcagcttgttctaccacgtgaacagtggtgctatcaagtgccttttggagccctccatctagcttattccaaagaatagcaaggagagataagaaagccttcctcagcaattaatgcaaagaaatagaggaaaacaacagaatggggaaagactagagatctcttcaagaaaattagagatatcagatttcatgcaaagatgggcttgataaaggacagaaatggtatggacctaa

SEQ ID NO: 35232 - DNA, 1247 bp, Bovine  19866880996790
gtttgcccttgctgccccatttctctcactggtgctctccatccccacaagctaaacccgttaataaaatgactgctccatcagtctgctctggtaccccaggtacacgggcctttcagcccagccaagagcatccccatctctagctgttcagtaagtgtttgggtgtgagaaatgctataaaaattcagctgcaaagaaaatttcagctaggccctggagttgtgacaggctcattttcagtctctgtcttgccttttccattcctttataattgttcatcttgcttgttagtggctccagctctgtcattacctcatttgaaagcttcatgaatttcctctttcctagcagtttctgacttatctgaaaccttacatacaaagtagtgaagggaagatagtccttgaatgtcacaaagtggatctgaatttccgggttcttaatattcaaggcagttttattttttacttccctaaaactgtagttatgagtgttataatttacctttcttcttcccaatgccaagtagatggtagagcgaaagaatctgagtcccctctgccattgatgacacttagagctcaagagccatctttcgcaaaacagcccatctatatatctcagcgatggtttaacaaaacatgaaagagttgcatgtaactatggctgattcttgttgatgtatgacagaaaaccacaaaattctgtaaagcaattatccttcaattaaaattgtttttaaaaatgaatgaccaataaggacttaaaaagagcttcagagttgtcagatatatcaactgtcttgataacagattgtattttcccctcttgttttttagcctccacgaacatctcatcctattgtgaggttctcctgtatagattgtgagccaatggtaatagacaaacttccctttgacaaatatgaacttgaaccttcacccttaactcagtacatcctggaacgaaagtcgcccgatacttgctggcaggtacttcccctttgttgttagccaaatgtctggaaccactcagagatctgggaattgtttaaagaactttcaaaggttaatctgggaatagttgggctgagtctattaataatgtttctcacaaatgctatcaagtaagcaacatggctaagcaaataacttcaggctgaagttagcctaccatacacattgccatttaaggaacctgatgaaacctacatatttggaggactcccctgaagcctatccagg

SEQ ID NO: 35233 - DNA, 1352 bp, Bovine  19866881266949
accctcaaggagctgtgagtctataacatcatatctaacattcatgttatcagaatcccagaaagataggagaaaagggataggaatgaaaaagtacctaaagaaataatagcttaaaatttccataatttggcaaaagacagaaactacacactgaaaaatttcagtgaaccccgaataagataaactcaaattcacaccaggatgcagcatggtcaaacttctaaaaactaaagacaaagacagatcttgaaaacatcaaaaaagaaatgattcactaactattagggggaaaacaatttgaatgacagtgaatttttcagttaaaaaaactggggccagaaaatgctacacccaatgaaaacagctttcaggaattaagaggaaatcaagacattctcagatgaaggaaaactaagagaatttgtcatcagccaactcactctaaaaaaaaaaaaaaaagaggctgaagaaaatttcctaaatagaaaggaaacaataaaagaaagatctttaaaatatcaagaaaagtgaaagaacacaagcaaaaatatgattaaaaacagcagactgtcctcgtcattatgtttgatgattcaagcaaaaataacaacatcatttaatatgattctaaatatacatggagttctgtgtttggttctacatatgaggagctgggaagtcaccactctatcctaaaagtcagtaattcttcttggatcgatgagacagtggatgacacaagacaaaacactgctccaaagacggaagagactaacggattaatacagggagatatggctttctggagcagagacttacaagcagaaactgctatgggaaccagtactggctttgttaagctggaattataattgacaaattgctggacactcagtgcagacaactctgagtattacaaactctaaggggacccagtctaggagttatgcagtattatgcaatttacctccaggagttaatgctaagtatcagagaaaaatccccttggccctctggaaggaaccactctgaaatatacaaaaacactctttccttcttagtaaggcttgccctcagaagaaaccagttaaacagagcataccttttggtgtattatcagggcctaagtgacctaggaaaggaaaatacccaactccagcccactctagccatcctgtcccatgtaaggaggagtaggtggggaactgaggaacacttgtgaagttcacagtccaaggcatgggttcagtaaaagactgaaatctaatcttagaactgtagaatgcttcccctctcctcacactgtgtagtttagtcgctaagtcctatcgactctcgcgaccccaggc

SEQ ID NO: 35234 - DNA, 746 bp, Bovine  19866881319501
cgttcttttctgagtagcagtgtactggagccaaaaaatttactttttcacggcaaaggggaaaaggggccccagcacttcactccccaacctgaatgggcaagatccgaagccactggcctcatgcaccataacaggccaccagacaaaaaggaaagaaaaaggtcacgacaaaggcagcagcaatcaacataactttccaacaaagcaacttctcctgcctgggctcccccagaaacagtgctccctccttcctctccctcccctcccacaagacaaaattaattcacatcacaagaacttggtgctctggttaagtggcaggtaaatgtaagaaagagtaaatctgtcaccttgtatacctgaactgagacataaagctaacagaacacaagacatcactgtgaaattaactttctaaacaggtccagtctacatagtgcggccaataaaaagtaaaatgaagaatttgttcacaatctgccttgtacagggtatttatagtctttcaatgctatataaataaatagcatttatatagcttaaacattcagagacatgcactgggactttttaggtagtacgaatttcttcacaatcacatgtgcaaattttacagatcactaagtgagtaactagtaagcttaggctggaccgtgtctcgtattatctaacaaatttaaggggggctcagaatcatccataggtagaaccaggcgtgttccccgaatgaccagttcatggtc

SEQ ID NO: 35235 - DNA, 826 bp, Bovine  19866881514066
ctttttttctttttgctatttatagtgtaataagaaatcttctgagcgaattcatctaaaagaactctttattttaacaggttacttttgatccagaagtatttttcaacatattacttcctcctatcatattttatgcaggatatagcctgaaaagagtaagtgcttttgtatttcatatgctttgaacacccttacactccacgggctttactatcgctgccgctcagaaatggccagctcacccctcgcttctccctctcctgatccttttgagatgctgaatttaatgcctgtacgaagtctctcttagttatttcttttaatggataatgcatttaatattagtatagtacactagaatatgaaaccttttcttttaaaaataattggtgaatattctaacacagtaaaacttttttcctatcagagacatttctttcgaaaccttgggtcaatcctagcatacgcttttcttggaactgcaatttcttgttttgtaattgggtgagtatttgaagcttaaaacacttttagccttcaaattataattttaaaataatgcatatttgacttctgcaatattgtattcttgaatgtgtctaaggacttttgtagtaaaatgtattcatataggtaataagttctttgaattttccttaaggctaaggcattacgatatttaaatgacatgcagtaaatgcgggtttagtcacaaagtactaatagtagacccgtcttattcttattgtattctaacttctttcgcagttgatgttttttctaaagtagacatatgtttattgaacagatcaataatgtatgg

SEQ ID NO: 35236 - DNA, 1410 bp, Bovine  19866881707460
acatgtccaaatgaagctgcacatttcccctagaaatctgtcccctgcctcactcactggcccagcttatccacctagttgccaagtcactttaagttcctcttagtttttcatctcccttgctcccagtctgctcagtcaccaaattcttttacaagataatactttctaaaaaatctccctctctccctatctctgctgtcttagattaggccctgcattcttagtgcctgaataacctcagtggccttcttatctgaccttcccgaacctctgtagtctagaccagtcatgctaaaatagaaatctgatgtcaagcccctgcttataggctttctatggcttcatttgctttcaggataaagtctaaactcccttccccaacatgcaaggtctttcgtgattcagctcctgccagtctttcacacctcaactcttgacacttgatatcccagccatcctgaactatttatgattccctgaatgggctatgttttctcactcttccgtgactggatatgtactgctagtcctcatacctgggaaaccattttctctgactttgttacttgcttagatgacacctctggaaagactttcctaatgtcccactccctttgccaagtggactgagagctacttgaaggagggaccttgttttcatttgtgaaccctgtgggcctacttagcataatagtccattcacatatattaaaagaaagactgaccagttagagtggacggagacaggaaggtaaaatgccattaaagcagagttaaggaaagttccagatgtttgagttcaatttgcagttgaggtatatctatacactgaagcattatttgaccataaaaagaaataaagcactgatatatgctacaacatggataaaccctgaaaacattatgttaaggaaaagaagccagacatgaaaggtcacatattgtaggattccatttatatgaaatatctggaataggcagatttatctagagaaaaagtagattagtggctgtcaggggatggcagttggggtgggggaaatggagagtgactgctaataggtctagggtttctttttggagcaatgaaaatgttttggaattggaaagtagtgatcagtatacaactttgtgaatatactagaagccactgaattgtacagtttaaaaggataaactttgtggtacttgagttatatcacaataaagtcatttttaaacatttttgatcaatctaggtttatagtacttagaacattgtgaataactgaatatcaatatgatgatccaggtaaaattctaataatacattgatatagtgtcaaagtcagttcttctgtccatgttttcattttgaaacatattttaaaattaaaatctgaacctttagtattagaagaactcaat

SEQ ID NO: 35237 - DNA, 796 bp, Bovine  19866881778744
ataagaacccctgttgtactgtggcctttgaaatcctccttattttgaaatagtaaacaggataaattacaaagcagtagacgtttttttctttaaaggagtaatttagttaacattttgctgaacaatattgtaaagttaaataaaattaaaaacattttgctgaacaccaagactcatagatgaaaaattatttttgatctataaagcttttatggcaatatttacagaatctttggaaaggaaaaagaaagtctggcccccctcttaaccatcatcacagctttttttttttaacctagcattgtaatcagtgtactatattacttttgaattctacctttcccatctgctttgttctatgaattattcccagtagccacatagtcttcatacttaaaatttttcgtggccgtgtaacttacccatggtattttagatgctccaggtagttctgtgggcagaggggaaaagttgaattttgtttttagtggaaatttcatctgtcagctttttatcttgcaatcttgtacactacattttatcctgaagtaaaaaacattcttctaagctggctttgatcttttttttatgtggacagctatgtgaagacactgtgattaacacttccaattgctaatcatgagctatcctcttccttacgcttttccaaagtcattcaggttttttctttttaatcttatatgatacctacatgtgctggggaacaattactgattttagtgatgtttttgtcattttgctgtctataactgaattgctaatgatataccat

SEQ ID NO: 35238 - DNA, 3979 bp, Bovine  19866880226539
gaaaagactctgatgctgggatggattgggggcaggaggagaaggggacgacagaggatgagatggctggatggcatcaccgactcgatggacatgagtttgagtgaactccaggagttggtgacagacagggaggcctggcgtgctgcaattcatggggtcgcaaagagtcagacacgactgagcgactgaactgaactgatagttgtgaaaatatacatgtatatatacatgtatgtaggtgtgttggtgggtagagagagacagagtcaaagttctctatttctgcatcatctgaaacctttatccatcatcctaagatatgggtcctaaaatacccagtataatataacatagctaggttagtaggtagataggcacttttcactttcttcatgcattggagaaggaaatggcaacccactccagtgttcttgcctggagaaccccagggacaggggagcctggtgggctgccgtctatggggtcacacagagttggacacgactgaagagacttggcagcagcagcaggcagttatggagaaatcactaggaactagaactcagtgaccaaagtgggtacacataaaaataactggattcagaacagacagtgcaagctgaaattacagtactttgttttgtcctatattttacgtaaagtctgctatgtttaaatatagaaccagggactttcctggtagtccagtggttaagactccatgctcccactgtagggggtatgggttcaatccctggtcaaggaactaaaatcccgcatgcagtgcagcatggccaaaaaacttataaataacaaaaagactatgttcggtcaaattttaaatagtcctattttctgtatgtctgagtagcatgtttttctttgaattctttcatccaaagtaaaaaattaaacaaacaaacaaaaaacataaatcaaacatttcggccctttcctggtcctcctaccatggcctgactctattcagaaagtctatatttttccccatgacatctgaagtacaatatagaaattcatccctttagtgaactgggcctttgcccaagatttttattttgcatttaacaaaataacagcaaatttcaggtattagaaggatcgaaacaacctctttctattctgttgtccttagaacaccatcttttattcatagcttctcttgtggtgctaggaggcagattctgttgctatagtaacgccctgcatatccttggggatagcttacagttttactttttttttgaacaacaaagagccattgatactacatgttgccaaaggttacaaaagttgaattctaaaatgaaaatatttcttctatagaagtggtacaccatatgcgtcccacaaattcaaagaaatatgtacggatatgacctttgtgtgaacactgatgaatctagtataatactgtttggcttcaatggattattcacagcagaagtagttgaagtgtatgccttgttttctaagactactgtgggggataaggggtttactcccagtatctgttaagatccaggagcaggaaagaaaaaaaaaaaaaaatcaaaggtaccatcacttacattttgttactttgtaatcaccttcccttgcccacccccactaaaatgaactgctatatcaaaatccaattacactttgacagtaaatagatccttaaagagtggttgtgactgaatccttgttcctcgggatagatattaaatatatgagagtctcaagagctctgaaatctgtattcctagcttcattttaacttgattctcttcatctgtgaaaaaataatattccttagctagctgtttttttaaaactaggaaaaagtatttcttttcaagtatcttttcaggataagttatctcatccccctagaagtctgaagggatgctctgagaaccactggtgaaaagttagaggctccaaggaatcacttcctggggaaacagctacaagagcttataaagggtctggaggtaggaatatggatttttcttcttaacaggagagacagctacagactgaaaaaatgcagataagatgcatatacaaatacatatacaaggaatgatgtcaatctcctccactcactacagcctgggcaaattctcctcctagcaaactaagcaaaccccacaattcaaggccatttattcactcatttatcaatatttatttactaagtacatgctacattccaagccactcaaaggcttttcaaatgttactaaatgcctgattgtactcttgaagagttaatctctaattcaataaagtcttttttggtacagtttttatagctaccatatggagaaatctattaaaaataacagattcacaaggtaatcagagctagcaacataagctcaaagacagtgtttctaaataccatctcccaccaaaaggaacaaggtttccttagagaaatgactgattccagaaatgattgggataggaaaaacacaaggtagactagaatatcttattcaagaaaggaaggaagtgcttaaacatcgatagagtcatatggaaacatactggggctagtttgaagaacctcccactggccacatcttggacaatttgatcaccgtgaaaaatgacagaaacaggtcataatgcagttgatgaaaaataactcaatgaatccatcatgaaactcagaagaaggagaaaatatggtagaggtggagaaggaagaggaggagggaaggggtggggagaagaaagctcagttttacagaacactatctgttataattgaattgtctcccacccaaagtccatatgctgaagccctaagtcccaatgtgactgtatttgaagacgggacctgtaggaaggtaattaaggttaaatgaggtcacaagggtagagctttgatcctacaggactagtgttctgtaggaagaggagaggaagacacaccaaagggttctctccctccacaagtcacacgggagaggccaggggggacaccttgagaagacagctgcctacaagtcagagggaggattcaccagaaaccaaccctgacgagactttggtcttggacttccagcttccagaaccatgagaaaatacatttccgttgtttaagccaccaagcggtggtagtttgttgtggtagcctgaggcaactaatatgccaactattgaatgtcaagaaaatgatagaaatagaaaatctctattttcaacccacagtgaaaaaatcataacagatgccaaaaccaaagggcaaaaaactattggttttaaaatatcaccacacaggttaactgtacaacaggggctttaggcatgataccaacttaaccaaatgaccaaacttagcatcaccaatagtgggacaatctgatatgaacctcttgatggatccactaagaattatagaccagctatccagtatccttgccatgaatatttaatctgtatctaataatgagaaaacaatcaaataaattccagaaagggatttatacagcatttggtgtcctattcattcaactttcctgtggtttggaattcctcaaaatacacagtttaaaaacaagaaatgtaaatgtataaaaggttaaacgttttatggcacatagctcaccctaactgctactgaccaggcacctaccaagaccaacctgtacaacttaatggttagagagcatggatgctggtccccatagacctaccttccaagcttgctgctcagaccttccacaagtaacaggatcaccaagccttagttttctgcggtaaaatgagaccaccacctaagtgataagcagttgagaagatgaaatgaggcagataaactatctggcacacaggagacagtgattattattacccagaaggatgagggtaggaattggaggctatttagtctccattacatactgcatactctgtggtaacctctctcacttaccaatcagttactaataacaag

SEQ ID NO: 35239 - DNA, 1810 bp, Bovine  19866880263751
catgccaggcttccctgtccatcaccaactcctggagcttgctcaaactcatgtccattgcatcggtgatgccatccaaccatctcatcctctgtcatccgcttctcctgccttcaatctttcccagcatcagggtcttttcaaatgagttagttctttgtatcaggtggccaaagtattggagcttcagctttagcatcagtccttccaatgaatgttcaggactgatttcttgtaggatttactagtttgatctccttgcagtccaagggactctcaagagtcttctccgacaccacagtttaatgttgcagacatcaaactggaataaaggaaacttcaaagctatgggaaggttaggggcgtaaagagagatgaacttagatgaacttttctttatactgtgtcaatcctaattactgtttgaccagttggatccaatgaaacatggaaatgagatcaagcatgtgcgtatgacacgtgtaaactagactacttcctccttctctcttgctttcctttgcacaacagggcagtctgaagacctgggttctgagctcatatctggtcctcatgaggttagcgatctcatgttgaaggctagtgtggcagagtgctgagaactagaattcagtggtgcttcactgcaggcgtcgggctaaacactttacatgcactcgtttttgtcctcacaacagttctgtgatgtaaatggtattatcccctttttacagatgagggaactaagctagtgagagttagggaacttggcacaggttacacagaagagaaatattctgaagctcagatgaaggaatgtgtaagacaaatgtttctaaaattgtaaaatgctctacaaattttaactatcaatactattatatcatcctcagcaaaaaaggtaaacattttttctttccaagtgctgtttccagagaggcttctacttattctgcattaatatagcaacttcttccatctccaaaaaatgtaagattagtattaatacctgcaggtgttccaatggccttactgtcacaatggcagaaagagttgttttggcagagatgatgacagatacaggcggaaaacaataggaaatctactctcctcgccactctgttaggatttaataaaatccactgtgttaataacagtgaattttattgtatgtgtgggaatcattgggctgataatggccctgcatcataatgggtctcttgggaaaggtcactcttggctctgtgactttactgtcttgtctcttttcagtcacacaggcagcacacacacgagctatttgtcaacttcacaggcactcagctgcaaacagcagcaaccctcagattatcttgatggttggtgtgtcctgagagataagacagctgcctcactcctgaatgactggtgactcctctagaggctgtggccctttctttcatacagaagttatcagagcacccaccaatcagttcagtgttcccttgtggttgtaactgctattaatacaattaaccttcttatgggaatatgataccagatagcagggaaaaagacgcacaacttcattcccacgttctgactaggactttgtggtttattacatcttttctcaacccagtgttactaatggtatttctatttgactcttctcagaagtcaaatcatcaagtgatgccctttgttaattctcacgatcctaacgtgttatgatcctcttttatttagttggggagactgaaggaattctcagcaggccaatttagaaagcaccagaaaaacccctggactggagagatctgattacatg

SEQ ID NO: 35240 - DNA, 1112 bp, Bovine  19866880408576
tggaccctattaaacttctcttttggctagctattttggacactgctctggcagggagtgggaaggcaccaccttgctgctgctgtgtaaacgcagattgccacttggtgtcagttcactgggactgggaaagaaatccaggctccccgtgtataggttccacggtcaccgtgggaggggatgggattgtttttagttagtagggatgaaattcctggctcccaacttggccttctctgatatcatccctgcagaggtgaaagtcagctgcctattccatctttgcaggcatgggtagggttggggccacaggtttcctgtagctggagtagggcatttattgttgtagatgttgtaaatgtaaaaattgtaaaagttttctgtctccctaggctgtcctttttctggtcctctgagtaaagtaagcaggcttttgttgggactttaaaaaaaaaaaaaaaaacctgttcccatgatcatttccagtttccagctacttcagctccaagtctgagaaagatgaagcaaaaaagaaaacccactggactcagcaccgagtcattcctagtcccaaggagcccagctggtctgaattattctctccaccttgcagagtgctcttatgcttattttatatataattgccaagggttttagttgtacttggtgagaggaatggggaaaagtacatctactccatctcctcaaaagcaggaaaatccattttttaaacttcaaatacaaatttctcctttacagcaaaagctcctcataattgggtaacactgtaagaaaggatgacttaatttggagatctgcaataagtaaagcacttgaaaatcagtgcctgtaacagtgcctgataaaatcagtgcctaattctctttcaaaactgtcctgtgtctagacacctgattttttatttctaaccttgctttcagtctctaattaaattaaaacataagctatcaatatgacccaggctttaagataaaatcatatcacgctttgagaggcttgtctcaacttctcatcttatttttacgtatctctgaaagttcgcctcccaagtttacagcacacccaaatactcgaggcaaacgaccgaggtc

SEQ ID NO: 35241 - DNA, 1181 bp, Bovine  19866880493621
tgcgattcatggggtcacaaagagtcagatgtgacttagcaactgaactgaacttgataccaaacacagtgatgtcattgagtgtttttgggtgtagcccgtgatgaagcaaagtaatttgtatgtttgtatgcaagttatatccagataaaatattaatctctaatctttgttcccatgattgctgaagttaagagtttagattagaaaaaaatattggttgggaaaggaggtcttttaaaatgtagagaaagatcaaacattttaattataatcttcatattataaatattattaataaaacttcagtcaatcaacaatggcatattttattgtaacattgaagtaaaaaagaaacatggggaagttgtagcatttcccactgttagtttacaaataacaatatttaagcacaaactattaaaccaacataattaaggctcttgtacttcaagagtcagttagcaataatattgaaagtatctaaattactaaatggtagaggaacatactcctgtgtagtctagctgcactaaaatagaaatgtctaaattaaagttagtgcagtgttttctaaagaacaaaccagccttctgcaattggtttgaataagatgtctgaagtgtgaatgtataaagttgactgtcatatgtgatggcccctctggagggttctcctctgctaggctcatgcttctctcctaagtatagcttcttgaaggcttgtgtgagagctgttgagtggaagagtaaatttcctaatatttctcctacttcagggagtgagttttaaaaaaaaggcgggaagcggtgcttcaaaacacattcttttttgccccaatttcttttttttttttgaagattcaaaggtggacgggtgaaagttggatccatccagtctagtagttcttgagcagttgcaaatttccttctgtagaaaaaaatggcggtcttatagttggttcagatgtacacctcaagataattgaaactttcaccaggggttttagactttctataagaaaaaacaacaataattggaaattgttcattgtgaatacattagatttgtacagacaaaacattcatgaagtgcaattatacgccagtgttgctatattagtatgaatgttaatagcatgtttgtttttgaaatgggttatgcattctgataaatgtctg

SEQ ID NO: 35242 - DNA, 3655 bp, Bovine  19866880531521
gattccttacgattggaagatatcaagccggtcaaaaaaattccaccactttaaaaaaggaatcctacctgctatgaaggagcaggaggaaggggtggcagaaccagtttggagagtcttgccataagttacagtgttccagcatggacttacaaagggcagagcttaaagtatataaaaaaggggtggaaagatgggatgttaccgtagatgtgagtttttttttctcagttaatagggtgagtacatcaagaaaagtccactcaggtgcctttttttttttctgtcaaaagcacctgcatggtcataaccatatagagagatgggagtcagatgaaaaaatatgattttcattacaatatgaacctaccccaaataaattcgttaacacatgatcaagtgagataaacactgcaaaagtgatctgcaacctgttatatgcaatcataatgttagcggttttattattcaattagtagtaacacagttcttaaagattaaccagttaatgtccaccagccatatcttgagctttagcatatatgcatttatataaaatatgtaacttgtactattccttgtatatacttttcattctgttttatttatcaggtttcatctagacctaaagttgtttctttacaacccccaatatcatctttacatgaaccataaacatacactgaatttctaaggacatgggctatggcttcttcaatgggatttcttttagaatactcagtatttgaaaaatctttcaactacagaaatttatttcaagagagctgatgctgctacacatcctattatgagtcctccaatgacatatcccaaacaattcatctcaagaaggaaatctgctaagctgctccaaattctaagcaatgcatagggacttaaccacatttttctgtttacaatctgttttgtgccagggattctgggcccacaccatctgcaacttccattaaaacacaaccaaacaaaaacacacagctcttcactacattaaaaaacaaaacaaaactatagttggcttctctgggaggaaccactcccactcagccacttgatgtttatcaggatatacttactagttgagctctatgaaaagtaagagtggggaagttccctgtaaccaaaacaaaaaatgttacagatgcctaagtgatccttagcaaaacttttttctcctgtccactacatgtttaggagtttagcaggttacacaacccaccaaataaaagacaactagtatatattctcctcaaatatggtaatgtgatgtaccaaaaaaggaaagcattaactttatttttgtctgggtaataaattcacatggctcaaactctaaaaaaaatcaaaggtactcaattaaaagtttctctctcatgctatgccccagccacctagctcctcaccccagaggcaaccaacattggccatttcttaggcaaccttctagagagttaagaacaaggaagtgtgtgtgattcccttacctcctttacacaaccggtggcctaacttacgggcttcccaggtggtgcagtggtaaagaatctgcctgcaatgcaagactcaagttcaatccctgggtcaagaagattctctggagtaggaaatggcaactcactccaagtattcttgcctggagaatcccatggacagaggagcctggtgggctacagtccacaggggtcataaagagttgaacacaacttgagcacatatggcctaacttataccacttgtagttagactcttaggcacttctcccctctgtgctatggacaggaaataggcttcttcttgtgtgtcttttttgatagaacaatagtagcttcctcaagtgctgtgctttgaaggagtttgacgccagcaatcttggaaggacagtattttgtgattatttttatgtctgttacacccatctatttctcttctatgtcttattgtatcttctacatgcctctaatataagaattaccacactttatacttgggaagggtgtctgagggtaggtaccctgtcctttcatgtacataatgcacgatatgcctacccagcacaatgcacagcatataattagcattcaataaatatatactgaaagaatcctgcagcagaattcccaatgcttagggagaacaagagagcttttcatattcctgagtcagcttcttcccctccatgcaaagacagacttcactgaccctggaactgtagatttgtaatgaacgtgtatttgaaacacatgtgacagtgtttccctgtccctgttagaatttacagcaatgccatctgttacttgacctgcttgagaaaaaatactcaggaccccatcatgggcctgatcaactagtttccaatcactgccatctaaagagaaaatggttgtataagcatgtgatttctgaaaccaaagtggggtgaagagggaggtcaggtgatggtgggagaaaacttgaacgaaaacagtatgagtgaaaaagaaagtttatgattgtttaaaaaaaatccagtgagtgagaaaaattaacaaagaaagaaaatttcaattgaacgttactcattaagacacccctgctaatcattctcaaatctcttgtattgcttatatttccacccaagtactgccatctatagtacatggaggaattatggttttcttaaaggggccaaataactgaaatgaaagcatggcatattatataggcttacatttctgtaccctttaaacatatgcattcatcaaagttatatgctatattttctctttatcacatgtaaaaaaaagcaataatactcaatgggctggttattaacttttaaaaattaatgttgtaaagctacagcttatggactaagtcttcaaataacacgttatgtatctatgaacaacaaagaaaacataatttataatttgaactataattttaagaaatgttttaaatatgccccaatttccatttatttcattttgctgtgagatacaaactgggactctctaagaagtaaaaagaatctcttatttttggtgggattcctcttttctgaccagtaggttagcctagggatagacaggacataagaggaagaatataaaaagcaaacagactaactcagatttacagacaaaagcagaaaaacctaaatgaagatatcccagaccacagatggctttcatgctcccaagaggactttataccaatgtgttatgttattataacagaacttttaaggtaaataagcagacttcattaaaactattttttagagtaaaaagaaaaagaaaatgtgattttggagacagataaacatactagtgggcttccttggtggctcagtggtaaagaatctgcctgccagtgcaggagacacaggtttgatccctgggtcaggaagattccctgcagcaggaaatggcaattcactccagtattcttgcctggagaattccatggacagaggagcctggtgggctgcagtccatggcatggtgttgcagagtcaagacatgacttagcaactaaaacaaaaagccaataatattaagaagacaatgagaaattttctgctttgtttaaccaactattctcaactgggtataaaatttcatatttcctctcaaattacatcacattaaggttg

SEQ ID NO: 35243 - DNA, 1592 bp, Bovine  19866880643655
tatgcggcatgtgtgatcctagttccctgaccacgaacccaagccccctgcattggaagcacagaatcttgaccactggcttaccagagaagtccctacttttattttttaaatgcttggtttcaccaatgttttagtattttattcttaagccaattttctgttttaaagcataaaagttcaaatatttaatatctttggagacctcctactatcctcgtttcaacaagcggtagaactgggggaacaaataattttttttttttttttagggcaatggcatctgcaatcagctgataaagaggacagaacaatcataatttatgattacaaaattgaagaaagtaattgctcatgttattaaaagctagactatgtacttgtcactcttggaggctgtggtgattagtgctcgggactgggtaagctgtgatctaaggctttatgattaagctgtgattcagcaccacagggataaaaacagctccacgaccaagagctggcaagcaccagttgagggagggggaaggaggattgcaaagagcttcttaattaaattttaattattgctaattagaactactgttttttatatccccaacaaggaagacaagagctgatcttgcctttttattattctgctaattagtttcccaaggagaggtttgaaagggcagactctgctttgacagtatccaagttgtcagctgaactcagaactgcaggtggatcttgtcctcaacttgaggtttaaaatttctaggtagctctttttctgaatcttggattttattctggatacctcaggaaatgagctaaccccatccactaggtgaagaaattcatgaattagttttcctttagcttatcctatctaccttatcttcacacaagtcccaagatttctgcttaatgactaaaatatgtgtctgactctttgcgacccgatggactgtagcctgccaggctcctctgtctatggaattctccaggcaagaatactggagtgggttgtcattcccttttccaggggatcttcctgacccaaggatcaaacccaggtctcctgcattgcaggcagattctttaccatctgagccaccagggaagccctcttatagacagtgaatcctctacatactattaatgtcctcatgtaaactttatgcttttcgtgaactgctaaatgttagagatgatctctactgggtttgaagaataagcaaaagtacacataaaaggtgactgctagttttctgtagccatggacttggtgctttgcaataggtaacaacaacaacaaaacccaagtccctgccctcaagagctcccaagttctattaaataccatttaagatgaaatgctccaggtaacccccccttgagattgcaaaagagaaaccctaattgcaagcttgatataatcccagaaggttcccaagatccattagcattataaaccctctgcaaaacatgaatcttattttataagtgcatacatttcacaagtcttctcccaagataataaagagttctgagttagtacaactccctgtgttaattacaataaaatccatcaaagaaattacatt

SEQ ID NO: 35244 - DNA, 1053 bp, Bovine  19866880708897
tctctgatgacctttctttgcatttcaagacgtgcctttctttgctttatgtacatcagctatgcaaataggacatgattggttttacttatgggaaccaacataattggccaaatgaccagagttctgcttttacaattcatatgaaaagaaaccacaaagtacattttttccattctgtttagagatgtagattattgacatagatgtggatttttcactgtgttcatctgtgttaaaaaaaaatattgaaacagtacccaaaaatcttgcccacaaaaaggccacaaaaaattgctgcatttctcagtttataatattcactaaaaaattgaattcttcaaactcagcacttctactacagtacatcaaggaatgcagaatactctttacataataaaaagagaaatatacctgaggaaagaggcagcaatgcaaaggtggaagggtccctggggcactagcaaaagatgtttacatttggagaaagttcatctttttcttgtcataaaaaacaaattaagattttgcatgaaatgttttgactttccctttagtgcaaaaccatttttccttgaataatatacctaatagacatgaagaactgctatcaagccttttctcctccagttacagcagcaagaaaattatcttacatcagttgctgacaactagtatccctctcgggggcacataatgagagaactgtcaggcaggatgagtgtccagtacagaaatatttaattaatgagctttcatcatgcctccaggtaattcttcacagaactaaggatacagacagaacactctctgagcagtccaaggaattataaaaaaaaaaaaattgctgttgagagaatttctgttttcatttttttgaaagccaagttaacctataaaattctatggacctatttttcatctgcttaaactttttgtatttcagaaatattacataacttttttatcatggtaaaatatgcacaacattaaatttagcattttaagtgtataactcagtgacacgacatttatattactgcacagccaccg

SEQ ID NO: 35245 - DNA, 1724 bp, Bovine  19866880710308
atagctttcacttgaatctattcccaaattaatatttttatctttggtgtttctacactttaaggccactttgtgcaatttaaaaagtattggcctctcttcccctagtcaccttcaaaattaacttctaaaacctcaggaacagtacggagatcgaagccctcagtatggcagcacaattggctgtagtatgtgttagggtacaactgaatcaggtattcctggtggtcttatgcactttaatttctgttatattgagacttaagaggatgaagaagagatctacttaataacacttagggcaggaatatctgcatttttccgtttgttttctcactgttttacctctgcagacatcttcctgtgcagatcactacttcaaagatgccaaatgttaattaaaatattgacttctgaaattcattatcagcaaagttatgaatgttgttctgtttctaattaaccttagcaagtgtacataatgtcataatctgatagtatttgacagtacttatgtatacgatgtttcataagcatttttaataagatttgtatttttaaatttagtatataataaaaagatgtgtttgagtgtcaaaaaaaatttaatttcacatgcttcttttttcaccttcaaatatgacagctagagaatttaaatttacatatataaattttatttccattgaacaatattaatctagaggatgtaagtgtttaattatctttaaaatccttctagatggaccattctgtgaattgagaagagcatgtaaacaatgtgtcaagatataaggtaggataaagacggagcatatcatcttggggttggtgcaaaagtaatccttgggttaagttataggaataggaacagtgtaactttgcatagttgcatgaaactacctgaggaaaaatataagtgtgaaaaattgttgtttctgtgaaaaatcagttcagtgctttaaagccaagtgttaaagcatgatatcaagatatggctagaagttttggagggaaccgtaaaaatctacaaggattctgtacttagtttgctttacagtgttatcaagagctatgaaaaacctagaatctgtaaataatacattatgaggtagtttatgcaggaaagaatggagaattctaactgtttttatatcaaaagataatttatctaagtagatctatatgtctgtttctgtgcaataccatgccattttgattattgaaaccttgtagtttagtctgaagtctggatgagtaatgcctccagctttattctttttcctcaggatttctttgacaattttgggtcttttatgattccatataaattttagaattatttgttctaattttgtgaaaaaatgtcatggataatttgatagggattacattaaatctgtagatttcttagggtggtatggccattttaacaatgttaaaacttccaatccaatggtgtaggatagctttccattttttgaatcatcttcagttttctttatcaatgttttatagtttttagcatacaggtcttcatctccttggttaagtttattcctaggattttttttttttttttttagcattttctttgtgatatttcatggttagtgtaaggaaatgcaacagattcctgtatgctaattttttattctgctaccttgctgaggagacttagggttctctagatagagattgggcttcccaggggcagtaccgaa

SEQ ID NO: 35246 - DNA, 1787 bp, Bovine  19866880740158
ctatataaatacagagtattagtacaaccagtttctttttggtggtgtggtttatcttttcaataatattttaccaaagaaatctacaaaaatctaggcttattctgaaaatcaatgaaaaagataaagtgcagtactccttaacattttctggttatttatttaaaaattgctgcaagaaatgctctggtgcaaacatctataaaatttgcatatgatattaagagttcatagagttccccaaagcttatccatgtggactccaggtcaagtgactcttaacataatgtttttcttttttatcctctccattgttacataaagatgagtggaaaaaaaaataacacttaaatagtaataagtaataaataaaatctatcaaataaaagcctgcaaaagttctttggtggcttaaaaaaacgcatttaaggaatacattcccttgagtaactttaccagtaaccgttgcaacatcagtacagaaagcttgttgattaagactgcttgtttccgagtcgatgtgtagtgtggttagactagccacctcttgctcttcagcactctgataatggccagaacctgaatccatgtcagcagaggatgcattcccagtatccgctccaaaaccaaaatctacaggaagacgacatgctagtgaacagacattctgattacataacaaaaatatttacgagacagacagagctactttatcaaaataattaaatatgaacatcccccctaaatctacttcatatttacataccgttcaggcaagtataaacaatgttaacactttgaagtttataattagaaacaaatttttaaagatcttcagagcctattattaacaaaaataatgataaaaggacagaaacacaatcatcactattcttatgcatgttttcttgtagatggaaatacagctaactgcttttcaagttttagaatctctagaacagtgatatgtatcataaaaatggcacatatgtggtaaaagtaatttttctcttaaaactcatttccagtccaagattaaagtagtatataatccatgagggcaagaaatataattctccaatgaatctcccagctcttcataaacttagttcccaagattttgactctcttcttttaaatgttggtatccttcactgactgccaagtagaatacagaattatagcagaaaagctatatggtagtaatacagcaccaagtaacatcactgatgtcactttaacatgaaatgattattcaagtaaagttctgggtaatgtaacattgaatgtaactgtactgaacatactgaagccttgcccctaactagatgttaagtgttagtcactcagtcgtgtctgactttttgcgatcccagggactagagcccacctggctcttctgtccatgggattctccaggcaaaaatactagagtgggtggccattcccttctccagatctcaacccagcaattgaacccgggtctcctgcattgcagacagatttttttactgtctgagacaccagagaagccccatgactagacagtggtccccccaaatgaccgcatgaaatagtccctctcataagcatgactgtcccttattctaacaccaagtccatcctaatttttctgtcttctatgtttctggtcttaagataccatttgttttatgaaagaaaagtttttttttttttttaatgtctttagttggcaaaacaaagtagtttcaacttgaagtattccccaaaaatccttacagtttcacgaaaataaatcaaaatac

SEQ ID NO: 35247 - DNA, 1740 bp, Bovine  19866880902212
attttaaatttgcagctaaaaaaataattcctactataaaattcttaatttttatagaaaaattatgtaatctttattctttgttgagtccttttagaacattttgtgggaagaaactggagtgcatggtgaatataatctcttggcagaggttcttatgacctattatgggacacaaaccaaaaatacttcgcgtttgtcaagatgcacaaatatgcattacttatctgctacagtattacaatatatcataaagtttctgcggaaatgctttgtttttcatttagaagaatttgtaagtaaagtgtatgaagaagaaagctaacatttttttaaagtattctcttcaacttaatgataaagagttgtttcaactttaggagatagtttatatttgacatgtattgggagtttcagtgtatatcttcaggaatatagtgcaattttagtatatcacaaactgctcttgatttgaatttagtataaggtggctccttttggatctcatacaaagaaagtgatatcagtgaaatagcagaggtaccagcctctcttcatccctcacatagatccacaagaatattttgaattactgtcccccattttataaatgagaaaacttacttctcagagtctagagtaagaaaaccttaagtttttagatcttgcaccatttcagtaaatatatctgtgatcttggacaagtaactgttttctctggatctaaatcttctcattttcatcagttatagttctgttacttttaatctatgcattacaagtctaatgagtaccaatatcagactttttgactttgtccctttttcatggtatttttctgaacatgtcttttagtaaaatgccaagatgtttttgtagacatgacattttatcagtagtaaatgttttaatttgtatatatctctacaattaaatagtatttcatattgtaattttcaattttgtacatatttttgaaaatttatcatatacttatcacttcaggcactaaaaacaatgtaatgacatagaacactaagcctgcttctcaaacttgagaagtggtttcctctctttaggactcagtttgttcagtaggagagttaaataatctataatgtccattttgactctcaaatctgtaatttttaaaagaaatgtaagaagctgtaggtgcagtttttagggttccatggttacctaatggagtgggccagtgtttggcagaggagattggttcctagtaaattaatgctgtttgtgtcaaacatgaaaaagtagaatttttttagcagtgtattaattttatttgatagggtgaatagattttgcagggtaggggtaaatagattttaatagtgtaataaaataaagtaaaatacctcagtagaacagataactagtttcctgacaaagagaactttaggaagagaatagagatttccaagtgtagtaagtggtcaaataagcaaaatttgaagaaaaggtgatgtttcttgcctggtaagaaggaaacagaggaattatgagaccctatggagtttctgtagtgggatactaagatgagcttttttgtgttaagatctacttttttctgcctgaaactttattaagaaaaattgaatagcaagtttgaattgcttgatttattggcacagctctatctttaattgcacttccaaatgtttcatcacctcactgtttgttctatgcatgttaacattttaaaatgtattctgg

SEQ ID NO: 35248 - DNA, 892 bp, Bovine  19866880954008
aatctcaacttgaatgagaaaagacaactaacagatattaatacgaacatcaccaatgttggagttctctggaaaggatttaaaaccaacctgaaaaaaaaaagaaagaaagaaagcctcagcaaggaaattgatgatacaaagaaaaactaaatgtaaattttagaattgaaaaatgcgatagataaaatctatcgaagcttgctgatgggctcagtatcatatctgagatgagagcagaccaatcggttgagcctgatgtaaaatgagaagaatgggccagtttgaacaacagagacatgagcaggctggaggggacagacaggaacaggatcttggagctatatgttgtgatagcaagagatttagcacatgtccctagggtctgaccgaaagcgtcaggattttaaaagtagccagagaaacatagctgaaaattactcaaacttggtagtgggccctaagttacagattcaagaagctgagccaataccagaaagaagaaatccaaagaaactcacatcatcacgtcataatcaaacacttgaaatttaaacagcgaaggaaaaatagaatacagtgaataaggaagagcaccttacttacaagcattagtgcaatttaaattaaagcagctttttgtgagaaattatggaagccagaaggaagtggacaatgtttttcaagtggtttaagaaaaaaaagaactgtaacccagaattccacatcacacaaaagtattctacaggaatgaagactaaatccaggccctctcagatgaagaaaagctaagagatttttcaatagcagacttatcttcaaaggtggataaaggaagctcaccaaagagaaagcaaataatagaagaaatctagaaacatcaagaataaaa

SEQ ID NO: 35249 - DNA, 678 bp, Bovine  19866880988219
ctttctctgcaattaccgctggcatgagcctgggagaaaaccagttatgacctacctgcaaaatggggctccgggaaagccctgggacccacctcttgacccgcctttatctttcagcaaaaggagaaaagtgagtcctttccagggcttgttcagggctccatggtcctggactcaggcaggatgcatcccctgaagtgtaatgcattttaaaatactctttctgggaaatgaaaacatgattttgaagtagtctgtagtattgaaatgtaacactcttcttctgtgagaagcaagactagctttaggctcactggtgcagaagagtcctcaaggcaaagaggctcagaaacagcaggaatgggatcgtcagaaaggtatcgctcatcctacaaaaattggctctaattaaaaaatacgtcacattagcaagagtagctcagttggtaatgtggcagtgggagcaagctgtaaaaaggctccacagaaatatctgctctacagttttataatatgttgtttagagttatgatgaaagggattggatattgatggccagcggcttccaacacttctggccattctctgctcctttcactcccttctctgaagaataagaaccttagaaaaatttctcttccgttctccttttcatcctctgtcgactactgactgcaa

SEQ ID NO: 35250 - DNA, 825 bp, Bovine  19866880994274
aaggtgtgtttaatctgttgtggtgttggtttcagccccagtttcagactgagaacgatgatacttgggaaaaaattgggagtctgcctgcgggcaacattcaccccctgatgcagagattgctacagaaatctaaccgttggaagttttcaacatacaaaatcaggatttattaaaggaattaatatctctgaaggctcacaaagcaattctgttttcctgcaagatggatgaaaggcagagatttcaaaacatttgctagaaaacatcaatagccaatcctgctgatttaattttttcaatccctcaggcatcaaaagaagttgtgacttgtccacatttgcctcggaagcaaagcaatattgtaaattaaagatggctggagcttagctggctgcatttcatttttaattagttggcgcttcacaatatttttcaatgtttcttaagctcagaagctaaggaacttcctcctcacatttgttgggatgagagtgtggaacatacaggtgatattcacttacaacacccacgagaaaattctcagacttagctgtccatcccaaacatgaaaagaattggtatttagtcagatccattcctcctctttattcttgagcaagcagagatttctgattccttttaaccagttgggaacgcagacataacctccccagagatcagtgctggaaattaaagcaaattctgacaaactgtagcaaaagcaacagattttgctttgggcattttgttgaagtgtgggctaatttgtaggatggagatgtggaatggtgttttccctagataataaaaataaaaagtcat

SEQ ID NO: 35251 - DNA, 5356 bp, Bovine  19866881006194
gtggatctgtgggctgcatgcaaacaggaggtgaagattatgacagagttgtgggtggcccagtttggccttgaaatagtgtcccagcttagagccaaacagcccggactgggagagcggttctcacatccttgctctctctttcttattcattgatcctaggaaacctgtcaggacattggttgactcactgtgatatcagaaaagtgaccatcactaaacaaacaaatgactacagccctcaacaagtaataaagcaacctttggaaaaggggaaatgccaattcctagagttactgcattatgaaactgaaatgtttggtttacaacacaaaattacaaagcatacaaagaaaagtacagctcattaaagggaaaaaaatttgactgacatctctgaggaagctcaaactttgaactcactgaacaaaaactttacaaatcaacttaaatacgctcaaaaactaaaggaaaccatagacaaagaactaaagaaaaccaaagaaatgaagtatgaatgaaatgagaatatcaattgaaaaattacaaaaggaaacaagttctggagatgtaaagtacagtagctgaaatgaaaaaattcactaaataggctcaacagcagatgttagcaggcaacagagagattcagtgaactcaaaaatagaacaactgagattatcaagtgtgatgagaaagaagagaattgcaaatccagagctaggcctatacatctagggatgactgaattttttgacaagggtaacaagaccattcaatggggaaaaatatctttccaacaaatgatgctgagacaacaagatatccatttgctaaaaaatgaatttggttcatttttaattcatttgctaaaaaatgaaaatgaaatttaaaaattcatattatatataaaaagtaactcaaaatggatcgattagctaaacataacagtaaaaatcataaagttctcagaaaaaacatgggggtaagctgtcatgacctagaatttagtaatggattcttagatatgacatcattaaaactgaaaccttttatgcatcaaaggacattacttaaaaagtaaaaggacaatctattgaatgaagggaaatattatgtatctgagaagagtctagtatccagaatatatttttaaaaaactcttacaagtcaacaacaaaaagacaaaaccccaattaaatgggcaaaagattagaagaaattttctccaaagaagaggtataaatggcaaacaagtacgtaaaaagttgctcaatattagtttatatcattcattggtggtgggtggtgatttagtcactaactcatgtccgactcttgcaaccccatggactgtagcctgccaggctcctctgtccacagaatttccctggcaagaatactggagtgggttaccatttccttctgtaggagatctttctgacccagggactgaactgacatctcgcatcagcaggtggattctttacctccgagccacctgggaaatcacttctttatatacacttcccaaattttgttcagttgtttcttttttaaaattggattattataattaggtttatttttaaaaagtaaagagatatatttttcatcttattatttgtagttgggaaaacaatccagaacacagaaatatagagcatattcttaaaataggatatttaacttattacattcattataattactgatatctgattcattgtaattactgataattttgcatcttaatttttttaaaccatgctttactatgttttctttttcctaccttttgtttaattcatttagcttgattataaagttatgtattctatttctttttttttttttttttttgggatttgttcaataccttatttttgaaagcttttattctttttctgagctgttctaggttccaagattgaaagaaagttacagagatttctcacataccctgtgtccccacacacatcacacccttccatctgtcattatttttgtcctaaattttacttctgtgcatgtttgtgttgtgcattaaagtataaggacatgtttagtatcatacagagtatttatttttttgttgcctaaaatatactccatactctgcttattgatgccttcccttccctgaactcctggaaaccagtcatctttttactgtgtccatagttatgtctttttcagaatgtctgtagttggaataatgtactatgcagccttttcagactggcttctttcactgagtaatatgcatttctttattcaacatatttattagttacgtggatttttatgtaccagatactgaaatacaaggtagagtacattagatatatttcctgctctcatagaattgaggagagagatattctaaacaatacaaatataaatatataattataaattatataatttataatgtccaggacattcaatctattaaacgtacaggacactatgaggttcataagtaagaagacttatattgaagcataaggaaagctctctttaaggaaactacattttagctgacacctaaagaatgaggaagagtttgattgactagggaggaaggtgttctagggaggggagaatatgcatgaaaaccctaaggtaagagggaaggcctgtgtggctaaagcacagagaactggggagagcggccggagatgaggttggagaggcagacaggagccaaatcatgttgagctatattgattgtggtaatgatttttaaagtatatatttaggttgataagaattttatggagaagaatggttaatgctacttttgtatttaggtgttagatcattagatcacattacatatagattaggttcccaggtgggctagtaattaagaacccgcctgccaatgcaggagacataagagacgcgggtttgatccctggattgggaagatcccctggaggaggacatggcaacccactctagtatccttgcctggagaatcccatggacagaggagcctggtgggctatacagtccatggggtcacagagtcggacacaactgaagtaacttagcatgcatagattgggttggagagggacaagaatggattcagtgagactagtcaggaagttactgctttagtacagaagagatgtcatgggactttgcactagagtagtgacagctgacatgaagtgggaagactcatgtgtatttttgaagtagatgcgaggtttcttggttgtaagcaatagcaaagggctcgctgattgaacaaaggatgaaatttcctgaaagagttatgaagtttctgggaaggctgaataatcaacttaaaaagtggataggagagtgggcagctagaaacatagttgtgttcattcattctatagaactggggcctacaactgagcttcttggcttttgaagcaagagatgtgtgtgtttggaaattctccaggcactagaagtaaattcagccactggaacataaatttaacaaatgacagaccgaaggcggctaggtttctgaccccacgtgaatttttgtttctaactatcatcattagtgtttatcagagaacattaacttatttccagttataactgtgatgccttaaaatacattgatttctaatgtcacttgctgttgagcctcttaaaaaacaacactaaaccattaggcaaacattattagataacctggacccattagagcatggcatttgttgttctctttttgccagacattgtttttttggaagtactgatgcttaagttggttggatttcacccaaataacaattacaatgtgattatgcaaagtagtaactgtcttctaattataactctaaagctaaagaaatctattagcaaactagttataactagggaaaaaaagaaaattttggccccaaatattcctagacctaacagcagtttattagaatactccagattgttagtttgctgttgggaaaaaaattgaggcatacggccctgtttgttttgcagggttttaaaatatagtgatgtcagatatatcacttgctgggtaaaatgaagtcatcttctccttatagaatgcctctctgggaattgtatcatttaaaaagaacttcagaagcttgttaacctttaagttcaaagtcagggaaggacctgaactacaagcaatatcttatgtgtacatggaaaattgtgaactaatttggaccgtcattctcagtggtgttccccacattttcttctttgtctttcatgtcctgtgtatgactgatagaaaagtattttatgtctaacctggaatgaagtgagagataaggcaagattgctatcatcgtttctgaatcaccagacgcctagcagtttctggagcaaatgtttaatgtttaaatgtattaaaaacatttctggtcacaagctctgtaaccagtatgaaactactgaaaagaaggaatctgttacaggtctcgaagaatctcattgaacattgaatatgtccaattttaacaacatatcttgggagggcaatataaatgtacctacctatgttggagaaagactaatgctatataattgttaagaaccaaagcaatctctacaaagtagcttttaagaccagcttttccaggaaaccttttatccacttgcatcccttcctatcctttcagtaattcaggtcagcaaataactgttgttcctgttttcttgctgcagtctgtctgtttcttacacaacagccaaaatgatcttcccaaagcacaaattcagtaatgtggatagaggacagagacaggaagttgctaggaacccacataattgacatcaggacttaaagaaacacattgtgccatcaggacaccatcaagtcacatcttgccggggatttaaagtcaacaaataaatcaagattaagtagaaacaaagttattatttacaatgtctttgatcacctgtgagaccagcaccctccattaaagacttgagatcagaaaccgattgaaaaaaagacaattattctctcccttcctacacaaaattttattgaaccgaatggtgggacttctgtctgttgtgttattttttttaggttctctcttcctgccaaatgcttatagttgaatttctgtgatctaaatgcacatatgctacaactcgattctcataatagcctatgaaatgatgaaagttgttaataaggtgagtcaggaaccagtagttctaaaacagtggttctctttcctgtactgactctgataacattgactggcaatattttcttagtgataacttagaaaagtttgtcttttgtgatataagtttggctcagattatgtatgtgtaagagacaactttacacactttt

SEQ ID NO: 35252 - DNA, 1107 bp, Bovine  19866881051138
ctgataatctgaggatgtgcccatggagagacatatgtctctatcaaatgacagcagagtggaaaacaaaaaatgaggttagacagcagtgcccaggacggctagctgctgctccaatgagcctttcccctctctccctgggacagcccccttgtgtgggcgagctgctgcccagcggacagtggggggagtactggccacgtgaccaagttctggccaaggagaggttgaagacacttctgaaaaggctctcaggagggaggggggtgagcggtcatcacactccccggctcagctgccctccagtctgcaaggaggaccagcccccgccccgcacagcccccaagctggggcccttgccccattcctgcccgctcaccccatcatgccagaacatctggactcactgctcacactcaaggattacaagggccagacactaactgaacacacgtttcaggatctgactcttttctatggcacttggatttatctacgggtatgtggctcaacagtctgggtgggctacataattatggcaggatttgccttattgcatttgctgatgtttccttcacggcccatttatcgccgacaccccgtcaaggggttacctgttcaagactccggcacacaagacaagaaaccaggggaaaaagaaaattaagaggcatgctaaaaataattgataggggttttcacggttcagctttactacttcacctgcttgtttcatgtgaatgagctaaacagttttcttacctaaaatacgagctaaaaaccacctacgctcagctatatacagattctgttctccttgtgttttacttctcaattaggttttgatttataaaacttttagactttctttttttttggataagaatatttttattgtattattaaataccatcttttttccactgttacaaatttgtagatactacatgaatgatgatacataatttatattttatagtttgccgatatgatgtatttacacatgcagttagtaccaatgtcatgctaaatttccttaggagatgctcgttcaaaacaaaaaacgtgagcaaaatgtgagcagcttatctactgtaggaaaatatt

SEQ ID NO: 35253 - DNA, 726 bp, Bovine  19866881232622
ccaaccaggaggacacccagacacaagcttagcatgggataagagtctttacgtcttccggtgaaggcaaagccatttggttggcacttcgtaggaatatctttccaccaggtcgtcatcataaggtatgtgccacgagtctccagttgtttgcaccacggtgtcatagctgagaatatgctgttgaattaaaaagggaaccacacattgagaacaacactataggaatatctggccatttccctttcttttctgacgatttcttagtttgcttcagagatgtattctttgtcttactttaacaatggattttcaaagagcagccagctctgtgaagatgaatcctggtggtaggaacggtgggggttggagggtaaaacaggagttaggattaacagatacatattactacatataaaagagaagacttccttggtggtgcagtagataaagaatctgcttgccagtacagggaacatgggtttgattcctcatctgggaagattccacatgccaaggaacaactaagcccatgcacaacaactgcagagctgtgctctagagcccttgagccccaactactgaagcctgcacgctctagagcccaagagccaaactaatgagcccctgtgccccaactactgaagcctgtgcatctagagtactgtgctccacaacaagagtagcccccactctccacaattaagaaaaaacctgtgtgcagca

SEQ ID NO: 35254 - DNA, 1210 bp, Bovine  19866881242099
cttcttgcctggaaaatcccaatgaccagtggagcctggtgggctactgtccatggggtcacaaagagtcggacatgactgagcaactcccccacttcacaggattgcctttgcaggtggtggacactttttcctggggcttatcggaaggactgactttatttccctagattgatgtatggttctaaaaacagagaaatggacataggaccttaaaaatcctttttagacatgttattcaatttaagccaatgaatatgcagtgagtacacagttgttttagatgctatggatgatagcaaatgtgaaagatgtgggttctcatagtcacaggagtttataatattctatccaccaaaacatacaaagaaaaaaatcaaggcaatagcaataacaaagagaaaaacacagtctagaatgtattcaagcagaaactacaggtacaaatttataaattttgtaaaaaatcagagaagaactgaaataaagggaaagtttgcatttgagttgcttaatttacttgatgagaaatataacttaagagaattaaaatttcactgttccagaattaagaattacagaaaaatctgtgagtaccattttgcctttttatagagatggtaaaaattgagtgtattttcaaatactaaattgcataatatgtcttgaggctaaacaagttgagtgtttttacgacaggctagaaagaaacccttcctctttccagggtcctctcattacacgtgcattcacaaaaagggaaataaaaactacctggcccataatatggacattatttataatctaatagccaaataattatttttctaccaaggacttcttgaatttcagcaacacactaagcacaaaactagaaggaaagcttcatgcagtggtattgattaggacttcccaaaacatttagctcatgtcacggttacttaaaatgtccacattgtcagctgcttaacatacatatgattaaaaaaaatggcattgtatcctgagctacatgctttcttgccccatttatttgtctaatctcttttctttttattgaagtatagttaattaacaatgttgtgttaattttagcccaatgatttagttatatgtgtgtgtgtatatacaaacctattctttttcagactcttttccttataggttattgagtatagttccctatgctctacagttggttatttatttt

SEQ ID NO: 35255 - DNA, 1859 bp, Bovine  19866881243848
tctaattcataattctctcttttacccccgagttttcaggacaaattttctacatacaactaccttatttatgttaggggtactttggggaaaagaagaaagagggcagtgaccagagatggagagagaggacagcaaatgcacagacaggatcctacaagagagcaggctgcagaagaccacgtcctggagcacagatacctccaggaattcacagaaatactggagagaggcacagtggatttcccacttcacatggaatagggtctgaagacattttaagtagatattttttttaaaaaaggttgactgcaggaaggtgagtgaccttggaaacacattacatatatctatattatatgcataaatagccatttggaagggaatagaaaggcctcatatataattatgagcatgaactttgcagccagactaagtttgaatctcaaccccatataactatgtatctctgtgctagttcctaatgcctccaagactccattttcctctccgtaaataaaaagaaagtacctacctcatagggttgtcatgaggattaaatatggtacagttgttggcatatggtaattgctatgcaagggctttaagcaaaatcaatagatatatatcaaattgtgaacagtgactatttctagggaataggattacggggggtttacttacatttaatatttatttctgaattgtttaaattttctacaatgataatgtgttatttataaaatcatgaaaacatcattttaaaattcctgtttaggaaaagaagcaaagtatctgcgagaatcttcacagtacacatcaggaacacattgttttctacaacaaatggtagcataagctatttattgtcaagttttctgttaaaataaaatctctatattttaaaaaacttcaaatcgggacatgtgtccagctcaagattcaacttatccatcatcagaagacaagtgagactaatgaacacatttgtttggattctgcttctatttctagagtctattaccttcgtaggagtcattagtgtctgcttgtaagagataatatgcttgaatcatacaaatcttgtatttcataagcagaaactcagattcatacattattggtgaagaattaaaattattatagatatgtaatattcttcttaaaaatacattatgtagtcgacaaatagaattgcagataggactgtctttccatctggacacaatagcaacacatgtatcagatataaaatgctcacatgtgaggatacagtaagtcccctacatacaaacaagttccagtccaagagtgcattcataagtccaatttgttcgtaagtccaacaaagttagtccagatacccaactaacaccatcagctctatagtactgtactgtaataggtttataatacttttcacaaagataatatataagaaacaacacaaaaaataaaacatttttaatcttagagtagagtaccttgaaaagtatagtagtacagtataataactggcatccagggctggcatctagtgagcaggcaagaagagctactggctggaggagggagagggggtgggaggtgctatagctgaaggattatcagcaataggagatggagggcaagctgcaattccactcacacctgacgctgatgtgacacacatttgcatctttgaaagttcataacttgaaggctcatatgtagggaacttactgtatttacaaatcgccatatagctccaactacatttctgacttttttatacaggttaaacttggttcaaaggtatttgttacttttgccctatgtaaggatcatactcagagattcctaggatttaaagaaacaca

SEQ ID NO: 35256 - DNA, 1493 bp, Bovine  19866881310126
gggagcctctggcactgttctctatattccctccatagttctttttcctgtcttggcacgtttccttgcacgtatttatgctcagactgacaggaaacctcctccagtcttctaggatcttactgggtatggctctttcatctttggaacttttgtcatgtggactcgagttaccttggtttccttggactgtcagctcattttcttagcttggtttccactggttctgcctagattcccttttccctcagcgtggcctgtaaactcttaagtcagtaaactggagctgtcaaaggtatacttcatttgtttgccatctgtcaggaatgactttccctatctgatgtctgtacctgcttgaaacatacaaaccaaagaacagaaaaacccctgaaacataaacaattttcagaacattggacatcaggtgctgataataagttctcctaaatgagtgagactgaaaattggattcatagtcattcaacttggcccctactttttaacacttttatatttagagaagaaatttatggtcagttgactattgattatatctgtgaaaaatatttaattgttctctaatctgaatatatcaatgttttcaaaaagaaagttggattaaaatatcttcaatcaggaaaatgagaaactagtgttcattagatataaaaagtaatgtataaagacagaaacaagtattgtttatgttcattaagtaaataacttgaaagcagtttagattaacatggaacagctatgcctggaaatctgaaaatgtataggaatcactgtgaactgtgaactgtaaactgcatataaaaataaactaagttgatatttgaatatgtttttaggattcgatatgcaaagttagtaagtaatcctatatacatgtcattagactttttattgttcttttttttaaattttattttatttttaaactttacaatattgtattagttttgccaaatattgaaatgaatccgccacaggtatacctgtgttccccatcctgcaccctcttccctcctccctccccataccaaactctttatattctttagtttgactcttgaactattttatctttgtatatttacaaagaagtgatatactgagtagattatttacataaacaatgttactgattaatttgcttagtaaaccaaactgttgcataatataccaattttttttttgtatttttgcattaacacttcttttattaaggattttattccatccaaagaattttgcatggcttataggactgaataaaatgtagactagaacaattagtgataaacagctgaatagccattacttaaaggtaacatcatcaggttccagagatgagctggttatagctgtaaggcattgaacttgattcttagatttcctggcagccaaagtaaaaagagaagcatgttgagttacaagtttacagtgtcttagaaaagaaagcatacttttttttttagttaaaa

SEQ ID NO: 35257 - DNA, 1685 bp, Bovine  19866881442583
ccacatcatggggcacaggttcaatccctagtggggaaactaagatcccatacgtggcacagtgtggccaaactttttttaaataaagaagtgatataaatccatattcagttcagttgctcagtcgtgtccaactctttgcaaccccatgaatcgcagcacgcccggactccctgtccatcaccaactcccgaaatccatatgagtcatccacaaaaataaagaatattgtaatgaagtttaactcacgcataaaaaaaattttttttaagattaacaaaagaaaagcatacaaatttatttagcatacttttcatgtgatgtgggaaccttcaaaaggaagacccaaagaaatggttaaacctgagcatttttatattaggtttgatgaagagcagaaagtcatgaaaaagcagcagagggcaaagggcatgaagcaagtagatagggaagcttagcaataattgttcattcagaatcctctctggtccctagattttaagacataaggatgctcctttcctccagatataatgagggcatctctaatatgaaattttttatctacttcaggggaaggtcagaaggtccttcttgcacatgctggtttctcaaattccttcagtttaaaatactcaatatgacaaaataccatatttggcagcagcatgtcctgaaccccatctgttaacctaaaatgtgacacagttatgctttactttatcaaaatttataattacacctaatgtggctcttttttcagttgatgaaaactgtaaaggtgacttttcctaaaccagaagtttgggtgaggcttcacagcagaataatcatataaacagcagaaatgtaaccataatattgcaatatttgataatttggacttctacaattcagaaaatattttcatatatttcctagagaaactgaatcagaaagcagaccatttgaactctaaaagaaatggaaaagtgtgagatcagaaatcagaatcagtgagcatcagaatatgagaataagaacatgttagcacatacatctagccagtggccgatgctgaagaagaaattcaaataaaaagtaccgaggcattggttggaatgctgagtatgccccttcccacaatcctccagccacagtggcccctctggctgtagatcttagctgcaaccctagtaatatgactcatccaagtaccatttccctgcccttggctgtgcccttacagaccttgaactgctggaaaagtaccatgtgtcatcaataaagtataaagggaaagacattcacaaagcatagtaagatataattactaatgatggtcttgtttcttcaaaggaaccaggttgagaccacttccaaaaactattcaatttcccacttaatagccaggtaaccatgggcaagtcatttaacctctcaaagttcaagttttccttgtctgtcaaacagagatgataaagtacttattttataggattgttatgaggattcaataacagaatgtatgtcaaatgcttaactcagttcttcatacacagtatcattgctaaatggaaattattattatattattaatataataaacccaaaccccagcagtttcttatatggaaaagtaaagatatggaacccaaactaacccttatacccattaattgatgtatgagaaagatttaaaattt

SEQ ID NO: 35258 - DNA, 1545 bp, Bovine  19866881464451
aaattgtcactaaatttcttccagaattctacttactaacctaggtctgcatgaaacactaacattggttctgggataaaaataactaataatagaacccttggttgaagttagttacaccttgttgtattgacctttttgtttctcagcatgaaaaagtagtcctcctgaactgaaatggtgtgtctgtattttgtaatgtgttgcattgttactggatatccttactcatcaaatagttattgttgtgtgccttacactgtactaggcacctgaaatacaaagacttttttaatgatgttcaggggaagcaggaaaaaagaatacagtatacttggaattcattataacaagccttcaaattctctttatattatataagttttctttgtattaaataagtttaataggcacagtactcctcttctggcctaattggtttgaaaaaaataacaataattctcaattgaggtttagtctgtgaaattaaagtttccgttcctgtcacccacttaattggccattataaaaataattttacaaagaaacttggagccctttcaattaataatataaaatacctaacaaagagaaaattatattagactgggttcaatcttttgaaagattaaaaagtcttttaatgtttgctttggtggattgacactatctgaaattactcagcttggcattaagaatgatggtaaaagaaagatactaaaaataaattaatgaacaacaaagtaaaaactagttaagtatacctggacatttcatttttaataatagagaatatctgataaaatatcagacattattgaaatagacatgaacacttttgtgtatcatatagttgaaccataagtttcacaagtgaaaatattgattagaccatgttcagactaacttttccccttaaatgtatacaggctgtcagtttttatgttgtagttgtttactagctggagtccttcatattcctgttcttaatgtttttcttatattttatgtattatcctgcacatttgaccagatacataatatgggaagtaagtagtattctcacattctgagacattaggtaaaggatgatacagcagccaagtcaaggctctttggttaatttggaggtgagggggttgtgcctggtcttagtcgcagcttgcaggatctagttccccaaccagggatcggatgaaccctggcccccacattagaagaagcccagaggtcccagccactggaccaccagcaaagtccctggttaatttttttttcagttgtctttgcttttaggaaacactagaaacatgaccttgaattttttttacaaggtctttttacctgtaaataacttttccaatattactgaatacatttttatgcttttttatagacttgaatagttatgaaagttaaaatttttatcagagtagttttaaggtggtttttttttttcctttaatgtggaccatttttaaagtctgtattgaatttgttataatattgtttctgttttgtgttaggtttttggacccaaggcat

SEQ ID NO: 35259 - DNA, 1174 bp, Bovine  19866881560742
tggcttgtgtagatttgtaaaatgaaaatttatattttaatgtataaagaattcggaaaatttgaaagatatttgatatttgaattattgaaagataataccatttttatagcaaatattaatttcaaagttattcattaaccaaaagcaaacatacgcaagaaggaaacattaattgatttttttactttaagggaacagatgctgcttgtgttgctcagagtcacggaatctgtactgaagatgccatcacaagcttttctgcagttccaggggaaaaaaaacatgactttggcaggtcgacttgcaggaccacttttccaggcaataaaaataaataaataaatagataaataggtggatagatacgtattttttcttaagattcattgagccctgaacttgtttcttggggaaaaaagctttaaatcagaaatcatattaaaggagcttttgtagagccaaataaaagttgtatatctagtagtatgtttgccatacatacaaactaacagcctagcagaatagatgagataccagtcaggcctatgaaaaaaagtgttaaactgatgacatttactttatttcttgtggggtacactttcatatgattgcaaaaagatgccagaaggctttgtggtaatgatttgattgtttgcgttatgagtttccaagtctctggcgttgttagaaaaacaaaacttcttttaagttgttctgtagttttaaaaaaagtaaatcaagattctttcccaccacgatataccgttagactttatcctcttcacgtcttcatttgaagtatcagtagtagttgatgatataggaattacatgttgtgttttccaacccaaggatagagtactgactttacatgtgtaatagattatttggagaacaaaaagcaaaataatgtttttttaaagacaaaacattaaatataaacacatggataaaatggctcttaatgtcaaggataaaaactatctcagatctaagtcttggccatttagtgtagcttttcaatttaatatttttttcccagatggtgctagtttacctaaaattctgtgttgatagtgaataagtctttcaaatcagctacatttattatttaaattccttttgaccattagtcttttattccacccccccatcattagaaccaacccca

SEQ ID NO: 35260 - DNA, 753 bp, Bovine  19866881656968
atcataaataccaggcatcaatacctgccctccaaagattcacaagaaacacagtaagaagcatgttattacttgacactaattttgctaatcaacataaagtatgatctgtaaaaataggtcaccaccatataatcaaggaagaggagaaggaaagctgctagtctacaaaagtgctccttttcgctttcaagcccaatagcttaatttggggtaaaataagattgtaaagtaaggccatcagttataaataagctgatgaagccgtctatacatactcacgtatatatgtttaaatttcagttctgatttaacatgaatgtgctattacaaaccatttataggaaacattttatcaggcttatttacaaatacatgatcagagaaaagatcttgaaaatcaaaaaaactgcagataaatgtagccattgctaacacagttcactaaaggtaagacagatttacataaaaaccaaaggaaaaagtttagtaagaaacccctaccatatacacctattggtcattggatcaaaaaggcaaataaatgtaatgatcatgactaaacttttattactgtctcttttaataacatatcaacatgaggtttacttagagtactacctataaatacagtctctcatgattcaatgagaatattaagttattgaatacatttttttattcccatggcacatcatacttggtaacactaataaggtagatttagataacactttatcagattacgaatgt

SEQ ID NO: 35261 - DNA, 1316 bp, Bovine  19866880344604
ttgtagctgttattatgaatctgaccttttcagtgctttggtatgtatattaagaaatcacatgtcatgtcttcttttagttcaagggtaggacacccacaaagatttaaaacgataagctgagattcgtaaaatttcttgacaaaggcaaagaatgatgctgacagtatataatagcttgggtatttattgacctttacattatattactagatacgacatagtgtactttgaactgacttggtaaagaattactttgagtttctaccttaattcaagtctttaaaaacttgtgtggactagttacaagcccaagatttgctatgttgaagtcttagggcataaaattgtttgtaagattaagtgagtattatggaaaaaaagtcccaaactttagggtcagggagaaatttttcatatatcaattttaaaactgtgtattgtataatatggacaagtcacttagctttgataaagcatagcttcctcacaaatgatatgagaaaaaatgtctagcttgtaagatggttataaagattaatggtggcatatgaacagtgatttccattaatttcccttaataaacagtttaaaattaattaattttactttaagttaggaaatgattagatcttgtataggaagtcaccacatcagtttcatgaataaactaatgattgaattcttagaatgcctgctgctactgctgctaagtcacttcagtcatgtccaactctgtgcgaacccatagatggcagcccaccaggctcccccatccctgggattctccaggcaagaacactggagtgggttgccatttccttctccaatgcatgaaagtgaaaagtgaaagtgaagtcgctgagtcgtgtccgaatcttcttgaccccatggactgcagcctaccaggctcctccatccatggggttttccagggaagagtactggagtggggtgccattgccttctccgaaaaaaagatgtttagaaattaaattatgtttgatttaacacactttttcaacttttcataaaagataaagaattaaaaaggcaataaaatgaaagtcttcctgattaatgtttcctgtcaacaactgctaaaaataaaacttcagatgcctgacattatactgagtatttcatagttacacatgctgtcttccagagctcttggtacatctgatcagttttagtatgttagcccataaatatctttcagttaaggatgaacataatatctcattttattgatagggaattgatagccaaagaagttaaataacttcctgaagttgaacatacatatatatata

SEQ ID NO: 35262 - DNA, 1545 bp, Bovine  19866880435739
aattacaaaggactgtataagtccatgagatcgcaaaaagagtaggacaggactgagtgactttcgcctttgctgataaggttaggatatgtgcagggactttaaacttgtctcatgtaatcttgttgatgagtttctctggatcctttagcctagcctcatgtggtgctctctggcatgatgactgctgttcatttgctgggttttagttttatcaagggtttcaagacattgttaagtgtatcccttgagaaccctgccccaaggctgaactactgttttttggctgttcctcccttgagtttgcatctcctccttcccggattagcgactgttccactgattgaatttgcactttggaattcagggaagttcatagaatctagagtttgtcccctataagaaccaggggacacagaagtctccttgactaggagccccatatgatcctgtttagtttcattaacaccgtggggtcttactgattcaccctagcataaaggagactaagccttcagcagtacgggaacacaaactatcagagccaaaatttttattcaaaattatcttattctccaatcaggagcagtggggagggggggacactacagagactttctcacagtggtttcaaaaatataacagagctatgtgagctcagacagactgcacaaaccagggaaagtaacacaggagaggaggaggtggtaaattcctaaactcagaagaatctcccaagcctggaattctgtgattcgcaggcatgttccactctgagctggacccatgtcctgattgagcccataaaatcttctccagcaggatgctctgagctatattccagcaaatctagggcatggtaccatctgtttctatataaggggcatggagcatcttctagtatcagactaaaggttgaagaatgaaagagtaaatatcttgttatggtccaggtcctaagaaatagggaaagtcaggagccagggtgagtcttttgggagagtcataagcaaggcatgtgggacagcaagcctgcctttgtggcacgcatcactgcattttcctgtctctgcagtgggtgagcagacctttagaggagatacttaaaggtctatggaagtgtctgaaagatttgatgactaatcccaccccctccaccccatatctaggaccttgcaagtgatctcaaattttctgtacaaatataataaaatgatgtttttgtttacaatacattagtttttatccaaggtttacaaaatattaaaacttttccctttgttaatgaagcaacaagaaaatacaacctgtgcccaagaaactctttacaactccaactctcaaactttctcatttttaacagtcatggctatctaaattcaaagacttttgccaatgcagagaatactaagtacagttgcctctggatctgaactgaaacagaattaaaattcttaaaattatatttcattccacacttcaaaaggaaacttttgaagtcaacataactcacacatcaaaacctccaatgaaagacctcattgg

SEQ ID NO: 35263 - DNA, 1138 bp, Bovine  19866880666516
ctggcatattgagtgcagcactttcacagaatcatctttcaggatttgaagtagctcaactggaattccatcacctcccactagctttgttcgtagtgatgcttcctaaggctcacttgacttcacattccaggatgtctggctctaggtgagtgatcacatcattgtgattatctgggtcatgaagatcttttttgtacagttcttctgtgtattcttgtcacctcttcttaatatctcctgcttctgttagatccataccatttctgtcctttattgagcccatctttgcatgaaatgttcccttggtatctaattttcttgaagagatctctagtctttcccattctattgttttcctctatttctttgcactgattactgaggaaggttttcttatctctccttgctattcataggaattctgcattcaaatgggtatatcttcccttttctcctttgcttttcgcttatcttcttttcacagctatttgtaaggcctcctcagacagccatatttcttttttgcatttcttttccatggcgatggtcttgatccctgtctcctgtacaatgtcacaaacctctatctatagttcatcaagcactctgtcagatctagtcccttaaatctatgtcacttcctctgtataatcctaagagattcgatttagttcatacctgaatggtctagtggttttccctactttcttcaatttaagtctgaacttggcataaggagttcatgatctcagccacagtcagctcccaaaaagcattatttgcctctaaaattttcttctctctctctctctcttttactttctttctctttctgcttctctctgcagctgtaaactgttacttcagacttttactattctacttcctatgcacaaacaacacctccagagttaattcattgacaaggtttcctgggaattcactgaagacaaagatcacattaacatctacagcacaaacacacacagtgtgatccctgtggtgtcagattacctcataaacaccgacaggcaggacttgtcctctgttcttatcttttttcctttaacattgactgccctcaccacctgcaaaaagaacagcttaaaaagattaattattaattttttaaaaa

SEQ ID NO: 35264 - DNA, 810 bp, Bovine  19866880786921
tcgtgtctgactctgtgcgaccccatagacggcagcccaacaggcttccctgtccctgggattctccaggcaagaacactggaatgggttgcccatttccttctccaatgcatgaaagtgaaaagtgaacgtgaagtcgctcagtcgtgtctgacccctcgtgaacccatggactgcagccttccaggctcctccctccatgggattttccaggcaagagtactggagtgggataccattgccttctccaaacttggtatctactctctactaattgtgtgattcggagcaattaagtctatgactaaagatggaagaatgtttatttctttgtaggtagggtcttcaatttgacctttatcacaatcaaacaacaagatagccagggtccaaaacacttcaaagtctcaccctgctgccagttttaaaggctttcggaatgtttgtttctttcatactttaatgtttgtgtatttataacaaagagcttattatagtgcataatttcataattatccattgattcatacagctccttgctaaattcagttccaggtgtattccttatgtttttcatccaagtttcagatttgcctttgagataatttatcgttggtttaaagacaagagaaaaagaaaatgagagacattgcacctttctgaatcctttgggcacaataaacagtgcaattaaatcagcaattctaagaactctgaagttgttttaagaacaattttcctcaggtctataaaaatgccatcccttgtaaagcttctgaaatcaactagttgtatcttatagccagtgag

SEQ ID NO: 35265 - DNA, 977 bp, Bovine  19866880845783
ccaccagggaagcccaagaatagtggagtgggtagcctttcccttctccaggggatttccctacccaggaattgaaccggggtctcctgcactgcaggcagattcttcactgagttatcagggaagccccaatccttagaaataattgcactgtttcaggaaaaggtaaacttctcatcaattaaatcagagaatattcccagactctgcagttttgcctccagccttcattaggggccccttgttattacatgcttttagataaactacaagttgttagttcatctacagatctttatgcattgtgattacagcttcagtattgcatacgtgttcctgctgagtttttagatgtctttccacgtggaaactccagtagagatgtttctgtatagcagatgcttttaagcatcatgggggttgtaacagagagtgacctaagtttttgagcttaactggggttctcattcagtgaaatatgttcttcgtaccttcctttgagagataaggggctggtcaggattatttgaaagaagaggagtctattttactttccatgaaataagttcatcttggtagatgaaaactcttccaaagaaaatgactgccgggagattttctggaaaccattgatttgctctatttgtgtcgcctttcaagttgcctcctgctgtttggatgatttcacacactcttttcaatctggtaacagggatctgcatattcgtgattctcaggtctcaacccaagatatttatcacaggacgaaactagatgaaattggaacaaaactgatacaaaaactaactcaaatgttcatatctgttacatttttaatctcattcatcaaaaatattcaggtaatatgctattaaaatatcttgatgtgcaactgtctcatttcattgggtcattagcaataagaaaatgtttgttaaatgaatcaaaaacattcttatcatcctggataggaacag

SEQ ID NO: 35266 - DNA, 1746 bp, Bovine  19866881272975
actcctagctgtcttaagtcatttaaggacacagcctgtccataaagggtgcctgtgcccaacgtggacctcccctacggttagtctgtcgccacgatgcaccttgggctcatgtgccatggttggaaaagtctctgtgtttattttgtagcatatctgtgagctctcttgggcagcactaggacaggtctgggctgggtttagaggtcagcttgaatctttttcaactgggctggctaccccctgttgctcatgcctaacttccctacctaacaataatagtagaacatagtcagatttactgttaagtgctttttaaatctatatagtattaagtagtccttgaataattcaatataaagtattctacaagagttaagtactatcaagtacctactatcatgacatataagacctgattcctatccttattacagaaaagtaggcatgtgcatacataactcacataaagtattaaatgtgatatcacagaggtactgtaaagtcgtatgattctttacagtagatagcatgtgctttcatttgaagtattaataaaaaagttcatggatcaaagatggctttatggagggagaaagattgaactggaagttgaagggtagaataaatttacacctgggaaatagaagaatgagctgcagaagagtttttttttaataaaggaaagcatgtgatcaaaacatagaagctagaaacttatttggcagaaatttagagttttctggagtacagtgataatatttctggaaagataaaagaagattgaaacatggatgccctaatgaagattactgatggcctctacactattgaattgacctgagttttacacaactttcctgtgtataaacagacttacatgacacccatctctacatgtctgaagtctgacttgcgggatgataaagtaggtgcacagaaaaccatgcgatgagcaggctagcacctgttctaagaaacacacacttcactgataaattcatgcttttattgtcacaaaactgttggagactaatacttccctactttagatttaacttcccattaacaaattctgttctctaccgtgtaattgtataactcttattgatttaacagtgctttaaaaattagcattgtttcatagcaaagctggcagaaatacaaaaggtcttgtatccttgatgaccagaaactgtgtattgtctcattcctaaaagacaaacagtgggaagtacttccagctgtcatgaaataattatgtttttggaggtactgttgtcaaggtgaggttgtctagaactattctgctaggttctcattttgagtgaatcgctttaataaccatcattatggaagcaaatataattacaaataatgattgttttggaagtacaaattgagcagaatcagctaatggccagtttctattcaaccttgcagtttgcatttctcattttatgacaaaatattactggaaagagaatgaaaagcaaacactgcatttctacatttttatattttaagtaaaaagtaaaaattgtagaccggccgaatgagatttttaactaatagctgtccagaagcaaagatgtaccctaagagaattatcacattaagtatggagtgaatgacaatttttgaaatgttgacatatacaactgtctggattataattgcttaacatttcatgttacaactaaaaataattgaggaaaataaagttaagatttttactaactagtc

SEQ ID NO: 35267 - DNA, 2491 bp, Bovine  19866880345281
tggtttaatgactgccttctcgtgactataatttgagttccatggtggtgaggattttgccttttttttattcaatgcagtatgcctacagcttagctcaatgctgacacaaagcaagaactcaataaatactagttgaatcaatgtatggtctgccctcccatctcccctggccccactgagcatcccctctgccagtttcagagaacacacagtggtcacgtactgtgtgtcagccactgctcacggtgccccaagcaaactccacttgctcttctggtgaggggctcacctgttcctcagttgacagtccacccctcctggccccctgaaccccctcctgcatcctcagaagccctttgtagatcaccttctcaggcttcccagcccatcaccctaatgatggatcccaccctcagaaccccattccaccctccccatctccctgaccttccactggaagcttctccccttctatgacccccttctatgctcactccctggatgtccccctcagtttgttctccctcaccaactactcaattttctcgcatccttagacagcccctaccacactctcctcccctccctgacagcctgactcagttctctcttcctacctgacctcccccaacaggcaactgaccccactgtttgcccccaacacacaccttcctctctgattctcactgcacagttctttctcctcaatttctcacctgagcgctctctagctccctgttcaccctgagctctttgtctccccgaacccacggcctcagttctttctgcctccttggcagagctctcaaccctgagcactggctgcagggaggtgtttaggctgccgggcaaggcttggccatctcccaggtgcactgccccgcttgcgaggcgggtgccatagctcacctctctgtcatttctagctcctcagaccctagcacgatgccatgcacgcatctgtgaaagaaatgaaaaacggttcctgtccacgtgtctgcctcccacgtaactgactgctggtctgctcagtatggcttcccctgggcaatgagaaatctcgtggccactggcaccaacaagaaaaataaacggctctgcctctacccagaaccacagtaatcttccaaaaacggaaaccagattgtgtcactctccagctcaaaaaattagatggctcactgctggctttaggataaagtctgcgcttgttagcagatcaccaaaagcctccttgagccaatccctgtgacccctcagaccctctccccatcctgcctcctcctcagcttatgccccagccacaagaacatgtcacacccacctagccctggctctttgtttacactgatctctcggcttggaatcctgtctccctttgtaaggacctctgatcgtgtttcaaaacctggcttagccattgcagctcctaagcagtaagtctttcctgtttggtcccctctcccctcttcacgtgcccattccctcctctgcgtctcaccatgcccagcaccaccgcattccaatggaacatctaagactgtgtcttactccacactccatgaccaaagagagtgtgctgtgcgtctgcagagggggcccctggttaggatggaggggtaagaggaactaagaagtaggcagctcagaactaattgggaatacacgctgagacaggcttgtgtggtcccgtgggccggggaaggagaatcagggagggtggtggagaatgctgaagggtccctgagaaggaagtagtatggggtcccaggcaagcaaggcctgagatctaggaaaaaagggggaccggctgggcttaaactgacatccttgctcaaaggctgttcctctgagtttcaggagatgaaagaccccatgactgtgccacgctcagagcattacagggatgacgggcccttctctaaaacaggagtgtgtggagctaggtttctcagtattcgggaccaatctccttggcatctagaggtgtggtctgagaagggcacatgccctgtgaggctgtaacactgaggagtcagggtgacttcaggacacccctgcccatctgctcacaggggcagaaagcactggaggagggaagcgggtgttctgctgtgagtgccgaagctgagtgcctgtcccaagaaagtgcagtcaccttcattccatttcttaaggtcaaagaatgacccgttgctcagtatcttcaagagggggcaaaacccaacctctcccctcctactggtactactcacacctgggacctctccaaggatggaaggagccacttggattctggctcaaagcagggagcaggcaggctcctcaggggagaaactaagagtggccactaagcctgaaggggctgacaggagaccacaggggtaggggatgaatcctgctcaaggtcaatggttttttagcctgactgcttactgtatgccaggcactgtgttaggcatgggggagacagagataataataaaga

SEQ ID NO: 35268 - DNA, 1701 bp, Bovine  19866880364503
ctataatgacagaagcgaatgagtctgctgaaagacataggaacagaaagcacctctgagtacatcagagatcacaaaagatagcattggtttctgaaccatgggactctgcaggggaatgttctcctagacaatgctcagttgggtgtagaaatgacttctgacccttggtgcttgatttgcagggagagcttctgtggtgatcactcttcaagaatcaatagaggcttcaccctgcatccagccactctgcttccaaactttggtcccatcctacctttctgacctcattctaccatttccacctaaccagcatttgccctcttacctgtgttgtacttttttattcccacaaggttttttcccttctgtgttaacctgaatttcccttccctttcctctctgcttactcaaattttaaccttaaaatattttcttaaaacatatcactttgtaatggcccgtgttcataacaatacatttccttcctgaacacctattagctaaactatatttaacttgattatatttaatcacattaaacttatctggctattactttgaacatttcacatgaaatttgcctaatatcctgacactcatggaaatggagcagcaaatggcaatccagaaggagtctgaaaaatatattccttcattctgacccaaattaaaactttccctaaaggctgtgaggagtggagcagttggtgaaattgagaggggttcatattcattgcttgctcttccccaaaatgattccataaaagttgtatttaaatctccttatccttaagagcacccaacgaaaagtatcctgagtacaggaaatgaatacacacctctctggctctgctaatatagccctccttttcatcccacttgttccttcactctcaaaaaattcagatttccctttggctaagaaaatttaggcaaagggctttctttgccttcactcctcccaccactcaggtaagatttatttccttctgaagctgtggactgtcagctcttaggattagggaaggaatgagtgatttaaaatctggaagagaatatggaggaaagagaccatagagagaataagggaagaatttggggtatggtatactattaatagatggacctactgataatggcattcagatggtcccagtgaggagggcatctgaaggaatgaaagccccagtttatgagtccatccccctgcctctatgcagatgcacttgctcagaccataatgggctgtggagaggatgcaatgggactccagttgggcatagggaagggaccagggccagattcaaacaagtaagggcctcagaggagttaataatttgacatccttccagccccgtatattttagatactcattttacctctattcagaggagaggctgagctttcccaggataagcacagagatgaagggccactggtagcattgctctgcctctattctgaagcatcagccccaaatttatataaacaaaagacccatcagaaaggctcaagagggagggaatatatatatatatatatatatatatatatatatatatatatactttttcatgttgtcgtacagcagaaattaacacaacattgtaaagcaattatccttcaattaaaaaaataaataaaagtaaaagagccccactagaaaacaaattcattttccttagaaggaaatttac

SEQ ID NO: 35269 - DNA, 1369 bp, Bovine  19866880424076
tagattgctttggatagtatggacatttttaacaacattaacccttctaatcaaggaacacaggatatctttccattcctttttatcattttcaaattcttttatcagtgtttatagttttcagaatataggtctttcaccttcttggttaagtttattccctggtattttattcttttcagtatgatcataaatgggactgttccctgaaatttttttctgataattcattattagtgtatagaaaagcaactgatttctgcaaattagtcacagaattctgcatattaacatgcaacagtctaactgagtgtcttttcttcccacagccatggacacagcagagtctaggcccaatgaacccctgtttagaggcaaaaataggcaagatctccaagagatgctcggagaagtaggactggcagttgaatactagttgtcaaagctgcaggaacacctgggtgtgacttctgcccatgccttacaacactagaagaaaaagacctccagaaactgaaatgccaggtgcaacattcctgggagaaaagggccctggagaaactgcttaacctgtcacactcaaatactctttcagagttacaggagtcttgggtggaatcattaaagaaaaggaagatggaggcagaacaggcactgcaggaacaaagagaaatgctgtcagaacagaggcaacaacaggaagaggcagtgaggaaaaaggaagcagtgctgaggcaaacaatggagatccccaaagaattctggccatcacctgaaaaccccccaggagaagtcatggaagatatgcagagacaactcaaggtcatgaagggggcactttctcacaggaaaaatcttccagatagagaactggtgagacatgcttctggaggactagccctacagggaatttacaaaaccagtgaccaaaggtgtcttatagggaagaaagaggagctactctgcatccccacggagtttgtactccttggccctactcagggtacatggacagaaatgaaggaatttacatcttctcaagaagaatccatgttcactcagactgtagagaagctgggcttcagtgtaactgccttagcaaagggtgggaggttggggaattagcctggaagctggtatggatcatagcatgcattcagaatccaagaaaatacaacagtcacattctacacactcttatttctgctcaaccaagttcagctatatcccactggcctccttccactttcccattgaccagctccaactttccaatgctgctctccaggaattaaaatgcattgaagaccttttgggtaagtcagaagacccagacaaactacactttgttgaggcatagggttgaagc

SEQ ID NO: 35270 - DNA, 3230 bp, Bovine  19866880441562
cagcacactggctttccttagttgtgatgaacaggggccactctctaggggtggtgtgcaggcttctcattgcagtgacttcttttttatttgcactgagaaaccaaaaaaattgtgttagtcattttattgcaatattcactgtattgcaagggtctagaaacaaactcgagatatctttgaggtatgcctgtacatgcccggtactagtttaggtagagaaaatgtaatggttcagggacttccctggtggtccagtggttaagactctacccttccaatgtctggtcgaggaactaagatcctacatggcacagccaaaaaacatttaaaaaatttttgaaaaatatatgatggtacataagacaagcaaatcaaaactagcaaagaaaaaatgcataaacaagcagaagcaaaagcatatacaaataaaataatttcaagttttattaagtaacataaaggaaacccgcgagattctgaaatagctagatgaggtggacaagaaaggcttcattgaaaagatagcatttaagcaagaatcagctacaaatattatgaaaccccagtacagttttatttattctgtgataggtaaacaaagcactttccccttaggatagaaactatgaagaaagtctgattactagtaggtctctctgaaagagacacctcctccagcccttccatcccaggtgatttttgcaaagcctgtgggggtgggggcaagggcggaacttggactttcagcaatggtgaaatattattgacctgtcaagggcaaagataaagagacttgggaatgcccccaacaggtccctgatggagcttggaagaaactgttctctgagtagttctaagtttgtttgtatgtgtgtgtggttattaagtatatgtaagtgttagtgtttttaagagtctcagagctgggcttggcacagttcacaaaaatgttactttcctcttctctcctcctgcgttgttcaggcaagtccaaccacggtcaggtggtcctcaatcaatctaaccccttcttaccctttatgggtacccagacgcatcaacaaggtgaagagtcatgttgaacatcaatggcctgggccagtcaccgctcaaaagtcaccaaagtgctttgctgtccacctgaaactatcaaacgttgttaattggctatactccaatataaaataaaaagtttaaaaaaaagtcactgaagggggatggggcctcctgccgggaagagttagtcttggattcagatttctgttcagaccctgaccttatttgcactgatgtaatcagccaatattggcatagtcctgagagatcttgttcccagcaggcttggagtgggggtagtgctgttgccttctctatatagggggttcagccaggtgcccagcgctgtcctggggcctctccagctcaccatggctcgggcattgagagtgccagttgcactgtggctgttgggcttgtgctggtctttggctaaagcccaccctctgtgagtaaagttgaggctggagaaggaggaccggggttgggattagagtgggatagggccagcttttaggtctggggtaagtctggggtcttgggacttccctggtggctcagacagtaaagcatctgcctaaaatgcagaagacctgggtttgatccctgggttggaaagatcctgtggagaaggaaatggcaacccactccagtagccttgcctggaaaatcccatggacagaggagcctggtaggctacagtccatggggttgcaaagagtcagacgcaactgagcgactttacttcacttcttcaagtctagggtcaggagctaaggaagaggggttagctgctgtggagccagacagctctgtgtcttctctctagggctagagctcctgagcttgggcacggagttgaaggtgggaatgtggccaagccggatccagaagtgacgggtgaggccctgactctctgtgtctctctctctgcttctgcattgtatcctcttactgatctttcacctgctgcctccctgcctcctccccagaacgctgctcggatggctggggctttgatgctaccaccctggatgagcatgggaacatgctgtttttaaaaggtaggaggggctgggactggggcatttgggacctcagacttggttgccttcaccaggatgtatcctggtggtcttaggaattatttaagagcatcacccatggcttctttgtaactatctcagtaggccaaaagtttgctctgggtccttcagtgactgtgtgttttgcaggggagtttgtgtggaagggtcatgcctgggcccggcagttgatctcagagaggtggaaggatgcccccagtcccgtggatgctgcattccgctatgatcgtaacagtgtccttctgatcaaggtacgactggacccaggtcagggccaggccagaaatgctggagtcaacatgagaaaccctcccctaggtggcccttgccaacaggttccaggtttcctcctcctgggccttcctttcctgagcaaggtcaggctaggggggtgtgtgtgtgtatgcatgcggacctgacaggcgccacatccagtggctcttcttcagtcctaatctgcctccacacctctctgctactcctcaagctgttgaccatcctttccttcctagaaattcctccttggcttccatgaccccgcatctggtcttcttcctatggttgccaggttgttcgccgcacagcggtacctggctgaggggtgagtggaggatgaaatccaggcccactgtgctcatcaggtcccatgtcctggcccagcttgtgtctggtccttctgggcaccttctcctgactcacacaaagatgctgcatggctgggtggccctcactgctgggtttgttttccctcctgcctttttttcttgctcttctcagcttctcatcctgggccactccctgaatgttccgtggggatccttcccagcctttccattcaccctccctgggtgatctcaactactgccacagctctgagactctccacgttgtggacaccagatatggctctttccccagagctccagacatttctttgcaatttcctggctgacatcttcaatttagatgttctgtagacacctcaaatacagcaccccccaaacagaacacagtatcttctgtacaaatccctctcctcccaagtcccctatttcagcaaaggca

SEQ ID NO: 35271 - DNA, 932 bp, Bovine  19866880456835
tcagagctacaatatgcccccacatttaagggcacagaggaaaacttcatgggtacggacattatccagtagtgaacaatggggaatcagcatcgcaggaagttcattttcagatgaagtaagaggaaactggggaagggaggagttaggaaacttaaaatgcagaacttggctgaagaacttagtacaatatgttgactcagttgagacatttatagatgcctatttttcccatgttctctactgggtggcccaagagttgattaggcatctcccctatcctctaggaattcatcagctagtgatgggtgttgaacaatgtaactgtgccattgctaaaacgaagggtgtactgtgagaaactggaccactggaaaagtcactaacttagcttgcggaattcagtgaatacttcttagaggaggcaacagatcagcttctggctacatcttggaaaatgtacaggtattttctgtctgtaggtaggttagaaatatttcaggaaattgaaatatgaaatgtgtgggaaatcagttagacacaagtttacattcttgattgtcattatgaacacctaagtccctggagtggaaggagcctgtttcttcagctttggtatattcagcagtgtagctcagagctgagccacagagctgattatgacaaagataacatgtagtgacccctcctcatcttaaaaacatatattgaattcaggttcaattgtaggaacagagttatccagaagggtgaatcccagttcctggctttgggtgctcagttgagtgaaggagtcagtcaagcagacaggcaactatagtagtgtgagaatgctttgacagccatacctcaggactcttactgcactcaagaatggacttattcccatatggaaggcgatgtgaagttggcctcaaaatactgactttgag

SEQ ID NO: 35272 - DNA, 1781 bp, Bovine  19866880537879
tagcaggggaatgatttcttcagatttgcgttttgaaaaggtcactggttgccgtgtggagattggaaagagcaaaactgaatggcagtgaagggctgtcagtactactgttcaaagggagctggtgctgagggggtactgagaatctccatgatgagtaacccgtccagtaggacttcaatccagaacggtctcccagacagtagacctcctttaagcctctgccaatgtgagggctactgcacttgctcaggctctttctgtccttcagtcagcctgtgacatgaaatctgcctgctttattccctcctcttcaacccctcgacccattgctgtaatccccaccactggcctctgtctgcagcttgtccctttcagtgtttttttttttttctttcagttctttacactacaactggaggcatctttaatacacacatgtgtgatcatgtcactcttattttcaaaaatcttcctactttttataaaaaggtattagccagaggtagaaacctgagattgagggttggaactcctggtcactagccttggtcctgtagcttgtggccttacagtgtttttctgggaaccccatcacctcatctatacaatgaagaaagtgaggtgggtggtttctctgctctccagcctcccaaaggttgagatggcaattttgaaagttcttcaggccctggcagtcttcgtgataagctaggtagttgattgggaataatccagatgcctctaaccagcatctgaatgaggtccccatctctcttctactccctaggccccatccattctcgccccttcattcatcccttgttttcccccagggctccaaccgccgccagctcttggccacattacgggccctggaggtagcatctcttccccagcagtcccctagccttcctggcagttactctgaggaggaggaggaggaggtcgtggaaacaaagaagaaacgcccaaaaaagggcttgtttgctggtgcgtctaatgaagtagaggagaaaaggaagaagaaacgtcacaaacggggcccacctagcagtgactccaaggaagaggaagtggaaagggagaagtgccacaaaggggctcttcttggcagtgacttggctgaagaagagaaaaaaaagaggaaatgccagaaacagatcccttcaaatcttgcccagcccctggacagtgttgaccaaacaggtagtatatggggatgatgagggctgggggtgtgggggatcagctgatcctacatataacagagttcctctgccaccagtaggtttggggttagggaataagtactttcacatagaccacagtttctctcttagggacgggggtatggccagggtgatgtgctaagcctctgaattcagggcatcttgctccccagtatgcctttctgtctctctttcttcaggttctaaagcttggaattctagtgctacaagtgatcccaccaagccaacctgtgagaccccttcctctaatcctccctataccttgagtcgcaagcaatggcggaaccggcagaagaacaagcgtagacagaagaacaagtttcggccatctcagccaccagagcaggccccagccccggccccagcctctgcagaggaggcagaggtgccttctgcccccagtccagacaaccatggagcccgggcagaggctcttcgagctcgcatggcccagcgtctggacggtgcccggttccgctacctcaatgaacagctgtactcagggcccagcagtgctgcgcagcgcct

SEQ ID NO: 35273 - DNA, 1984 bp, Bovine  19866880603556
ttgccctctgggctccaataccagaagcctatggggaagctccttcctcacctggtaaggaagcagtagcttctgcagacacagtaagccaaagacggaaatccctgtggacagcagccacattcccatttgcttgttgagcaaaaagcagttctaactccaggtccgagacctctaggggtcagacatggggctgagatcaatttctggatagggatcagacttgaggctaaggggtcatacaaaggggatgaggggatagaccatgagacccaagttcaagctcaggcccaagttcaggataaagtcctagaagccatctctagacagcaaacccacccttggctccatccaacagtcccagcaagggctgcaacagctcttttggccagtgaggcataagatgacagttctccagcaccagccattcccccctgagcatagccttgtggagagagctgatcacgatggagactgggtcccaggtttcagagcccagagctatcaccttcagatgcttctttccctggagacaaacaacaaaatggcagagtaactcaaagagatcctaggatgacccagaggacccagagtaatgccacagatgacccaaagtccctgagtaatccagaaagagaatgctctgggggagcgggggggtaccacccaccccagccctaagagccccgtcactctgtggcccagaggcgtgggctcaaacctgtttatgtctggcagccagcttctggataacggtcaggtgatgcagggtggcagtgggatgaccaggtggtggtaacaagatcagtatgggctgagtagcctgagtgtgttcaatggggatggtgtgggcactcaggttttcatccaggggccggcccaggaggctggtggtgaaggttgccagggtgctgaccaggcactcaggtcgcagcacacgccacaggatcagcttctggaggaggctcagtgggtgagcccccggccctggtgcagggcccagcacactggatgatagcgacaggtaagcctgccaaacactggcatggcccgccagggatgcacacagcccagcgaatgggggcagcacctctaacatctcacattcgtgccaggttctcagccctagccaggccggtcgagccacacgtgggactggtttttcacagcctgtgctgggagagactgccagtccaggccagagggccagcctctccagctccggcgccttccttgccactcgcaacagagccaaagcacccaagacacccaccaagggtactcgggtcaggcccagtgtagccatggttgtacctagtagctggtgggtcagctgtctcttcagctgcagcagacggcaggttacttcctcccgctggtgaatctcaccctttatgctgtgcagagcccgtttggtggcagccagacaatcctctggactcaaacggaaaagtggtagtaagttctgcagtgagctaagagcctttatgatggtcatgccatgccagaccacacgccgatagggtgcccacagtgccacctccttcagcttcagctcttctaggtcctctaaatgggcatgcagctgacacagctccgcctgggccctcaccacgtctcgcaggaacttggctggtttctgacgccgtgggccctggagcagtagcatcgtcagcagccgctcctacaaacagttacttattgcatggacctggtccttctccacgtagatccccgctcagtgacattcatctccacccccatactgggccccatcccaacccacagactgaatctccaagcacctcaacagcccctgcagcttcccaggagtccaggaatctgacggtcaggtcccaccagtgggtctcaagctcaggacgctccgtgcataagatttcccgcagcatccgttcttctaggatttctgtattcacacccaggtccagcacattcagccccttcagcaattcacagcctagca

SEQ ID NO: 35274 - DNA, 1306 bp, Bovine  19866880718443
aatgggggctcacgagtaatgctgcagatcccaatcggaatcgcaggatcgggccaaaatggcagtgattgagtacaaagggaactgtctcccacccctgcccctgccacgcagagacagcaaccttacactcctaaaccagctgcttcgggggctgcggcaggaccaggaagcaagcacccgcagctcccacccagctcaaacaccagaagtttaactgaagccaaagggcatgtggcccccatcagtgcccatgatcacaggccttgggagctctattaagctctaagaactggagcttgagttgtaaaatggactgtctgattggagtctggagcccagaactttctgagacccagatacccttttctttgcacaataggtaaaaattcattgtatgtatgtaaactgattgttttcccccctttggatttctggagaatgagaactgagatagtaaattcatggcatgtttctggctcttaatctgggttgtgttgaattaacacagtttggtttttcttcatgcctgattatatggggcatgtattctgtaattccaaactagcccccataggtgattgagttttgttatctagcatagagactgagcccctgggatttcttaaagattacttcctgacaagggtaggagggtgaacatctagaagtgaactttctgtaataatctggtaccctaggaaccttcaaggttccattcctctgtttctggacaggatcacatgttaccctcaagtgctcccctcaaatcctgaatggacttcagaggagaggaccatcaacctggccaggagagtggaagcatttagcagaggatgttgactgcaggataagctccttccttttggggtgggaatggaggggtgaaggagagggtagaagtggaagaaagattaggaagttaaatccgtgggaatttcctggaagttttcattgttgtcaaatctgggcctctctgggaactcggaagagggaaatccggcttcagaatggtcaggggatgtgagaagtaggaagttcctttatgtgcactaggaactgtgaagccagactgggcccagccaggctgcccatccctcacactcagaggcttcacttggtgatagtcacgggaagtcttagagctatcatccctgcatgaatacgggatagggcctagcagatcccagattgctagtacagtgggaaaaagagatttttatcttagggcagaccttcagagggtatttggcccaccaaacccatacacctgtttgagataataaggttgcaggtggagggctca

SEQ ID NO: 35275 - DNA, 1071 bp, Bovine  19866880741367
ctttgtaaggagtggcatctgcatctcaaccttaatgataaccttatgtagggaaaaaaatgaacttcagtagacctatgtattgtctatgtccactcttcccattatctgattctgacactcttgaagctgtcttgctccttgaagttgtagacaatagcaatgcaaaacacctcccttaccccaaaccccagcccacaaaaaactcagcttgggttccatatgcacatgcattttaatgttcctaatccatgaagctgcctgttctttgggttctcattaataagctaaaaaaactcctgttaatacatatttatatgtgtattagaatcatactttttcaactttggaaatggccttttaacagttttgggggtcctccattaaaatgcataatgcattcatctgacagagccaggtaaacctcatcaccaaagatgtggttatgctcaggcacatctctccttgactctcagaggggaatccaaagtgacaaggcatctttgctatttttctgatttaattttcctttctacaaattttgtgttttggttttggttcatttatagccaatactcattagtggcagcggtgactgaaaatttggtctttgaccatttggtgatctctgtaaatggactaatgagttatagagatccatgctctgctgggtgaaagatgatagagaatttggactgctagtcatttttgtttgcctattttgagcccaactctattgagccctttgccctttgagaaggagaatgactccttcataccaagcttggtgagattttactcatgacctgtgacagaaattttagaaagtaagctataagccttctttatctgtgtgtctgtagtttttagaaaaacctttatccctcattctgaaagtgtaatattttcacacttgctgagggtattaataaatttgattataaagtctcatgttaattgagttcttttcagattggctgatagagataagtgaaagtaaaagtcactcaatcgtgtccaacctctttgcgaccccatggactatacggtccaagaattctccaggccaga

SEQ ID NO: 35276 - DNA, 1160 bp, Bovine  19866880777871
atgcccagctccaaggcctcccaccttcataaaccaagcaggcctagagggtatgagtctgaaagtacctaatctctgcagaaagcagacattgccatctggggatgttaggtcacaaaatagaacctctcaatttcctggaggaaccagcttcccaatctactgtgctctgtgtctctccacagccatctcctgggtggaggcatttagccagcaaactgtagtgtgagacacgcttcccacaggaagggaagaagagaaaagaggaacgaggctacgtcttaaaccagacttctcagagatccagggagaccaacaactgggccttgggctcgtgtgggtaggtagatacctgaagtgggaaactgagatgggctgaggggcgaatagatagcaagtgggcctgagctccactttccatgtagtcactctggggagatgacttgcagggtgcccttatactcgtgtgacatgagacagtcacagcagagcagaaaccagggcgtgagaaagaggatcaaagttaatgttcccaagaccccacagctcccagacggcagtggacacaggaaacagtggagagttgatagccagcaggcgtggatggtgttcctgggttgaggggcgaggggcccttcagcagaagctatgggggtggccagcctaggacaaagactggatgaagggttcactaaaacgccaggacatgtggtgtcaacaggagccagtgcagagccaggtcagcaagggcagaccctttgggttcctaccagctgagagaacaccggccagctactccagctcaggacgcagctgcagcggaagcagcaaggtcagaaggagggcagagacctcatggaagtcaacagaagccagccaagaagagcacacggccctgaagccccctccaatgccaggtgccaccctgggaggaaagtgagctgaggacgcttgagaaacagaacaacccagaaccgtagtatgaattttgaattgaccaattaccccaaatagactgaattagaccaaaagtcctactttaaatggaaaaaaaaatgtgttcactttcaattggaatacagttgtccttaggggaattggttctaggacttctgaggatatcaaaccccacacatgctcagttcccttataaaatggca

SEQ ID NO: 35277 - DNA, 711 bp, Bovine  19866880817003
tggaccctggcagtcctgaattctgtgatacacacttcatatactatgcattttcctttttgcatgacccgggaaatcaggcacctcttctgtgagatcccacccttgctgaaattggcctgtgcagatacctccaggtatgagttcatggtgtatgtgtcaggttccgtctttctcatgccctcccttgctgctgtccttgcctcctatacgtttgtcctagctgctgtcctgcacatgtcctcaggagagggaaggcagaaagccctcttcacgtgttcttctcatctgactgtggtgggaatgtactatggagctgccatgtttatgtatgtccagcccagctcccaccacagtccccaacaggacaacatcctctctgtattttatattgtcatcactccagcactgaaccctctcatctgtagtctgagaaacaaggaggtaatgggggccttcaggagagtattagggaggttttctcttatctaggatggtggctgccagtgtgatattgaagccctataactcccagatggtgcttcatatccactcctggttttatgtggttcttctacattatgaaaattctgaaaatctgccacattagaactaagtcctcatttggtcttagagacacaactttgtctctatcagctctgtattttgatagttaagaagcattcatttctctgatcaatatcccaggat

SEQ ID NO: 35278 - DNA, 1677 bp, Bovine  19866880845519
aagcctttctatttaactattctgtcaaggaagatgattcaattccctgagtattcatggcctaaggtttgcttgggttccaagctcactctacaacttccttcctatttgaccttaggaaagtttctcaactttcttgcctcatctgcaaaatgtgtaaataacaatgggtcttgctgcacagggttgttctgggaattaaatgagttaatatttgtgaactgtctagagcagtaccttgcccatagtatgtactatggaaaaattaatttgaattgatgatcctactgaaagtgaaagtgaagtagctcagtcgtgtcggactctttgcgaccccagctcctccgtctatgggattcttcaggcaagagtactggggtgggttgccatttccttctccaggagatcttcttgacccagagattgaacctgggtctcccgcattccaggcacgctttaacctctgagccaccagggaagcccaatcctactaattgcgatattaaaattttgtcccagaacaactgggctccaaagcctgtgtgctttcaataccgttgataactttctgctatttaaagctggctcacttcctaggcattttctcacccagaccaattaacctttggaagcccactctcagctcctgggtcctaagggcatacaccatagggttaagggctgggggaatgacactatgcagcacattgagaagaacagggatgatgggaatctgtcttcctgccagatgggtgacagacactacaataacagcagtgtagaaaaagagaatgagggtgagatgagagctgcaggtactcagcgccttagatgttgcttcagcagagttcaacctcagcactgagcgaataatcaacatgtaggaagcaaagaccagacccatgtcactcccaaccacaaaccaagccaaggccaaatggtaaaatctattaatagtgatgtcatcacaggccagactggtgacccccaagttagagcacaggcagtggtcaatctcattcctggagcagtagtgtctctgggcagccagtacaggcactgggatggtcagcaggccattcctgagcatcatagacagtgtgactttgatcacaaaagtctcagtgactatggaagagtactgaaggggatagcaaatggctacatacctatccacagccatgcagaggaagatgcctgactccatgcccatgaaacagttgatggcatacaactgagcaaagcactcagtgagacttatggtcttggcattaaaccagaaaatggccaggattttgggcatgatggtagtagccaggccaatgtccaccacagccaagataccaaggaggtaatacatgggctggtgtaaggtagactcatgatggatggtgatcaagatgaggagattggcaccaagagctaagaggtagagtagagccaggggcagggagagccagtgttgccacctgtgaatgcctggaaaccccattagaacaaattcagacacttgaaaccttgagccattggttatacttagggtagtatccatgtcatgggatgtcttcttctcaacatttatctgtgaattaagggaaagcaagaacagactgtggttagcccagctgagggtcaaaattcatgtagaggaatataagattcaccaacgactcagtt

SEQ ID NO: 35279 - DNA, 1421 bp, Bovine  19866880913799
tgtgtgtgacatggcccaggtaagcccctctctccttccatagaatgcactctgctcaccctgcatccttgtgtctactcctagcattcagtgctggcttcctccttcccataatgtgtgcttagtacaacattcttactctccacaggtgcctctggaggatgaatctatagatgtggctgtgttctgcctttcactgatgggaaccaacatcagagacttcctggaggaggcaaatcgagtgctgaagccagggtaggtgctcccaggacacagatgcatgactgtgcacatggcgcgtgtcagtgtacttacccagaactttccgtccttctcaggggtctcctgaaagtggctgaggtcagcagccgctttgaagatgttcggacttttctgggggctgtcaccaaactgggcttcaaggtcatctccaaggtgaggaccccaggaaatctgtcctgtttttgtcacatgtgtggcccttcaggctaataatggtgttcaggaaggaggtcattgtcagacacagatgtttgctccttgaaggcttgagtagtgggagagagctgggaagctttctgagcaggggtggggcctggacagaggtgatttgaagagctggggtgaggacttagagctcactgggtcttttctgtacctaggatctgaccaacagccacttcttcttgtttgattttgaaaagaccgggccccctcgggtagggcccacgactcagctctcaggcctgaagcttcagccttgtctctacaagcgcaggtgacctttggagccccccttgaacgaggaggcaaatcttgaactccaaactcagtactctgaagactgtatccagccagactgtgacctggggcctggtaccacccttactccatctcaagaagaaaatgtaatgaaactcttggctcaaccctgatgtaaagaaggcttcttggttctaggaagcataaagtcgttagggctagctacagagtaaggagttcattgtgagaacacaggagtatgtgggaattacggatcccctcagtgtcatggaaactacatggtttggaattcaaggcatctctgggtttggtgtctgtttccatctctcagaagccatatgagctttctgtctgagcatctccactctctgttctaattttcctgttggtacatcagatccctctgctcacccaaagcttctacaaagctttagtctgctcgggcctttaaggccgcaggcaggcattgcttcttggctctagggcagcttagctctagagcaagtgcagcagccctcacatcagcagaggcaacttggctgttgtccaccaacatcatctggacgtctcggtcaagatggtttgattgtccctgtactgagtactttttccccctgattgtcatctccatcttcgga

SEQ ID NO: 35280 - DNA, 658 bp, Bovine  19866880951460
tcctccgtctcactcccgctgttgctcaggtcctcccactgagccagctccccttcagattccacttcaggcaccttctcttcctcctcctcttcctcataacccttgcccaggctctggggtgctggcccacagcagaagacattctgagctacctctaggagcagtctggcacagaaggagcgttccttgaggctgtccagccggtcacaaaacgttctctgtgcctcatgcaaccagaggcgcacgatgttgcgcgtggccatcatgatcatcaggcgggtgccacgtaagccggacacgcggcgcaggtgctcttgatggttgagacagtccacaaaaccccgggagcccaccctgacgggcagcagctgcaggctgcccagaagctggctcacagaatgcatggagaagcggtagtgtgggcggaggggtgagggcataaagcagttgcccactgcctcccaggcctccaatgaggcccgaaccagggctcttgctagaacactctcccgctccacagaggggaagcgctcgagccaggcctgtatgctgggcatgtgcctgctcagcagtgtggcctgggtcacactgcccagggccagcactgtgaagagccgagagaggcgcgggcagagcagctgctcgcagaagccgg

SEQ ID NO: 35281 - DNA, 1694 bp, Bovine  19866881002220
ctggatttatctgcccgtttcctgatgtgtgagactgatttctgtcaatctcgtgtccctgttctagaaagcttctctctgagaatgagtcccagactcccatggcagctttcagaacaggagctctttttcctccccctgggggtgctcaatgcagtctggataccctggctctgtagtttggggacttaagatggtgaaagagagggaagctaaggttaatgggcttgttacaaatacaacacatgctcttttttctcctacaattttccctatttctcccccaaacaatctgagcttcctcatcagttccttatgtttttcatatttctgagtaatcccagggtcacatttactataatatgctataaaataaacagctatgtttgccttgattttaaaggttaagttcggaaagtgacatcacctcaagcacactattccatagtctcagacaatctaaattgtctcccctctttggcacatggagactgtagggctggtccagtgaactaaggcacacactttagctcttctaataaggctgtttatagctttgggggctgcaaatcaatgtggacatacggtgtatggaaaaaaataatgaggtacattattgatatcacaccgatgctcttgttttagtatttcatattcaaaataggtacacagaacagtgactgggtacttaaatcatcagtcaaacattatacctaaagcataggtataagaattattaagagcatgcatacctgaataatgatatattgcaatgagaaaggtatttgaatttctggggagatacatattcaggtttgatatcctgaataatattcttatctagtgatctttgaatatttagctgttaatgtgatgcttgttctccattcagatggttcttttcaagatacttaaaagattcagaaacagagatcaagaaataaaattagctaccagtgggaaaggaatcaccatattggactcatattggtcattctgtggggcctctgatgttacaaaatgttgcaaccatcttaacaaaaattcacctagaatctacttggttctaggcaactaaagaaacaacacagaatggagcactggaactccactctgggaagcggcttcatattgatggggattctgaatgacagtttgtctcctgagctgatctgtgctacaatcacagccctgtacacgctggccctcaccagcaattgccttctgctcctggccatcacaatggatgcccgactccatgtgcccatgtacctcctgcttgggcagctctctctcatggacctcctcttcacgtctgttgtcactcccaaggccttcatggattttctgctcagtgaaaacaccatctcctttgtgggctgtgcccttcagatgtttctggcactgaccctgggtggtgcagaggacctcctactggccttcatggcctatgacaggtatgtggccatttgtcatcctctgaactacatggtcctcatgaggccgagggtctgctggctcatggtggccacatcctggattttggcatcccttagtgccattgtatatactgtgtacaccatgcactatcccttttgcaaagcccgtgagatcagccacctgctctgtgagatcccacctctggttgaagttggcctgtgcagatacttccatatatgaactcacggtgtatg

SEQ ID NO: 35282 - DNA, 1699 bp, Bovine  19866881006240
tgccaattcctattggttactttcttcaaaacccccatcagatccattccttgtatgtctcaattatatgtccctggaactcactatcctactttccagttgcagagatgctcatgaaagatgagtcaatttacttttaacccttcaaagcataaaatataacaagatggagccaggctgccagagtttgaatccttgctctaccatatgaccccatcatattggtattattcctgtccttggcgacagtggagttgttcatattgccaaagccagcttccaagattatcttccagctgcaaatccacctgacagcttgttttctttaatccttaaaaaacaaaaggcaaagtgcacactcttcttggtccttcttctgctagagcagatgcagtaagactcctcagacagaaactgtttatctggtgggcattctgcttatcagggacatggcgttcccctgcctttgcacatgctttcatccactgggtgtgcccctgggagccttaaccacctagtgcagtcggctccagtgccccctgccctgaggacgcctttcccagtctctgcagacttccttcctcttcactgagccaggttgagggctggctggagagcatttattgcactgatacgtgattgtccatttatatatttgtctctactgccatattgtgagcctctctgggtgagaacctttctgtctcactcatcacccttgtctgctggtgcccagcacgggccccagtgaactgcagctaatgacaccaggcaggggtccagtacgtgttcagtgactgagggaaccagttcatgctctggcttccccttcaagctgctctcactccagcctcccctggatgctccctgggcactgcagcccctcacgcctcactctctcctgtcttcagaatccaagctggtaaacatcaggaaggacattcttgaacaggtacagaacgagtgccagagccgcagtcagcagctgataacggagctcacaggtttcatgaaggccttccaaaccatcaactcagacatccactccattgcatggtgctcccagaaggtgggcgctcccaatccttcctccccggcttatccagggccatcccgctcacgtgctaagcacactcccttccggtctctgctgagctcccagtggggcttgatgcccttaaactgcattcacctgtgtgacctgccctggccagttctcatcctgttcacatggccctcagtatccttatgatatggggaggccctgatgtgatgagagagggacagtcctgctttcagagacagagttctgctctctgtatgcttaagtagagatccattgccctgtcctcagggcaatgactcgatgggggaggagctgtgctgtcttcagggagacctcggtcagatgggggtctgatcctgggctgccctgatctcggtgggttaaaaggcaactgctgggacctggagcctctagcaggagggagtgcccctcaggatgggtgcagagagatgcacagggctatgagggtgctggtctcatgctgtcatccctgcagctgaatgaggccaatgagcggtacgctgagctggaggagcaaatggaatacacgcggtcactctatgagctcatccgcaaccactttggcctcttcagtgctgagaatgaggcactggacatctcggtagaaggcat

SEQ ID NO: 35283 - DNA, 490 bp, Bovine  19866881085020
agggtgtggttctgggggacacagctgtcctaggtgcggtgttcctggaaggtttggcgggaaagccctgaagacggtggagggttcccagggaaacacgggcattctaattccctggggcctgaggggagaggaggctggggggagggaggcagtaacgggtacctggaggctggatgggcaagaagagcccctcctctctgaggccacttcattggaagccgagggtggtgaggcaccttgccaaagtgactctcgcatcaggcacacagtcaccttggtgtagccacgcccacttccagccctcctcgcctggttgcccagcagcctgggtctggggactgactgcctgtccctcagtgctgcctcttggaccagtcaggattcctggtttccctggtaacgggaagcacgtcagcagtctgggcgctcccagccggtcctggtgctgcggttaccgaggagacgctgcagcctatctgggccctgg

SEQ ID NO: 35284 - DNA, 4197 bp, Bovine  19866881157049
tcacacctgtcacatataccatgaattcatatctggaagtatctgcacaggccaacttcaatagaggtgggatctcacagagcaggtggctgatctcctgggacatgcagaaagggaagtgcatggtgtacaaggtatgtcctagagcactcagggaagccaggacccacgatgtggccaccatgagccagcagaccctcggcctcatgaggaccatgtagttcagaggatgacaaatggccccatacctgtcataggccatgaaggccagtaggaggtcctctgcaccacccagggtcagtgccagaaacatctgaagggcacagcccacaaaggagatggtgttttcactgagcagaaaatccatgaaggccttgggagtgacaacagatgtgaagaggaggtccatgaaagagagctgcctgagcaggaggtacatgggcacatggagccgggcatccattgtgatggccaggagcagaaggcaattgctggcaagggccagcatgtacaggactgtgattgtagcacagagcagctcaggagacaaactgtcattcagaatccccatcaatatgaagccacttcccagggtgaagttccagtgctccattctgtgttgtttctttagttatgtagaaccagagggtgtagacaaaagtctttctaagggagattaccctagttttgtattgtctcacatcactatggaattaccaataagaattccatgagatgatatcttttcctcttgatagctaggtttgccttctgtcttctgaatttatgaatattttcattaaattattataaagtatcatataaattagaaacaagcatgttggttatagcctgtcatctttaaataagataaccaagagaatgaacccaagcaaatatctttgtaaatagataaaatcatagctatcttcccaacaaaaaaatgctctgcacattggcttttaattcagttgcttttctgctttaaatttccttgggattccaattctgttttttctgctcccctagacatgacatctggcttcattttccagtctcattgttccgaacagttttctcaacagggaacctcttggctcttggaccacttggtctcttgtgttcttgaactgtcctcacatccttgatgagcatactgctactttacagaagggaagaggaattctgtgcatgactgaatcattgggatagtatagattttggacgtacatattaaggaacagtacaaaaaatgtttgcctattttcaggtaatgataagatgtttgctcaggaggaatgaggatagaaacgaaggtgatgcatgagacttgaaaagatatggcaaggtatttgtgtttaggatacatgatagaaggggtgagttataaaagagggggatttatagaaaaggtccaaagccatcccatcacttgaaagtcaaattaagatcttgaataaaaaaaaaaagagatcctctatctcatagtattagctgtatgagtaaagatgctggttctgctgagccctgaatctatgtggaagtttgagcaggagaccaagtggtgtgtgaaaccgggctacttcatttcctctacatggtttcagacctttcatagttggatggaggactcaggaggcactctggaaaagaagagaataatccaccaaatgtttcatcttcctttgcatcatctgctcttacccttctgtcttcagtttatgtcaccaacgttgtcaacttagggttgggacctttcagtagttggatgataaaatcctaaaattggaaggcttttccaactgatctagttcctttcattcactccataaatatttactaagcacttacaaatataccaggcactatatttgatgctagggaaattgcacggatgtgaaatgcccattacataaacacctacacacatctactggcaatgaaatacgaaggaaagtataacatactatgagtctatctaagtgaagtatcagggaaggaaactttatataatcacttatatgtcacttatgcaagctacaggctgcagatgaatataaggggctaaggaaaaaggggtcagagtgcaataacagagagaggagacagcactataaaggtcagaacattgaagcagtacaaatgcaagtatcctccttgcacttacgccacagtgacgtctaggcaagaagtcaaccagaaaatcatcttcttgtaaaactgtttcatcattctttaggggctgagatctttctctggtctcacaaaaccaagtatatacattgaaactgagaaatagtgactggaagaacttctttgcccattggcagcaacaaaaacacaaattcaaagacaattcttagtactgttcctagtatatatatgacttgaaatactttccttgaattaaaaagatgaatgggtatattaataaagggaagaaaataattaactggttatatttatccagatttatgctccaggaatttggacaggacataaaagaaaaagcaagacttgtagagtggtgatacttaggactcaagatcttttctatctgccttcctccccttgatttcagagccctgccctccctccttccatcctctagtttgtctccactacggtcatctgaagataaatgccagaaaacatatagtgtgcctacacaggataagccccatttctggaaaactgctgatgatacctcagaccaagggaagataatagaaaccgagattaacagaggggcattgttgtactttataggaaatggtcagacaaagccagtgaagaagatggagtcaaaaatttggaatcacatctttatgttattactctgtatcactgttagcatactttaaaatattcactgacttcaattagctttttctgtagcattggactttaatatcaagcaggcatatatggaacaggcacttcaactgattttagattatcctcttttgagatcccagtcttttatgggtacacatcagaccatctgaggccaggataatctaggtctagagataatactgagacttttaccaggatgccagcatcaggaagtataggaacccaggtcttaccagtggaacagatcaattgtgggtatatgtaaggatggaatggacgagttataatggctgaaggactgagaatctaagaggcaaagcagtgaggtcttgaccatatatctcaagacttccagattccacttaattttcttgaaacaaagaaagagcccttacctcagatggggaggggttcagctgcctaagtacacctactgccctgtaattcatttgagggatgaaggtgttcaaggagatgaagaaagaggtgatggttcttctggcaggggaggatgtaggcatatgtacagctgtgactgaaatcagaggtcaaagacacctccagtcacattgccagtcctctctggaggtggaaattgatgccaatgagcagatgagaacctaagcaggatcctggggaagcaaggagctaaatctctatgcacaagtgaaattctccttgtgagaaagccttaagagccttggcatcattctaactgaattcttgagtccaggtactcagattttcaggtattcctatcttactgggagccacaaaaaaagatgagaaggaatttgactaaaaaggtataaaaggagctgcccaatggagattctacaccagcctcactgtccctggggtgacagtgagctggggccctgtcctgggcgaggcatcatggtctcatcccctcagctaacatgacctcccctgaaaatgctgctccaggaaacaaaattttaatgaatctctcaggcatgtctcctggcctccaactccagcaaagtttacccactaaatgagctctgaggcctgagggctatgctgccctcacatggatttaccaaggccatttccaaaatcctactaaatagacagtatcagtgaatgacctaagaagcaagggcccctggttagctttctttccaaattacaaagtgtatcttgtgggttctgtaaatgctgccactccccgtctcccaatttgtgcctctagcctgggccattatcagccagagagaaatgaatttttgcagtgcttctgttcatatcaggccttccttccttgagctttaattagcattaaagcactgattcattggacctttctatactttt

SEQ ID NO: 35285 - DNA, 761 bp, Bovine  19866881167769
accttggcttgttgtcctagccgtgccttccccgcaggtctcacagggccccagaagcacgaatgtattcctagacgccttctctgtttaacctcccgggtgagccttcctatggcccttttagccctcaagtaaggccctgacctggggtctccaggaccctgtagcctacctgtgaaagcccacatctgaagccacatgtaaccttccagtgggagccagtccccagtgtacgctctgctccccacagcataagccccaggctctggaaggctggtccttcccttggtttctatcctctgcccaacatccctacatgctctggttcttgcctgtctgtcttctcagctcattgcctctttgtttaatcatgccaagggaaggaccttcgatgtgggcagggagtgtgtgggcaggagctcagcagagaggcatatctgcacatcacagaaatgcagagaaaagaaggccttgaaaggtgaggggaggaggcaacccacacagtcacaggggagagattaagccactgggccagcaggctccccaaggagtaaatgactggtttccctcctagctcttgatcccagctgcatgtgtgtcagggtcagggctgtggaggcagagtgtgttcctgaccacgtgcgtgaacactgggctccccagggaaagtgttgatgttttgtggaccttcaggctacctggaataagccctaccttatcaagcaggttatttggctgtgcattcgacactatgtgctttt

SEQ ID NO: 35286 - DNA, 720 bp, Bovine  19866881176503
cactgatctaggattggagggctctgtaaatgctggcatctcccctggggaacaggagccacatgggtgtgcagaatctccatctctgcccttgcagaacagctttgaaactttaaagagtcccctctcacctcctcacaccacaagacacatttctcaatatccaatcttgattctctcaaccccttgatcacctggcccagctcctgcaccctgctttctcatcttctcagtaaccctcaccctctgcacagactgtgcagctcactgaataagactgaaccctctggcaaatgtcaccatcaacagctagcaccttcaagtcttggttcctgctctgaggtcccctgcgaccctctgatccattcccgtccacagcaccactccactgtgtgttggggggcttacccacctgcaggaagcaggttcctggctgagtgccctcaggcagcgaggcgttgtagaaagtcctctggaactgcggctcgttatcattcacatcttgcaagaccatgctcactgtggcagaggaggagagagagggcaagcccccatccgtggccaccacgattagctgtggctgaggttccaactcatagtccagcaaagcagctgtagtgacaatgcctgaggtggggtctatggagaaccagcgggtgtgggcgcctggggccaggctgtaggtgacctaccattggtgcccggtcaggatcccgggcc

SEQ ID NO: 35287 - DNA, 953 bp, Bovine  19866881220808
cacaaagtcggacacaactgaagtgacttagcatagcaatgtagaccaaaggacaacagaggatgagatggttggatggcatcattgactcaatggatatgagtttgagcaagctccgggagatggtaaaggacagaaagcctggtatgctgcagtccatggggtcagaaagaatcagacatgacctagcaacagaacaaaaacaatgtagaccaaaatggaacaaatttgacaagtgtttaagaagtgcagccagtgggaggtgttgtctgattagatacagggagtgaaagatgagcctgggttgactcccaggatcttagcttagatgactaagtggatggtggtgccattcaccatgatgagaaacacagaaagaggactagtttacagggaggttcagccttggcctggttgagtttactgtaacactgggacatccaggcagagggaatcagtagacagcttggggagaaggcaggttagagagggagggaggccaccaacattcagatggctaaggggattacagtgccaagagcaggacccagcaaatactgaatgaggagagcaaagaggaacgggcagagagacagaaggagagacggtgtcagggtagccgagtggagcaattccagaagcagggaatgagtagtcatcagtgtcaaaagcagctgagtcagggaaggcaaggatgggaaaatgttgccaactgaagagtgaatgggaggtttggaagtttgagtaaaaaggagattgaggggttggatggcagctgggaaggacagagggacaaagcagagttcttatctgtaatgggaggcttgagcatgtataaattgatgagccagcagaggagggaggcaagagactagaagacatgggacaaggtctggggatgggagagtggctcaggttggcttgaagaggaggagcagatggatagagggagg

SEQ ID NO: 35288 - DNA, 1893 bp, Bovine  19866881261257
actgactggatacgtctctgaattccccataaactcagacctcgcccccagtctaatgttctctttgataactcccacctctgacagctactgctgtcaggccagagaatgaaattccccgttagttgaagtttctttggaatgaagaagaatgacatcgagcagggggaaaacattagtggaggcaagtcctacccaagtagctgaaccgaccgcagtcctgcgcatgccccattcagctgtgttcctggtgcaccccagtgctcccctttccagtccccaaccccctcaaccccccgccccaccgtgggaacctgactccctacaccggctgctacacctgcgctgagaacaaacagggagcttcagtgcgtcgggtgagggtgggcgctgcctggagaccacagagaaagtcagccgcctcctcccgggttaagcctgcgctgggctgggaggcgaaccataccccaccttcaccccacctcactcctgtttatcccggggagttctcgccgctaccccggccgcccctcgatccccaaatcattcttcctccaggcagcccttttccccagcggggcgggaatgctgccccattccacatcgttgccggctgggggagggttccttgggcgctttgcgtggaagcctgggtgttgggcctgatgtaggaggtgagggtgcggggaacagatgcaggggctacccctgccccgaggcaaagagctgcagggaacgaccagcgatggtgtcacggtcactgcggccactgcggcatagttgggtaccgtggcgcttcccgcgggctaaggtgtctgcgctgcagccggtgatcccagcgttctcggtggccacctcctggttccccgacccaccaggaaaagatgctaaaccctgcggcagccgcgccttaccctgtccctcttaacgctgccttcttacccagcctcccttctccccgctacctctccatccactactaacctctccccaaacctcgccaacacacacagatacacacgctcccgagaattccccggaaccgggacgctggtgaaggggagtggacgggaaggaaatctctaagagaagaagggagaaatctagggggtggggtgcggacagccccccgggcgggaagcaagacagcccccgggcgaggggcggaggggcgctggtaagccaggagctggagaggggggcggagagtcacctggctggacagaggcggtcccgagcttgggagggaggcgagcagaggcggggcgcgcagaggaggagcggagggacaggggccaaggctgggggcgggaaccaggcggggcgcgagcctcagccggaatcgcggcgggagcaggtggagccgcagcgggagctcgcccgggcgagcactgggaggcggcggctgagccgtggcaatggagctgctaaagccaaaccggagcgtgctgggatccggacccgggccgggggcttccctgtgccgctcggggggccccctcctcaacggcagcggcaccggcaacctcagctgtgagcccccacgcatccgcggagccgggacacgaggtgggtgcctccctaagccccctccgcgagctccttctcactgcaccccacaacactcacagaggcccccatagccttctcaaagggatagcccacactatcccttcatagtactccctccgtccccagacagctcccctgacacatctgtcctccacagctcataaaactccatcccagcttcacactacctgatcagagtcccttcacaccctagccccctcgccacccccagagctcttggtcacccccaaaacgcatcaccttcaccaacacacagcccactgctagacagagacagtgggaaagcaaggacctcctctg

SEQ ID NO: 35289 - DNA, 709 bp, Bovine  19866881269589
gtggtggggactgggagaagcaagatctgtccctgtgattgatccttttctttcctcctgcagtggaattcccagcacctaagaatgaattggtgcaaaagttccaagtctattacctggggaatgtgcctgttgctaaacctgttggtatgtgtgtccttttccacccaggcaccaccaccttgatctcaaagcccttcccccaccctctacctcccagtacctcttttaccagaccttcctcttgcttgatgtcaccctgctcttcagagtgcatcccaccttctgtacctctgtcccagcttcactctgggtcctagcttccctgagtgtgaaccaggcatatagggagacccattcttgaaaagctttggttaggttgggaggtaggtcttcgatgactaaaacgctggagcagccaggagctgtgtttggtattacagcaccaactatggactgtgatcatctagaaagggagcagtgagcatatttgtcaatatgctttgtgttggtaaagtacttccttacatgtcatttaattcttgaggatcctgtgaattttggattatgatgatacccattttatagttaaggaaactgagagtagagactattaggttccctctgatatttgtaatactttcacagtacctgttattggtcattcacttagcaaataactatgaggcctaccatgtaccaggtcctg

SEQ ID NO: 35290 - DNA, 880 bp, Bovine  19866881317315
cctcggcctcccccgccgccttctcctctccctcatccgggccctgctcttgggtgctgatgatcaggccaggtcctcgcggccctctgttggccgcattgtgggcggagagctccagctcagagtacaggtgcatcaggcctttggggcccaggggtgccatctcgggttcctggctggcctcctcagccagggtcaaggtcacattgcggttctggtcgcggtgggctgtggcggcccgccggagttggttctggccctcctttagccatttggcgttggcagggcctggctcgggcccaccaccctcgcccatggcgctgcgcagatccttgggtcccacggccgtggcctgcagcttggcgttgagcagctggttgtgggcagcgtgcaggggcaggggcaggctcaatgcggggcctccgtggctgttggcattaatggccgactggctcagggatgatggaacagacatggcctcagcaaatcctgcaagcggggagaggagaccatgctgagcctccaggtcagcatagcaacacccctgcttcagccccaggcctgtgccctgcacctcctcacctccctgcactcagtaggccagcacataccactgtgtcctgtgagctgttgtcccaggagagtaactgggctccgctctgtccaccatcaccaccacacccactcaacaaccacctgcagtggccaggcccaggccaggtccaccccatccccaacccccagccccgagctgccagggatagcacagccagcccctgatttgccctcgctcccaatggcagagactccataacaatggctctctgtgcatccccacccccaagtcatccaactggggcttactgtaccaggagtgcgg

SEQ ID NO: 35291 - DNA, 1655 bp, Bovine  19866881317500
gaacttcgggctatacttacaaaactattgtcatcaaaacagtaatagagaacctggaaataaacgcatgcaattctggtcaattaatctacaatagaggaggcaaaaacttacaatggagaaaagacagtatcttaataaatgtacagtttacaagtaagagaataaaataactggacagctacacgtatgagaacaaaatttagaacattctctaacaccatatacaacagtaaactcaataacacctctgccttttccaccccagttcagcaagttctatcagaggcaaggaagttagcctcaaaatatcaacaattttatgacacacatcggggacaataaagctttagatcttcagtcaaaagggcttgtttatattttgcccccaatttaggtatgtttgctcactcaggcagcatagacaaatgaaaatctcaatgggaggggctggctactaactacaccaatgtggatagatcagaatgtatggtctattcagagagaggttgactagtgtgagggaacagggcttaagttatgactcactaacatcagatgcccaaccgaagcttcttattcagatgaatgagttagaacaaaaagttaagagtttcagtctaaatgaggaccctatactttaagtaatgattgagaagaataatcgtcccctgcctcaagtctcctttttttccccctttgcttatgaacattactatttgttctttcccattgtaccacgtcttgtacaatattcagattgtgataacctcccttaaaatttccttttctctcttctccttttccttttattctgtaatgcttttatttctctttctttcctttttgcttgaatttcttcttttatggcttcaaaattccagatttaagtgcaacctaagtgcttatcgctgctctagggtgcaatattttactctcgagaactgtgcttagcaaaatgctccacttgatacacacaactctttctccacagaacattcagcactgcttgcacacaaccccataaacagcagcctacaaactctttgtgtgctattgttctctgggggcttagggtgtgtttgggtgcatgaagatagtattggttatataaaaaaatctgtgcctttgatcttttaacataaaatatacaaaggtaaatagataagcagaattgtctaatatttctatagatacttatttttccaaaggaactgggggaaaataccagactaatactaaacttcttttctgttgactgagatgcctttgacttctgagctcaaacatagaaatggtaaactcaaaaatctctaattatcctacaaaataattaaaccatctctatgcaatcttgttcaatttttagcattctataaaattgctttggaaatagcttaaagttactttgaaagacaaggtagatgcatggtgtttttcatttcaaaaagaacaaataaatttgttattcatggattctgagagacagaactcagggaaagagtgagataagattctagttataattttggcttaacttttccagctcattaaaacataaaaccatactgttggcagagtcttgtgaaaaggtcgtgtggaatgctcactgaattttgtgttctcctagttgtactgttttgttgttatatttt

SEQ ID NO: 35292 - DNA, 751 bp, Bovine  19866881320200
acggtgatggaagtgcatcttgagacagttcgccgcctcctgctgttcttgcccctgaggccaccaccatcctgtctcacgcctctaaaggggtcccgcagacttctgcacagttcgcctgtcctagttgacgccacctccctccaaccggctccctactttcccacgcctgcctagcctttcccctctgggctgcggaggctgagggtggcgcgggtctccctgatgtaactgagatggggggctcaggctcctgagagagggctgccagggccagttctgtgtccttcacttgcaggaggaagctgaaatcccagccaaggccttccagaaagcgccggagcccttaggcccggtggaacttggcccacagctacccgaagccgaagctgaagagagctcagacgaggaggagcccgtggagtccagggcacggaggctgaggcgtaccgggttggagaaggtacagagcctgcgaagggccctttcaggccgcaaaggccatgccgcgccaacacccacgcctgttaagccacctcgccttgggccgggcccggagtgctgagggccagcgggaagcccagcctgctctggagtccaagctggagccagaacctccgcaagacaccgagggaggatcccgggagacctggggctgccgaagcggcggctgtgctccaagtagagagtacggcctgatgggcccgtgctgcctgcctcccctgtgcctaatgctagtccccaaataaat

SEQ ID NO: 35293 - DNA, 973 bp, Bovine  19866881541753
tcctacgtccttttctcattctctacttggtcttcctaggaatgcactagaatagtcctgtcgaagaatggtgttgaggaagtccttgctagacctagcaattgacttttgagatccagtgcatataatatgggagaaggcaatggcaccccactccagtgttcttgcctggagaatcccagggacgggggagcctggtgggctgaggtctatgtggtcgcagagtcggacatgactaaagtgacttagcagcagcagcagcatataatatgtaggaagattttactcatggattttccaaatgataacaaccaatctgaagaaagagggtttattgtatcaactacaagaaaaattacaatatcaaagcaatatttacatatagtagtagaaaaggtcatctttgctcgaaaagtgtctttgctgctaataaggttgcaagctctattcttccctataggtgacttggttaggtgatacagatgttcaccaggctgatctattaaaccaaacagcataaagtcagtactcctggtaaatgactctggatggatttgcttctaatcagtttttcctggtaagtccaaggtagtaatttgaaaaatgtgctgcctcagagggacccacgttggtcaaaaccacacagagtatctgaaatggctcataagctactggttgttctggaaaccatcagaaggtggatgagatacaacatagagaggatagatgaagggtacaggttaacaccccaccaatcaggaggctttgcagaactaggagagcagggattcaggaaaagtgtgtgtggagcaaactgcactgtatgtacatctttttttttttttttttaacagcttggttacagctcatagttttattcagtaaacaaaggatagtacaccccccaggcgtgagggtggagatcccaaaggagaggcctgtatgtacatcttaactacacttaactgtatgt

SEQ ID NO: 35294 - DNA, 1992 bp, Bovine  19866881546539
ttcccttgatctctttaacttctcctttctgaatctggttagtcagctgattctgcaagtccagcacatgacttctgagctcccaggtccagctcctgtacacagtctccagtttattcatagccatgacctcccgagtgttcttgaacctgaaaatgaagttctcattcactaaggccttccataaatcctgtaccctgactttaagttctgatatctttcaaaatacttcctctggattcttctttggcatgcttaagaatcctgcttttcagctcctgaacattgtggctatagcagggattaggaggggccattgggggagacccttcccagaggtgagcaaagtaatagatgtggttcttgacatcaaacttaatgacatcactgaagtgacacacccctgagcactgttcatgtttggctgctgcgattgtcatttcatccaatatctcttgcagccacctttgcctttccatactttgatctgtatctataatttcttctatgttgtgatgaacaaataggcatcttggtgagatattcagttgtttcatcctgagaaaggcatggagagctatttgcagaatatcttgtatttctgaaagatcctttcccaaaatattgattagagttaagtttccaagtccaataacgaaggttgccaactcattttcctcattttgggctttgttcatgagctctgagacttgcagtccttctgtgtccacaacaagcataaaatcaaaagcccagctgttctctgagcatctcgtctactttcagaagatgcatgtaggcaccccaagtatgtcttccagcactaaggctcaactgcagcccaaacattgcattcagcagagtagactttcctgagttctgcaagccaaggacagaaagaacaaacacacgtttgcctccaagtttttctgaggccttgtcaaaaacagctgccacccacctcaggggcacatatgaagcatccccatccatcagttcaatgggagccccggatatcatcaggtcagcagccatttggggaaaggaaagaaacagtgtatttgtttgggaggaagcttcttccaaagcttcatagatctgacccagctctcttaagaggtgctcaattcccagggtggaatcactgatttctttggaaacagcttctagctcagcctcccagcatctgagggagtctctctttgactgcttctgcttttctgttcgtacttgagccaacaaagaactgtgcctctggtggagcttctctaactctgttgtggttagttggtccattgacatactcagcacctgcagaaagtagagctctgtgtgggtctccaggtgggactgcaggctttcaagcagggacttcatcaggtcgttaaggttaatgactttgtgatactgttcacagcgtatcttgagcttttccttctcaatttcattcttgtattgttcaatgctcttgtttcctttttcttgcagctgatggagttctttatccttcttacaccagtcacgccatagacctccttggagaggtagtaacttcccctttatctcagataattttacttttctcaagatgtccataaggatgtttgcttttttccctgcttcttggcaatctctttggtcctcatcaataataaactcatacttccttgccatgttggcccagttactcagactataaggagatccagatttcttcaacagctctgctaatgtagctgtaattttatcagctaattctatcttatttagattcttaattccaattctcactttgtgagcataattcttatccataatattttctacattttcaaacaaacagatgagaggtttgggtgaattccaaaattcaagtagaagggagctattcattatgtcaaaatcagaagttgccaggaggataacagtgaccgaggagacctcctgcaggaaccttacctgcctctcatgtatttcagcatttccatggag

SEQ ID NO: 35295 - DNA, 1543 bp, Bovine  19866881700414
caaggacacaaggctgaagggagagcgtatggagagcagagggttctttggcaacctagcgacagatttctgcatctgcttcagggcctgtgccacgtcatctgggcccagcggctcctgacagcccctgcagagagccagccacttgtccagcagctcctggcgtcgcactggtgggaagggacccaggtagttgatggcagctgaacacaagagggtatctccgagcaccgtggaggagtgacccttcaacttctggtgtggaagggaagaccagacagtgtgtgggctggcggggagggttcaggtagaaggtctggtggggagggagcaaggcagggtgtgggggaaagcgtggcaaggagggcagagtgggacagagggaggcggtgagggcatggggaggggcagagggagtggtctgcagtgcagaaatgagctttagggggcaatctagaaggagctggttacctggagttccgtagtccaggaatgcataggtgtgagcagggcagcctcaaccggccacttgtgatgtttgcccactgagcctgccccagattctcgaccacacgcttgtgggaagtttgggcattttccagattcttagacagggccaaactgtgctctagaatctcctgggcctggaactcatactggcccaggcgggcctgctcccgagccagtgttgcctccacctgccgcagtagcaggcccgtgggcagtcctcggcgctgtgccagcccatagcacagaacggcccagagccaggctgccaggcttgctataggtatgctcactgcccgcaagtctgcatcgctcatgcctggagctttcagagccaggtttaacttgattatctctgcgtctgtcatcttctccttggggaagaacaccagctcctgggggagtttgtgttaagaggggtggaggaagacatggatgctctgaccttgtcccaacagcctcgctctgccaagttgccgctttatgcctgcatttctcctcctccgtggagccccacatttcttacctgataaaaatcctcagagcatagcagctgcttggcactggcccagcctgtttcacggtggaagaggtcgcacagagcatcagtcacctggaccacagactctggtggtgctcgatagcttcttatctcctcaaagtcagccacctgcagctggctcaggggccccagaaatgccttgcccatctaaacaaggagagacgtgcagttgcagtgagctcccagaatgtcctttcttccttcaaggtatttccaggagggaccatcttctcctagggtctccaagggaccacaccccaagccatcctattacctttgccccaggagactccatgacaagccaacccatcctctcctctgggcatcctaggagaggttgttcccttccaagaggggatcagtgcagggcaggtggtaggaagagcgcacctgctctaggaaagcctcatactgagcccgcagggcatcccgctgcttggtcaggttctcaatgaggttctcctgctgccgaca

SEQ ID NO: 35296 - DNA, 1561 bp, Bovine  19866881739207
ttccataagtttttggtgaaagagttctaattaagctgaaccccccatagaaaaaaaaagaaaataatataaatatcaaaataaaatacatacatagacacgtaaagccaaacaaaagctagtgaaaatgttataaaaaaaatatgaaaacttttagtggccattgataatttataaaatttataaattttttaacacttaaaatgcttttaaagagttctccaatttggaaatttatatgtactatattaagaaaaagcacagaactctaggttatgtgaaacttcaactgtatgaaaagattgcagacaaaaatgctgaaaattaaatgttgttaactgttaaacatcattacatttgttgagattttgatttatagttacttgcatttaaagttattttttagcttttttgttttctaaaagtgaaactatactatttttcttcatcaatttcatgggaaatatacatttattgtaatctataaatggcatggtcattcattcttcatacagatggtgaaggatagagccttgatcttactcttaatgccatcaaatgaagcaaacacagagatgtggaaaggaaatattgacacctaaatatttgacaaggtaaggtagtattcacagataaagaatctaagatattaatggattccaaaagcttaatgtccatgtacaatttttggtgcaaacacttgagtatattactcaacaattcaagaatgaacaaaatcaagaatgtcagaacaaggaagatcaaatattgaaggaccaataataagacatgaaatcacttaaacaaaaaagcctaaatgtgtgcagtacatgccttccgtatttcctacaaatatcacacaaaaatctggaagtaggtggaagtttcttggtcattttctctctttatatattttattaataaatttgatgatttaaaaatattcctttaacagactcacagatatagaaaacagaccagtggttcccagtggtggagtgggggccaatgtagggatttgagaggtacaaaccactggtgtgagataggctcaaggatgtattgtacaacatggggaacacagccaatagtttgtaataactgtaagtggaaagtaacctttgaaaattgtatttaaaataaaattttaaattaataaaaattttaaaataaaaatattgctttaagtatacctctaacattactttcataataaaaacaggaacaaatggtattcctaaagggtactgaacttttggatatgatttgatgaaaagggtgctgaaattaaatgcaaaaggttaaaattttgctgaagctttatcacttattagtgttttcaatatatgattcttatctagactaatcatttcagtgctgtatcctctatgcatgtgtgaatagcaacagctgtttgatgaagatgaaatgagatgagttttgtcagaaacaatttgtcagcttcaggtgctgtttagagaaaaacaaggttctcattgtgccttattctctttcttaagatctctaagaacagggaaaacacttctgcccttaaacttta

SEQ ID NO: 35297 - DNA, 2083 bp, Bovine  19866880403667
tcctctgagttttacagttagtttcagcccaggtattaaaatatgatctgctgttgggaaccaaaaggctacaaagcccttactggagttgcacttaatcctttctcctttccccgctctcttccccaccctccccccaacccctttgtggaacaagaaaagctgtgacttacttaaaactgctgttagcatgaaaacattccagaggagtagggctggatgcatggggagagggcagcagctcgacttcagaccataaaaaggtaagtggggacttcgtttgccaatatgggaagataatgctggtgaatgggtggtgccaggaaggtatcaccaggataaggttttatgggtcattggaaagaaaagtgggctaacagcatcctttttgaggtgatagaagcagagtagaagaaagcctgaaagacaataaagagaaaaaaaaaaatgttaaggaaaaaagctaaaagtagtaggaggggaagtgggagctttgagattcagggtaatttcctggcagaactctagcaaatgcctgtgcaaaaccacagtaatctgatgatgctgtcatcctcgtcttttcctgaagccaaaaggctgctccccaggcttagggaagagggaaactgaaggcattgatttgcctgttcagtagcttaaacacatacaaatcagcctgagttagttattccagcttattttgtgggctgttgctcaggcacttgagtatcaccagtggtgggatattgggtaatttgttgcagtatagtattccactggtagtaaatgtaaagatatctttcacaaattttctcttccctttgccttttaagcgcatatagttgttagaccacacatttgacagctgatacaaagtgtcagacatggctaaagtgaattagcacacacacacagaggacccataaaacaaaggcagctttcctctgttcattctatgcctaaaacagaaacttcttccatgccagtttccaagagctctacaaaccctgctgacaatttggatccttggcttaaaacaatgttgagagttgcctttgactttcttctgtgctaaatatgtgattcctgaacaaaacgaaggtcagcactgtggactctgatgaagacacatgtcatgagatgtgagagtataagcagatcactgttcagtccgtgccttctctttctttcattgtcttttaagatttattgagtatattaatatacaaaaattgcagaaacttagtgtacacattttgatagggatatatggatgtactcatggccgcatcggggctttcccagtggtgcagtgataaagaacctgcctgccaacgcaggagacgttaggagacatgagtttaatccctgggtcgcaaagatcccctggagaaagaaatggaacccactccagtattcttgcctggagaatcccacagacagagtccacgggcgggctacagtccatgggctcgcagagtcggatgtaactgaggacatatccaatgcgtgacagcattaccacaattaaggtaataaactcgtcccgcacttccaggagatttattttgtcctcttgctcttattcatggtaagaatacttggcatgaattctaccttcttaataaaattttttaattgatagttgattaaaaatgctatattaatttcagatctacaacacagtgagttggtattttcatagattatatactcaatataaagttattgtaaaatattggctatattccactgttctctgaaaggaactagtcatcagagcagtgaagatcacagcattggcctttccatgcagagaagcccactgggctgggggtccattgtttatatctgtagatccactccgcacttttcccccattctgttccctgggaggctgcactctggctaacatcactctagctcacttgtcctctatcttccattagatttggccaatgagagggactggcaagaaatcaaagagtgagaaggatgagtactttcaaaagtgaatttcctcccacacagcctcttccaccctccctcctttcctccaaggatcagcttgcagtgactgcag

SEQ ID NO: 35298 - DNA, 911 bp, Bovine  19866880761690
taaatacattaaatgcaaatgattcaaacccccaatttaaaatacatagattgttgatctatgacagtacaacccttatgctactgaaccctttacaatagatttttatttatataagaacagtctctctaacatgctgttcttcttcaaaatgggcataactttcattgtactcttgttattttatatatattgatatattttagaattttagaagcagtggtttcttgcatcttgatattacatcctacaaccttgtggtactctgtaattttaacttcactaatttgtcagtagatcctcatgggttttgcatgtgtctcatctatgaatacttgcagttctatttctttctttcttttgtttataacttgttcttcttggcttactaggatgactatgttctctaaataatattaaaagtagcatcagcagcaggtatccttgtctgatcgctgaatttaaaggaaaacatttcttatattttacaattaactaacatgctattaatatttgataccctctatcaagaaaggaactttaccatacttgttattaatttaaccaaggggtaaaacagaattttcatcttctttgtgatgcttctctctccacagtcttgtaaatagattgatttttctctaagatattatcagcccaaaatactaaccttatttggaggaggagaacagtgctgtctgatgccgtaatgagcaatattgcataggaacctggaatgttaggtctatgaatcaaggcaaattggaagtggtcaaacaagagacagcaagagtcaacatcaacattttaggaatcagtgagccaaaatggactgcaactggaataggtgaatttaactcagatgaccattattcctaggactgtaggcaagaatcccttagaagaaatgg

SEQ ID NO: 35299 - DNA, 1478 bp, Bovine  19866880881373
ataagaatagcagcagtggattgacacttcggctcttccagaacagctgtccagggatattccagccttaaagtgttatccgttaaagccagaattgatatttccaccccaccggggaacagttcagcccttaatctcttgcaaggagcagtcgacttgagaaccaacagcagctgagggcctggccaaggccaggtaacctgtgagtgagtgaacactgaggaattgagaggtttctcactgtctctgtctttctcactagtctttctttccaacttccctgtaggtatggtaaatccaaatgcataggtctcagaaacggtaacacattttctctgggcaccaagcaatcttagcatgctaagatgcttttaaccacccactgttgcttcttcaccagagcttctggcatcaatcaagaaaagagaccacctcatatgccctcctcaatcttgttatgtgccgtccaaacacacctatgggaggagaaatactcgcaggcacatgatgtgaattatgtctttacacgcctgatctactgactattcctgagccctcgtgcaatatgaaagagaacacaatgcaagtcaaacctgaattgattttagccagatttttccatgaacaggggcttataaatcactatatgtgtcaaactctgcccttttccctgatttggtaatcactctcttagtaacttgggagatctaaactagatatgttatagctaccatgggcttgactgggttatttatttaattcagctgagaatcagtgatgttaggttctattaattcactgacaaactatattgaagtgaatgcttcagagccaacttctttttgagatgtgcagtaaaaagtagttctccatttctggtttcacttttttgttgtcctaactatccacataagaaaacaaaaccgctcaaatgctctcaagtttcacagacatatttttctttgtatgtttactcagaaaagagtccaagcctacagtttcattttcatattttacattaacagccagaggaagattccaagccaatccaaaaatcctagttattctgaattgaagctacaattatgaaaacttgttataaccataaactatgtctggcttttaaactctctccattgcacagatataatttaaccacactttgtgttaaaagagttttaatgatttttaaaagagggtttgtctcttcttcccttttattccaactgacttgttcaagttctgtggtgctgagacctggagttaagtgaaatattgatactatattattcataatggactttgaaaaattcaagtgcaagaagagaataaaagctctcccagtgtttgcctattgaaggaagaggagaaacgaataagcagtcaaagctttatgattcaaaacaatggcatgtagtaaattcctcataaacaggtaaattctcaaggatcaccttttaaccccacaactagaggtt

SEQ ID NO: 35300 - DNA, 1311 bp, Bovine  19866880901361
actggaatgggttgccatactgtcctccaggggatgttcccaactcaggaatcgaacccacatctcctgcattggcagatggattctttagcattgagctaccagggaagcccatatatataactgaatcactttactggacagcagaaattaacacattataaatcaactatatgtcaataaaaatatcgataagaaaataattaaaaattctgtcaaaattacttatttgcctatctattttcctactagatttaaaactccaccagaaaaaacaaactgttaaaaaacctcaaccaatgtttgatccatcatttccttcccagcatttaatataagcagtaagtgattcaatgaatcttgaaagccacagacaatcccacaataaccaagcactggaccagaggcccaaaacagctcagaccaacacccatggaaactcatgactcaccggaatacagtccttctgccttacggaaactaactgcttctgttccgacccacttgatatgcaagtcgacaactggaaaggaaaatgtgagtttgtcagtatggcaagatacttctgaaccaaaagcaaaactccaggataagagtgagaggcgataaaataagctatatattcatagtagagtcaaattttatgcacagcaatataaatgtttcacaggggagggagttggggcaggtggagaaaacgtagttttcattaatgtcctatagtgatctcctattgccttcaaccccctagtcctgctgattcagtggaataaatctgttaataaaaagaatgttttaagaaattattaaaacctcagtctcttgcaatctaaagcaaatgcatttgtaattagtccaaagtttgaacacgctattagaccatttcatttttctcaagcagtcttccttcctcctcctctgtctcagtgtaacatccaagacatcatgttgctcagggtctctggtcacacagctttcctctcaatcaccagggaatgatgttgatgatctcatgcaaggtaactgctctgatctggccctggctactctgaattgtgttgcattctacattgtggcactccatattcttgcctgggaaatcccatgggcagaggagcctggagggctacagtccaggggtgtggcaaaaagtcagacacgactgagcacagcaccaccactacgttgtggctaatcttacatatcctttggttaagtaatggttttgtactgtgtttctattctgatgctaaccaccgtagttagcactagattctacagaattaaggacacagtccccaacaagactac

SEQ ID NO: 35301 - DNA, 3054 bp, Bovine  19866880987307
taggtagataataatgtatcagtattagttcactggatgtgataaatgtaccatgtgtcagatatttaataaaatagcaaaaatgggagttgggtatatgaaaactttctgtactatctttacaattttcctataaatctaaaattattctagggcttccctggtggctcagtggtaaagaatctgcctgccaatgtaggagacacaggttcgatccccgatccaggaagatcccacaagctatgaagcacctaagcccgtccaccacatctactgagcctgctagagcctgtgtgccacaactgctgaaacccacgtggcctagagcctgcgccccacaacaagagaagccactgcaatgagaaacccgcatactgcaactggagagtggcccccactcggtgcaactagagaaaagcccttatggcagtgaacacccaacacagtcaaaaataaatattaaaaataaataaaactattctaaagttaaaagtatattaaataatattcccagtctccatgctaatcctacagaatcacactatcatgagtggaattcaaccacctttgtacttaacaagacccccaagtttggaaagtactagtttaggcctaatctgagatccctgctacatttgagaggcaagaccctataggccacctccttggctgccacaaagaaagttgcagactcttccacacacagggatattctcaatacccaaagtaaacgttcagcttctagaacaatgctggcgattccttttttgtgtgtattttattagcatcaaatgcctttggatagaaattacgagttcagtgttttgcccccagattgaatttgaacctctgccataatgatgctaatagagttacccctaataaaatatctaggcggcagtttagtgcttctgtgattagtaaagcaagcatttggagatttaatttttcttacttcttggctcctactcttacctgcataatctcttggaataaaagagtaataaaaccaatatttataaaggttttccatgactctgtgaaaatttttcaacaggcttgaaagagcgaaataattactttctgtaatggattgctgacgtgagcatacagaaatgcagtcattcattagttgaattcagatatatcaggatcaaattatattgcaaactgtagcaacaccaacaacaatagaagaggaaggcggcgtggtgaaatggaaaggaaattaaaccaggggtcagaggcctaagtagtagacggtggtgctgttctggccagttgtgtggttttggagaagcgatctggactcaatttcacatcaacaaaatgagcagtttggaatggacaacttttaagacccttctgaactctgaaattttgagtatggactctcaaaaccaagagttagtctaatgcctaataacatagtattaaaacctgcatttataaactcaaaactattcataactgataattcagaaaccaatcacaaaatataggtgtcaaacttcagccatcttaatccttgagatttatatcccacacaagaaagagacacagccaatatcaaagccgatttaaagatgcctttcaattcattttgccactgttacggatgctgccatgtgagacagtgaaaacgcccagaatgaaagctgacaacaaggagagaaaagaaaagccccataaaacagatgttttaaacatgagccgggtgttgatgtttatttataccttgctttatagcttgacattgttacaatttcaaaataggagttcaccctgtagacaaagggcaacagaagcaaatagaccaatcacaaaagaaataaaagtggtaaagaagcatatggaataatgctcactctaacaaacagacatgcaaattaaatcaacaaggaggtaccgttatttttctttgccatttttttcttggtacattcctgaatgatgatgatatgctgaaactatattttcatacatcattgctggaaaaagcataaattggtacaaactttttggaaaatatttaatgatgtatataaaatagaatttagggattcctgttctaattctgtaattccactaagaacacaggagaaagcaatgcatatgaagacatttattgtagagaaaaattgcaaaaaaccactacatatccaaaaatagatgaaagattgtaaaattgctttagtcagtgtctgactctgcaaccccatgaaccacagcatgccaggcctctctatccatcaccaactcccggagttcacccaaactcatgttcattggagtcagtgatgccatccaaccatttcatcctctgtcatccccttctcctcccgccctcaatctttcccagcatcagggtcttttccaacgagtcagctcttcacaagaggtagccaaagaattgaagtttcagcttcaacatcactccttccaatgaacacccaggattgatctcatttagaatgaactggttggatctccttgcagtccaagggactctcaagagtcttctccaacaccacagttcaaaagcatcaattcttcggcgctcagctttcttcacagtccaactctcacatccacacacaaccactggaaaaaccacagccttgactagacggacctttgttgacaaagcaatgtctgtgttttttaatatgctgtctaggttggtcataactttccttccaatgagcaagtcttttaatttcatggctgcagtcaccatctgcagtgatttgggagcccaaaaaaataaagtcagcaactgtttccactgtttccccatctatttgtcgtgaaaagatgggaccagatgccatggtcttcgttttctgaatgttgagctttaagccaactttttcactctcctctttcactttcatcaagaggctgtttagttcttcactttctgccataagggtggtgtcatatgcatatctgaggttattgatatttctcccggcaatcttgattccagcttgtgcttcttccagcccagcgtttctcatgatgtactctgcatagaagttaaataaacag

SEQ ID NO: 35302 - DNA, 1367 bp, Bovine  19866881036040
aatttgatttttgaacattttcctctgaatttaagccttttgggtaatgcaattggaaaacaacatttctttacagtaaaaatgtgtttggcagcccctctatatacaaagttcaactttagggcaaagaaaaagagacgctcattatgtaatcaggtcaaattattggttactgggaagagttcctggtttagccttcatctattatatgaagtagatattagatcttttattctgccagtgccattttaatcacagcagttctttattctaaatagtttaaccttggacgacctttccccagggcttcttatttatttagatattgttatgcaacacacacacactagcatcagtgaaggcagggtgatcccttcttaactttcacaggagggattgtacaatacataaaggagctggttaaagaagtggttttctaaattcctgggtaaagaggggcagaggtgagagttgaagacctagagcagagatccctccaagttgcagtttaagtgatggagaaatggatttggagattttgttctttctctctcttctctttctttctctacttaactcaatctcaggacacacttttagtcttttcacttaaagcaaaaggctcatgtttgctgggtataacttgcaaatgactttgaaaacttttgaatcaaatgaaaaaaatcaggaatttcatgtaaaaatcatgattttcaacttctgatgaaatattagagaatctggctacccttggtccagagtccatcaagacaactactgccaagttttaggcaataaccaaagtcctccactgaaccacagtttcaaccttgtttgcctcccttgtcatattaaaagttgggttattttaggcctttgggattgtgctttatacagctatgatttcttgcactctcatttgttcatcgaacaaatatttactgagaatcactgttccaggacctgaggataccacagtaagcaagcaaatgtggtccatgccctccttgtgcttatatcctagtgaggagagatatgaaaccacaaataaaatatatcatgtcaggtgaaaagcgttataaagataaataaagcatggtgtctcagacattactatctacctggacacaggatgatacttcttgcccacttgcactttagttggttcggccaatgagctctgagtggaagtgatctatgtcacctctgggtggaagtgcttattttctggccttgatgttcatctgtctctggcaagtgtggtggctcacattgataaagacttggtggggaggactgcctgtgagggttgcctagactggcagaggatttttgttaagtgataatgtttgtcttaagccactggt

SEQ ID NO: 35303 - DNA, 1717 bp, Bovine  19866881088612
atagcaaaaagtataatgttgaaaaagaaagcagttaagtgatgagagtaatgagtccttggggaggatgatgtcatttggtgtaaggtgattgtgaaaggcctctcagaagtgttatttgatcagaggtctagaggaagtgagagagtaacccccaaggctatcctggagaagagtgttccaggcatagaacagccagtgcaaagttcctgaggtgggatgtgaaagggtatcaaagaaatacacctgcaggagcagagtgagcagggtaagtggtaggagatgcatgcgggaagtagtagggaccagaggatgcacaatcctagtggccactctaatgtctttgactttcattttgaatgagatgggagaccaatgaaaggttttgaacacgagggctgtggacatgactggatgtattgaaatataaaggattgctttccttgctgatttgagaatttattatagaggatagaaagtgttagtcactcgtcatgtccaactcttggtgaccccagggactgtagcctaccaggttcttctgaccatggaattctccaggcaagaatactggagtgggtagccatttccttctccaggggaatcttccctacccaaggactaaacctaggtctcctatattcctggcagattctttactgtctgaactaccagggaaacccataaaggagggaaatagggagctaatttggaggctagagcaataatctagacaagagaagaagatggtttgggtcatgggggtgtcaagagaggttgctgagaagtgactgtatcctgcatgtattttgaaggtgaaaccaactatacttgctgctatggaatgtgagagaaagagagaagccaaagatggttccaagacttctgactcacagaaatggaagaaagaccattgccgttcactgaagtgaggaaggctatgggaagaacaggttttaggggaaaattcaagtcaactttgaacatgtaatttcaagatgcctattagacatccaagtggttggtttctgacctgcctgccctccatctgtgaatttggggcagatggaaacagtcagtgctttttaattgtctctgattccagcacttaagagaatatgacacacagtaagaattaacttttgtccagtgttgactgaatgactaatgggagatgagagaggaaaggaatgttggcaccagaacatgaagggcccttgaaagagaaagtgaaagtcgctcagtcatgtccaactctttgagaccctatggactgtagcctgccaggcttctctgtccatgaaattctccaggccctggcatctatctctggaatggatagccatgcccttctccaggggatctgcccaaccaagggattgaacccaggtctcctgcatcatgggtggattctttactctctgagccaccagggaagggcccttaggggttgggaaatgaggagcctttgagagtcttccatcagggaagtaacagggtcaatgctgtcatttgggaagactgacttcataggtgtcccatcctgcttccaacttgcaggaggctgtcaccacctactcactgaaaagccactctcccaaaaacttcctttcattcccaaattttctgatgtccccacagacggcctgatcactgacttgtggctctgtagctcttcaaacttggtgttttgactgggattttcccgaatttgaat

SEQ ID NO: 35304 - DNA, 1715 bp, Bovine  19866881211851
tgggacccagaagtttcaagaaagcagcagcagtgaagagtaggtaggaatctcctacccagaaactacttgtggggcagagcttcctctctccttcccctctactaaataagcaaacttgaacttcacacaagctttctccacggcagctgctgcaaaccaagcggctttgaggatctgtgcttcccactggacaggaaagagtatttgaggatgaaaaggaaggaaaggaaggggaatctatgtgaggatgtttatactatctttaaacaaaggagagttcaaaggccagcatggaaaagggagatgagagctaactaacactttttaaaagtatcaacctaaaatttcacacagagagggctgaatatcttgttttaaaaattaccatctctttcctattagcaacctgacaataatccctctcactgggaagaaactgcatgagacaagggggtggagggaggaagtatagaaaatggtagaagcatagaggaatgggggaacacagagcaatgctcatcccctttcaactgcaaatactcttagcttcagggagacaaaatggccaagactgattcagtagaatattcggattttgtctcaatgctcaatccaaagtctattttctcagtttgtgtatatttgtggggaaattaaacaccagttaaatctctattattctcaccctggagcaaaaattgttgatgtggcaaagacttttatttagaaagaattttatccctagatattgtctttcttccaaggcttcttttccactaagtaccgctaatctatgtagaccactgcattgcatcacccactaactcactaaccaccattatgggacacctccaatgcatcagatgtaggggatataacaacaaacagcacagcccgtgccctcaaggagctcatgtttagtagagaagagagacaactgaacaaataatcactgcataaaacttccatagtcaaaggctgtaagaagtaggctgaagacatctggcacaaataaatatctccaggcagagaacatttcttatgtttttctgttagaaagggaatttcccgtgttaagaaaaaataagttgatattattcaaattgttaaccccaaattaatcagtccctagttttcagaaccctgtagctagaaaagctctaattcccctgtactgagatctactggcacatacccaagcctgatacagtacaatcctaggggaaaaatatcatatttctctgggtatgcaattgagaaaactccatccttagcatctatggcattttcattgcataacaacttggggaaataacatcaggctcatatttagaaggtatcccatggtaaccgtgagaagtggctggggtctcacatagcagaacataaacattaatcctggcttatcagatgcctggaagaagcagggaaagcagaagttatcctatctcctttgcattatcaaatcaaacacccctctgggcttacatgagcccttagggcaaattaaaattttgtctcaccctttgtcccatcattgtaatggatgttctccatggctgattttttttccctgagatttatggaatgcatcttgctcatggttaggggagtatggttcgatggagatcacactgaacaaaaatttaagagccctctctagtctttccatgtctctgtctctgtatttcgactccctaataaatactgta

SEQ ID NO: 35305 - DNA, 1261 bp, Bovine  19866880209965
cccatgaatcgcagcacgccaggcctccctgtccatcaccaaatcccggagttcactcagactcacgtccatcgagtcagtgataccatccagccatctcatcctctgttgtccccttctcctcctgcccccaatccctcccagcatcagagtcttccaatgagtcaactcttcacatgaggtggccaaagtactggagtttcagctttagcatcattccttccaaagaaatcccagggctgatctccttcagaatggactggttggatctccttgcagtccaaaggactctcaagagtcttctccaacaccacagttcaaaagcatcaattcttcggtgctcagccttcttcacagtccaactctcacatccatacatgaccacaggaaaaaccatagccttgactagacgaacctttgttggcaaatagccagatccttttagaacttcataatagcagtaatctcctccacaatggtggtcattaaacttatgaaagtatatacaataaataccactaactggggaagactgcatcttgaaactcttcatgatgaaatcaatagtagtaataaaaatgtttctatggttgaaaaatgtaattgaaattgtaactgctgcatgattcgtaatgaaacataagtatatagttcaacctagaagtatcacatagtgaacatttttaaaatatgcctcaaattcaaattaaaattacaattatcattttcagagtcaggcaggaaggatgagacaatattagccactgctttcttcacctatcactaataagcattatgctttttataatttgaagagacccaaggaaagtataatatattttatttcatttgaagagaaagtaaaactgtctcattaagaaaatcatgttctaatgacttgagagtgactgtgcctacataactttattgggagcaaaggctatccttaacagacacgaagtaagcgcattactgaagtgatagatttttctgtcttgtatttttaattaaagccaatgttgtcactaataaatatattcttcaaatcattcactaacaatgaataccagaagttcttggaataaagaattatagaaacaaataaggatggtaatgattacatgagcatcatcatggaataataagcttcattccaagggatataagagctgttttagcataataatttcactactgatcttttttttccccccaggaagggactcaagtattttcagataaataaattccttaaacaaaa

SEQ ID NO: 35306 - DNA, 2686 bp, Bovine  19866880460457
ttctaccacttgaatataaactgctagatttgcttaatatgataatttaaatgtctttttctttttaattacctgcaagagaaggtgagccagaacaattttatgcttcatatggtgttcataatttggcatactacaatcatgaaaagaccaaaagcatggagtttaaacagatgtctaacttgtacaggtccataatacattggcagctttttcatcatgaactctgaggcatcctgatttcagttaggtggaagaaaagacaggcctgataaatgtctaggaggaaaaaaatgaatcagtgcagctgtgacccaggtcaggattattcttaatattcacaattaatttctggagaacagcttgtatacagcattaccagctgctttttaaacaaatatgtgcacattttggcaaccatagatttagtaatttgctctactcacatgaaaaccaaaaggtgaactcattttgcaccctttgcttttttttctagtttcctttatagtgataatgcttttcattgtatgaattacaagtgcaagtaaattaagaatgatgtgattgacatttgagctatgaatgagcattgttcaagttaggatacatgtcttaattaaaatgttggtgaatggtaaaggtagacctctcagtgactttcttttcttttttgttctgaatcattgtagagatactttcatttttgctaatctgtttatgtactttgcctaaagtgtagatatcgaattagattatattagtttagattcagtctgcaatgacttgaaactgtaatgaaaacacacacacactttgtgtgtgtgtgtgtgtgtgtgtgtgtgtgtgtgtctcctttacagagatgaatggttgaaagcagcccatgtgtatctcctatgcaaggtgacacccctctctcctaccgaatctcttttaggattgttttgtatagattcctgtccaagggctgaaggatgaattacatgacctttcgacatcaattccatctgcatgcagtcttctaacactaaaagatacactaattaagaaaattcaatagtatcatgtgagtattagttaaatgtgttcaaaggtgagggggcagtattagaattctataaaaccagaactgtggggaaatacggtctttgtttttgcaccttatcaattacaaccagggtttacttaaaagatccaatgttttcgagtttgatttataaaaatgactatatgaatgtatacatagggttactgaaatgcaggttcaaatatctgacatcacatatatcattttgtgaatttggtgcttaaaatgaatacagattatgaccctcttttctaaaatagatttgagaagatcaagaactaaataatgtgagaagaataggggagaattcctcaggattatactaaaaaatctagtgtaacagttgaataataaccaatttttattttgagcgcttgtatactcaaagaaataatggaaaggacccactcaaaattcatattttattcattgaaaaataagttctactattaattaaatcaatctatagatttttataactgttgcttttttgtgaaggtaaatatttttcaaataccttttttaaaaatatatttgtaatatatatagcctctgttatttcagggatgactgggggaaattaggaattgattttctttaaaattcacatatatccaagtactgccttaatttgctggtgttgccatatgaaatgccacaagctaactagtttaaacagcagaaatttatctcctcacaattctagaaacatgaaatcccaggatcaaggtagaagcagggtttaatttattttaaagcctttctctttggcttgtatatgtccatcttctccctgagtcttctccctacttctctaagtctcactgtgcttgtctgtgtccagtctcttcttataagaatgctagtcagattgaattaaggtccccccatatgaacatcatgtaattgtctccttaaagacccttgatccaaatacagtcactttctgaactactgggggactagacttcagcctatgaattggcgagggaggcatgatttatcccatagcatatgcctcactatgattataaatgtgttgtatttttcaaaatttatttatttctgattgcattgggtcttcttcattcctgcacggggtggggatactctttagttgtgatgtgtgggcttctcactgcagtggtttccttgttgcagtgcatgcactctagagcatagactctagctgtggagcattcacttagttttccctaggcatatggaatcttcctgaaatagggcttgaaccaatgtcccctgcattggcaggcaaattatttaccactaagctacaagggaaacccagtatgttctttttttttgccttacaaagaaattgtctttgcaatactcaacaatattgtacatgggacagcataggacacacttgaagatttgtgtattaatcattatgaaatattgattttatccttttctagtatcttgatcttcaattaaactgaagactattgctatcaatgcttttttttgtagtttatattcatttgcctgctactttaccgttacatgacattcagtgatgctgtgttattcttttcttggtgctgttggtcagttgctcagtcatgtctgaat

SEQ ID NO: 35307 - DNA, 934 bp, Bovine  19866880463005
agacagtggatagagaagtgagagcacgttgtttcaggggagcagaagctaagcagtctccgtgtaaggtaatctcaaaagaaagccaacattactcaatgtaaaaagatccagagaaccatctctgaagaagttaatgtgaaaaaattaattgaagtagaaatctcagagagttgggtcaaaagagttgggagggaggtcaataatacagaaccgatgtgtttggatttagaaaacgtagaagtaaggtagagattaaaataatacatcataaaataaaattatgtacttaaacttatttgactattcactccaagtttaatattattgttactaaaaatgctttcttaattaggtcattaaatgtccttataattagtgccttttttcctgaaataaatgcctttaaaatgtttttaactgaaataactaatgcaaaatactcattattttggaaactctatttcagcaatatctggaaataggttagcatataagtgtgtggaaaagttggcttaaagctcaacatttagaaaatgaagatcatgacatctggtcccatcacttcatgggaaaggaagatcccctggaggagggcatggcaatccactccagtattcttgcctggagaatcccatgggcggaagagcctggtgggctatgggttcatagacttgcagagaaccagacaggactaaagcaactcagcatgagcaccatggctgtaggtggtctcccacctctctgctcttctgctgctgctaagttgcttcagtcatgtctgactctgtatgaccccatagatggcagcccaccaggctcccctgtccctgggattcttcaggcaagagcactggagtgggttgccctttccttctccaatggatgaaagtgaagtctctcagtcgtgtccaaccctcagcgaccccatgga

SEQ ID NO: 35308 - DNA, 2445 bp, Bovine  19866880691177
ttagatacacatggttctctggaagcttgcatcatggatgaataagaagaataacagaagagatattatatagtgagcattgcaaagagaaataaaaatggagaattgagtggtgaaaaatacatacactcttaaaagcatatagatttaaatcacttctgtgattaccctttaaccctcccaaatcagttcacaggaattcagttcttggatgttttatttcactgctactctttttccagacttactgtcttttaaggcatctgaactgataagaaattaagtccttatgtgtatgtgtccaacttaatagacaatgcattatctaaaagcaagaaaagctggcaagtttaaaatcagagaatacatcgctgactgcaaatgaaggcacagcaagggcacaatactgacctcttagtaacatttagctcgtgatcctacttcagcaagccaacaatgacatggagtcattaaaatattataggaaaaactgcctattgaaatattgtatgctctattatttaaagaactcacctacagcatctggaaaaaaaaagaaaacttcccagggccacctgactctctgcaggttacaaacatcacgctttagttcatttactaaataggcataaaatttatactataatattaaaattgttgtaggatgatagtaaaaaaggaaaaagtagtaagatagttaagtgtctataagcttgttacatatcatctgtgctaagcatgtgtacatctataaactttgtaagagaatcagtggaaaattccactcatttccaatagcatcagcagtgaatctcagtaaggatgacggaagaccaaaaacaccctttaagatttgtatctcctgacttaatttctgttaaatgtgtgtctttctcctctactgtgtacttgtgagccccttatacacttcaatttgtttttactcctgttgtccttagactccatgcgtgtctgctagatggcttcagacgtatctgactctgtgtaaccccatgaactgtagcctgccaggctcctctgtccatgggattcttcaagcaagaatactagagccagttgccatgccctcctctgggagatcttcccaactcagggatcaaacttgtgtctcttttgtctacatgcagtggcaggcagattctttatggctagtaccacctggaagccaccttagactctatccttgatgaaataaagttctttacagtcttcttttcttgccccagtagtgatttctagaaattgggcttttgaaatcccaaattaaattattaacatgtgttttagctacagttaacgagaaaagtttgcagtttcttatgctgaatattatctagaattttatgtttgatatgtttcaatgtttgactaatgggggaagagtagagagggtcagaaaggaattaataatttaaataatccataatataaattgttcttcttagttctgcttttgtcacttttcatacctaagggaaggtgtatcctttcaaatccagttatacttggagagtgaagctgctgctgagttgaggaaaagatcattagtatcctaaggatgcatgcttacttcatttttatttaaactgaagtgtaacatttattatggaactactgagaatctggaaaactccacatgaaataacagccatagaaatttttataacgaactgtaaagggtatctcaatgtctatttcaaaaccgatttgatgaatacagaaaaggtcaaactaaaaataactagactgaatcagtcataagtgtagtaacatatgcctcatttaataatgaactctaaatttgcaccacagtttaagtcgtatcatgaatgctaattctgacagcaaagggttatgaactacctgttgacttgcacccagcacaaggtcagatagttaagcgctaatgaaaccctgatataccagaaggtgaatgactgatgggagtgggctgctgggaagaaactgcaatagcgctgtgacacattcagaatgacaccgtgtcctgaaacagaaacggctgtgatcccatctgttgatgaagtctaactgcttcagttaaagcctcgctatgtaggctacatatttcctaggagatatttttttatctccataaacattcagatgttacaagtgctaaacagtttcaggttccccttacatatgcatgcggttcgctatttctaaaggtttaattaaatatttttggcacgttgagcaacaataaagacttgtgtgtggggactggaggatagtcagttttacccaagagcggattcaaagtttctgaacatcatgttgtccatgaagatttttaacattttgtgtccatggtactgatcaaatggaaatttaatttacgcttgttaaaattcagaaaatcaaagggagcccaaagcactgaaactctgataaagctgatgt

SEQ ID NO: 35309 - DNA, 2635 bp, Bovine  19866880707699
tgacgagcgctgaagtcgtagagtagtcgtggacattgttaccttaaaaatttaataaaaaagtccctagccaaaatgagtttatttgagaatagcagaagaattgtaatttggaacacacaaactatggcaaatcataggcaaatctaaagagaccaagggaaggtcagattttactgggttttaagagggaagtgggaaaggctgtggcttatctgttagagctgcaagcagtaggcagcttgttgctgggtcagaagaaggcaatcatctttcttcccactgaggtcagtaaactgtggttagtgatacgtgcttgaggtcccttccttcttggcttccagactccgttttgacataggtttccctgttcattttcacaacacatatccatcatgtacctgcagtcactgctgctgctgctgctaagtcgcatcagtcatgtccgactctgtgcgaccccatagacggcagcccaacaggctcctctgtccatgggattttccagccaagagtactggagtgggttgccatggccttctccaacctgcagtcactaattgttaacatttttccatgtctgtttcatctctctgtatagatataaatacatattttgctgatccatttaaaaataaaagctacagattttatgatgctttatccataaatatttcagcatgtatttgttaaggcattgatttatacatccaccctatgattattatactcaagggcattgatatttatacaattatactataatacctattgaggctagatcccaatgttcccaatttcccaataatatctctatagctgctcttagtttttactagtgaatttttgataattttctcatttggaggcaatatatattcagttcagacttaagtataaaaaagaaatgtattgcctcatataactgagaagatctggattgattttaggcagagttttaatgctattaatattagcatcaagcctctctctctctccctccctccatcttcccattttactttcttctctattatatcattctcatgtaggatttctctatgttgtatgaattgagcttacatcatttacagtctggagttcaaaggaatataattttttttttaatctaaaaattctagcaaccatctccaagatttattttcactgaccacatctaatttttggtcgtgggctactcctaaaatgaaaatgttgttcaagtacgggacacaggtaaatccttagagtgtggagttgactctgcctaaaacatggggcagacaagggaaggagtggtgatacaaaagggaaaaacacacaggttggtttaaaaacagtgggaggtatcaataaagacttgagaatgtaatgacgaatataaatattccaagcctagaaagctcccactgtgtggctggggagatgaacacataaacaaatgcatacaacattgataccaaatgcaatagtaaaggcgtaattcacagtaagatcacgatacaacaatattcattaagatgctttttaatccagagtatctaccttcatgtgtaaaataaataaaatactcattcctgcctttcattcaaacaaaatatgcttatgcaattatttgcttattttggtttgggaattgttttatcaattaagtagctgaaaaactccagagtaggtgtctcagggttaaagggtaaaaagtccattacttcatttctacttttgaacacccattatttccagtcattctactaagcattgggataaaagatggtccttgctttcaagaagcttaaagttcagtaaggctgcaatagaaaatcaccttagttgtgatgcttgtctttatttatgggtcccagagcttattcttctccttgacttcacctatttctcatttcctgtcaatgcccagaatactctcggtacccattttgctctgatttctgtgtgatatgtatcttcttggttcctggctgtctacctaagttctagccccatcactttcctgaccccaatttttcatgtatgtgctctgcttcacttcctcaaacccagtaagtttttgacttagtagcatgaacaccattgtgtgataatgcctgcaaaagctcaaagcagaagtagtgaaataaatgtcttatacttccatgagcaataacaaatcaaattaacactataatgtacctaaatattaattatgacatctgctggctaactaattctaaatgtaactgttttcctgcccaaatcttgcctaacaaatgcagtatttgaaaacttcatttttagagtatttattattagaagcaatattattttgcacactttcacatatatgtcaatgtccaactctatcaatttccttggaataaattattagaataaaataaaatgtgataaaagtgggataaaagtcataaaaatagtaaagattcttgcataaatattgacaaattactctcccccaaatggactaactttcactcccaccagtatcatgtgaaaatgctttttttaaattccctaattatttatatcatttatttcacatctttgcaaaaataaaatgcaaaagatagtctaactagcttaaagttatttattgattgctaatgtcaatatttataaatat

SEQ ID NO: 35310 - DNA, 1734 bp, Bovine  19866880760224
tttcttatgaacatcaatattaagcgatggtcagaaaaaacagagaaatgttttcaaagccctaggggaaatcaacaactgaactagaattgcacagacaggtaaaatacagttacatggataaatgacttaaagacatagtgaagcagagaagtattattgagcaaaagttcatagcactcaccacagaacacaccaataagttgagagacaagttattggggttagaaacacgtgggaagtcagcaaactgagaagacgcggactagtgtcccagggacgttaccttcaataaggagtcgggtttgttctctgctacagaagggcgatctggaatgccaagatgtgacaaagaggataatgctacattaatagagagtcagagaagatctatcagttaagccaagatggcttaatgacaatatgtttcttattagaaaaacagataacaaataagatgtgacaatggagaattaagatcaaagtagtgagcaaaatacaaattagtgctaagactgagtatatttgtttttatattaattatttcatctaaaatttattctacttattgtttagggtgatgaatttgaaaagaggggagaatcttatgagaataatgtttgttagagtgcaaatttctatgacaggaccctgttaagatcttttaagaagataaatacattaaatagagttttgcttagattacagtaaatgctatagaataatactgaaacatgaaaaggcaatagaaacttttaaggacaggaaaacaaaatttaactgacttggttagaaaagacttcatggaaaaggtaacaacaaattatgacctaaagaatgaaagtatgttatgaagctgtcctcatttatctttcctgtgttatgttccacaaaattttacaatacatttcaccttgtttcacaatcacatttcaaaacatgataatttctttttcacattagtacttctcttacttagactgttcttcagaatttattgaaattatactatcagctatatctgattttatattttaccatgtaatgttattataaaaattacagccaactattttaagtacattaaaaatcttacctatcctttaaggccaaattaaaaacaatttctacccaaattgttgtgtgtgtccttagaaggaattttttggcttctttcattgctaattatttacctgcttgttttccacattagtttggaaactgcatcccttagttatcctcataaacaacagttttgtaaagtcctttactgatattaaaaaccaaaaccattcataggctagaagaagacagaggaaggagaaattaccaaaattccgagaatgtagtgtacccagaaggccattgaaagatggtgagaagtgttgttaaatgtgtagtcaacttagagagacctagaaggaagggggcagagaaaagaaatatatgacttcactctctgtgctcctatctctcactgtgcctttgatacgttttagtagaatcaggagaaggagaagaagagtcctgtttatgcagttcttttgaaatcaccttccccgggtagtcaaagctatggtttttccagtagtcatgtatggatgtgcaagttggaccataaagaaggctgagtgccaaagacttgatgctttcaaactttaatgctggagaagactcttgagagtcccttggacagcaaggagataaaaaccagtcaatcctaaaggaaatcaa

SEQ ID NO: 35311 - DNA, 1915 bp, Bovine  19866880775485
tgagtgaaaaaaaaaaatgcaagcccatcatgagtaaaaaagttactacttgaaaatcaataattactctctgcagatcgattagcatattattagctagactaaaagtcatattaagacaagagaactatattcaatattctgtgataaatcataacagaaaaaaatattttcaaaaataatgcttatatatgtataactgaatccactttgttgtatagcaaaaattaatgcaacactgaaaatcaactatacttcaatacaaaactgataaaaaagagaagaaagctgatttaacagttattgcaacatgagcagtgccaccaatttgattcatttatgctcacatcacttttagatacttcctgtgagtccactgttttcaatgtagaaattcaacatgaaggcaaaatttggtttctactcatgaactctcaggaagcaaattttaaaattccttcctgtctactcctctggtgatcattctgctcttgtgtacaaaatcacatacagcattctgggttttactcttgactctggcagaagagttgaggagatcactcatcacgcattgcccgcctggtgaaagctgactgcgtggcatcattctctccacggctggggaggggaacaccttgcttgtcacaggctattgaaaatcatcagctttcatcagtggatcctgacaatgcagaggaatgattcacctgaagggagcagagggcatagcacttcaaaagtgatctctaaagactgattatttcttgtccttgacaccctgccaagggctagatacatcgaacatttgggatgtaatggagccacaaatcaccagttgcctggagtctccctgggcctaccagaggatagcatgcttggctttagttcagtttttattacatgctgtgaacttttgacggctttgatatgctttgtcattgatttgtcaagattggactctgacaaggtgtctgacctgatcgaaatcaagaatgctctactggatcttgtagaaataatgggaaaacttctgtcataggaccctgggcaatggaatacatttcattatgatgccactgaaacaacacagagagttattctaagagcattttagttagagtgaaggggtgtaccttggactgaaaaatgtataatttaatcttatattgtaaaaattcaaaagacataaaggcacacattatacattttgttaagggctaaattgtgtggtagaaatttgtgcatccaatacctattgctaagtaacattttgttgttttactgcagttgatgcaaatgatttttttggtacaaaagagaaatcacaaaagacttgttatcaacagagagataagctctgcttttgttattccagtattcaaagggctcactcgataatatttgaaaatcttttatgactgactcatgaaatgcagtttcagacaagacagtctcgctcctaagaagactatcgatgatagtggtttaccctgtggagaaaggattgtggatcaaaatgtttttttcttcttcaaagatatttccgactcagaacaactagtaaacaggaagataagggtattattttagccaccctaaatcctaatcaaagtagcagagtgctggtggaaaggagtagccccaaagcatgcagcaggttgattttgtaatattttcaataggagagtgcccacttgtagattaaaagatgcagtccagcacaacctggaaaagttgatattttgaagaagttaagaaaacaatcacctttagcccatgggtttaagaatattgcaaagcaaataaaaacaatctttcatgcaaagagtcctttaaaggtaggaagaaaaaactatggggcataaaatgtcattttcttcaaaacttatccttttcctcatgtttctctgtccat

SEQ ID NO: 35312 - DNA, 1628 bp, Bovine  19866880897564
cttgtgagttttccaatttgctgaattttccaaatttccaaattttaagtataatggagtgtatatgccaatcccaatacctcagtttatccctttccccttcttttctcccttggtaaccaaaagcttgttttctacatctgtaaatctattcctgttttgtaaatagattcatttgtaccatgttttttgattccacatagaagtaacatcatatgatatttatctttatttaactgacagtctcaaggttcattcatgtcatctcacatggcattgtttcatcctttttttaaggctgagctatattccattatatatatatgtttatgtatgtatacatacatatatctcctttatccattcatttattgatgggcatttgggttacctccttgtcctggctgttataaatagtgctgcaatgaatgttggggtgcaggtattttttttttaaatatggtttttctacatatgcccaggaggggattgctagatgatatttatcccatttctgacatgcttaaaaggtattggtctatcaacttgccatctcatattatgacagttcttttaagagaagggttttattttatatgctttgtaactagtcaatgaatccagttctgtaaaaaaaccaaataattcaaatcaattactaaatttaattttaatgttttttgaagtcattttaaaaggttgttgccaagaagtcaacctgttactctgagatctgaccagcgcataagactgttgtataattatcatccttaaaaatctcaggtacataatctggttcactgacataaggatacaatgcatatatagtatttttagcattttcaagttcatattatacaattcatacttaattaaaattctgagaccttatttccatgatttttccatgtcttcttattatctaagtctctcaatttgtaatttttgtccttggtatttatagtaatatgactttactgttttatttgattttactctccatcaagtatttctattttaagtctttcattcatcgttcaaaattgaaacccaagcatattacctacagacaatcttatctattgagaaaagtgttctgtttcactggccacctgtaaatttctttgagcattgagtttgacttttgtgatattgctttgtaaaatactatatacattaggtattctaaaataaatgtttgaccctagaatattggatttttggtaaatgtcagattgtagtggaaaataatatagcaatttgtgatcgatttaggacatgggttgcataatttctcatttctgtgctcagatactaaaagatatgcatttttggtttatcttttaaaattcctcataagacttttccttgtaagtggaactaagtatttacctttcttaaacaatgcacagttgatagaaaagctagatatatttattgcatttatataaagtataccatctgtaaagtctcaattataagtaatcctggtattaaattcaatatatgaagaaaacttaacatatgcccaagagatttagctgtataatacatttttttgactagctacatatttttataagtgttcttttcttcaatgatatttggtgggttagattcccaagtag

SEQ ID NO: 35313 - DNA, 991 bp, Bovine  19866880903272
agaaggaaatggcagcccactccagtgttctcacctggaaaatcccatggattgcggagcctggtaggctaccgtccatgggatcacaaagagttggacatgactgagcaagttcattttcaagactcctttaagattttgtgttgactgtacaaagtaggaattgaaaaatgtgaaatattatctacctcacagaacttgttggtaggataaagaaaataatatttagagtgacttagttcatccttagcatatattaagagctcagtaaaagcttttattactgttgttgaactgttagcagtggtggtggtggttgatggtttagtctctgaattctgtccgactcttgagaccctgtggactgtagcctgccaggctcctctgtccctgggattctccaggcaagaatactggagtgggttgccgtttccttctctaggggatcttcctgacccaggaatcaaacctgcgtctcctgcattgcaggcagattctttactgactggctataagggaagtttttattactgttattgaactgttttcagtagtaaacagaaatggcgtttatgtgtatgtgtgtgtgtttagatttctgtatgtacatttgtaagtgtatatgtatttttatatactataatattatgttttacctgtatctctaaattcatttaaaatgatttctttctttatttttgaaatctaaattcatatatatatttttaagaccatgtacattattaccactcaatgtgcttttagggaattttgaaagagatattctaatctttatagctttcagtatttttaaagtgtgggattatccccttgagtgtatgagaaaaagctcggttaccaaaactgaaagaatgtgtgtcatttctacctacagcattggcacaggcgaattttacaggaatagggaagattaactaggaactcagtgtgatgtaaaggcatctgggaagcagtaggagatgatacttga

SEQ ID NO: 35314 - DNA, 609 bp, Bovine  19866881132183
tccacctcccagtgccatgacatcaggtgtttggtttaatgtttacattaatatgattaagattaatgcttaatgttaatataaatttgtggtgatacaaacattcagaccatagcaaatcggaaattttaaaatgataatactaagctatggggaataatataactgattagtaaaaatggagcaaattactgaaaaaaaaagaagagaaaatgtcaagattaattaggagcagagaggcagagagagttttccctaaaccaactgcattttttctcagaaaatattatcagtgaaactttgacctgaaagtcccagaagactcactgaacactttacttagttctaagtatggagaacaaagagcttcaaggcatttcagatttgtactctgcttgtaagtgaaaattatactcacctctaagtgtatcaaatgcccaacatagcttccccaaagacatggaacataatataaatggagaaaccagattataagtttataaaccaggctctatacaaaccaaggctccaagaaattgaataactcctgttggtcctagagaaatgctgataaattattagacatgtttgaagtatatttagtattaa

SEQ ID NO: 35315 - DNA, 1617 bp, Bovine  19866881185701
gagataatgttccaaggtctttgaagagccagatcagcaaaacgtagctgtgcccagtcggaactttcagagaatccctaggaactctgaatgtgtatagtctaaatgtcccctcaccatagctgctttcttcattattttttttaatcgataagcccccagcaggcacttttctgtagctgatctctgagtgcttatcaaccacaacagctgagatgacatcttgaaacaacttgcttcattcttaaaaacaactttacttctaatacctttttttaccctggtcataaacaagtggattaaaatagcttcactagagtcataaacaagtggctttgaaaagcatatcaaactaatatacaatatcacttatcatcatctaacgtgataaagtcaaagtcaatcatatctatcttgttgatttccagtcttcttacaacaccagttcatgtaagcttaggaaggggtggaggggtctcctctgttctccatggtgtccattgttccaagtgaatgatctagcattgaatgcactgagaaataagcatctgaacaatagtgacccaaaaactagagatggaatgtcaaaatatagaataaaaaaaaggcaagcatataaaaataatcatattcatattcaagcataatcaaaactttatattgaaaaagatcagtgaaaataccctgcacttggtgggtacagatctaaaaggttctaagatttggcaaacaattagaatcctttatctgcagaagcctcccttggtggctcagaaggtaaagaatctgcctgcaatgcaggagacatgggttggatccctgggttgggaagatctcctggaggagggcatggcaacccactccagtgggttcttgtctggagaatccccatggacagaggagcctggtgggctacagtccatggggttgcaaagagtcagacaggataaagtgagtaagcacacacatttgcagaagcacctgaaatctcaagttttttgctatgtgttctttctggcaagaaggttgcaatagatacaaaggaattctttcaatctgagatggtcaccaatagaagaaaactccaggaaaataaaataggagagtgttgaattgaattcttcattggttttggaatatcttcagcattccagaaggctgcaaggcatttacaagagaaaaataaaaataagaattcacagctacttaaaagttcaacaaaacagccaacatttgaaacagcagcggtgttttgcatgctggtgaaagtgggctcattagcaaagtgatggcttagagctgacactgggggaggaaacggctgaacttcacacaatcagtcctacagaactgattgtgaaatacccttggtctcactttgttggaagcagctcagcttgctttctggcctaaggtaacataggagtcagtacaaaggcagaaggacagagaccaacattttgaaataagcaaaatgaaaggccaccgtaaaagttggcaccgtataaagtaagaacccaaattcctgtgtgagtcctttgaacacagaatgtgccaaagccattgttgacacacagtaagaagtctcaacacatgatctaaggtacacatattggg

SEQ ID NO: 35316 - DNA, 819 bp, Bovine  19866881215017
ttggatctccttgcagtccaagggactctcaagagtcttctccaacaccacagttcaaaagcatcaattctttggtgctcatctttctttatagtccaactctcacatcccacacatgattactgataaatcttagttgtcaaaatagggatgaatcctacctgtatctaatgagtagagccctcagatgctgctaaatattgtacaatgcaagaacactcttccacaacaaataactatgtagtacaagtatcagtagtgccaagattgagatatcttgttttaaatagtctcctttattaacatcaaacagattagctacttttaaaatgttttaggattggacatttgtattattatttttttttttttcctttcttcaccatagaaccactgatcctgtggcagaacttaagctttacaacaggcaaagaacctttccaaaaatatgcttgaggatttataatttttaattttgaaaaatatcatgttctttaatttaacgtggaaaaaatagttatttcatcacatgaccttatctacattacacattacacttagtcaagaacatttttaaaaagctactaacatctgtccctcccattacatttcacacaattatctgcacaaaagtggtctggggctctgggcttcatttgcatgtctttcctttgtatgctaaatataatttggcatgctctttaacatttattatcctggtatcgtttgatgttataatttactctctatgtcagcatctaatttactactaatctttcaagtgttgagtaaagatcctagaaaccttacttctttaaa

SEQ ID NO: 35317 - DNA, 804 bp, Bovine  19866881240744
actaagacgtagcaaggatttgctgacagtatataaataaaagatggcaggcaccctcaagaagattgtatcttcatgtgcaaaatcaaaaaccatccaatttttctctttagctgtgtttagttggaacctttagcagcatcatttaatggcagagatgaagggtgatattgtgagggttggaaaaaaaattgcaacagggaaaaatgcttaaatagtataaatacctgtataaatctttctaatagcttttctaaaagctagactggatgtattttatcacatattcctgggcaactagagggtttaacaccagaagtagagctggactgcccttggtactcagaactttatttgggaaatttacagagatcacccggggcatggaagtggggcacacgtgctagtttcaaacatctcctgtgaagaaagagaaggaaaatatttaggtgaaaattaggacatgtttgaaggtgtgggatttcagaatgagaaaggggggtgggatctgatggtgtctaatttctctgtaaggcaagagctaaggttaattgctgagaataagggaggcagggcgtgaataataaggttggtgagttcttaaagtagctcatgggggtcaaagaaagttgacatagtgaacattgcagagcagtttttgaagaccttgtaataattccttactgtattttatcaggactgtagtagcacaggaaactatactcaatattttgtaataatctataagggaaaaattcaaaacatataggaatgtgtatttgtaactagtcactctgctgtaca

SEQ ID NO: 35318 - DNA, 928 bp, Bovine  19866881454617
atttcttaatggatctcatggggaaaagtaaaatggaagtaatatgatcttctcagagagaagtaaaaatcaaaagatacagaggaaagtagtccactttagagttaattttggtgaagaagtcaaggaggcagaatgagttatttgtgacagctttaatgagggggggaaaaaaaaaaaaggcaaacaaatccatggcatccaactgaaatatgagatggtagccaagggcaagaaaagagactgtaggggaaacagaagtaattaatattttcagaacatttattttgtgccaagtgttttaaacatattaccttatctttcatcacaataaggcactcctctatattacccaggagtgaagaaatgtcgtccaacacatcatacaagattctagtatagtcatgaagtgtacaaagttcccaacgctgtttgtttgaaagaataaattcatattagcaagaaagacataggtttagacagattaagcaatatgcttatgttctggcagcataaggaactacagaattcaaagtctctcttgtatcaaagtcttccttataatcaccgtaatgaatcatctcctttagagttaagtgctttctttattcaaaagatcctagaattcctgacatttctttttttttaatttaaatttatttattttaattggcggctaattactttacaatattgtattggttttgccatacatcaacatgaatcctccacgggtgtatacgtgttccccatccttaatcctcctcccacctccctccccatattgttctaatgggcttccctgatggctcagcggataaagaatccatctgcaatgcaggagacacaggagatgtgggttcgatccctggatttggaagatcccctggagaaggaaaaggcaacccactacagtattcttgcctgg

SEQ ID NO: 35319 - DNA, 1226 bp, Bovine  19866881665258
ttttagctgaagatagtgcttaacatgaatattttagtcattttggtgaattatttagtttttctggatctcttccatgtatacatgtaattaaactttgtttgattttatttagttaatctgtctcaggtcagcttaattcttagtctagccagaagaatctagaaaggaaaaggaaaatttcttcctccctgacacttaggaggtagatttgtaatatggtgtttccaggatccactctgctctcccatccttcctcacaataactcagtttggttcacatttccccatttcctcacacaagtgttgaaccacctcgcctccttgaaagtgtctagctggtccaaggtagcctgatcccagtgagtacatcaggaggccaataaaatgctaaagagtttttagcagcgttcctcgataattaagaagagattgtgtacacatttcattttccttttactctttgacatgcacagaatttagaacagtaactatttcagctatttcactaccagcctgagatacgcagggctattaaatctcagagcatctcagaagcatgggtggctggttcaaatcagatgtgaagcctgatctacatctcaacttcttgaatcatatgatgcaacaaattcaagccatttgaattagatttttgctggcaaaataactgataggaacttgtaagataaaatatggtggtagagatggaaagaatcaggggaaaacaacttattcaagggtatcagcaagtgcaaaaagtcactgatgatgatattcagttatcacgaaagatggtattatcaatgcaatattcaaagaggccagtgagttttgagagagcggtagaggacaaagtcacatggcctagcaaggactagatttgttgttcagtcactcagtcgtgtctgactctttgtgaccccatggactgaagcacaccaggtttccctgtccttcaccatctcccgcagcttgctcaaactcacatccatttagtcagtgatgccatccaaccatctcatcctctgtcatccccttctcctcccaccctcaatctttcccagcatcagggtcttttctaatgagtcatctcttcacatcaggtggccaaagtattggagtttcagcctcatcagtccttccaatgaatattcagaatttatgtcctttaggatggactggttggatctcctgcagtccaagggactctcaagagtcttctc

SEQ ID NO: 35320 - DNA, 746 bp, Bovine  19866881714545
aaacgagacatagagctgagcgtgctcagtaaagtcttttcgtcacctagagtctacatttaagtttgctactcctatatcttgaaaaacacactgagtttttctgaaatataaatttaatcgagcggagtatttattgtacatttgctacccccatggcagttccaagagtacaacaggaagacatgagtgacatagtactgctcagctcgtataatgatcagagacaagggccattcatcatgcttcaaccaggtcttaaattatgatgaaaatgcactgagactcacttctgctgatttcattacaatgtagttccagactcatgtggtaagcatttcagctcagactccccactggcaactctataatattaaaggacaacaaaatgaatcttgaaggaggaaaatagtgttacaagtaatagaatatttgttggtgaaatatctccattattctgtttgtttttaagtaaaccaaaacagttgcagaaattgatttaattgataaatgtttaatgggcatctatatttatgaagcatttactataactcaagtatcttatgtcacaggatacatgtagtcacaaaacaaattatgtggaggcaacatgattagggcttgtatggcagccagtgcatccttgacaagcaacactgaacagaaaaagtaactcatgtctctcacccaaatcttctacatctatggaggcccagttatgtggcacatattgtgtaaaataccag

SEQ ID NO: 35321 - DNA, 1375 bp, Bovine  19866881762990
ctgagcacacattgtataaattttaactatcctgtagagtacatagctaacatgcacaattaaattagcatgcatacatacacatccctagaggtccacacatttaaaaacttgttaagaagcgcaagccagtcttatgccgaactctttgaggtttacatggattaactttgcacttcaaagaaaatatattaaacagctatcaaggctaaactctgaagaacagtgaaagtatatttagaaatattcaccactcaggtttttcatctttctgtcattacaaatatgttttcactttattgtatttattagagattggaatctaaatgctaaatgttttatttgataaggagcacatggcattcatagtcacagtaatgtttgttgatgaagtcagtggtcatgagatgtctgatgttagcggattgcaggatttcagctttcctttgatattgctggcattaattttttatagcaaccttattgagatataaattacatgccatacagttcttcctttaaaatatataattaaatgatttttagcagattcatagagttgtgcaaccatcactattatctagctttagaacattttcatcattcccaaaagaaaccttatgtccattagtgggtgatctaccatctgcctttcccactaggccctgcagacaactgggtacttactgactctaaatgtgcttattttggatatttccttaacaagaaatcatataataggtgatcttttgtgagtgtattattttaccgtgtataatgttttcaaagttcaactatattgaaacatgtatcaatatttcactcttttgtatgatgaacaatattccattgtacagatatactacattatatttatccattcatctattggtgaacattagtgttattcgcatttttagctactatgaataatattgctatgaacattggtgtgcatgctttttgtggacttttgttttttatttctcttgagtatatacctaggaatagaattgctaaatcatacaataactgtttatttaacattttgagaaactatcaaacagctttccaaaaacactgcactattttaagatactgttagctgtgtataaagttcccaatttcttcagtctttccagcagttgttatagtcagtctttttatttcagttatgtttctatggtggtatctcatcttgtattgatttctatttatctaatgcctaatggcattagatataatttcatatgtgtatgttagataaagcttgctgtatacaagaaatttccagaaaattcatgagtagaaggattgattatactatgatatagataaatgatatatagatagaaatttccatttatttgttttt

SEQ ID NO: 35322 - DNA, 1220 bp, Bovine  19866880255808
ttatgaccaacctagactgcatattaaaaagcagagacattactctgtcaacaaaggtccgtctagtcaagtctatggtttttccagtagtcatgtatggatgtgagagctggactataaagaaagctgaacaccgaaaaaactgatacttttgaactgtggtgttggagaagactcttgagagtcccttggactgcagggagatccaaccagtccatcctaaaggagatcagtcctgggtgttcattggaaggactgatgctaaagctgaaactccaatactttggccacgtgatgcaaagagctgactcatttgagaacaccctgatgctgggaaagattgagggcaggaggagaaggggacgacagaaaatgagatggtggatggcatcaccaaatcaatggacgtgggttagggtggactctgggagttggtgatggaaagggaggcctggcgtgttgcaattcatggggtcgcaaagagttggacgcaactgaacaactgaactgaactgaaacttgctttgaaatgggtataaagcaagtttgaggatgattattttaataaaacctgttaggaatgctaaaaagaatattttggagggaaaatataggtgacaagttgtatgtgtttgtatatagtatatgtataattaaataatttgtttcaggcaaagcaagtaacttacacgaagagtgataatccttttcctcttatctccttaggatagcagtgagattcacttcaaagtgaaaatgacaacacatctcaagaaactcaaagaatcatactgtcaaagacaggtctgtatgttgtagtattaaattcagtgctttatatatcattaacttttcttttaagaaagcttgtcaaaagaaaagtaatcttttgggaattctttggtggtctagtatttaggactttgcaagaagaaagatcatttaggtgttgggataaggaaaacagtgggcttccctggtggctcagacagtagagaatctgcctgcaagacaggagacctagattctatccctgcagggtcaggaaaatccactggaggagggactggttacccactccagtgttaggataagtgagccaataaacttttttttttttttgctgtactgcgtggcctgtgggatcctaatgcccggaccgaggattgaacctatgcccttggcagtaaaagttcagtcctcaccacgaactgccaggg

SEQ ID NO: 35323 - DNA, 2064 bp, Bovine  19866880435847
tattctggtagaattccagggagagaaggagcctggcaggctatagtccatgggttgcagagtcagacatgaccaagtgactttcacttcacaacagaatgagccagtctgggcttttgaagagactcctagtgtggagttagctgccctggacattaaggccagaaatctgccagatatccagtctcctatgtccaccactctgcaagttcatcaactgatgctcatctcctaatttaacaatccatatgcagagttaacggaaacctttaagattacaaaaatactgtcgggagttccctggtggtgcagtggctaagactctgcacccccaatacaggggagctgggttcgttccctagtcagggaactagatcccacgtgccacaactaagactctatgcagccaaataaataaaaataaacattaaaaacaaaagtactgtcatcacatacagcactcacttcaatcattcattgcccttgtaagccaccaagtgcctgaaggtcagttacgtactcattcagcagctatgtatcaagcactgtgttttaggccttgtgtcagatgctgggtacacagtgaacaagaaaactaaaatctctattttcacggagcaaaagagagcttcccaggtggctcagtggtaaagagtccgcctacaaatgcagtagacacaggtttgatccctgggttgggaagaccccctggaaagggaaatggcaacccactccagtattcttgcctgaagaatcccatggacagaacagcctggcgggctatagtccatggggtcgcaaagacttggaactaactgagcatgcatgcaagggggtaaatcacacggtagaggaatgctgtgatgggaaagtacaggactccaggaaaacacaggaggtcagggaaagtctccttgaggaagtaacttttaagttcaaccctaaagaaataattattggccccatgaaagaggaagtaataaaaggtaagcaatctaggtagaggaaagcctaatggcaaggatgtggaaaagctgccagagaaggaggagaataaggtcagcagttggaagggaaagtgagatccagggagaggtccgttgtttttcttatttgactgtgctgggtttagttgcaacacacagatagatcttcagtcttcgttttggcatttgggacctttagtttcttttttgtttgtttttttttttgtttgtttgttttttgggggggggatctttagtttcaacatgtgggatctagttccctgaccagggattgaacccaggacccctgcattgggaacacacagtcttagccattggaccactaaagaaatcccagggacaggtttttgctgttggtatatttgtttacaagatgggagaggttttataagatgcgagaaaaacaaataaggataaaatataaacaattggttagggacttctaaatgtataaatattaaaaaaaaaaaaaaacagttggtgaatttgagtaaaggtatatggaaaagggggcttccctgatagcttagttgtaaagaatctgcctgcaatgcaggagatccaggttcaattcctgggtcgggacaatctgctggagaagagatagggtacccactgcagtattcttgggcttcccttgtggctcagctggtaaagaatccgcctgcaatgcaggagacctgagtttgattcctgggttggaaagatcctctatcgaagggaaagggaacccactccggtattctggcctggagaattccatggattgcatagtccttggggtcgtgaagagttggacacgactgagtgactttcactcactcactcactcactcactcatatggaaaaggatatatatcctccaaaaaaactgatcatgttggtcccctggtagtaactctctgatagcttcccaagatgtgaaaatgaagactcactaggacatacaaagtcccttgagaagtggaacctgcttaccttccaggccttatctcccttctgttcttttaacacagccttccagccacatagctccctgagtactttaaactcatt

SEQ ID NO: 35324 - DNA, 1706 bp, Bovine  19866880500253
ccttacaggtcatgtgaggtaattacttcctgagcctcagtttctgcaacagacaggggctgggccaggtgtcctgaaggtctcagctgttcttggagaaccttccactggccctgccctctcccctcacacccagctccctatctgagcatggtacttctaggcccatagcaggctccgggaaagaactacagggcggagggggagcaggagccagaggtggggctccagttggcctcacgctgtatgactgatcatagcctctccatctgtgaaatgggagtaatgatacattttgtagagagttcttgaaaagctaaattaggaaaatacatttggaaattctttgtaacatatcatttaacacatgcattatatgaccaatttcaatgccttattgatgcttgaagggaatcagggtctcatttgtgagtttcaactgcaaggtcgtacaacttttctcatgtattaaaaagatctcacatttattcttcaataaagcgaatggatttatgaaaatcataaggtatcttgcattattaagatgaaagtattaaatctctgttcctcttccaggtactgaaaggctaaacaaagatatacaattaaattcttctcaggaacagcgcagataaaccttatcaataagaggaattgtaggtttggtggctttggaaactagctccctctcccgccagttacatcactctttggttcgctcatctcaccaatcctcagtttcctcatctgcacagtggtgaactgtacacttaccaggaagggggtgggggaaattaaataaggtttaatatgtggaaggcctgctcttagcagggatcagtgaatatttctttcttctttgtgaatcgaatcctttatagatgtgaaaactctttgaaaattattatttcgtctaattctcgcctcaccattgagaggtaggtagggaggttccagtattactatttccatcttactgaagaggcagctgaagaggagtcccacagtgtgacaaggttgctcagagtccgagaacacccagggcttcccaactgctggtcagatactttaatattgataagagtccacttaattcgggcttttttttgggaggaactgtcacagactcaatgccctgaatattcttgctggcaaaattattttcaagtgtcctggggtcatcgcatctggaaaccagcttgggattcatctgcaacttgcctgctggtggccaacaaagtaggtttcaatgactctaggcaccggaacttccctcctcaggggcccactccacctctggacaacgtcttgagcatcaagcatcgttttgccgttacttctcctcactgaaatccatgttgtctcttccccacatgaccacagggttcagggtagtgacagccagactcttcttggcaggatgtacccacacctgcctgcgtaagttacatccaagtaacacctgactcctaaccaaggacaggggacaactcagggtaccccatttcaggcaggtccctctgtcgggattcaagggcaccaagcgatgactgcctgtgtgatggctgtgaggtggaggcttatttctcattcttcatatcctctgggcataacgtacataccctttgatgtcagtgtcgagtataagcatattcaattctgtatctagcattaattggcattattgctattttcttccccactac

SEQ ID NO: 35325 - DNA, 1282 bp, Bovine  19866880532315
actttatcttttggctagctttcgggacatcgtcacttgggtagagaaaagggaaggagtgtttgacacttactctgaagcagatcactttacaaggtgcttttttttttttcttttggtacttttatctcattttatcctcaccataaccatataagataaggtgctttatccctgtttcccagaggaggcaaatgaggctgagagattaggtaactaacccatggtcacacagccctaagtgaaggagctgagccatgaacccaggtttctatactccaagcccctggctcttaaaagcaggaaaagccatccatgtgtttctgattaggaaataattacaaggtcggagaaacaccacaaaattatggcaccatttttttttttaagccagcatgaaacttggagattatttagaatctctactgtaggtaaaggaacttgaggtctaaaagccaagagaatcatgcaaaaccgtggctaataatgaaaaccgaggtaacccaagtctgcctcaactaagtgttcctaggtgtttcatttagtttagatcaatatactttggttttgaaggcgtttcctcaggagcagttcccaacaccaggaataaacagctccaaaaggaacaagaataatgactacctaatctgtgccaagaagtgaagcagccactgatgcaaagtttctcttaaagctggggataaaatagggaaaccagaaggacatgcccaggaggggaggcactgctcctgcaccagcatccaaagcctgaaggtgcttcccactgcaaagggccgccttgcaatgtgggtctcagctcctcacttccagaactgctctgccttgatctgcagtctccgtacactgccaggctctgctgtctggagccctggcactgggttcagcgtagtctgctagctcttagcagcctagatgacctacacacggtatcactcctttatttttccttctggaaaggatttcaaagttctcctctatagtgggaagtgatgcatccttaagactgtttctggctcactccacacagcccaggatggaaaccccccagaatcccagaatacagctgttgccccttgattctgaaaatcctcttcacctcccaggaagtaaagcttatttctaacttgacacccaaattcatcaaaaccaaaaagaagttgaaactagagacaagaacagcataagaaagaaaatctatagaccagtctcactcgtatatgtgtatccaaacgtaccacaacgaattcagttaccccaggaa

SEQ ID NO: 35326 - DNA, 732 bp, Bovine  19866880644063
atggtaaagaatctgcctgcaatgcaggagcccgggtttgacctctgggaccagaagatcccctggagaagtgaatggcaacccattccagtattcttgcctggagaattccacggacagaggagtccagcgggtacacgggggtctcaaagagtcggacatgactgagtgactaatactttcactttacacttttagggtatcttagaactagtgcagctagaagtgttgtttagaagtctgactcctaggatcaacttttccacagttgctctgcttctctgccatggatcttatgaaagctccatgtttctacttccataagtaacaggacctctgcgggtgccaggacagcggagctaggctaccagcaaagaggaaatggcttgtaagctgttgaccatctgggcacaaaagaagagactggaaagaaaggagcagagtacaactcaaacaaaaagttttctttatttgtgatataggaagaagaggtaaaacaagactcctgataactgactggctggtacttacctaaaccaagaagaggcctgagaatctgggacttgatatcacttagttttgaatagaagcgtctttcagtagtagccaactcatggagactggcaatatatcccataatgtttttgtccaccaaggctagataactgtcttttcctgctgtcactctgcttatatacccaagctaaaacaggagaagaaagagattaaaaa

SEQ ID NO: 35327 - DNA, 1844 bp, Bovine  19866880648142
cccctgaaaacttgcccgtgaatgttcatggcggcattactcataattgccgaaaaagggaaaacaatccaaatgtccatcaaagaatgaatggataaataaaacatgagtctctctcctctctagactctcacatacacacctgcctgcattcagcatttaatttcaaccatttgatgaaaaaatcagtcttctccacataaagggtttggagccaggttctctccaggagcctgagaggagaggccactttccctcctctaaagtcctccctcctccacatacatcttctgctttagcatcttcacattttgcatttctggaagccttccatgcctttgtgcatcctcatcatggaatgctttctcctgcatttctgcccatggaccacctactggtcttccagagcctttccctggaaccacttggttactgcctccccctgggttgggaagcagcacaggccccatgggactgagctcttcaggtgcagagactgtggctcactcccctgaatcctggtgggatacaggacatatggtgggtctctagtgatgatgggaagaaaagggaaaaaagaggtagagggacagaaggagaaggaagaccattttttgtattatatctgtttttatataatgatatttaaaaggaaaaggaattagttacaaaggtctctgatttcttccatgtaattttttgttggtatctaatttaattcattaataaagtggaaaaggagaaagacatattttacatcctaatgaagtgaacagatttgaggattttaaaaacagttatcttttatagataatattcatttcttccctataaaaaatcattttttctcccttagaatcaccttgatccttactgaataagggctgaatatggagcttctttctctttgttcaagtggaaagcgcacacacaattgttgcctttcaaatcagaagtggcttaacttctttgttttggtccaaacccatccccctcaacactccctgtgtacaaatgcatcaaatttgtggacttcaaagggcgttccacgtgagtgctggagatatgggggttcaggaggtgggaatggcccctctttattagttagcatttactaagcctttataatcattaactagtttgagttttggagtaattcttttttaaattttattgtaattgatttactatgttgtgttaatttctgctgtacagcagtgactcacttatacacatatatatcctttttcatattgatggaataattcttgcagacattgatgagaactgtctgaacatagcagggtggaaactgatctgctgactggtagatgtggtcctgtccctatgcaggtccctttatgagacacgtttcagaactgggggctgtatggctcagaggaaaaaaatgttgaaatgatttcttgccctgactctgtcattaaccagctgtgtgaccttggctgcagcctcagctgtactatggctggcttcaatcagggaaagcaaataggtagcacatgtgccatgactggtgccctcctgtcaccagggcagacatcgttaatcaatcccagcctttctcctgagcctggacaggcttcataatcccatgtgcctacaattgagctgattgttgcagcttatttaccatgcctggcctaaatgatctcttgcctgtcccttccaaggctaacgttcaatgatgttaagtattacagctattccttttgttgtggcaaccaccaccaacagactctacaaaattgtgctattccattccaaggatcacaaagaatttccctcctaaaatactcctagaaacaggaaaataagcattccat

SEQ ID NO: 35328 - DNA, 1288 bp, Bovine  19866880656065
tatgttccagtgtctccagtttacagtctatggagatttgaatagaatttgtatcctactggtgtgtgaaaattgtataaatcttaattatgttgaattggttgacagtgcttatcaggtctactatatcctactgcttcctcagtatattcattctattaatttttgagtatgatattgaaactccaactaaaaatcttccatttatctactttaaacaattataatatatagaggaactatatgtaatcttgttctgtattttccaagtctcctataaatgtgttatcatactttcataattaaaaaaataataaaaaaataagtaaaatgagcctctcttgtgtcaagaaacagggttccttctaagagcagctaattagaaagacacactgtgtttgactttaacagtggtgtctcagaaaacctggttgtgtaccttttgcacattattctcaaaaattataaactttgtaatgcctctgagagtcaagtctgtggtctgctttgtgacactgaccaagcactactaacatcactctctccactattttgtgtagcacacagacctggctcagtatatgtctcagcacccaggagggcttcatcctcataatgtcagggtaagtactttaagggctgggactcccctctggcttgcccacggcaggagaattcagaaacagactgccatcacaaactgaaagcccatgatactaggtaagaagatggacaccactgatattctagagaaaagttaaaaaaaaaaaatctgccctcaagatatggagcaaagtccagctgctttctgggcaagctaaccctgtcagtcatcaccatcaagcaaatgtgtctttagaagtataatccaattaaaaagaatcgccttaaaaggaaagaagtgaagttaagctatcataaattaaatactttcttcatagcagactactgtgctctgtgataaagttcatgttgcacttaaagttcccaactaggactagcagactaccttgactggttctttatcagttatctgtttgcctgttctataaaatcgtattacatgcaggaccaacttccatttttccagttattggaatagaaataatattaaactcttaactagctataattccacatttgtttgtatgccatatttttcattctctaaggttttattggcattaattgattggcccttaacataaccatatgagatttgtatatgatgtacccattcatttaactaatatttatgtgttcatttattcacctcattcaagatata

SEQ ID NO: 35329 - DNA, 1367 bp, Bovine  19866880670112
atggggcaactaagcctgcatgctgaagctaagaaacctgtgtgcggcaactactgagtctgtgcgctgtaacaggggagaaagccctgccctgcaatgaaagacccagcatagccagaaacaaaactatataaaatattaaaaagagatcaaggaacatctgaatacagattgaggatttgaagtaattgatttgttgttgtttttcagtcactcagttcatgtctgactctttgcaaccccttggactgtagcatgccaggcttccctgcctttcacgatcttccagagcttgctcaaactcatgtccattgagtcagtgatgccattcatccatcttgtcgtctgtcatcctcttctcctcttgccttcagtctttcccagcatcagttttttttctaatgggttggctcttcacatcaggtggccaaagtattggcacttcagcctaagcatcagtccctccaatgaatattcaggattgatttcctttaagattgactggtttgatctccttgcagtccaagggactctcaagagtcttctccaacaccatagttcaaaagcatcaattctttggtgctcggtcttctttatggtccaactttcacatccatgcatgactactggaaaaaccatggctttgactataagggcctttgttggcaaagtaaaacaatttacaagttattattaattttcaggttgataatgtaattatatttaaaaacaagacctattgggaaaatgtgaatactgactacgtatttgataacagtaggaaacattttcttcaaatgtgataatggtgtcttggttatatttaggaaaagaaagtcagatttaagaaatgcatactgaaatatttacagatggaatgatataatgtttgaaatttgcttcaaaataatatggagcaaagggaatcaatggaaggcataaataaaacacagttgacgataagctggtgattgttgaaggaggctgatagacacatggaagttcattgtattgtctacttttatctacatttgaaatttctataataaaaagttaatggaagctctactctcatagaaatacatagtaaaatatgtattgatgtgatagatatggtggatttattttaaaatcagaggccaaaaagtaatagtagaaatgaaactagataggctatgtgtctctaattgctgaagttgagtgatgggtatttgtctaaattcaaatttttaaattatgaaacattaaaagtgtttaatgaaacattaaaagcaagtggttagtcaggcccattctatgaacacaagggttgataaaggttttgaatgttttgttatcaatgaattaagatattgaagcagaaaaca

SEQ ID NO: 35330 - DNA, 1372 bp, Bovine  19866880739069
ctcatgtacgatgtagccttttcagattggcttctttcacttagtaatattcatttaagcttcttcccatgtcttttcatgacttgacagctcccatttctttttcctgttgaataatactctattttttgaatgtaccacagtctgttttattcatatgttgtgactgaacggcatatggccttaaaggccatatagaggtctttggtttctaggctactacatttcctgagtagatgacctcaaccggaacaacatcttggttgtttcgaaggtttggtgattaggaataaagctgctataaacatctgtgtgcaggttttttgtggacataatttttcaactgctttgggtaaatagcaaggagcatgattgctggatcttagagagtgtttcttagttttgtaagaaactgctaaacagcattttaaagtggcctctaccattttgcattcccaccaataattagagttcctgttgctccacacagcattggtgctgtcagtgttctggaatttgatcattctaaatccaggacgaatgtgtagtgtacacatcagcttttggcaatatctcagtcttttgaatcatgatccaatgctaaacatcagctgcttcttcgagagttgtgtgttctacagatttgatagatacatgatgactggaaggatgatagaccttggagacagccaggcctaagatctgtaccttaactctggtgtgctactatggaggagttagttaacttctttgagcctcagtttccttcttctgtaaaatggaagtaataaatgaatggccacagtacttactttaatgagttgtatgaataaattgcatgccttctctgattttattcaagtgattaataaaaacatttgaccagaatagaactcagggctgaacctcataccacaccactgccagcctttctccagcaaggccactgttctttgagcacacacaccccatcatccagcccacacagttccctctttcaggtatatctgaacaggctttaccaaatgcctcactaaaattgaatactcagtaaggaagatttctctggactatctgtatatagtttcatcttagactttgagtgcataggtactatttttaaattctctcttaattagttccgccttgttcttctaaaggccatatagaagtctttggtttctaggctactacatttcctgggtagatgatcctcagatgaagtaatttgagtttcccagcttctttcagaaggacccattgtagaaaatgaaacacgtgttagctgagacagatctctcattttatttgaggcttatgggcgtgcacacatgcatgtgtgtctgcatggtgcaataggacttagttacta

SEQ ID NO: 35331 - DNA, 2458 bp, Bovine  19866880760698
tatgaataatgcaaacaagatttttttttgcttcatgctaagatttttgacctacaaatcactgttcgtgttaaagtttcttttgaaggcacccagttaatctcaagattaaaacaatagtctgcctttattttcccaattttgaagctccctatctcttctcttaaaccttgatcatgcccaggctacagtttctgtacatttctgcctgtggagaaagatctcagatcaatcaagtgactttattgatctaataggcactaccaggtctgctacctgtcaatgcagaaggatgcctgtattataacagggtggtccctgtgctctttgtgaaaagataaaagcaaagtgcccgaagtcaatgctgagatgcccgaagtctgggaagatctgagctccttctctcaagcagggtgctttctctatgtcattcttagagactacctacatttaacctcttttatgttcttgtgtattatattattaatgccaattgctaatattattgagtgttttcctgagctaggcactgtgataaattgattacatttcccctatatgtcttcctgttaagctggtattcttctcccatttttcagatgaggaaatagggcctcagaggcactgactgcctcagagacccacagctcatggttggtgaggcctgcacttgagcctccacagcttgtcttcaaatcctatgcactttctactgcataaataactgtcttcagcaacctgtaaaacaggtgtggtcatggaactcagctcaatgttatgtggtaggctggatgcgaggggagcttgggggagaatggatacatgtgtgtgcaaggctgagtgccttcaagctcacctgaaactatcacaacattgttaattggctgtatctcaatataaaaagttaaaaaacaaaacaaaacatgtcattcatcctgttgccaatagagaaattgaggctgatggaatgcaagtgatttgccactttcccaaagttttgccactgggaaatagcaaagctggaacttgagtgttttaactccaaattcagcactcttcctctgacccttgcagcagccctgggttgctggcaaattcagaaaggatagaaagctgagttcctggttcctccagggtcccttgcctcggcctgtcactacctggattcaggtgcttaggtcttcttaggccttgggctgagcaagccaagtcatgtgaccctccaaggcctctttcatcaaaaccactttccagtgcaatttaaccacaagtatcctcacctgggtttggctacgttatttctcagggtccctcttgggttctttccattaagatcccccttcaaagtcccactcctacaggaggccttccttctgtctttggctcaggttactctacttatgggcttccctgctgtctcagtggtaaagactctgcctgcaatgcaggagatgcaggttccctgggttgggaagatcctctggagaagggaccagcaacccactccagtattcttgcctggaaaatcccgacagaggagcctggtgggctacagtctatagcaaagagttggacacagctgaagtgactgagcacgtgctctacttaaaaccttcttgtctttcgagttgactgttttctccttcacttttctgccctgggtccatgagagtctatgctagattccagatgtggcttctctagaatatgaaaactcccagcacccctgggaggcaccccccatctatgaggaagttgatcacccaacagtaccttcccctgtacatgctccaggcccagcccccactcctgttgctcccactttgggttcaccatcctggaaaaggttcagggtggtgatggagttaatgcaatccaatcggaacctgtgaggaagagcttggcactagtataaacttccccacctgccaagggcggccctggtatccatcatcttctgttccctcttcccaataaaatgacccatttaaaccagatttttcttattaacaagcttcctactaaatggcttcagctgtgcttgttgatttatagggcttaggatgccctgctcagctgtgcccctccctgttggtcaagggcctgaatcgtcttgtcctggtgacactgggggagggcagaagccaccttccaagtggcaactccagaaagggcggcttctttccttcttaatattttaattttggaaatgtttgaacacacgagattagagaaaatctaattgtatagtggaaccccttgaaccatcagcttgccaatctcatttgatttgcttctccctgcttcccaaacctcaagatagattattttaacttgaatcccgaacattttatcattccacccatttcagtatattttctaagagataaagactgtctgtgcttttagtctaaccacaatgccatgcacacatctaaaaatattaacaatacgtttt

SEQ ID NO: 35332 - DNA, 1726 bp, Bovine  19866880842018
cttggtggagttcaacctccttatgtcttggctcagaaagaattcagtgagaggcgaggtgatagataagcgtgagttattagtataggacacttgtgaaggctacaggtggacaggccagaggactctacagaagaacttagtgggctacattttttataatcaaagggaaagtggggaggggggagaagactaccttcttcctcatccttgagtagacatcaggcttccatcatcagcttctcctctaaatcaggtgggggagtcttcttgtccctccacagtcaaacccagatggtcatggagctattcaaatcagtagaaaggtggtggtggtggtggttcagtcgctaagttgtgtcctactcttgcggccccatggactgtagcccgccaggctcctctgtccatgggattctccaggcaagaatactggagtgggttgccatttccttctccaagggatcttcccaaccccagggaatcaaacccaggtctcctgcactgcaagcagattctttaccaactgagccatgagggaagcctagaaaagtgctaacatatgctaaaatatggtaaattatctcaggtttcagtgtaaagatgttcttgtactttagaatgtcatttcctcatatatatatatgggatcattaacttacttacctcaaccagcaagatgcaggtgccattgacttgtatagttttgttattaagcaagcctgctatatttacaatgtctagattgttttctcaagtgatattaacttacagttgtctcctaaagccccctaaatttccctctctatctataatcctctagtgggatttctaaactaactgtttggttatcctactctttctgtatcaccaccaagctctattcagatttagctctcaaaggctaagcagaccttaacaaagtgaaggatgtggggagggtattccaaggagagagagaggaaaaccaagtttaggattctggagaagttctgaatacttgccaacaacaggttattttgatggcttttggaaaaggattttaaccactaaagtggcttgagttatggtcctttctcaatgtgagacttagggacttctgaagtcccttacagtagtacatgctatctgacttcactgtttctcaacacctctgaaccatggtgttttcacacagggagtcagaagaccttggtttgagtccttgcaatcccttgcaagtgataattgcatttggactagcatgcacattaccaacctattctaaaaaacgtaagattgaacaagtagacaaagaggatgaagttattgaaaagaaggccaaaaaggccaaggttaaaattaaagttgaagaagaagtagtagaagatgtagaagacacagaagaagaaggagtacaagctgtagaagaacaggaaacatctgtgaagaagaagaagaaaaaggacaagaagaaacacgttaaggaagaaccactttctgaagaagagccatgcaccagcacagcagttgctagtccagagaaaaagaagaaaaagaaaaaaaagaaagttaatgaggactaatggaaggaaccattctttcaaagagttcataattgaatcacctggatacatcatgcttatgactcagtcagaaatatacccaagatactctgtaaaataattgatgggaggtggatgagaaagaaagattaatcgttaatagcatttatacctatttgtgt

SEQ ID NO: 35333 - DNA, 1628 bp, Bovine  19866880895647
aaaagatgattttatgaaggctaagtgtattaattggacaatactgagaacatttttaataagaaaacagagttgtcaggtgtcattttattcattcggttgtgaaccaaacaacaggttacttctgtacaagatctggatcattaaaaattaacattggtatgattttccttaaagctttacccatacaaagcttttcatgtttcaaaggggctaccaaatctgactattatacaaagagaaacctttaatgcagtcagtagataataggaataaaaagttagcaagatcagtggaaattcccttttgggattatgaaatagtatctaaacacctttctttgtagttgttcctgtcaagcctctgacttgttaccatgccagccacccaggaatcaaacttggttaaattcaatgaactaaactttggggaggaaaatagttcttttgcctctgtatctggtttggcctgatttgcttttagactaaatatataatctgcccctcatgttattgttggggcttcccaggtattgctggtggtaaagaacctgcctgcgagtgcaggagatgtaagagacgtggggtttgatctcgtgccctggaggagggcatagcaacccactccagtattcttgtctggagaattccatggacagaggaggctggtgagctgtagtccatagggtcgcacagagtcggacacgactgaagcaacttagcacacacatgttattgtcataatgtgggattgaaaattttttgctgtagttactaaaatccatggttatttaacaggtaatttgtactcatttgatttttttagtggagattagtaagatttctcttgagtttgagtaggtagaagaatgagccttcttttttgataaaccccatttgagtcaataaattttggataagaaaaattgtgcatagctttaagttcacctcttgagtgacattgttttgagttgaattctggcattaattaatattttataattatcaaggaagccctgaaaatatatacagatctgtgtctggtagtatgtgtatgttaatcactcagttggtgtctgactctttgcaaccccatggactgtagcccaccatgctcctctgtctgtggaattctccaggccagaatacaggagtgggtagccattcccttctccaggggatcttcccaacccagggtttgaacccagatctcccgagttgaggcagattctttatcatctgagccaccagttcccgagaggacagtgctcagagtgggatatgttttgcagtcacattctcccctgttggaggagatagcgttaacactttaattaatgaaatgggacagatactaacctaggggtgatgcttggtatcttccatgtgatcattgttttttccctacctcatccttatcataattgattttttaatttcatttcttttttttaaatttctatttttaatttttttttctatttctctgcagaggggagaagtatatgggactgtggcaagatgatgtatgccaaggcaatggtgtagtagttacccagtttggtttatactatgaaggcaacttccatcttaataaaatgatggtgagtggaatgttttgcatatagt

SEQ ID NO: 35334 - DNA, 1100 bp, Bovine  19866880932929
acattgaaagagccagtgagtaaccctccagcttcctcatcccttgctgtggcaactgagggggcctcacgttaagatggtagaactgcaggcatggaagtagctgagatcactgcatcattagtgaagagggagaggaaggtaactttcctggattgctcctatgatggactttgcattaaccagaaaaaccccttatgatattaagtaactgtgatttgggggttagtgtgatgtaacccagtctatcctgatgaaatgagacaaaagaagatgtagtccctatcacagaactatatgcaagacaacagttatattctaggtgactccattcagggatgaatgttttttaacttttaaggtcaaatatcaaccacataactagtgtcacatagtatcagccatcctttaaaaatggcagtcataggagattaatatgatttaaaaaattgtgacattatatactattcagattcaagtttaagggaaaattaagggggaaaaaactaactttcaaacatcaaatactgtatttagaaaattttacattaacagaaaactaactcaccttgaatagcactttacatgacaccaccaaatttaatcaggacagagacaaaaagagaaactctattaattagaaatctattaaactgtcagattgtaaattgacttatatcattacaaatttaaaataaaattagctttcacagaaaataagctaatttacaaactagcttattatttataagtaataagctgtttaataagactaacaaaataaccccaatattttctgaacctacatatacatactccctgtctattaataaagtgggttaaacagattaaggactctcatgttgtcactgattaaaatcagcttaaactctgaggaaactattctcacaaacaaaagaggatcagaattctgatcaacaaatcactaaaacattcagaacagacacagtatacgaatatgtggacattcagtctttgaaacagaatgtttaattacaactgttatcttaatgattcaaggatttttcatctttaagcttgaggaagtcttttctgaattattataattgtgcaatgct

SEQ ID NO: 35335 - DNA, 1112 bp, Bovine  19866880951511
ctcaccccccacccccctgccccgaggaaaaccctgaaacctgaccctgaggctgagagagaaggggtcatccaggcagatgggtcagagggcatggccaggggaggggtcagctttgtttccgctccgtgttggtgaaagccaaatctttatggaaattttctagctgcattttgggctatttagcttcaaaaacaaaagatttatttttccctgctctccttttgggttttgtcctctgctgacagcagtgacatatgcgggtctagaggctgttaagattaggccaggttcccccacccccaatcccactccttcttccccagtcctaaggaaaagaaaagagaatcctaagtaaaaaagaacccaacctgcagggaggcagcaggaacattcccaacttccaccactgcttctctggtcttttcaatagagaaaagaacaggagtggcatggtgggacgtgcctttcattatacactgttgacataacctgttacattttataaagcacttgcacatgctgcagtatcccatgggatccttgcatccgttccttgagttggggcttatggtccccttttgcagatgtgaaaactgaggcttatcagtaactctgccaaggtcagtgagatatcaaaggggtagaactagcactcccaccaaagtttctgtctccaaacacagggaccttcctgatagatacgctgggagatgtgatttaacttctccaggtctcattttccaaatctaaaaggaggttattccctaggttctattgagaccttctaaactgttttctcactttggtccttcacgagaaaaagtcaatgaaaggggtgtcaggagcttgacagtatgaggggaagaaatcaagctgtgtctcttggtagcttctggggttttacctcaaggtcccctgcatggtgacaaagatgggttgttgttcccatgcagttctcaagtatcgatcagagcagttatcgaatcaatctggaacatctccagagtggccctctggcattgtggatgtggaagccgttcttagcattgccaggtgttcaaaagtaagggattttggtaaaaaaaaaaaaaatacagtccgtttcaaca

SEQ ID NO: 35336 - DNA, 1979 bp, Bovine  19866880976554
taagagccttcagggagagagtaaatcaactatttttggttttcagtttcccagtcagtgaagtggagatttagtaattttctcaagtgaaaatgaactcaataattttcaaataaaaactgagcatcaaatttccaaataaaggatattgaatttttgtttaaacttttaaaatctcaaagcttaaagcttttagcacaatcttctaaaattgttggtatccattgttggctttaattacacaataatacaaagtagccaacaattctggtaacttttgccttagagaaaatatggatgtggtcatttttatttcctttattgctttctcttcattatctttgctttcttgtcattttcttgctaggcaacagagatgtaggggtatttgtgaatcattctgcccacttgtttacacacacatctgtgcaaatacataagatggcagtttagcaaagaagaattaactccccatcctttggccctctcccacaaaagaagaattagtccagttggtttttcaaaatggattccaggattctcagtgttccctctggctcggggtggctgataggaaaagctcacaatcctctcagtagcttttcaatttgtttagggaatggatcaaagaaagaagcttctactgggtggcttgattttattattattattattattattatatgagggaaaatggcactttggtatcttttgtttgaggacaagcttaacaggcaccacaaagtatacttgtcagccagagtcctactcagctaactggtggttattaagaggcttccagattcctcatcaattttcatcagtcgaggcttcccagatggtgcaatgataaagaatctacctgccagtgcaagagacacaagagacacaggttcattggtaagatcacctggagtaggaaatcagtcattgttgggcagttgatttcctgctataacaattgggccagcatctgtctccagcattttacaaatggattcactaggcttcttctatgagagatgcttgtattgaggtatgcttcccagaagagctatattgtagtggtgtatgaaagctactaatgtttcattagtatttcacaaaaacaatattattctagctcccaactgacattgagcatttatgattatcttaaaagaatggtaaggttttgtctacaagggaactcagagtaacagagtcatttaaaatctgaagtattttgacttaaattctaaaagatttttcttttcttagtaattaaaaagtaaagcttcagtttagtaatccaaagcataagtgagctctttttcaagcaatgttgttactattatgatccaccagttaaaaaccaaacactatattccaaactgctgggccacagagaaaagaagcagataagatgaattcagtagaaaagactagagttaggtttcggatcatttttagccaacattccactgcctaaaggtcagtaatctgaatcctttttaatttgaacacattggtgaacagctgaatgcccatgctgaggcataatttaaactgtcaaatgtctcctgttgagatatatatatatatatacacagagagttatctgatgtaaggcaaagggacactttgccactcacgtctttctgtatttccaactccaaagatagcatcccaatgtatggtgatcatgcactacatacagtaggcaaacttcgttttattgcgctctactttattgcactttgcagacattgcttttttaaaacaaattgaaggtttgcagcaacgctgtcttgtcagatgatggatagcaattttttagcaaggaagcatttttaaaattaaggtatgtacattggtttttaaattaaggtatgcacattggtctgttacacacttaatagaccatagtatagtgtaaacataaattttatatatactgggaaaccaaaaaatttgtgtgattcacattattacagtat

SEQ ID NO: 35337 - DNA, 1403 bp, Bovine  19866881013409
actaacatgtaaagatactgttatgaagaaagtacttttatccccagtttaaagacaaggaaattcagacagaggagtaacttgcccaaactcaaagatgtaggttgatggggctccaggtacgcccaggtctaaagcctaggatcttcaccattatgcttgtactattaagattaaaatactgtaatctactgcaaaaacaaatttttcactcttttaaattcttaatcactaactcagaggtcaagtggccactccaaaaccatccctatctatgataaactgaaaaagatactggaccaacaggtttgctgaatttctgtacttgttcaaaataaacacacatcacacaattttatttttctaagcattttaaagaacatttacagccaccaacaaatccagaaggcaacagactaaggatgagcgtttgttgctgctgctattgttcagtcgcccagtcgtgtccaactctttgcgaccccatggactgcagcacgccatgcctccctgaacctcaccatctcccgaaatttgcccaagttcatgtccattgcatcggtgatgccatgtacaaatggtgagcgtgtgtattcaacagttatttccttttccattctaaacccaaaagaaaatactgtacttggataagccacttcagccagtgtgtttttcctattccctcatcaacaaagccctaagcaatacaccaccactttagccaaacacacaaggaggaccaacaccagcgtcagtaccatttcctcacgaaaacccctgttattttcctcttcacttgtcaaaagaacttgccaccctctgctggatcacttgacacgcaaaaggactaacctaaactcctaattcttaatatcattttctttttccacgaccgccttttcaagtcagcgaaacccttggtccactgtccaccgcgagctgcatccaggggcaacccctcccgggacactcaccaaggttcgcggccagggacccgagtttatctggtcggcgccaagagtgggcattcaataaatcctccggaatgaatggctggaaggcagcgtgggtggaggcgggaaggggggacgcgaagaatttcaggaggctgaggtcttccgcagtggcgccccgtgtgaggagggaggaaccggggcgactgggagaacctggggccgttgggtgctcctccacaggcaggcgcagcggggcggacgctggcttgggaagatgggggcgccgtctccgcggatccccgcagagcgctcctgggcctctgcctgcgcctccgcctttctctcggaccccggccgccctcaggctggaggccccggccggtcagccttccgaagccacgggccaacccgggacccgcgctcgctcacctgacgctccaccagcgg

SEQ ID NO: 35338 - DNA, 2144 bp, Bovine  19866881073095
aacctgtaaggtagggttctgttctgcaatcaaatgttctttatataccccctcatagagctattcattattatactgttttttccaaataccttcatacactttatctctgaaacttaaaatatttcccagttggaaaggatgtatggtgccttaattgtcccccagaattttagaggaatggtggcttttcagggggaaaacaagatgccatgggaagtcctgaatgcctccatataaatagagccggcttggctccataaccaatgagattaagtcgcccatcagtcacatctgagtcccacatctttcagtataatctgttggttacccacatacagtaaaagaacatctattccaagagcacatctttatttcttcttcccaactctgtcaatgtgctggatggttataccttgtcaattttagcaagcacttgccttaaagtgtggagcctggaggatctgtcttagctcttggatctcaggggacttgggggtttcgcgtagtatcttcactacctggttggtgggaaaacatacatgtgaatttttaataatctttatcacctagttaacatcacccaggttggataacaggtatattgacatgatatttacctaagaaaagctgttactaaagccttcttcttcacctttaaagtcaggtgaaattagcattttttccttattcactaaacttcattacagccgatagaatccaagactggggatagatctaaaccacagtgcccttgtcctggcacctcacagacttgggggaaggactaacttaatcgtgtaagatcatatgtgccaaggcagtttccctcagtgcctctaaagtgactgtttgctcatgtgaatgctttatgggcaagttaagatatctgggttctccaggtacaggctcagttacctggaaaaccaagtagctttaatcccatgggatgttccatttttcaactaaaaaacgaaacggtaatttgtattttaaggcttttatttgattagtaattttaatgtttgttgcaacaataaaaaagtgttagaataaattctgatccctttgctttggtttaagtgtagacctggcttctgatagaacataagagctttcaagaatttaactctgtaaatcctcaccagtcaagcaacatcacatccagtcaaatgaaaacaagaggtttagcaaacttcacctccactcactagggttacagctgaataaaatcacatgtatgtgtttccccatggatagctaagaacaatttgagttgttgattactggagttttggctgtaaggctttattttttttctttttaaaagtttctattaatgtggtttggacaataaataaaaataaaatggattatatttatgcatccaaatattgggcttccatggtggctcagatggtaaagaatccacttgcaaggcgggaaacccaggtttgatccctgggtggagaaggtctcctggaggagggcatggcaactccagtattcttgcctggagaatccccatgaacacaggagccaggtggactatggtacatggggttgcaaagattcagacatgactgagtggctttcatttttcaacaaatatgtattgaacatttactatgtgctaggtattgttttttgtttgtttgtttttaaatatgtatgtatttatttacttggttgtgctgggcctgtcatagcgcttgaaatctttgattttttttctgaaatgcaggatctagttccctgacgagagatcgaaccctggtcccctgctttgggagggcagagtcttagccactggaccaccagggaagtccctagacactgttttaagtgatgcaaatacagctgtgaataggcagacacaaacccccacactcatagaatttacatttttgttaggagccacagaaaagaagtaaaatgtgtaaataaaaaaaagaatagttttatttgatgatgaaaagaattaagaagaaaaataaaacaaggaaggtggatagagagtgctatgaggggattgcagttttagatggggtgaccagagaaagtctctgtgagaagctgacgtttcagtggaaactggaaggagatgtagaagcatatcatgtggatatataggcaagagcatt

SEQ ID NO: 35339 - DNA, 1770 bp, Bovine  19866881081058
cttttttttcctaaatgagatctatattgttctgtaacttgtttttcttcatatatgtctatcttatactctagatgtttgcatactatttcactatatagtaataatttagccagtcctccattaatggatattggtaaccaggctttcactctttctattataagtcttgctgcaattaatatactgttacatacatctctgtgaacttggacagagtatatatttctagtgtattttttcattctgttactaggatgaatattttgaaggaaattttttatattcttagttcctaagatagtttatggaagtgagttaaatcttgtttatacataaaatatttaaaatggtatctcttccaaactcgcctttaacaagtaaaaacaataccacaagtattaagatacataataaatacttagttttgtagtatttatattaaattgttaaaaattaacattaaaccactttgagccattatttttctccactggagtaacgtaaattaaggaaatcagaccttcttgactatcccaccttgaaaaagcagtgaaattcatgactctctcaaatatgtttaacatagtttttattaaccaaaaatgggtattcgctttctggattaacagtcttttttattctccagccatttttgtgtaatttgcaagtgtagaaaacccaggataaatcaatctttgcgtactaggtcttactttgtagaaaccaacttcagtatcttctaagaaggcaaagtaaaagaaggaaggagcaaactcaagggtgctactgaaacccttgtcatgtttcaggaaggatatgacatcttatccactgtactccccaccaagtgatggacagtaattgagaaagtttaatttgaattgactcaaaaggaggaaaagctgataaacatcttagtgggctgattttaattggggcacgggaagtctgtctgctttcaaggctgcttcagtcattatgtcattccatattgacagtggggtcttgcataggtcctgaatttctaccatgtgtcagctggcttcataatgtcaaatcctgggggtgaaatcctcatctctaaagtctctcccagctaatgagtcacttacctgctaatccctttgtaaactgtagcataagaaccttcacccagcttctccaagttcaagtaagatgaagctgccccaaaagggaggctcttcctctgcataagaggaatgaggagtgaggaggggggaaagaaaagagcatttttttagtgttgactttttcccccacagaaattagacaacgttgcagaatgtgcttgggaaggtctgcttagtaattgtcttggaaaaagggccagccttcctagataagtacacattaaattcctcttgatcaacatcagctgctcactcacccactgaaaaccttgcctcagatcctcttcctgaaaagaatcgctgttactccgtggccttttactcttgaacttccgggcatgcacagcctgaagtcccctggggtgaaatgaagtcatggaacatgatgcttcttttaggtctgttagctagagaaaaaggaaagtgcaggaataaaatttatgcaaagtcaagacaatggctagcataaaccgctttttctttatttgcctgatgttaactcttcaaatgttttctaagcttcccacactttcaaaatgtacctttcttgaacatcagttcctttaaaaaaacaaaaaacccataagatatcaactgctaaaacacaacattcttt

SEQ ID NO: 35340 - DNA, 1253 bp, Bovine  19866881083463
ttttaaggaagtagcaagatttttttttttttttaatggcacaggacctatatttaggccctcactgttgaccatttagtttccatggctaagctaaactaagtcatccgcctgttgtattctgccagcagtatttatatcaatgacatgttttgtttgttctttttatgtctcattgttattaaaataagtcactgggccggtttagtttattttctcctaaatgtgcaagaattacaaaagctggcttcttgttaaataatgcatgcttggttgattgttttatgaagaaaagtgggtgaagttgttcctaaaaagaatgaatatagatccagcatagcaagtagaaagtactcaaggaagtgtgtgtgtgtgaactaggaaaggcactggatatgtactgtttgtgcttgccagagtttagttttgactgcatttaggactgtgacgctgcagactttctatttatgcatcacgaggtagagagaaaatgataaagggcactaaactagcatcactcattcagaggacaggaagtaaatgtgacttcttagttgcaagaagatatcataaagcaatcaaccgtaggctttacagtgtgtacagctttctgtagtcttgaataattataatgataaagataaaatagtattatttgatggtgatagaaataataataactcatatttgcatagcatttactgtattctgaggtattgttctaagagctttacatgtagtaactcatggaatttcccagtgaccatctgaggcaggttcttctattatcctcttgtaactcacttaatctccataaaggagacatgttattaaggccacttacaaatgaagaaacgaggttaagtaacttgtccaaggtcatgcaactagtagtagaactggggttcagaatccatgttcttaacctctgtgacaggctcaataatggccctccaggatacctagaccttagtctcctggaacttgtgaatattacctgatacagccaaagggattttgcagaaaggaccacattgagggattttgagagggggagattattttggctaatccagttgggccttaaataaaagtatgagtgtccataagagggagatagcagaagatttggcagaagacggtgatgtgacaggggaagcagagagagagaagagatccggagatactggctttgaagatggaagaaaggcccctgagccaaggactgcagctctagaagctggacaagacag

SEQ ID NO: 35341 - DNA, 2846 bp, Bovine  19866881189988
actgttagaacagtctttaactgttctacccatctccaagttctgtatttttgtcctgtcaagaacgtatatttctaaaattctgatctgatcaggtcacttttatggtggcatctcctcatgactccctagtatcaacagaataaaatccaaatacattagcatttgaaaatttccataatttaactatatccattttaaaacaccatatactccatgcttcagggctggtcactgtgcctggaatcctcctgacttttgctgaccctggatctctgcccctccttctgcttataatacttcacccttcctaccatccaaggctgaacactaatactgcctgttaagaagtcctccagagtccccctgagctgagttaatctctcactcttctgagttcccttgtgtacaacaagcaccattgttatacatctggtgcttcatactctggagccaagactgcctgttagaggatccctcaggcccctgtgctcctccaagctcagtcactgggtggggtgccccaggaggagcatggcctctgaactgaggtgggcctgaagctctcgcaggtgggacctgtcctctcactgcactccctacagctgaatggcaagttgtttctcggagggagacctgaatggcgggcaacccttgctgccacagaggccctggggaagcagccagattgactggtgccagctagctatggaagcactattgtcttattctccctctgaaccctcaactccactgttctctaggctcacatattttctgaaattgtgctccaagtactttactgagaaagtgtcgaggggaccaacagggctccccaatcatgaagctggtggcctgagtacacagcaaagaaaagttttcaaattgtgtgtgagcttctgcagagtacagcccaggctcctgcctctactactgtcccctaacccctgttagagatgtgcttctgcaactgggtctccggcctattaggtaaatgtttcatgcaactgacgaggcctcgtccccttgtcatttgcctgctgcccctgggttacagctgagagattggctatacctccccaacttccctgtggtagagatcactgaatccttgatactactgtccccttaagaaagaaagaaatgagagtcatgagcagagcagacgtgtgtccttataaatgggattctccccttgaccctcacactccccttactgtcccattctttcccccaaacccagactagtgagaaacttctgagaaacaacgtccacaattaaatataaggtcacatttagttcagcaccactggctgcttaattggctgattctatagcatcttttgggtgactgatactgttgctgaagttgaaactccaattctttggctatctgatgtgaagaactgactcattggaaaagatcctgatgctgagaaagattgaagggaggaggaaaaggggacaacaaagcatgagatgattggatggcatgactgactcgatggacatgagtttgagcaggctccgggagttggtgatggacaaggaagcctggcatcctgcagtccatggggttgcaaagagctagacacaactgaacaactgaattgaactgatagcttctctcctcatctgccaacatagtgtctaacaaactggcttgcagggaaattaatcctcaggttcctgagacccagctggagtaggatttgtttccttcatgggcatctgttcatttgtgaggttgttgggtgggggccagggtacaactgcatggaacttagtggagctaagtccagaggtccggtgggaaacttacaggggctcagaggaccaaccatcctaaagaggagttgtcagcttcttggagggaagctctagccttttgttagggtccaggacaagcagcctaatctttttctgggtctcagattcttcccatgtgaaaatgggtaatagtaacaactgttactatactgtcacctacaaataaggattacataatgttgtctatgtgtgacgtgcctggtgcccatcactagggcagtgatgagactggataagcaaatgaagtcatgttgcccaaggcagatgttctcagccctcagtgggcagtgaaagtgttagtcgctcagttgtgtccaactttttgcaactccatggactgtagtttgccaggctcctctttctatggaattctttgggcaagattactgaagtgggtagtcattcccttctccaggggttcttcccaagccagggatcaaatctgtatctctgcattgcaggtggattctttatcatcttaccaccagggagggaactgtaaatgatgggcagtggggagagggcatgtctcttagtaggatgggaggcagctgtgaagtcaacccagctggagcagagttgaagcttgagtttttaaggagacaattactgtcacaagggaaggcatctgggggtggtccaggtggaacatccctcctcccaagtttattcacttactgactgtggccataaggaggacggcatctatccaggcatcctgattgtcattatcattatccagatttggagtgtggtttgcacacatctatgtccatgaatgcatttgatcctcagaacaacctatgaagttcacatttccagatgagacaatgaggctcagagaggttattatttgcctcacttggccacaggcctgggtgagaaatggggatttgaagtccattattttctgagtccagcagtgcatcatgctatcatgatgacagacacctctaacattgctgagggcatgggttgcttatgacccttctaaacattgctggagaagttgcca

SEQ ID NO: 35342 - DNA, 1298 bp, Bovine  19866881342438
gagacagtggctgactttattttttggagctccaaaatcgctgcagatggtgactgcagccatgaaattaaaagacactccttggaaggaacgttatgaccaacatagacagcatattaaagagcagagacattactttgccaacaaaggtctgtctagtcaaggctatggtttttccagtggtcatgtgtggatgtgagagttggactgtaaattaagctgagagccgaagaattggtgcttttgaactgtggtgttagagaagactcttgagagtcccttggactgcaaggagatccaaccagtccatcctagaggagatcagtcctgggtgttcattggaaggactggtattgaagctgaaactccaatactttggccacctgatgcgaagagctggctcattggaaaagaccctgatgctgggaaagattgagggcaggaggagaaggggacgacagagtgtgagatggttggatggcatcaccgactcaatggacatgggtttgggtggactctgggagtgggtgatggacagggaagcctggcatgttgcagttcatggggtcgccaagagtcggacaccactgagtgaaccgaactgagctgaatggcatcgcacaattgagaatacacagaaattctgctcccaccattagcacacagtggtgaagctttgttatacaaaatgatgtcctgaaagccattttctcacactagggaatctcatgtgttgttcacagtaagtcgctggggctgcacaactagatagttctccatcacctggctcccagttcactctttaaaccatgtgatggtaatggtttttatactttctaactactatggagtgaaaattgtgagctgtctgctaatcattttagcaaaatgctaatttgatgtacaaagcatttgtatctttccagggacatatgtattgtataacccaaggtacacaaatacctcccctctatttgcccacattagtgaggttttgatataccaatcagtgtcctcactcttagcccaggaagggagctgccaggaagctggagctgacagtctgaggaagaggaaggggcatcacggagccctgggttctgggagaacttcacctcaaggcccttgctgctagagttcactttgtaccaggagcccctggcccacaggtaagcccactgtctgtgactcaacctttatagtttcctttgggaaagcattcatatcttctggagagccgagttcagatgcaagtccttctgcagagatggcattaaccatactgtataggaagggga

SEQ ID NO: 35343 - DNA, 961 bp, Bovine  19866881359856
tttataaatgaggagcctgagtcacagagctgttaagtaacttatccaagctagcacaggtagaaaggggttgaggcaggcttcggaaactaggcacgtgctttagaaaccctgcacccatgcccttaaccactagatctcgtggccttatgatatcaggcagagagactggcaagtctgactcctgtgctcaggaatgcagaggcacctccacttctcagacaaggtcctgagattcttgcggctggtgaggcttcatggttcaggtaataaaaattttggctgggttttatttagaccagagtttccatctcagggttgaacgatcctattctcagcctgctggtctctggcatttgcaacaggagccttctctgttgaaggactgactggtccagttgagccccaggtagaagacaaaggaggtataagacaatctttctccctgctggcttggaaacaatcatctttctccccaggaatcaatgtctttgcattctggatgttgaaagaaaagacttcatgtcattaaaaataaaattttttaaaggaaaaaaaaagcagtgttcgtctctttgtgcatctctacaccctcttagatgtgcctgcagaaaacttcacttaaacgagcacattcctagagtgctaagggataaatggaacaggaagtggactgactacttggttatttgttaattctctgcaggggaataacttaggacaatgcctggtgaagatctcagagacgcaaaaaaggaaggtgtcaaaaggtaaagggattcttagctgggagtagcaagggaggaatgaaggaaatgtatctaatgaaattataccagcctataacgatctggagaaaacaaaccaacatttttaactgctgaggaattcacactgagctcagataagacaatggatttatttataggtgccccatggtgcatgttggggcgagggcaag

SEQ ID NO: 35344 - DNA, 2523 bp, Bovine  19866881430170
tctggtgttcctttttctggctgcaaggttaataattcagtttaggatttaatttgacgtggctgagccactcttattgcaggtgatatgaggtctcctggaatataatgatggggctgtgtgaatttggagtacatgaggtatttgcaaggcctctggagtcatggaattattgaaatacagcatattttcctcagtcacagtctctcttgaagaaaacctttcacattccatataaagggtatcttcaaaacaggcatattaaaaaaaatgcaaatgttggttgtgtggctccttagtagcaggaagggtcgactcagttgtgttttagctcaggggaggcctgacccaggcctggggtcctaacaccgagagttcaggtccttcctcagaaccaactaggcacacacagggaaacaaagttacttttattattactgtgttttaatgagtgtgagggaagaggagaaagccaggaagttggagataagggagaaatagaggccatgttggttcatctctcaaccaccagcacccgccccagccccccgcagggagagccccgggctgtgctgcgtctgctgagacccgcaaagttctaggaaataccctgagttgtctctctagagtgaatctcaaggcagtgccagcttcaaatctttaattttaaggaaccaatttataaatatttgtaaacatatgtcctcgaatcactaataagtattttttttttattttatttatttatttggctgctctgggtcttagttgtagcatgtgggatctagctccctgaccagggatcgaacctgggcccccggcactgggagctcagagtcttagccactggaccaccagggaagtcccactaataagtattcttaatccacccggataaagcatttttctcctttcttcacagtctccttgcatttttttcttagttgctattttttctctccccattgggaatgagaattagagtaggaaaaaaacaggcccattggcgcaaagtcttagtccccactgcctcaatggaggatgcctttctgtgtttccctgttcccttctgactttgcagaagtcagggaaaggcctcttcagcttattcgcgcttatgaagagccagacaaaacagtccaagttgagttaagacattccaagtctatgagttaaggaacctctgtgattttatagtctgcttgtctcatttaattgatgaagcaaatgaggcccagagaggtgaagaatctcacccagggtcacacagcaagcagggacaagaacctcaaagtcccgactaccagtcacttgctcatgcagaatcaatactgtacctgattctctggcttttgagtcaaaggtgaagtctcattaagattcatatgaagatctgttctggattcagtgtttactatgatgaaaatcagagagaaaagggtcaaggttgtcagatataggtctcatgaatttttatgtatacaatacacctacatacctagttcatatgtgtaagactataaatgtacacatgcttatggcattcatatttacttaccaaataacacatgtaacctctataggcacagtctaaatgctccatttaataaagtgttatagagcttatattcaaatttctagttttcttgttttggttgctctttaaaagaacaaaagtaaattctttgtgctactaaaattcagataaagctgaaattaaaaaggaaatattgatggaaaaaaatctgctgatactgttgaatataaattttgtatgatccaacttcactgaagtaggaaaatgcttctgcaaccttccagatagagagatcagagccttcccttttcctcattatgtggaggggcaataggagaggtggaaacacaagcaaacaaaggcaaaggtcaaaacggggctggtgggaggggactaacagaaatcttgccgctcacccagaagcaggcacatacggacaaccacatgggctggcgtgtaaccttcacgactcccctccatggtcgtgctgtcatactcgctataggtgtggaagctgaggctcaaaagataaagtaatccacccaagggtgtgcaactagtgaggttttgagtaaggatttgagtccaagactgccagactcaaacttcatgctgttagaggataggatttattttgtttttctttttttcccctaagaaagtaaatttcatgtctgtaaaggaatgtttatttgaggaacagattcagctaagtgcatggctcctctgaaaaggattttagtctcttgtactggactagtgtccaacacaaagttctttacatacttgctactcctaagtagttctgtgatgagtctggccatatgcaattctgcatctttgcctctttgacctgaagcctctattctttctttgtgggctgactttccctttcccttttctgttgtttctcagctgttctatcttgctggaaaatggcttctgcacagatgaaaacatttgttatttagataactagggaaact

SEQ ID NO: 35345 - DNA, 1064 bp, Bovine  19866881570231
ctttgccttggaaatggggaaagtcaagtcaaagaaacatcttcaactaagcaacggggagaaatacagttttcttctcctccctggcccgagcccctggagtcactaagagcggccacacttgaccgtcagggcacagctatgctgctgagtagggcacaaaggcacaaggcagagcaggaagcagaggctggaggctctgagacctgtgccgaggctctgggctgcacacgtgcttgaaggacacggcttcatttccttcgcacaagatgcccctaccagcctcaccttgtccctgcagggatgcctgaaaccaaaggacccttcttttctagacctcacggaagccatggcataggcaagtggcagccccaccccattcatcccacactaactttagacaatggggcccaaacatggcgcagctctggagaaccccaggagggagagggcagcgagctcctgagcacaccctccagcagctccccgctggggagagcaggctacattcggcctccctcccctgctctagtgctaacactcactgccggtgcctgtgcttattttcaagaaaaatctggagaccctacattgggacacttcttgcaaggtccaggtggagaaaacatctgcctgtccctcccagggcccacccacacccaggagcttccgtcacgggaaggtaagatgagacagcccaggtcagccctgtttccttggggggaagattctacctgcagcttccaaaacttcccagcagcagagacatcattaaaaacagacgcaagtcagccagtttctctcctctggctgacacagaggtgcttctgtagttcagacacaataacccaatgtttgcttaacaagttcgctcttgcatcaggagagagacgttcctgtggaatggctcggaggaggcctaatgtgctgtgctgatgcctcgatgaggatgataaagccctcttggtatttgcccaaactaaacaccatcttttctcttctttccaaccaccctccagaggtggaggggctaattggtatccaatcaggtctcctgtaatgag

SEQ ID NO: 35346 - DNA, 1429 bp, Bovine  19866881658982
tccctctcccacagagtccaaaaaactgttctatacatcagtgcctcttttgctgtctcatatacagggttattgttaccatctttctaaattccatatatatgcattagtatactgtattggtgtttttctttctggcttacttcactctgtataataggctccagtttcatccacctcattagaactgattcaaatgtattctttttaatggctgagtaatactccattgtgtatatgtaccacagctgtcttatccattcacctgctgatggacatctaggttgcttccatgacctggctattataaacagtgcttgcggggaaattttgaggaagaaaaatcttttggcttgaaattttttttagtgtgtgaatgtttcccaatttgtcctgtgttcctccattatatcctccgtgtttccaaaagaaagcttaatggcagtgattaatctctataaaacatctgaatttcacaaaggacattctattttagtgttcacaacacactgtgttttctgggtcatgaatctgtggcactagactggtttgcacagaatatcttcataaatgtgagtcattgtccctccagacactagcaactaactcttcccttttcctaaaagtttcctgaggattatcttcaccttcatgttgtaaaattcaacttaaaaaaatgatataagtgttttttacatgggcttttacaaatatttatttatttatttttatttggctgtgccaggtctcagttgcagcacaatggatcttttgttgtggcatgtgatatctaattccctgaacagggatcaaacctgggctccctgcattggaagcacagggtcttagccactggaccaccagggaaatccccagctttttaaaatttttaataaatgaaggactctgcagtggaaacataattcaaaaatgaaattttatattattcctgcaaggcaaaatgtttgatgacattaagtcaaaatcacaaagagtttgagaaaagataagtttcctcacctgcacacaaaaatcccactttgcattatttccccagatacctgattgggaggctattagcaagaatgctctagatgcttgcttgaaacaagcaaacttaaaggaatccgaatccaggatacaaggaagtaccctacccaccccagtttaaagtacttgatacatgctacaatatggatggatcttgaaaacattatgctaagtgaaataagccagacacaaaggacaaacactgtatgattccacttatatgaaaacctagaatgggcaatttcatgcagacagaatgtagatgagaggttaccagtggctaggggcaggaaaatggggggctggttgaatggatatagagctgctgttggggatgatgaaaagttttggatgatgaaatggatggtggtgatggttg

SEQ ID NO: 35347 - DNA, 2035 bp, Bovine  19866881667078
aataaagaagtggaaacacacatacataagcatcctgtcaccttagaaatctagttttggagcataagtagtatatttctcttacactaacatgggaagctaacattttgttttatcagggctctgtgaaaatgtagtgttttatcttcagttgacaaagatccatggccaaatatgtggtagaattagacctgggggttgcagggaaggttagtaatggcagaaattgccctaggatgttaagataatagtcatcaggagcaggaggattcaagggcatctatgggacaaagggggggttcctaaccactcattccctaggtgcttaagcccctggcaaacaccacagtttccacaacctcaaaatatggcttaatgtctcaaagcagatggactgcttcatttgtttctaacgcaaatttggttcaaagttttatatgcatatattttttcttcctaagaggaattcttctcttacctcccagatcttctccagctgttcaaggatgttggaaaccccaggaaacaagggttgaccctggaacatttcaataaagatgcagcctgcacccctaacaaaggaaataagagtcaacccgatactttcaaggaaaccatacatgcaaaaccgaactactagcatttcatcccttaagaaatattttaaggataattaaatatgggccatgcactatgaaaagtcttggcaaaaaaagtccctatgttaaacaaagataagaccagcttgcagctttttgttaaaatggaacgcattgggcatttaggatcccagtatagatagcaaacattttagttcattcaagctcattaactatctattttatgagagaggaagaaaatactgagtctccaaactgaataccctctttcactgaatttaaggtgctatcattgtaagaagcatcattattgtatgtacttttaagaacccaaaaaaaaaaaaaaacccaaaaaaaaaaaaaaaaaccccacaagttaaactatgacatgatcagaatgtttcttttatactcattgaaagggctgttacacatttaatcagacagattatttcatcaactatcatacttgtacaatgaaaaatattaaatgaaagaaattgattcaggtactcatcaaactttctcacattcagcatttgacaaagactgtttaatgtctgtgtttatatccatgatatcgtcttttgatggtattgtccaggagtttgatgatacagcatttcttaaaataatccttatttcttaaaataaaagaactaagagttattggtgctgggatcctaggctgaccttgcaattacaagttacacttttgattccagcttaaaaaatattgctaaatatgtctgattcacttattctccacaaccatttggtttcctaagagttaaaaaataaagaaagaaataaagctctcctgtcttcaaagtcactgactcccattcagcaagttttgatgctgacatgtttgatgtccacacacatacaagggtaactatagtcacaactgcagcatggttgatggctattctaagatgttactgactgaaatgcatcctgatttaaacagagaatgcacattttaaaggacttcccaggtggtactagtggtaaagaacccatctgccaatgaaggagacacaggagtcgtgggtttgatccctgggttggcaagatctcctggagagggcatgccaacccactccagtactcttgcctagagaatctcatggacagatgagcctggcgggctacagtccatagagttgcaaagagtcagacatgactgaagcgacttagcactcaggcacatgcatcttaaaataaattgtctttcctgcttagtcaaactggagggtaattcctaaggaacagtaagaagtaagagtttgctggtaacacacatttttactctcacaaaacttttttgagaatgcttcaaggggcttcccttgtggctcagctggtaaacaatctgcctgcaatgcagaacccaatgagacctgggttcg

SEQ ID NO: 35348 - DNA, 1381 bp, Bovine  19866880340132
tggcaggttttttggacaccgtagtttggtaaatcctggcagagactggaaactggtttccatcttgatttaacgctgttttaagtttataagaaaaatgtcactatgtaaacaacagacattttgattaaacactcaagttcttattttggctgttaaatcaataacgcagctggactgaatgtcgtttacattccctccaagctgggctccagttcagctggtcttgtgctgacatcattttccagcaagatctggctgctctcagcggccagtttagaaatatcccttacaaacaaccacataacgttcaatgttagcacattttaagatgagagtctcaaaaatgcctgtgcttaaaataggacagttgatcccaaaatagtctcccacctgatgtgtcattcactagtaaaaagaaaaaaattaagtagtttaacaagaaaacaaaagcttctggtgatactatttatcttgacttcacctgagaccgactctgggaagagttcctattttcctctccagagtagattaactaatatgtaactcagagcaatgattctcaaacctgttttggtggcaggctctttccctgaaacaattagcttcaggtagaactttacagatactgatgaattatttaattacttaaagtcagaatgacttagaaaacaagcccaggttatatacataaaagcacagctaccagcacaaagacttattttttaaaaagcagttgaacggatcacaacacattgagtctttcagagaccactagcttagaacttgaacgtttagtgtcagaaccaaaaattaaagaaaaaatatgaaggaaaaatgctaaaatgtactcaagaccatctaataattattattttatgtgaattagggaaaatgcccctatggtttcatttcagcagctagacactcatccagccaactgaacaaagggattctagagcccacgtgggagaagaagaaaatcagaacttttggaccaggaactcaaactgctcacctgcagaaattctctgacgttagatcccaggacgcgcaggattgtatcataaccagattcttgacagaagacgaagaacatcttcccaaacatttggaggatttctccagcgttgagatctggtttatagatttgagaggcaacaacagaaacaaaacgtattagaggtagaaaatcattagaggcaggaataaagataagtgcatgacagaaatgttaaatagcctcaatttctttgcacagtgaacagatcataggaaaaatatctggccaggaaaatacaatgaaatctgagaagaagcatattgacacgttaacagtttaagtctgtacttaaaagcaaagcaaccagtttctcaggtt

SEQ ID NO: 35349 - DNA, 777 bp, Bovine  19866880602634
ttaccattaaagcagggattcaaaatgaaagtctatcagaggcaaaatgatacgacatatttccagaaatggcactagtcaaaagaccaataagagcattcacatcatttttattgaatcaaaaaccgtctagagacaagtggaaaaaataatttattacaggttctcttacacatgaacatggaacatttatacaggttatcaacgtgctgataggaaatgctatatttgaagacaaacatttttacacaaaagtagtggtcctgtattttataaagatagatattaataaattatcagagataatgaagaacaacaggtgatgattccaacaggaatgcactctatgttgaaattaaagtaacttttctcaagatggcaccctggatagaatcaagttcttgtgagctaagacaaaggagctcttttctgggaagaaagggccaagaagggctctgaccaaccaaaacaccccagctgtgcttgccgcgtcatccttggatgtagttagagcccctaacgtttactccaagctaatgcaatagctcattgtgaaacagtgctgccttcaccaacagctgcatgaggttaatgagatttataatgcaaaggatacagtgcaaaggacagcattttagaggaactgtaatcgccacatgatctgaatgaataacctaatagtttaatagcaaagaagtatattctctatttctgaagggaaattaacataattctaaatagacactgttttcttagcatgatatatggagtctgaaa

SEQ ID NO: 35350 - DNA, 1653 bp, Bovine  19866880714650
aacattgccttaactgctctgcaaattatcaattgctttcgaattcctaaacattcacctcagtgtaggctgactgcctcctatacccagatatggcacaactcttgttttccatggatccagatgttgactgaagtgtttatagtcgctgcgatccaggctcagcaatgccagctttctgcttcctccatcattttctgcttcaatattgcaattctttttctccccgggttggtcatttgaatagtgaggtagtgtctggcataaagttcttgcgagcaaaatacctaaacacccacactttatatcctgagaagtgaccgtgttttgggaaacagcttctgggctccagaagtcctgtctctctcacccaatggacagagcatgttcacatagcctgcagagacttcgtctggtcaccatggcgactgtggtaggttcgtggggggctttgattcagataggaaagacgagtgaaatacacgttgtgtgataaacccaagtgcatccatgagaagtgaagaggggtgactgatgccccgctagtggttcttccttggaagggaggagtagaggaacattggctggaggtttggaggaaggaggaggtgtgggaagagtgaagagtataataatttcaacaggtccacaaacagcactgacaagcaggagtgtttttccagaacactgactgacttttcgctttcagatgcgcattgggctgcattctgggtcagtttttgctggagttgttggagttaaaatgcctcgttactgcctttttggaaacaatgtcaccctggctaacaaatttgaatcgtgcagtgttccccggaaaatcaacgtcagcccaaccacttacaggtatgaccccactgagcgcctgcaatgtactcttttatatgcagttgtcatttttgttcattgatttgtctcattcttcataacattttcttgcttagataatattagagaaaagtcataattgagtcatcctcattttaactgtttttaaactacttgttagtctatgggaatgaccctcctgagatacctgtagcctggctgtcatcctcaatgtatatcctatctcccccattattaccctttaagcaaagggtaataatgtattccttctcacgggcttgggaggtattctaacactgaccagagttacagagaccacacaagttgatgggcatggtccctgaaaagaatgcccttaattcatgtgccaggtgtatatacagtttatctgctttgaaaaatcaaattataatggaaatcctcgaagaacaaaaagattttccagatctaagcaaatgaactgctatgatggtttcatagcatcttctttctactccaaacaactttcctttccagccctgattctaagttgaaaaccttgctttgttttgcccaagaaaggctgaaacctgctaagacccgctccagcttcatgctcagatccagtgcacctggctccctggcactcttgactgtgtgtggttcctgtcctggggaccaacagccctgctctggatttgctgtcctttcaaacattttcttttgaaaatatcagccttgtctatgatcagttcctccaatgaaatgattcttcccatcaaaatacagccatatctgtttacttac

SEQ ID NO: 35351 - DNA, 860 bp, Bovine  19866880718025
tcttgctcactcacatttattggcccttttgttccaaatgaactaagtttgtaatgaggtagaaggaagtagaacaagatcatctttttacagaacaaattgattagactgattggttaaaagatagactaatttaaaagttattacccttgtggctctatttacataaactaacctcttttcctatgtctacttgaaacaacatccctcgttatctgttcagacatgaacttaactctcactgcacctttccagatcctatcagaactatatctacaacctattgagaatcaatagtataaccaaatggtcattaggatagctaagctccataatttttactataggagactgttattaaaactttaaaaataattcctgtaaaaaggacttattaaccccaagaacaaataaataaatttattgaatatttacataaagaaaggcagagtcagtttcaaatatactaagcactatacctaagttaattattataattaagctaattccattattaatatttcctaactggggacttgataataaggtttgctttttcagtctgataagttaagtatattacttaataaacactaataagtttcactgagcatttttcacttgactgggtttagagaattctcctgcatgcgtttcctgctctttctctttctgtcctgtgctcttcctcctttccttgggctagtgtcccgatttatggaacttcttcctccttctggaatcagcttccacattctagctgcactacactacttcattctgtctgtgatttaagtaggattgtatgatttgaagtttatttatccctcaggaaaacgacattaagataaaaaagaaat

SEQ ID NO: 35352 - DNA, 1451 bp, Bovine  19866880739975
aacaggagatatagagaaaacaggagcaaaagacaaagacaaacagaatttaattacctaggctgtcaataaaaaacacttaaagttttaacctcagattttcataactcaaagaatacccaataatgacctgtgaccaagtggaatcttagactctttgtagtaagttctgtttgatctttgacacaatcatgtgacatagattacgttggatgattattttctttcagctgcaagtcaagctggtgagagattcggaatacccatttcaagcccagaatggcctctgccgttacttttccgactcacattctggatcttcaatcaaaggttattctgcgtatgacttcaggtaaatgtctccttctcttgtggttttctctatgtttcttaagttattatctattgactacttggaattaataagttgcttggcagctttactgcatagttttaattgttttaaaatacacttgatttcctggtggctcagataaagaatctgcatgcaaaacaggagaccagggttccacctctgggtcgggaagatgccctggaaaagggaatggccacccactccagtattcttgcctagagaattccatggacagaggagtttggtgggctgcagtccatagggtcacacagagtcagacacaactgaacgactaacacttttattagaaagatgcattggcagtcaccatggaggtctatggatgttgtttcttaaatattatccactttttttccatgtctctaccaacagaaataatgcaattaaatcaacacatttaaattcattttaaggtataattgatacttagcacctcctaccaagtttcagtgtcacaattacccttagcacatttcagtcttactcttgaattaataataataataaaaacttgctttctgtagagtctgaagctaatgtcaagcagtcttacttaccaagaagtttttttgaaccccctctctcttccctacattgttcaagtcatcgactgtaagaaaaatataaaatgaagttttcctattagaggcaagtggacagagtatataacgaggcagatgacaagctcatcctgcaggcgtgatgggatgcgggggtgggtgaggaagggacttgtgtgggaatgggaagggcgtgatgacttggggtgggttcaggggaagcaatccatttaaaaatgctttaaaaacacatggcactcaaagccagctaaagaactattatgaccatttcatttagtgcaaaagaggtgctcagggatgagaaacagagccatccaactccttgcttattttttagaagtataaaggaagctttccacagggttttgaaacagagaaagcaaaaaaaaaaaaaaaaattaaatttggctaaggtaacagactggtctactacttacgaatataaaagcatctcgggtctagaggcatgtccc

SEQ ID NO: 35353 - DNA, 1062 bp, Bovine  19866880758361
cgtcacatcaaagatttggagtggcggacattaaagccccactcgatatgtcacagctctcgggtcttggacagaccgtgttatagctctcaggtctcgaacggaccctgttatagctcttagacaaatcagtgttatacctctattttatttagaagatagcaggaaatccatctttgaggcgtgagggcacattgacccaaagacgcgaagagaagagcaccccagcacgcaggagagagagagcgcgttattttttaaataagagagtttcactcataatcaggattactcccataaaataaacttatagacttagaattaaatcaaagaatataatttgaggagggggatttttatgcatattgtcaatctatccttcagaaagattaatcaaactacccttccattagtgatgtatgaaatgactcttttttactgtgtcctacctaatatggcactgcagttttatatacttgccagttgatagatataaaagacatcacatatattttaagatatgtatttctatcatttagttttcctctgtttccacacagcattttttatcatattaaacagtactgctctgtctgatgtgtatgtcatttaccgtaagtgtgtgcctggcttgaggggacactgagcctatggggacgggggtgctttactccagattctactgaagatgctgcatggaccactaggggactagtaccagatttgcagttttactgtgaataattattgccttcaaatttcctaagtcagtatccaaatatagttttctatattaggcatatatagtatttgcatattttaaatctttaaaattaaccttctaaatgtggttttcattaccaatttcttaggtatttaaatattgtaaccaaatggaaatgccagacagttaacaccatttatctctttggcatccaggttattcaacaaagaaatgaagaatgtgatcatactcaatttttgattgaagaaaaagagtcaaaagaagaggatttttatgaagatctgacagattgaagaaaacggtacccaggaatcacg

SEQ ID NO: 35354 - DNA, 1475 bp, Bovine  19866880760806
ctatagacaatgatatactatggcattttccttagcacttggaaattgatttcatgccgtcaggtaagaactgtgcactacagtcaagttgccaaaggctccccaccaggggtacagggtaaaactcaccaactagtttgttacaagtctcataactgtaccaaaccagacatttactattagatgaatgactaagatgaatctgttgaagatttgacttgaaaaggggacagatagaaaatgtggtccaacagatggaatgtataaaacaggaacagctgcttaccgtcaacttgttttcttgaacaaatctcctttcctagtcattaaaacactttttttaaggccacgcacaaagtttgaagtagctattttgtcaacacacatctgcatgatatcaagagctacatggtgcaattttacaatgcggttaggggactttcatttggaagagtccagtggaatgtgaaaaaggaaaatgcctctcaataagaggcataggatgtgctctggaagaataatgataactttccacgttagtgcacaataaatgtccattttattactgctttacaaacagtaatgaagagattagctgagatttgagaaaatagactgtagtcatggaagtgataaaacaaaggtttgcataagatttaaaatcaactttttccttcctaaattcacaatttatttgaaatgagtgtaggaatgattgctaaatagtcattagtgattaacagttagcaaatacttcattatttgggatggtagcaaagagtgacagagacagtagtagtaggagagtcataatttattattccataagtagtgttaatacctgtaaaaaaaaaataggtagttgcctatagcttaagtgcttatagcataggttaagttctatggaagattttttatattcaaagataaaatttacatacaagatacatctactgtagataaagtaggatgaaatacatttgactattggtatttatcacctgtgaagactgctggcctcagggtggcaaacaggtaagtaactggacgtggcttcccagagcattgtgttgagaaaaattctaaggactgactgagaacatataaaatgatagtgatgtttggggtgagtgtggtgattaatggtctacatacctaacatttattacccctccagcttgtatattatagcttacaaattaactcaaggaccaaacaaattctattgtgtataagcaccaagcatgtttttaacatttaaagcttaaagaaacttaattaaatgtgtagtgaagttcttttcctctctaaactgtgatagttcttgtggtatatgatgaattttatcatattttcacatttggaacactttttggttgtgaaaataaaaaaactatagtaagctgaagcacaagttcccactcttgacagtctttaaaataacacttgacctacaaccaaaagtccaaaatttc

SEQ ID NO: 35355 - DNA, 1291 bp, Bovine  19866881145077
gagatcagccctgggatttctttggaaggaatgatgctaaagctgaaactccagtactttggcccctcatgcgaagagttgactcattggaaaagactctgatgcagagagggattgggggcaggaggagaaggagacgacagaggatgagatggctggatggcatcattgactcgatggacatgagtctgagtgaactccgggagatggtgatagacagggaggcctggcgtgctgtgattcatggggtcgcaaagagttggacacgactgagcgactgaactgactgactgactgactgactgataccatatttgtttttctctttctgacttatatcatgctgtatgacaatctctaggtccatccacatctctgcaaaagcactattttgttccttttatggctgagtaatattccattgtgtgtatggaccacatcttctttatccactcctctgtcgatggacatttgacttgcttccatgtcttggctattgtaaacagtgctgcaatgaacactggggtggggtgcgtgtacccaactgactcttcacataataagcatgagcgagtttctctttcttgcaaatatttatttgatattaatagtttttgataactgaaaggataatattcccttaaactcatcatgtaagcacaaggaactcaaaataaggtgactggactataaaagtgctactaccttcctgttagtactagcactttttggagggattgtagaagactatgtggagaaggcaatggcaccccactccagtactcttgcctggaaaatcccatggatggaggagcctggtggactgcagtccatggggtcgcgaagagtctgacacgactgagcaaatttgctttcacttttcactttcacgaattggagaaggaaatggcaacccagtccagtgttcttgcctggagaatcccagggatgctggagcctggtgggctgccgtctatggggtcgcacagggtcggacacgactgaagcgacttagcagcagcagcagcagcagaagactatgaaataaagaaatacttatgcacattatgaaggaattaaaagtaccccgaactgcctcccatgtgtggagctgtgaacagctcatcaggcttgcccagcttccacccacaaccacccctccacaagagcattttccagagcagctggagtaacaactgggacacaaggagattagcattttagctgctgccaaggtgaatcttcccaaatcctgattatttttatttaagtgaaacatctgccaataaga

SEQ ID NO: 35356 - DNA, 923 bp, Bovine  19866881296246
ctgatgcaaaaagccaacttactggaaaagaccctgatgctagtaaagattgaaggcaaaaggagaaggggtagcaaaggatgagatgtcaaatagcatctaaccatctaaccaactcaatggacatgaatttaagcacactctggaagatagtggaggacagagagggctggcgtgctacagtctgtggtgttgcaaagagtcagacacgacttagcaagtgaacaggagaaatacaagtcctgacttaacaatagcttgatttcaatttttttactttatgatgatgtgaaaaatgggacccattcagtagaaatcatacatcacactttggattctgatcttatcccaggctagccctaggcggtgtggccctctgatggtgctgggcagctgccaagagcatctcttagtcatgtggtcaccaggtaaaccgccaacactcaacgttctgtacccagacaacctttctgcttttcactttcagtgtcatagtcaataaatgacaagagatatccaacaccgtgttataaaacaggcttcgtgttaagtgattttgcccccctgtaggccaattgaaatgtcctgagctcatttaaggtaggctaggctcagctaagatgttaagcaggtcaggtgtattaaatgcattttcaacttacagtgttttcaacttatgatggatttatctggacgtaactccatcctaagtcaaggttattaacacatacatgtggaatctagaaatatggcacagatgaacctatttccaagacaggaacagagacgtagacataaagaacagatatctggccccaggggcggggacggcgagggggcagtgaattgggagtttagagttgaagtatacactaccatgggtaacataaatagctagtgggaagctgctataaagcacagga

SEQ ID NO: 35357 - DNA, 1621 bp, Bovine  19866881367749
aaaggaataacaaacatttgcaatgtttgagggaaaacaggaggccagcagcttgggacaaagtgagcaagaaagagaataaggagaaggatcaggatcaggggcagtagaaaggcaggacaggaactttgggggcagcttaagggctctggcatttattctgagtgaaataagcaattgctgatgctgtccccctttctcttctctctcaccttcacccctccagattgccagctttggatcagaacagtgatatgatctaggttacaataagaatttggaggagaaaaatgcacctattacaatttggtagctaatttgtgaatttaaatgaactgttagttttctatattcagcatgacaactgaaaatcactcgtaacaacagcaataatgacaatgataataactgatcaatacatgaaattcacagaagagattgatttccgatagctttccaatcaccattgtctctgcctcccgtttgacatcttagtctctgtactttatgattaatattcatgtagacagtttatcattgctatgacggcaccaaaagttctttgaaaagttgcaatgtcagttttaaccttaactatattcataggaccttgattcagtagtgactttgttcaaagcactgtattttatgctgagaggatattatcacccaatatctcaaacatattataatagattcaaagtaagtcatttgcttctgcaaagtccattttacatggtgtgggaagaaagaggtgcagggatatgggggaatcagtggcaagtttgggagcagacacccctcctgacactgtattcacagcagggtgctgcctttcagcttagaaaccttgtgagtttcctggaaagaaaaaccttttccaagagtctgtgattgactctgatgttccattggcccacgaagctgagatttctgcttcatgatgtaatttctgctgtatgatgtacactgtgatgcttcctgggtttttgttgttttttttttttgtaatgtggagaatctgttgtgcgtaggtggagacgattggcgatgcgtactgtgtggctgggggcttacataaagagagtgacacccacgctgttcagatcgcgctgatggccctcaagatgatggaactctctcatgaagtcgtgtctccccacggagaacccatcaaggtgagcctgctcacgtgttgttcaggagatgtcacgagagtaaatgctgggtagttagtcttgctgtatctcactgttctctgaaccgtgggtaggcaaggtgccagcggggaagctggaagaaaagtcaaggagctgtaggaactgcagacatgtttattctttcctgactggcacagcagccatagcagcagacaagctgtattttctcatggttgacccagcggacacagccataaccgtggccataacgcagcctcaagggcttttcaggtggatcttctgtatgtttacagaacagaagtggcccgtgcccaagtgggtacattgtgacatgcatgcacagtgctataagttagctcagctgttacataaccatgtatttacaacacgtggggccagagtgagaggccatgggggtgagagagcctgaccagtacctg

SEQ ID NO: 35358 - DNA, 1751 bp, Bovine  19866881375845
cagcatttgttatttgtagactttttaatgatggctgttctgaccagtgtgaactgatacttcattgtagttttgatttgcatttctctaataattagtgatgttgaacatcatttcatgtgccttttggcatctgtgtaaacaaagactaatattttattgaacctattatattacattcttacatagaaatgggaaatctgtccatctatttgaaattaccttctttattccatgtgctgaaagtcatgaggatgagattaaaacccccctgtcccttctggtttattttttaaaatctctttcctaaatctaatgtaagtggccagattcatacttttgaaagctccaaagaatgtttctctcatgccagattttgtgagggtttttgtctgtaatatgtttggagttctagagagttcttatgatttttatatgatgactctgaattctttagtctagcgtgaccaataattcctattattgaatgtattgaaccagagctttgattctgcagataacgatcgggatccacacaggggaggtagtgaccggagtcataggacagaggatgcctcgctactgtctttttggaaacactgtcaacctcacaagccgaacagaaaccactggagaaaaagggaaaataaatgtgtctgaatatacatacaggttagaacacatctaggtatctactgacttgaaaaatgtctctttgcagctgctttaattccctgggtgattttattaccttttacagttatcaactctgcttttaggattactattatttttcaattaaacaaaaacaaaacaaaaaactggtgtgttgttctttttttggtcacaccatggtatgtgggatcttagttccccaaccagggatcaaacctggggtcccagcattgggagtggggagtcttaaccactggaccaccagggaagtcttgggattatttattttttatttgagaagattgtgtcattatttccattttaaatgattctacatactcttagggatttctgctgtggtatttttactaaagccttggtacttttaaataatttactgtgtgtcattcctgtctctctttataactttgatgtatgttactttctctgtgcgaccatacagcaagcttctctgcctgttccctgtccccttctagatgtctcatgacaccagaaaattcagacccgcaattccatttggagcacagaggccccgtgtccatgaagggcaaaaaggagccaatgcaagtttggtttctatccagaaaaaatacaggaacagaggtatgactcatcagagtataattccttttttaagacagggtatgaatatggggagctaaatcataatctctgaaaatatgtttcatttgcaaagagttcttgcttacatgaacttgtaagtacagcagcggaaacactgacccattagtgagctggttagaataatgcagctgctaggggagacctgatgtctgacagttttgtcctttaatgaaattaaaaccaaaagcactggagagagagaagccctgattttggttcttctgccgtaatctggctggagccccacaagtgagtgggcggtgagggggcgtccctggccccctccccagtgccctgggttgccatgtggtcactgccagggctgagacaacatgaccatcttaaagggggggtttcctaaccacgatgctccagatccttctaaggccacaccatcaccttgtgggaat

SEQ ID NO: 35359 - DNA, 953 bp, Bovine  19866881400452
atgggactgaaactgaacagtaagctaagcattaaatctgtcccttaaaaaagatcagttttttaaaaagccctatttaatcaaagacacctagatgtttgaatagctgatgaagtaatctagtttggttgctattcagcatgaatgtatccagccctgcgatgttcactaaaatgtgaatgaaaatggcctcagttgtgggaaagagtcctggttcttcaggtcaagggcagacctcttgcttccttggaagtcctcagcctggctttctctactacatgacagcacactcaaagctatgagcccgcaaacaaatgacacacattatcctaaataaaggaaaataagaacgcatatatttgatattctgaatgtttttaaaagagattccaatatgtgcatgacttccattgtaggaattcagaatttatcaaacaaaataataaagccaacagggtaatgacaggacctggggaaagcatggccactctccagcttcccaacctcaccatctgctcatccctgtgctctgcccttggaaatgagggtgccaaccgcttcccagactgacaccaaccaactgcctgggaagagctgcatccctcatcctagtcaatgctggctgctggtgactggagcggggagactgtaattaaatatttccatctcaaaggccactagccagtctactactgtgcttatcttatatttgaaataagttccctcaacttcctgccaattctaatttatccattcttcaaacttcaagtctcttctttgcccgttgagcccatattgccgacagcagtaattgctatatctttcaaaagctgtgtgactttagtcaagtcacttagcctctcaggtccttcttgggaagtaaacaaggttacctctgaagttccttccagtcctaaagtcagcagcctgtggtccttcagtgtttctcacaa

SEQ ID NO: 35360 - DNA, 1159 bp, Bovine  19866881811252
aaaaggcggattatgcagaggcagacttgttgaaatctcactttatgaaaatgacagttatggctgctgctcctatatttataaaatacagtgcttaaacagttgacaatattacctacaagaagtagtgtcttaccagattcttcttccttttcagaggatctattttggtctgattatagaaataatgcaagcaattaaaagggcctcccctttccaacacgggggcagacatgcagagaagccctccctggtagagaaccgctgatgactctgggtaaaattaaaaatgggattttagggtttaagcaggctggatgtttagaaagggtaacaaactgaagcaaggaacagagaggggaaaaaagggcctcactggtagcaagcacagtagtagcaggagttcctgggagttcatcacctgacgctgtgggcgagggcctcggagctcggacatggggacaagagagaataagcgcagataggaagtgataccacaatagaggtcttgcacggtgggggtgcattttctcctcagtgttggcttagaacctagagaagacagtctctcctgagttttcctgatctgaagcctgcatgtccatggtttcagctcagaaattcatacatattcagtggcttgaaactccgcaggtggaaccttgaatttaaaagtgatcctgtgttgggaagactgcaggagcctggcagaagcaaacacaaattctctctggaataaaaagtgttccctcagaatcacccattcattaaaatattttggtagaaaaacaatcacacagcaggcactgttctagaaactggacacttaacaatctgtaaaacaaagacctttgttgtcatggtgtttccactatgaaggacaattaaaaatattaacgaaaaatgtaggtcatcagatggtggtgtgtggtgtgagaaaaacaaagcagagaaagacgatggacacagagtggagaggtgggagggaagaagaagtcactgtctgaccaatgccatcgttttaatatctcaggtataaaatatatgttttattatgaacactatgtcagattgtttcttttcaggaaaacggaaatcacctgatgcattttagacagagctgtatgaagaccttggcgaggagtgtggggatcagagg

SEQ ID NO: 35361 - DNA, 2600 bp, Bovine  19866880245504
tggcccttttctcggagaaggcatggcaccccactccagtactcttgcctggaaaattcctggatggaggagcctggtaggctgcagtccatgggatcactaagagtcggacatgactgagcaacttcactttcactttttcactttcatgcattggagaaggaaatggcaacccactccagtgttcttgcctggagaatcccaggggcaggagagcctggtgggctgacgtctatggggtcacacagagtcggacacgactgaagtgacttaacagtagcagcggcccttttcttctaacctcttttctccttaacctatactcatttcttaaaactctagctgtaataagtctcccgtgccaaagagacatctccctcatctttttagtcttgaaatccttacttatagcctcatctggttttggtggcagttttacttagtctttaagatgtaacggtacaactggcctcgatgtagcctgcaaggccaacaaatagcttcatgcattaattcagcaaacatttgctgagctgttgcagtccaggaaatgttataaacttggggtatttggtacttaaagaggctcctgcttcctttgtgaggcttaccacaaaaggaacagaaatagatggtaaacaggtaagcaaatgagtaatgcaatttcaggtagaaatagatacaatgggagaaaatcaaacagggtgatgagtgttgcaataggattctgactgtggttctgttagactctctattgaacttttctggaattcaatggtcacttaccagttccaacacggtgtccagcacattggccaagctgaatgtatctggatggactgaatttttaatatcgtcagttatttaggctacagtttcttcatcttaaaaatgaagggattaaagaagtgagtacttaaggcctgccacgtttgggatttaagaagtaggtaatctacactgtctgatgttttattcctttacaagagtcaaacaagccagttattttaacaattattgaagaatcacaactaaagatcacatcttaaaaataccttttgagatgacatcttgtttgaaaaaagtatcagcagttggtattttctcgaattttactgagttacttccacagatttactgcaggagcttatagtcttttgaaatttacttgttaagcatttttgaatgctccataactctctttcttcaaacactaaatgaactagaaattaaaattcatattcaatggcagtattggaactttaacatatttaaattaaaatgatttatattcactttaaataccaaatttaattaaaatgaaataactgggtaatgttacttttataaaaatgcattaaatcatactttcattaaaatattttatacattttgaatataaagtgaaaacagaaggaaagagataataaaatgacagcatacattaattaaaaaacagaaaaataatacagaaaatctttggagaaaatcaacataatggacaaatgtctggaaattttaattaaaaatagaaaacaaaatatgaacattatgaatgatgaggggctacaacttcatgaatgaggagatgagatttaagaggaggagaggagatgatgaagaggagatttgaaacaaaataaaattgctttgtaaagcctatttagatacatttctaatcctaataaattggatgagttattaggaaattgtaattatcaaaattcactgagagagtgaattgataaatattgaaaaataagaattaaaataccaaaaattttcttttaaagattcttgctctatgtagcttatgtggaaatgctaaggtaaagttatttctcattattaattttttaaaagctcagagaaataaaattctgggtaaaataaatacctctccttgttattatgaagctacataattatgataactgtaatgactgtaaaactttacaaaacagcaaaaaaataaaaaaatctacagtgttacaaaaattctaaataaaataataaatgtgtcaatatataagtagaatatataatttgaagaatttattctaggaatgcataatttaacattgcaaagcttcttaaatcttactgttggttaaaaggtaaaactgtttatctcatcagatctctaaatgttgtttgatgtcatttaaaacatactgttgttcaactctatattttcttgcaagttaaagaaaatcagtaatgtcactcttgaaaatgaaaacctagaaacatttttattaaataaggaataagatgaagatgtttgctatgataaatcttgttcagcgtattccaggaaattttagctaataagataagagggggcttcttataagaatctgcctgcagtgcaggagatgcaggtttgatccctgggtcgggaagattcccccctggagaagggcatggcaaaccactccagtattcttgcctggagaatcccatagacagaggagcctggcagactacagtccatagcatcacaaagagttagatactactgaagcaacttagcacgcacacatgcaagatatggaggctagagctactggaaagtaagagacaaaaagatctttgca

SEQ ID NO: 35362 - DNA, 2222 bp, Bovine  19866880340339
aatgcaaggttcattttatttcagttttatcccatctccttccatagctgaactacaacattgaactgttctcaagtcactcacagatgctattagaaaactgtttcatctcttcagttcctaatattgtctctttttttgttcttttaaagaaaatggtaccgtgtgtgttcctggtcagtcataaaggtctaatgctgttgtcttctctttgaggcctgtttatagcacctaattctactgataaaatgtgacctcatgtgttgttatgaaaggcattgcaaatatagcttttactattttttttttcctttgcagtttcctatgaaataagacaagagtccaacttattttctcagtgctttgccacttttggagaaggaaatggcagccaactccagtattcttacctggagaatgccatgtacggaggagccgggaaggctgcagtccatggtatagcagagttggacacgactgagcgactatcacccactcaatcacttgccacttttaaagtagttagtgtctatgtgtatatctaattaaaatatttaatagttttgttatttaaataagagttactagccttttctctatgttctttgttaaataattttaggtttttcttcatcccttcaacattataaattaagtgagttaaggagttgctctgttttgaaggtggctaccttggtagctcagatggtaaagaatctgcctgcaatttggaagacccaggtttgatccttgggtcaggaagatcccctggaggaggaaatggcaacccactccagtattcttgcctagagaatcccatggacagaagagcctggcaggctacagtccaacaaagacttggactcaactgagtgactaacactttctgttttaatagcttccgctctagtggtaaacacagtaacacaaaatgctgctcttggagagaggagaccaaagaccctgactgtctggacagcctagtctgcagaaaggaggcaggacatgtccctctttgattattttcttataagagaaatagattagaaacaaatgtatgaagtcaaggacaggaggtgatttgaacacatgccgatgtgctggagccattttaaagacactaatctcctagttcttggagaaaatggaccagctcctgtctctgatccctgtgcctgcttgatctcggagtacagactgtggtgggaaagtgaggggtgctgtggactgggtgtttgagtccccactcaaatcagatattgaagccctcattgccagtgtgttggtatttggaggtggcctttgggagataataagtcatgaggggagcagggaattgtatccctgttctcagaaggagagacatcagagagaggctctattccttggccatgtaaggaagcagcaggaagatggccatctgcaaagtaggaagtgggttctcattcactaccagatccaccagcactcagctttgcacttcccagcctccagactctgagagataaatgtctgttgtttaggtcacctattctttgttttgctatagcagcctgaaaagcttaagatagcgagagacagcaaaggacatcctcacaaaaggagaaagagcaaagagaggaaggaaccatttgctcaagaagcaggttgtttcaggatccttttgaggtgtctgggagtaaaacagactggcctacggaatggagtctcccttgttgagaaatatctcacccactaagtcacaatttcattaacagagtgtgtgtttatttgtggaggatatgtgtgtgtgctgaagagatactggtaaaaattgggtctaattctttgttttcacagagattttacagctctcatcattagcactcccttggctatatgtattccatcatccacttagatggtgaaacagaaaggttgagtttgaacctcaaagttcagtttcagtatataaaacacaatcctttacagaattacatgacaatgtgaggaaaaaaatggaagaaaagttgcttattcatcttttctatactttaatcatagaagtgacttgagtttctatacatgcaaaaaaaaaaacaaactgcagaattttaaaaaatatgtatgcttatagccattgaaatttgtagagatacataaaacactgtttctagaaaaccagaaaaaataataatttctaattataaataagaacttgtttttaaaattatttattttat

SEQ ID NO: 35363 - DNA, 2253 bp, Bovine  19866880404066
tcaaggtactgaaagtttatttgtggattggtgtttagtttgaatgtgtcctgagttgatatggccttttgggattggtgggccactaagccctgttttattaaggttatttctatgatgaaagtgcactcttgtatgtgtatctcttgtagtgatgttgaatttattgtattttatatggttgacatttgagagtcataaactaagacttgacttgtgtatagaagaaagaggcaggttaaatatcactgaagcgaatgtataattccccaggccaatcatctacagatgaaaatgtactttaaaccatccgagaaagagttccttcctgcatctttgaaaactctttttgtttctaggattttggatttgaggagtctaaatatgctgcagcagtttctccatggcagtgcaaaattgcatatgtacatggacagattcatcagattctcaaaactacccaaaagaggttaaaagccactgatctaattatatgttatatgctttatgttaatttcccttttgttacctgagcctttagccttttgagaatatagtagcctaatctcaactctgaattgggaaattaagagaagggataagcatttaggctcaggccagaatgttaaagcaaggatatgctccactccagtccgacacagtggggacaatattcacttaagatgaattgccaaggaggagacgaatcacagggacaggtgtccagattgaaagaataaccatccccaacctctcaacatgctatagagatcaacctcattgcttaccttgaagaattcaggttttatctaatcaggaaaccagcagttttctttatatgcttgccggatatttctctacctgaatccctcaccacaaactcaacatacttaaaagcagcttaatagtcagtccactatattcccaaatcatacatctctgcctccctcagagttttccatttctctgaattttccaaatcatttaggctcataaccatttctgctttttctgcttcgctgcagtatttcccacatcgaggccattattcacagggttaatttcctgtcttcttgctcatctttaacactgtgccagtaggggacccgtcattcagaccacactcagccctgtccagtacacagaaatgcctccaagagcctcttctcctttcactcctgaaagtgagttgttgttatttaatgtggaagactgacatttgtttgccaacatcttcatttttccaaacaagcatatttgaaaacaaatgaaacgagattatcatttgtcatcaccattgttttttttttaaacattaaaactgatattcctttataactaaacaggcttaatttaacattttggaatgtttcctttttgtttatttttctcatttacctgaagacgctgagattttaaaaatgaacacctctcctagcatcggaactgacaaccaaaaccattggcctatggcacttaatatgcagaaaggttaagagcttgccctggagccagatccatgggagtgtcacacactaattctgagatctcagtcaagttgctttcctctcatctgttttgatctgaaacagtataaattggggatgtgaatactatttgccttgtagaaataaggtaaagataaatgaattaataaaggcaagttgctcagcataggagttggcacacagtaaactaccaataaatggaagatataatcattactgttactattttgaactcttattatgcttcctgtgtttaacttttcactaatagcaggttttttcttaaatatgtgttgatttagctagttccttaaactaagttagtcccttggataattgttttaccttatgggggatcagtaattcatgcatcttaggactaagacactgctgctatttttcatatatttaacgtgagagacatttttctagaaaatttttcatttcattgaatgttattattcttactctgagaaatttaactgtgtgacttattttccgaaaatggacttcaatttggcctttgctgtgatcaaaaaggaatgaagattttactgtctgatctaggtttacaaactaacctaaaagaatcccctttgggcaagactgcagatgaattttctgcaccactgaatttcacatttcctcataattaaaagggtgggtaaaaccctccttactacatcttaaacacaagaatgtttacctgagcacatccaaaagaataccaacctttctctaacag

SEQ ID NO: 35364 - DNA, 3627 bp, Bovine  19866880438673
tgaagagagaccagtaaccagaaaacataaatgtgacatgataaatgatatcatagagcaaagcagcagaaagttttctagatattaggacctgaattcaaaatggtgtcttaggttaatttttttttatattttaaccatgtagaaaaaagccaactcatatttgtccttttgatgtgttctcatgattttctttctgcaaaggacagagcacagggtgcttataagctacctatcaccaagtttgggcttcacttggggctcagctgataaagaattcaccagcaatgcaggagacctgtgttcaatccctgggttgggaagttccccaggagaagggaaaggctacccactccagtattctggcctggagaattccatggactctatagttcatggggttgcaaagagtcaagacaggactgggcgactttcactttcataaccaagtttaaggcctgtctgagcaaagaaacttctgtattcctctcagaactccagaggacttaacaatactcgttttcagttgttgaaaagctgaatgctgggaaagaggagtgcgttagtatggttgagctgtaacaaaagtattagcagagaagagtgcagacaatgagatgaccacgtggtctggcagtgccacagttcgtggaagggcaaacgctgtgtgacatcagtagtgtctccttccgtgttttttcctttttctgcagaaaggggtggatagaccattgactttagcaacctatgagttgagaacctttctcttccataggtatgacactagggcatatactcattttgctcgatgatatttgcttcttgcctgcaagttaatcagctttgcctgtggagtagaccctatgtaccacttggattgagagcccgggactattgagatggctgccatgactgctgtcctaagcactttctattgctgacagtattactttttctttcaaattctatctcgtcagcaggacttgtcctgggattgtttatgacagagattacttgtgtaacatcatttctactcccattttggccctttttattaaaaaaacaacaaatagcacattgttgtagtcattataattctagttaattttgtatatctaaatatgcttttttataccctgaataccccaaggttgtgtgtgtgtgtgtgttttttaatgatgcattgtctgctttaaaaaaaaaaaatcatttggtacttagctcatatcttttccagactttatgagcactttatccttctgtttctgtaccactaatataataaaatacataagaaaaatgagatctcaacctggtccttgatgccaaacataatcagtttctaaaatgatccacatgttctaatgatgttctgctgtctatgtccacttggattataagcatcgatcagattttatgccttggacctgtattttgttactttaacttaaatttcttgacatttcattatatgaagtattcttttttgtcaccatagttccatttcacattattggaattctaaacagctagcagaaaagagatatataacccacaaaagtaggccataaataggtttgtgttcatggtggactattataaaaagcaattgtgtagacgtatggccaatattgctatagtcatagtgtagccagcctcctaatcttcaattttaaatgatttttgttctcttcctaatttcaagtttttcttgaaatcagtctcagagaatatcttctttcctaatattgagcatcgattatcttgatattttaattgaaggctgaatcatttcgtagcaggtgataagtatgcagcaaaggagatttgcatgctatgtatcttatgaatagtactgctttggccatataggtgttatagagatatagtcatgcataggttatcattagaggatgccctgtgaataactgaaggataatggagtaagaaaccacacagtgactccagaaatacaggtcacttcagagcatgatatgaatatattacaaagtgagatgaatttccttttttcatttttcagtcactactgaatattgatttcttccctctgcagctcttacctatatcctctaatttccctaccgcttttaacaacctccgatgtttaaaggggaagaaaggtacatttgtatttataggggtggatgaatgtgcctacatacattatatagaaatatgtatagttttaatatgcatagttgttcatacagaaatatttgcatatttcttgctgcagcttctgctaaacattctaacttacctctaaatccagcccgatgtgcttcaatgttacttatgtgccagaatctcagcaggttgttgggaaatatttgtttaaaatgttttccttctgcaggggctgatgtactctcctttgggccattccccgtgatgccattctctcaaattatcccagtggcaccctttggggtcagtgttggcacatagaagagtgctggaaaataattgtaatttcaccatcttctaacagagtacaccctcaggccaagtggtaaaataccacctccgccagccccaacatccatcactgtaatgagctacaaaatcaatctgtaattgacaaaagcatttttaatcaaagtatgaggcatttagagtctccagatactgcttttttgtcttacgtcagtatttactttatagcaggatggaagacatttgattttgtttaagagtgtaacttatttctgccaaggaacaaagatctgcttttcagaaactcacctcacacccaaccacctccaaaagtaagatgacataatcgcctgatatctgtcctaaagcatcaagtcaggaagctcgtgctctactagtttaggaggaagaaaggatttgtttttgtgagtgattgctgatgctttctaccagaatgcctctctatatgaaatggctactttttgtctcaaactgctaccatttatgcagaaactaatcccagaggttattattttgtactcacctcccagttgcttggatctgttctttaaaatttacaggtatcactaaacattcctcttattagtgctgttctttcttaatcaagttaaactccccaaaatataagggtatatggacacttcaggtgaatacacattaaacattttaatatgtttccatgtagtgggaattacagccaaaggcaaaatatttataggtatatgcgatgactttctggacctgagttcttatgttttttataagttgtactccaaatttttagtatcatctctttcatttggaggccatatttgtattatctattggaaaataaggttcttatattctgagccttgtccagcacctcttgggtactttggccttggtgtttatgtatttgagagaagctccataactatgttgcatagggtatagagtattttcaaaggaagctattcagaggttgcaagaataactaaacacagtctaccttttctgatgttcttatttgtgggttttaagattaatttttctatacatatatgtgtgtctgtgtgtgtttgataagttttagtgggctttggatatatcaacttaaaaccttgcaactcttatctaaatgaccttaacatttctggaactttatta

SEQ ID NO: 35365 - DNA, 1922 bp, Bovine  19866880443181
catgtctttgcagggtgctccttctccatcttgggaagggtcagagtggtcctctgagtgccctggcttcctgacagtgaggcgggggcagcctatgtgatgactgacgggcagggctcagacacacacagccgcaggtcacagagcacggaatcctctgctccaccgcacctgaattctccccgttgtccgtaaacaagggtcaggttcatcacgtggggtggcactgctaggtagtcatagtgaacccagacacatgtgaatggagctagatggattctcctgctaatcaattctttcccccttactaacacaaactagtttaaaaatcagctgatcatcacatggcaagcctgggacaacaaatttagtctcaatgcacaaaactggtcaaaatatcttacactgcaacttcaagccaatcttcaagccaactccagggctctctccctatcatgtttatgtagaggaggccctctgtcatcatttcaagactatgcttcttactttcttttttttttttaattttattgctttattttttttctaattttattttatttttaaactttacataattgtattagttttgccaaatatcaaaatgaatccgccacaggtatacatgtgttccccatcctgaaccctcctccctcctccctccccataccatccctctgggtcgtcccagtgcactagccccaagcatccagtatcgtgcatcgaacctggactggcaactcgtttcttacatgatattttacatgtttcaatgccattctcccaaatcttcccaccctctccctctcccacagagtccataatcaaattaaatacacattccctgtttgggaaggaatttgcactaagaaaaaagaggcaaagcagagggacaataatgattggaggtgggctggagaataagctttaagaaaaaattaatgagggacttacatggtggttcagtgactaagactccacatttccaatgaagagggcccaggtttgatccctaatcagggaactagatcccacatgcttcaactgagaattcacatgccccaacttaagatctcacatgcagcaatgaagatagaagatgccacatgccacaagatgccatgtgttacaaccaatacccagcccagccatataaataaataaatacatatttttttaaagaaaagattaaagaaaacacatttttaatataggaacaataactagagaaatgaacagtgagaaaagaaagttggctgaacataaggataaactaggcagagacttcagaggaattacaaagctgaaaagactgaggtttttctctctagcttcttccctattttgaaattttgccattaaaaattcatagacaagaaaaatgacaatcatatactgaaattagttaatatgcttgtttttcttccagcttcctactcctccatgcaattaactctctcatcaataaaaagaaacagggttgatgcttgaaacctgaagctattcgacaaatatcttgcgactggaacactgttatcagtgccatagataagaagcttgatttaggcattgggataaaggaaattacaaagactgcatcataccagatacaatagattacagtgccagcttttaatctcaaaactgcatgtgcgtagtcgcaatccttggtttacctccagcaatttccttccaggagctgtcttctaatttcccttggtacttccccaaattctctacatattgctccatctctgaagctaatatcatacctatgcaaccctagaatttgaattgctgctctgatgttctttggagacattcctaatgagtttattatcaatgttcttactacatattccccttgtgggcttttactgacttcacccataaatctgattctcatacaaattcatctttgg

SEQ ID NO: 35366 - DNA, 2157 bp, Bovine  19866880450353
atggagtcttaataaacttcaaatgtatttggatagctgataaatttaatgatctcatcaaattaaaaaatagcaagtaaaaagtaagtgatcttgagaataattaacagggcaatgatgggagagaagaacattacacagaataaatggaagtgtccttatttctgttgaaatttccattaagaaactgtaatcatcattttgtttttgttattcatagcttaaactgtactctacgtattttgtatattttatactaggaactgaaaataatttacaaatgcaacattaatttattggtcctttttatatctcagtaaaccaagaagcaaatgcttgcaacctagagttgacagttagagaaactaaagccgaagattggtgcacaactgtttagtgatatctggggaataattaatatggaagggatcatgtgtagagaatctaaagagactattttatctttctacaaatgtctgtggttttgttccaaaatatgttaatatgataaattagaaaggatatgtatttcctttatctaatgcatttttattcttagcatattcttaccgtaagtgttgtatgaagagaagggaatggaagtttctgccctgaggacaataatgttttatctggctttgtttagaattgccaagcacatggttataataaagagtagaccaacttttcattgattttattattgttttaaaagtctttacatttgtaaagattatttgattttcttatttattattgttttaaaagtcttcacatttgtaaagattatttgattttcttattgcttgcacccagggagagtgtccctgcccccaccccactgtccttggcccatcactgatgaggctaacatttcttgaggcacagaataagtttgaaagaaaagtgatattttttttctattttagagataacaacactgaggtagagtagtatttttttttacaatatctcttacttgtaagtgatgaaagcaagcattttgattccagactcctctgctaagtgttataatctaccatctacagaaacacacagtgagttctgactgacttgtagctatttaaccatgtttacctagtgttagtcttatttttgtttcccagttgaattgatattgttttataattatttcaagtgtcaatgtgaaaagtgaaagtgaaaagtgaaaagtgaagtcgtgtccgactctttgcgaccccatggactgtagcctatcaggttcctccatccatgggattgtccaggcaagatacaaatcttaatataatgtaagtttttgatttggtttagctccttttctgatcatttcatcatatttttaaacatcttgcatccctaatacctacatggaattgtgtattctttgactagttcattagtgtaataagttgggtagggtatacactgcaacagggtcatataatcaagctcttctgtcaggtgaggtcagattgccttaaagtttgaaatttcctcagctgagtgatacagacaggtagtcattttcttatgtagagaatgccattaacttataaaggttatcaacttgtcttcagaattaggctttaggacacatataagaggaagaaagggaacttccctgatggctcagtggtaaagaaactgcctgccaattcaggagatgcaggtttgatccctgggttgggaagatgccctggagaaggaaatggcaacccactctagtatttatgcttggagaatcccatggactggctgactacagtccatagtttcacagagtcagacacaactgagtgatggagcacaatgcacagggagaagaaaatggtttgtttggacttttggtatacagtaatcacacgggtgttttctaccataatcagagtcttttcattacttgtacagctattactgcaactagaggtactattgctgaagaggttttatgacaggctcagtttaatctgaggcattactctggtactggggcaattgtcttagattcatgtgtaatataagaatggcaggagtttcagaattagcattttccaatataaatttgattttcttcaaattactcctatgctaccatgtaccactttacataattacacctactactttcatattctcattatcatccattatcaa

SEQ ID NO: 35367 - DNA, 1500 bp, Bovine  19866880451480
tactctgtgacaagccctacgttaggcagaggacagagcaatgaacaggtcacaatttccatccatctttaaaatgtaaagaaccccttcataaaattttgtgaaaccagaagccagcagccatcccatgtaggctgtgggaggcaatgtcacctgagtacgggaagctcctttgagtttaccctgtgctttctgactgccacgctggtgattgaactgccagtcagtcggagtgctttctgacttgattccagaaactctgacctaaaacacgggaaatcctgccaataactcactaaagttagggggagggtgtggggaagcaagatctgtctctgctccttttatttaattagctcagaaatctggcaatcagaacccctgacgcagagaagacaaaataaggtcttatttaaaatactgcaggaggctgagtctggaatgccggccagcccctgttgggacaggggaggcagctgaggtgacctgtcaggaagcagcgcctcagctcccagtttctatttgaattcccctgtgaggctcctattaccctgtactgatttgcatggatgccaaaggccccagaatcagcaggctgatgaagcagactgagcaccagtggtcatcctggcagttctttctattgaaggtgtgaaaaacacaactcctgagaggctctggcagatggccaggatgtctgctgtgtgtatgctgaagggagcgacacagactccagaaacacgtcacaagagcacactttcttcacattctgactttgatctgtaatttttattcatccaaaattcctttgtgaaagaaatgaatgggttgaatactgcagaatatcccctttataggttcaaactcactctcctttttaatctacatgctgatcactagccctaagtctaaaagccttcctcacaaattcaaaaacggatggggtgtggaggcttctttttctcacacccataaatcaaagacttgagatgaaaaggcattaggatttcttttctaattttcatagctagccttgaaatgatacaagccctcctactgaggccagatgtgaatgagaacatcaatatacacatgacaccttttacctgaaagaggaggtttctaaagtaggaagacaaaatagaagtatttacaaacatcaagagtgaggcaaggtttccataccaacttaataaagctctccactcacacacacccatgcacatgggtgggaacagtggaacagcgcagtggccattcatccatgggacagtgtggtggctggaaggctttataatactgagctggcctttcagaagagtgaatgatagatcaagtagtgaagatataaagggcatttccagtgggctgagtttagtgactgaaatccgaataggcgtgtctgaggctattcaaaaaaataagctgggaatttcaaatagacttcctttttaacttcttataatcttgccactcttccctacagattaaactcatctc

SEQ ID NO: 35368 - DNA, 2235 bp, Bovine  19866880461467
catagactgaaagcaggaggagggaacatgcatgaaggagaatgacaaaaccagcatttccttagacgactaggcatttagggatctcagagaggagtgatggcattagcgacgactgtgagcacatgggtcaccccagtttcagctcggctgtgaccagtgtgattcagtgtggggagggaagcctgaagttcccagatgacaatcagaaagtgggttctcaaggaaagttagagcttctacccatggtcacttggcaaggatagaatggggaccatgacttcctggctcttttcccagtgcccgtccagtctctcagcttggcttttggacagtgggatgcgaggggcctgtgagtttacactggggtagcttagctgtttcctctgtgcatcatctgtgcctaccgccatgatccctgccccgcctccgcacttggcaatgtgtatgcagctctcacaatgccacagccctcctggttggtaggacgctcacactcccttagagactattctgctcacttggcacagctcaaatcgtgtctcttggcttttgcacactgatctcctgttctgctctaatgtgctgcctttgccagttggtgggcttctgttaaacccatgctgtggatattgcccatctcgtgttcctctggatagactgattctgcctttggctctgcgtggactggcttgccttgctgccagtgggctgaactgacctgatttagatgttttccattgatccatcctctccttggctagcaatgtactgcctgtgccagtgggtaggttccttccaagggggctgcttgggctccatcttctacttctgctgcctttatcattgcttttaccatcctggttggccaggcttacccacaacatgcaattgccaccatattgtggctggccctctctccttccactgtctgcctcctggtaactctgacttatctgaccctggtgcctccatctttcatgtgtgatgtgttattcaaagcacattaaattcaatttgactaactcacggtggctgagaacatttcacactattctgcggaatgtgccttagtataaatggtttttgttaaaaaccagcttctcaccattattcagatatccccccctctagcaatattacacttatctatctactcttctcacccaagaagtcagttagtatctatgaagcacctactaattttccatgtctgatctctctttattgaacaacctgttagttccaggagtcacttcaagactcttagactattcatcacaggggaaacttgacagaaaatgcagtccatcttttttactttcgacctggcagtcccacaattattccagagaaatgagtatctaatttctaatggcctcaggaagaagctctagggagttcattctagtatttaacagccttctctgttaggaatatgtcaaaagcaattgacacacttcaccgtttttcacccctttataaaatgggttgcctttttttttcagtcaccagaggacataaatagcaggttattaattttttatttaaaatgactcattaagataaaaaatgcactaaatgctgacatattgtttcttattttgtcatgactacatggttcaaatttcttttggtttcctcctggaaggatttggtagattagctgtctaacttctaatttagagatttgtttggcatacaaggaagagaaaagccctcaacaggctcaggatgcttaggggaaaaacaaaacaaaaaacaagtatcaaccagccaggaaaaaaaggtagggaccatcctttttgaagtctagtgttgggatatctaaggctgctccctgggatcatggctcttctatgattaaacccatccatggtttcccagtgattattccctgacacccagtcttttaggcacagccgtagaactctgaaggatttggattcccacgtccattgcaaatctagtttttcccctctttcactctgctcccattttgctgggaggtcctcaaataccctaaataattttctgcctcgagcctttcatatgctgctgcttctacgggaaacttcttctgtcttcccttcacaaagctaaatctatctcatcgtttagattttcagatgaaacatcatatgaaacatgcctacttgaccatcccctccactgttttctttgttgcattgcttgtccacacccctaatggcatcttaaattggtaattgaata

SEQ ID NO: 35369 - DNA, 3224 bp, Bovine  19866880473091
tttccacatgctcctcatcctcaaatatctcacatctatttcacttttctcctcttcttttctatacttcccatctttagcattatttccctccacttatctgttattttaaatcattaaatatcacacagtagtcacgatgtgacagagtactggcctgtgatgcttactaccagaaatattctgcaagttcaggcttttgaaagaaacaacaatatattatgttttatatgtccatttggaaaacttaagacatatgggggcttggcagaaacatcatcaactttagagtagtgctcaatcattcccacagagaacattcttacaacctatcgccgcttctagaaaatgggtaccgactctgatggaaaataaatgcgaacaggatagctttagaaaatgcttccaagtcttttgtaggaggcctagattaataaaaatggtcagattattggggtaggaagggctatttttgcaacacaatataccattgaatcatcacccttgcaatgttcaatctgtagctatatgggtatattggaaaggaaaaaaaaaaatctctttctgatattcaggacttaaaggttcagttttgcctttttgaatttttttcttcctcttgttggcagagaaaactgtttcagatctcattttttggtttaaaaatattatctccaatccagaaaggttcactctaaaccagagatgacatttctgtgctatgaaaaaaacaggaacaaagattagattcaactaactctttggcaatcaatatagggagctgctttgcacccctcccctttcccccttcaatacatttcccatgaatgctcttctatatttggagaagagctggaggtgaggaaggctgtacacaatgaattgagtatgttttattaatgtaaccacagacctgtgaccataaattcaaaatttttccttagttttcttttccccatcatttattataatatttttcctttcagagtaattttgtattcttttattgcttggattttatgaaattctacataacttgttttcatcacatcaagtgatcaggaatattcttgtctgaatagtttcagggctttctccagtcactaatgctgattttcaaacagattatggtccagaactctcaaagacctagttattcttgaagttgtggccactgtcattgattaaagtcattattctggtagttaaatatttagcagattgttatgaatcaggcacactagacaaaggcattccttaatgataagaaccctgagagatttctcctttgttcccaggataaggaagtaaaatgacaagctcatctcagccagagccgtgatgaccaacagctcttgttggcactgtatatgctgacagcactttcttgatattttttcccacttctttttgtcttcctatttttctttctgtattaaaaatgatagtcattttgctactaggtgatgaaggagaaagaaatgcctgtttcacagataaaagcaaggcactactttacagcaacactggcttagtgtcttgtatcatcaatctctctggctttatccatcaccatcaccatttcgtctcttgcggtccaaggttgatggcaacaagacagatatcattacctgaatacaaagaaatgcagggaagaagccctgattccagaacactgttgtgctgacactcaaactaaatacctagagactcatggtcttccaagagtgtgcacaagtgcatttacttattcatttaaacaagtacttattgagtcgccgttatccctggattcttgaaattgccccctaatcggtatctctgcttctgctggagccccttttcaatctattctcagctcagcatccagaatgatcctattaaaacccctcagtctctccttttcttcagacattcttggcccactgcaactaaaatcatcacttccttacactggccctatacatggtcctcagtcaactctctgacccactttcagtctctgctcacttgctccactccatcccaaagaccgttcccctatttctcaaacaccagctgagctcccatctcagggcctttgcacttgcccttctctctacttctagcacttttcctgaatctatccacagcgagacctttcctggcccttttatctaaaattgcagtcctcccttatcccttttccatgatttatcattctccttaacacttgccaatgtctaccataccatatagttatattttagttatcttttatgttcccaactaaagtggcatgaaggcagggattttcttgtttctttgctatatctacaatgtctaggaaagtgcttagcataaaacaaaaccttaatataaggtgaatgaattgggacagagaagtcaatggtcagtaagacagggatgattgctgcccacaggatattataacccactgggacagaccaaccatatttaaagagacaagtaggcaatcatttcaaactctgataagcactataaacagcaaacaaaatattgagatgaaacacaaaaggagggaagatgtcattcagaatcattggtcatgaaagtccttgctatgagatgcgaagcatgagataaagctgaaacgtattagagtaggtgctagaaacaagggagagtggtaaggagagaacaggtgtcttgaggcaggaaaaatgtcggcatgctgcaagaacagagaaaacttgtggggctggatctgaggagcaataacgtcattgctcacctttacgaggctttattgagatgccagactctgttttaaaggctctgtctcaaactatcttaacagccctacacagtagagaatattctatcatccatttcataggaagacatgggatatacagctagtaagtggtagaactgggactgtagaacctagattctgaacactaccctcctgctgtcttcctacacagcagaattctatgcttaaatggaggtgctgaggatccaaaaatgcatgtgtttagttgctacaaatcttcacatggaatatttaaaaatcaggcaatatactaattttttatgctgttcgtttatttatatatattttttggagttatgtcacaatgttgttttggtttctgctgtacaatgaagtgaatcagttatgtgtatgcttagttgctcagtcgtgtccaaccctttgtgatccaaaagactgtagcctgccaggttcctctgtccat

SEQ ID NO: 35370 - DNA, 1362 bp, Bovine  19866880483443
atccaagtagttacaacatgtcgacctaaaccagtcctagttcactaaagttgaaaggaatctcagatatgacacttataggtccttacaagtccagatccagaaaggtaaaaaggtccagagaggttaaacactttgcccaaaggcctcacaaatggacaacaatcaaaattcaacctatagctcctcattcgcaggccaatcttctttctttttaagtcaatctgagtcaggacagcacaaaatgaagcaccatggcaattatctgataaatctgatggatgtgtatggacaaacagggataattacggccaggaaatccaatttaggtcttcaattacctagattgactgtctacattgaccaaataaactggacaaaggccaaaaacgcactctacattgtgttgtgcaccctgagaagcacttcattgtgtttgtgagattaatagggacacacacaccattgagctaactataaagcacaattgtgaatgggtgcattttccatcaatgaacagatctgaaagttaccccaaatctttttggtaagttgaatgaaaatgctataggaactcatgtacacacattatagaatttctctgaagaagccaatcacactgcctgtgtcccgatcctttgttttatcaagactattattcctccaaatgaatcaaatataattaggtccaaatggtaggatgaaagactacaaaagcctcaataaatctaagtcattcttgacttcattctggaaagtacgtaggtctctgttttaaacttaagataaacatcacacttaggacatttggccattgatggaaagcatttgaggaaaggggttttcagtcaaggctgatataaactttcctgcaagatgacatgttttaaaataaaaattctaccagtcaagtatacagggatttatttgcctgtgtatagtttcaacaagaaaaaaaaaaatacatttccaaagtaagatgtttccctgtatttttaaaaaataaataggtttagaactttttgtgccgacatcaggaacacaaatgactgtgcatcatgattagaggctgagaagataagcccacggaaagatgaatcaaaaagcaagacacagtgtggtgcagtgcaaatgctgttggcctggaatcacgaaactgggttttacttctccatttggcaggaaacagctaggttatatgagacaattcaccttctccctggactttagttcccttatttcgaaaatgagaaggttgactggaattatttccggttttacctctctgtgactttaaaccagggatgagcaaactaaggatgatgggccaaatctagaccaccacctgttttgtaaataaag

SEQ ID NO: 35371 - DNA, 2194 bp, Bovine  19866880492265
ttgccacatcctctggctctcgaaaaagcaagagagttccagaaaaacatctatttctgctttgttgactatgccaaagccgttgactgtgtgaatcacaataaactggaaatttcttaaatagatgggcataccagaccacctgacctgcctcttgagaaatctgtatgcaggtcaggaagcaacagttagaactggacatgaaacaacagactggttctaaactgggaaaggagtatgtcaaggctgtatactgtcaccctgcttatttaacttatatgcagagtacatcatgagaaatgctgggctggaggaaacacaagctataatcaagattcctgggagaaatatcggtaacctcagatatgcagattacaccacccttatggcagaaagtgaagaagaactaaagagcctcttgataaaagtgaaagaggagagtgaaaaagttggcttaaagctcaacattcagaaaatgaagatcatggcatctggtcctatcacttcatgggaaatagatggggaaacagaagctgactttattttggggtctccagaattactgcagatggtaacttcagccatgaaattaaaagatgaatactccttggatggaaagttatgaccaacatagacaacatattaaaaagcagagacgttgctttgccaacaaaggcctgtctagtcaaggctatggtttttccagtagttatgtatggatgtgagatttggactttaaagaaagctgagcaccaaagaattgatgcttttgaactgtggtgttggagaagactcttgagagtcccttggactgcaaggatatccaacaagtctatcctaaaggagatcagtcctgggtgttcattggaaggactgatgttgaagctgaaactccagtactttggccactctgatgctgggaaagactgagggcaggaggagaaggggatgacagaggatgagatggttggatggcatcaccaacacaatggacatgggtttgggtgggactccgggagttggtgatggtagggagcctggtgtgctgtggttgatggggtcataaagagttagatacaactgagtgactgaactgaatgtccccaaatttatttccacagcagtcttgttttcaaggtggattggctacaggtttcatgagttgtcaaggtgggatttttccctaaaattacacgtagcaccttttccacttgtgtcttccagtatttcaactgagtgtcaggttaacctgcactgcagtagtcttataaaaccaaattttaagcttgtgggttgttgcttctaatatacctaatgagccttctttaatcatcctattttgaaatatttttctatgcgcctatttcatttctaaatttccatcaaaaaatacagtttctgaaacacccacaaagcctaatcactttcatttgcatattttataaaagtttctgagagagaagcaaatgatgaatgaacaagtgactgtcactagtttgtttaaaatagggagtttggggctactgtattgagtgggaagaagtcaacccagtgtcctatatgtccttctgtccttcagcctggctcagagcaaacaggtaccagtgacggtgacctccaaggcacttgaaattctcaatcactgaaaattcttcaagaatgtcaagagttctgtaatcactggcgtagtggaaataaacatcgacctaaaaatgaaaagatctgggttcagatcttggctgcattactaattagctgtgacttcacaaattatgcctaatggggcctaaatgtcctcatctataaaatggaagccatagaccagacaatctcagaatattttaagattccacatgcattccatttatctgaaaattgtgatccatatgtgctgcataatgatggaaacattcaggaaagcataatgttcaattaaccagcgcactgccgcttcccagacatcctgaattagcggaaatgtacactcctacatgcaagccgcctctctcagtcactcctctaagtggcaatttttgccaagtctaaccagcagttagacttgttgctgtttatttttttttcctctaagctaactaaaagattatacctttcctttcctgaagcttccaccaaatgctttcctcccaatcataaaaatcaggaagaaaatgtctcttaaaatcagtcattgacc

SEQ ID NO: 35372 - DNA, 2111 bp, Bovine  19866880574600
attgagaaatgcctataaataactccgtggagctgtgatcaattcattagcagccaaaggtgttgggaaccataacatgccatatgatttctgatgaatattaagagagaagggtcatgtatattccaatagtgcaggctccactgaaactgacaatggaggcctgtgtcctttactcttactgctattctgatctgaatgccattagaggcagtctagttcaggtcaataggtatctatgaattctaactcctgtcaattccaataatggttttagataaggaccatactacttatctctcctggaataaaaatttggattttagcttcttattttctaggcatttgaaagcctttctttaatctttctgcatcatacatattcatctgtgcaacagctatgcatgcctgttaggaaaggctgaagaaattttagatctggattatcacagtggttatagaaattatattcactgctactaatgattgtttttacttccagatatggtcacactgataggcattaatgtgtttgaaaattgaccaggcaactatggaattggatgatactaagaaagattaggtgttagaaggtaagattgtttcgattatctttgaaagtcaaagtccttcagtcaggtccaactctttgcaactccatgggctatacagtccatagaactctccaggctagaatactggaataggtagctgttcccttctcccagggatcttcccaatccagggatcgaacacaggtctcctgcattgcaggcagattctttaccagatgagccaccagggaattaacataaataagaagtctttacaaaagaaaaagtattaaagagttcagatatattttaatatgacataactaggaatggaaaacaatatgcctctaaattatatatttttaagagaagcacaaggcatattttctatagaaagaaggactactgacctttaaaatatgtcaaaaaggtaagaatctatggtttaatgtcatcaactacaaacataagttttttatttataagctcataagaaagagaaacaatgtcaacttcaattatttctttaaaaacccagtctttaaaagagcaaattagcaagttatatgtattcaaattgctcagtacaattccagatgcacaacaaatacaataggggcactttttgtgtgcttaaataaaatgcctcaatacacacattttcaccaatgtgagaatgttttatctgttattgtggtccatgtccaggagttaggagtttttaagtgtatgtgactttccatgctgcacctataagatatattaattaaaataacatattttgaaaaataagtacctactaagaagcaatgcccatataagtgagaacaaagggttttataacataaactctaagaaaaagctgatctccttgacactgagctcatctcatagactaaaggaaatctggagtgttgattttcatgtaaaacttcccaaactgccctgaaacaagttaagggctagcaatcagagtcaaggtattatgtgcgtgcgtgctcagctgctaagtcatatttgactctttgtgactccatagactgtagaccactaggctcctccgtcgatgggattttccaggcaagaatactggagtgttgccatttccttctccaggggatcttccctacccagggatactggacttgaacctgggtctcccgcattgtgggcagatactgtatcctctaagccacaaagtaataaagggaacgggcaagtccgttttgtttatccacttctctctctgcctccagccccctttacgagttccccagttccctgtagagagaaaaatgttcacaggcaaaaaacaaaagacccgaagcagccttttcgcagcctatgaactgatctcgaactttccaggggcttgtccttcataggaaaaaccctgaggcacttcctctgtgcttttgcatctggaaaggaggcccccctctccaagtgctgagtgacatctcagagcttctttctttccagtcaaagtggaaaatatcaactaaggtttcaaaggaaaggaaatgttatgtattttctcatcaaatttggcattat

SEQ ID NO: 35373 - DNA, 1033 bp, Bovine  19866880575288
tgggttaggcccaccattcctcattctaccccatccctcaacacccatgactagcccaggcaccaagacctgagctcttgcccactgcccattggggaagaatgtaattacctgggagctaagaaaataattttcactattcctttagagttaaatgcaacctgcaagcagaaggcagtggctggtaaaacctgagagattaaagatgcaaggagagagttattgataggaaaacatcacagaggaaatgggggaggagatcaggaaaacaggtggagactgaacagtgatttccaaaaactcagtgcattttatcatttttgagcttgaactcagcagagaggaccccttagccaaatttctagggtctctccagccaccagaggcaccccttcagggccattcaccctctgctttggtctctttcctcttgtgctgcccctcctcctttctcccacctgactcgagcttacctggctggactgtggttcagccctaattggaggcacgaggttaccaaagtcccacatccactgacccaggagcttttttccagtttctgtttgccatgtcattagtggcagcttcaagctgagccgaaggcattctcaagagtcattcattgttcctcccctaaaagtattttaaatgtggacctaggtgagatggtatctttttttttcctacctccataccaatggctttccttttcacacgcactgagtttcagaaaactaagcaaaggacaacgattccctcttgctgctactcttggaccactttacggctaagacattacctaagcctcctgtgattatgaagtgccttttgagttgaaactctttcttcattttcctcttccttcatgatctgattgttactgccagtgtaattgttttctggacacatctacaaaagacatttgagctttctttaatactcttctcaatgagcccttcaagtaaatgccataattaaaacgcacacatttgcttcatcagaaagcacagcatgcaggattcaagttcagagg

SEQ ID NO: 35374 - DNA, 1588 bp, Bovine  19866880605550
gaaaaaaataatgatttttaagaacttttaaatttgaatttgcataatgtgcattttattctacctatatttcttaaaaataatgcttaatgacctccaaggtaaggttcttcgcttgctttccttccttgcttgttttattttcagaagaaaggagtgaaaatggatctacccacctggccaggcttactccctattgtgatgaccaactttctgcccctaaatcagaccaagaaatctgtggccacaaaacagtgaatgatatgtaaagaaacaagttgcaggcttttcgcttcagtggcaccacatattaattgagttcaactggccacagtgataccaaacgagggaaaaatgttctaactgcttcaacgccatgcagactttaaatgcgatgaagccttgaagattgctgcaggacagcatcgtgtattttaccatatttatttttcatgagttctctcttgccaggctttgtaaaacattcgtcccaataaatgatttaccgtggcagaaaagttgcaggaaattgctctgagctcatcttcagacattatgaaggctctgaagtctaatcagattctagagaggattcagaggtggcagacatttgtgaacagaaaaggggaaaacacactaggaaaacatcataaggactcattatctgtctttcattttaacatatgcctattctgaatgctcctgctttgaaggaaggccattcacttgaaatttatttttagttaatgaaggtaaccttttaaactccattagcagcttctttctcagcctaagtgtagagaagcctgtgggatttgggagatacccagctgttctccaggaagtgtgtttttaatagtgacctggggcttccacaaaagcaacattcagaataaaccagagagcccacttggactttccaagagccagagtcttaggtttagaaaactgtctaatcaggatttccctgatagttcaatgacaaaaactcctcattctccatgcaaggaacctgggttcgatctctgtcaagtgaacgaagtctcacatggtgcaactaaaaatcccacatgctctcatgtgccgcaactaagaggggtgcaaataatatttttttttttaaagaaagctgtctaatctttgagaaataaaatattaacatcccagacacccagattttctttaccttttaccaggtttcactaagaagtctcatcccaaggggcaccatgttttcagggagaaagaagagttgattcttagagtagctaagtactctttcactaagacctccggatctctggatgtagaagggtaagcagggttttagaacttgagcttgggagagaaccaaactcctgaatgtgatatgcagaacacggtgtggcaaaactgagtcacacagtgtaataagacatctgggtttggaggtcagacatggatacaaatcacagcttgtccatactaaaaaagttatcattagatattcatttgatactctagcttaaatcctatgcagaaagccctcaaagttatagaggagtccacataggataatgaaatcagtgtgccttaaaaaaagaaaatt

SEQ ID NO: 35375 - DNA, 1510 bp, Bovine  19866880614429
ttccacccctttaggtcatcacagagcaatgagctgagctctttgtgctttatagaggttcctaccagcttgctagtttacacatagtagtgggtatatatcaatactactctctcaattttccccaccctccctttcctccaccaatgtctacatgtccattctctacaactgcatctctattcctaccctggaaataggttcatctgcattatttttatagattccacatatatgcattataatgtaactaaaattaataaggaatagtataagaataataaattaggagtttggggttaacatatacattgctatatataaaataaacaaccaagaaagacctgctgtgtagcacctgctgtgtacacagcacacatattattattatatattaatattccccttattatcttgtaattaggggaaaaatctgaaaaaagaagatacacacatacacatacacgcacacatatatatatataaataaaaaactgactcactttaccataccacctgaaactaaaacaacattgtaaattatatgtcaataaaaaagagtaatgtaaaatcagtttaacaaaaataaatcatgttattattatttttacctctgagccaatgaatatactatactatcttgaccttacagagaagaaattggtgttttaacttatataagtttacagagacaaagaagcacagtgtcaaaatgaaaacctatctaccctgaaacagcacagggtatgtgccctggatcaatccatcgtgcctgttacatagccagcacactggcagctagcatctcacactttagatgcggggggcgatggcacataggcacacacagacctgctcagccagctccttgaaaataaccaagactactatctgaaaagagtttttgtgtctctgagaatcctcaaagacgctttgaaagacttgaagagaaatgatcttaacaaaagaaccaaaaaaaaaaagaaacttgaaagtgaacagaagttctgaagtgtgtgggggtggagaaagctatctcagagagaaacagggaagggaggctaactcaaagcaaccagaatagcttagtgagctaaggatctgtgacttggtgattctgtgccccagggagaccactgcttggcaaaggaaggatggagcttactgcgctgagatggtcggtttctgcacttcctactgtgcacaaagggctcgacccagctggctaggggatttccatgtcacttaatctgttgttcttagaaaaccaaagaccttgatctgttgggtctcctggctgaccagaagggttcctttgtgagaaataaaattaccatgaactccaccgagccatgtgctctgccagattctatgagggcagccatccctgctaacttctgccctcctgaccagcctcacttccacctgttggctttccatcaccccttgcaagttcaagcacaagccccttttgttggccaccgggcttatgccagtagtcattcctttt

SEQ ID NO: 35376 - DNA, 3084 bp, Bovine  19866880614681
gagtgatttataggctttctaattattcaattctggagggaagatatcaaagcaaaaaaacaacatgtaagaaatccttatataactttaactttctctcatgtttcccctctctcttcctccacctgctccctggcacttccaaaaacaacttgcagtcaaattgatgaaattgatttccaagaattgataatatagattgggaatgaagtttaggagccatgtgtcacagtcgcaatgtcaccactgattcagcttttggaaaaacacacagctttcttggacatcagctttaacatttacaaaatgggtaaaattacttcccatgtgagtttcagtggtatgttggaacagtaaatagtacattagcaaagatattacaagtgcataaaccaaattcttcagacatgtcaggcactttgaagacagtttgagggcaataatagatatattatctcatgtcttttattatcatgcatttttgatgagtagagttctctacaaactcaaaagaattagctgagatcatcttatcttttataatctatggtctctgaactcagtcttccctgccttccactctggaatcttcttggacagtccacctggtagggtactattccagaaagaacagtgattcggcatttacaaaatccaggttctgatgtcaccttagtcattaattaactctgtgatctttgcaagtgtctctgttcctttgtcttaatttctccatttatatatttggcaactggaataaatgtagctctggtatgttcaacacaataagttattgtgtattcacatacactttatttggaaatacttggtttatcaaattgctgtagataatttacttttccttattttttccatcaaggatttttaaaattgagtatatattaaaaacagagataaacaataggaaataccataaaatgtgttatgcaataagatgattgctctctgtgattctgtagaacataagtgcttaatttctactagtttctcaaagtaatagtcaaatatagattcctgatcctctttattgccttagtagccctctgaagagacaagaggcagtgaaatctatgaaccactgcgctggcctgcctttaaggtcccttctgggtcaaataacccatgattctctatatcagacttgagccatcagctttgtgttttggtgctgtgtgtttggttctagaaaactctctcttgctctttgagtgatcgaagcttgacttttggatgttcaggccaggttaagatcaacagccttcccatttggtagctaactgctcctgtgtattctagaatcacagactcactcaccctgttcataataataaaagatacttaggcagatggtgaaattagttaaataatctgggtacaaataaatgcaaaccaagccccaagatactatttataaccacttttcccatccttagaaaatgttcctgaaaaatacaattttaggagtaagcgttaaaactggtgaagtcttcctaataagacagtagaggaaaccaagagttcagaggttgccactctcactattatgtgaactgccttagctttggctgcataagttagagagtggaggtcctagtcagtcctaggtctaagaaatgctataatttcacctcaacatacctcacctcatatttgcctgtattcctccttatacactgcattctcaggccaaacttaatagcctgttgctcttcaaagtactaaaggccttaatgcctttgctcacactattccctacatctagatataagggtgtgtccaaattcaatccactcttcaaagccctgctcaagaaattagttcccccatgaagtcttactttctgctcacagcataatgtactgtactacacaatgttgtgaactcatagtcctttcttataattccccctcattcttcccagttaatatttcttgtatattctctgtatatgtgttccctctctttctctctcctccctggctcctatctcctctaacatagaagctacatcatattcatcttcctagtcttataataccttgtggttgtgagtcacacaattaatatttgttgagtgactaaaagaatgccattcaaccagaagctggattaactgattacggttagaatgatttagaaaggaatcactccagagctgtgtatctacttactcttcctgatgataattaaagaagacccatcaattctcctttcctttaatcctattccccacttgggtagttttgttaacaagaatttgccaacgaagccacagagcaaatttgtgagattaaggaaaaaacacatcagacttaacagcactccaaaaaaaagatgttatcacttattctccagtcagtcacttgtcctccttgccaatttgatataagaagaagtctcttctctccaccctatactaactcaccacattattttctttgtaaatgaaagtggaaggaagggaaagagatagttcacatttaagatagttttagaaattcagtgatgtattcatagctgtaatattgtccataaagataaagccaagcacacaggctgctgaaagtctgtgctggctgagtagtctgtcctgatgatttttccatatctgaacaatttatacaattgacagtttttcttttttatgattagaaaatgtgattgaaaaacatacaatcacaattttaaaatcatattaatgaactaattgaaagcaacccagatataatatctcatttaaaaagtaataaaattaatccatccattttttgagtcactgaggtgtgtggaaaaaagggacaataaaatttttattacattatctgtctgggggatggttcctgaatgacttattagcagattattatttttcccatggtgcttttctgtcagtcatttgaaattggccttgtgcttaaagaaatatgcaacagtgatcagaaatccagagaaaacagtactaaccctttctgatgctgtttctgatgctcaaattgtgccatcccttccttatagctctctttatttgactcagcttcacttagcatgatcaccactattagg

SEQ ID NO: 35377 - DNA, 3715 bp, Bovine  19866880623354
cttttctctgttccttttttcttttctttccttaatggccggagcttgaaatctatctattatgaaccttggctccttgatttgagcttaacatagtactgggcagctcagtgctggccacactgcaaatgagtccccgccccctcctctcccacatcctgctcatccctctactcttgatggctgtgacatcaccactctgcttgggtgaggactaatccatcaaggctttaaagggcatgaatttactcctccccgccaactccccttcctgtacagaattccagaaaaaccatgcacacacacgcccatcccccacaaaagagcatcaggttattttaaaggttttagatcagaacacatttgaatgacattaagttttcttttctcatccatgtgcccagttttgaaattgttctacttgaaaaatatttttattttgctattttggtttcctctttttggccggcattcatttctgtcaaaggaaggaagcaggaaagtaatgttctacatgtcagatggaaggaatctgctaagtgtcactgcaataaaagacaacagcctatattctgcagctgctatgcatgagcacgccatccttaagaatagggttagggttagagtaaataattcctgagaaatagcttgggcaaacactgaaatctccaaatagtgtctcataaaaattaagtaagcttcttttttaatctcatttccaagtaaataggtgtcttgccacttaatattaccttagaagtaaccctgtcatatcttaccaactgagcagtattataacttgtcaaagtagagagcagagatctgcagcaagttcctcttgtaaacaggacacactggctgacagtttgtgtggttcttattaggataacatcaatcagtaatttatgcctaagcttcacaggtaaatgaagagagtcaaatgttttaaaaatgcctgttaagttattcccctgacttctcatgtgatgtggtgttaagataaaggggttcaactgtcctttagttgaaaaagttacatgttttactcaatggagtcctccaagaagagtttaagcactgatgtgcctggggtggtgctaggtactaagaagccaaaagcaagctaaaagacctccactttcaagtataaagataaagcacaacatccaagggagtattttcacaagacagaaaatatttataaatacttgcagacttgatattgtaaatatgatccctttgactggctgttcctaagatgccctaactgcaatgaaaactcagaagttgaaggcaggattccatgcagatggcagtctttggccagggtagagcaggcagatgtcagccctggccttgtgccctgccctgaggccaagtgggagagataataagcctcctcaatgtgaaatcaagtgggccttaggaagcaccattatgagcaagctagtggaggtgatagaattccagtggagctcttttaaatgctaaaagatgatgctgtgaaagtgctgcactcaatatgccagcaaatttggaaaactcagcagtggccacaggactggaaaaggtcagtttccttccaatcccaaagaaaggcaatgccaaagaatgttcaaactactgtacaattgcactcatctcacacactagctacgtaatgctcaaaattctccaagtgaagcttcaacagtacatgaaccgtgaactttcagatgttcaagctggatttagataaggcagaggaaccagagatcaaattgccaatatccaatggatcatagaaaaagcaataaaattccagaaaaacatctcccttattgactatgctaagcctttgaccatgtggatcacaagaaactggaaaattcttcaagagatgggaataccagaccactttatttaccaccagagaaacttgtatgcacatcaagaagcaacagttaaaactggacatggaacaacagactggttccatattgggaaaggagtacatcaaggctatatcttgtcaccctgtttgtttaacttgtatacagtgtacatcatgtgaactgtcgggctggatgaagcacaagctggaatcaagattgcctggagaaatatcaataacgtcagatatgcacatgacactacacttatggctggctgaaagcaaagaggaactaaagagcctcttgatgaaattgaaagaggagagtgaaaaatctcgcttaaaactcagcattcaaaaaatgaagatcatggcatttggtcccatcacttcatggcaaatagatggggaaacaatggaaacagtgacagactttattttcttggactccaaaatcactgcagatggtgactgtaaccatgaaattaaaagacgcttgctccttggaagaaaagctatgaccaacctagacagtgtattaaaaatacagtgcattaaaaataaaaagtactttgccaacaaatgtccacatagtcaaagctatggtttttccagttgttgtgtatggatgtgagagttggaccataaagaaggctgagtatggaaagattgatgcttttgaactgtggtgttggtgaagattcttgagagtctcttggactgcaaggagatgaaaccagttaatcctaaaggaaatgaatcctaaatattctttggaaggactgatgctgaagttccaatactttggccactgatgtgaacagctgactcattagaaaacagcctgatgctgggaatgattgaaggcagcagaaggggccaacagatgagatggttggctggcattactgactcaatggacatgagtttgaggaaactctgggagatggtgaaggacagggaagcctggcttgctgcagtccatggggtcgcaagtagtcagacatgagtgagcaaaaaaaaccacagcaaagcgagcaggcacaaacttatttctcttgttctcactagcctggcatctagcacattgcaggcactagatacaaacaagaaaacaaaggtatagaagctttatagatgctgccactgcaacagtaatttacacactcacgtttaggcaacccaggagaactctgcaggttatgatggcaaactgaagtcatgttcccgttgacagtaaataatgatcaatgactaatagaaccctcaaatattggaaatcaaaggagaaaacatcacaaagcaagaaaccaaccagataattattggtgccacccgtcaaacagcttttaacagaattttttaaactgatgatttacttaatatgttttcagtgcagtctggttggaaaacatgctaaatgagtcaattaagttgaagcacaaagagctttcttaggactgaaacaatagagtaaactccaggcattaatcacagatgactacagggaaaaagtcaaaggaaaagggagcagaaagcagtgacagagtgaaaacactctgagaaagaatgtattcttattcaccatgatgattaatttctgataaatagcttgcatttccctctcagttctttttatctaaaggtctgctctactataacaaaactctgttctactaaaactaactgtgggtgtcatttaataattgtttaaactccctctaatttgcacagattaattagcatatatacagataacaataaattctgaggtatgtagccatgtcatctttatatgaaaaaacagaactgatttacagaattgttactcttttttacttt

SEQ ID NO: 35378 - DNA, 691 bp, Bovine  19866880662258
ctgcctttatattactgtctacatatatttcttccacagattttaattttctatttcagtcactcagtcagttcagtcgctcagttagtcatgtccgactctttgtgagcccatgaaccacagcacgccaggcctccctgtctatcaccaactctcggagtttacccagactcacgtccatcgagtcagtgatgccatccagccatctcatcctctgttgtcctctttttctcctgcccccaatccctcccaccatcagagtcttttccaatgagtcaactcttcgcatgaggtggtcaaagtactggagtttcagctttagcatcattccttccaaagaaaacccaaggctgatctcctttagaatggtctggtttgatctccttgcagtccaagggactctcaagagtcttctccaacaccgcaatttaaaagcatcaattcttcagtgctcagctttcttcacagtccaactctcaaatccacacatgactactggaaaaatcatagccttgactagaagtaatcttctatttatgctggaattattgctaattcctctttatagatctccattccttgaatttctttctcttttgaatccaaatgacatatttctaccaatgttaatcttcaaaaggaaaattaatagacagtcccagctgacatggctatctaaccctatctctag

SEQ ID NO: 35379 - DNA, 791 bp, Bovine  19866880709217
gcagttttagaatctagaataccagcctgtacattcataagtcttgatttagagaataagctgcttaactttcagagaagagccaatccatgtagctcacacccactgtagaaactaagcatcttatatattaagccttatatgctaagcagcctttattaagaatgactggagatgggatgttctggcactaagaatattcctcttaaccagtgaatggaaattaccatttattcacaaattaccatctctcaaaattttgaagttgctgtcacataaacttgtattagccttctacaggaggatgaaggaaagacttgatgaattttcagattataaaattctagacaaataaacattattatcatgtatatcatgttcctagttttcatcacaagctaaaatgctcagcatcctggaataaacagtatcttatattgtttttttttatttttggaaagacagtttatgtagacatctctgaaagaaaataaaactgttgcacagggatatcatacaaagaacaaatactgtcatgaaaaagagacttaaggactatacaacatattaaaagcacatttttcttggaagatattttgctgtatgaggaccaagcatacagtgatactcattctgcctgaccatatttaagctgagccattaatgatgctattgcttcatccagctgttttaggacaattagccatgtgacagccagacgggagagtaagatggcaacagccaatttcagtaccgacatatgtcttttcttcattacaaaaaaagggggg

SEQ ID NO: 35380 - DNA, 2038 bp, Bovine  19866880724730
acccaaatccgatgtttaaaaaatatattctcaatatcaatgcatgcatgtgtatgcattttaaaactattacagaatggtacttaattcttgcataaatggtactgttgcttacctaaaaaaatacataaataaattgcaaaataattatgattaatacagtgatctgaataacacagtgatctagacagttcaaagcaatggcttacactttttctgagaagtagtttttaaataataaagtttttagaatttagtttatttcaacccaccttttacaagaaaaaacaattcttttttttatttggaaaatattgcaatcaactggaagatgaaatctttccaaatgaagaaacaatcaaatttcagagctttagaatagtgtaagctaaaaaacaagaagagcctatatgtaggatggctgtgagctactaaatattaaatacattgaccttacactaaaaaaggggaaaaaaggtgttacttatattactcaattgttttgaacttactgcttttttacctaacatttttttttcatttgtttgtttgtatttcaatactgaattggatccctctctacacttcagtgatcagaacaattgaaatatttgtatgcatatgaatcagaagacacagctaatggaaaaaaaaaaaaaaactcttctagtaagaaacaatggaggagctgttgaaaaatgctggcaattagtgttttcctttgttgctagattttatgacctatgtgattgaagataaatactgtatgctcattcatttaacattttgaagcacctactctggtccacatggactcagtgctccacctggggatttcatttcaccatgcttactttaaacaacattgtagcaggggagaaaaaaaagaaaaagagagctctggaagtagagctaaaatgaattatttgagggcaaacatatttctaacttcagaatctctatctttcttttgaaatgtccaaagcgaatggtatattgattttttacagcataccctgcacttttcactgattggtatcaaggttgtggaggcatctgttaagtgagctcaaaattctcttctatgtgtaaacaaaatccacagttttaatcaaatttaatgtactctggcctatatgtgtcttgtgaaagtcagagcggtctatgtaacagaattgaaagcatacgttacaaaaaccctcacttttcagatctcttgaaagcagagattatcagaggtagtgtcggtatgttcttttaagtcacctctgaagaggcaacaggggcatgcggaatgagatttgcatttcagagctggaaccaacatcggttacaaagatacgatgaattacaaaatatctatatctgaaggacaatgagatcctgggcacaggagtttatttcctatggtaaagagcaggggtttcaggtattcatatctctaggtcccatctcaaaaagctcccaataagggggtaaaaatgctactcgcatactgatgaattctcctggtccaaaaatgagccggccctaccccaaaggaaacctgtgaatgacatccaagaagaaccacacttgtatgctcctcaaattctggaagtgctaatttaatgtaccgtatcaccaaatatgctttacgagtaaacttgatactatgaagaaaacttttcagtacaattacctttaggccatttattaaaaagtacggtacctatttagtatacatcataaattttccctaaaaatttttactaacaaaaatgtctattgacctgaacaggagaatggccaagtattgtcaacaggattatatagggaggatctgtgaaaagaatattaagtactcatgtaagggaaagggattttggagtctgttcaagaaagatgggaatatggcatagaattagagcaaagataagcattctgtattaattttttatgtaacccaaggcaagaggtgaatacttatatgaatctcagctttcttatctgttaattttgggtgataatccaacagctcaacagttacagtgagaag

SEQ ID NO: 35381 - DNA, 1189 bp, Bovine  19866880725546
cttctcttagtatgttgggccaattgtttagaactgaggattaaggcgaaatattccatagtatatagtcaccttcaacactcaaattcataccctcaggcacaagttacttcattttaagccatctctcccctctgattataatctcagccaacaaaatattaaatatatgaaagctgacttcagtcaaacattttttgattagttttttttcccttttctgagcattccatcaactcattgttgtaagagtgtgtgtataaatgtgtgttaatttgagtatcatgcagggtttatctacaccaaaagatgaatttactaaaaatgattaaacctctcttagttgactcattattaaaaaccagcctaactctattacaagaaagacattttggcctttttgcatttgtcaaatgcaaaagggaaaaataatcaacatcttgcaaaaagcaattggtcaaagttattaatgaggcaattctttctacataaggcatcatagaaaaactaatgagagaaaatgtgacaataaattgcaggctactttagattgtgtgacattctcattaatagtcaactttagtgggcgaaatcgactttctgtatattacaaatacaaatgtcatactttatgcattatataccaccattgtcttgtatcttgaaccaaggacagagttttatggattctgaggccttcataatttggggatctattcagaaattgcctttgaaaaatttacaaaaactgaactttttgctagacattttccatgatcttagaagggacctgatctagttaagggccctaaaatgcaagtctcattggcttagttacaaatctcattccatcttcattcctttacttaaataatcaaaaattaacctttagtagatagactgccgctaagtcatgtccgactctatgtgaccccatggactggcctgccaggcttttcttttgccatttcctacatccgagaatcttcctgacccaggaagtgaacctgtgtctccttcatcttctgcattggcagctggattctttaccactgatatatgatatcatatatattaccactgatacctaatacatgatattcatattgtctatcattaatcagccaattagttaattaattgaagtatatattcattagagttactagcgatgtctcaaataggcatg

SEQ ID NO: 35382 - DNA, 1188 bp, Bovine  19866880758608
ttctcctcctatacttattaatgcagctgtgagtacatttccgcactcttcacctgccacagtgacgagggatcaggtgccaggtagggtaatcaatctggagggcttttagcagcgcatcctgccactgtttgacagcatgtctccgtcaaggagactgtcttccctagatcgataaatcaatcagttctttttacatcttatgaaaccctcctcacaccccgtgtcactcacgctgcaccacacacaaatagagaatcggggttgggttggcccaaagcttcccatttcacattctatcccataatcgcgtatccttccccaaaatcaatccctggcacagtggtaatggatcaaagtccagttcttcattcctttgaactgacgagtgaatctgtcttgagtgttagatgttgtagtgtgtttaaaactaaatcacaactgaaatgcagaggagactaattgtttgttttacgattagaactcttcaaaggagacaacagttgcttcactaacacacagtagattccctgattctactcaaagagatcgtagacttttagaggctgtcaaagttgggaaggggctcagagactagctagggaatctaaaccaggtgtctgctcctgcgtactaagtttccagctactttgctggcattgtgttggatgagggctggtaatggattctgtcacccagagaaagccacttgcctttgtgtatatgttgggtttgggtctgagatatcacttatataatggcttctactgctttggtggaaaaatgaaaaccagtagtccatatcatgtcttgtgtctttgtattattaatacaaacatagaatctgaaactcatctttgttgtgtaacttagtcaagggcccacaacctgtccatggaaaagctgtaagagacatcccctaccctgacattgtgtgtgcttcatcatgtctgactctgcgaccgtatggactgtagcctgtcaggctcctgtgtccgtggaattttccaggcaagaatactggagtaggttgccatttcctactccaggggatcttcccaacccagagatcaaacccatgtctcctgagtctcttgcattggcaagtggattctttaccactgagccacatgggaagcccaccctgacatctgtccatagcaaatcccttccagaaagtgactttgg

SEQ ID NO: 35383 - DNA, 4768 bp, Bovine  19866880761505
cattcattacttgctttgtctttagtgctctgtttttgcccctgagactgcttcctctgtcactggttcaccaaactgcatttctctttacttcctaaatgcactccctaaagcatgtcatgtgtcccactcttcattatatacaattttttttcaccctaatgatttatcaattcccctacttaagtattatctttttgaatatgggcatgaaatctgtatatctaccctaactcatctgcacacctctatccatggtttgcaatgttttttgcaaaaaaaaaaaaaaaccttggtacacaatccattcaccaaacactccaagctaaactttattacttctcctcttattatctcctgctattcattttcccatcactatttcaggcatcagttctaaactacacagcttttaatctcagatgcttccttttccccctgtgttgtcacattccacataccaccacagttttagcagagatctgtaaaacaggtttctttccacattagaatcactgtaattgaggcacattttgtctcttacctgaaatacttggtcttcttatttctacacactgctgacagattaatctccttagagtacagctatcatcttattatcttatgcttaaaaaccatcattagccactcactactttcaattataacctaattactttacctgacacttaagacccacatgacatagaactgaagcagtatggccaaaaattccagctaaataaaatgacagagtctttccaaaaaaaaaaaaaaaacctaaaattttattaatttcagtggctttcttgatattatgaatagctaagaaactgctcccaagtccacttaacgaagtgattttcatcattctgggccaagctacatacccgttttgtcatcacagtgtttctataacttcaaaattcaatagggttccccttctgagctactgaaatatttgtgtggttcatcatgactttgaaatgacagacatgagagtgaaaaaaatataaccatactcacatgaggagttgtcacagttttgcttaaaaaacagcttaaagtatgacttttgtacatttcatagcatgtgacaaataaatgggttctcaaaaaacactgaatattttgttgaattgtacttaattaattttctccagaaataaatctccatgactgggttgaacatatctctcagtgatacttacatggaagcctgcattctaatcaggcaaagggctagcagtcctttattaaataagtggggttttgtgaagtgggttggaaagttattctctgttactgcctagctttttttagtgtgcaaaggggcttcttccatgttgctaaattcatgctagtttctttcttgtgggcttaaggaagtgctctttctagtttagtagtttttggagaaagctcttctgagcatgcccatcttacacatgtctgcacgcagcagccatcacaagtgtgtcacatgtaataccagcaggatgccaataggtagattgtaacctgtcagtcccaaatgaaatatgtgactggctcaagctgagcccaaattcattgtcaataagtcagcagttaactccaggagaaatgaatagagatgaaggcatcagcttccttccattttctataatccactttgagtctactttgcttggactgacttaaattgaggtgtgtgtatatgtgtgtgtgtgtgcgtgcacgtttgtagtctgagaagaagttggctgaatgctatttgaaatgagattagaaagcactgtaattattttgctcatgtagaaatacgcagagagcatctgaccccttgtaaacaatgcagtttgggggggacttaacagagggctcagttcttcttcactaattagcacctcattaagctatcctaatactaaaactcttgttaatgcagaggctgcttaagaaatcaacagagaaatgcccctaataacagtatcttcagaagacttgcctctggttacactctcctctcatcactttagtttcaaaacacagtcaggaccacagggcatacttttcttcccattttgccccatacaaagccgctgcatatttaaatctgaaatgcaccactcactgcatgctgatttaatgcagaaaaaggaagagccgcaatcctgactctcagtccttctcaatatgctaagagcataagaagcagaaaatgagaaatgggaaactctctatgggaagacaagctcatgcacctcaagttcaagccatcagccaggctgctgtggtggttttcagttctgcatccatgtgtgagaaaagccgtgggttttaggataagtgacactatatcacaagagattagaatcagcaactgctgtttctctgtggaaagccgaagataaacagcaccagatgactttatttttacttttttaagcaaatgggttgtgacattttgtaccaactcagggccagttctcctggataagtgctttatgttcatttgactaaaagcccgatgacagagatgaagtggctgtacttcggggaaatgagtgcattggggtggggtgaagctgagagtaaaaccaagggtaaggacgagaaaaagcagaagggggcatggcaggtagctgttgagttgagctggcgtttgattgtgagggacctgataaagcagcacctaaggcttcattagactcttccatttatgataccatggagggtggtaaatgtatgtgatggagggacttcagcagtcatggaaccctcatgtttccagctaatataaaaggactacagaagggaagagacaagaaggaaactacaatttcttgtttatctgtgaaactgtctgttcttttgtcacacactgcactttctaccattttacattcattttagttaacttttaccacaactctaataggtcagcattaagagaagcagctgagatccaccatcataagcagtcacacttttatgggatccaaggagaagcaaagaggtgcctgtatggctgctgggggaaggaagcatgtgtggggatgctagtgttcaaggaagactgctcctaggaggtcaggatcaaatagctacttgtgtttccccattccccaaggatggcggaagctggagaaacaagtgttatgtgaaatttgtttaaaattataattgcagttgaaagtaccagagtgggatttccttgtggtccagtggttaagaatccacctgccaatgcaggagacacaggttcggtccctgatcctacgtgtagtggaacaactaatccatgtgccaaaactgttgaacctgtgctctaaagcctgggaactgcagctactgaagcctgagtaccctagagcctgtgcttcacaacaatagacgccatagcagagaagcccgcccaccacgactgcgagtagcccctgctccccccaatgacagaaaagcctgcacagcaacaaagacccagcacaatcaaaaaataaataatcttttttctttttaaagaaagtatcagagtggatcctcttttccttagcaaaatataatcagagagtgctgatattcaggcctctatcatatatttggtctagggcaatacatggagaaggaaaaggcaacccactccagtattcttgcctggagaatcccatggacaaaggagcctggtgggctgtagtccatagggttgaacagagttggacacgactgaagtgacttagcacagcacagggcgatataataaagagacttctgtgctatttatcaaaataatgataccatcatatgcccctagaaggccaggtctacacttagaatcctcagctccttgaagctgtgtgtctgaggcaggcggggctggaagagccgctctgactactgatttctctgcttctcatcctgtcctggcttcagctctagtgtgaatttgggagggccccttatccctacgttcatgctctttaatggcccagaagaggggccagtgcagatgtagagaatgggtctaagatactctgggcagggagttctaggataccagatgcatttgggtcatggagggtattcttcactctttaaggagacctgtgaccttggaaggaccaggcagagtgtggaacccagcatagggttcctcttccctgggtctaggaaagaattaataagactgttaccctacctcaggcaatcagtttaggcctacaatcagaaaactgctcagctaagaaattcctgtataaacttgtataaacatgaaacagaactttacattttcattctaggttgataagacagagcaccacatatcatggatcctattcttcttagccacagataataacttaacagagaagacatgtaatcatggatagattttccccccaaaaatctaggaaaatgtctatattttgaaatagagtaccctgacatcaaatctgctgttcactattttcttgtatggttttaggtaaacaacttaatttattggagttccagtttccatagctataaaaatgagggctgacactacttatttctttctgttgggtgggttagattagctattctgtacaaacacagctactcctgtgtttgaatacatagtagatgcttaataaatattcatttccccttcccttcccctcactatattttcttaagttacatttcctaggaaagtccttctaattaagtgataaaaatatatatttttcttcctaagaatcttgagggctgacagtacacattgtgtatctatgtaattaat

SEQ ID NO: 35384 - DNA, 1522 bp, Bovine  19866880768447
gttcctcctaactagttaacctgtgtcagaacatcatggctagtcagatcttttcctaaagactctatccaacctggaatcagataaggatatgtttccttcttattctgttacaaattaaatagaagtagtaaaaaagggaaaaatgctgttggccgagagcctatgagtgggctctccttcatttttctgaattactccacggttagaaaagagattcacagaaaggtctccagttgactgcattttcctcatgtctccacctcaagtgagtgagagattacaaaaggggaagatgattggcctcaagaactagatggtttcctctcctgtaaacacttcttgtaaagaagccttgtggtgtttggcatcacctcctgtacatttgtagatcatgagacaaatcttcctcagtgaattttctccactgcattgtgagaatagaaattagcctcatgttctctctcttaacaccaaagtgtccccacaatggtagctatgaaaacagcactacttaatattttctttgattgagtgatccaaggggagcccaggtgcatattgcttgactttgttattttcactccttaggcaaaaggacatttgcttcagcatttaggcaaaaccatgtggaatgtggagtgcagagtagaaatcccaatttgtcaattcagatggcattcacttagagaaaacattagaatactttcatctatcttagggcatttaagcaaggtacatacactctagtgatgctttatatttcttccttctcaggagaaatttgagctctgttaaatagatcctgagcagagatttgaatcacctttaaaggcacatgcactttgtgaggtggaggaattatacgtggaagaatgagggacatggagaactgcttcttcctttgtatgtttcctgattcttcaacttgatttaacttatttcttctcttgtacatattgattacatgtatttgtacattctctgccctctgcttacagtgtattccctagacaacttgtgggtctagacaacctgtgggttgtctagtgggtctttctttctgggtcatcttgtggatgtttcttgtgggtctttctttttggttagagaagcatccccaaatcctaaaccattcagattatgccctccattgctattctttcaattcatggttaccttttcctttgaacacttagaacagttagtgattttacatttatctttgtgctcattggtatgatactttttctttaaaccagactgtctgcatgtgaagaaaaggaccacatccacaattatctctagggtgtaccataggctcacctactttttgataatattcagtgttatttataacaaatatttaatactgtttataaaaatatatatttatttataacaactaaatgtaatatacctttattatcctgaattgaatttagtatataatataacctacccacacacacaattttttaaaaagtcaataattcactgtaatagaaagaacatgtaatta

SEQ ID NO: 35385 - DNA, 2606 bp, Bovine  19866880798006
caaaacaaaagcaagatatgccctacaccagtaagtaaacattgtcacaaatgatggagcgaggttaaactggctgttctgacactattattctgagcctcagctctctctccagttagtaaaccagagacctcctgagacgcatgaaaagacagccttccttagccctccattgcactggtgggcaaaaacaaaaatggaggtgtcatattttcttattcaaaggagacctgggtcctcctcccaaactggctacagatccaagtgtgagaacactgagctgcatatcaccttttcacattttcaacacatcacacagccttatatttaagccactcctctcacttagaaagtaaaacccttacataaatattaatgggtagacgacccaggagcagaaaggtatcaatctggcagaacttcataatgatttcaattctctccttcaaaagccacaattaaatcccagagggaaaattatcttttgtggataatgcaaataatggggtttttaatatattcacagattcataatgatattactattattaatagtgacaataatgaataaatttgctactagaaaataagtagacagtccagattttataatcctattaaacatctctgtattttatatgttgcatattattttttctttatgagatgacctgagtcacatatgcacttttatagcttcctagagatataagaaaatgaagccataacttttcatttctctctgtcacatgtgatatgtataagaatatgcatatgtataaaattttttcttttgcttcagctctttgatctgaagagttgaaattactttccatttgattttattcaaaaaagccatattcccctccagagatgtttaaataaaaaggaaattatccaccaaaacaaaactatccacaactaatgtgatgtttcttaaataacttttgtcactgaccaacacaaatagggtagtcagcaagtaatgttacacgaacattagtaacagcaagcaatgttacaagactgcagaactaatactgaagtcaggcaaagtatgagcaatcaacttgttgagcattctaaagatataagtggacatatcacattgatatgatttcctaaaatagcctttaataatctgctaaactccccttgttgctgctgctgctaagttgcttcagtcatgtccgactctgtgggaccctatgaccagcagcccaccaggctcctctgttcaaaggaatatctaggcaggaatactggagtgggttgccatttccttctccccttactatataggaaactatcagaagagacatgaggacaggaaaacaataaaacaaaaacaacactatcaggaagacagaatggaaaagaacacaattgaattgatatttgcatttaaaaagagacagatatcgattgcctcaaaggtactgaagaattcatctcactatctcattgatattgtgcctaaacatgtaaatttgccaactatccagtggttttatcattgcatatgcagtcacatgggtttcccttgtacctcagctgataaagaatccgcctgcaatgtgcaagacctgggttcgatccctgggttgggcagatcccctggagaagggaaaggctacccaccccagtattctggcctggagaattccatggattatacagtccatggggtcacaaagagtcagacacaaatgagcgactttcatgtagtcatatatcatgcaagaagattcaatgtattttcagtcatctttaacttgaaaaacttactgtacaagttttctattcttagttattctaacacttgataaatcaacaaggtcaggtattttttgaccttttgccatacatgataaacagttcttgatgtcttctactgtcaggaaaatgtagactaaatcaaagtttggcactggagaggcagcatggaaatatactggcagttcccagggaaagttcaaggttagaagatcctgaggtcctcaagtgccatagccacctctgatcttactacttggtgctctgaaaagtttattccaataaatttcaaaatttattttacataagaattacctggatggctttttcaaatacagattgcctgggcccatcctagactttccaacttggtggaaagagacctgacttgactttctagagaagctgagaatttgtatctctaaggagttgctatgcaacacccatgcttctggttcaagaattacattttgcaaatcactgttctattaaactgtgtgtggatttccaagaaaatcttgtcatagcttctatgatacttaaatcgtatctccacattaaacaaatactatacagtcttggattgaaaattaaacatctaaagagttaactgtatctgcctgatattaaatattcaaatggataaggctatttaaattcactggtaatgatagccacaacaggatacattctattctaaaggtatgggattttgctgaagaacatttaattctacggacagaataaagaaaatacagggtatagcctcatcctttataatgtcagttttttatatgtaaaggaaatattatgaccaatctgtaaaaata

SEQ ID NO: 35386 - DNA, 1273 bp, Bovine  19866880812796
tgcccgctctttcttttatagaatttcttgccttaatttactccctaaatcttatttttaataccttcctttgcttcccaccccaatattttcactttcttcactcccttctgccttagcattctgcattccgattagatgccatatgtataacaaggtagacagatgctttgctgttaaactaaagggctttttaatctaccagaacagaaaccacgagctttctttttgtttggggacatcagcaattcatggcaaagggcttaggaatacaaatgagggtttttttcttccagcagcatggagtctcagcatgtctctcttactctctccttacttcacttgatctgcaaagtaaaaccctgcatatgggagggattcataaataccgctaatgacacttaaatgtctgtatacacagtgctttcacgagtggaaccagtggaggtggctggtgtatgtccatgactgtcaattcattttacctattgattcatttacatttttttttttcagtctgtgaccattgacagtgtctattttgatgggcttcttaggttgcgatttccctattctttattcaaattgcagatgttttcttttctttctggcagtcgctttgtaataaggcatgtcttttgaggaaatagtgaaggcacacagacagcctgtcagaccacataaccaggtaggtcatgctagggtgctttttatgacaaccatgaccctgtagggttctcctgtggtaactctgattcaaaagagaaaaatgtgaggagaggtgtcagcagtttgagggcaaggcccctcagccgaagcctcttctgaccccagagtgcttggagaggaagccaacttccacctctctttggggtagcatggcttatctcccagggggatggggctctactgctcttaccagtggatgacagtgtggagttatgaataaggctgctatggaggccagatgtccaagtcacaccctgagccctttgcatagagtctgtgtcctcaagtcaccaagagtactgtgggacttcaagtaagatgatatttcagggtccctcatccctttctcttcttgcttttctggtaaaagagtataatgatgtcaacttttctgaccaatgtgctgatgatcttccttaatggcaggtatctggttgtcccccctgactacacacacctctttttttctatctgccttcttggtacctcctgaccctactagccccagaagtcttcactccctggtactactggaacaccagtc

SEQ ID NO: 35387 - DNA, 1803 bp, Bovine  19866880919763
caggctcctccgttttagttattttgttctccagttcgaactgtttttttcttatattttctagttccttattaagattctcactgcgtttatctgtttattttcccaaattcagttagcatttcctattactaatgctttgaactctttatctggtaaattatttgttttgttagctgctttttcaggggtcttctcttattctttgaattgaaacagattcctctgtcttctcattttgcttaagtatctctgaaattaggtaaaatggttacctatcagggttttaaagggatgttcttgtgtaggagaattcttacacaatctgcatgtgctgagtgcctttggtggagagctggatttgatgtgagcatgagtgatatcttgcccctggatgtgcttgaatatctattctaagatggacttcacatgatgataacacttgcaaccatttgctaagagctcacaatatagccagtattgcactcaataaatttcatgcactatcacatttacagtcttcaaaaataacccaaagaggttaatgcccattttaatgaaaatgggggggggggttaaatactcacagctgatgagactgacatttgaaccagactccaaagctcatgaccgttcaattggagcctactgtgtgtgagtcatgtgttgtaagagctgaatgagatgaagagagattgccatggcttgatgttaagtgggttagggtgaagaagaaaactccaaagacagggcaacagcaacatcaggagtaatggagatatttgaaggacaggacttcagcatgtcattttcagtttggagagaaactgtccccgtagttttcattgattgctttttaattgatagcagcaggggtagctctgtgtaccttttgataagctttctatagtctggaaattttcagatattgcaggggattggagcacccgagttaatgcactttctactcatgctaatgtgtgccctaggaggcagaagaaggtcagcctgaaaagagaaccaccggtagctgaagttagaattgttctttctaccagccttcagcaatatgtcctttttaactttctctagccctcctcttgcaaagttaaaacttttggtttaagttttaatagaactcgagcaagtgttcaatcctaaaatcttaatatacgtgtctaaaattcgtccacgtctccctccacaaaggcatgtgaagaaagaaagcatttcatgtttcattgcatattttcctcaattcctttcccgaatgataaccccggggtctaatattaatagcatgttttctgcttctttacctaatttgcatggtgaatactttatagtacaaaatatccactgatgggtaaggaaggatgaaaaggatagtgacggtttcatgtcaacaacaggggaatgtgggtttgggtttagcttaattctgaacagtgatgagggggattaacactaagatgcaacaacaccaagatgccacaacgctgatgttaccagcttctctgccccttgagacaaggcagaagtttataggcatagagtttagaatatggattctttagccagagactaaattcaagtcctggcttcattagttcctaattctgggacttggctagatacttaatacacttcagtctctgtttcctcacctgaaaaatggaaatagtagtagcaccaatttatttagtaattatgattagaaatattatatacgaaatgtataaaacagcctggatctttatgtgattggagacaactgttattaagagcaaagaggctagacag

SEQ ID NO: 35388 - DNA, 953 bp, Bovine  19866880937292
tctaggcctggtaaggcatacccaggctttctgtgggaaatttatcattcatgcccaagatggaaattacgatttctccacgatgtgtgggaaccagaaaggcactgagcatctgaaataaaatgaaaacaatttagctctgttgaatgtcaccctctgttgttgatttccacacatctgtgcattttcccttatacgagacttcatgtaaatgtgctagtttttgagaaagatgaagaaaatccataatcaaaattatctggctcacggcattcctagtttcatagactcggtatctctctgaagggagttacctcttcagcaagtccatactcagacagataacatgtgtgtacatatgtgtgggtatgtttcagaatatgaaagagcaaatgtctcagctggaaaagtccctatttttcaaagactatcacttccatatcatcctggttaaccagaagccagcacacaagcttcagtggggagaaatacaaagaccctcatgccagaatggagccaatgcagcacaggattcaggcctctcttggaagctggatatgggggtgtccttcacgtctccattcgctgcttgctcatgaggccaaggtgtgtctcctttctaagtcctgacaatctgaaaacgatgagaaattcatctcagcccccttcccagatgacaagcaagttgtacattgtattcactcccactcttcccggtttatctgccctgacagttcactgcagctctgtgtagctgggagcccagagggcatccatgacctttctcaagctgttcccagctgtcatcagtgcctctgtccctctttcatttttctatctgttgcttctttcaggtgcttcctctcttcttcatttctagtctctctctgtgcatctctcttcctccttcaaatcaccagcatctttcaactgtatcactttacaaactgcta

SEQ ID NO: 35389 - DNA, 1305 bp, Bovine  19866880945773
atttttattacactagattacatatcataaaacatgttatacatatacacgttatcatatttaatatcatattgaactatattttatgtgttcacaatattatactgttgtagcacagtatattgaactaagtacattttataccttgagatggcacagctcttcactcatacaatgaaggaaggtctgattgtttttttgccccactgctcattccttccatctccttattctatatgtgtctgaagaatgtctttctcagacatttataaacagtcatcttacagccatgcttatttctagacatgctgcttcacacattccatgggacaggttaacaattatttttggttttagatgccatctgttacagcttctctgggccaaagatcctgtttatgtcaacaaattacttaattaagcaaactaggtgatgacaatgatgaggttttgaaaatgatatggacattcatgtaaactatgtaattcattattatgctttattttaaagagtatcaaagagctggggtagtggagtggtataggggagaaagggtacccataagaggggactggcaaggcccctcagagaagtgggatggcaagtgatgtagtatggaaaagtgaggaacttagaccccttcttatgagcgaaaaggaaaaaaggaaaaacaggaaagaagtccagttgagttctccctgtgcactaagcacaatagtgcctactatgtgacaggccactgggaataaaggtacaacgaagtttcgaaaaggccacattcacttgaccctgaacttgacttcagagtactctgctcactcccaagacactatttctcatttaattcatgactccatgatgccctttcatacctaataaggacaagacaccaagttagagtacttctcacatatccccataaataatttttgtaaaatactcacaaaatataattttatctcaattgagaaaatttgctaactctaaaattatcagataattcaaaaatgctttttgtttgtaaattcatagctccctcagattttctattattctagttataggcagggatagggacacaagtattaatacagaaaatccttgggtttgctgtaattctaataatattaaagggataggatagacctaaacccggagaaggcaatggcaccccactccagtattcttgcctggaaaatcccatgggcagaggagcctggtaggctgaagtccatggggtagctaagagttggacacgactgagcaacttcactttcacttttccctttcattcaatggagaag

SEQ ID NO: 35390 - DNA, 1212 bp, Bovine  19866880975154
ctcctctttgattgcaacttctaggcacctgaagcctccaacaaagcttaacttctacctcagaaccaacatctttcattacactccagggtgaacaagcctttcagctgcctccttgttgtctggcttagattttaaccttcctttcaatcacatgtgtttctctcactcaaaaatagaacagagtagtcggaggacactagggctttatggttcttaaagatgatgtacagagagaccctggggcgctggtccctcacagttcaatttcagaccacattgcccgaaaggcaagtaggaaggaatactattgtcagcatttcaaaacaacatgcagtatcaccttttgttttgacctgttcagccttttctttcaagaaattatcctttgattctcagactcccttgcccttgtctgagaatagagattccccacccacccctcacttcctttttagtgcataaattgctttagtcattttcaagttatgaagtatgggggaaattttcatgcagagacaatacttatgattttttatggataattcaaatgtagttgaaccttagaactttaagatgaagaatgaaattattatgagttgggaagaaaaaaactgagcaatcaaaaaccagtcttcatatgtgcacaataaaattgagttttaaactgtgtaatcatacctttgtgtaacatggcagggatattattgtttgttttgatattgtgctctactgtaaaatgtacatagttatgcaaataaagttaggtaactcaatcaaggtacaactttccttttttcttaaaaaaaaattgccatcttagtttcttaaatccaaagcacaggaaaagtaaatgcaaaaagtcaaaaggaaataattgaaatgttgatgttacctcttcaaaaaattatatatttaaaattttcatcaggacaaggttaattaacattacaagtaagtgatcccataagtaaaagaaaatgtttccaaattgcgtatgtctctttgactctccatcatgttccagcttccacatccccatgcctctagccttggcacaatcacttttccagcctggaatgccctttattcctcttgtctatctggctaaatcatatttatctttcaaaactcagatcggttgtaatcttatctcattccccttacccttgctggcctggaaaattatgctctgtcttcacatatttttat

SEQ ID NO: 35391 - DNA, 2674 bp, Bovine  19866880979443
attattaagttttcttatataaaacatataagtaccttcaccagaaattcaagttaggaacatagctggagaattcagtgtcccggagtttccctgccctgccctccaacctccaggccattgcaatttccatagggacctagaataaaacaattctcagccctcatgtccctttttagtttgaccactctgaggctgtattggtagaaccctatttattcttttttttttttttttgcttcttaattttctaatggaggttagtaatattaatatatatagacagtatatttcagcaaagggcaatgaaaaatatggggaaagatggcaatttgattatatgccagaagaggaaacaaagcaatgaaacatttttattccaacctgtcagttctctatacaatttttgaattgtatagtttaaagagacaaaggagcttttctagaacacaagatattataattttacatggtctataactgtcaaaaatggttatgcaaaggactattaagagcacatctttaccagtaacattgattgtgaacttaatcacacaaattaacccttgatccccttactttcctgctattttgttcatattttaatttcttcatttcttctctttggggcttccctgatagctcagttggtaaagaatctgcctgcaatgctggagacctgggtttgatccctgggttgggaagatcccctggagaagggaaaggctacccactccagtattctggcctggagaattccatggactgtatcgtatatgggatcacaaagagtctgacatgactgggtgactttcactttcactttcttctctttacctacacctcagaccatttgcctccctggctagatttgaatttacttctcttagaggtttcagtattgagagatggaggcccaatatcagccactgtaaaggacactctaacagaagaaagagggtgctccaagtccataatgaagaaatacatgcaaagattctttataaagtatctatacaacatctgtccatgaattgattacacatttcattgtaatgtctcaatattgttaacttcctattcaatattattttagatatattcaatatttgagctatttgcacaaccatattaacaacagggaacatttttacatgatatttaggaatatatgtgtggtaaacagttttataaccacattagttttccctaaaacatatttaaaagggggaaggcaaggtattttaatacacctggaattaaagcagtttgaagttgaattaaaagtaacattacttatggtacaagcaactacagtgcagaatctgagcaatttgagatggaaagtatctaacttgacatcaaattttttcattgcttgctttgcctcctccatcactctcttgaatgtgtttggaagatatatttcagcatttcacttcaggtcacccaccacttccaaatcaatgtcacttccaaattagtctgtccacagagtagatgtcattaaccaccacccaatttctacctgctatctaagctagattctcttttcaaaacccatttctctgtacagatctacctgtatcctttttatcagcgtaaattatttcttcctccattaagtgtttatggttttcaaacacgtacacacataccttccttagccaagttgtacagacataattctttcaaacttttcccataagtcagcctctttcccctaatcaattgtgaaactcttctttggattccttccaatctgtctacttattttcggtagtcagacaaaccaaacagaatggggcattctagaagaggtctcatgaatgtcattgggagtggaactgtcaccctctattccatgatgaaatgctctcaatacagtgcatccaaaaataatatttcccttttgggtcccacatcacactaaaaatgtgtagtcttttctgtttttcagctttgtatctccaggtgtccctgctagcatctcaggaataaatcctgaccagtccagattcttaagaaagtatgctgtctaatattcttcataaacattccccatcaacttcttacattttaagttttgttttctttatgtaattccttaagctcttcaagactctcctgtatacttgtgtgcttctacaacagaaaattccctgagggattttttttttaacagttatttccccattgcttaagtcttttgctaagaatatatttgttcctttgacccttttttagtttaattcaataaacatctatcaaattcctccaatgtcattcactatattaacagaaatagagaggatagcaatggcgaaaaagtatagcaaaggagaaagagtaataatccctataggagagacaagcacacaattatcatttgaatatcacttaattctttcctggacatcctgagcacaagccttcctttgacttactcaaaccataaatgcaccaaatgggtttccctggtggctcagacagtaaagaatctgcctgctgtgcaggagacacaagttcaatccctggatggggaagatctcctggaaaaagaaatggtaacccactccagtattcttgcctggggaatcccatggacagaagagcctggtgggttacagttcatggagggcaaagagtcagacacaacttaacaacaaaacaa

SEQ ID NO: 35392 - DNA, 1427 bp, Bovine  19866881084958
ctgagcgctgaagaattgatgcttttgaactgtggtgttggagaagactcctgagagtcccttggactgcaaggagatgcaaccagtccattctgaaggagatcagccctgggatttctttggaaggaatgatgctaaagctgaaactccagtactttgaccacctcatgtgaagagttgactcattggaaaagactctgatgatgggatggattgggggcaggaggagaaggggacgacagaggatgagatggctggatgggatggacgtgagtctgagtgaactctgggagttggtgatggacggggaggcctggcgtgctgcgattcatggggtcgcaaagagttgggcacgactgagtgactgaactgaactgaactgatgcatgtattagaaaaataccagatgaggtagatttatatgccgcagcaatgacagttgccgtgaggggtctggtcaccaactctgctaaaatgaaggaggtgaaccaagaagatacagtaataataataggaatgttaggacaatgagaaggatcataatagtagttgacatttaaattctagactcaacattatattccagtttgtcttccctttgtgtctcttcaattccttgggtatgccttcattcaaatcatatttagatcccagtttaaaaagaataatctttgattgtagtataatccagggtcatactggatttgtggaattattttcaatagatttagcaccttcaattgagactagattagtggccccctggatacctagttaccttttatattatgcttgtggtctttattgtgttttaatcaggagctttcatgggaatattctgaaccaaggttagaattttatgtgaaataatgagaaagggcatgggaggaatagaatctgatgaaaataaagcattgaaaaacagttaaaattcaatataataacattaaaattaaagcacctggatattcattctcctaaaagtccactgactttttcacatccagtcatgtgagccaaatgttaggctaatgatagtcttcctaatctgtcaccagactattaaagaccatatggggcaatgacctttgtaattatgctaatagcaaatccttccttgtacagtctacctcattttattgcacttcacagatattgtgttttttccctaattgaagttttgtggcaaccctgcattgagcaagtctactggtagcatttttccaacatcatttcctcactttatgtctctgtgtcacattttggtaactctcacagtatttcctactttttctttattattatatttggttatgggggtctgtgatcagtgatctttggatgttactcttgcaaaaagattatcacttgtaggctcagatgatagcactttttagcaataaagtagttttcaatgaagatatata

SEQ ID NO: 35393 - DNA, 1619 bp, Bovine  19866881099367
tgcactacaaggaaagcatttcactatttatcctaccaactgagaaatggactatttgctgccatatcagggaacaaaggatgccacagtcatcagcaattgtagccaccacagatggtaagcaggtgagcccagagggaactcaggaaggaaagaatacctgccatctaggagccatcaacttgcagccactccctatggtgagccctgaggaaacttaggatgtgatgaaaacacaagatactgaccccagataggtgatgtgcatatcaaaggaatgatttcagggagccaagactcttgcatcttcccattcataaaagtgctgaattctttaacttgatatatctggttttaattaacaataatcttttgattttcagactacctgccctttcttttaaaactcccatatgatctggcttctccccttgcctcctgggagcagttctctttgcgttactggagatgctgccctatgggcttgaagtcctaataattcccaccaaataaactgtaactctcaacttttaggttgggagtgttctttaaggccatgcagttaagggcacatcttgctcttaaagttgattcataattaattatgtgaatatcacattgtaagactcaataaaatagaccaggaagaaaagaaagtacttgaaatattttcttagcatcatgttttccattgagaacattaatgaagaaattgtctaaaattactttgctgcacagtgattctatcagttttcttagaaagcactttgcttgggaaaatgttatgtctgcattactttggaggcattttggattaatcagacggttgatgatccagaagtgttcagcaggcccagatttcactgccagtaaacacagagaaatactttcccccaaactcaacttgtaacaaagaataagatttatcagacttttttctaaaatccaaagttagggactttgctcaagtaggacatttttgcttaatcttcacaccctcctatttcagagtgctgaataaccaagtaagccaagagaagattatactaaaaatggtgctctcagaattgtgaacttattcagtggagattttacaggaacctcaggggattttattcaaaattgaacttgaatagttttcaataatactttctggttttggaaaactgcctctcaaagtttctttcttctttttcaatgtgaataaagaaaagtaacttatatattagaaaaaatgtagaattaaaagaatcttggggatttaaacccttaagctgtttgagttgatgacaagatttttgataatggttgttttgggaaaagtatattcaaatataggattctgcaaaatccattcatgtgacaaaactgtgtttgacagaagtgtatggagtgcctggtctgtaccaggctttttcagtttccaggcacccttggtaataatttgcagtaggaccaatcagttcatcctttgtggtttctcttaggtagaacttagaagcccggatgtagagaaagaaacctgtggcattacccaagatgtgtagaagaatgagatagtaatggattcaaaatggagagtgtgcatggggaagggttagtctcatttgacataaata

SEQ ID NO: 35394 - DNA, 2091 bp, Bovine  19866881150971
acaaatgttaaaagactgtgtgcctggaattgtacacccaactttgccacacactaggctatgtgtccttgtgtaaattatctaagatttctgtaattttatatatctaaagtgtagacttggtttaatggcataataccaaatttcacagtagtgaaatagacaaaacaaagaatgtagatcattctaaatccctccacccagagataggacctgtgaataatatatgtatttcttttcacatttagcatataagtccgtacacaggcacacaaataaacacaatagaatgatgtatctacacttttatgaccaacattttcttttgacatcacattgtgaatatctttctttgattccatgtacataatcaccatcactatttaatgtattcagtaatccttcttaaatatattttcataatttatttagacagtccccatttattgaacatttagcatgtgtgctgcattttgctgttacatacacagctttagtgaatgctttcaggcaaactttgaaaatttatcttcatataataagttcctagaattcaaaatgctgtaccaaaatatagtcacatttttttagaaatttaccacagattacaaacaatcaaaaagaaaaccatgaaaaaagatgtgaaccatcatttcacaaaagaggaaatgctgtaatcaaataaatatattaaaaaattaattgttgaagaaacgcaaagaccacgatgatacacaactttgtgcctattcaactggcaaccactttaaaagtcaggtaatatcacatgatgagtaaattccactcgatcttttagattttgctattggggagtttaaactgatataaccactttggaaaacagttcaactttatattctaaaattgaatatttgcatacctgatgactcagcaactccactcccaagtaataagggaattcttgctcatgtaaagcaggataatatacactaatattcaccatgataaaaatttggaaacatgtcaagtacatcatctggagagctgaagaataaactacatcatattcttccaatgcaaccatatacagcagtcaatatgagtgacatgcaaaaatatagctgattattggcaatataatagtatatgtaaaaagtaaagttttactactaaagaacaaaataactaaaattagttctctctttacttacatatttatatgtacatatatgagcaataatatttaaaaagaaggcaatagaatgattcatatgggatttagattcaaggaagaaggacaatgtagacacacaaagagaggcatacacaacaggacagtgtatgccaaaagaaccccaccagcaagaatgtaagaacacctgtttcactagactgtagaaatccccaagaagttatactgtttccctaatgtttcccaagttgatgatttaaaaaggtattcactggtatttttatttgcctttatcactcactagttactttgaacattgtttcaaatgttaatttaaatgagggagtgaggctactgataattagaacagcattaatatggggcaagatctgggtttgtgctttgtgctcattattgtctcaagaatttcaggaggtgaaatcattcttcttttcacaaataatgaaattcagagtgtaaaatggcccagggtctaatggctaatgtggctaccccaggatactgtctgactctaaaatgtgaacacatgaagactaggccatgctgcctcaccatttctacagttttatttcactaatatgacatgagagtgatggaaattgttggctgtgaaattcctatcaaggggttattaggtcatgaaagccctggaggataataacagtggctcatagataaaatagatggaattaagatagttaggaggatgaggagtggcagagaactgttaaaattagtacaattattttccatgggccagttatatattttgaagaatttaatagcgttgaatcatagggaaatatgaaggtctctgaaaacaagcccacaataaggagatagtgacttccatgacagatgagaacatttgaaaaatgatttgcagatacaggaaa

SEQ ID NO: 35395 - DNA, 983 bp, Bovine  19866881170894
caagatttttcagcagtctagggctcttcctacaaagtcttccctcctgtgtcatcttttagcactgcaggaccaaaagcacaccttgcctactttctcctttgccctcttttatccacacagacctttcccacataaatctcttcacttccaaatcctgttttggcatctctgcttctgggatgacctgaactgaccccaaggggttgccctgagggctgaggatttaaagttaacaagacaaagcttcaatctccaaagatactttaattcctcagtttctgatgaaatgtaagggcatacatcttgattctactttagtctctaaggacagaatggtctccatttgcttctctttatttttcaacgcgttgctttgatatcagcacacctgaggattcctaggatggtttggctcctctctcaatttaactttgcactgattcccttatacctctgccaagatctgtacctttatgaacaatcccatcatttatggctctgcagagctaccccttggcactgtggcagaaagtgagtcatcagacacccatgaagtccaagatgattctgagataatgcaggaaagattagctatcacacacctttcccttcattctgtgttcaattctggctctctgcccctagctgacaaaatgtgcctgtaaccatcctcattctgaattgcattctgagaggagaatgcctcgacacccacctgcctctcatcaaaatcctaacactgatttgaagtgcatgagtcattttattcatatcttgggttctgtttgggaaaatgctgatcctagaaaacagggaagtctcatttcctctccccccttcattttccacaatgcattatagcctataaagcacttctagcccacccttcacaaggtgatagctttacaacatttctcagtcacctgatacctgccagggttggtggcattgccaccgatctggtgtacccaggcacaggc

SEQ ID NO: 35396 - DNA, 1256 bp, Bovine  19866881224214
ccctgtgggtaaaagctgaatggggatgcagataaaacaacaatggtggaagggttgaagactagaggaaaagctacatattcccattgggaggtagggaatattttaaagatttcagccatgtgatgctgttcattatccagatcactttagagaagtttgaagactgcatcaatctaaatttaagctttcttaaaaattgatttattcattcaataaatatttattggatgcatacaatgtgccaagcattctggaggatacaaaatgaataatccagtcttttctctcaaagagtttatgattgtatagaggatgatgatatatatatgcaaaaaaactgtattattttatttaggactctttcagttgcaaatgacagaatccaaaaacaaagtcacttacacagaaaaggaatttattggttcaggtaactaaaagtttttgactagctctttaggcacagctgaattcagggactcatttgatataaagttgctcttattctcatcctcctcccctccccactacttcaatttctttgaatttggactctttggacaattcactggatgtcatactgtgacaacgggaaaatggtcaagggagtagaggctatggggagattcagagcagactgaaaaggagtgagaaagtaagagatgttaaagtgattgtgagacttgatggaaaatgagtctgatgcagtgttgctaggcaactgaagtggagaaggaacggaggtcatgggagttgaagggactgtggcacaagaggtcaaggttgtgggtgagtcttgaatttgcaactgtaaactatgaaatcatacagacagacccaaccctcagggtaagtagttaagtagtggggagcctggtagtgaggtgagagagggggtaccatccatgggggtgagtgacctctggggctgtgtgttctgtccatcaccatttgtaaacagtgctaacagtactatctgggtcagccctggccagagacaggtaaacaggttcttagacaggaggtgtggaaagggtgatcagaccttgcctggtgcactgagaggctgtggacagagtgggtggctgtataggtaccttgttttgtgttttgagcctttaattccttaaaataactggcatatcttctaccccacagtcctaaaaccagcccttgctaggtgccccaaaactggggaaaatttctctaatcgtgacttcctaagaaaagttttcccctgctttaatatttacatt

SEQ ID NO: 35397 - DNA, 1080 bp, Bovine  19866881225361
caattcattaattagggttctgtctggagttctcctgtgaaggataataatttgttagcttaactaagatcttcttccttcctgagaaatgtcattctgagaaaatattgattgagagtggacccctgctagttaatgtatatacaatttatacatacttgaggatattcaaatgcattatctcttttttgatagctagtaatgattttaataaactaaacccacttcattttaaatagacaaatgttttcagctgacagtaaaggcataattcacaaatatgctaataattatttctgagttaggagattttaatcctaacttaaatgggaacctacatatttactttatattgttttatttaactgatccaaagcaagtgccttttttcatgcagtctcctcagtatgaaacgctatcctgtttcttcaaattgaaataatgattcaaaacagtcataagttctgtcctctcatgtcctctctgaaagttcttacagctatgtatcttgaccacctttagtcatgaattagtaagtagaaaacctgtcatattatccctgccatatctgattttgctgttgcttttctttttttaatatataattttatttatttatttttggctgtgctggatcttcattgctatgtaggcttttctctagtttcggtgagtagggggatactctctagttgagtgtgggcttctcagtgtggtgtcttctcttgttgcagagcacaggctctagggtgctcgggtttcagtagctgcagcatatgggctcagtagttgtggctcctgagctctagagcacaggctcagtaactgtggtgcgctgggcttagtttttctgaaacatgtggtatctcctgaatcagggattagacctgtgtctactgtgttggcaggtggattctttaccacttgagcaactaaggaagccctatcgttgctttgtaatggatggccgaacatggcttagtgtttggaaccttaaggtaggaccattaagcaatcttccaggctgcctcaacccttcagccttgagtgggtattatactatttttttaatttatgtat

SEQ ID NO: 35398 - DNA, 2437 bp, Bovine  19866881261507
ttgaaaagccccctagcatatctcctgaggaaaacagtcaccaaaatgaaagacagtgggaaaatcccattcctctaaacatttaatatcagtttcaataaccactctgaattccttaaaataattctctttcacttgggtaattttctgttaccttaacccaacataacaggtactctcaaaacacacatgtacatttctacttggtatcacatggactctggaaccagtctgcttaggtttgacttctagatctatataaggtctgtgatcctgaaaaagtcagtttatacttctatgcctcagtttctttatctctaaaatcaacataaaaatactgacctcaaaccattaatataggcttaaatcaagtaatatatgtaaaatgctgagaacattcagttcagttcagtcactcagttgtctgactctttgcgaccccatgaattgcagcatgccaggcctccctgtccatcaccaactcccagacattatctgacccatattaactgctatgcaaacattctcttaatgaagacataaattcctacactaactttcttactagactgcatgactactcaatttcaacatagttggccaagattaggtcaatatcacccaggaaaaatatccttagttataaataccagggaaacagaaagagtaatggaaacatacaaaatagagaagcacagaggcgatatatgtgtctgcagaaaaattagaaccaagggttccctacgtgaatgattagtcatttcatgtctacaaatgattccattatctcagaaagtaaagcacttggtagacattctgacacatggtaaacattcattaagtgtttgtttaagtactagttagctaaaaaatgaaatagttgtttgactataaacaagttacttgacacatctaggtttttgttcccttaagtataaagtgaagaaatttaatgtaatttcattaatcaatgaaatcatttgagaatttggaatcattttggaatcatttgagaatttgacaaaatctgatatctcaatcatatgcctagagtctctgatttaattcatctttggaatggctgaaaaatcagaatttttgaaagctctccaacgattctaatttatgaccagggttgagaaccacgaaagtaaccaggcgcagatcctggttacctttgtatacaaacacacagtaattatcagacatttcatatccaatccaaatatttaaactgatgtggagatctaaattctgtgggcccacagattaaacttctgtgagcccactgtgaagggcttcttttattcacttaggattaagaagatgaatgtgttcagttttaagacagaaatatacaaccctctgtacatcgctcaccctttcccttctgcacattctcaataattatcctctgctcatcagattaaggttattcattaaacaatgaggaaaagttaagagacaatgaaaaaagagaccacatagaagagagaagtagagtgagaacaagtatctccattaaatcattttaaacaaacccacataaaataactacacaaataaacaaaaaaaacagtctcttaacctcaggtcctagtgtctaatttcctggaccatcagggtctcaaagacaggagtggcttttcttagggtcagaccttttcatgcatagatacagcaaaaagtcccgaaagggtagggaggagagaactgagataggaccatgagaaattgttattctgggggccagaggggtttgctgtccctcctcttgggttttcccatgcctggagggttacaactgggccaaatgatagtactggactttctcctgtacacccagaagtcacaccctgagctctgatctccttttacctgcacaggttctgggctgtcatttcattaaaaggatggttttcacctcaagtctttgttcctggtagagagttagacctaaaatgcctcaaagtcttgaaagaactaataaatcatatttaatatgtagaaaagaatctgttttgattaacaatatgttatatcataatcaaatacagttataactgaagggcaatttgttctctggggtatcacttctttgagttaaagaaaatactcctgtttgttctaaaccaccttcaaatttactttgatttgcaaattcagtgtactttgtgtaaacaaacactgccagtgaattaacaatactgtatgaccctttctttcattatacaaacattttttcatgctcagggtattttgtctcccttttatacattttacctcagatcttagtaggtaaccttgagccttaataagttttactttatatcaaactcccttgtttctctttgatattttcctcaactatatataatctctattaaatgaggaaagtagagggtgcctgatgagggcattcgttcacaaaggaaaa

SEQ ID NO: 35399 - DNA, 1662 bp, Bovine  19866881313486
ttcttcccctactcccaaacctgtaccagtgatctttaaagaaaaagtgtaatttgattcaaatgcattaaccttctgaaagttctctagggcagaggagctgaggctgtaacagaggtataggaaagataaggtgcaggataccttttgtggataaggtggtgatgaataagtgtagcattctgggggaaaaaaagagatatgaattgttataaacatataatgaaagataagagagtaacagtctgggttttatggctctgatgtttcactatatactgagcctccaacaagtgctaaattacagttacaagccacgatagttattcagagagctgatacgattatttaaataaaaagtgattatttaaactttcaacattaaatcagtatgcaccattcacatattttttccaacatttgcttggcattctaaaagtacaagtcaacttaattatggacccatgtaagtaaaggaagaaacaaagcaacaaaggagtcaaagtcattgaggaaacagcagcttctgatagtttgcatcattattattatggcatgttattcatcgtttattgtgcatcaggttggcctactctgaattgcaaattaaattttcaaaactgaaggacatgtacttgggagcagagggtttttaatgtaaaataatattgctgtcatcctaaaaatcacttgtccctaaaggaaacaaaagtaaaatctctctaagaaataattaattgtactgcttagcagacttaaatgaacatgctatgttagcttgtgtataccctaagcagtgattacactcctgccctctttgcatgccagaaccttaactgcaattgtcatttagggtccccctggttcagtcattaataattgtattacaataatacttggtagaaaccctcaatttagggacttaaaaagactaaatgcaccgtatggattgaagtttcagtatagcttgttatactattaaagagtaatataatacaataagcaatatataatatgaaatgggtttctgatattctaatttcttgctcagtctgaaatagctacagtgcattgtatcttggtttcccttgtcttttcatcatgttggttctattcattttttccctgtctcctacattgtgcccagggtggttgctagttttagtcaggatccttgttattaattacagagaaacctaagccttggcttcagcaattgagttcagcagagttctgatctcttaaaaaaaaaaaaaatccttaccagctattgatgaagagggtattattgtgccttccactgattagagattaggggtgatttctttttctttttgtgaaacagaaattctgtggctgttttagaacattttctgttgttgtgtgtatgtatgcagctgctaccctgcatactttattcaacatcgcttcttcttcatctgccttcacactcttccccatgcttggcccacgagagagatggtgtgggatttacccaccttggaacttatccactttgcttattacaagcagagtcaattcccaactgagtacggactaaacaggatttgtcacgagcagaggtattgtataatatttgaggaacaacatggaaagagttgcttaatctgtccctacaaggatctgttttcacacccgcaa

SEQ ID NO: 35400 - DNA, 2024 bp, Bovine  19866881322428
tcagagcagtcagggtatctgacattcttagcagctgtgattttttccttaagggtttaaggggtttgtataatatttgtacaaagcaatattatcattatcataaatgttttctaattatttcttgggattaatggaagcatgttgtattattgatggattaagtacaatatttataaaacagtaataggattaaagagaaataaatatgtatatctttttgcatgtgtaaataataaatattaatacccatcatcaattttgtgcaaagtggtttagtacatattaataactactaaatagttcagttatctgttgcggatttgaggtatggatagatgtttatctgcaagctgaaggacttgggtaaagtccttgaagactgcaggaagggcaacgatctggaaaatggaccccaaaaataatgcaaaggtgtaagagttgcagaaaataaacaaaatgtacccaagaagctttcaagaggaaggacactgataaacttctatcaaaaacaaaaaaaagtttatcaaggaaaaaagtcataaatccatgtagcaaatattcacatttatacagttgttggtttaaatacacatgtattatttataacatagtggctctttaacaccattcctttgatttttgacttgtgtattcatgatttttctctgtcccatttggctgtgtaagccccctgcagacaacaataaagcatctatgtgacaaactgtaaagcaaccaaaattggaagacagaagacatagcttggaatttatactgcaatttactgccagagagatgttagaagacagtaatggtttgcatcaccagctcattctcttgccatcattttcaataactaggtcaatccttaactgcaaccaaggacttggtttgatataaatgtaaagcaatttctcttccagaactgaaaagtataatacattttaaggccaagatatgaaccattcaaaaaacatatgtttgctgatgaggttttaaagaaattataccagtgaactgatggaagtcacttaagtaaatagaatcataagagactacagaagtgatgatacacttctgaatcacaatgctacctttgataggtatagtaagttgtttttcctttggattaatttattctaaggtaagagacaatggttcagaaactgaaaaacaggaaagctctcgtctattctagtatataaaaaaatacaactgagcaacaactttctgaatttctcattttactagactgatcaatttaatatctgttttaaataagcctgtctataatacactattcttttttcctatgggcaaagttattgccagtaactctcatggctcattatccagtcctaaaagatttgttaagaatggaatagcatcaggtaaggagaaatcatttacaaaattatagtcttagtctcagtatctaggttgatttttaccagaaaatgatccagacagtgtggacttttcagaagttttccagcatgacaggtggctatgcaatgacatgcacagatgtctgtgaatacaggaggcatctccaggtcaacccagaagtctgaactttcactccaggcatcccctaaggtgaaagaaaccttttcaaactttcacctgttccaaaggatccagaatacccatgaccctgagtgactaaagcatctgttcttactgcattgcatcagcagtaacttcattatattgccagaacaatatgaaaataaatatttattcttaatgtaaatgaatttgcaaaaacctgtccaaggaagtaatgactatgtagtatattccttgaattatttatgctttctgctgtttcttgaaagcagggttagcatcatatttctgtaagcaattttaagtgttatatatatgtccaacctaattcagtccacaaaagttattcctaactagcttatttgtgttccatggtctttcaacctgagaataaaggcactatctaagcacctaagattcccggttaactggtgcccaggcaacaggag

SEQ ID NO: 35401 - DNA, 895 bp, Bovine  19866881329533
atcccaattttaaaagagtatgccatggatggtgatgttgctaatttaatccaatgtgctgtctgaccctcagtataaagtttatagtttttatgattggattaaaacaaataagtagtagagggtagtgggctcaattaatatgtttttgtcttgctgttatgaagattaaaggagtcaatacatgaaagccttttgagcagttcctggcacatgttatgaccacaataattgtttgtacagggactattttaggatcaagtgcttgagtagagaaaacatggtgatgatacttagaactaggttgcaaatgagtcagaactgtttaaggggcctctgggatttttttctgctctttttaggatttctcctcagcttagatcagttcctcaaactccaggaagaattacatttacataaaacacccaaatggccaaaggcatcttctgagacaccaggaattcagagacattttctacctgaactacagttctgctcatttagcaaagtataattgcagaaaattatccgagacttctatagctacagtacccacttctgcaaaaccttgaggttataccacagtttttaagcaaagaacacaaaagtgcccttaagatgatcctggctagtctcctctttattaaattagtcagttaatagaaccaaattactattttctgcagtgattataacccctgaaattcattatgatttgtcctttatcctggatcttttgggtttccacaaatcaaaacagatattatatttataatcaaacaaatttcttttcttctcctctgaaaatgaagagggaagaaaaattcataatcactaaaattcacaccatcatttagatacattacatacattagatcacttacattaacagatt

SEQ ID NO: 35402 - DNA, 1572 bp, Bovine  19866881384123
gagatgacatacaaggagataataatccccccaataattttgagaggagcaagaccaaagaccaggaaggtcaggtaaaagaccttcacaacatcctcaggaagaggagagctgttccctagtttgtgaacaaagaatttaaatttgaaaggtggatgccagagactagaacataatgctttaattttttccattagattcctgacaatgctctctaggtaagtgatgacctagacaatggaattaatgaaaatgatgctcaaggtctcacaacttacaatgttttccaaaaaaaaaaaagatgtttaccttaaagtaatagacattggatttgatgtcaaatgagatgaattaacaagtcaaaatgtgctcccccttgcagtttatgaagcattgtcagtgcacattattacttttaagttacacttagacagttttgatttctcctcagtaattatcagttctctctgaacttaatctaaccctcatattccttcctaggactaaattacaatttacttttctctttctgtaaaagccaggagccccggacgatgccattgacagtgggacatctaagctagttccgattttgcttggaaaatccccaccagctgctctgcctgatgctgagttaattgccttcattagctttcttacaatacccttcttaatcagtccttgtgaagagatctgaaactcacatcgtggttcctttctgacctttaaaaaaaaaaatccattcattctttttgcacaatggctcttgaagtctaaaatgcaagatataaaagtaaggggaaaaacactatttttttctgtattcctccccaaactgtgacccttaacttctaatcaagataggttattctgacttcctaaattaccaacagctagagcttactttctctttcttttcccatggctcccttagccttcttttctaatgaatgcttaattaacatcaatacatatcctttctgatgaagcttgcagttttcacagtttgcaacctgctgcaatcttcctcataaagaggctaaaagctaaaagtttttagttataaaactttaaaacttgtaggctggtgaaagcataaagacaatgttatttcagtttattttgtagtatttcatgtagatcaaaatcttgttggtatctggcaaggccatctctctcattcccttacaacctgtgacattaacctgtcattcatgaaaagtgattaaattggttcagaagacttgattttcataaacctgtcatctttggtattgaccactaatgctttttttgttctgtgagatttatgtaagttgatttttaaaaaaggtttatgcattcatgattgttctgggtcttgttgctgtgccggcttttctctagttgtggcaatcagagactactccctggttggaggtgtcttctcttggtgtgaagcaaggacagagcacatgggcttccgcagttgcgtctcctgggctctagagcagaggctcagctgtggcacatgacaggcttagttgctccagggcatgtggaatcttcccagatcaaggatggaacctgtgt

SEQ ID NO: 35403 - DNA, 844 bp, Bovine  19866881399092
tttttatgttgggaaaagtaaaggcagaacatatcccaaagcagccccatgacagctcagaggtgatgagaacaaagatttcacattttccaacagagtaaaactcttttgagctcctgagttgcagttgctcagctctcttaaccaaagagagtgtcccctcagtcctgtcgcctctcctctgtcctctttgttgtgattctcatttaatcaattcaggttattccagtgaggatgctaaatttaaagtcctgggttggcgtctcatttatccataagccaggtagtgctaccagggcccaggctgtgggctccattcccccaggtgcttgggctccgacccacagaggctgagctattaatgagcaggactcagtctccctgcctcactcagcccttgtcttctctgctgatattgccaacaagagaagcaattagggccaatctggtggtggttggctgcattttaaaatagaaaccatctcaaaatccatctacgagcttggcttacttttagcttccttacagactgcagagccattcggtgacaatgctgagaattacccagattatccatggaagcctgtaatagtccaattaccaacacttgtttgcagtcttattgtgaacttcctctgaagtcaggaaaggatacgccacagtaggaatgctacgtgtcgggggagaagcagggagagagaaagctgttttgagggtgaaattgttttcatcagcgactcaagactgcagcagattcggggactaccagaggctctgatgtgttttaataaccttaaccattgtggggaaaggcttttccataggctgggaatcgcccaccaac

SEQ ID NO: 35404 - DNA, 2427 bp, Bovine  19866881561343
gtgatgagaaacgtcacctccatgattatgtcacattatcgaagacctcatttgctgacactgatgccagagactcctccggagtgtgatgaagtaagcagtcatgccgggaatgcccacatagaaaggaactgcaggcagccttcgggaaatgagggcagcctctagtcgttagtcagcaaaaagttggggttctcaactacacaggttgtaaagaaatgaattctgccaagaacctaaaaaagctgaaatgtggtagattctttcagagttgagcctccagagagagcacaattcatgtggcaaagtgactgtagtcttgtgagatgaagaacagggatcctaaccaaaatgcccaattttctgacccacagaaaccataagatcataaataacgtgttgttctaagcttctacatctgtggtgattcattatattactaaagatagctaatataattaagtatagcaaaatgttaggcaacaggaagaacatacttcttacataaagaacatactgcctaagacatttgaatagatatgtaaacagagctggcaaaacttaaattctcttaaagcgttcacagaacttcaaggtggaaaagatgcatcttagacatgatcaggtctaacccctcttcatatcacgttgcaagtaaaacgaccaagctccaaaatggctatataacaggctggaaggcatgggaccagctaattgcagagctggaacttgaaatcaagtcttctgacttaatatttcctatcacgacactgatgccaaagctgtgatttcccatttcagtaagaatttgttgatttctgagttagtattatttaaatcaaagagcaaggatcaatgctgactagatcttaaacgatcatctgacttattgattatgcaacttcatctccagttcacttaccatcattctgatatggcttgcttttaaggtaacactgggttgctgtggtatctagcaagccccaactgtagaagaaacagtaaaaatctcccaaatgcagagcaatcaaggctctgtcagagagtataaaagcactgagatgaagggtaaaaggttcagttaatccatgaaaatgtcaccatctacttggaatctcagcctgaaggttaagtgtcacagactattgtcagatggtgccagcagccagaatggctaaattgactcgggtgatgagtgtggtaacagatgctataatcaggctgcctgtatgctcaatcagatgatgtgaccatattaaaatcagaacataattcaaaacagcatattttgtcccaatttttatagcgttttgttaatcagattctccctatcacaaattaaaaagtccaatgtctctccatttctcctccaccaacatctccccagatgaaggtgttccggagatcaaaagtacaacattgtgactagttaatgctgtattgtatatgagaaatttgctaaaagagaaaggtaagtatgtgaggtggtacatatgtaaagtagcttgattatggtgattatttcactatgtgtgtctgtatatatgtgtgtgtatatatatatatatatatatatatataaaagcattaagttgcactcattaaacacatacatttttttaattgtcaactataccttaacaaagctgggtaaaatgtttaagagagattatgtccagactatattaaaaggtttaagagatattatatccagactatatctgtaaatttttacatggaacatattctaaaaatataactgaatatacattctgacagtgggacagagttttggaaatcaggattattctgaacattattgtcatgtatcttttttcttactcttgtatctgttcccttcactagtttagatcacacctattttacttactatctgggtaatttaagagttattttaccaccctaactttgaacctcttcatgaataccttgcatgctagaagatgctctttggtataaacagaattcatatatatgtaaaatatttagtagagtactgattatataaattgttgcctttatcttttcttctaattttccccatggaaagcacctttctatttctctgtagtcttctggacctttgaacagaatagcatagcaatcccaaacgtattaaggtatatttacattttttgaatcgagaagcatgtgttattacagggaagcttcaagttagctatgtcttaaaggtttacatggtgcctctgtggacagcgcggagtcaagcatggacctaccaagcctgttttgtccaagcatggtgaaggacaaagatccattcccagctataagacagccaaccttttagcaaatgaaggggaaaattgaatttaagtcagaaaggggaaacaaatcctcctgtccagtaaatttcttaatcaacaaagggtttctcgagactca

SEQ ID NO: 35405 - DNA, 1175 bp, Bovine  19866881817253
atatatgagatttaaccatatgatgtaactataatttttaagggtcaaaatctttagaatatcagaaactatagtaacaaaacatttgataaagaataaaatatgtgactacttatacatcaggctgcgatttcactaataaagaactggtttatcagtgtatatagttagggagtaatttcagtgacaaatggtgcacacagattaaagtctttattagaaacctggaaaaacaataaacaaccttgatggcacatttatttgaaggacactgaccgagaaggtattgcaaacacattgaagcttgagaaagcaaaaattatttagggtcctagaccaaatagactaagatattttaaaaaacaagccaatgcatttgagaaacattttactctttggtctgtgagcaacagggagatgaatgcctgttctaacaaaaaggcaaaataaatagtatttataaatgtcctaatatcagtgttcagtaggcaatggggtaggcccccaggtcacttttaggtggttcatgtgtgactctttgcgaccacatggactacagcacatcaggctttccctgtccttcaccagctcctggagctactcaaacacatgtccatcgagtcggtgatgccatccaatcatctcatcctctgtcatccccttctcctcctgccttctatctttcccagcatcagggtcctttccaatgagtcaatactttgcatcaggtggcctaagtattggagcttcagcttcagcattagtccttctaatgcatattcaggactgatttcctttaggatggactggttggatctccccgcagttcaagggactctcaagagtcttccccaacaccacagcatcaattcttcagctctcaattttttgctttcacaagcatcaattcttcagcactcaattttttgctttcattcattcaatgaaaattcattatgtacctaatttgtacatttttgtttcatttaatccttaaagaaacaaaggcaaattaaccaaactaagaacctgagaaatgtgtgctgatattacagatcaggaaagtgagtcccacagtgaagagaagtgtacaactccacatgcctgtggaaggacagagcctttctttcataattactttccactgagtcatgtcccaaatggagttctctgat

SEQ ID NO: 35406 - DNA, 811 bp, Bovine  19866881936533
aaaaagaaaaaacaggaaatgtgttaggaaacattttgtgttctatctatgaccctctctatttgcccctgtgtctgtctgctctgagtgtgtgggtgtatttgtatctctctctgttcatctttggctctttttctccatttctcctgaaggtctcctttcccaaccccttcttccccacagtgaaactaaagtggtagatttacactggattccacattcactgctggaaataccaccttgagcctggcttggaatatgtctgttctggaaggctcgctcttacaggtgtattagacccacacagcccctctgtgacctgacgttctggcccccatgattccctgaggtatctcatgtctagctgctgagcttagtgttccagacggttacattccccagaacaggccaaggacacgggcattgatttccaatcgttacatgccagtgcagtcacctctctctgtcatcctgtgtcctagtctgtctcagggccagaaagaaaaaagaaaaaagttttggacttgacagtgaggggaaaaaaaaaaataaagagattttttttaaccccctagaagggaaaatacattatgtagaattatatcacatcaaggaaaacatgattaaaatagcctggtatgaatattcatctgtgacttgacagaagggagggagcacagggagtgatggcagcacactgctaacagagatctcgtttagagaccaggttctaaaagaatgtgtgatgagatttgctggcctgaactatggaagtcttttttttctttttgcttgtttccttttttttttt

SEQ ID NO: 35407 - DNA, 2712 bp, Bovine  19866880245012
acttgccattctctgaacatcccccacatcctcccgctcccaagtcattgttcctgctgttttattttgttttctaatcacaggttgaagcaaagcaaagtgaagtcgctcagttgtatccgactctttgtgaccccgtggactgtagcctaccatgctcctccatccatgggattttccaggcaagagtactggagtgggttgccatttccttctctagaggatcttccctacccagggattgaacctgggtcttccgcattgtaggcagacgctttaccttctgagccaccagggaagtccgttttatcttgttttctaatcacacattgaaccctatttattctataaggttcagtttagatgtttccacctcccattgataatattggaattgctatgactaaagtcactgagtcatgtctgtctcttttgtgaccccatggactgtagcctgccaggttcctctgtccatggaatctcccaggcaagaatactagagtgggttgccatttttttctccagggtattttcccaacccagggatcgaacctgcgtctcctgaactggcaggaggattctttaccactgagccaaaagggaagcacaatcttggaactggttgttaccttttccacacttagagttgtcgtcaacatcctgctttaggaaattttcatgctttgcattaaatttgttttgtgtctgcttccccaacagaccacaggcttcttgagatgatagaccatggaccttgtcttaattatatactttgtaactagtacagtgctccatctggagtaaggtctgaaatgaatatttaattcagttaaaatctggcactaggttattttgaaataatagctatcaagattttgtttgttattcatttttaggttttctatgtttttgtaagagcactaatgtgtatgaaatattacagctacacacacaccagccaaagtgagcatggtatgactatggcagataatcatcttgaaacagaattgcagattagtctgaaactgatcatgaagaaaatctggatatacggaatgaaataacattgcataaatgtgttgcataagtagcttattgtcttgcatttgcaaatttatgggtgtagcctcacatactatcttttgatcagcaaggaactacttcacataaatagattgagtccaaacattttagcacaacatatgtcatctaattaaactagtaatagtgctagaagagagctgcggtagtatcggcatgtaaagagattttcacaagtatggaagagaaatctaacctttcatattcatgtagtttactctgttttcacataaagaagccaaatgttattgtagcttatatttgcaacatttgtctctggagacactcttagtatttttctgttccacatatccaacttctgaacgtttttctaagtatgagctgtctcatatcacacatgctccctggctctttcacacactgaaaattcacaaaagctgtgtttctggccaaggtgaaaactttatccatgcttatacttgactccataccctccaaaggagacacaggcgggtgtaaacagttatgctgttgtccttttccttggggaaaatgaaaaagctaactctatactttaacataagcctgggtaacgtttaccctaacacctttcatattgttaccaaaccaaacttggatccttacttacttgccttagtgcagtaaagcctatctacggacaccaggttgtggtgaagaaaagtgcagcatttattgcagggtggccaagcaagttgttcaggacagctagtgctcaaaaaagccagaactccttcggcctccccctgcccccaggggtttcagcaaggcatttaaaaaggcaaggtgagggagggacatcccaaggtatgtgatcagcttgtgcacagttctctgattggttgatggtaacagggtgatgtcacatgggttaacattattgattcttaggcaccagtaggttgggggctacatgcttatgatcatcaagtaattaatttcttccatttgggggtgattttagcatctatacaacagctcaggaaatgtgcatcagctactgttatctaagtacttcagagaggatatgggggagaaatctgcctgggaaagcctcgtaaggttctacttagttacagtatcttatggtccagtgagtttaaaatttgcccaaaattacacaggtaggtccagaacacaagtcttctgacttccacccagtgaggtgtaattgttcagtcacagatttgtccatcatctattttgaagcacatattatgtggaggaaccatgctagttggagagagcaaatgatgctactctatcaacgtggcagggaaaataagacattcacatcgataattagttattccctgagaaaattaatgtcctgagaggtatgggaatataaaaaggagataatgctgtattagtttaacaaaataaaaattgattagataactcatttagatatttcaccagattaaccacaactgtggaaatctagctgtttgaaccacaaaagccatcacagtattactatgtacctaatgaaaaatgaaccaacttataaaataaataacttcctaagggctaaatttgcaaattcaagctataattagttacaagaaatgtcacagatatctatggtagtgtcatccttataaaagg

SEQ ID NO: 35408 - DNA, 1293 bp, Bovine  19866880417474
tgaacatgtattacctttaaatgaaaataaaataaatttgaaacaatagagaattttaatattctggaatatgacagataaatattttaaattcaatatatactaaaagatttcataatctttcttacacagagtgtagttagaaagaagttgtggaaaaatactttattgcttcggatcccttcatgtttatatcaagatgacaattatcctgcaaatgttattgataataagtttaggaggccatggacaagaggtatattttatttgtattttttaaaaatttatttttaaaagtatttcagagtttagcataataaattattaagaaaattcactgttttctcattatataaaaatatattcatatcagacttccaagaagtttataaattaatatttttatgtgacaaagtatttaggtgacaaagttaatatttttacgtgacagagtttaggtgacagagtaaggaattggaaagcttatactagatattaataaaacaaaagatatgtaaatgatgaagtcttaaaatattctgacattctactatttgtattacagtaggatctttcccaactgtatgaaggctactctaagttgtaacgatacactgactataaaactattttttaaatgaatatgtactaagtatcatcttttgctttgaaaagtgtcaagtaagatgagaacagaattaaccattagcttaattaaatgtagatcgataacctcgatagaagtggtttccctggaatattatgtatgaaaacctgatcagagtattttgagaagagaatgcccagtgggatgtgagatggtggacatagtgagctcttttgaagatttttgctatgacagtacatagaaaaatggaggtgcactagctgaagggagaaatgagttaaagaggattttttttaagatgtgacattaaaaatatatatatgaatgataaggaaagagactatgaaatgtttgtttgccaaaggaaataatcttggtaaaaagagagaaaatgatgatgcaggaaagaaaaaagataactcagtaaaagagaatagaaccaagagcacaactggaggagttggtgttagaagccaggatggttcctctactgcgatagagaggaaggcaaagtttgtaggtacttatgccagttagcatattcaaaagcagagacattactttgccaacaaaagtccgtctagtcaaggctaggtttttccagtggtcatgtacggatgtgagagttggactgtgaagaaggctgagcgctgaagaattgatgc

SEQ ID NO: 35409 - DNA, 3999 bp, Bovine  19866880427176
tcgtgtccactctgtgcgaccccatagacggcagcccaccaggctcccccgtccctgggattctccaggcaagaacactggagtgggttgccatttccttctccaatgcataagagtgaaaagtgaaagtgaagttgctcagtcgtgtccgactcttagtgaccccatggactgtagcccaccaggctcctccatccatgggattttccaggcaagagtactggagtggggtgccattgccttctccgagtcttctatgactaatttgcaaaccataaagaaatgttcaattttatttttaaaaattctacactatcaaaattatcatattttacctcattttatttgtaagcatggtgaattacgattacaataaagcttctagtatttgaaacattagactaacctggcgttcctttaattaatgcaactgagtcttgataagttagttggtttttttaggatttttgcatcatggtcatgagtacgatgatgtataatttagtatccttgtcagatggtggtattatgactatgttagcctcatatcaatcatattccattgttgttgttttttaattgctaagtcatatctgactcttgtgcaatgccatggactgtagccaccaggctcccctgtccatggggtctccccagacaagaatactggagggggttgccatttccttcttcaaaggatcttttcgacccagggattgaacccatgtctcctacactgcaggcagattctttaccgctgggccactaaggagcccatgtagcattagaaattaaagcgttatctcctatttacacttatgtgctcaatcatgttcagctgtacagactgcagcctgtcaggctcctttttccttggaattttccaggcaagaatactggtgttggttgccatttcctcctccaggggattttcctgaccagagatcaaacccacgtctcctgagtctcctgcattgcgggcacattctttaccacttgagccatcagggaagactaaaattaagtttatacagttaacactttaaacagacagcatttcatgtacatgaaggacataggattaactcaaaagacataaaaatgtatagagaaagttccacaaattccttaagagctatgaaattaaaactattttaaatagtgaattgaatttcatttaattaatgaaaactagtttaaatagagagatgtaccatgtcatggatttaaaaacttaaaattgtaaagatataaactcctccaagttgactgatagacttattgcaaactcaatcaaaatccagcaggtttcattgtgagagttaagaagaaataaagatctaagaatatccaaaatattcttgaaaaagttgggaggacttgtttgaccagatatcaagacttattataaatctatagtaatcaagatgagcttcctaggtggcactcatggtaaagaatcttcctgccaatgcagaagacacaggttcaatcactgatgcagggaagatcccgtatacctcagagcaactgagcccctgctgctgccgctgctgctgctaagtcgcttcagtcgtgtccgactctgtgtgaccccatagatggcagcccaccaggctcccctgtccctgggattccccaggcaagaacactggagtgggttgccatttccttctccaatgcataaaagtgaagagtgaaagtgaagtcgctcagtcgtgtcggactctttgtgaccccatggactgcagcctaccaggctcctccatccatgggaccttccaggcaagagtactggagtggggtgccatagccttctccgaactgagcccctaccccacaactattgagcctgagctctagagcctgggaactgcaactactgagcccacgcgtcacagctatggaagctccacgcccctactctgcaagcccatcctctgcaacaagagaagccatcacaatgtgaagtctgtgcagcacagctaaacagtagccactgctcaatgcaactagaaaaaaagcccacacagcaacaaagacctagcacagccataaataaataaataaaattagtttttaaaaaagaagatgagactctgaaatctaacaaacctagttctaaatccaactccatctatcagccttgtgaccctctgctggttaatcaactgttctaaaagtcagtagttctaaacttcacccacactttgaattcagctggagaactttaaaaaaaatacagacacccaggttccactttcagggtttctgatttaactggtccagatggacggtagcctgagtactgatagttgtaaaagttcccaggtgatgggctgagagctactgctgtaaggccagttaccctatctgtgaatcggtgatgataacgctaataataatagcttattggaaggttgttataaagagaaaaatacgacggtgcctgggattcaataactttaaactcttattaaactgctcactctattaggttttgaagtttgattgaaacgtatactgaagagtcacatagatgatatttttaagacataggatttgatggcaatctgtatgcaaaggaattaaagacgagaaccccagttggcatgctcagggtaggcaggtggggggaggggcaggggaggaggcactgggagcgggcagcagggcagagagaggacaggacgtagaaaaggaagcagaccagtcttttgacttcggttatctggacacaatctcatttactctctgttgtaattttccaagtttatacaagcaattcaaaatccagtgaaaggcttggctttatgttgactggccttactgtgggtggaatcttagcaatgctggtgtcttgtagatataatgttctctttgtttgaagattttgttttctaaccaaggaaatgattaattaagcatggattctcccatccccctctatgatattctgaacagctggtacttatttgggatatgataatgattttgcttggaatccatggtgataaagtatttgtttactatcatgagtgtattatattcatgttatatgattttctaaaccaatcaataatcttgcattagaaatttaccttcatgcaaacaagatttttgaaaatttacttcttaaactcagacatcaaaaaaaaagattctctaaatcatgtaatgagttaggtacccccaagtcctaaaaaaaatagtgtgaaatatctataattcataataacattaaattttctttaggtaaactgatctggccttttcagaaactacttttattgaaataggcattatatttatttctttaaaatgtcacttagcaaataaacactcaagtagaatgaccactaaaataatgtgaagaagagatgccttaaacaagggaggcccttgtgggggtggtgagaaccattaagggaatctgttgactggcttggctcccagctagattccatctagaccacctgtcaaatgccaagaaaaataagagcattctgcagaggccggtatctccagctctctcctctgaccacccctccctcctgaccccttgaccctccctgcaggagctgctttgagcaactgtgcccagcacctgggagagaactctgcggaggccagcaagtcagcattccaccaggagcaccgtggctagagctcaacaaattcagctgtgatccttccacgccctccatccaggcctgcaccaagcccctcctcttcactactgaacattaccctgaaataacccagtctctcttctcatccttccccagttgctccctactcttccctcttccatgcctcacatctgtaaggctctccactgtgccttgagaaactctcgtttctataaggaactaactccctttggtctacaaacaattccttgagcattccccccaaattattaacaaatgaaattattagctttctttccaaaccttatttcattagacaccaaccttagatcaccccctaaatcat

SEQ ID NO: 35410 - DNA, 2001 bp, Bovine  19866880578546
atgtaaattcttgctgttgttttcgtttagagctaaacatgaagtttccggagagacagtggtgtttcagggaggaagccttggcaaaaccccctgatgggtaagtgtgccaaatccacccatcattggagacgccttccgtccagtggagaggacactcaccaagttgatttccagctttgtgggaagtgttgtgtgttagcggaagaagacccttcaaagaaaaagcataggtttttagattcagtttcctggaaaccagactgagatggaactctgtgtgctggaattgattgaaggggaccccggggtcctcacctggggagtaagggggcaggacgcggccaggagccaagaaggagctgaactgctgcccacatttacgaggtcctgaccccatcaaggagcccaggactggactgggagggcgattcaaaaaagttcttatcactctagcttagaaaagacgtaaggaagacagaagttgtctttagacggctctgtcaggatccacagactttggtgcacagtgtactgaaggattatcgctgcctcagaggtgacgagggctccacccgcacgggcatcgtatgtaccttaggtcattcaccagctgttgctgagaactgaattaggcgacttcttagtttctcttcaccctggttctctgcctatgtggtaaagagataactcaatattggaaatttagtgaaaatgtaattttaaaatgtctagtaatattggtagtgtaatttttgttagactggaggtagagaaatacattactgtgtactttttggttcttgttttcaagccagggcctctctacttataaggagctctgttctctggcaagtgatcttagtcagccggatctggtgtataaatttatgaatctagccaaccatcatgcgatgtggaactcgaggaaggtaagtggctgttgcccaacagttttatttttttttcttcccttcaaatcaaacctgcctcactggcagatggtgacaattgataacacagtgtgttttgtacacgtctgtggtgagagagctccgtcccaccccagagctggtatagtgttgatactggacactcggtaaatcaggatgtcttcagggacaaggctaggaggggaacttgtgtggtatttaatgtgttaatattttattgcaataggtgtgtctgagccacttcaccttgctactgtctttttagggccctgcttttggtttcaatgtaattgctaccagagctggagaacagctggctcctttcctgcctcagctagttccgcgtctttatcgttaccagtttgatcccaaccttggcattcgacaggccatgacaagtatttggaacgcactggtcactgacaagtcaatggcaagtatctgtgaacgcttgtcccagattacaggcggggtgtaaacccaggcttaccttcctttctcctctgtatacctgtttgtttaaacaaatagactttctttcatctttttgctttcttcctcctttcaaggtaccaaagacgctcatgacaacatttactgaaacctcaaaaatagaagtaatgaaatgtctagtgggtggatggctaaggaactggcagtgtatccacaccagtggaagctgtgtcgatagcagtgatgcggtggagaacaggaggtggatgaggaagcaggcagttaccgtgtttggctgcttcttgtattctctcgcattgttagatactaggatttctcaggacttgcctctgagtacctttttctctctccattttctcctttgagatgagctctcaggtccagggcttgtaaatgtcaccttgattgtgatcgttcccagtcttaatcttctgacccaggcacgacttatgttcctgacttgtattgctatatctcactgcctgcttgacattgtcacttggatgtcatttcaagatatgttagacataacacattcagaacaggacttaagaaaaacggccttcccttggga

SEQ ID NO: 35411 - DNA, 1545 bp, Bovine  19866880630050
attttaattattttgttatttttgtttaaaaaaggattgtggtaagatacacatacgtaacaaaatttaccatcttaaccatttttaagtgtacagttcagtggcattaggtactcaatccatcttattttgatgggtttcaaagtgaattggagacaacagtacacttcagtatttcagcactagcattgttttaagtgctttgtatatattgttttattcgtcaatataatcctaaggggtaggtaaagttattactgctgttttatggcatgtaaaacaggcattttagactcccaagatcccacagctagtaggtggtagttagagttggatcgcagatggctcaatggcattggtagccagcctttaggctgtacctcggtgtaccatagagcagcaggcctcctccttttgggcaccagggaccggttttgtggaagacagtttttccatggactggaggtggggagtggtttggggatgattctcataaagaaggagcaaactagatcccttgcatgcacagctcacagtaggatttgcacttctttgagaatcatatgctgatctgacagaaggcggagctcaggtggtaatgtgagtgatggggagtggctgtcaatacagatgaagcctgcttgcctgaagctcacctcctgctatgtggctggcttcctaataggaaactggaggctggggacccctgtcatagagtgttcatgctgatgaagagatgaagtcagatgcattcctaaattctcagctacatgttactttaatccagttatctgactgctttttaacactgctgtgggcgacaaaagaagtctgctgatggaattaaaatactattgagaagaaagaggaagactacatgtaaagagatatgtcaggaccaaactgtatgagttgttacagattatactagaaggcagtggcaacccactccagtactcttgcctggaaaatcccatggacagaggagcctggtaggctgcagtccatggggtcactaggagttggacacgactgagcgacttcacttacacgtttcactttcatgcactggagaaggaaatggcaacccactccagtgttcttgcctggagaatcccacggacaggggagcctggtgggctgccgtttatggggtcgcacagagtcggacacgactgaagcgacttagcagcaacttagcagcagcagagtaatattaacagttttggtcctcaggtgtgttattttgagatgtgtagctggtaacactgcctttctatagattttaaatctttgcgttttaccattgcacttggagtgatatgcatgttaaaaatttaaatggcatctggagctgtcagtcgtatctgctaccacactctaggagctcctgaggaggagaactgatgggtaggcttgtcttttactcttctctttctcttctcttttcttttcttcctctccctctctcttttttttccgagtagtgtcatgggagtggtatcatgtatgaaggttgccaaaaggtaagcaggataatcttgg

SEQ ID NO: 35412 - DNA, 1611 bp, Bovine  19866880657429
actcttggcaatttgaagtgaataaatgatagttaactgatcttgcttatttgatgcttagtttaatttgcatttctttcattattagtgatgttgacattctctttgaaaattaatggttttcttctgtgaattatctgttcatgtcatttgcctttttcttttaagtcttttcatcctttaaaatgatctgtaaaacttcttgtgtgttataaatattagtactgacaacatttgggcctttgtttatctttcttttgtgtccaattatagctgaaaatttttatgtgataaaatttcatgattagaatggcattctcccctccaaaattgctagaatatttattcacttttccttatagtatgttatattttatcttctagaaatttaatttttattttggagcaaggactaaagtgtttatgcttcaaatgactagcaagttataataccatttattgaaatcttatttggatttttgttgggattttaatgactttatagattcacttaggggaaacttatttacaatatttctctccaagcacaaggtatatatctcttcatttatccatttttgtctcatggcctaaagttttcttcatataggatgagattgaataatagtgaagtagatcatacttccatgctgagggagagggacagtgagagaggaaatgttgaggactcaagagagaggaagggctgagagatgaagggcagcctctgaagaagagaagagatgatgtccgggtcaccttgagccagaggatgaacttctcatgcttagagaggagtgagtgaggacagggacagatgctggaccagttgagaattcctctctgatggcccatattgttttctcaaggagagaccagtggctattctgatggagagatgtggtaggctatttgatcaaggactatgaaactcagtgccctttgtggacactaaccatgcagcatacagactcccttgaaaggaaaggggtctcacgcgtctgaatgtgctttctgtttcagagttgtggaaagtaaaaattcagccttcccaacaggaactattgtgctggctccttctggctggacaacgcattccatttctaatggggaaaaactggaaaaggtgcttgcagagtggccagacacgttaccactgtctctggctctgggaacggttggcatgcccggggtgagtttcatgggtatatttcactcgtttgaatccctgacgttttggttttccaaaatggttggtccagagcttgaataacaagaagagacttgaggcattctaagctcaggagtggattagagaggatgatgggactaagaagggaagaagaggggctggaggggagagaggagggctcaggtacaaggaggaagtgccagtgaggaacagcatgcagcatggtccctctcaagcctccggcaagtggtgacacaaagaaaccagctccttcagtccctggaaaggtcttccttcacccctcactcatctgcctctgtttcagagcttaaaagggagagaaagttcaatgtaccttggcctttctgtatcacctctgattcctcaccatctttcgacatctagtttccagaggtgtc

SEQ ID NO: 35413 - DNA, 1115 bp, Bovine  19866880663545
ggttagtatggtccctggcacactgtaaggctaaataggagtggctactgttgttctattaatctttggtttatgaccatagtaatatgttaaacacatacttcaggttggtggtctttgtttctctgatcgatatttttccttcccttcatttatctacagtgcaaattgggtatagtgaaattcatagaagctgagcaggtgcctgagctcgaagctgttctccacctggtgattgcttctagtgacacacgccacagtgtagccaccgcagcagacctagagttgaaaagcaagcaaaggtgagttccttccccctctttaaactttagaaattgaaaagatgctagatttctaaaagcttgctcagcacatattcttttcagcttttgcgtaatgaggcattcaatttatgagattgtgaaatatacctaatttgtatgaaagacagtttgctgaggagcagaattctgtataaggcaaagaggaaaagctgtttggagaagcagtttaaaattggaatggataaggataattaccataagaactgagacctttgtttaggtaaatgaacttaaagaactaatgttaagaaaaatgtcgaaacccaaaagttactcatttttgattcttcctctaaaattctttgagatggcttttaataaaggatatgtaggtattatggttaatatgaaaatcaggtcccatgaaaagagatactgaataggtcttaatatacacaggagaaaataagtgtaataaatagactcatggaaaaaattgtatataagaaatcaaatcatgcacaataaaacaatagtatgccaactggtaaataaaattgtgtaacagctgattactccatttaagtttctgttgaaactgctgtgcttataccctgttaattgacactgtaaactgaaataattttggcaaagcagtttgtagtaggtaatgaaccataaaaatacttacttttttttatgtgaatcttctgggacttcatcctgagaatcattcaaaagaagagaaatatttagaaaaatgttacagattcattaattgtattatttcctataattgttaaaaaaggaaacataatcagatttctacag

SEQ ID NO: 35414 - DNA, 557 bp, Bovine  19866880668049
ggtgtgtattgcccatgcatacatatacacatacacagatgtacatgtacctatgtatgtagatgtgtgtatatttatgtgaacagtatgaaaagaggacacattaaacattaatatcgtgtatcagtaagtgatattttcacctctcttatttaaatccaaattgtttgacttcaataaatctttaaatcttggagttttaggaaagacagtatttatttgagaataaagtatacttttccctccaagaagtacatactacttctttgtaaaagtgataagaacaagagtagtcaatcaaattagaaattactgactgcttgctatatgtaaacattattttgtaccactgtttattcaagtagtttatgtaagaataatagactgtccacccaatcattcttaagttcattaggaaaaggaatttataaacatcatacttctaacataaacttctaattgtacacgtatatttttggttttgtcttggcaggtgtattttggaacctctcatccaaggtcctatatctctgccaatgtcactggtttcaaatgtg

SEQ ID NO: 35415 - DNA, 753 bp, Bovine  19866880726947
tagtatcgtataccacaaccaaaaaagcacgactttatgtgctccaggagggtcatcatgggtttgttttatttgtgaaaagaggtattgagaaaggcatcatcatggtaattgggtattcctaattctgccaatttgacatgcactgtgatggaaaagccgttaattctgcttcattctgaggctgagcaagaatatggtgtcaggttcactcttgggtgacactggatagtcctgtgattgaagctctaaattcagattgtaattctctgatattatgagttcaacatccacgagtacctgagattttgtagcttcggtccaaaggtacattttgttgctgtctttcaatttaactactggattcctcttcgcccagtcatgctactgtttcttggtgtgtactttgctgctaatggtgtatgatgccttaattcatttaggtggaattttgagtgatgaaatgaatggaatattttgtaaaccaaagttcaactttagaataaacttgagtttatttttgctatttcacatatttttgttccataacagaaaagtggaaaattgaaaggttgggtaaagggtttaggagagaaatgaggacattatctgcgcctagattctttcttcgagcttttgggcctacatggatagatgtgttaatttacaatagactgaaggcaagcaggtcaaaccacaaatgctgggatttaaataatgacttaaataaaaagctttccagagtttacagat

SEQ ID NO: 35416 - DNA, 923 bp, Bovine  19866880796927
acgcactattactgtacttttctctaagtctgaaattatttccaaatacaaggttttaaaaaatactgatcacaaaggctattctaatctagatgttgaaatcctaattagtttcaggttaatactttccagtttgggggcacatactgagtctactaaatagacgagttcagtagttggttccatgaatttagttcccagcacaaggcaggacaaaaatgaaaacccccttatccatgtcaaaaagtgaaagcgaaagccactcagtcatgtccgactctttgggaccccattgactgtacagtccatggcatctttccaggccaagaatactggagtggtagcctttcccttctccaggggatcttcccaacccaaggatcgaacccaggtctccggcattgcaggcggattctttactagctgagccacaggggaagcccaagaatactggagtggggagcctatcccttctccagcagatgctcctgacccaggaatccaaccggggtcatctgcactgcaggcggactctttaccatatcagtttaccactcacctaaagaatatgtgattgatttacaagtttcaaggagaatttcagccagagcctcaggatctgcatgttcttcttctaaaagcattaatctgtacaaatcagagagcaagatccaaatactagttatttcagaaacattctaaagcctttctggcacaaacaactcctatctgtatgtattactttatgatgtcattttagctttttgaaatttaacagaattccactgattatacataagatgctaaggggaaggggaaagtaaaataaatgactgaactatgaagcgaattacccctgaaaaaaggcattcatcgcctgtaggactcccagctgcactttccatgtgctgagtttcagccgt

SEQ ID NO: 35417 - DNA, 1359 bp, Bovine  19866880826555
tattcaatctaactggctaaaatgaaacacagactgaagaagagattcttagattctgctaagaacttcatgcaacatgaagaagctatgactttcactacaaataactgcatttaggataaatatacctgcaaaatgaaattttacctttaaaatcagttacataatagttctcatgtatatgaaataggactgataaagttttcaattattaatactacatgacaaaggatgcaattttaaaaagcagacaaagggatcataaaaatgcctgccttccctctgtgtgttcaatacaactgacttgcaacaagagctacaacagagaagatgcaagcatttactgcagctatgagagtcactacataaagatttatagaaaaagtgttcaaaggaaactgagaacaatactcatgtctaggaataggagactagtttaaaacatattatgtgatttatgcattatttaatacagacatttaaaaagacattattttaaaacttgacattttgtttaaaaaaatgaagctcaaatagtatattatataaaaatgtaatgtgtaaaattacatttgtgtacacacacacacacgtatatagagctggtgaaaggtgaatgacaaactaaggtggtgggattccaagtaatttttaatttcttgttataatattctgtattatttgaatatttacactatcactaacactatcatttgaaaaaaagaaaaactgtttcatctgaaagaaaaaatgtaaaaaacaaaagggatgtttaaaaattagaggaaaacatctttcatccttgaaaccaaactcttcaaggctcaaccatgaaatggacaaaagacatacagaagcccttaggaattagcaaatcatgaccagtgtaagattaccatttaatgttaacactgattctccagcactgagagctttaacactcagagagacctaaatgcaaagcctcctcctaggagtgagactgtggtaaatctccaaactcagttcttcttacaaaatggaaccaataatttctatgccttgtcagttctgctgtgaggattaaatgagataatgtattcaaagtactcagtatagtgcctgtcacataggccacactttaaagagtagcttctgctagtatttacctttctttctttcttacatcacagtttaagaagaaaaaagatctataaaatatgaagatttaatctaatcacacagaacccttgctgaacaaatcattctataaatttgtgagcggcaagaatgcccacttcaattcttccctttcctgggaacactgtttgatcagtgatcacttacatgccagaaagaaaaggaccaaatcatttagac

SEQ ID NO: 35418 - DNA, 1479 bp, Bovine  19866880852254
tttagctgtttctaataaaattttccttaaaattccaagtatttttttttctacagatgcatataataattctagcatgaactattgggcctgaatgaaaactgcacatgtttgttaataattttccattttcccctaattatgaaaggaattcatggtcatggtagagaaattgaaagttacagatatctataaagaacaaaatagaaagaatcactggatacttacatacttatgtctatctagttgagatcatacagaatgtagttttgtatattaatttttatgtgatattatatcctgagcttttgctgtcatcattacagatatttcaaagtatgaattcagtcagcttataatatcgtacagcagttttttccttcacagttttccataaaatcttagggattcatagagttgtcttggggccaccacagagcttgggaagtgaaagtgaaagttgctcagtcctgtccgactctttgctaccccatggactgtagcctaccacactcctccatccatgggattttccaggcaagagtgctggagtcggtggccattcccttctccagaggatcttcctgacccagggattgaacctgggttttcccgcatcgtaggcagacactttaccctctgagccaccagggaagtcctacttagaaaagtcttcttgccacatgcctacatgtcaaaatccaatacctctttaaaagtatagttgaaagtttctccttgatgaagactttttcacctacacatctagaattattttttttctgaatttatacaggattttatattatacaagaatttcctccacatgcaaaagctgacatttggggaagagaaaagttaccttttgttcagctatcccatacaataaagatctttagcatcaccagtccttgtccactcacctaaaacacctgcctgtcaccatggcaacccgttattcttatttccaaatgccctctaggaaggcctggcaggttgcctgcccttgggaaccattggcctaatcatccattatcagtcagcacttatgatctttgatctctactgggttataagtccctaaaggacaagggattaagtcctttgagtatcctaaagtgtgagtcacacacaacttcctctgcaatcaaaattcaaagctgaatgaattacaatatcccaatatggtaaagtagaaaaagcactggatttataggacaagaaagttacttgacctctttgattcaacatctgttaaatgggaacaaaatagggtaatatctgaatagaaccttccaccgcctaacagagactgcgtgcatggcacaagctagcttcctccagtttcttcttcctctccccttttcctttatgtcctttcacattgtataaacatgaatatcctttttcaccattaagatagggaagagaggcaaaggggtcactaaagtcccatttttatatcagccactggaccca

SEQ ID NO: 35419 - DNA, 1206 bp, Bovine  19866880923373
ggggcagtgactcttggttgtctgatcagtcccttttcagttgtttgaggcaatcacaaagaaaggagattaagctgtaacaagagacattcagtaaaaactacgagaatagttcacaaactcgctactgtagcagagtccattcctgatgtgatacctgcaatgttatcaaataacaatattcaggtcatcattgctgcaccattttccctgttccccccatttctcagccattcccaatatccaacttctacaagaggtcaactagaccaaactcccagagatgaggcaaggtctgctgtgtccactgctaccttcccagtgcacactgtgggtgtcaagtgagtggttgttatggaggaagccacttaccttgagcttagcgatctgccccacaatagagcccactgctcctgctgccgcactaaccagcactgtttctccacccttcactccacagatgtccaacaggccaaagtaggctgttaggctgagggaagaaaagcaagactatgtggataaatgtgtttctttcctctgtatctcatttatttataccctgaagaccttctcagcagcccaatgccatgggtccaggtaaaagacagaaaatataggaaatggatgttaccagctaccaatggtccacttcctccttccttacctctaggagaggaataaagatgatgggaactatggatggaacagtgaggtggctcaaaaagagcagtatcttgtccatccccatgagagagtcagttcctaggcaggttgatagggagtctaggggtccccaaagagaggggtctggaattctcaaggaggaaaaaaggacaaactttttttctttctccacattccttaggattatataccaataatgtatcctgcctaaggacagtctttggattcaaccttctgttattttaaaatgttaattatgggagtatacctggtctttacaaggatgtatcttgcctgaggacagtgttatcttaaaatgtaaattatgggagtaggtcggaggaggtctttacaacctccagacattctttggattatataacctcattgttaacactagcaagcgggtactctttctgcccccttctgatgcctatgtcagaagctttctctatctcctttatactttaataaaactttactacacaaaagctcgagcgatcaagcctcatctcggccccg

SEQ ID NO: 35420 - DNA, 1963 bp, Bovine  19866880941930
cgcataacactgagcaccgtccgtagtgcctcttggtgtttcggtgcggtgacgtgtcccctctctcctactagattgggagctctttgaagtcaggagctgtttgcttcgcctcaggctcctggtgcccacatagtgcccgcattgtgatttgcttctagcctgctcattttttaggttgtcctgctgccagagatatttttctaaaatactgctttcgttgtgcttcttcggtaatctgcaccatgagcgtggcatgttgggctccccatcgtctatccctccctcagccacaggagagttgacgctgttcactttctctcctctcccatttgttctcctcctactcttctgatttggcagttttattttctggaccttccattacctctgtaatgtgtgtgctcggttgcgtatgactctttgtgaccccatggaccggagcctgccaggctcttcagtccttggaattttacaggcaggaatactggagcaggttgccatttcctctccaaggaatcttcccggcccagggatcaaacccacatctcttgtgtctcctgcagtttctttgtcatctgataacatcctgtgctgttgagcgtgttgtgttgttattttctcagcttgctccagtcggtagacagtcttacacctcctgttgttcctctgtctggtgtctgggatggtagtctgtacgatattagctgttcagtaattgattggtttacttcctgtgtactgtcagtcttgcggtaacttaagaaataaatgaaaatctccttttacagttgttaaatcaggaggcagccagaattggcaggtgatgatggctttggtaatttaacttggaagtccagatttaacttaggcacacaatgtacccaagccagtggtccctcatgttttccttcccagtgagaatttgcattgtttatatataaatattaaagtggtccttcaacaagtttttaaaaaattagatgaatttaggaatgaaatgaatatgatatatagtaatgtggaatagtttactgtgctgttaggctcctagtgtttaatttttactataatggatattttaatatcaaatctgggaatttgtcagcttagaattttagatttcagagggacttgaatcattatttatatcaaagttttcattttgtagatgagaaatgcttaattggtttaaatgtttaaccagtttaattggttcaaaatgaatttaccagaaatcttatttttaatctgtagaagctaaaaatgaaataggatgataaatcagtaaataagtatttgtgaagctgtacgctttgaacgtataatggaaaaagctggtcctcattatgatttttctcctttgggtccttttgaattttttcattttgggggcagtatatgcttctgtggtaagtggtttggaggtttcagtgggtgttgtgatggagagatacaagaagtttaaggagaattgaacagaaatgggaatgaatataaaattattctctgctttgggtataaaacaatagcttttttttcttttaatttccattacaatcaacaaaatatagtgggttcatagtgatttttagaataataatttatggattgagtgtgaacagaatacttatattcattattggtaactgttatggttcatttgtagtcaaattgagcagatatactccagtggttaatttgctgaggatgtggataccttttaaagatacctatctttaaaattctcctttatgatgaaattttaatttcaagtgtttattcttcaacaaaaattctgtgggaggaaagtatgtaattgaatgtattacatatacatgtgtttgtgtgtgtttttatagaggggttaaattcccatttcctttccagatatgtgttaaatgaatcccagagtcgccaaaattcatcttcagcacagggttcttcttcaaatagtgggggg

SEQ ID NO: 35421 - DNA, 968 bp, Bovine  19866881011464
gatttgaaaaatacatggagatttgcttccatgaaaaaaaaaaaaaaagacttaaaacagtgcttgttgaaaaatagagaataaaaatgcatatttgtgaaggagtactgattttttttcttttggcattttttggttataaattcacattgctgatacagccaatatacaaaccacagttgtagcaaccagagcaagaaacaggatatgaccccctttataagatgctcataatattcccaaggagtcagggcaaaagtccattcatctgcattttattcagaatgttcctttcttttgcttgtcattttggaatgggcttaactgttgctaaaaagttacaggaacaacagagctagaaatcatctgtttcttcacaaaacaagttcatcccagctcagccacgtgatcttcccctgcagtgcccagccctctgacctgagtcttgctggaacagcatctctttggggaccgaaaaagaattcctgttctaagttcttcatgttatttctttcaagtttggtgcctgctgcaatactgagtcctcctaaaccagatactgaaaagtaaaactaaaagcccaaatccattcaacagagaactcactgtgcagatttgagataaaataagccacaaatatttggggcagtatcaggatatacattgcacaatttaaaaaaaagttggtcggggatgattggaatcttctcaccggcagaactggggtagttatgtgaccatttaaattgcttccaacattttattcacacaaatctcagaagattcttaatttcaaaaaatattttttgtattaatagaatcagctctgtttttttcccatcaacacttaatacagttatgtcaatttagaaatattttaggaatgatgtgctcttattaatttccactaaaaagcatttattaaaaacatgcatttgttgatgcagttattatacacaaccagtttt

SEQ ID NO: 35422 - DNA, 869 bp, Bovine  19866881049422
tttattgaaactagaattgacaaatagaattgtatatgtttaaggcatatagcagaataatttgatgtatgtttaaatgcgctagactaggtcttgctccctcctgtgaagcccatcttaaagtaagtattttgagtaagtggggctggagttcttcctgagacagattggttggccaggctgtaataggtgataagcaagaggaaggaggattcagtttcttgattataagataactacctaggctatcaaccatacgtttttgttgaaatccttgaatacttcttttatactaacttgcctttctctcattgcatcagaattttactataatttatgttaagatgggctatcctcggctaccggtggagaaacagtgtgagctggcccctacgcttcttactgccatggaaggaaagcctcagccccagcaggacaggtatgctgtccccggttacctggttccccacctctgagagtcagtgctgccgttcaaaaacagatccacacatctggtttcacctggccaaatgcaaaggcttaattaagtcgaactctttcagccaacattgctgtgttacctcaacatgactgtttggttaattttgtaaattataaaatatcttgtgagcatatgggaaactgtgcagaacaattaacatttttttcaatctaaatgcattttcagtttggtcagttattttgaagcaactgattttcttgattgcaaaaattagagcttgtgattgcaaaaattagagttctaatatgcttttcatcaaacctttctgtcttggaggatataaagtttccagagcagttttcttaagaaactgattacgcgtttgtattcacgtgggaattgacga

SEQ ID NO: 35423 - DNA, 1518 bp, Bovine  19866881087663
ctaccaaaactacactcccatatacatttttaaccatgtttctaaaccctactgttcattctaggtccttcctcaaattttagccttgtattttaaaccactcaattgtcattctataataagcacactgctataaaacttcttctcttggtggtctagatgttaagtttagccttccaccctgagatttcaagcccactgatgcccacttgaggtccctaccatggatattctcaagtcatctgcccatctcagtcaatcagtgcctgtatatgcccttaacagaaattatcagcatcctatcccggtgtattcagtgtaggaagagctgtattttaggtactgtcacaaaggaatgagtggaaacaaaagaagctaacattttatcaacccctaaactaacccacttgtgatctgagttcatatgtaagttgtagttcattttagttaagcccatcttcatggtaactggttaattttttgctaaagtgatttatatccatttcctcttataaaatcatctgcccctcccataagtccttttaggcaattttaatccccaatgttttctcttgggacctatttccttcggctttcatactttctggtatactgaaatagtaagtaaagcttccaaaagtgactaacttcagatgttacacatgaaaagagcagttttcagaactgtcttaaacagctcgttccttccttcaaatgatatctaccacagaaacttgatgtacaaaatggctaaaagtagagtggctctgtcttcagagatgagagaatctggatggatggggcttgtgcttactcctgacccttgggctgcccagaagaacctttccagaaatctagaaatctacagaccacatttcgaaaatacttgtgctaaaggaatccgaattctttacatatcttaaatatgttgatgatttttactctaatttggagaccatgccatgcatgcatagaccaaatattaaaatcaaatgaacagcaaataaattgatatagaatcaatgaaaataatactgcaacaaataaagaagccaactacaaggtgtgaaaactcaagagaaaaagtagactcttaaaaataataaaacaatttctagaaaagtgaaaggaaaattctggcaactagttgcatgatgttctcaaagatacatgaagacatgatttttataaaatagcaagccttaatgaagaatatagttaaatgacaaaagagattccaaagaaactagagaaaagcacaagtccattatagcataacaaaattaaaatctccattgaaggaagtaaacagcagatatgactttgaataaaactataacaataatattgaagacaaacatggcaagattccctgcacagaaaggtgatgaaaataaaaattataattatgacaatgaaaaaaataattttgaaaatagggaacgaggagagatcatccagggagaaaccaataagggaaacatggccttaaaagacacgttagagcagatggactta

SEQ ID NO: 35424 - DNA, 1843 bp, Bovine  19866881130119
ccaagggagcacaagaattagggaaattatacaaaaagcagattttttccccccagttctctttgtttacggctgattgttcaacattgcaaatagggcatgagtctcatccagttggaattcaatgccttgaccttctaatttgaacctggaatctcttaatgcaacaactacaagccatgaggcaccaatgtcatttgttggtcagtaccacacagttacaggagtcatgactgtatcttggacaattgaagaaaaactaaaacttgccctaggttttttaaaaattctgtaaaatacttctggattacaatgacatctggctagcagttccccattgagcttgtctgcttcttacataaaagactatgaaataatggaaaaaaaaaacaagaaaaacaatatagccactttgctgtacgctagaaattaaacccaacattgtaaatcaactatacttcaataaaaaaattttttaagactgtgaacacactggaaaaagatgaaacgatcaagaaccaaaattaaatcaaataactgcctcttttcaacaggtcgctcactgcttctagcaatgcaatactagtgaatttcttgggcacatactctgtgacatctttcaccatttgaagtaacatggatgggcctggagattatcatactgcctgaaataagtcaggcagagaaagagaaataccatatgataccatttatatagggactgtaaaaaatgacacaagaaaacttatttacaaaaacagactcacagacttagagaacttaggttgggggagggatacactgggagtttaggactgacatggactcactgctatatttaaaatggataaccaacacagacatcctgaatagcacatgaagctctgctcatgttatgtggtagcctggatgggaggggattttggaggagaatggatacatgtatatgtatggctgaatcccttcactgtttacctgaaactatcacaatattgttaactggctatactctaatacaaaataaaaagtttacaatataaaattaaaaaaaaatagatgaccaacaaggacccactgtatagcataaggagtgctactcaatattctgcaataacctaaaagagaagagaatttgaaaaagaatagatacatgtatatataactgaatcactctgctgcacattttgctgcaacgcaacactgttaactaactatgcttgaatacaaaataaaaatttttaaaaataaaaataaagcaaatgtgcagtgagattatgggggaaaatggagaaagaggatgtacagcacagttttttctcaatttctcctgaaacatggcatcatactgctcttgaatcccgtaagagttccctgctgctgctgctaagtcgcttcagtcgtgtccgactctgtgcgaccccatagacagcagcccaccaggctcccccgtccctgggattctccaggcaagagtactggaatgggttgccatttccttttccaatgcatgaaagtgaaaagtcaaagtgaagtcactcagtcgtgtccaactcttagcaaccccaaggactacagcctaccaggctcctccatccatgggattttccaggcaagagtgagttccctgcatcatacagcaaattcccgttggctatctatttacatatggtaatgtaagtttccttgttgctctttccatacatcttaccctctcctcccctctccccatgtccataagtctattctctttgtttctccactgctgccctgtaaataaattcttcagtgccatttttctaggttccatatatacgtgttagagaatgaagtgagtcaaaaagag

SEQ ID NO: 35425 - DNA, 3506 bp, Bovine  19866881155001
tataaaatgttaatgatatgggaaattaggatatagaatacagggtatatggaaagtctctgtactctctttggaatttttctttattctaaggtaaagaatggtttactattctgtattattactgtaacacaaaaggggggagggagaagaaaaaacaagtagatgagagagaaagacaattcgcttgttagttagaacaaaattagtgaactagtaggttcactccgttagaagaaagcattagggacaccggcacagtggtgtctgttgtcagctgtgatcatatttgatttcaccaacagagacaaagaggctacacacttgggaactctaaaagcatcctgctcttcccagatccctggaaagagcccagcccagcactccaagagtgttagactgggagagatgccaaactccaggggctgccagacgagcagtctatttctttaatttggagacaatcataagccagaagttagaaagtgtgggaccacttttctccttggaaatgaaaataatgcaccttgggattcagatttctgttgactaaagctccacgtggtgttaggtgggtaaatgatcacagcataggacaacggggctggcctcctcctcaggacctatgaggtgtgcctatgagaagactgcattctcggacctggaagagctgtggcccaaacacatgcccctgtaatgctcattcactcagcagtattcatctagtgcctatattgattcagaatattctaggtgccggggatacatcatgaaaacagaatgtgtgaacactgatgccctcatggaggttacattcttgtgaaagggagatgggcgataagtataatatatgagttatagtatatattatgtcaaagatgataattgctatggatcaaagtaagataaggaagatcaatgagtgaaggtggattgcaatttgaaaatagggtcattttcaaggctgtctcattcagaaggcagttttcagcaaaaacttgaaggtgtgtgtgagacagaattgagtaagcaattacagagaggtggaggagtgtggggatgaacaaaaagaaatgaaattagagaggtaatggagaccaaacagtatccagccttgcagggtttattctaagagaaatgaagagttttgtagggttttgaacataagaatgatttggtatgaagctcactctggctgctctgttgggaattgcctgcagggtaaaaaagtggaaaagctgagtagaggccaccgcaatatctgggctagacaagatggtggcctagaaggatggtgggaattgaggaggggcaactgggcagattctgaatgtatttccaaagttgggacaccagaatttcctgacagattagatatgtgtatgagagaaagaaaggagtcaaagatgatttcaaggtttttgaattgagcaactgaaaggattgtcataactgagacagtgaagtctgtacacagaaagcaagtttggcaggaaaaatcaagacataatttggtttttaatacattaagacagagatgaaaaagtgtgctacacatccaagtgcagctattgaacggtccagaaatcagagaagagatctcgactggagacagatagttgggagcgagcagcatattggtgatatttaaagccaagagcctggatgagataactaagggctgaaaagagtatggacagaggtgaaaagaggcccaggaaccatgtattggaaagctctgctattaatttggagagaagaaaagaagctagtagaggagtctgagaaggaccgatacagtgaggaaaaccaagagccaagggaagcaaggagagagagtgatgccctctgtcaccactccctacagccaagtgatgctaagagctgaacacaggagtttacatgtgaggggcattggcaaccttgacaaaagcagtgttggtggaagggcaacagtgcaaaacccgacaggcatgtttaagaaagaatgaggagggacatccctggaggaccagtggttgagacgttgcctgccagtgcaaatgatgctggtttgatccctggttggggagttaagattccacatgcctcgcagccaaaaaaaaaaaaaaaccagtatattaaaaaataaaaaacaatattgtagcaaattcaataaagactttaacagcccacatcaaaaaaaaaattttttttttaaatggagaggaactgcagacagtgagtgcagacaagacttcaaggtgttttgttataaaagggggagagtgcaatgaacccatattcacagcggaagtgaaatctgcaacccccacaggaagggcatctggtgtcacagtggctccggggcccctcacctctgagacccacttcagcaagtctctcagagccttctggcggacttctccttgccagcggtagacgacgaagccttgcaagtggagttccttaaagatgatgatttccggggatgggcctgtgaagaggagggcacgtttgagcagcaggatgcagggaggtggccgtgatgaaaacgtgcatggtacaaggcatgtcagcattcccctagtgctctccctcctgtgtcctccactcttcccgacccacagggctgccccaaaatcaatatgcactctgtgcaggcagagtaactgccccaagacgtccatgtcctagatcccagagccttaactatgtgaccttacatggcaaaagggactctgcagataggaccaagttaagaagctttagatggcaaaattattctgcattacataggtgggctcacatgagagtccttgtaaggaagaaagggatacaggaaaattagaattgagaaaaaaatatgtgatgatggaagcagagatcatagagatggagggagatttgaagaatcagtgctgctggctttgaagacggaagaagggaccatgagctaagagatgcacgtggcctcgagaacttaaaaaggcaaggaatctgagccttcggaaggaaagtagccctgctaacccatttcgagttctagaactgtaagaataaatttgtgttgtttcaagtcattaagtttgtggtaatagacaggactgagcacaactcacagctggaagactcaccccagctatatttctcttgggttaaggagtggaatcctcatctcctcatcttggaagaggatgaaatactattcctgggattgtccacgctactggggatgtcgtttctttattgtgagcggaaaacaaatatggcatgaaagccgggggaaacaattacttgtctctgagctcccctaatagtgaaacatgttagagttcctagagatcaccggcaggcagactgtcacctgcttaagatggaatggacaataccagctgacatctcataacctgtctgagcagatgaatttcaaaaggctagatcaagttactgtatccaaaatatttggctgggtcaggaaaatgcaccctggagctctgctcaatggcaggagaaggattccccag

SEQ ID NO: 35426 - DNA, 923 bp, Bovine  19866881183575
ccccttggagtgaatatgacctcctcttcgcatttgactcccatatccaatctgtggccatgtttacaattctaactatgtcctcacctaaatgatttaaaaagaaaacggcagtattattttatttattgtgtttttacactagaatgctgtgttctccatatcttaattttttaattaagaaataatttcctgttgagtgatattcagatttttgacagcagcacaaagtcttcaaagaatctcttatttctcaccaagaaccatgtatcctagtcatatctgaatagtctccattgtacagattcactcccagacctttaattatgttgtttcctcattatatgggatgctctcaacctggagttgtcaaggttttttggagacttggctgctactatctgcttttacacccatgtctccagcatttagcacaatgcacagaaagagctcaagaaatgtttgttgtattaaaaaaaataataataaaaataaattactcattccttggtacagcatgttttctttaggttgatggtcaccgtagaaacaaattcctcagtttacactgactggccaagaaaagagaagatgtgaagaatgacaaggaagaactcatgacaattgtcatgctgagaaagaatgagaaactcttagattcttctttctcatggggttaaagaactgtcagaggtggaatgaagcaactgcaaatagtttgcttccctattaatccttcaggggaagaaaacctgttctaagtagaagatggaacagctgctgctctaccaagtgcattccacaaaagtcacaagaaaattgatgagaattcaaatactctgataacagtaggaagaagctgccaacgaaaaacaccaggagaagagagttggagacttttagagaactaaagaactaaacca

SEQ ID NO: 35427 - DNA, 1300 bp, Bovine  19866881231116
aagtgactgggtagaaaccaactctccttatgagacctaaatcccaagctacatatgtatcaggagcatcagaaaaccctgcccccaggctgtttcagagcagggcacctggtgtggatagtgatgttcactctggagctcactctgtaaagcttgtgcttcacgcagtctgtgttctcactctggtttataactccctggcctttccatcagaggattactatcaggagaacacaaagctgcttcctacaacatacagtatcttgggagaatgagaaaaagggcccattctctggggccttagcctcatggattattgagcagaacatgggctagatttctaccccaactcacctccttcagacactctatattcacagcccaacttgcacagccatactgggcagtggcagtggccctctgttcctccttcaaagagcctaggtaagttaggggagtcttttcatccatgaaccttaccaaccaaatgcggtggaggacagggtgttactcaagcagatgcacactgatgggaattactcaattttaatggaaatttgttccactcattcctgaggtagagtctaacaaaaacccacttcagctcctgatgttggggtctttcagactttcctaaatgggaagttggcatgttattcttagcaccttctctttgaagtagtatctggcacacatatctcaaatgatgtctggtgagtgaaggaaggaaaatgggaaaaaggaaaagagggagggtgggaagagcagggaaggagaatcctctgagacaaagatcatgtctatgtgatgaaaaatatagagttcccagatcaaccttgggccatgctatattcaggtggctgatgcatgattaattgggctgaatggtatgtctggatggtaataatctctatatgtctctctcccctaccctcagtctgaaggtctgccactgccagacaaaacttgaatggatgtgttaggcacctgagagacaggaacacatcacttaatagtaggctttctgtgtatgacgctttgcttgactagtaagcacatggcttcctgaatggtaggttcctcccaaacaccgtgggttgctcttaaccacagcatcaactactaaatggagagaatctctagagtcaggcctatcagagctggtgatgagatatttggaaaacatatttgggatggcagaatgacatgctaagagagtacgaaagagagaccctttatagcaggtagaagccaaggagctcatccccaagggaaatgggcagcggcattgttgacatac

SEQ ID NO: 35428 - DNA, 1324 bp, Bovine  19866881286920
ggcagcagtgaggaaccggaggatgctgattgtaccgcccgaccgtggaatgtgaggtgtaagagatttagcactttatacggaagagggttgcatgaagaaagccattaacagacaaggtagaaagtagaaatgggttctgtgacactgaagttggaggggtgttcatagctactaaataggttccagagggctcagtggagggtttggggggaagaaagagaggttgggtcagcctgagagaatgcacagaagcatgggttttgtagtaccagaatagaaagattctctgcatttcctagcctggggtaaattcaagggtgtcaacagctattcttctgtctgacagtgtgtatagcattgtctgcctatgaatcttccttgactcatagatccagttccaaaggtgaatctgggcagagtcacaatatatttctctgggtggggcttagaattaaacattctttgagcccctgaatacaaaactggactcccatgaaacatgctaggcactcatgacccaggagtcagttctcatctttggagctggctgctttctagacactggatgccagttttgctccaaaggccccactggctggcctctgatgctcttggggacaagaaacaaggacaggctgcaatggggccagatgattttctgaatgtgttgacattacctagttacactggatgtccttactggtttaggaatgttcacctttgcattgacctcagctagctgtgttcctgtttgctttacaacttggatttctcgttaatgacaatctttgttcttccatataacctgtcctatatttaaagtacctatagtactttttgaaagtaagtagataggaagggcagagaaggcaatggcagcccactccagtactcttgcctggaaaatcccgtgggcggaggattctagtaggctgcagtccatggggtcgcgaagagtcgtacatgactgatagactccactttcacttttcactttcatgcattggagaaggaaatggcaacccattccagtgttcttgcctggagaatcccagggatgggggagcctggtgggctgccgtctatggggtcacacagagttggacatgactgaagcgacttagcagcagtagcagcagataggaagggagtggtaatcaataatgtttacttaagtcagctcacatattcaaaacttagcttcttagcttttttctcatctccataccaattcttctaccttgatttgttgttgttcagttgctcagttgtgttcaactctttggatcccatggactgcagcatactaggcttccccatc

SEQ ID NO: 35429 - DNA, 1526 bp, Bovine  19866881287807
tgactcaatcaatgccatgtctagcacagcccacagctggtactcagtaagcacttggtgaatgaatgaataaaagtctcattttaaaccctcacaacatgcaaaattccaacaataaaaaaatgccttttgtctgaatgacttaacaatcagatagcaatataaatacctccacagaatccatcagaccttgcaagaggagcttctggtgaggaaaatctcccatccccaactggaaaataccccagtgtttggatagctctttctttcatctggaagaacagagaaatttttttttaaatgaactatataacagcttggccccagaaaaatgtcttctgggagaaaaatgagaaggtagggtggaggagtctgtctaactaaatgcatcagtgttttttttttaagcattcaattttacagaattatgtatataatacactggaggttgaaagacatgaaactaagtttattaagggtccagcactacaaaagaaggaagcacagtctttagctcagtaccctacaaaccagaacagttataaatgtagactctgggcccagaagaacctaagatcgggtcacagctagaccatttttagtagcctttgaggctgtgtgacctcaggcaagttacttcacttttctgaattttcctcctctgggaaaacagagatgacaagcatacttactccaccagaccttctgaggattcagttaacaaaagcatgtgaagcactcagcatatgcttggatggtaatgactagctaatagcagccaataaaaattacattgcgatcttctcggtaagttttaaaaaatagctagattgagaataagattacatatttattaaacttgtagtaaactgagtttttctgttcattaaatcatcttacatttcaacactgaggtactcttatcccaaagaaaaattttaaagtctgtgaaggtttttatctaaaattaaaatactataaagatcctctgggcttccctggtagctcagacagtgaagaaactgcccaaaatgtaggtgacctgggttcgatcccttagttgggaagatgccctggagaaggaaatggcaacccattcccgtattctggcctggagaatcccatggacagaggagcctggtgggctacagtccatggggttgcagagtcagacacgactgagtgactttcacattcacattcaaaggtccttttcctcagagatgactcacactgcttactaatgcccaaacttattaaaacccacctggttataaggaggctaagatttagatctggtctgaaattataaaaatcatataactatttaacactttattacctaccttttgcatgacagaagaataaacttgatgcatttaatctttacccaaatcttaacaagttatgggccttaattggagtaactgagtcaaaagggcacacataacaaggctatatacaaatcacccacaactcaaagttaaacagtttttagaagagaagggtaaaagtaagagacatgc

SEQ ID NO: 35430 - DNA, 2087 bp, Bovine  19866881324017
cccctttcacttttcactttcacgcattggagaaggaaatggcaacctactcccagtgttcttgcctggagaatcccagggacgggggatcctggtgggcttccatctatggggtcccacagagtcgaacacgactgaagtgacttagcagtgagagactttcactttcacaccaatatataaaatagataacaaataaggacctatgtatagcacaaagaactctactcaatactctgtaatgacctgtatggaaaaagagtcttaaaaaagagtggatatatgtatatgtaaaacttattcactttgctgtacgcctgaaactaacacaacattgtaaatcgactatattccagtaaaaaaattaataagaaaaacattcacataagaacatgtcatccccagcttaaaactgtctgatgagtttgcgttagtgttggaatagaatccacgtgcctgaccatggaacgtgtagtctggcccttgcctgcctcactgacctcatcttcctctgccctctctctttctctctaagcatcagctgcctccctaccttccttgctatttctcaaacgggtcagacttgtttttgcatccaggtctttccatctgggcttactcatcctgagacactctctccacaggttgtcattgttgtgtagtcactaagtcgtgtctgattctttttcgaccccgtggactgcagcctgccaggctcctgacatgggatgtcccaggctagaacaccggagctggtggccatttccttctccaggggatcttcctggcccagggatcaaagctgcatctcctgtattgcaggcagattctttacatctgagccaccagggaagccctatcactcagatttctgctcagattcatcctttcaaaaatcacctccccatcaccaccccatcacgctccatccatttcctctgtttgaatttcttcacagaactcatttcagaacttgtattttgaattttacttgtttgttttcttttcccctactaaaataggagcactctgatggcagggatttttgtctgtgtgttctgccttgaatccccaacacataaggatcgtgctagcccacgtaaggacagtgataacacagcaaagaaatatttttgtaatgaacgcatatgaagaccaatctccaaatggccagcgggtggtattggcattgagaaaatgcctggttagttaatgaaagctttagaccaaaaaagaattcaccagctggtgagttggaaggaaatgttcaatttgggcatttcttcccatggtgatttatcaagatgaatagctattcagtctcccactcgttggtccttctcctgtttggatgtttttgcattgctgattcacattagcatttcatatgttttgatttgggagagagagtttcatcttgatgagcctcatttataccttgttttgtacctgaaacacagcctggtagctcacgcaccctgtatctgtgctcatggccaccaggggacactgttgagctgtttgaattcattgagaccctgcctgcctgttttccgtctctatcccactttaaagaatttgcaatttttaaaaagtgtgaaagttctaagcaaacaaacaagagaaaaacagactccaagccctctctttaatgaagaacagatatgcttcgttgcctaagatgtgactcttttagtaaaatcgtaaaatttgaattttaccagaaatgtgaggcaaggggtttggacctggaatacgcagcagctggtttcccagaagaaaagtgcatggaatttccattctgagtgtcttatgttaagttaaatctcgctgatgggaacaagatgaaagcatgcgctttaaatatattgctgacctcagaggagaatgaaagttttcggaatgttgaaggacagaggcaagtgttgcagtgaaaacaagagggtgctggtgagaagggtggtgagatgagaggagagccgcagtgcttctgactcatggcccacacgcttccgcaggcagcctgttgatgggaattcctcagaatagccccaccattcattcatacaccctttaggtcaagggga

SEQ ID NO: 35431 - DNA, 970 bp, Bovine  19866881330499
atgcatgaaagtgaaaagtgaaagtgaagtcgctcagttgtgtccgaccctcagcgaccccatggactgcagccttccaggctcctccatccatgggattttccaggcaagagtactggagtggggtgccattgccttctccggctataacagtataccacagactatatgacgtcagttcagttcagttgctcagtcgtgtctgactcctttgcaaccccatgaattgcagcactccaggcctctctgtccatcaccaactccataaatagcatttatttctgagagttttggaggctggaagtccatgatcagagtgccagcatggtcaggttcttcatcaggaacttttcatggtttacacagggctatcttcttgctttatcctcaaatgacagagaaagggagaactcttgatatcttcatccccttacaagggcatccatcccttacatgtgaactctagcctcattacctcatccaaacctaattgcctccagatcacagtggggattagggctttgctgtacgaattttgggagacacagatattcagtctgtagcatggcgtgttgcagtcatttgcgcaccatcttctgggggactgtgcctcagtataggcctctgtggaatctcaacttgaattaacttggaggacattgtgaaatacatggcctggtaaaattctggtgtgtggattcttggggatagcattttggaacaagattccaatattctatactccctttctgggatgccaaatttacatcctttacaagaaaaaagtaaaataggtaatacttgagaagtgaatttgtttttaaaatatgatcaagaatttcagttcctgccgtcctctattgtaggtaatggaactgttggtccatctgaataagcgcataaaaagccgccccaagatacagctcccagtagagacactcttggttcagtggcaggaccctgctgcagt

SEQ ID NO: 35432 - DNA, 1315 bp, Bovine  19866881367303
ctgggacaccctcactgcactcttacaggtaagacttatctcagaaggacatggaactgtgttcagggaaagagagaaggggaagacacttctagggtacctggagggtggtggacttccacttcagactaaaggagttgactgattcctgatacctctcccccgccttggcccaatttccctccagatcacagcccctgtacctccccacgggcccagccccgccctcggcactgctctcaggggtagctgtcaagggccagtttctggatttctccgcactgcaagcaacagagctggggaagctgccggctggaggggttctctaccctccaccttccttcctctactctccagccttctgccctagccctctgccagacccacccttgcttcaggtgagaggcgggcggatgctgggcttaggggtaggagtggggtgcttgggagttgacattgtcctccctgttccccaacaggtgcgacaggatctgccatccccctcagatttttattctgctcctctgcagcctggtggccaaagtggcttcctcccctcaggagcccctgcccagcaggtactttttattttcccagtcccctttgtgcgctttgccttccaactccagcgttttttgttacttgtttggactcttcctggttttctgacattcctccctgcccccaacacacactgccctgtttctcattacagatgcttctgcccatggtggactcacagctgcctgtggtgaactttggctccctgccaccggcaccacctcctgccccaccccctctctctctgttacctgtgggccctcctctgcagccccccagtctggctgtgcggcccccacctgctcctgctactcgggtgctgccttcacctgccaggcccttcggccctagcttggggcgagcagaggtaaggtacaggagctgaagtgctagggaaccccaagactcaggggtaaggattcagtatcaggatgaagacgtggagaggcaggacgctcatgagtcttttttccttcagttgcacccagtagaactgaagccgttccaggattatcgaaaactgaatagcaaccttgggggacctgggtcatcacggactcccccatctggaaggcaagagaagggaatggggagaagccatccccaaggatttactttctttggggaccagaggggggtctgaaggttgcctcaaatatcctttctccaggtctttctctggcctcaattcccgtctcaaggccccaccttcgacctatagcggagtcttccgcacacagcgcatcgacctcta

SEQ ID NO: 35433 - DNA, 616 bp, Bovine  19866881388755
atagtttctgcctattttcaggattttagattatattacctgtcgaatccacttctactatcccagttcagacctcaagcttctgctaacttggctactgtaatatttacctttcttttagccttgctgctcttggtctctggacccttgcaatcaatgttaacatcacggccacctgttaaacttataaaaggatctactcatgttacattccctgcttaaaagcctttgatgctcctctactgtctacagaacaaagttcagactagttgtgttggcattcctatgcaagccagtcccaagctatcttcccagctttacttcctaccaccattcctcaccaagaataataatttatatagaatttaactgtctgtacagtgcattaacatgtatattaagcctaacaacactgcatttcttatgggaaagaaacagagacttagtaaggtaatataatttgctcaagatctcaaactgtaaaaggcagaaagggccaagcaccttaactccaatctttaactcctttctcagaatttcatgcagccatcatatatcagactcacttggactttctctaaaaatacatatttttcaatctctatgtcttagctca

SEQ ID NO: 35434 - DNA, 1319 bp, Bovine  19866881413057
gctgatccctggtgtatatgcactggaggatgattcttaacctgaaggggtaaagccagaggaagtggggggacggggaggtttggactgtgtgagtggactgctgtcagtggtacagccttcaggtagccttggccaccttcacaggtggtgtggaccccgagagcaagattctcagtctcccaagggggtagagtttcagtgttctgaatgtctcttttcttatttcagtctcatcttaaagaaatccagagtgcatttgtttctgttctgtcagaaaatgatggtaagttattggtaaatatttgatttccaaacttctttaagcttgtatcgtaaattttgaaaaatctagattatgaccataagagaaggctacaggaaacttgattcttacgtacttattcattgtgtgtgttaattgctccgctgtgtccaactttttgcaaccccatgtactgtagcctgccaagctcccctgctcatggtattctccaggcgagaatactggagtgggttgccatgccctcctccaaggtattttcctgacccagggatcaaacccacatcccttgcatctcttatgtctcctgcattggcaggcaggttctttactatagcgccacctgagaagcccatccattttattcattaatgaatcatttattcattagatcagttttgcatttgaaagtggagccgaggctatctttaacgttcgtagcttctactaataatagctttctcctacttaggattcattttttccctttttgatttaagctaggagagggtgcaaatatatgtattagatatttaaatagtagctttgttttataaattgtcttaaacgtgtgatataatattgagctttcatttaaaaattacccgtgggttctcctgaaatggattacgtctcgtgtgtgcaccttgcatccgctgaccgttggtcactgcgcactgcccactgaggcccagcagggttggcttgatttgtgagttgggtattgtgtgaatgcagttctcatttaagggacttggctggtgtcctgtccactcagatgatttaatacatttttttaacaaaataggttgatggtgttttcatatctttgctttgatatcatttttggttaatgttacaggtttattaaagtttttttcacttgatggctagagaacaaatttttcttaaaagaatattgttttgtctgacttttgtgtagaactgagccaggatgttgcctcaaaaggccttgggttggtgtatgaattgggcaatgaacaagaccaacaggaattggtttccactcttgtag

SEQ ID NO: 35435 - DNA, 1485 bp, Bovine  19866881524712
tgtgacatgaaaataataataatttttttgtctataaagtgacatttaactgcattgtaattgacttcatgttacaacctaccgttcttaacgatgagtggaaaaatgaaagaaagtgaaagtcactcagtcatgtgccaactctttgcgaacccgtggggtgtagtccatggaattctccaggccagaatactggagtgggtagcctttcccttctccaggggatcttcccaacctagggattaaacccaggtctcccgcattgcaggtgaatttgttaccagctgagccatgagggaaacccagtgaatgggaaactgggtgctatgacattagaatatgagtatttttaacaaagtttatctctgggctctttaaatggtcggctcctctgggcctttatataagatacgactttctcttgactctgaagcacacatgacatttagatcaagcatctgttctcttcattagtgctctgtttatgtgttaacctgcctttcatagttacgaggttggtagcctttttgaaactggtttcccatttgcattttgttttgtggtgtatcagggccttctaatgtgttctagctgtatatgccttgcagtaagtcacattattaggacgtagtaaaactgggttttaaacccagggtgtttcttctttcacatttgtgtttttgacctctgtgctatgctgccgcccagttattgatgatcatcgtggtgacaataccttaagcctcttcagagtgctttcttaaatggttctcatttcatcttcagctgttgcctgtttgacaaattagaagaccaaagcttagaaagtgaaatgtgttaccagattttctgtttagttattggcagccctaggactcaaccgcagatcacgaggtcttttttttccctctgtggagtggtagaaagtgtaggatcacttactcttcctgtggctgtaggaagtaggaagtgttttgtcagatgaacgctttatcagatgaggggtcaggttcactaatttctgtgctctttgtctgtgaggtctgtgtgaaaatgtgtgaccctgccaaaggagcagctggccagagaaccattgctgtcctcctgccctgccttctggataaaggaatgatgagtcctgtgacagaagttcgagccctcaggtttgaatcagcggatgagattgaatacactggatttacttagttcttagccatccagtagaaattggatttcttcaaaggttaagattctggaacgtatggagaagggagttgaggagaatccactggggtgacccaagagtgtgtgtcagaagtggcgagtcagaacgttttgcagagacgctctcttgggagccttgcttccgcccagtgttctgcaccctgcctcagcctcgagtgcggtgtgctcttcactcgtcaccggcctctgcccccagcaggcatatcttgttatgcttctgttaagcaaggtcttgggaag

SEQ ID NO: 35436 - DNA, 1338 bp, Bovine  19866880351355
ctgattgcatcatactgcagcaaaaagagacacaatttcttctgtaatatgttacctttaacattagcaataaggaaaaaagctactcttagggttatacatatctatatacaccatctctattttttcattaaaaatggcattaaaatatgccaaaagatttttacatattcagtattagaagtagattctgtatgttattttccagggtaataaccattaggtatactggcccttaacaaaaggaatttaacttgaagacattaaagtaaggcagaactgactgcttttcagtattgttttgcaacttacactaacatgtcataatcacagagtaaattaattatttcagggaatatcttgcttactgtggaaatgtatacccagacaaagtagcaggtccttggaaacaggaattattttaaaaattcaaaataaagggcacacacacatttgtggaaaagacttacttaagtgttactgaattatccagttatattaataaaaactagtagtaatatatcttagaatagtaacaaaatgcatagccccttcctaccccatgcaaatgtaactgtgttcccagaaaactttgggtttaccaaaattaggtatgatatagcctaaaaaagaattaaaatgattttttataattctatatacattttagtgttgtacaaagtattatttaagcacataatttaagatgataaatatatacattaaaatctaggctataatctagacatgaaaagtatgacgggcagacaagagaagtccccccacccacaaggatgatacgaaagcaaaagatccgaatctctgtcatgtgttttctgggggaaacactccagattttatagcaaatttacatcttatcagaaaagcacagtatttcagtagcagagatgatgacaaccacttgacagtaaaaacatattacaatgtttggctgtgaaactaagagaaatgtagacttaaaaagaatttaaaaaaaaaatttttttttgaagcaacatctgggatatgtaattagaaatttgaaagtaactgaacaggtaatctttcagaaaacttttcttctacctaaagtagagttgaagagagattttaaaaaacataaactaactttaccaactctgtagtaaatacaaaccatgggacacagtatggagattccttaaaaaactaaagatggagctaccatatgatcccgcaatcccactcctgggcatacatccaaagaaaaacatggtcaaaaaggatacacgcaagcttatgttcactgcagcactgcttacaatagccaagacatggaagcaacctaatatccatcaa

SEQ ID NO: 35437 - DNA, 4599 bp, Bovine  19866880490693
tgaaacactacagttcaagagcatcaattcttcggcactcagccttctttatggtccaactctcacatccatacatgaccactggaaaaaccatagctttgactagacgtacctttgtcaacctttgtgtcctgagttgtccactaaccagtcctgggaacttggacaaatcccttgctgtctctgccctatggtgtcctcactggtaaaatgaagataataaggattatcattgtggggcacgttttaagggagcactgttttcggtagctgacatggatgacttcctgtcatcttcccaacaatcccaagaataggtattgttatcattgtcattcattttagagatgtagaaagggagacacaaaaaggttagttttcttacctgtggtcccagagctatttttggaggcaggattcaaacccaggcagcccagtggccagaacataagctctgttgtgtgccctctgtcactgaattatcataattcagtatttgaaagtcagtgccacacattgttattccctcacttccccgtctatcaaaaggagacaatacttctgtttcagagtgtccctaaggcataaacttgtgtgagaggggtgagattttgcaacttccctctcagcaccacagccaccacacaaaacacattttgcttttcagccttaagaaattgcacatggtcgaagcctatctactgctacaatataaaactgacgtctttccccccttttgcttcttacagatttttgcatatatgaatgaaaactcttcccggaaagaaaagtgggacctccaagctcttagatttttatcaattaactcaataattgacccttgggtctttgccatcctgagacctcctgttctgagactaatgcgttcagtcctctgctgtcgggtttcattaagaacacaagaagcaacacaaacttcctgttctacacagtcaaatgccagtaaacagattgacctttgaggatggtagttaagaagtgctagttaaccaccatctggaagatcattttgaaatggttccttagagaaatggaaaaaaatttataaagacaatgacgttaccctaatgaaacagagcaaacaaacatttcaggagtggtttgggctatagatgtgctgacaaggcacttcttgcaaggtgtcggaaggatctataaaacctaccctcaaggaacacgttcatggtcttcggaggaacaaccaagtgtatttatgatcccgtgtctttggatttaagcgtccttgttgaatgaggaagcatgtagttttgtaatttgtttaaaaccctaaatagttactgtgttttccattttaatcttctaggctagtaccattataaacataacagtgtacagtctaaccagataaaaacttacgtgttctttaggaagtggatttgggcaagcaaccaagcctggtgtcttgtgattgcttatcaaaccctttctttggacaatgagtttgaaaatcataagtactttgtactgtatgtttgtatatgtgggagcatgctcttgtcacgatagtattactcacagaagagtaggctcagttggttaatgtcagcttttttcaccatccatgagaagatgtgtgtcagagtgtcaggttatttattttataacatctgtcaagctaatggtaacgaaaaggactttaggaattttcctctcagcgataaatagtagactattaagagaagtaattctcattaatattttactttttatttccagggaagggtgtatgtggctacgtctgaggcaaatattagaattaaaaactgaaaaatctgggtcagttcttcagctacactgaactcttttaacgctgatgtcgaggctgtgactgacacagtttgtaggatgatggtgttgtagcaaaattcatgtctgtatgtttatctgggaaacatggcttgactcatgctctataggaaatcatacagtgagtcataccataatatatttctaaatctaaatgtttggcattgtataaattcagcatcaaaatatttcagtgaatttgcactgtttaattaaatcttagttatagtataaactcatctgaaatgttacaaaaataagctataaaacaaaagatttgaaaatggaatagtatgtgatgaattccccccaaatagcaatttatagtttgtgtggatatactaattttaaaaattagataaaagtggagtttaaaattttaatttagcagatttttaaagtgtggttgcattgcaaattagagtttgagatattcagtacaatacttgatattagaggaaatttttccccttatagcatgatattcaatatagtggacactttatttattttattttatattttgcagtgagtgttattacaacatagctgtaataaaaaccaaaaaagaatattagttttttcaaagtctcattgaattgcttacacaaaactatttcctataagtagttatcagactagatgatcacttaagagtgattccaaaccaatttagaaattagtgtattatgacagaatctatatcaaattatcccttattttaaaaagaataagtgaatggtttgcttttgtactaatttaaacaaaccaggctaagtttaacttagctaaaatctggatgtgtaaataaagcttccctgtccaccaagataagaaattgttctaaagaagactaattaggctcatgggtaattcctgaacataaaatgctaaagttactctggatctggaagattaatttcttttatcagatgacttttcttcctccaaataaaaatgttacctacaatcattcaccctacctcatcatccccccaaatttttgaataatgcctgagaaatttaaaaagaaaaaaaaaaggacaaacttggatataatatcactagtgaaaacaaaattattcactctgtggtcccaaaatatgagtttaagccatttaagaaccaagatttccagagctttgtttcctagtatattcctgttccttgcactgtgttaaatgactaaatcctaaaatttatttgcactgatatttacatagaaggaattgaaaggtaaaatcctatgtaatagtaaattacttactattaatggaaatttcaaggtaatacaaaaattacttatattggatatgtaaatatttcttttttaaaaatcacatcagacgtacctgtttaagtttgctgactcattttcaagttaaataaaaaacacagaacttagtctggtgtatcagaaaactgaattataataaaggaagacctagattttattctttgtccctgacagtcagtggaatgaaaagagaggaaaactattgtggatattcaactcagtatgccacaactgagacctggcccagctaaataaataaataactgtctttaaaaaaaaaagccaggataaatgcgcatgcatagctgattccctttgctatacagcagaaactaacacgatactgtaaagcagctccacctaactttaggtgtccagaaacaggatgggctgaagcagttctgttctgagctgaattgttactgggtggctcactgtggggcttctcaggtggccctggtgataaagaacctgcctgccaatgcaggagatggggattccatcccctgggtcaggaagatccctggaggagggcatggcaacccactctagtattcttgcctggagaatcccatggacagaggagcctggcgggctacaatccctggtgtcacaaagagtcgtacacgtctgagacaacttggcacgcacgcttcactgtggccctggatcatcttttccaagagaaaactgagaaattctggtactaaattgtgtccttgaatttcctaagatcctaataaggcctgtgatttctcagaaactatagaaagcctctgaaagacctgactctcaaagtggtctggacccacaacaacccagagccagaaagagcaccgacccctaaccgccatactggcggagactacaagtcctgggcaggtggagggcaaatccgagcctcatcactacattctcagtgtgattcagttcagctcttggtgccctggcctgctctcagcagtgcactttcagagacagattgccctcatgctaatgtaatgtcagctctgctttgaaccaaggaaaaatgaacatcttcaagttcagaacttgatgactttgaaaggcaggggaagacagttagttcacatttaagcagaggtttgtttacttcccttggtttagttgctcagtcattcctgactctttgggaccccaaggactgtagcctgccaggctcctctgtccatggggttctcgaggcaagaatactggagtgggttgccatttccttctccattacttcccttagtcaaatctaatattttaagccaaaaataatggttttctgaatttgagaagcgcccctacttgaattattcacagagaaacagtctttgtagacatttattatatgtggacttgccatgcctgctcaggatggccatcttctgcctttatcagacacgactctgctggaattcctctttgattgcacttttaaaacatat

SEQ ID NO: 35438 - DNA, 1312 bp, Bovine  19866880502935
tccaggcaagaacactggaagtgggttgccatttccttctcccaatgcatgagagtgaaaagtgaaagggaagtcgctcagtcgtgtccaaccctctagcgactccatggactccagccttcccggctcctccagccatgggattttccaggcaagagtactggagtgggatgccattgccttctctgagtaagcctcttagattccaagaaatatttttttccatagcttgtgctctagtcccgtattagaatttgtttccatacttcttttttgaagtatagaatagctagtgcctttgactaacttcaaaaaacaaatccagttttaatactccatgagtcaaacactaactgataaattcagccttgatgttactcttagaatttgtcagatgttgacattgcatggactctgagtccagtcttctaggaactaagccaaactgaaccaaatttgtagtaagcctttaggattggatagaaagttacccaccctctggaaatgaataattgacatgctttctatttgtgtgcactctgtaattgcatgcatgatttatgtcatctggtaaaacttcttaactacttgaattagtgtattttgtaatagcaaatactattgctatttgaaatagtattcaattgatactgaaattgataaacattattttgtgtttgtgagtaacttcagaaggcgatttgtaaacttagttgattgtgttttgctttgatgggcgaattcctgaattttcaatcaagttagctatgtcaaagaaatgtcaattagtcactttgtatcagaagtttagtttctaaatgtttttaatcactggttgatgcatctgttgtagtcactcattgaaatcttaatgtaaaacaataattttcttatgctaaaattgaatggagtactttaattgaaatattttggcagtttgaatgatatgtatactttgaaatggtttactgcttctactaacagatgacaaacattttattaagaataggacatatcagaattttggaaaccatcaatattttgcacagtttcaacatacaagttttcgttatcatgggtttagttaacaccagttatctaacaacatggttcatggttttagttaccaccatacttttgtttaattgcataaaataccaactttgcttctaactcttcagtctacagttcagtgtgtcagtaacagacgagtacatttaagagttttcatgttacttgcatattacagatatttattggtttaattccatgtacaaggccctgggctttgcctttgaagtacaagataaat

SEQ ID NO: 35439 - DNA, 2419 bp, Bovine  19866880510425
tcactagcaggtcacatggaaaggacaggaaagtaaaagtaaaggaaatgtcaataactggaagggttcctgggttctgcaggttcgtggtgtccgcagggctgcctccagagcctctctaaacaggcaagtttgcctggcaagtctaaagtgcacgaagtgcttatctctaaggatgtactgcagtggtgactttcacttcccactccaaagccaaacatgaagcatggggaagaggattaggaaaactgtaggtagatgaaaaaggtgggtaaaaggaaaacaaagtgaggtagggagcagcatctgaaatcaggtcagtagcttagaaatattactatgtggagctgttttatgttcagctacaataaatggtttattccagagcttatattccgtatcacctcctttcctctttctgctttatcttgattctgtggagtatgactagatcaaccagttaaaaatctagataagatactctggaatcttgttgtaaaatatcccatgaacaaatgaatagaatccaataaattctggggctctgaacaaggaaataaccacagaaaatagcagttcattatgtactgctttcacccaggcaggatgatttatatgaaccgtatgtttcagaatttgcatgatgcaatccacctaagttatacaatctcctccctgccttaagtaaaatgtttatcagataaaataacttaagttttataagtacaggaattttaattttgtaaaggtaaaatttttataagtacagtacttatttataagttttataagtatagtacttataagtacaggaattttaattttctaaaggtaaaatttttccgggttataatttagtgttcataataactggcaaaagcttttagagatgcatttgccagtcacataaatttcaagaatgtgaacatgactataaaactgacatttatttattaatgtttggaattccttcacttttgtacttacttgaaaactttaatatagtcagcaagttcaggaatggaagtgatgtcaccctaggaaaagaatgaaaacatttttttctcacttttaaaaaatctgaaactctgtttagcatctgatattaagaaccagcttgttcaatcaacaaggaaaattacataaattacagattataaagattttaaaggtattatatacatggtcatataggacaaaggtattttcaaatggcataaaaagctattaaaaatttgatcaatacagcaatttagacaatccacaagaatgtagtgttgattctaatatgactaaaactgtttatagctgcatacagaaattttctgactcttaacagtcctgagaatagtgtttcttctgtaataactaatatctaagcatttaaaaattttactgagatctatttattcttcttttcataatatttcaaatttggagatcaataaacggattttaccatggcttgaagttaacttttcctctgcagaaatgttctcccactacttgtaagagaacatgcagactgtactggcagaggatctctctctactgtgttggaagcactagagactaaacagtattgatgtaaaaaacttccctgaaaattttctggaaaatctatgtctgtattttctaaagcattaaatatttctctatatgtcccaaacacttcatgaaaacctaattccaaaaaaaggtacaagcatcagactaaattaataggcaaaagattcaccctaccaaaattgttgatgttttccccccttccaaagtaatctccaggtctgaaagggcagcatcaacttcatcaacttctttgtcgctgttgttcagatgattctctgacgtcatgatcgacagcttattgatatgatactaaaaccaaagtgacatttaaatgacttttttgactatgaatttttaagtgagattattatctgtatctatattgaatgccttttgccacctaatctgaaaggctaaaagtctcccaagatttaaaggatagaaaaatggtgggcatggcacctgaaatcagtgtcctaaacttgctaatgaatctttactcaaaaaaggatttttttgacaaacacaaatgaatttagtttaggaatccctaggatttagagttaacacctcttccactgaactctacacgagcagtgacttttaagtgctccactccccctgcagtattccatgtctagcacacaagctagaagcaactggatgaattgaacagactatgcataaggtctgaataaatgcattaacactggttaccttatcttacttacttatcttactactattactacttctactgctaggtactattaccctgcagcggggaagttagttatcgctattatgttgaaaactaaagttccactgcctccccatcttcaattcaatg

SEQ ID NO: 35440 - DNA, 4238 bp, Bovine  19866880547299
ctcccacattgcaggcagattctttaccagctgagcccaagggaagcccaagaatactgtagtgggtagcctatcccttttccagaggatcttccctacccaggaatcgaaccggggtctcctgcattgcaggtggcggctttacctactgagctatcagggaagccccttctttcagattagagtaatcaagagcttcaggggcccaattatctggaacaaatactaaagtgcacacactaaaattacttgtaataaaacctgtttcaaatgaaccatgggtgtgtgctcagtcacttcagtcaagtccaactacagtccatgggattttcctggcaagaatactggagtgggttgccatgccccctccagagtatctttctgacccagggatcaaacctaagcctcctgcatctcctgctttggaggtggattctttactgctgagccgccaagaagtccccagatagaccataagctggttaaattttatgaatgattgttttaatcatcacaatttcctttctttactgttcttagatccaagcatagtgtttagagcaagttttcttccaagaatgttttcagtttaacataagcataacctttttgtagcccgctgtccccagcagtgtgactcatgaattaatttaaaagtgaaaaaacatgaatatataaaaataagttaacatgaacatacacaaaaataaattttagattagtagctaaattatatcttgttgagcatgtgtagtgtgcgaggcactggtaggtgtctgtatatactaagccatttcttcaccagtttcatctccattttacaaatgacgaaacagattgtttaatttacacggccatgatcagatagttgacatctgaatatcaggtctgactctagagctcatggtctttcctcatctacgtttcagtctcggctttggtataattttgtgaccttgggcaagttacttgtctacacctgcatttcctcatctgttaacatggagatcatcatcagtactctaggattgttacagtgagtgagtaacatgtaaagttctttgaacaatgcctggcacataataagtgctgaacaaataataacttctattattacaccacactaccttcccaaagcctctgctagattgcagcattccctatatagttacatcgggttatgcaatataatctagctttatggaaaagttaaaagtagttgcccttagacatactgtgatttatgaaataagagaacatctgggagttgggttattggtggaagttattctgttattaagtggactttaattttttcctgtattgctttgttttatggtagtatattatgcatatagatagatgagatacggagcgcagagtacaagttatatgcgaattttctactgtgcatttttgacagcatggaggatttgcaccctaaacccgtgctggtcaaggaccaactctggtttaactggggtgtggtgttagaaatgaaagtttagtgttaccacacagtctcctggtaattgtttggaagactgttccctccagcaatcctcttctacagaagcgtgcccccccacctgtttctatgcttcatgtttttcattctagcatttctagctttcatttagtttcagttttattaagactacacctaataagaacctgaccatttctgaatgttcaaaaagagagaaaaataccgtaattaatcattttccaatagcatgaaaaacacaggctattcttaaaaagttgcttagatgcagctgagcaacttctagatttttagaaaacctgctatgaaaacaaaatccaatagatactttgtgtgaatttatcatagctgagaccaaatattccagtgaatgcagagaatcttctgttcatggttcatattttttttaaagctacatgctcagtagtcttccttagtatcagataaaaccaacaaattattccttaatccaataatgttaataaaaaaaaaagtcatttaaaagtcagatattcaaaatgctacgctagtagcactggcccataggaaaaaatgttttaaaagtcctgttagaaaaatggagtttaaaagtgtaacaacttctaaatttagtcgttcatttactgtatgacagaatttctgagttttctatatagctctagctgtggcatttgatgttacattcaggatagactaaaataagtacctggcatacctgttaaagattttttctaagtgccattcatttttattaagaaattgacaattttgccaatcaaaaattttctattaaataaaatgccttaacatttaaaattttgttttagatcttactgcaaagatgaaacctgatgaaactcctatgtttgacccaagtctactcaaagaagtggactggagtcagaatacagctaccattttctccagccatttccccaacacatcctggagaaggtttggttttgaggcctctttgtactgctgatttaaatagaggtatgggctcagtttataaatgctacttagacttataattagcattgttttttccacatacatgatgatgctgataattttttttaaatatttgactttcatattagttttttgtgcttaaattttaaagtgactgagaacttaattacaatgtgtataggccagatattactgtactacagtactgaattacaccatttcaaatgacttatatacaacagtgctccttcctaattaagcagcaaaaagggggaaattaccttgtataaaaagtaagaatcttctctaagaagctggatggaaaatgagaatgaagataatttgcctcagatagttgcaaaaggttttgtctacatgtattcctttttttaatatctaaattctccaaaataatatccttaaatttcagtaaccaaaaatcaactttttacagttttcatttttttggcaggaaatcttaaattattttggtcgaatcagttcttcaatatataaaagttaagattcccaaagttctatgctgttcatattaacataacattaatcgggaatctttaaaaaaactgttgtctcaacaatgttatattttacaaataatatcatatttgatcacaatgagaatcttgcatttttaaaaccaaagcacgtatttgggaaaatttgacatcccttgcattgaatctactgcaaattacatttaaaactgtatatgctggttctatatactgagtcttaaggtcagcactattccaaaaatcttatgcaggcaaaaacattagtaaaatctattattgttttacatattgattatatagaaagaatgggtttgtttaatcttttaaaataatttaagaatggttcattacataaagttttgaaaaaataatgcccaccagcttgacacattgcttcttttaatatatatttgctcttctcatgacttgaaatctgtttttcaaaactaggtttttttaaggtactaggtcagctgacagagactggagttgtcaacccagaacaatttatgagtaagtcctacagcctctttttcctgaagaaaaagaaatgaaacaagattatatttttgtttcaaactctgttcactgtctacttgttttgttcaaatagctggaaaatattcaaataacaaattagctattatttgtttaatgtggccaatctattctagaatccaaaagtaactactaccatgttttacaaaatacctggctatttttagataattactatagcataggacctgggtggcagttttagagattttcattatagtattttccttccacgtagttaggttatttcacaaaaacttcattgtcaaaaatgtaataaaaatatgtgacaatagaaacccagaagggtcagttgacttacccaaaatcacagggagttgttggtaaggaaaaaactacaaccttcctaactccatccagtgctcttaacactgtcttcctatcttcttcattttcttcaataggtaattttattttgtactctatatgaccctcttgaagtaaaagttattattttgtgattctgttttccttctttgaatctatttcatcccatttcagacccattactagaatacaactgtggaaataaacagtatgttaatactcttgggctcagtttttattcctaaattcttctttgtgggaatactagagagaaatcatgttatttcatcaatataagtcagttgaggggaagg

SEQ ID NO: 35441 - DNA, 1578 bp, Bovine  19866880705610
aggactcattaaaaactccttgcatggttttaaaagggtcaccacaatcacccttttgccttgctttggattaattttcttgaataatatcttgaagccaaacttaaaaagtcattcaaaatgcactggtgttcctatatactaaatggaagaaaaactttacccctaggttgcccagccaaaaagagtccaaagaaggtctctacctacaactataagctagaaactagacaagaaaattaaacatttagaaaacacctgttcaaaattgtactcaaatatatttaagatttttctggtatagtaactgatggaactctcaaagaatctctagagcttagtcataaaagctgttatttgatcccctagctgattactggggtagatatatttctaaacacatgaccactcaagggatcacatctgtggcttatccatattgtcttggttcaccttagtttaacatcacttctgtatcttcaagctcattttagtacagcccttgtgggtcagctggtaaagaaactgcctgcaatgcaggagacctgggttcaatccctgggttgggaagatcccctggagaagggaaaggctacccacttcagtattctggcctggagaagtccatggactgtatagtccatggggtcgcaaagtgtcggacacaactgagaaactttcactttcacatgatagtaatgaagaagatttcaggtttcatttatatattcacatctgcttacgattcctgtcagattagtccacgctgtaaaagtacgacagaaatgctgaaaacgtaatgtgaaataggtgaaacttaaaatagtttacttatgtgtcttatacatacccaatactttccaaaacggcaatttccgtggttaagacaaattggtatgtggtcccatatacaaaagcagcttccatgacagctctgtgctctaaaaaagagaggggaggtgagagggaggagaggttagtttgtgtgattctatttgaatactttcctacacccttttatgctctactatgtttaaagaaaaatcttttgtagggatcccagttgggaaaatgcaggcagttaaagaagttataaaaagtctgttctagtcaagtcaaggtaagagcagaactaagagggagttaaaaatgagttatacttgaagatatacaacaaatatgtgatatttttttcccagtagtagggcagagagtatgaattcaccacacaacttttatatgttatattttatatatgaatatgtctgtatgctatttatggcttatttttttaatcaaacttattcttatctaaaaagagacaattctataaggtatatttttaaaattaacagttcctctacccttgaccccatttccaatttccaagggacaactacttccaactttctcactctttctttaggtatttacctccaaatccctaaatgacactcttacactcttatttcctgtttatttgtgtgtgttagtattgtctactgacttcccactatgaaagatgataaatagctctcttttcgaaacctcattccacaaatgtacacaattctatcc

SEQ ID NO: 35442 - DNA, 1521 bp, Bovine  19866880745708
aatgtccataattgttccaaggagatcctttatagttgttaaaaaaacaaacaaacaagatctaatcaaggattacaggttgcacaatttatgttgcattcgtttattgggtgcttactaggttacacaggccttctggtttaattttcacaaggaaacttgctatagcttttgatactatgtcaaatggtgataaaatctttacctgtgaacacttgatatattttacttattcaccattttactcacagaatttagcacagagccttgaacatactaaatacgaaataaatggaacatggtgtacttgtccattctgatggaaaaactacaactaaaaacacgatggaaaggacctaatgtgttgtgatgacacacctaggcagaagcagcccctctccgcatccccctgcttttccaggcactttggtgggaacattggagccgtccaccttagctgccttcagtgacccgttacaggataacaatgacagtttatgccaactttgcttctattcaatagatccattttttgttttaatattaaaatttatttttaatttagcatcaaggaggaaagagtttcccatttgttttgtcaggctacagggtatatcagacacaaatatggaacacaaactaaatggtagccaatagaaaacataagtttagcatctaagcactttcttttctcttttttgagtcataggagtttgagaactcagattcacctaacaatatagatacaaatagcaaacaattttttaatctttgtgaactatggcaggctaatccctgaaaacatatacacagaacattgcaaaagaggtgatagactgcaacaatttcagcctaattttggtgatattttgataagtattacctggtaagaaggtaagtcatttatgtcatttattgggctaaaatattctctgatactttgtcagcctcttgtagaatcttgagagacttatccatcaaacaactgttttagaaagatgatgattttttaccatgaatactgtaatttctatgatgtatgagtgaagaatctgaaataactcatagtttccatgataaatattcatcatagtaattttgtacagaaatgtataattcggccctccaattgctagctgaatctgctgaataaagccaactttgtaaagcggaacaatggagccattcatcttatttggattttaccagtttgctgtgatgtctttttggttgtctatgaagggaaacagtttaaacctgtttaaagaaattcctaccagtaccttcccctgagccagcatacatctatccaaagaagcaatttttcaggtacttctttgtgtgaatactttgcattaggctgatattagtaaaactgcatgcagaatttactcttgtttttaaaccatcccacttcacaggctgagaaagccaaaagagacattttctggggtaaggcatcttcaggaagggtgcagggaggcagagtgtgccaaggttttttggtggcagactcctgca

SEQ ID NO: 35443 - DNA, 1703 bp, Bovine  19866880763002
tgagtcggtgatgccatccagctgtctcatcctctgtcgtccccttctccttctgcctttagtctttgccagcattagggtcttttccactgagtcagttctttgcatcaggtggccaaagtattggagtttcagcttcagcatcagtccttccaatgaatattcaggactgattttcctttaggattgactggttggatctcccttgcagtccaggggactctcaagagtcttcaacattacagttcataagcattaattctttggaactcagctttctttatagtccagctctcacatccatacatgactactggaaaaaccatagctttgactagatggacctttgttggcaatgtaatgtctcttctttttaatatgctgtctaagttggtcatagcttttcttccaagaagcaagcgtctttttatttcacggctgcagtcaccatctgcagtgattttggagcccaagaaaataaagtctctcactgtttccattgtttccccatctatttgccatgaagtggtgggaccaaatgccatgatcttcattttttgaatgttgagttttaagccagctttttcactctcctctttcactttcatcaagaggctcttcagttcttgtatgtatttagtataaatatttcaaagtttcacaagaaactgatgattggtttatggaaatggaatgggaaagctaggatgggaagagagaattggaggtagacttttcactcttcaactttgcagatactttttgagtcctacaaagtgttaaaatgtgcaaaataaataaaatttaaaatagaggtaagattataggtttagagtctaagaattcttagctctattttctaaaatatatatagtcaaaaagtttggtaactgtaaggaaaatttcacttcccagctttaagatggcattaagaaaggtaatatttagaaaaagataatatttagtgttacttcactaagtaacaattaatctttatttgttgattgagaaaaccttatgtaacactcctgaggcaagtcagatagagatataggagactgaggcactgtaatctcaaaggtgggcttccctggtggctcagatggtaaacagtctaaatgccaataaaggccatttcccctactagtcattattgatgtctagaaatttatcaaatgatccaaaaaggaaagattgtctagtgctgcagagaaacacttaaatctcattaactctttattaaggtgtgctaattgatattcttgtggcaatatttagtcaaatggaaggtttctttcctcttaaggttaatatactcctgacaatcatacagatattatgggaattattttcaactatcataatttctgctaacagtttatttttaacgcattactgcagagcctgggtactgcgactttagttgatgttgctatagagcctctggggaaagatcctactggaggtgtcttcctctaaaactcctgagctgtgcccaggctggtcccttctgataggttgtgagctattgttaaatcctttatctctatcagatttgttcctacccagtattgtcacctgggttcctgtttgatagtgacatactgggagaaactgtaataaaataattacttgtcttagatttgaattcctcacagctctttgttaattggtagtaactaatattataaacacacatccac

SEQ ID NO: 35444 - DNA, 1942 bp, Bovine  19866880835694
ttcttgtacacatcttttgggagcataagcatacatttttgttaaggaaacaactgtgaatgcaattgctaggccataggttttgtctttggtccatactgcaagcagtctttcaaaatggactttattaggttctacttccacggcactatatgaaacttttagtcaatccacatgttcatcaataccttacatattgtctttctatttttatttagctgttctgggactgtatagtggtataatactgtggtattaatttgcatattcccatatgcactttttcatgtgtttattggcatttggatatccctgtctgtgaagatctgttaaagtcttttccccatttatagaacgttctctgtcatttgcatattgatttttatcatctcatcatccgaatctattaggttcttgaatctgggcagtatgtggctaacttttgtacagagtgggaattctagtaagttcaatctatttggtttctggaattcaaaataagaatgtagataatgatggatacctgaagccactgtaggtgtatttctgctgaatctggcttctggtgtctcattgcctgatgagcttgttagtatgttaactgttcatatttctgagattctctgaggcctaggatgatggtgccttcctccagacagaatctgtatttgggccaggcacctagagtcaatccatgactactttagaccagttcacagcatgacgcttttttggaccaaccaggaaaggtgaatcaggttacatactcacagtctctgccagcatgtggttttaacttccctggggtagggtttttctttcctttactccctctgcactgttcagcctcaaaggattttatttttcatgtgtctctttggaatgagaattcgagtgtgagcaggtttaattctggttcattcttaacctgaggaaataatagccctttaggatcctagccttgtaggggaaggtttcctcttacgcgctccatctttgcacaactaagtctttaatttctaaattcatgggctgtcagaggacttaaaaaaataacgaccgagtttccttagctggcagatgtcatcagaggcagaagcaacctcagcgttctactttccctccagatccccattttcattcagattttggcctaacattttttagttgttttcatctgggggattaatctaaacagtgtagcctgctacattactcaaaatatgacttcttttaagttttcagactattgaacaaccatgggaacagggagggaatctctttaatgagataactaaaactgttttagtaaataattaaaactgatgaatgtaaaaaaaaaaaaaaagaagtataggatcctgtattttagagggaaagccattgttggtgttcagtcactcagtcgtgtccgactctgcaaccccatggactgcagcacgccaggcttccctgtctttcacaatctcccagagtttgctcaaactcatgtccattgagtcagtgatgccatccaaccatctcatcctctgtcggcccaagtatttttaatatgaaaaaaaagataacattatttacaatttaataaaaaaagaaaacagttcctaagcaaaataggatttaaaatgataaagacaaataaatgaaaggagaaaaaacataagtgaaccaaaagctgattctttggggaagaaggagaggtaggaaagacaaattaaattaactgggaaaataacacaaaacaaaattaaagctcacagagatatgacactaataaaaatttgcagttgtaggaagatactgctgctgctgctgctgctgctaagtcgcttcagtcatgtccgactctgcgagaccccataaacggcagcccaccaggctcccccgtccctgggattctccaggcaagaacactggagtgggttgccatgtccttctccaa

SEQ ID NO: 35445 - DNA, 967 bp, Bovine  19866880869825
atatcataacattacctaatgcctgttctccttatttttaaaaataatagaacatttatattgattttctatttttggcaaagactaaaaaggattatagatctcagcctcctttcttagttgaaaagtaaatcttcatattctatctactacattgttcacaggcacctgctggcatgataaacagtcacagttatagttccagagcatacttcttcgacaatccgaggcgatatgatagtgatgatgacttgccaagactgggaagttcaagagaaggaaggtagttgcactgaattggtaccaacatagattttttttaaaaaagctttaacccaaatatgaaaagggtgatttgctgatatatgtcaataaataagatcatttaacattggcgtgtagaacagtagatgttaaacccatgatgagacctgtactataaagaattatcatctgcttctaagtccacatattacctttatttgagaaatgcctttgggggtaaaatggcaccctttcatttcaggatcccttgttagttcaaagctgatgggggttggtgagcagagaagaaatactgttatatatgtttccatatctactatgctgttcaaattgcacagagaaactctaaataaaactcttgggaagcttagctgctataagaaatcttcagtgccctccttgttccaaaatcattacaagtccatcccattagctttggtatcagtgccgaggaagccttaatgcacactaaataatgctttgaatttaatgcagcattttctataaccctcacttcatctggacaagttacttaacctcaattttttgtctgtttttcatctgtaaaataggaataataatagaacctatctgataggattgttgtgaaggctgagtgcatgtgtgtgtaaacatacatatgtatgtcctagaataaagcccagcacataataagcactat

SEQ ID NO: 35446 - DNA, 797 bp, Bovine  19866880937575
actcttgcctggaaaatcccatggacggaggagcctggtgggctgcagtccgtggggtctcgaagagtcagacatgactgagcgacttcacttttacttttcactttcatgcattggagaaggaaatggcaacccactccagtgttcttgcctgcagaatcccagggacgggggagcctggtgggctgccgtctatggggtcacacagagtcgaacacgactgaagtgacttagcagcagttttgcgtgcatattaactcaaaatatcaccaggcaaagtttatcatggttatgcatagagatttctgaatttctctttcattactactagaattctgatattgtgcaagtatgtaatcaacaaatttcaaatcagttttacaacccccttcatgttaaattttacataaagagtaccaggaatgaatgagggaaattccagtactgtttacttgcgtttgttctgtatttgaaagatcagatttccactaatcagatttacctaaaaattagagccctaaagaattctaaagatgaagaaatttttagaatgagtcaatggttcactcttgaaattttagaaccgaataaaatgcataagtactttatcctaatgacatgaggaaaacagtttaaaatgaccagaggctattaacatttattaggaaagtagtgagaaagtggctaaatataggttggaaatttagagacaaacagtatctgagtcaagaatggacgtctgatgtgtttcctgtgtcctgtctcatttcaggaagaaagaaagtttccctctatct

SEQ ID NO: 35447 - DNA, 2492 bp, Bovine  19866880962112
aaacgtgttcatccctcagacatttatggagcacccgcaaagttgctagcactttgactcaaacagcagtgacacaatgtccaaaagtggccgctagaaacagcaagcggcaggaacagaccccagagcagccccctgccccaatcaagccatcacccctcaccttcaggtagacactgcttcccgttcccgtaaaacctggactggcagtggcagcagaaacccgtggcatagtcagtgcagaaggcgtgccgggagcagcgctcgtggttgtgttcacaggtctccttgttggcagcattgtacgtgaagactagaaagtaaaacaaactcgcatgaaaaggactgagtgattctgatgtcatggctgccaagcttcatcatggacacagcatctgctccataaaatccatttagagtgtaataaacaagtgcagttttgacgtttcagagacagggatgacattcaacgcagggagaataaacctgcctggtcttctggcaagaagcactgctgactgctcgcatctggtctccctgcagagctgttgagcaaggatgaggctgagaccctctgtgtggggacaggaaagccagccaggaagtaggtcttaggctgaactgtacaaaacggccattttctgggtcaaaaaatggccaaaggtcagcaattttatatggttcaaattactagcagtgagtttctgagaggatgaccaaagagaaaaactaacaaatgcagtcttatgtctaaccattcttctcttctttttggtaaccctgaacttgagagagaataacctatagcttgtcttactacccaggggaaaaaaaaatgtttttctgaaagagaagaagggtgttaaagaaagaacacacatacacgcacaccccttaaagaacgtgtatggggagacaggtcgagatagaggagcagggaacccaggcgtaaaaagttctggggcttagcagggtttcttgtggtgggtgtgacccaagcgggatgtctgggcagtagtggagagcctgggcacagtcacccctctctaggaagccacgtggccccaggtaagtttattgctccagtagctgtcccttccatctcctgcttattctgcccattaaaaaaagaaagaggaccatttgtgctgccaagaaagaagggaactggagcagattccattgtcactacagcaaatggccaaggaggtggggtgtggccaggggtgctgacagacaagagaaggctttcccggacactggggacgatgccagtcccgagcacggccactaggaggcagagcggccatgcacacctctgccgcgggatcccctgaactaggagttgggtggagactccccgagcagaccgaggagaaaagacagcacagaatctagggctagcctccgagctgctgtgatgaccacggataacctgctctttggaaaaactgagtggcagctgcgatccaggactaggtctgaaaaggaggaaatgggaaggggaggaagaaatgggaaaaccaatacttacccagtattccagaagagaacagaagacaaaatttggggggcgggtgcgggggtgtacccaccatagaagttaacagtggagccagcataaagacttgtaccagcaagtgagaatataacaaagtgaacattgcaacagtgcctaataaatgccaggtactttaaatgccaggaactttaacttaattttttcagtttgcacaagagcagggacttttttcaaattcctatatgcagataaagaagttttggcacagatcaaactgactctcctaaagtcacacaggtggccaacgtgggatttgaacccagagacacttgctccagattcttaacagctgcacctgaccacccactggtggggcccaagaacatctatcctgagagccaggcaaaggagctggtcaggtaactagcgttaatcaacacaggcttcgaccagtagagtttgagtcatacttcacatatcagatggaatgggagaagacagcagagatcccccagagggctatctccctggcagaaaggcacaggtaagggaactgagtagcagcagccacttctggacagtatctgactgctgtttacaggttcctgagaaagcagcgagctgagggttggcaggacagacgatcttgactcaagtggaatatctgactgggaacagaaaataaagttggtgaatcaagatttggtactgggccttgagcacatggctgagaaattccagttcgttaaaaatagaaaactaggcatcactctgaacatttgggaaaaaataagaacaggaaagtgacacaaaactcaatgcagaaaaacaaaacagataataaaaaagattgtaaaaaatggctatgagggaaaaactgtgcatcattatttaccattggtttaataagaaagagagcaggaaatcccagtttgagtaaaaataaatgaatataacttatcaaaatctc

SEQ ID NO: 35448 - DNA, 953 bp, Bovine  19866880966809
gcgtggaaatgatctagtctggtccaggtgacatacagaacatcccccagttctgagataaaagtggaaaatgacccgacaaagagtggagaagaagttggtcagagatgtttcccaggttgaagtgcaaggagtgcagtattggtggagccccggaacccggagcgcggaaaagacttgagtcaaagaagctcaagcaagagatgagattctagggggattggcttgttagtggagtagaaaaccgaacatggggtttaagggataaggcgtatcagtcagagtagcccttttcatctttactcgtgttttgaattgtactgcattaattacacacgtttcccttacctcctgaactaaataaaagagttgcatttttttcttaatgcaccgtcaccgacgtaataaatgaaaaccttaaccatacttctgtggagctttatttaggttaaaaagccagagggtaacagtgcatgtaaatagataaagtgaggagggtctaactcttattcggatttgtaatctcagattcggaaatgtcagaaggtcaatatctgttaagaatgttacctaaaatgtgctcaaagaagtaagtattgccgatcaagaaaataaaaatacgtgctttctctgtaatatttcgttttgaaacatgtcatctgcaaacagcattgttacttttgtgtggtttgattcagtggatataaaatatatgtaaagtgaaacagacaaaaattaagatttggtggcttaaactcgcgaagattacttaattcaaaagtgttcaaattatattatttcagtaagggaacaattaaaagaacttaccaagcagtacgaaaagtctgaaaatgatctgaaggctctacaaagtgttgggcaggtaggtaatggagttcgggatgtagagggtgatggtatttatttttttaagctctggcaaaaaataagct

SEQ ID NO: 35449 - DNA, 1614 bp, Bovine  19866880971026
acatgatttatcctcaggcttaatgtcacagcccaagttgctgggtttcgacaatgagcctgtcatgataataagatgcagctgtgctatgtatctacaacagttaaatgtccaggaaccctatctgcttaacacacaaacacacagattctccaacctgcatctattttcatatgtttagaagtgaaacaatgcatataattgcaatgatcatgcatccgaagtttatcaaaaactctgaatcccagcttccatttttattaatgtttatagataatgctgactggtgagtagacaaaatcctgagaattcttaatatcccaacactggaagaaaaggaaatgaggatggagagaaatgatgaagaactgtacaatgaacttttgagggctttgtggggaagtggaagatcaaaccaaaatcagaggatcttctcccaaaggacctaagataaatatttccctctcccatgtgaacagaaaggaaaaagacctatatactgttttgttttttcttagttgcttgaagtcaaaatctaacccaataacaactgaccagaataaagaactcaggaatgaagccagtagaactgggactgatgagctctgaatctatttaaatatgaaagcagggctatagaacacaatataaatattataacctttacaatgtaaaataacacaaaacaaaaatctggagggtaaagagaaactgagatggaaataaatatatgaagttaacattctcatcttttacaccaaggagtaaatcaatattatctaaaatgaaaacaagcagttttcttaaaataataattttcacttctcagtgttttccataatcatttcaacatttaagacagtatttcctaaacagccttctaatgatgaaacaatttctcaaaagttccataattcctctagtttcttatcagtttctttttcttctagtaaattcaaataaggttaaatctgatgcttcttactataaagcgcccatgaatccattcatccctctatctgtgtgtatctatgtggatgcagagatgactggctgcagctaacagttcatttttgaatgacgggaattggtggctttaaaatttttcattttttatactttgctgcactgtttgaattatttatagcacatatgcacaacttttatgtaaaaaggatatgatgagtgagaaggcctattgaaggttttacatatgctcaggacaaccctttaaacttccagagagaagtcagttgatcagctactgagtctaagagtctttcagtctgacactaaggaaagtgagacaccaaaaattctataatgcaaatatttataaacttttaaaacaggaatcaaaacattcacaaaagaggtcttttcttagcccatgatgtaatctttgtgatcttagaatggtcacagttcattgtaactaccacagaataattccacagtttattataactatcattataattacacaatgctatattgggttgttcaaaacaacaacacttcaaggcattaaaaataccattttattaatacacagtttatcctctaatctacctgtaataaggtactactcctaaatctgcctacataaataaa

SEQ ID NO: 35450 - DNA, 1129 bp, Bovine  19866880991788
tcaaagttaacaagtctgatccatagtctcagaatttccagccaacttctttagtttcatattctaaatcacgaacaaggagtaataagcatttgacgaaagcctctaacatgaaagaccagaacaaacagaaaaacaagtaacatggaggaaacagattattcaggaagaagaaaggttcagaaaaccaccaccgataagctcaaaaagatgagaagatagtatatccacaaaaaatgaaaactaaagttgaataaatctgccagaaagtatggcaaagacagctggaaaatagaaaagataataaaattgagggactagttcaagagactcaacattcaaacaggagtcccagaaagagagaagggagaaaacagaagagaataaaacatcactgaaataaacacagaaatttcccacaactaaaggagcacgagctgccagactgaaagagcccactgagtaaaaccagcataggggataaaagcagatacgcagaaagatgctttcttgcaaattgtctaataatagaaaatcatttttctaatccttaaattttccagagagaaatctgtatttagctacggtagacataactctaaaatgactcccaaaattcccggtgtacacattttgtataatcctaattccttgagccggggtggtactcacagcatagtcattcccttgattagattataccatgtaagactgtcacagcacaatggagcaagattgtctgctggctttgaaggagaaacttccaatgttttttgagagggccacgtggccagaatctgagaacagaccataggagctaagagcaacaccagccataagctagtgagaaggtagaaacctcagcctcacaaccacacagaactgaattgtcaagacctggatgggtataacagcctgaaggaacagaaaagcctggtttcttctttgagtatttggagaaccataagcaattcaatattaaaaagtaagaacgggaacagacaagtaaggctggagaattggcaaaggaccagatcattaaaaaccatgtatatcctcctaagaaaagtaggccttcattctgtaaataattggaagccatttaggaactgcaaaaattaccagaaca

SEQ ID NO: 35451 - DNA, 1934 bp, Bovine  19866881143708
gataaggtagcacctggagagaaaaataaaattcgcacaggaatgaaaagaagcgttgcatctttcagcaataatcaccagtgcgtacttccacttccccatttctgctgctgttggagacagtacctaaggagatctgataaccaggataaagtactatcagctgttgatttcatgagttccccaaactttctgttcaagagtgtggttccatcctatcccatttcacactgcttctctttgtaggaacttgttttctgtgaaaaataaacccctatgaacatcctgacggagaaggcaatggcaacccactccagtgttcttgcctggagaattccagggatggtggagcctagtgggctacagtctgtggggtcccacagagtcagacacgactgaagcaacttagcagcagcagcagcagcagcagtatgaacatccttgacctttctctttcaaaggctgccagacttagaaaaaccaaacaaaactccccaggacacccatttatatttgaatttcaggtgaataaaaaaacagatttttagtataagttatgtcccatacaatatttggggcatacttacagaaattattcaaactaatcattgtttatctgaaattcaaatgtaactaggtatactgtattatatttatctacttttgactcaaggttttatcaaaccttgattaaaagcaagaccctacaaacagctactgagctctatagctggaggtgagcaaagaacttctctctcacactttatgtacaataaagataaatccactgaggaacaaggtgtactgaggtgagaagccaggatgtattccctacacccttgctattaaacggtgggcctcagaccagaattatcacctcctggaagctcgctaggaaaacaggatcccagatacccctggccccccttccctgcaactttctcctccccccacttaatcagaacctatcctttcctgaggcctcaggtgatgtgcatgtgggttaaagtctaaggagtgctgtctataccattataggtacgggtcatcaagggacaagaaggaaaggcacccctccccatgaagagaaatcacctccaggggccctagaattttcacacgcatccctatttgacagatacgtgcatgacaactcagttacatgggctgtgacacacaggcttcaacaaatggggtaagagaccatgaataatccaaatggaatcatcctacttctcagaacaaccttgaaagcatttagaaggaatcacagggtcttaaaaacagtcctgcaaggccaaaccatcccccaccaccttggacagaacaagcccacccatgtggctctgaagcaagtgaatcctcttccactgagtggaaacccaagcctccaagccaccaaagcagtggtgatcgcggccttgctcacctgtgaggctaaagccgttctcccagcctggtttttctaaagcaaagagccagccaaatagacctccgatcggcgtgagcgggagaagggcctgggccgcgggctgcgggatgtggctgatggccgtgtaggctctgccgtcgttgcccaccacgtaagcatgcaggtccacgtcggtgaagtgcacgggtgtatggcccacgaggaggtgcccactcaccttcccattgactcgatgaggtgcccctaagagatagaaaaccctgtcaaccttgaccatcatccaggcacacagataaagccacccaccaactccccagtctccatcttcagcccttttcccaactccttaacatcccactggccatctaggtaccagacagacctgccttccatctctctcctcccctcctccctctctcccatccactttgactctaacgcactagcaaaatgggaggaaacatttctggttaatcctcaaattgggaaatcagctcaaacg

SEQ ID NO: 35452 - DNA, 823 bp, Bovine  19866881192200
ctagcattactgtgtgtgtttgtgtgtgtgtgtgtgtgtttattttctttctcttcaagtaggaaaaaaactccatgatggaaatttttttgtcttttttatcattaaaataatatctcacatagcagggggttcaataaatacttcttcagtgaatgaatgaatctgtcagctagcagtttaggcacaaagaaccctaatttttaattgaggccgaaggtctttggaaaaataaaatattcccatgcttgctacacagagagtttcaaagaagagaagacaactttagcacaattcatgcaaaaagaccaaacaaagccccaaacccctaaaagtaaccttcactacatagttcttatacacatttgtaaaagcatatcttttgtattatttcttttctgtttattttcatggctggtatttctcttctcatgaaatacatttccatgaatagaaccctactctacaacgtaacggtaggacctaggagtccaatttgtgactacagtccagaaccaattcgttcctaagtcaccagtttccttacatcattggctccctgtcatcctgaaggtgagatccaagctccttaacggatgaacaaggatggacagggtctgctgcttctcttatctcacacaacccctgactcctgtctagggctgaggtacttccagcttctcctctccctaccttggctgacctgtcccctccatcagcagcgctgctgtcttcctgtcctgaagtctctgaggaagggattcttgacctcttcttcctatcagacactaagaaaatcaaactaattcaacataaggtcaaa

SEQ ID NO: 35453 - DNA, 926 bp, Bovine  19866881207561
atgatggagagagaaagattaacatctgttaataactaataggtattccacaagaagagggagaatgggggcagagataccaaatatggagacaattactgaggattttccagaatgatgaaagataccaattcacaaattcagaagtttataaatttctaagtggattaaataaaaagaaatccacactagacacacagtgaaactacagatcaaaggcaaagagaatcttaaaagatgtcaaagaaaaagaccaattacatccatactattgggagctggacaacagctgaatcaaaggctgtggcaggatattttcaaaaggttgcaagaaaaatattttctaacccagaatttatatccagtgaaatttttttttttttaaaaaaaggataagataaacacagttcagaactgagtggccatcaagaaaaataaggagattccggatatttatttcatgtggaaggaaagagatcccagatgggagggcagagaagacaaaagacataaaggagcaaagtgataaatacatgggtgaatctgaatgagagcatgaaacactcataaatgcaaaacttaaaagaaaacatgatggaattaacatattaacaacaacaatgtataagtagggaaaggagtcaatagagataatgtactcttaagttccctgggaaatggagatggttattgattaatcttagcttatgacaggcagtaagtatgcattttgtaatttttagggtatccactaaaaggatagaaaactttcacacagtgagagggaaaaaatgaaggtatcaaaaataatcaacagcaagaaaggaaaataaaaaatagaacaggtgggataaatagcacaaaataagacagcaatttaaacagaactgctagtaaacaagtgcaaatgggtcaaatattccaat

SEQ ID NO: 35454 - DNA, 1109 bp, Bovine  19866881241099
tttaagagatcttcagttcccagcataccagtgtaagataccgggttctggccttccttgtacatctttacgacaggaaattcggtaacattttgctcggtacacacatgagaccagtctgcgcagtttactctagcaagcagcatagtggatgtgcctaaataaaaagaaaacgcacatttttataaatgttaatgcagaaaactcagttgttgagaactgttgatgtctttatatcccgttctgatttcaacttctcggcagcatgatgtactcctgggggactctctccccttggttctttgcagcacctcctcccatccgctccaacctctccccagctgcctccttttgttccgttttgcaggctcttcggccagtggagtcgggagttccctcaaggctcagtttaagttgctttctcttcttgttcttcactctcttttagacaatctcaataatcaacaaccacctaataaatcctaaatttatagctttggcccaggatcctcaaagttccagatccatgtatccatactgccttctctaggtccctttgaacagaaacatcctcaaactcaagacgtctaaaaccaaacatggtttctttcctctgaacagtagtgaacgttgccatcctgagcaactctgaaagcaaagtatcacctttcacacctcttcattcctaaactccgcaggtcttacattatcaatccacacgccttccaattttaccacctaaattttgagtacctcttgcatctgtccctttctctttactgccaccattctagtcatcacttctaattcatctcccagaatttagtatgtctctacgctgaagctagagatatcttttcaaaactcaaatctattttggtatcagcccacctctaccaattttaccagtcaggtctttctcacccttcagatctctgcatgtgtgaccatttcagagaagcctccactggacaccctgatctacatctgattcttatactcctaaaggaccatgctcttttccctacctcatcatggaattatgtactcatttgtgttggatgaattgagcttcctgagagcagggactgggtctggtttcctcatca

SEQ ID NO: 35455 - DNA, 1255 bp, Bovine  19866881269797
atgcagcagaggcagtccttggagggaaatttatagctgtaaatgcctatattgaaaaaataagaaaaatatcaacaacctaaccttccacttaagaaactagaaaaagaagagcaaactaaactaaaagcaagcacaaagaaggaaataaagggactttcctggcagtctgggggttaagacttcatgctatctctgaagggggtgcaggtttgatccctgctcaggggcactaagatcccacatgccatgtaccaaagaaaacacacaaaaagcagccacctaaaaatatggcagattgaacagactcagacaatggagaacttagaagacaggagtgatatgtgtgctcattgcttttggggtgtagttactccaaggctttctcaatgcaaagaacttgagaatatgtgtacacacacagacacatatttacatctacattgcttcacctactttaatatgtcttaaattattgattcatattcttaaatccaattccaacccaaccatgcaggtttcattcttttgtattcataactcctctcttccacagtgagaaatatggttccaatagggataatgtacattgacttgtttgaacaagtctcctgtatgtaagcagtttgtcatctgtgctgactccgttcctccatatatacacctctctattcttgagaatgtattcctcattgcagattgcccccacccatataaataacttcctcagactaagtgtccatcattgtagacaccctccttatcccacctggtctgtaacatcccacatatgttgcttttcctcattgcaaagcctgccctgaaccacagtgcagaaaagaactaaaatagcagggctgagattgctatcctctgaaaggccttgccagtttggcccttagttggcatctgggaacttggatttgttcttccctaataatggttcactgtgcttaatggggataggcctaatgttttcacagatgtcataataatgctggaggaattaagcacatcctgtgtaactccattgggagaggactcttcagagccagactttcgtttcctctggactttgcaccatacccttgattcctttgctgggtaagagatgcaccatcatcagtctgccttaatactacacaactttatgtacgataaacttatttcaacataattccatttactgtcctctcccatcctttgtgctattactggtatctactttacttctacatatattataaataccaca

SEQ ID NO: 35456 - DNA, 1177 bp, Bovine  19866881333318
tctatatgtatcttccccatggagctgaagttccttgaaaacaaggcccccccagccctattccttcatagttactttgcatagaattcactgcaaaatatgcattaattccatgtctcccaggaaagaaaaccaaggctttttctcagaaacaaggacactggtgtgactggcaggggcagggatttagcaggttgaacttcagtgatgtaatatgaagcaccataggggttgtaattttcaaaaaggatttgactcacagaagatgtttaaagtgaattttgctaaatttatctttccactgactttcatcataatataaaagatgcattcagatggaaaacattcttacctcaagatgaagaggaggcttggtgtagtagaaaacgcaccagttttacaatcagagagatgtgagtttgaatttcacctcattccttattccttgaataaatcacttaagctagtaattgttgtcaggctggcagagagatcaggtataggtggaatactgatgacgatgatgaaagtagttattattataatctgtcaacagtgaagacgaaaatgttctataagtaataaaacacaaaattagagtatacccagaatttagagctatatttagatagcatttggcaccccactccagtactcttgccatggaaaatcccatggatggaggagcctggaaggctgcagtccatggggtcgctgagggtcggacaggactgcgcgacttcactttcacttttcacttccatgcattggagaaggaaatggcaacccactccagtgttcttgcctggagaatcccagagatgggagagcctggtgggctgccgtctatggggtcgcacagagtcggacacgactgaagtgacttagtagtagtagtagtagtataactagtatacctggagtattctttcaattacaaagatgaaaacaaattcaaaaaggttaagctaaaagcagaattattaaatcacaagtcggggcattcaggtgtgtgtctagtttcaggcacatctgaacccagaatttcagtgatctcctgggagctccaactggctctccatgccttgagtacactttagccatagcatgggtcccatgagttgagtcaatccagaaggaaacagaaatgagtggcctgggatgagaaggaaccagg

SEQ ID NO: 35457 - DNA, 857 bp, Bovine  19866881393399
ctcccgccaggtgcgcgccggcgggagaaaaggacgcgtctctcctcccggcaccccacccatgggcaatacttccaaacgactcccagtccgagaaccgcgaaagagccactgtggctcccctctggagaaagcccggccatcagctccgtgatgttcacggccggggtgctggggaacctcattgcgctggcgctcctggtgcgccgctggcggggggactcagggcgtagcgagggccgcggaaactccatctcgctgttccacgtgttggtgacagagctggttctcaccgacctgcttgggacctgcctcatcagccccgtggtgctggcttcgtatgcgcagaaccggactctggtggccctggggccggagaggcgcgtgtgcacctactttgccttttccatgaccttcttcagcctggccacgatgctcatgctcttcgccatggccctggagcgctacctagccatcggacacccctacttctaccagcgccgagtcacccgccgcagtggtctggctgtgctgcccactatctacatagtctccctgctcttttgctccctgccgctgctggatcattggaagtatgcccagtacaacccggggacgtggtgcttcatcggacacaagcagaccacgtacctgcggctttacgccactctgctgctgttgctcatcatcgccgtgctggcctgcaacttcagtgtcatcgtcaacctcatccacatgcaccgccggggcaggagaagccgctgcggaccctccttgggcagcagccacaggagagcggaaagggtatccatggcggaggagacggaccatcttattctcctggctatcatgaccat

SEQ ID NO: 35458 - DNA, 1884 bp, Bovine  19866881720641
tgttgtggctgctctaaaatatcagggactcagactcgttctttcttttgcaccatccttagcaagggtttctcctttaaggatgccttatggcccatgatgactgctggtgcctacctgccttgttaggtttttttctttgtcatcaaggagtgggaagagcatgagtatcagacaacctcctttaagacccttctaggaatgccaaacctgtgacttctccgcacattatgtacctatccttagcttttgggggagtctggaaaagtcttttaatgggggaacttgctattagtgacattctgttagtgaagcaaagagagtgggatggatttggggtggggaaccagcagtatctgtcatacctgtgttccagctactgagatgcttctgtggttccaacttaccattcacttctctgtttcctggcttttgcccatgatttttttgtcttgcttttattgtttccttccttttctacgtcattatctcctacttccttcataagattgaattgaattgtgcgtgattaaatataactcttcggtataagtgagcagttacagcatataagtcagaaaaaaagtaaaataagaaatgtgatctggagatacactgcactatttaactttcctttgtgtttccctaaccaagaaactctgccatttgctctacactcttaagtgttaaatataatcttttaaaggttaattgtgtcacagaagaaacatcgagatactgtggaagtgaaaaggatttgataaaagcatatttattcaggtaaactagtttttttttcactgggatggataaatataaagctatgcctctaaaatattcaagtatacgaaatgtcacgaagccagaaggaagctctgtgtaatggggatcatatgaagcttagcaaaaaagtctaagtaatagatttgttacctcccactttggcttcctaatcgatagattgaggagaatgatacttaactgtcagggttgttttggatattatatgagaatcttatgtaagctttgactgcaaatgcctggtaagtaagcacttagtatatgtcatgttctaagtaggtatgtcaggtcaggtgtgaaataaatgtcttactactttatttttgaggggtctacaggtttccaggttatagatttctccatactggggtcttctaatctgagtcagcaaactcttgggatttggcctaggaagtagggacaggtcctttatcctccgggacctactgctaaggacccttctttgtctcttctgcttgtctccttcccagcccatttggggcatctgtgtatgctgtgagaaagggaggcaggaggaagccctgttgggactcatgttttttcccagtctttttgccaaccacagagcttttcaaagtgagcctgtctatgaggtgtgtatagtaagtatttcagtgtgtgttatgaccagtgctctggtaggtgcatcggatagtggatgagacacaggttctaacatcaaagaacttccagtcagtgtgttagagccacaagtgaattgaatgctaaggaaatctttctgtaatgctttacaggggcaacataccgctgagagaattcccaacggataccttgtttgacgtggatgctatcgttgctcatgtgctcttgtaagttcagggggcacttgtttacttactcatttgttatttatctattgatttcattttagacaatcgcaatccattgtaatacttcagggccttaacattatatttgtaagcatcagttttatacatattgcttgtctgttttcccacgtagtgaagtgaaagttgctcagtcttgtctgactcttggcgaccccatggactaaacagtccatggaattctccaggcaag

SEQ ID NO: 35459 - DNA, 862 bp, Bovine  19866881845933
cacaactgagaacacacacacaccagtaaatagctattaaacataatatacttagtattgtgttttccagatatccttgatatctttgtatcaaaaattaatagtattataaaatcaatgtcattatatatcatcccctctcacatttgtactagaaggaaatagtaaagtattagcaaaatcaaacctgagactaatttcttatattattctttttacagattttacttcattcattcatttaacaaattcctggggcacaactttgtcgcacacctactcttaccaggtattgtcctgggcaacagaagacagcagtgaaaagagtagattctcctgtccgtacgcagccgcagctgatgatgccttccagtttcagtgtgtttagagctggcatctcttttgtcatgatgtgtattttttatacatcagcagtagactctccagagctgagtcctcagacattcttcagtacattgcaaccaggaaaagccaccttagtttatttttgtcaagctggtaagtattttttatattttaatatgatttttgtgatgtttctattggtgtttaatcattatgctcagggagaacttattgtcaggattaataaaatgtgctttaaagctgctactatgatatgcctacctgggtttgaatcctgactttgcttcttcacctgttgtgtgacgtgggtcaagttacttaatctctctgtgtgtcttttttgtcatccataatgaggaagtagtgtgtgctttataaatttgttgtgacgattaagtgacttagctcatgtccctaatccatagtaaatactaggtgagaattagctatgagtaatatcatttcattatcattt

SEQ ID NO: 35460 - DNA, 738 bp, Bovine  19866882121595
aggctggcaggctacggtttatgggctcacagaagagttggatacaacttggcgactaaacaacacactgttcctatgtcgatctctaaataaaatacatatgtatatacacacatatatgaaaaattcccctcagcatgtacaatcagagaaatattttctctatgggtgactcagcaccctaactagtattttgccatttattatataatgatgataattggcaaaaatttcatctttgtttctatttgctaccagattgctcagggttaagttttacgatcactgcattgtttctaggtattctacctaattatctcctacttttattgcttgactcttatccttgttttaatgattttattgtatttgtgctttttattatctaaagactaattcttttcataaggaggcccagtgtaaataataaacaagaacttcaggacaccaggcacctgaggtaggcagaaaacaaggtcaatgtgggtgaaaaaacatgagaaagggaaaaaggagtaaaacatagaggcatttacttcatgatttttcatagaatagaaattaaaaagttacgccctctggattttgctttctaagatggtaagccacatggcacacattaacagtcttattcttctttctagtgagttcttttttttttttttaattttgaagacaaagtagaaagcaaaaattactagacagcaatttttagaaagcaaaatttaataagaatca

SEQ ID NO: 35461 - DNA, 901 bp, Bovine  19866880244153
ttacccggctgctgctgctaagtcagttcagtcgtgtcctactctgtgcaaccccatagatggcagcccaccaggctcccccgtccctgggattctccaggcaagaacactggagtgggttgccatttccttctccaatgcaggaaagtaaaaagtgaaagtgaagtcgctcagtcgtgtccgactcttagtgaccccatagactgcagcctaccagggtcctccgtccatgggattttccaggcaagagtactggagtgggttgccatcgccttctccgaaaattaccctaaaccttagcaaaactgactgtttgaagctcatgaaataagaaatgatgtgaaagataaacagaagccatgagtgtttaactctacatggcattctgcagcattatatatttcacaggagtcaaagtttgaactggactatttgttttgctttctctattttttacaattttcctaaatgggtctgatttattattattatttggaggggaggattttgtattggcttggtgtaaatatcagaattcagaaaataaacaaattcagcaaataataataaataaaagaggctactccctgctccaagtcaccatttgaataaaaaaatataggtaggggtttttgtttttgctttaaggtgtacttcaccacccccttccaagaggaactttctcattctccctcctgttccttctttccttcccacatcccgcaaaaatacatatcctcagaaagtccatgctccactctaacccataacaaagaattagatgcagcattgtggaggatctaggaaacacccagctctgcagagctcagattcagctgattagaatcagggagcagctgttccagtgttaccaccacggctgagaaggcacaaatgcaaa

SEQ ID NO: 35462 - DNA, 1337 bp, Bovine  19866880361175
gagttctttttgtcttctttcttttgttctctgatcctttccctaggaggacacagttatcatgaagcctgtctaacaatgaggacatgagttgagttatggaagagctctgctagaagtctctacccatcctgactcatcccgtaaattatgctgcttcttgagagtgtgttgactcctttttagggtttgtctgttacctcatttatctgaatataagaatgttgagaacacgctttgctttaagaggcttattatgggataaaagaagggactgtgcccctgtagatatgaagcaagccccagataaacattttatgaaaggacagttttccaattaaagccttttagctcctatacttaagtcgtctttacattccctgtttgatctctgagaattgcagaattaacaataaaggaccttattcaatataagcccctgagtctgtggataaaggaactgaaacctaaaaaaactgacttgcgttgtctaaggctacagaactacttaaatgcagaactaggattaaaatctaaatctgatttctggtctagtgtgttcctaggaacacttaggttactaggaaactctagggacctaaacatcagttacctaagttgatgaggtgggcatgactaagttaatgcaaatcagcactcccaccactgaactcagcactgagtttcaatgccccacatcacagcgtggggtgttcaattatctctatttttaagtattcaacagtcagattgtattacagaccaatctgggcctggtggaggcagaatatcagcacccaaaaccccttcatttcaaattaaatgtaaattcactctatttttcttcaaggtggctctttgctttagctagaactttcccctcacaattgaaagcctttcttaggagcctcctgtgtgcaaaaatgttgacttcaaggccaagggggtcagaaccaattgccagaggcaaaagatgtatttaattataatgtttttgtttcgtgtgggagagcaatctaaggatattggtgagtggcttttctttgagtacctatgaaactccatgtagcacttgaccaagtatatctatagagtatgtcattgtgaagggctcagtgtctttttgatactggaaagcatggtctgaaggcagactatggaaccctgtcctcacatctctactttttgctgtgtagcctcaggcaagatactaaatctctctctgcctcagtttttagatatcaagtggagattaaaagtatggacctgggagttttaagtgagttaaacaaggagatccacccagtccactctgaaggagatcagtcctgggtgtt

SEQ ID NO: 35463 - DNA, 1813 bp, Bovine  19866880387995
tgagtagaactttcaacactgtgtttagctgaaattccagtgttaacccaagtcaaataacattcctatccacttctccagaatttgtaaaagctatttaggtcctatttataattcatcaaacattgactgaacacctactgtatgcgtggcacacaacagaatcaaacaagtaatttaacatttcaaaagataactactaatctcacattggcttatttcgattaagctgaagaagtaatgatcttctcaaaacagtaaatttacactttaatactggctttcttgaaacactttggcaaagtttcataaacagacatatgtacgtacaatcatcctctcttatccgaggttctgcctcctatagtttgttactcaaagtcaactgcagcctgaaaataatgaggaaaattccagaaataaataattagcaagttctaagttgcaggccattctgagtagcatgatgaaatctcgcgatgtcctgcccgtgacttgagtctttcctttgcctgcatatcagctgttggtgtgggtggtttgtagagcttgggttcaggtaacccttactgtgcttaataatgacaccaaagtggatgtctagtgattgtggcgattaagttatgccaaagggaagctataaagtgcttccttgaggtgaaaaggtgaaagtactcaacttgaggaaagggaaactatccaatgccgaggcctatggtaagacagaatcctctctctttgaaattgtgaagaaggaaaaagaaacttcggctggttttgtttttctgtacctcaaactgcaaaatttatcaccacagtgcctggtaagtgctcagttaatttggaaaaggcattaagtttgtacaagatattttgagagagagaccacattcagtttttattcatttcagcttttattacagtatttttgttataattgttctattttattattgttgttgttaatctctcactgtgtctaatttacaaagtgaactttatcatagatatgcacgtatgtggaaaaaaaacatagtatattgatataaacgtttccaggcattcactgagaaacgctttccctgcaaataagggggactactgcaaaagcaggaaatcatgtgaaagatatagtcttttgtttctttgttttttattggggtagataaagtctttttttaaaaatccaagtttctcatctttaggaaaaatcataaaatcataatttctcatctttaggaaaagtctccaaagattttcaatttgaaatattcttttgtttttgttgttgttcagttgctaagtcacgtctgactctctgcgaccccttggactgcagcacgccgatattcttacttcccattaacttttcttgaggatccatgtatccaatacaggttaaatttactttgtcttcagtccaatttttgagaccttaaatgtattcttagatcttggtcttgacaatttatcattgtttttcttaatttaaacagtaatacatgagcgtctgattcacagaaagggatatataaggaaaagttctgctgctgctgcttctaagtcacttcagtcgtgtccgactctgtgcgaccccatagacggcagtccaccaggctcccccgtccctgggattctccaggcaagaacactggcgtgggttgccatttccttctccaattcatgaaagtgaaaagagaaagtgaagtcgctcagtcgtgttcgactcttagcgaccccatggactgcagcccaccaggctcctccgtccttgggacttaatcttagcaaatgtgttgaccaagggattaat

SEQ ID NO: 35464 - DNA, 1186 bp, Bovine  19866880483931
ttctgtgtgaatttgaacgggcaaagttcaaatgaaggggtgttttgaggtcctgagtttgtgtgtttttctcacttgtgatcacaaagaatgaaaacaagttgatgagaggcaggatggggtaagaaaatgaaatgtttgggaactgaaagttctcacgtgtaccggatacattttgagacaacctggtggatttgttatggaaatcagtggaggacttgaaaccatatacagttgtcttaaagaaaataagtctgtgtgctaccccagatccatattggaccaagaccaaatgtaaggataaggtgcactggtcaacagttaacaaatcaaccaacctatcctatgagagagatagatgccacaccttcaaagggcgcctatcttctcggggaaatgttgccctgagagctggggtatagtataaaaggctatgtcagggggaatatttttgaattgataagggagtttagaaagctaaggggaaagttccattagcagtttcagaagaaaacgagtttaaagggagagtggcattctaacatcattctacggtgatttgatctgtaactgaatagcaaattacaatatttttattttctgttatcaacttaagagtgactatcttcatattacaaagtatggcttcagttttacctgcttccaatacatccatgagatctgacaggaatacatatgttgggtgagtaattttgactttttttctattgactttgacaagatggaggttccttggactttatattaaatgttcagaagatggatctctacagttatgtaagtttcttaagtttagagatcacatagttggaaagcagttcagaatacaaagcaaaaacaatgccaattttcttctcagtggcattttctttcctcagttcttgggagagtttagctcatctttaagaaagtggggcaatatgtcaattacatctcaattaaagaaaaaagaaagtgggggcaaaacaattcaccaaaaaacatggaaaagctgaaccaacctgcctgaatgaacaaattcacagttcagcctgaaattcagtggtggaggttcagtctttaattccaagactatgtgctgtatctgagatataattaaaggggcctcctggtatctaaggcagatttaactgtgttgcagcatattgcaaagtgatttcatatg

SEQ ID NO: 35465 - DNA, 2008 bp, Bovine  19866880485560
atgtatgttgattttataatttgagattgtatgtaaatccacatgctttatttctgtgcaattggagatttttgattgtcactatttcaaggggaagaattttacattcaaagtggtccaaaagatatttattgatgtttttgccttaaaaacaaacaacaacaacaaaaaaatattgtgtatgtatcgctagccatggaacagattaaaaatttggcagtcattttaaactgataacaacagatactatactttatcttagccaaaaggccgagaagtgatgagaatcattttggaaaggcaatagaaatatgtgtgcccactgggcttattttggaaacaaaaaagaatttgaaaatgtcaagtttacaagagcagaatccctttgtaaggtgccagaacatggaacatgcttaacaagaatcaagcatagattattgacattcctcaaattgttagtggaagcacactgactgaaaccgcccaccctggccaggcaccatagtaaccatttgcatgagctgttttacgacaggagataaaacaactgaaaaggtggaacatggaactactaaaccaccaccacccgggagagttcaggaaaggtcaaaatatgacaccacgtgtccaaccatctcccagaatccttctcatggcatccgtcttggctgaacgaggcgtgcaccagcaggaaggactctgagttagaacgacaggctgaaggcaacctagaaactaatcccatcaccataaaacctgagactgcaagccatgtggcccgagcagttctcctgggttcctttaccctattctattgctctctgcccaggcagcccttcccaataaaatctcttgctttgtcaacacatgtgtctccacaggtgattcatttctgagtgttagacgagagcccactttcaggccctggaaggggtcccccctcctgcaacaaaatgagagtgttcatgagcatatttgcctggcagtgagaaaaatctttgtgtttttattaaatcatattaaaaatattcacagttaactcctactcacttgctcagaggagtttttgtcaacactttagtgagatttcttggctcaggcctttgtctggtcattgatatattaaattgtggcttaaaaaatatatgtatatatatatgtgtgtgtgtatgtgtatatatatatataattgtagtttttaatatcccccaaaccaaaagcatttaatatatttatataaatgagttataccatatataatgctcaataaattgatgttttaaatttcatcagtctacttatttttataaaatttagaatcaagtttttaatatctaagccttttaaaatttatttcaccttgaaatttcttattaagtttaaaaatttttttccttctcattagcattttaactattttaatgaatccctttctaaagttaatgatttcttgattttcttctttcatgtgtgtgttggttacagatgtccaatcaccccactcccactccatcctccttatactatttgaagtttgctgttattgttcggtccctgagtggtgtcctgactctttgtgaccccgtggactgtatgtagtatgtagcacgccagtcttccctgtccttcactatctcccagagtttgctcaaattcatgtccattgagttggtgatgctatctaaccatttcatcttctgccgcccccttcttgtgccttcagtctttcccagcatcagggtcttttccgatgagctggctcttcgcatcaggtggacaaagtcctggagcttcagcttcagcataagtgcttccaatgaatattcaggattgatttccttgaggattgactggtttgatttcctccctttttaagggactctcaagcgtcttctccagcaccacagttcaaaagcatcagttctatggggctctttatgggccaactgtcaacatcagtagcatcttcccaagtggcacagtggtaacaaaactgcctgccattgca

SEQ ID NO: 35466 - DNA, 1011 bp, Bovine  19866880521789
ctttacatgtgtgtgtgtgaaggcctctcctgtggggatgaggcccactgtgaaggccagcagtgcttttcctcgctgagcataaatgatggcttccacgtctaccagaaaggctgcttccaggtctacgagcaggggaagatgacctgtaagaccccgccgtcacctggccaggctgtggagtgctgccaaggggactggtgtaacaggaacatcacggcccagctgcctactaaaggttcccatggacttttctatttctaggtcaagggttttagtcagtcttatcctggttctttgtgggttaaaaatgtgagtagccacaaggctttcctcctactctttgaacaatgggtgacaagcaagttaggtccagtgaggaagagaaaggcatggcctttgggaatctataacgaggatgggcgtattagggaaagtgagcagagtgatatctactatggggacgatttggcagaccagatgtctcttggtgtcatgaggaggtgagtagctcctgatacctttttctgaaaggagctatgatatcatactttctaaaacagttgtgcttattaggtacttgtctctatgttgagtatgtagggaagaaaatggaacataaggctctggtatctgagaggaatgccttccttcttaagaggaaggagacaaagccattctcctgtatcagatgcccagtgatctgtcactgcaaattgaacctgggtgagatttcatctcaaccttgtaggttatgtggaatcttctccatattatagtcaatatggacttcagtcctcttctgaaactgtttccccataaaatgagccctgaactgcatctcaaagtccctacaaatattaatgtaccttagtctgtagattcagctcaagccaaatttactgtcttaatatatagcacatttttaataggtgtccttaatcaatcttacactcacacaaaaaagaaacaaactataggagagattatgaggagcatccaaggccagaa

SEQ ID NO: 35467 - DNA, 2636 bp, Bovine  19866880594822
atgaaaaatctctaggggatggcaactttgtgaatgctctgaagtgttatcctagaaaaattcacttgtgcacacttcaacattaatgtgcaaggttagccctgttcttgtcttccctggtggctcagacagtaaagaatctgctggcaatgcaggagatccaggtttgactcctgggtcgggaagaccccctggaggagggcatgtcaatccactctagtattcttgcctggagaactccatggacaggctacagcctgtgaggtcgaaaagagttggacatgattgagcaacaaacactgtcacttttcactttaaggtgagaattggaccgtagttgacttaaaatatttcagatatatgttttctacttaaacttttccctaccaagggggcttttacattacctcaaagtattcagagaagctttaactactagagctatttaaagagtatggaatgtctttgcaacttacaaatgaaagtgtgataaagtttaagcagtgttttaattggcttttcttagttttccctgaggcagataaaccaaactagcagaagaagctgacagtgaataacagcaagtaacaaatcttgctgatctggctcttagatattgttcttgacagcacatgcctaccatgtagaatttaatataaagctccctcagtagataaagctaatgaatattgtaatcccactttgaatagactcttgagttcttgtttccaggttttaggaataaatgtgcaatcttaaggatacagaacagagaccagtgcccaaaatgtaactcgtttgcttgaaattgttaagttatgaacaaaaacagggcttccttagtggctcagacagtaaagaatctgcctgcaatgtgggagacccaggttcgatccctgggttgggaagatctcctggagaaggaaatggcaatccagtctagtattcttgcctggaaaatcccatgaatgaaagagcctggagggttatagtccgtggggctgcaaagagtcagacatcactgagtgactaacacacacaaaagcataaatatatttatttataataattgcctataaattattatgtatataatacatacaggaagagagagagggagagtaaaaaagggagatataaatgataccaatgataaacttctagtccgtagtttggaaacactcgcagatcgttacaatttttctaccaccttcagaagccctggtttgtctctcctgggaactgtggtgtttatttttgcttactttcattttgcattgtccatgctaagacctggactaggggaatgggcaatactttttatgacccaaggcctggtacaaagccatcacctagtagttcacttgatgaaagtttctcaatcatgatcactggggctgggatctccagaaacttcctagaagtagtgggcccctgagttgggcctggagaaagagaggatttaaattagtgagcaggaggtcattagcccttatcactggggactgtgcagtgaagacaagcagaggagggcacacagtgggaagccatgagaagttctgaagaacagagagaggcggtaagtgcaggatgggctgagatggcgacctgagatagggcatgtgagtataatggcccacctgtgacctcagacagcctcacaccagaatcagaaattatcatgccaccttttaaattaattctctcatgtagcctacttcagcaagatatttcaggaagataattggaattggctggtttccaggtatcttaaagatcaaattccaaacaaaatgtgggcaaacttcaaagtaatactttttctgacatttctcagaccatggaccacagccactattctcagctcaagcccacacccgttctcagattcaggtgagaaaatgatgattgctctaacatcacaacactctctaccaagtagttaccctggtttggctggtggcaccaactagctggctgttggtgggagcatcctgccctctgctggctttggcaggaaaaacaaatttgcattgcctgttaaagaattaatgaaggttgagagttcagggttttatctgaaactaaatatttgcttgcgtgttgatgaggactaattaaccaaggaatgcatcccctgaatgacatgtggcttcttagaagacttccaatcatcagggaaaaaaaaaaaaaacctttgtgtagcatatgcatacttcttgctcagtaaataggggtacaatattagcatttttaaagaaatgtgaagaatcaacgctgcatctttaataatttttgaagtattcacatggtttatgatggaagaaccttgggagtactgtcacactgcctgggtttatgtataaattctgcaagttaactcaatctatctgagatgaagtctcttcatctgtgaggatcagatgaactaataaggaatgagaaagcacttcactgtgtccattgaaagtgtgacatcttaaatatatatgctattcacagattcacaccagaatatgcacacacagaatacacacacacacacacacacgcacaaagtgatgtggaggaggccaacctcagtgatatttcaggttcggatacaaatcactgcagtaatgcaagtatcacaataa

SEQ ID NO: 35468 - DNA, 921 bp, Bovine  19866880626046
ttcccctcttgaccaaacacagtttaaggagtcacaaggtttccttcaactaacccactgaagcccttagaacagctgtctttcccaaaactgtcaggaaatctcctcaagtagaccttcagaagagaagactgggatatgaactgcatgggaaacataactgcatgcatcttattagaagtcgtttaatttaattagcagcaaggccccaaccttgggaaaacccagcagaagtctaagtggcagatttcacagtggccacgaggtggcgatcttctgcatctatttgaaatgctcttctgtcatccggttttagcttactttcaatattaaacacatcattaattttaaaagtgtgtattaattttaaaaggatgcaagtagatatgatttaaccggtgagacttcaaacttgcatttcactcaaatactgacatgctctaaatggggaaatttagtgagatttccacatcagaccccagaaaaaagataaaaatctgtttgagaaaaggctgtggtccttgcaaaatgaaaaatgtcactcaaagaaagtgtcttaaaagccttctgggaagctggttttcttgagaagtagcagatgcactttggtcatcagaaaaaaaaaaaagcatcatctggtaaaacttccttttcactggtctgtagtcaagatcagaaaatgaaagacagggagtggggcaagagagagaggaagagagaaagggaagaaggaaagaaaagaaggaaggaagaaagaagaaaaaagctctgggtgaatatactaacatcagaaaataagagccaagctgaatcaaaaagaagagccaaactgtggcatggcttgtgtggacctgagcctttctcccagccattctagtgagttccccaggaggagcagtagcaggtgaggaagccagtggg

SEQ ID NO: 35469 - DNA, 1536 bp, Bovine  19866880657027
tgaattactatgttgtgtcccaggaactagagtagtgtcataggccaattatgcttcaaaaataaacaaactcacagaaaaagagagcagatttgtagttttccagaggtgaggagtgaggggagggagaaatcggatgaaggtagccaaaagctgtgacaaacctagacagtgtattaaaaagcaaagatatcactttgcaacaaatgtccatatagtcaaagctatggtttttccattagtcatgtatggatgcgagagctggaccataaagaaggctgagcaccaaacaactgatgcttatgaattgtggtgctagagaaaacttttgagagtcccttgaacagcaaggagatcaaaccagtcaattctaaaggaaatcaatcctgaatgttcattggaagaaccgatgctgaaactgaagctccaatatttggctacctgatatgaagagccaactcattggaaaagaccttgatcctggaaaagattgagagcaggagaagaagggggcgacagaggataagatagttggatggcatcactgactcaatggacatgagttggagtgaactccgggagatagtgaaagacagggaagcctggcgtgctgcagtccatggggttgcaaagagtcggacacaacttagcaacagaataacaacaagccaaaaggtacaaacttctagttgtaagatgaataagtactagggatgtaacgtacaacaggataaaaagaagatattagtttctttcttgtccaggggaaagagcagagaaggaaaaatgtggaaaaaagccatagatatatgatatatctgaaaaggtgaaaaataaatctccgctgtacataatggaaacacacatagccttagaaattctctttctccccctcattttgctctaaaaatgtcaaaggggaacctctagagtattcaggaaacaggaatccattgtaatctccattgctagagagggataatcactgttaagttaaagtatatgtttcattcattttacattggcacttcagtcgtgaatacaccaggctatatttttcttcttcagtgacccatttgccaaaagtactacagtgattaaacactaagcaaatacatacatagataagataaagaatagcactgaaatgattgaaacctaaatttacccaacacatttaagcctggtgcagcaaggcatatgtgcgtatctgtctttattaatggatttctatttctagcttctttccccctccttgctttggtaatgctatatgtaggtacaaaatctagatatttattcagaaattggtattttactactgatgagttgatacaaataatgtaactagggtcattataatgttaagtgagttttgaacaaatagagttagaaatccaattatctttccatagaaagctttttgtagagtcattgttataaaaaggaggggaaccagtgggaacattagaacaacaatttctcctgcctgcaaaggacactggagaatttcatctagcacatacattaatctgt

SEQ ID NO: 35470 - DNA, 2197 bp, Bovine  19866880697177
gtcccagcaaggcagagcatctcctgaaaatgagtatcagtttaaacatatagcattttcatctgctttccgagaataatttccagatgtgtcctctgtgaagtaagacttcccagttgtgaaggtgtgaagaggtcgatttagtggatttgagagatgctgctctgatacccactttgtgggtagatgagatacatgttgtacttgaatgagaataggtattgcctccagaatgcagtaaacttaaagttcaacagtgcatttttggtatttttggctgataagaaagacggaggtgaaaagttatggtagggaatataggttaagagttatcgacaaatatgtgcttccctagtggctaaggcaacaccaccatttcatgaaactttgttatacaaggaccaggatgagcctcctattcagagcttcctggatgtaaacttcacttactcagcaagtacagcctgcttcttacaaaggagtgaattcctagtgtgcaacttgagtctcttctcaataatccaaacttgagaagtaaacttatctacaatagcaagattcacccttagatttacttgagcattctcctcatgataaacaccacttgggaaaagagcaaaggaggaggaagaataggagaaagacagaatcatgaggatagaggaaagaagaaaaatatggactgaaggaaaaataccaacaatcaaggaatatgtagtctctggcagaaatactttttctatcaccatctccttttatgcagttgaaacagactgcccttaggcaccttccaccgaccagccataaatcaaatataaatgccgatagcttcacaaatatgattcatggaacaatgtggacttaaatattccctttgcccttttaaaggtagcaggatcaagaggactcagacaaggacaacgttatatgagatcagttacctaccattgctcaccatccgcctggccacctcccacaagacaagtccaaaggcccaaatatcgactctcttgtaagaatcaaaacaatccacctggatagtttcatcaagaacttcgggggccatgtagcgtttggtgcccacacgggggttgttccccacatcgagctgattggtgctctgggaatgcatgactgccaggcctaaaaggaagaagacaacagtgtcaacccactccctttctcacagagggttgctgaaggttttcaacccaacccagtcaactgcgccctcttgtggcactcaaggtgactgccatattccccccaacacccccgccccccgcccagtcatccctggagtgctgttgtgatgacttaggtgagagcaggaaacagggctgatgccagaaacatcctgggtgtattaagttaatataggaacctcagagacaaaaagattttgagtgaataatacaccaaatcaatatgaagctggtgttcagaatccacaaggaaacagactcacttgttaaatgggagcctcaaaagaagctctcagctccagtacagctcccactggtctccaaacaaatttcaaaccgtttgaagaagggactttgaggtaatttatcatgacacaaagaggcgactgctccaggccctgctctatccctgaaaaaggaccactcacctgaacagttgttattgttaagtcactcattcatgtcgactctttatgaccccctggactgtagctcgccaggctcctctgcccatgggattctccaggcaagaatactgggggtcggttgccgtttccttctccaggggatcttcccaacccagggatcgaacccacatctcctgaattgacaggtgggttctttactactgagccacctggaaagctccatctgaacagtaacctgggccaaacccacaggcttttttctcaacagccacatgtacacagaacaataagctgaccccagattcaaagcacagctctcatgttaaatggttttgaagcactttcttaagccatgactcatttcggaattcctcagccaactaaagagacccacattcctcacaaaccaagggacagatacacgcatggtttatttgagaatggaatttttgatgcataggcagaccaactgaaaatgatttctctgacactgagaataatgaaaattgccagagtgaagttagcaggctgtgtaaacctttgtatctcagtgggggatcccct

SEQ ID NO: 35471 - DNA, 4651 bp, Bovine  19866880699195
agcagctaggcttaatggactcttatatatggatctggagaaggcaatggcaccccactccagtactcttgcctggaaaatcccatgggcagaggagcctggtagactgcagtccatgggatcactaagagtcagacacgactgagcgacttccctttcacttttcactttcacgcattgggagaaggaaatggcaacccactccagtgttcttgtctggaaaagcctggtgggcttccgtctctggggtcacacataataagacacgactgaagcgacttagcagcagcagcagctgcatatatggatcatgaaaagttacagcacctctatcactgttttaggtgatcacatatcttgaaagcgaaagaaagaaagtaaagttgctcagtcatgtccgactctttgcgaccccatggactgtagcctacgaggctctatccatgggattttccagaatactggagtgggttgccatttccttctccaggggatcttcccaacccagggatcgaacctgggtctcccgcattgcaggcagatgctttaccgtctgagccaccagggaagcccaaatggtctgcaaaatggacataattcctattgtgttgttatgcatgctgggaggattaaatatggtaatatgcatgcaggtctgtagcatagcagtatctggtgcctgatctgtgttcaaaaaattgtggctcctgttattatttactttgcaaggaaaactgggacactagtggtgttgaatgtttccatgttccccaaagtcagattctaacagggtttagtaaacagtccaatgtgtgtggagtagtctggtgtagagtacgtcagtcctcgctacttgtatggtatttatttgaaaaatgataggaataaaaacacacttagtgactgtattcctgagctgatgtgatgctttttattatgctcgctctgtaaagctacacttcaaagttcctacctgcaaactgggaggatagaggttagagtatggcttagttagtattaaatttgtgtttttagccataattttgtgactgttaaggtctgagaggtttaatctgtatcgcttgttttttatcacagagatgtgattaaatacattgttctttgtactaggaaaccttgaattcatctgctgctttgctggtttacagactgaagaaaagagatcatagtagaatgagcctcagaacggtttcctgcccagaggcaatattttggattaaaattcctttctctaggcactgactcaatggacttgagtttgaccaaactcagggagatagtgaaggacaggaaagcctggcatgctgcagtccatggggtcacaaagagtcggacatgactcagcagctgaacgtcaacaagcccttcagtgtatcagataatttcgggctagagggaggattgggcacggagtgctagaaattgagtgcattgggccgtatctgactttgaatgttggttttgttactggaggttgaagactttttttttttaatttattcatttttaaggaggatatttgctttacaatattgtgttggtttctgctgtatttcaacatgaatcagccataggtatataagtatcccctccctcttcaaacctccctcccatctccctcacaatcccacccctctaggttgtcaccgagcaccagattttgatttgagctccctgcatcatacagcaaattcccactggctgtctactgtacgtatgttagtgtatatgcttccatgctactatctccattcatctccctctcccgctcttcttccccaccctagtcccaaagtctgttctctatgtctgtgtttccattgctgccctacagatgggttcatcagccccttctttctagattccatatatatatatgtgttagtatacagtatttttctctttctgacttatttcattctgtataataatctctaggttctggatgttgaagactttggccagagttaattggctcatgagttaaagtattccttacgtaggagcatatgttcatataattttcatacagttgagggagtcttcttgggtttagggccttagagcagctctttcacagttagatgaatgagagaacttccatgtggagttttccacctgaacgtacactgcccgagggtaagaacttggtcatatttgctatcatacctccagtgcctaagacctgcgggcccgcccccacccaaccccgccccagctcagtacgcgttagtcaagtccacaaatggctttgggaaggaaaggaagtgaattggtggggttcagaatgccccctggactccatgctgtcatttctgaatcagcctttcctaggggtcaggcagttgtttagaggagcgatccctccattctgggggccgttatgtgttgggacatcaactatgtgccagacaagccaggaactgggaggaaataccaccagagacttcagccagggtcgtcttcagcatatggcttattacagtttctgtttttcaatggatgtgacaaaggatagttccctagaatgactcctcctaaagtaccggggtgatctcgaggttcgagggactagaggagtcttctaaccattaagcctaagtcagtcctgagaattttgatccattttattgtccctgagaagctgatggatacatgtggacattgacttacttacatgatttctctttcttaatggccttcttttgcttctttttgctgctctctccagccccaaccccaggtgaggatttaagttcagccctcacctgcttcctgccccctcaggtaaaagaatgaattataaaggtttggagttcctttgtgactgtcacgatgagaaggggttgagagtgagctggtcttctaattcccttcttccctccctccctctattcacaattttgagcctatgtgttctacagtttttctaagcactgagatcttacatgattttcaactttaaagtcccctcttttttgatctttggggatccaaaccaagtatggacaagaataagtagggtgagaaacagggttcaccagggtgtctgtaagttcacacgcacgtttcatcattttgccgtacctggtaggtggtgctgaacttcttgggggaaaggcctgccgttctgttaccaacaagggagcaggaagtgtggttgctgtcaggcgggcagccaggaggatatttatagtcatagccagtggctgtgggcccatcatggttctggatatgcctcccgccttagagttcctggtgttcttgaactgaaccctgcccttgttggccagacagtggttaatgataaaacagatggctgcacgatgtggtgctcatgatggcctgggtagctctcagcctgcaggtgctgctgtggctgacctgaaccccgagtggcagagcagggatccctctcccacttctggtcagggcctcaatggtttctcagcctttctctgagttggcttcattgatgcaacactcactaactgggatcccctttctctgtgctgcatggaccacatcttgtggagatttatgacaccaaaaagaaaatgcggatcatgattttagcttcctcatctccttgaattcaggtcagatatttagacttgccttgcagaagaggccacagtctgttgacactttgcatgtattcactcactttggggtgtgagtactagagggaaaagtcaaagttctcataggaagtatcccaaatgcaaaatgtttttcttgtttacatggtgaggttatagcatgagttttgtgtttatcagtgggtgttcttggggccctctctggtggctcaggtggtaaagaatgtgcctgcaatgcaggagacctgggtttcatctctgggtcaggaggatcccctagagaaaggaatggttactcactccagtattcttgcctggagaattccagggcttccctggtggctcagcagtaaaagaattctcctgccaatgcaggagacacaggagacattgttcgatccctgggtcagaaagatcccctggaggaggaaatggcaacccactccagtattcttgcctgggaaatcccatggacagaggagcctggtgggtccatggggtcataaagagctggacacgactgagcaacagcaacagcagcctgggtgtttttagggtggaatgatggttcatttgttagtttgcatttgcaagtggcagaaaacacaacgtgggttagccttagtaaaatgagaatctaatgttggtcatactgaggagtctagagtagggcaagttttagatctgggttgacccaggactctagcagtgactcctggaccctgttgtctcccctctaactcttctttctttgtcagctccattctcagtgaggtgctcccttcctgatagcaaaatgaccatggtatattctctgaggttcaagtataatggaaaaatcaaactttgttttctagcagttcctgtaaaatcccaagggtcactctgattggaccagagtaagccacatcccacacctctggagaatgcagtgtgctgattggtctacttcccctaccctgccatcctctcaaaataggaggagctatagccccagcccagagtcagaggttaggcggaaggcgcaa

SEQ ID NO: 35472 - DNA, 1467 bp, Bovine  19866880727513
attggaatgaaaactgaccttttccgtcctgtggccactgctgagttttccaaatttgctggcatattgagtgcagcactttcacagcatcatctttcaggatttgaaagagctcatctggaattccatcacctccactagctttgatcgtagtgatgctttctaaggcccacttcacattccaggatgtctggctcattagcatttagtattttatgtttcagttcagtcactcagttgtgtcccattctgcaaaccgatggcctgcagcaagccatcttccttgtccatcaccaactcctggagccttctcaaactcatgtccatcgagtcagtaatgccattcaaccatctcattctctgacattcccttctctgcctgccttcaatctttccagcatcagggtcttttccagtgagtcagttcttcgcatcaggtggccaaagtactggaacttcagcttcagaatccgtcatatgaatattcaggactgatttcctctaggattgactggttggatctccttgcagtccaagagactctcaagcgtcttctccaacaccacagttcgaaagcatcagttcttcgatgctcggctttcttgatggtccaactcacatatccatctgtgattactggaaaaaccatagctttgactagacagacctttgtcggcaaagtaatatctctgcttttaatatgctgtgtaggtgggttataacttttcttccgaggaggaggcgtcttttaatttcatgggtacagtcaccatctgcagtgattttggtgctcccccaaatagtctgtcactgtttccattgttctcccatctatctgccatgaactgatgggactggataccatgatcttagtttcctcaatgttgagttttaagccaggtttttcactctcctctttccctttcttcaagaggatctttagatcctcttcgctttctgccataagggtggtgtcatctacatatgacattgccagagaaggcaatggcaatccactccagtactcttgcctggaaaatcccatggatggaggagcctggcaggctgcagtccatggggtcactacgagtcggacacgactgagtgacttcacttttacttttcacgttgatgcattggagaaggaaatggcaacccactccagtgttcttgcctggagaatcccagggatggcggagcctggtgggctgccgtctatggggttgcacagagttggacacgactgaagtgacttagaagctgcaccttgggcttcctgtgaaactttgcaggatgacacctttaacattcttttgctcttaagatccttaaaggaatctgaggcaccaccttaagtctttccagggtcttacacttacagtctacaggttttacctttagaccatgttttcctggcagcacccttgatttgatctcagcccagaagccatttctgtcctttagcat

SEQ ID NO: 35473 - DNA, 1213 bp, Bovine  19866880764146
ctgattcatctccacatccctccactcagctcatcaaagtatctcatacacagaggagggcccctctgaagtccagagaggtttgggcctcttccactgtgatgccttctggtattatataaagaaatgccaaaactcagtgacaaaaactgtgtatgttttaaatatttacaaaacatgccaggcaatattattgggctggtctcaagataattacatggtccagtaatgagacaaaagttcaaagttgtatgatccaggacgccttctttcaatcctgttggtgtacttctgggctctgtcattcagaagtagtattaagaccaatgtgaaggccttgaaagtgggctgcttgggccaaagagaacttctgttcaccaccaccaccacctcccaagggccctacatagcggcgagtggaggagtcgtggaagagtcgggaaacaacttcaacagtgaacacaaggtctctatcctcagggaagttacaaactaatttttttttaaaaaaggacacactttccacccccatccctctccaaatataacggaagaaatgttgcaccagaagaccaggactccatcctggatccatctttaatcatggacaagtcttcaacacatttaaacttcaggattttttcttttccctgtaaaatagaatatattaattttggccatgccttctatacaaaggttatctaaaggctcatataagatgtggtggtattttagtaaactgcaaagcactccacaaatgaaagttacatgggcccaatggttgagtatttaatcacatgctgccttatcattgccattaaaaaaaaaaagacagttataaacacacaaattcagaatccggcattgttatgtccggcaaacagtaagaaaaggggagaaaaggtgtgtggttatgacttgaaagtaaagcagtcttatggggccccagagagctctggcaatttttctgtgaatatctgaatactccttgtaatcgttactccttgttgaaataacttccatgagtaaccacagagatgactactcctcaaacaaacccagatttactccctaacaccccatactatgccaggcttcttctgcagttagaacttctagagtcatttgtgcgagcaagtctcctccctctcaacccctctaatctcatttccggctcatgctaagcttacataaacagaacagcctaaattac

SEQ ID NO: 35474 - DNA, 1123 bp, Bovine  19866880818145
aataagtatatttgtgttgatgtccattaattcatttactgggcctccctggtggctcagagttgaatatccctgcttgttcatagaaaggcaaataacattcccccaaactagcttctattaaaaattttctattcttagataatttgggggaattggcacactaaatcctccttttggagattcataattcaccctactatatcataataaatcttttgagagctcctactgtaaagaatcttctttcactttatcttagttttcctcaaacttactagacatccaacacatttttcatggcatacatgtcatgtgggatgttaacatgtcctatgggatgttaacatttcatgggccatcaatttaagaaatgaactgattatcacttgaaacagctctgtatgttatgaagagtaaaaaaaattagtattcccttataaattatgtttatcagtcaggattcttcagaaacaactgagagaaatctaactcaagctaggttaggctgaaaagagaatgggttgattcacatgaatgagaatccagaagtgggtcttgcctcagggactcaaatggcgtcttcgggttcctctcactctccacttatctgtccatgtttgtacactgaaatggacttcctcatgtgtctgggttgggggagtcagaaggaaaaggaggcatggctactagcagttccaggggtaattgtatcatttgagcttagcaactaaagagagaagagaaagcttttattcttcaatcagttcagttcagttcatcaagaggctctttagttcctctttgctttctaccataagggtggtgtcatctgcatatctgaggttattggtatttctcctggcaagcttgattccagcttgtgcttcatccaacctggcatttaacatgatgtattctgcatataagttaaataagcagggtgacaacatacagccttgacatactcctttcccaatttagaaccagtccattgttccatgtccagttctaactgttacgtcttgactggcatacagatttctcaggaggtaggtaaggtgctctgatattcccatctcttgaagaatttcccacagtttgttgtgatccacacagtcaa

SEQ ID NO: 35475 - DNA, 897 bp, Bovine  19866880820590
aaaatgtgcccaaggtcacaaaggtcttaagtggcagggatgatgcttcagccaaagacactgacgtcccttgccacactgttctacagagggaggtgggtacatacaggcacacatgcttgattgacctggagtttcctctccaaattcccaccaattatacaggtacaaagcccttttccttctgcatcttcttgcttatattatacctggggattcttttctaggggtttcatgtatatttgccttgtgtttctaattagattgtaaacccctgacccgcagggaccagatcatccattttctttgcaaccttctccagtaccgcagtcacccagtaatgcctgctgcatgaatgaacctgtagagataaaaatactttatggtattaccatttattgctttcttgcttttatttggctttgtaataggactacattgtaaacttctggagggcagagaaaatggcttagtgctttccttatactcatcaggcaccgtgcaaaatttgatcctcacatgcctttttgatgctctggataatattagcacactggagtgttttgtgtatctaagggccggggttgtcaacctctctgtgtcggggaatgttccttcctttccactgtaagctcccatggcgcctaggacagggctagattaccgcagaacaccagcgccccccgctcccgacgccctcccccccttccccgccccaaatgcatatttttattcctaaggaggcggtctgcgaaaatggcaagctcttgcataaccccagaccttgcgagaaaatgagcaaagtggaaggggatttgaaggcaggtcagaaatggcctgggtgagaatgccaaggtttttccctgtacatccagcctaagtcggagtccagccgcg

SEQ ID NO: 35476 - DNA, 1240 bp, Bovine  19866880989534
aactgcatgggtcccttttgcttttgtatataataatttaaaaccccagttttcccatttttgagttaagaaatactccagctccagactgaatataatctttaatccttgttgtaatatcttgtttactctatcaatgataatcctgcaattcccagagcccagtagccttcatttcttggatcagcagatgaatataatatggaattaaagtcaggattctgctcgctttcatcaaactctagtaaagtaatattatgaagactgaatttatccccaaagttcccagtatatgtcaaaagaaataacagtgaattcttcctttaccctaaagataaaccactgtgagtactgccaaaaactaaagacaaagaagatttaagtgaacctaatcttggataaatactaggtttcatatattgtcatgcaagcaagcacgtgtcaaaaggcagccagcactgtcttttaaagatggataaaaactcaacatacttatcacaagttcccagtgcaaaaggaatatcatctttaaccagaatgttaggggttttaattaaagtagattttgttttaagagatggaaaggtgtgtgcatattatagaaccatagatgaatatatgtatatagcattgtacagtgggtttacatggttctgaaggttcagcctttcaaggtagaataatttggtgaagaccactatttccctcacttaaatctttgttaaagcaacaatggactcccactattctttttcagcataatgagatcaagataacaacagtgacatagaggtgtccatggctctgtttcaagtagtttgtccatctatcagatattaggagatatagaagtattatatgaaccttatagcaaaaggatgcttaactttataacattttgccacttcctactgggacgagtatgaggcattccagagtcctttagataatcccaagccataaatgtagctgaataacaagaaaccagttgagtttgttatagctatcttctatggtctatagaagttgagtagtcattctttttattcatttagcaaatatttattgaaggaccatatacagatattattctaagtgctaaagatatagcaagaaaattacaaacagcattcctgttcttgtacttatgttgtaatggagagagatgctaaatatatatcttcatgtattaatacatgcaaaattatatgtaagttaatatataaagaaataagaaatg

SEQ ID NO: 35477 - DNA, 1079 bp, Bovine  19866881039186
ttgaacacaacttagtcaactaaagaacaacaaagtaccaagggaaaaaaaaaaaaaaaccaagaagaggaaaaaaagaagaaagaaaggaaagaggaagggaggaaggaaaaaggaaagaaaggagaaattttttaatctttgtgaatttacaactttccctaaagaaaaaaaagagtgaaattggtgatggtgaaagcagtggtggttatcaatgctcagataaagttcagatccagtttagatacctcagcttctcctaggacagttttcatgacctcctcgccatctcctatttctggctttagggaaacgaactcctcaagattaaaaaaaaagatgacaagatgtgaggatggtctccacgtttcctcccctgctgaccctttctgtttattaaaagtatgaaaaattattgatgtgtatgagatttatatgaccttcacatcaattaatttgcatttctttagtacatgctatgaggaggagatgccttagaactaggcagagatgtggacttgatcaattgcttcaaataacttgtattgaccatgggcacaaaagtctgtagtatatttatgttcaacttaaaggtatatttcttgactgtatgtgaatgacattcaactgaatagaaactaagatattacaatggagagatgtatagaaaatgaagatatagtgactgaaaagatatatacggactcgacagctgttaaaaaaacattcgcacagagaaaatagaggccttcatccagacaacgtgagtttttatgaaccatttccagattagtgcatccttcccaaaagttgctatagcaagcagctacataaatttaaaagggtccaaaacatccttaaagaaaccacagagtaatttatcattaaaactgctcctcttcctttcattaaatttttcctcaagtgaaaagatgctattattgcaagggtgaatccatgaatgtattaatataaatatcaaaccttcgactgcctccctactatcaccaactcccccacaaaagagaagcatttctttctctaagcttgtggctttgaaatgttctcagaataaataa

SEQ ID NO: 35478 - DNA, 1121 bp, Bovine  19866881078497
tctaggtagaagctttttcttcaaaccctctcttgtggttagaagatggctaccatctgtcctgggacaaaatgcttcctcattagaaaatctctcttctaaccagtgaataaaagttctcaccttcagtctaattaagctaatatgtatcctgcacccatcccaacagcaggctctaggataataccatgaactgattggcttaagcttacattctgaaccaatcacttgcaaggggattagaattactctgactggcttgagtagaaaaaagaatcagtttcctgagacatttaggcaacatgaaagagaggggcttttgtgaacaacatcagggctctttttgaaaggaggagaatagtagagatgaatgccatatagatgctaaatctagtcagaggggaaagaaggtcttactgggtgggtgagtttagggggaagagaagctaggtagctttcctttctctttgagggaaactggccctctcctgatggtggtacctttctttttgtggtaatagctataacacttacccttaaagccctgcacgaaatgtagggctttaagggtaagccctgcttcagtcgtcctacttctctgtatctgactgtgtcatatgaagtcaattaggtagcgcttcgtaggaaggctaattatggtcaaggtccaggctctacttgccactgtatatgtactggaaataaacctggctatttgatcatcatcagttggattcctgtgtctatttctaattaattcataaccagtgggaggcatgattatcacccctaaaaacttgctgtctggagcaagccagaatctagaggactctgggaactctgtcacacagaggaaatgtagagttcaatgttgaaacattcagttgccatcaaatatctagatatatctagatatatcagatattcaggaagttcaaagggtgtgaattttcacaggcatagctgtggagaaggctgttctgctagtaaggagaaccctgtcattggaagtattcatgcacaggctggatggcaatctttcaagtgtgctttaaaatggaattctgcacatttgggaagttgaacacagttgtttctataacaggatccaacttttagtt

SEQ ID NO: 35479 - DNA, 1882 bp, Bovine  19866881228367
ttactataaactaaccccaaattttattaccccttgcttttgttttagattaatgtgttcagtttaattggaaggcccttccataatttgttctaaacaaaatttaagacctttggtttacttcatgctgttcaactaaagtcagacttacctgagttttccctttaaagcaaagcagacaccattcatgtggtctgtcctttcaacagaaaaccatgttagttttttatccacataatattcatttccagtccctagaaacaatttctagagagagcaaatttgccacacatacagcaagtagcatataaatatgcatcatgaaaaattttccacacacagagaaaacatcatgatttggtttggaaaacaagtcattttaaaagttgtggaaaataggatctgttcctgtctttaaggcaagatctgccgctgacagtcattttagttattctgtgcctgtaaccagctttccctgaattaccttgagataatcatggagtgtgatcaattgcaagctcatatattgtaacctcaaaaagaaaaaaaaattctttttcttgaatttgttcataaaggacagctattcttaatagaaaacagttttgtttcccaaatcacatttgaactgtttaattattgactttctaaatatcaagacaatgtttatagcaataaacaccttggaaaacattgcagcctatgattatctattgtgagatagaatctctctttttcatcatcaaatataaaaaaaaaaaaacttatagggaaagtaatcataaaagttgaagtttctacccatgtaaaagaaacacatcttctcttattgagttccttcttataaaactagtattttctaccagttactatcaaggttttgtattgtgtgtctaaaatcatacacactttagaaaccagctgcttcggcgtgtgctcccaattgcctctacgacaccctctatctcccttcaggatctaaatcaatgtatcctcacagatcaacctgcctgtcccaatagtttcttccatggctgacgaagaatctgcacccttctatacaccagttgctctaagtgttattaggatcaacccaaattccattttaccagagtctcttgcgaagtcttaaatctttctggcatgtgctctgcccctacctgtgctgcagggctggaggtggcagggaaaaggcagcgagagcagtgtggctgccttctgggagatcctggcccggcacagagccggggaaggcaaagccggaggaaggagaggaggaggaattcgtgtgccactgcaaatgtgaaagggtgccaaaaaaaacaccattctttttcccaagaagttcaaagagctttgcaaacattaactcaggagcccaagtagtcatgcagaaattattaacctattatgcccttaaagtaaccaccgcaagcaaagtcatgagcaaagggagtctattcgttgtttcactagacctcagatgtttattgagtacctactacgtgtgaggccctgaaggtacagaaacaagcaagacggccaagatctgtgctcctccaggctctaatgctagtccccagcctttgtttgcccagtcagggtacaaagcacctggctacactcttattacacttatttacactttatttttgcccaaattgtttaatgggatgtgctccatccttcagaatgcctataatgtgataagtgctgaggaaacacagaaaagaaagattacctgtaaatctcattacgatgatcagagttggggagtatcagttcaaagtgctttattttaagaagccataagcaaagctttattgtgagtagtcctgtctcttgcaatgtttatggaattactataggcagacaaaaagag

SEQ ID NO: 35480 - DNA, 806 bp, Bovine  19866881415287
agaaatccaaagagaaattccagcaccaatctatttctatgaggatgagaaacatatatatctgttgacataatccagcaaaaagtttactcttgccaaaagcaagttgaaagataatatttctagggagtctagacacgcttgccactctcggatggcacaaagctgtgctgagagttgccaactatgctgcccagcaggtgatggctctctggagggaaatggataggaggggtgaggggcagagttagtggtgtcatactgacttgcgatcagagctgagaatttaaaagtatatgttgaaaagctgttgagtaatgtaatgtatgtaaatgtgaaacacaaatgtgtattttaagaccctaaataatttttaaaggtcatggatatccaaaaatacataactgaacacattaaagaggttgtatctgttgatgcttggttggggaagagggcttgaaggggtaaaacgaaaataacacaggagagaagctggccacagactgataatgaatagaggaggatgaatcatttacttgctacacgtacagtctgccaggaacaacaacaaccaccccaggccatagagggctcactcatcactgattctatggaaacagatggttcagggtaccaaagaattaatcgcacttggtggttataataaaaaaaaaaaagtcaattaaaagaaataaaataatgacaataataatttctctaatgtgccttcagagtgaactcggttcttaaagtcagagcccaaactccaggagcacaggcacaagatgtctcctgccttgccaagg

SEQ ID NO: 35481 - DNA, 1938 bp, Bovine  19866881432331
tttagactacatgttccctactctagaatatttctgcccctacatagttaggcttagttccacttattgttttctttcttttttttttaatgctttggtaattagtcttttttttaaattgttttctcatttattgtggctgtgctgagtcttcattgctatgcaggcttttctctagttatggtgggcatgctcttactgtgatggcttctcttattctggagcacaggttctggggtacgtgggcttcagtagttgtggttcctgggctctagagaaaaggctccatagttggggcccatgggcttagtggctccatggcatgtgggatcttcccgaatcagggaccaaagctgtgtctcctgcattggcgggtggattctttactgagccaccaaggaagcccctctacttaaagtgtgtacttaataacctcctttaagttggaaccttctctacattcctcctcccaaagctggttaggtgttccccctctggactcgctccatcttctgcccgcccctgtgacagacagcacctgccagcctgtactagacccgctaacttatgtgtctcccttactaagctggggaatcctcctgaggccaggaatagcacctttgcttcctgtgttaccaacacatatcagtacaaggcgtatcacacagttggtatccgctccccccaaaaaaaatacacagataaaagcatgagtcaactagacgataaaagagtttaagaaaaagacaatggaagcattttttacttccgacatttcacatccatttcccatggacatatgtctagttagttagacatttgcacaaagctttggtgattatctcagtcaccagcaaaaaggaacacaacatagaaatcactccagggtcaagagcgaagagaggaaaagaacgaatagaattggcaaacacagaacacacagcagagtgtttatctgtgaaagcaacttcacactgcccaatgtcacgggttcatttactaccttttaatatttttcataaacgccaatgaacaactggtggacccctcaccaaataaaacatctcattcagacttgcagatggcaattcaggttatcaactgattaaagcatcctccctagaaaaacaactcactcgagcctccctcagcagaaatgccaacttttaatacaggaatcagagcagaactgtgggtggtcttgggggaaaggctttataaactgtaaaatccaccagtggtcattactgtctgaattatccttgtgaggtgatggtccttcagcaggacagtggctgaattaagtgagagaaatgacttggtgctccatctgactcatgttttttctcctctcaagagaaacaagctctaatgatacattttctgatgaccaaacattaactcatccactgaaatctcctcaatgactaaaaagttccttgcttcataataaaccagtagcctgaaatgttaatgtaaatacacacaagggagtcaaatttttatatttttttcctcaagccatgacaccctaaaaaaaagtcatcttaagagcagattttttagacatgactctagaaaaggggttatccactacttgcccttcgtagaggcaggggaaaaaaagtgctctaatatgcttctgtcctgtggctgtaattaaggttgaaaaaggccttcagttttccccttgaagacgtcatcagattcgaatgactcctgtctcatcctcatctcccctcaatgtgctcttttaaaacagcttccacgtctttccacttcccctgggcaactaactccctgctttcaacttttcaccgcttattcaaaacgtctcctctcttgtcttaaaaattgctgattccatttctttactctctttcatcatcattccccttccccaaatcctaacactagatctttaatgactcatgggaa

SEQ ID NO: 35482 - DNA, 725 bp, Bovine  19866881564367
taagcacaaaccaagatataagaggataccagagggcaggccaggccacgggtcagaggcagaaacaggcagttcagtattaaaggcaaggcaaatgtggggatcaaaaggctggttggatagtctgaaactcagctagaggaacaaaagagagccccaggaattaaagggggtggggaaaaaggaacagcagtgaagtccccgcatgcttctagtagaatctaccctcttagccaaggagtttctttgattacagagccatttcagccttgtgcttcttgtcccaataattatcaagataagctgattcagaactttagttgaaaagaagaaaaggaaaattagatgggcctgtcttacataacataaaagaaaaataagtgtcatattataacataatgaaaacagtactaaagaataggaaccagaagaccaaggttttagtatattatttgaatggtgtaagacctagggaaagtcattaatttaacctctattaggctctgttttgttctttgtaaaaaaaactgaactggataacttttgaatgctaagtgagctatcaatttttaagagtttatgatctgtatattttactcatctgaaatatagattcagataattatgaatccaatccttgtatgccaatggaaaatcagtgaggagggccattaaaatatccagataatgtatcagaacataattctcagaaatttttggatgat

SEQ ID NO: 35483 - DNA, 754 bp, Bovine  19866881595428
acattgtaaatgtgaatctggaaagacagcaaaatgtaaatgcctgtttggaatgttactattaattgcatttggaaaagaaaataatttaaaacttgaaaagtccacagaatcattagcaactagcattcattaatgctggaagaagagattatattatatactatgtgtcacaagtcaactctaagtgacattcttctgtaaccacctatttattcccacactgcagggattgcacctggatctgttgtaataacagatgaagctgtagactccttctttaagccccggtttgaacaggtaatcttggacaacattgtcaccagaagtactgaacttgacaaagaactggctgaggaaatattcaactgtagcaaagaaatttccaacttcccaaccctcattggacatacgatgtgtacttatgatttttatgaaggtgagaagaatttataaactgtgaaagcagcagaaaattaccagcaatattttgttattcaaacctataattaatattaaaaacttcaccatagagaattaatagttggggatttaaaaaggcactgaaacagccttttcaacttactaaagtaaagaaatgtaaggacataataagcagaagagacatacacacaatgaatttattttgagagtgagtttaatcctccaagaacaaattggatactctatgcaattagtgatgttagcaaaatcttatactctgtttatacctttaatttaaacggagaaaggg

SEQ ID NO: 35484 - DNA, 778 bp, Bovine  19866881748856
cttcctgatggaattagtgcccttgtaagaagccacatcagagaacttgctgtctctttgccataagaggacacagcacgaaggaagctatctataagcaagaaatagagtcctcctcaggaactgaattggccagcaccttgatctggcaccttgatcttggacttcccagcctccagaatttagagaaaataaattactgttgtgtaaaccacccaacatatgctattttattttgatattctgagcagactaatacaatctattttatgtatttgagtaattgtgaaactagaaacaggaaggatattatgataattcaagcaagtagcattcatttggcttagtctgttttgaaaaatatttcagtgtggaaactattcatgttgacttaaatctagttttgagacgttattgtttaaaacatcacttctgtgataagtcttctgggagaactttcttaaacatctcaacatactaccttttattatagcaatccactcatgccttgaatttttaaattttgttttaatttttaaaattttgtcttttgttttgcatatcggtacaccccagtttgttgttggtggtcagtcacaaagttgtgtctgacaccttgtgaccccatcgactgcaacacccaggcacctctatcttccactgtctcccagagtttgctcagattcatgtccattgagtcaggtatcagtacttactgcctgaggggtaagtacgttggacagtcttcctctgcttcatcagattttgatactatgat

SEQ ID NO: 35485 - DNA, 948 bp, Bovine  19866881752558
ctacagaacttgaccttgtcgagcaagctgaaaaataaaagtacacagttactgaaagatccttaagacacaactgtaaaatgttctaaatcacaaaggactcttctttggccccactcctgggaaattgttacagaaaggcagtaatttccattctctagtgatagcaaaggacagctgggaaaggaaccattcaggtattccatttgaaagattaaaacaggcttcgataataacaccctatggcaaaagagttaatgtaatgttgcaaaattccaaagcttccaaaaagaacttcatatctaatctgtatctaaaatagcctctgaaagtttaaccgcagcagtttataatcacactgaaatccaaaggaaaaataacacccatagaatgacatataaaaccaaatagttgatagtttggggagatgctaatgaaatgactgtttattgtaatagttcaatatgttactgtttttagaaggataaaatcatctaataactagaagcataatttgggtaaaatgagggactcaaaatctcaattattatgatttatttttgcaatcattttaaaagagtacagtaagatttctatccaagaaaggaaaggaacttcagaatggtataaacattgtaaatggcataaacttttgcttccctggtagctcagacagtaaagaatctgcctgcaatgtgggagacctgggtttgatccctgggtcaggaagatcccctggagatgagaatggctacccactctggtattcttgcctggagaatcccattgacagatgagcctggcaggctacagtccatggggtcgcaaagagtcagacaggactgagcaactaacactttcactttactcctctgcatgttttgggaagagatcatttaaagataagcttccgggatacagtctatcattataaataaaggaaaagtt

SEQ ID NO: 35486 - DNA, 1458 bp, Bovine  19866881850602
aaaagtctacccttgagcttttcctatgaatatttaatttaatggacagagttgaagactcttttataaaactttgcatctcccactaccacttacttgattgtattgttatctagtggtttacttctgtttttcagtttagctgtttatatggttgcattctattccaaaccctgtgctaggtgttggggtagaaataaaatgaatacatcccctaaaaggcccaaaggctacaagtaattctgaacagaagtgaggtatttaatcccatctgcccttcatataagtatacatatatgcttccacatatataaatatgagacataatctgatgagtattgatagcaagaataatatttttaaatataaacacattatgatttacagatagcatgatatgacctacctaagtactttacatctgaaataaggataaaagccaagcaaatggagataatgaaaataaattaagaaaatatgagtacagtatagttgagaggttgagaatgcttgggcatatcaagtttattgttctcttccacgagaaggcagcccactgcatagctgaatggtccccacccttgttaatggtacttatcaggacaaaatcaggctgaaacaaaccatacaaactataataggccttccacagttagtccttataaattaaaaatagattgttgttcactcgctgtcgtgtctgattctttgtgaccccatggctgcagcacgccaggcttcctcgtccttcactgtctcctggagtttgctcagattcatgtctactgagttgggatgccctctaaccatctcatcctctgacgccaccttttgctgccctcaatctttcccaggatcagggtcttttccaatgagttggctcttcacatcgggtggccaaagtattggagcgtcagcttaagcatcagttaatgtatctatttgctatccagaacttctaagaaagtagtcccgtaattggactgaactatctgctctgttccttttctgcataaaaagatgaattaacagagataggacagacatgaaggagccaaaggaaacctttctggatattctacaacttggataatttattccaagattactgaaaacaatttagattaaaacaaacaaacaaaaagtcagttgctgccacctaaaaaataattattaattaatgtaattaattttttaaattaattaatttgttcaacagccatttactgagccaccagatgaagtcatttgttcatctaacctacgtgtcgagggccctcctcgagtgctcttctgacccctgggaatacaatggtgaactagacaagaaaggtatcatcccccatggttcttgaattctggtgtcaggagataagtgcagacattgagcaggcgcagacacaggatagtttcagaggcgggtaaggatctgcagaaagcaaaccaggggggagggtt

SEQ ID NO: 35487 - DNA, 1050 bp, Bovine  19866881913171
ccaatttgcccattggagttgcttcactgtttgctctgggtatttgacctttatttctgtgactgggaaagtgactttaaattttagcctttccagattttgtggaagttcatgcagcagttgaagtttgtgttttggaggatggactaggtcagagggacctatttagcacagatgtcctgatgggtttgtaggagttcagctctctgatcataaggctaagtcttggctgttttgtccttttccacacttttggggagaaccaaatcatttagggctcagagtgctttcattgcaagcatgtgcttcctggattttaccttctgacattcttctagtgtttggccatcttcagtactcatgctggcatttgactgatctctttgggagcaaggacttgaggttattcatttctctatttttaaaattctaaagaattcagtttctgtcactgaaaacttttcaaatcctcttaatgggctccatgtgtcttattcatcttttgtgtatctcttgcaccttatataatacctggcccagaccacacagtcagtaaatcattttttaattgctaagagaatgaatggttggttcatttatgaagggcaaaataacccagtactctggacaatcagggaggtggtctcaagagatgatgatgccagacacaggtccttaaatgtgagtttgggagctggggacaaaagacactcttaagtagaaggaactattgtttatatccctttattatgtatggtattataacttgtacttagtgatctcaaaagacatctattcttttcaatatatgtttccttttgggattgttgttgagtttcaggatgacacttcttttgaggggaagaatatctcaacttatttttcctaccctgcagcgctaggactcctgaagtactgtgtatgtgtgggggcagtggggcgtggggctggtgctcaacattggtgaattgactccttgacactgactttctcctgttgcatttgttctcaaacagtggacagtgaaaatagtgtggcaggcagtactcg

SEQ ID NO: 35488 - DNA, 748 bp, Bovine  19866882151124
ctatggttgctcttatattacttgcactcctgtcctcggtattgccatgttaagcctgtaacccactaacgcccaacaacaggtggcctgtataaacttaagatgctggttgatattcactgtgacaaaaacacccacttgaacaaaatcaacacttatttttattatgtgattatcttttttttacaaattaagtacatcaaactttttttctggttgccttatttaccggttaatgatgccaattatttaactcatgaacattaacccagaatgtctacatatatccttaagtatataactggaaaacgaaataacaatattaaagttgaaagatgacccttgccttttatctcaggtacttaggtgggtaattgtttatttttattatcagtttgtctgtgttggtggaagccccaacagaatgaaagcatttgcactgtttatgcacaaggagcttagattgacggacagtgaagaggacatcaaggatatctgtgctgggacagacagatattgtatgtacaaaattggtcccgtgctctccatcagtgtaagtactctaatagctgcatgtcacgtagtcatcacaagctagcaaaagaaagtaggaccttccaaatataggagtttcttttcctctccttctttgcattttcacacagttaaatgaagtgtccaggtgtgacattcatagttggaaaaagttctaggggcagaaaataacattctgtgccactttggtata

SEQ ID NO: 35489 - DNA, 1217 bp, Bovine  19866880104162
ctgaccttttccagtcctgtggccactgctgagttttccaaatttgctggcatattgagtgcagcactttcacagcatcatcttttaggatttgaaagagctcaagtggaattccatcacctccactagctttgttcatagtgatgctttctaaggcccacttgacttcacattccaggatgtctggctctaggtcagtgacacaccatcatgattatctgggtcgtgaagatcttttttgtacagttcttctgtgtattcttgccacctcttcttgatatcttctgcttctgttaggtccataccatttttgtcctttatcgagccatctttgcatgaaatgttcccttggtatctcagattttcttgaagagatctctagtctttcccattctgttgttttcctctatttctttgcattgatcactgaggaaagctttcttatctcttcttgctattctttggaactctgcattcagatgtttgtatctttccttttctcctttggttttcgcttttcttcttttcacagctatttgtcaggcctccccaaacagccattttgcttttttgcatttaggaaaccttgcctgccccaaccctcccaagccccacattaagtatcactttatgtttcattctgaaacacatttattttcagaattaagtcacatgcctaaccctaggtgaatcactggcaaaggagaataggattagtataaccaattatgactcagtccctggggctggacatgtagccacctctattagtagagaagatgtagctgtagaatgccctgccaataatgtctgctccaactacaggaaacatgtaaactgtctcccaggatccagtaaattttacaaaagccataaaaagtaaccataccagagtaagaacaagagggttgttctcacatacattatgagacaggaatgagtagtagctttcaaccagcatttccatgatcccgacatcccatttccccagatttctaggccactttggtggtgttgtcatcctttgtactcactcattgcatacatggcacgagctggtactcaataatcctgtgcaaatactaaagcctgacctaagggattcagtttgcatcgctgttgcaaactttttttttcccacggtaggattcagtaacccacatctaaagaaaaagaggagagacagttataaaacatgataatacagtgatgtgata

SEQ ID NO: 35490 - DNA, 1441 bp, Bovine  19866880369693
acacagtgcagaacactagaaaatctattcaatacatctgcatagtcttacacaatctagaacatagagatgatttcctggtccagtgatcactttggatggatatcaaagatcattccagtgaacttcttggttgtattttgttaacatatgatacattcacaaattagttcctaaactgtgttttgagacaacactgtgattcagaacattcttataatgccaagaatgctactctgattctacagataaactcatatcatacacttacaatgtgggagaaagagaatataatgcaacctgtgtatcaaagcttagtcaccccctaaacagaccttactacaaaaataagtatattcagaacatggatgacaaatctcagatctgtggctgaaattagcagttgatgatattttaataaacattattaccattgttgtgggctggctgcttcttattcaagtggtgtgtttgtaggaaataactagtgccataaagcttcctgacaaaaatcacatttctattttgcaaataagaggtttttatttttttaatgtcacagcaaatgagttcttctttggaattcgcctgtgcttttcttaatattatctgctggcagtggctttgtatacttcattgtttccacagaacatattttgctatatgtatctgaagctgtataattgcacctcctggttgtaaatcaagagttggcgttaattaacagttagtgctgtaatgccccactgataaaacaaatgtacccatttcttctctgaagaatcagaagtggcaggctgtcacttcgcagaactttctcatttccctaaactcataataaagccagcctcgttgtctcttcaggctactcagtcagcatccagcagtttgtgtctgtgctcattccatatctactctcgctcttctgtttactgaagcgctatagctgatttcaggatcactttttaaaaataaacaattacagtactttcgaatttggggttttacccaaaagaggatctaattatccatcacagatctggaccagacagttattccttacgaaacctaaggttgattcaaaggaaattattcctgcatggggacatgtgtcaagtgcattataacagtgctgcctccttggtttatatggtgtcccctccttccgtccagttttgtaggctggggatttaagtgtcatcttttatactttgtccttccagtccatttccagaccattcagtgttcctgaatattacctctgaaatccattctagcatgtcgtgggtgcactcattttctcttttccaaccatccctgctttgtcagttagtgtttcacagtgacttcctaactggtttacccaccattcacttgtgctcctgtctagcatttggtccacattatagtcaaagtgatattttcagattaactagtatat

SEQ ID NO: 35491 - DNA, 595 bp, Bovine  19866880536965
aaaaggtcgtacttcaaaaactgcctaaaaatttccatgtgtagctcagcatttcatagcagaagtacattccccctcccccataaattttcacaccctcatgggaatttccccagtaccagaagtttttattttttttttcattgtattttctgtgatgactaatggccacaggattcagattaatagccgaatacaataagctcagtgaaaacaaggacctgagctgtgaaggctcaacgctattcctgtctgcattcttatgaggactcttccttggtctccccagtctcacctgtctggcttcccgctgtggggagtccagagggagggcgagctttcgtgagagtatttgggggcctgggaggggattctaaggattcacttcctgcctgggcaggaaaggctccatccccagcctctccatgtatttccaggtcctcacacacgtttgtacctttgcctcaatgcccccacttaaatgcgtgtgcctgtatcccttttcacagtcctcccttcagacacctgcggtccctttctaactcaacatgcactcacctttcttaggctcatcagcggtccctaagaatgtcat

SEQ ID NO: 35492 - DNA, 1137 bp, Bovine  19866880561520
attgagggcaggcagagaagggaatgtcggaggatgagatggttggatggcttcaccaactcaatggacatgagtttgggtggactccgggagttggtgatggacagggaggcctggcgtggtacagtccaggggtcgcagagtcggacacgactgagcagctaaactgaagtgaactgaaatgtgtttattttcacctcacaaagcttatttttactgttacaaagatagcagtttataaatataatcaggaaatattttcttgttaacttctattttcagagcttcagaaagacgctctgaagatttctttagttctttttattaaagtataataaacatgaagaatgtgtaaattcttagcatgaagaagtaaatagttttgataaagcattacattaccaaatttatcatttaccatttttttggtaaatcataccaaacaaacaaacaaaaaaaacccacaatattcttcaaaaaagaattttaaagtcagatttaatcatctttttttacaggggctaactatccaagatgcacgttagccattttcttgttcctctagacacaatttataaaaattagatagtttcagcagcctcaaatagtttagctgtcagatggcctatagctcatgagaatgaaatgacttaaaaattttttccattctagagttttcatcatcctagatttatatgttacctcttggttccttccaccagaacaacaacaacaaaaaaacttaaaatgagtagctcttaagctctgtgggattgataataataagaggaacaagaaataaaagatgataacttacatggcagaggttactctatcctggaatgaatctgcagggatccaattcgagcctttcagaaatatgggaagtccattaattttgaagtagaaactcagaccaggagaattttgtatgggctcttctacaagttccactgtcctaaaataaacctattgttaacagaattaaataatgaatataaaatttaaaacataagcatatgccaaaaccaaactatattatttactatagccttaaaaaaatacgagtttttattttttaaaaagcaaacttctgagcagtttatataagataatttagtgttaattttttatcca

SEQ ID NO: 35493 - DNA, 2834 bp, Bovine  19866880617165
gcccgtccttaggctaagcatgcagcccgtgcctccctgttcagccctcacttgctggtggcggatgcgagcgtctgggcttctccactgggagttgtggttaggtgcggaatctgtgggttttatttatttgtttttttcctcccggttatgttgccctctgaggttctaaaactccccacaaacctaccggtgagagggttccctggtgtttagaaactttgtcctatctccttttgaagacaatgggctgcctttctgggtgcctggtgtcctccaccagcattcagaagttgttttgtggaattttctcagcattcaaatgatctttcaaagaatttgtgggggagaaagtggtctccccgtcctattcccccaccgtcttaggaccgcccccctcagtctacacttttaagagggcagtcagcatgtctgccttgttccttgctgaacctccagtatatagcaaaaactgcatacctggtgcatggtaaatgctcagcagagatttgatgcattaatacttgacattgccatagattctctctctcgttcttgctgaaaaatgcctgactcgcagtaaacacttgagagagacttgctaaatgaatgattcttctcaatgaaataggaagtcagttcattaagtgagataataattaaaacattttgagcgctaggtactggattaaataattatatcctggctgctgtaacaaactgcagcgttttagtggtttatgtagtaaaagtttcttttttactgagtaacactacagaatggctgtttctaatgggcaggcagctctcctgtttttcgagacccagactcctcccatctccaccatctcctaggcctttgcctgtgaactggggaagacaacgagaatgtagtctcacagacttcgaataggttaagaagccacatcctacaggcagctccaaattacagaaatggaaatatgaatttcagtggaccctgagccatctcttccacacatttccttttttttttttttttttaccatttcacaatagcccaatgacagaagtactatttattatccccattttacagataagacaactgaggcttagacctgtcccaaaacaatatgattctaacttgagatttaaactcatgttcctctgattccatatcccattctacacttaattatagccaaaaggccaagaaacgatccatagcccattctaaaccattagacctttgtttctcaagtggaagtgattttgttcccaagatacaggagaacatttggcaatgtctgtagaattttttgaggggagtgggggttaggtattactggtgtctagtaggtagaggtcaggtatgctgctcaacatcatagagtgtattgatataaaacctcccccactcacagcatacatacacaaaacaaaaacttattaggctcaaaatgtcactaggccagaattctgtaccagactgtatactacccatgatgggggaaggtcaagtgtaggtaagacatgattggaaaagattaggaacagctgctgtgaggtataagctatgattcattatgaaacggagaaggcaatggcaacccactccagtattcttgcctggaaactcccatggacggaggagcctggtgggctgcagtccatggggtcgctaagagtcggacatgactgagcgacttcactttcacttttcactttcctgcattggagaaggaaatggcaacccactccagtgttcttgcctggaaactcccatggacggaggagcctggtgggctgcagtccatggggtcgcacagaatcagacacgactgaagcaagcgacttagcagcagcagcagcattatgaaaagatatgaagagcgacttccttggtggtccagtggttaagccgctgagcttgagggaggcctggattcaatgcctgatcagagaattagagcctgaataccacaactaagactctgtgcagctaaattaaagtaaaaaagaaatatgaaggattggcaaacagcagaaatgtgctggtggctgtcaaatgtgaagaatgtaggtggctctatcatttttctattagctacttgactaaatgacaacttggcatttctgggacctgatgatacttttaaagaagtaagtgatctgtactttactgggtgaaaatattatctctttaaccattttatttctgaattcagggagaccagactcgtccttttatcacatccagtcctacaaatggggccaaaaccattgcagaaggttggctctctccaaacccctatgacctgaattatggggacgtacatttttatgattatgtgagtgactgctggaattggagaactttcccccaaagctcgatttgtatctgagtatggatatcagtcctggccttccttcagtacattagaaaaggtaagccatctttgatttcccagggattcagaattgtagactatgggcatatgtcacttcctcaccatggttccgaaagtcaaatgaaatctatttcttgtttaaacagaagtttaggaagaagataatagggaagaactttttatccttaacttttggggcactaaactgttatagtcatcattttgtggattataacttttccatattgcttttatttacattctttcaagagcatttaaaaattcagtgggaagccagtgattacttaaacctgatttgttatgtgaaatacatgaaaattactttcacttactactttctatatgtcctacaactgtttttattatttatggatactcagaacggatagtttgctacagtaagagaaagagtaaataaac

SEQ ID NO: 35494 - DNA, 1467 bp, Bovine  19866880618841
aaaattcttgtaaatcactggcttttctaactgaaaagtttttcaattctattttttctcgacaggggtgatgtatttatccctgcagtagactgtctgctttggcaagtttctgaagcttcaagtttgcagtctctcggcaggatgctgaatttcattgtggagtgactgctattatacccatagatcaaaggatcctcattcataaaagaacattcctatgtaatgggcttttttgatattacctacagagacatgttgttttatttttgctgttaacattatatgctactgttaatacacacacaaccacacgtacacaccatgggtttttcttcagttgtctccttgatatttctgcttacctggtagagatcatttctcatgttgataatttcatcagaaatcaagccagatgtgacttccagcagatctctcacaagctgattatgaaggtggatgattgccaagtgtaagacactggaataaaaatatagtggcaataatcagctaaagtgttaatggaaaaaaaaaaaaagaaaacaggttcccacgataggattagatttgtaaactgaatttggctctcatacctagtttcctttggctcgcaaatgtctggaatctatggaacatcctgaatctgaggtgggtgtgctctactgcctgctcacttacagagcctgcctggtttctcggggctcagttcagactccttgacgtgtaaaggagcctggactttgaggcagagaagtctccaagttcaaatcctagtcctgcctctgtgctatggtttcagggcattttcttctctaacttttccctgccttacttggactcacagatgatacgatgatgagatgatatgcctgaactaggatttgttcagaaaaatatagttatctcacctagccctgccccctcttccaaaatacaaggaggtggctcttgaagaacttcctagatcccaagaggggagagtagagttaggctcttaactacaggaagaagccttgatgcaaacctccggaggaacaatgtgattgtatttctcccctgaattctctccgctgcctggaatggttttgctcctcttgtctgcctcaacagtgcctctttatccttcatgctccagtccaaaacttacatccttggagaagactttctcagtttccaaggcagagcaagctgtcccccgctcaagtttcctgcttggttgagcaactacagttttctgtacatcctctctgtcttctgagcctcttggaggctggttctctctgggtcagccttacagccctggtacacaatttagacactaaaataaggatgactgaacaaactgagggcttacagtaatgaggctgaaaatattggcaggtgccaagcatcagtcctaggaacaaaatttttttaattactaaaaaaatttactattaaaattaattgggaaatgacacaacaaga

SEQ ID NO: 35495 - DNA, 2629 bp, Bovine  19866880637572
tggttcttttatactatttgtatagatgggatttttagtcggtgatagcctggaaggtaagtgcttctcgcacagaagtgaagttttgaactttcaggagaccccaacccaagacagctcctactataatagagtagcaataacagtaatagtctgatctaccttgctgtatccatgcacagataccactgggaaagagactcaggcagcctagaaaccaagttcagctttgaatatttctaggctcatacatgcgtaggtagtctgagttgcctttatttaaccaattctctgtattggaaaaattggcattaactggagcatgttgtgagggaagaaatctattttttttttccctcagaaagtccaaaaaatttgccctgtttctgttttgtgtctacttttttagaaggatgttaatccaaagcgggcaagtgaggagaggtgaccactcctggggaagccaagtgggcagggcttgccacctcattttgcacagagctgctcagctttatacactggaatttcacatgaaattttatgtagagataaaaaaggagataaaaaaagtcttctctgctgacagtgttttcaaaccatcaacaaaatgctctatgaacctgacccatctgtggcgatgtcacaagctcagaaaagaagaatgcacggaaccattttctaaatgctcctgccacaacatgaattctaggaaaagcaagccctcttagaagatcagccatcacatgctgccatcacaggatcagcgggcgtgtgcgctgctgctgcagcacctttgcggcttccaacctcagccaggacctgggtgcctcgtccctccccactctcacttccccctagtacagggccttctaattttgtttgtgccacagcttcttttgcagccctggatctcttcttaggatcatagttttcagtatgtaaaatagaaaacagaattacaaagaaacccagttgttttaaagtacatttctatccatggacctgcagaggagtcagtggactccaggttaacaaatactcttggggcctgttacactctttttgagaggattctcatggctgaatttcccattctgcccgcttggattccagtcctgtcttttgaatggcctatttggaatctgccacaggaacctaaaatgcaacgtgatttaaactgacctctgcctttgcccacccaaatctacttctgctccactgatccttcatcaattcatccacatcacaatcttcccaggtgagaattcctagaatcatctatgactcctgattttctccttcacttcttaccccaactaacagctgggtcctcctgacatcatcactgcgctaagaccttcactaacttctccctttcttacttggattcttgcattattcttctgactcactgctgcccagacagtgtcttcagggtctatgtagagaaggcagaggcatcattctgaatctaaactggcttggtccttcccctttcccatttcaaagcacaattctgtaggctccaatcacagcacgccagagcctggccctaccttccttcaggagtccatctgggtgcgccttagcctcacttttctctgaacatacactaactgttcctaagccagggaaaccctttccttctctgtggcacactcaactactgaaagacatgcccaactttcatgactttgaagaagctttcttcttgtggcttcttcagaatctagggttctctctccttggcattatcctatgtttttatggctgttttactttcagaactaccaaaataataatttgcattatagcaatttaaggagactattttctctccttcttgaggcatccttcgtggggaatagagtgctgccttaccattgttatagctctgcactgcatggtggctgagtcttctgtgactcagtgaggccagtggctgattctcctattcagcaagccttacattttcatctcaactgcctgacccctgagttattcaatatatgatagattctcaaattcaaagagaaattttaaatgctcaaccccatataaaactcggtggaaataacattattttaaaaggctagacttaattctatgaccctaaaatcatatattacttctttcttctctaaaaagaagtaccatggacccatggaccagttactaggaggctggtcaaaggaggtgactgcctgacctcttctcaacagcctgtcctcttgttggaacaagtgcaagtgtttaaataaccgagttacctttgatttcaggatagtagaggaaaggttttggttcgctagtttccaaatcagatttcctccgaagctggacgaacacggaggctggttttgtaatgttgacatctttatactttggagttttgaagacaatggcaaactgcaggatacaaagatccaaatgttggagtaggactacatttcttttacagcagtggtactcattaaacacattctttatgcccaatgcttagacacaatgtcttaaaaaaaaatacaaccctagagaaagttcggacaaggcaatggcaccccactccagtactcttgcctggaaaatcccatggatggaggagccggaaggctgcagtccatgaggt

SEQ ID NO: 35496 - DNA, 1010 bp, Bovine  19866880764151
actggaaagaaacattttgatatcacagggggcgatcagccagttaaccagaatttaacaacaaaccaataatcaccaaaactgacttctaaggtctggttaacctgtgagctttttattctgctaaatggggggtgtcaggcccagcccacttgcttcgttttcttctcttccccccacacacgggcgcccagcactttccactgaactaatggaagtaaatagttaaggatacaggtttgaagaggcacctaaatataagcctgcccatgtgtctccaccctgccctatttataactctacactatggactcaatccaatatagttaaaaatatcaggagaaagaaggtgtgaaggctaatgtagttgcaacacttcaacctgctaaagttcaacccgctaacaacctcagggatggctgacgaggcacaagactgcttcctatctcccagatccttgaaagaatcagcatgttgagctccagggggtaatcatctaagatacattttttctagaaaaggagaattcagatgttaaatatttcctatttcttgaaagaagcaaatctggaaaggctacagactcagttcagttcagttcagttgctcaggtgtgtccgactctttgcgaccccatgaaccgcagcacgccaggcctccctgtccatcaccatctcccagagtccacccaaaccgatgtccattaagtcggtgatgccatccagccatgtcatcctctgtcgtccccttctcctcctgcccgcaatccttcccagcatcagggtcttttcaaatgagtcagctctttgcatcaggtggccaaagtattggagtctcagcttcaacatcagtccttccaatgaacacccaggactggtctcctttaggatggactggttggatctccttgcagtccaagggattctcaagagtcttctccaacaccacagttcaaaagcatcacttcttcagtgctcagctttctttacagtccaactctcacatccata

SEQ ID NO: 35497 - DNA, 1685 bp, Bovine  19866880790009
tctgggggctttatttaatagagctttctctggttataagacttcgatgccatctcttatagtttgattattcaaatttcagatttttggcaggtaaattttccagtattacttggatgtgaaggatggacttagaactgtggtgaaaattatatactgaattaaattaaattatttgatcttaaccgtaagcctttttttctgccttaggcatttggattcaatcctaaagttaacaactatgttgagaaggcagttgctgtgtttggcggattttacatccttttcttttttgaaagaacactaaagatgttattgaagacgtatggtcaggtaaatggactttattttaaatgtttgatgttttaccctctaaagttactttatataggcatgtaaaggcaggaattttattcttacagttatgtgaacagttcagttattagacttgtgaatatgagcagaaagaaaagaatcaatatattgataagtataagaggaacagttgattcttattgtagaatttggagtaaatactaacaatttaatgtccaataacagatgcacataatttgtttcctctcatattcattaacatcagaaggtatatgtactctaaaacatgaaaaaaaaaacaacccacaacagaatctaataaatgaggatacatttaaagggagagaattttttttaatctaaaaagattatactacatttttctcttatagataaaaaccattaaattctcttgcctgcatgagcaatctttgtttcttcttgtaacattttcctctcttgtttttccctgtagaatgatcacacccactttggaaataatgactttggtcctcctcaagaaaaaactcatcaacctaaagcattacctgccatcaatggtgtgacatgttatgcaaatccagctgtcacagagcctaatggacacatcccttttgataatgtcagtgtggtatctctccaggtattgtcattctctctaccgcatcgcttaccctttgtgaagcctgcggtgcatgcagctacattagtattttgcccatttaaatgtgtcaggctttttcctgtaggtgtgggaaaagtagaatgcaagtctgttacttttcccactttccctccatgtatttactacaaacacatgaattaagcatgaaattgtgagtttctgggtcagaggctttactattctctgtgaactccgggagttggtgatggacagggaggcctggcgtgctgcgattcatggtgtcgcaaagagtcggacacgactgagcgactgaactgaactgaactgaagactgtttaactatgtaagaactacttagatttacacaataatgtgtagcaaaattaattcagagcatttctcttattttgcaattctttcaagatcccaaaccaaagaatacttttgagtgattttgaaattgaaaggagacttgtaagctaagaaaattgtgtttagggacttccttttgtggtccagtggttaagactctgcccttccaatgcaggggacacgggttcaatccctggtcagagatctcaggtctcacatgccacacggtgtggccataaaattaaaaaaaaaatttaaattgtgtttgttaattatttatatttcaattttctaaataatgttaataagtttcatttcttgagcaagaatt

SEQ ID NO: 35498 - DNA, 1964 bp, Bovine  19866881077669
taggacctcaatattacaaaaaccattttgtttagtgggcagtttaatcctaactaattatccatcaaactcaatgtctgagagagcacaagtagagagactggaaatgcgagtgatgtttccaccggaagaagggacggaagcacaaagtccagtgtcatcactgctgcatgagaagctaagatctttgtcccagagacagtccagccaggtttctccacagttaagcatgagcagcaaactagaaaagattgtattcttatccaaatcttcattctttccagccataaagtggatcaaggaatgagggagatagttgcataccaataaagcctcttcttgaaaacaagattatgcatttcttctctaactaattaatagatcaacttatttcatgtagtagaagtgcccactgttcttccactttctgacgcttaccctaattaatatgacataacaaaagataccagagttaattgtaaaagacacagaacaaggccttgatgaggatgatcctgacagagaattaccacatctgctttaggatgcaaagatgttcttttaaaaaatggttattttcagaggtaactttaaaacatcttgatggtagtttcaaacatctagaacaacagttatttaagtgtgactaaggaactggcgacccactccagtgttcttgcctggagaatcccagggacaggggagcctggtgggctgccgtttctggggtcacagagagtcggatacgactgaagtgacttagcagtagcagcagcagcagcagcagcaggggaccatacgggatccctggggacctttcaaggggatctctgagttcaaaactatcttcacagtaaagctaaaacattatgtgcctttttcactcttactcttttgaggggacagtggaattttccagaagctacaagatgtgtgatgacatcattctgacagctaatggaatgcgtgtttgtatattcttgtgtgttctataacagaggttgagtgtataaagaggtgggttttcagagattagctcaatgtgttctcagtactactctgctcttaccagctgttggtggttattcctgctatcatctctgtagcctcattactgttcaataaattcttatttttaaagccaaagttttccctgcaacttatacagaaacacaaaaggatgaggtacctttggtgaacttgttcaagtaataatttttaagttgtcaaataaaaataaatttttatttttgagactcatttaatgatatttcatctcattctaaaagtaaacatatttataatgtttttcctaatttttatcttaaattattgtcttaaaatgggactagaagattaacattctcacctaccaccacactgtctacatttaaaagtgctggaaaaaataaaactgatttatcagagagtcttctgactcaaggaagggaggaatctactccaaagaaactggggaaaataataaatgagattgtgatgaaagccatattcccttcaactttatagatggtaataatttatcttacagtgcattatgcaattggagaaggaaatggcaacccactccagtactcttgcctggagaatcccatggacagaagagcctggtgggctacagtccatggagctgcaaagagctggacacaacttaagtgacttagcactcacacattatgcaatggaacatttaaataataataatatttatggtgccagttacattgtagtatcactttgagaccaatcattctaagtataaagaaaaagaagttgaatattttaaacttagatgtgataagctcttctaaaggctaatacattctttactacactgtagtacattggtttatgtcatattataatattttttgaactagaaatgaaaaaacccactagcacaggggttgggttatcacactgcatttgctagagaagcacacgtg

SEQ ID NO: 35499 - DNA, 1715 bp, Bovine  19866881081716
ctggagtgggttgccattcccttctctaggggatcaagcccaggtctcctgcattgcaggcagattctttactgtctgagccaccggggaagccctattctttgaagcttggggcctaaaagaaaacaggcagccaacttatgagatagttgtatatactataatatttcttctagtaaaagagcttaaagaatgcatgctcatttgttaacatgatttgaggggaaaacagacaaaaaatttattataactattgcttagtaactcaattataaaatatagatgaagaaattttgatatactttaaagtcatgatgataatacatattcagcactcaatgatatgttaaacactattaattaactcatttaatgctcacaataatctcactaaggagagcaaattttattcctattgttagaggttaagaaatcagaaacctgttatctaagatcacacaattttaggaggtggatttccattgaagcttaacactcaaggtaagttcctttgatcctccaaacagtgttaaatttcattacatttcatgtggtaacagtgatgattaattgtatgtgtcaagtttgttagcgcactatacccagatatttggtcaaacatttttctaaatatttctatgaaggtgttgtttagatgatactaacacataaatcagtagactttgaataaagagttgcaattatttgataattaaagatacatgtattaaaggagattaatacttttgcttgttcaagtagaatcatgattcaacattctgccaagtggatcaattagtcttaataacactcactaaaggaacttgggataagcatgtagggagttcttgcttgctctccaagttttcattaagggggtcccccaagtatagttacaaatttgcatagaggagcaaaagtcctcataacatgaaaatgtttactaatgaacttctacttacactgatctccacttacacattccttcctttaacagattttgaaacctgcagattgccttctctatcatcctctgatttttggatgtcaggataaaaggcaagtcaattgcaaagttaaattccaaatctttcaaaaaggtaggattacatacagtattgaaaacattgttgaagaacgtctcaaccttttactgcaaaaggacattaggcacagttatatcagttagctgctgctgctgctaagtcgcttcagtcgtgtccaactctgggcgaccccagagacggcagcccaccaggctcccccgtccctgggattctccaggcaagaacactggaatgggttgccatttccttctccaatgcatgaaagtgaaaagtgaaagtgaagtcgctcagtcgtgtccgactcctagcgaccccatggactgcagcctaccaggctcctccatccatgggattttccaggcaagagtactggagtggggtgccatcgccttctctgatatcagttagcagtagaagacaaaggaaatagacccagatgacagaatttggttccttttattttgatgaaaaatttacatataatgaaatgcatacattgctgacatcaacaaattctttcatctgtgtacctcaaatccctattgaaatataggcttctaccatcacactagaaccttgtgattttttccagttaatattcatacccactgtcccagagaaaactactatattccatttttccactgt

SEQ ID NO: 35500 - DNA, 1727 bp, Bovine  19866881236063
ctgagtcatacaggttcacttttggcttcttgctggttctcatcccatggctttaatattttgttttgtgagtattgtaataacataattaaaaaaatccagaacacccataaaagataaaagaagaaacccaaggattacccatgttactgtccccaagggagaaccatgattagcatttttatatgtatcttttcaagttgcactcagaccatcgtaggattataatattaatttttacaaaaggtgcccagtaggcatgttgttacgtataaatataaatatattttacctcaatgctatgttttggaaaaatacagatattcgtcatctctgctactctgcatagtatttcactgcaggtgtaagccatatttatatgatccatgtcctatgcaggatagccaagttctttctttttttttcctaatcttcccccacctctttgccctccttcttgttcttctccaccctctcctttttcttctctttttccttatcctacttatcttcctcttttgatagctcttcctgctcctcccaacacatgccactcctccttcttcctatcttcctcttcctactcctctcacacctgcctctttgtctctttttttggtcttctttaattttctttaactgccttatttaactttaaactgttctgcaataagcccacttgctttcttcattatgatttcttagtgcttttttgttttactttttcttcttcccctccatgcttaagttgggattctattcagtctcccttccactctcataactttgttcatgctattatttctcccccgcttctgatcagtctgtgctttgctttgacctcattttcattaataatttaggtgaacaattttatgcaccttgctgatgattacactgtaattcttgtcagagccaagcaagaccttggtttgcctggatttcagaccagtggtcttttcactagattgcattgccttatcatgactgaggttagaaatagcctcatatttagtgtacaggttaaacaagggaagaaagcaaacaagcaacgagaccgaagaaaaataaaaaaataatgggaaagagagtagtcctaatttaacaaagacttgactctagtgttctgtctgctcagtgactttgttctaggtgaattaaaaaagaactgttcatgaacgtttgcctgctttcattccttctaagacttttaaaaatgtgtaacagttaatctagccaacagtgttatttcagacctaagattataagattaaaggaagtataataaacatagtaatatctgtactcagaggtaaaagaaccatgcctgatatattaatttgtttttcagaattaaaggaatttgtatacaggctctgtacaaaatttcaggtagttaagacttggtctagcaatcttttccctaagtcatcacaagtaaataaggaaattataaatatgtgattaggcaaatcaagttggtaaaggaaagcaactggtcttttgaagtgtatcttggcagtaagtttttgcaaagccaaggttactttctctatggtgtttctcatgactgcctttgtttctctttgacagtaattgtttcctaatctgggacttttcacccaagccacccatttgacatgtactaagtcattgtcagaactctccaccatgacctgtccatcttgggtggccctacatggcatggctcatagcttcattgagtt

SEQ ID NO: 35501 - DNA, 1738 bp, Bovine  19866881261084
taataaaatttatttgtactaaaatgtcctttctgtaattaacaaagtttttattatagaattatgtaggtatacagtcagaatgtgaaaggcaactttaaacctaaaattttctcttgattattaagaaatcctcctgcttcctttcttccttgtttccatcaatctttcatccccgtttcctctgtctgtctctctctttttttaaagatgatctcagtctggaataaacattcttgcgaaactggccaggatttttgccaagcatagtgtgtacacgtcagctgttttctggaaaataattgcactgtgtgacaatgtctattattttaattagtactgaggaatgcctccaagatatttcatcaggtcatctgacaaaggccatggcttttcatttcctgaaatgctgattaagcagatagatgacatttgacattttgtataggtgaacaaaataattgttataattaagccagaactcacagaagtaataaaaccactccccaagtacacaaaaggctttaggacctgaatcctgtgaacaggacatcttttagagtgcagtgttcaaattacccaaaggaaatagtaactgacctctatttgtgggaaggccactctctgggaagatcctggcatgcctggggagatcaaagttgttttgtcataagcttccaaggcttagtccgtcaatgggagctgttatatttccaggatatttgcctgtatttctgtgttaaattcaagaagcattgattccaagatctgaaaaaagagccctttgggaaactgtgttgagagcacatctccagaaactgacaaacttgaaaacacagtttttaatagtgctggagagggaaagggaagcttattttctctttccacaactgttccccagaaccactgtcagataaactaaagatcaggacaagaagtgttcatctgaaaaggaagacattttgtaatcatcatgctgtgtcgcataatatcaatatgattttttaatataaaaaagcacacatttatatactggttttgtatgtcttctgtgtgaataaaggtgaataaaggtggttagtcagttttattgtgaggctttgtggaggttggcaggccacaccctgtgggtggactccagctcctgtcaaagaggtggtaatatgacagtcagtccctctgggcagaggaggttttcagactggaactggactgatactggttggaggaaaggattctcctcctcttctgggtcttcatctcttagtctgaataaattaggagacactggcctgtacctgtgggtggggggttctgagacactgcacaagcacttagacgctggcttgtcggtcaagctgggtttcagaagtgcacatcatggtttgcaagtgttgtcatctgtgtgaaggactgactctgctctgcctccactcagcattttaaaatgcggtattttcccattttctatctgtttcatctctccatttctgagtgatgacaagaagttcaacattaataaattgtcatctctgcattgcataggaaccctgggccttattcaatccaggggattcagggaagcctataatgtgggtccgtatagttgccactatcccttttcattgcctgctcctacagtgctgcaaaggggggaggatctgcctggagtgtcctctcttgtgctaaacttagtgacagggaaccctgctgaggcctccaaggcccagcaacagtg

SEQ ID NO: 35502 - DNA, 1532 bp, Bovine  19866881273881
cgaggacaccaaatcttctagaattacatggaaagacatcacaaacttactttgacctgagggtaggacttcttgttcttttcactagatgcaccggggagccctccatgggaggggccttcacacacgtaacggaaacgaaatcctctctgcaaaggtgaacacaaggtgaacaagtttgaggaatacttactaaaaacttatagggacaaaattatacccaaattttatattcttgtgtattagaggagacacaaactgtgaaagaggactgtatatgagaactacttctccccataaccttatcatgaatattgatgttaactgatatttgggccctgagctgtggcttaaaaggcaggtccttggccctgcagaagctctccttctgtgctatgtggagagtaaactgctgcagattttaggcctaaggactcgacatgctacagcttgcctgtatcagagtttcctcatctcacattgcttctgccaagctctgaaattggccatatgactcaaagttaagcttctctgattcttatttaaaggcattcctttacctactctgatgacagttggttcaggagggaatacagaaatgtcttgttaaatataccccatcagggttacagaacacagcctatgcaagtccgcacaatcaataactctcaacagttcagaaggtaagaagtttcgatttaagattgttaatactatcaagttcaagctggatatattaactgacctgaatgattccaaacccagagagtccctttatatattaactcaagaatttttatagacacagtaatatcaactaggaattagcaagaagcctttactatgcaggctgattaaacacatgagttccatgtattttttttaatacaactaagaagattagaccagaccatattcaaggtctattccagttttaacattttatgacttaaaaagctaacagttgtaattgtgcatatttgcataccaagaataaaacaaggacatttatgagaatgactctcatcatcatatgaagggagatttcaacatatacagtctcttgaccaaatggtcttccgtttttcaaatacaccctttaatgaaaagaatatgttaatacactttaaggaacattctcaccttctgcttactttatcgtgggactgacttcctataaacagtgatagatccttaggcctcagaagctccgcacaccactacttgttagtggggctttctaccttgcaagctggatagtggagctcagtgaatatacaggttttgacggctttgagctaatggatcaatgtaaagtttctgccctccttagactgtacttcatttcactatgccccatagggtcttgaaaagcagcctgagaggttcagggagagcacctggaattgtttctaaattctgtgagacttttctaatttctaaagaggaccagtctaaagcatcttttacgggaccagcgagacctgacctaaattccctaggggaagaagctacccgtatgtcacacatgg

SEQ ID NO: 35503 - DNA, 1941 bp, Bovine  19866881284871
tatactgtttttaaataaagaaacagatcactgcaggccatgagcttgggtgtccatggccaacccttgtggcctcgtccctgggcaagactctctcctgcctaatctcatggcagattaggaaggactctttccattcacctcttttcttctcttgatttccatcagtcagtcagtcccagtcccgttttcactgatcttgcactcagcatttatgacataaaatgcagtatgagtgcagatgaaaacgtgttcttggttaatggaagagggtgcttaatggctacacagcacactccgagatgtgctcttccttccaactttaacaagacgtatgcattttaaatggtctacttcttgaagagtatctttcacaccggaaacaagtaccactcgtgttttatttccatcccattatttgttcatcacatatttttagaaaggcctaatttgatatcatactttttctacttactagcttgtcttagcattttcccatgttgtgatatggtcagatatgctaacttggaaatgtgcttcttatatagatctgcaactatgtgggacctgcaaaggttattgttcagttggtcacaaatggaaaaaacatccacctgcatgcacacagcctggtgggaaaacactgtgaggatggcgtctgcactgtgacagccgggcccaaggacatggtggtcgggtaagtgagcatgcgtgtcgctgcagaagggaggcgcagatcgaacacggcccctgcgggctgggactggacaggcccttttcatcaggggtctttgcaagaccctcagagagtcttagaatatgaaaatttgagaaaactagctatagcagaaatcaatactttatggatgatttcatacccttaatgattcatttaatgaactttgactatagatttgcattgtgaacattttgtgcagacagtgggttttatttcagttgtgtgctgcttaaaaagtatgcacagaaatgatatgacacataagaacttaatttccaaaatatacaaacaattcattcaactcaatgtccaaaaaagcatacaacctgattgaaaagatgggcggaagacctgatagttctccaaagaagacatgcagatggccaacaagtgtatgaaaagatgcttgatctggctaattaccaggggaatgcaaatcagaaccacaatgaagtactacttatacctacagagtggctatcatcaaaaagaatacaaaaaacaaatgctggtgaggatgtgggaaaaagggtgagaatgtaagttggtacagtcactgtggaaaacagtatggaagtttatcaaaaaactaaaactagaactgccatatgacctagcaattccactcctgggttatataaaaacagaaacactaattcaaaaagaaacatgtatcccagggttcatggcagcattatttataattgccaagatatggaaacaacctaattgtccatcagcagatgagtggactatgaagatgtgctgtgtacacacgcatgcacacacaatggaatgctacccagccataaaaaaggatgaacttttaccatttgcatcaacatgggtagacctggaaggtgttacgctaagtgaagtaagtcagacaaagaaagacaaatactgtatgatatcactcatatgtggaatctaaaaaataaaataaactagtaagtacgacggagaaggcgatggcaccccactccagtactcttgcctggaaaatcccatggacggaggagcctggtgggcctgcagtccatggagtctaaaagtcggacatgactgagcgacttcactttcccttttcattttcatgcattggagaaggaaatggcaacccactccagtgttcttgcctggagaatcccagggacaggggagccctggtgggctgccatctgtggggtcgcacagagtcg

SEQ ID NO: 35504 - DNA, 1486 bp, Bovine  19866881333611
tcaataatattttattttacttagtcctaaaggagagttcccatgagcaattatggtcatattgatgagaaactcacaaaagaaaagcttattttataacctactaaatccctttatatggatagtaatacctctttccctgtccatttaaaagctttctcaaagagaacctataaagtgggaaattcaggtaacccacaattttatctaactattcaacatcctctctgaatttcttatacatggtttgttgaatgagaatttaaaacaatctttaagtgaaatcttaaaaattatatatgatctttcaaatcaaactgtgtagccaatatatgggttattcactatataagtgtactgttgataagagactatcaagttctattcaaatacagttctctacaagccaacatccagaaaaacattgcagataaacaaaaaggaggatatatcttaataatgatattatggggactacaatacattttgaaaaaagctataaattctttcccttcagaacctcaaatcccaatattttcattaaaccaaatcattaccaactaatacattttaacctcaaaataaaccttccttcttagaagactggcaagaataaaacaaaaatttctttttcagtaaaagttccagactgaatcaaaagtgaaggaaaaacaatttatcctccttgccttttagtaagattcaaaaatcaggagcaaattaagtctgaaagaaagaaaactttacaattccttcttcccagataagggatcaacatgtcagcactggcttcctccaaacttgataatgcccagcattttctgagtgtgtgagtgaccatgttggtgtatgtgtacagattgaaggctaaatgaatgattcacagatgtgttctacacatctgcaaaactggaatggagtacatcatgactcttcatttccataatgcttgtctttatttgcaaatgttcagtctgtattttcccttccatgaaccttctgaatatagcttgattttgattaatcttccttaaagtcatttatgttaaccgtagacattattaaagtctgaaaaaaatgcaatgctatgattcttcaatgtgaatttgaggttagaacattttaaattaatgaatctctctggtaaaaatgaaatgtttcacctctcagatgatttgttctatatgtaattattttcatgatttcatgttatgcttcctgaggtttttaagctttacacatttttgtttaaatataaatagcaaaatgttgtgttttgaatttaaaataaattacataaagcaaatgaacaaacaaacaaacaaaagcaaaacaaaagcagaatcacaaatatgaagaacaaacgtggttaacagcagtggaggagggatggggaatggcaaatatgtgattaagggtcaaaactactatgtataaaataaataagatcaaggatgtaatgcatagcacagagaatatagttaat

SEQ ID NO: 35505 - DNA, 1327 bp, Bovine  19866881462924
tttctgtttcttggaccccataaaaaacatatatcttagtctttgatatacagccattcagctgttattttgcatttacttaaaatatcctctgctaaatagttgtgttcatctttaaaagcaaattgcttaaaattacattcaatttctttctgtaaaccaacatttcttcaccttgacaaaggaaatacattggataccaccgatgagctgtcatcagcgttacattacacttagagggaaaaaaaaaaaatctgagtctgaaattagtagagttaacaaaattttactgatttcatattatttcaagatggttttcaaagccatccaacaagtccctatctgtaatataaaaacaaaaccaaagctatgagcaatctttctctcctggattcattaaggccttggaatcatttatatctgtgttttgtacattttgattctcttccacatttatatgtacttgtttgtgaaagcactagaacaaattaattgaaagaaaccactctgaaactacttgaacatttgatccaaccatagagatttaaaggcttatacagcctagtttatattttcctctgggttttggtgtcgaaatgattacagaatgcatgtttctttctttgtgatggttttttaatatgcgtgaaacattaaaaaaaagtcagcatttaccaaagatctcatgtatcaggcttttcagactggaaccaaaagctttttaaagcatttttaacaacaaatgatggtctgtttcacagatcctgaaaccaataatcagttttcttgacatacagctaaaaacaaaattatcttttaactaaataggatcagcttaaaaatccctttggagctgtttttatttattaaatgccttcattaacaccaccatctttcacttcttattactccaattcaatttctcccgcatacaaagtgatgagaagaatggctgtgaatccagttaacatccctgcgttctgaatcatgaagaaggtgaaatcggtttttcttccagttaccttttctctcagcatatcgttcatctctggaaactagaggaaagatacattgttagataactgttgccatcttgtggtcaaacataaaagttattacagattcctgtgggggtggcagggggtgagcgtttctgtccctggtttaaatgttctagtacagagagcataacagcaaaagccagtgtaatcagacatcaacaagaagaagagtaagaagactgtgccccaggttagtcaatcagtggctggagattaatctcattttatgcctcctctccctcccttccttgctctctctgctccat

SEQ ID NO: 35506 - DNA, 1711 bp, Bovine  19866880244024
tcccggagtccaccgaaacccatgtccattgtgtcagtgatgccatccaaccgtctcatcttctgtcgtccccttctcctgccctcaagctttcccagcatcagggtcttttcaaatgagtcagctctctgcatcaggtggccaaagtactggagtttcagcttcaacatcagtccctccaatgaccacccaggactgatctcctttaggatggactggttggatctccttgcagtccaagggactctcaagagtcttctccaacaccacagttcaaaagcatcagttcttcagtgctcagctttctttatggtccaactctcacatccatacatgactactggaaaaaccatagccttgactagacagacctttgctggcaaaataatgtctctgcttttgaatatgctatctaggttggtcatactttccttccaaggagcaagcgtcttttaatttcatggctgcaataaccatctgcagtgattttggagcccaaaaaataaagtcagcaactgtttcccaatctatttgccatgaagtgatgggaccataagccatgatcttagttttctgaatgttgaggtttaagccaactttttcactctcttctttcactttcatcaagaggcttttgagttcctctttgctttctgccataagggtggtgtcatctgcatatctgaggttattgatatttctcccagcaatcttgattccagaagggactttttaaaattaattttttgattaatttatttactttttttattttttttaattttattttatttttaaactttacataattgtattagttttgccaaatatcaaaatgaatccgccacaggtatacatgtgttccccatcccgaaccctccttcctcctccctccccataccatccctttgggtcatctcagtgcaccagccccaagcatccagtatcatgcattgaacctggactggcgactcatttcatacatgatatacatgtttcaatgccattctcccaaatcttcccacgctctccctctcccacagagtccataagactgatctatacatcagtgtctcttttgctgtctcgtacacagggttattgttaccatctttctaaattccatatatatgtgttagtatactgtactggtgtttttctttctggcttacttcactctgtataattcaatttatttacttttaaattgaaggataattgctttacagaattttgttggtttctgccaaacatcaacatgaatcagccataagtatacatatgtataccaatgaaggagctcttcgcagaaatgtgagtagcattaagggaaaccaataagatatgatgaaaccttccacaactagcaatatcagaagttgttgttatccataggtctggaagagaaggagacagtaagtacaataaaacagagagagtaactgcaactctaggacaggactccctttcagtagagagatacaaccaacttgccagctggggaaattaataccctaaactcattcttcttttacccccaatctcttaccattacttttcatgcttaaatccaaccagaagtcagatggcaggggagcaaattaactataacaatatagttcaggttcccaggggcatgcaaacaaggtgaggaagggtgaagagtacatctagagagaaagagagaatatccaggacaaagataaaaaat

SEQ ID NO: 35507 - DNA, 1671 bp, Bovine  19866880263893
tgatgccatccagccatctcatcctctgtggtccccttctcctcctgcccccaatcccttccagcatcagactcttttccaatgagtcaactcttcgtataaggtggccaaagtactggagtttcaactttggcatcattcctcccaaagaaatcccagggctgttctctttctggatggactgattggatctccttgcagtccaagggactctcaggagtcttctccaacaccacagttcaaaagcatcaattctttggcgctcagctttcttcaatgtccaactctcacatccatacataaccacaggaaaaaccatagccttgactagatggacctttgctggcaaagtaatgtctctgcttttgaatatgctatctaggttggtcataactttccttccaaggagtaagcatcttttaatttcatggctgcagtcaccatctgcagtgattttggagcccagaaaataaagtctgacattgtttctgctgtttccccatctatttcccatgaagtggtgggaccagatgccatgatcttcgttttctgaatgttgagctttaagccaactttttcactctcttctttcactttcatcaagaggctttttagttcctcttcactttgtgccataagggtggtctcatctgcatatctgaggttattgataaacagcaaacttacttatggttaattcagttcaggcaataataaaaatgtttaagataatttatttattttttttttactgtacacttcttcgtgtctttactgtgctaatatatatggtgaatctttaagacagaaaattcccaaataagcttgagtttggaagccaggtattttgtttttaaagatcctattttgtgatactcctcttgcactaaaagtactttaaaaaaatgcagtcctgagatttccaggctgaggagatagcaaggaagctctgtggactcaggtgttatgtctaatacttaaaataatggtttcactaacattccccttaactgaattatatctttgacccctttcacaagagtgaaatttatatggaacaaccctaacttcaagacaggagaaagagtgatgcaacccaaggaaggagaggggaaatgggagggaggcagtgaccagagaggctagtctgttactgagagaatcgaagaacatgtggatcaaagggagagacagattttcagaattgcctttactggaaaaaatctgtgagactttcagggacttccctggtggtccactggttaacagtccaaggttctacagcaggaggtatgagtttgatctccactgtatggccaaaaaaaaaaaaaaaatctgtgagaccttaaatattgtaagaattaatgcagaaaagcataactttagataagtcaattaaaaaaatatagtgaagaagtaaattactctttatggtttctagaccattatttgaatttcaatttgactaggatgcatacaaagaaggtagcatcctgttttcatttatactattccaaagcagttttgagtgtgtgagaaaacaatcatggatgaacatgctttacttagtgtatcacattaaatttttgcaataaaaagttttatgttcagttcagtcactcagtcatgtctgatgctttgcgaccccatagacagaagcacgccaggcat

SEQ ID NO: 35508 - DNA, 3433 bp, Bovine  19866880603049
tattttattttttctattagaagcttttagaaaagaagttttcatgtgataaggtattcaaaaattacttggaaagcttattaaaatacagcatcctggatctatatttagagtttctgattcaggatgtaacacaagattttgcattgtttaaaagtccctatgtgactcagatggtaaattccctggtggctcagatggtaaagaatctgcctgacgtgcaggagacatgggtttgatccctggtttgggaaaatgccctggaggagggcttgacaacccatcccagaatttttgcctggagaatacccatggacagaggagtctagcaggctgcagtccattgggtcacaaagagtcaacacgactgagtgactagcgactaacactgatactggatttaccctatggggcaaagaggatcaatcaaaggctttaaaacagaggagtgatgtgattggcaccagactgcagagaaatgtctctgactgcagcactgaggatagatttcggggaaagaaggtaaggactaagaaaatgaccaggagagaggctactgaaataaactggaagagagaatctgagatctggaactgaggcaacaaataagagaacagaaaagaaaagacctgagaaatagggccacaagtactaataatgcagaagacgaacatgtgtatgcataccgtatgctcctattttgcttataaatttgtgtatatatatgtataaacacacacacacatttacacagaaaaaagagaaaaagaaatgtaaccagatgttaagagtggttatctctgaatgataagatataatggtgatctaaaagatttttttaatacatgtttttcttccaaaatgctctataattaagcatggattacttttatgattaaattaaaaaaaaaaaagaaacaaagagggaagaacttcattataagacaggagttcacaaagatgatgaggaagagacagaagaaaacctatgaaagaacaatccaggattcctgaggacttggaagcagattctggagaaccttgcagaattagtgcaagaactaacacttgcactattagttaactatgatgtggcagcttagatgagacaggatttttccagctcctactgtcatcttatttgcctttaaaatacaattaaataaaagttactaccgattgattgatggctggagtcctgcttgcttgcaaaatgggtaggatttgaattatatatttattgcacatataataaatctaatgctttcctatttctttaatgatttttaactttaaaggagagtcagatatccacaagggaggaaaaaaatccatagttttcagaactgacaagaatataaggcttagcaaaacccatgccaagtaccacagtttggtaatctatctaagaaaaaaatccaatatatggaatagtttccttagattagcatatgttaattttggttgcataaaacttcattgttgattgaaggttaaatgagtcaatgtaatccatgaccacaaaatgtgggagctttcaggatggtcactattccttccttgaatgaacttctttttttttttttttgaatgaacttaggatgaaggtcttttgtcataccttcattttacagaagaggtccaaaacttccctgggctccctaaagcaagcagcagccctgaaaagtcttcacagtgcttctcctctgacacccagcaaaggaacagacctcctaaccttcaccttcaaagaggaacatcagggggcttgaaatagcagaagggctagttacctcacagtgataacaaaagactggaagagaggttttcactgaaagctaggttgagcaagggcatcaccatattggaggaggcaagggtcagaaagagcagcgtcaggctctgctactgttcccaacaaaacaagtggccccagtcaaactaccaagagagaaaaggttggtgcatgtgtaggcaaagcttgtaaataggaatacaaatggtggagtttgtgtttagagaatatcaggacagaggtagaaatttaaacagatgagtaacaaacaagctcatctcaagccaacactgtggcaacacttgctatttgctgtctatagctcaagaggtcaaaatatctctctacagccctgttctggaaaagcagttcctaagttcagtgactcctatgaacctttgcaaaggagccagtgatcctgcaagggacccttatacctgtagatatgcaattttttttttttttttttttggccacaccacatgacttgtgggatcctagttccctgaccagggattgaacccaggatctcagcagtgaaagcatggagtcctaaccactggacctccagggaatttctacatatgcaaatcctataagaatatataagaatgcctaaatagaattacctgtaaagagcattggtattgcatctcacctacatttgtacacttactactactttttaaatgtatatcaattttaatgagattaattcttagtaactttgcatatttgatattttctcacaacatatacaaaaaaatgggtcaactgtggtgtgaggaactgtgaaacttccctgctcaaaaaactaggaatgcctgccttaaataatttacagttatcaacgtaagacagtaagagaactgataatagcttagagatgtagttcttaaatttggttgtacattctaattacctggggggctctttaaaaacccaatgcccaggtcacactccagaccaattaaatcaggatctgtgaggtgagaccccagcatcagatcatttaaagcacatatattcccgtttgaatttctttgaaaactgagaagatgcacatgagaaacatttatatgtataaaaaagtatagagaatgaaaagtaagtctcctcccacctcttagtccaacatctattatcttttcagacaccacagccatgaccagcttcttggcaatgatgcacagatatcccgagcatatgtaagcataaacattgatattcttattgttacatgaattgttaacaattatcttcaccaaacgtacaacaacctctactatatgaatggatgtagcataaaggtgtgagcccatgagtctacaaagaaagaagctgctaagctgagcagaatcagttctttctaggttttgcataaatattcttttgctatatgtttatttttttcttcttcttcttctcttttttttaattttattttatttttaaacgttacaatattgtattggttctgccatatatcgaaatgaatccaccacaggcatacacgtgttccccatcatgaaccctcctccctcctccctccccataccatccctctgggttgtcccagtgcaccagccccaagcatccagtatcgtgcattgaaccggacaggcaactcgtttcata

SEQ ID NO: 35509 - DNA, 1865 bp, Bovine  19866880618996
ttagttttgacatcgggcaacattttcaagagactttcactcagaatgttgctgtctgtgggctgacagttttctttgactcactcttagcccggctttgcactgaaaatctgaccagctctttctacctgcaaatctacaatatcctgaaataatatttgttcacataacatcactctattctctataaaataccccagccttcctcaaaagaaatagtgttattgcaagtttgactattgaaaaagtaatattgcctccaagggggtatgccatcttaataagacatatcttcaagacacgaagaaatgtacttttcaaatcctacatgccttataaaccaccacttatgaaacctttgttctaaagtgttgccagttttacctgagacagatattttactgcatttaaaaggtctctgaggatcttagggaatcttaggtgaacctggaggcctggtggatataatgaaaaccaaagtttttgtttcatgaagttttctcaaggcttttctcctgggcatttaaatgtaacttccattttgctagtctaacttcaccatgtagtgctggtagaaattttaggaagagaaatagctggtgtgtgtaataaactgaaaaacaggactctcttctcactcacctactattccactgaaggaagtggtggtagaaaatattgttagtctaattaaaattagatgcagccatccataaaaatgagagaccaatggtatttttagaatcttttacaactggaacttatttggctagttagctctagaaaaaaagttaccaagcaaatatccaccaaaatcagttttcttttcccctctgctttcaaggttctttcctttcctgttcagtgaatccaatgttttacccaaattgattgagtaaaccaattcatactgggtgctattgccttttactgtattgctcttttcagagacatttttctgtttatcttgatttatatatgtaaatcattttatcctctttgtccactgatacatgtttttttaaacaaatattatatgtctactactgttctaggcccttgaaatacagaagcagactagatcttacagatccttgcagctgtgaggctcacattttagtggtggacagacaaacaacacacaaagagatttcataacacacattcacgtgactaaacagtgcaggctacaaagaaattgaaacaggataaagacctgaaaagtggctggataagctttatacatcttatcccaagcacaaactatagcctagattgactattaaaaaaaacttaaatatcaagttaatgttaaaaagatccatttaatatcagtgaaagttgctacaaaaagaataataacaggaacatttgcctttggggagaatgtgacaatggtgtgctagcacagatgttctaatgttaagtgtggtccctctttggggctaaatttttaatggagaaactaatgaaacatccttaatgagaaaaagaggagtggtgaggacaaaatgctatccacctctggacctctgtggtccaatgtagttatcactggctggcgtggaccctaaatatgttaaatgtggctagcctacattgaaatgtgctctaagagtgaaatacactgctactgctaagtcacttcagtcgtgtccgactctgtgtgaccccatagacggcagcccaccaggctcccccgtccctggcattctccaggcaagaacattggagtgggttgccatttccttctccaatgcaggaaagtgaaaagtgaaagtgaagtcgctcagttgtgtctgactcttagcgaccccatggactgcagcctacaggctcctccatccatgggattttccaggcaa

SEQ ID NO: 35510 - DNA, 1943 bp, Bovine  19866880633468
atgaagagctgactcattagaaaagatgctgggaaagatcaaaggcaggagaagaaggggacgacagaggatgagatgtttggatggcgtcactgaccatggacatgaatttcagcaaactccagaagatggcgatggacagggaagtctggcgtgctgcagtccatggggttgccgtaggacatgactgagcaactgaactgatactgatcatgtacgtttcatgtataatttgtgtatgtttcatatataatcccattatatatattcttttccagcttatttttccttataggtagaaagtgctttttcttaatcatttcaagtgaaaatagtgtaaaacaaatttatatctttctgagattttaactatttaaaaagataaaaacaaggaaggaatacaaattaatagtagctgcctttgatttgtgagattatactggtccattttttctcagcttttcagggcttttcaaatatttgcaatgagaatcaattattttatactcagaaaaaaagtttatgttctcagtacataactgggaatgtattgtcttcattaggttaaatgtttgttataaaggttgacaaatccaatgaaaagaggcaattgtcctgaggttagattattgttaaaatgtgtaatgagaaaatatttgttagtgtcatgtatataaacaagaatatctatatcaatattgtagaatgaaaacagttagctcttgaaaatataggtaagagattgagaaactagatttgtaacttaaatttaacagagttaagtttatagcataatcagaaaacagtttgtcttagtgtatatgatgtctaggaaattaaatatctctgcaaattgattgagagtttcctttgtagacttaaatgacaaagcaagaataaatattttttaagtgctatcaataaaatctgcttgacctgattttttttttttttttgaaaaaagtttttgtggaagaaagtttaatcttttttgacttccatgtaggtttagaaaatagctttgccataatacatatagtcaaaataatgattttatatttatatttcttttcaggttataacccccttaattctcttattaacactgtgatgatttgattatgatcagtttgtgggattattaaccattcttggtttcttctcacctcattaactagcaagctaggcactgagtgttgataataaccattgtctcatggactgatgctcagtattaccaaatctttttagttttatgaagccatttccattagagagtgagtaggttttctatattgtttttctgttttgtacatgtcaggattacattaaaataaataagtctctatcacctagttcccaattattttttcttaagaagcaacagcacttattcagtgtttcaaataccatcaggttaaaaaattgtttcttaaatcaattttctaaataagtggagccagtttagctaaaatggcactactcaacttacctggggtcttgctaacaagggtgtgagaaaaagcaagttgaaattttaaaaatagtagtggtaacttggctgttattattgagaagtaatgacatccattttaattcacaagttgggaaggttctgattaaggaagcagactaaattcatcctatttgagaatgtacttgttctcagatacctgataattttttttatttgaaggataattgctttaccgaattttgttggttttgagttttacgtggttctatatattcttttcccaaggtcaagtactcatgcctgctctcagctgatgttctgcaggctcttctgtgtctgagggtgtattcctgatgtatccattgagagagatgtactccacattcacctactcctctgccatcttgttctccctgataaatgtttgtggttggagtgatctggagtccattagcgttgctgagaa

SEQ ID NO: 35511 - DNA, 2470 bp, Bovine  19866880638046
tagtttgactctttgcattggagtaattaccccattgcagctggactcaaggaattttgaatgtagtaatgaattgctgcaacccttccaagaaatacaaaacccatatgtctcagggacttggttgtaggctgaagctatagataaggacgtggaaagggaatggtagtgcttctaaagccaactggttatgaattgaaattcagtgctaatgtaaatgaagctggaatgctattcagggtggaatttgtcacagtagcaggaatttggatgctaaactttataatttgctttctaaagaagagaatgtccatattcttataatcttcatactagaagttcaaatttatatatagtttataatatatggatggctacaatcagaaacccttagaagcttaggcaagatcagaaaaaggccaaaatatgagactgaaaataatgagaattaaaacacagtagatgaaggtagtaatctggagaagttccatatttaagacatcttttcttcttccggaggaaatccaaatccaggcaagaaataaaatgtaaataagaaaagcagtaacaattaattgtatccatttaccatctctagaaagggtaggacatgtttatggaaccacagtattttaaaactgaggctgggaagagaggaaccaaaaataaagattcataagactctctaagaaaaggtactatatctaagtcacctggggtaaactctcattgaatgaggatggtttggcaagtttttcttatagcctttaagcaacttttaggatttcataaaagaatagggaaaatacccatatataatcagttgactttaagtaagagattattctctatatactcagtgggcccaattcaatctactcaagggctttaagagcaaatctgaggtcttctagaaggagaaaaaaaattcttcttgcagactgtagctccagcctttgtctgagactttaggcctgcctttcctgacagcctgccctatggattctggacttgtctaaccagcttccacagtcacttaagctagtttctcgatataaatcccttagtgtatctttcctattggttctgtctttcctggttgaacccttactgacatcctctcacacaccctttctcaggcaactaacagagaacatacgttgtcgaaaagaaaggctcaataaagaaagaggaagacaaggatcaagcaaacagagaattcaatttaaaatagagataaagggaatcccagaatgatggtgactgaacatttccaggataacagctgtggaccaggttggataggatgtctaacatctctcagaaaagcagaaaaggatacagtagttgccccttatccacagtttcactttccgtggtttcagtacccgggatcaattgaaaatattaaatgaaagatttcagaaataaagttttaatcaagcttctttctgagtagtgtaatgaaatctcagccatcccttccaggactcaaatcatcccaatgtccagcgcatcctgcccattaatcacttagcagccatctcagttttcagaatgactgtcatgacatcacagagcttgtgttcaagtcacccttattttacataatgaaggccccaaagcacaagagtggtgatctggatctaccataagaatgcttcctttaagagaaaaggtaaaagttctcaataaagaaaggaaaagaaaaatgtatgctgaggttgctaagatttatggtaagaatgaatcttctatccatgaaattgcaaagagggaaaaagaaatttgagttagttttgcaaaccccagagtgacagccaatgtgtgatatgtgctgagaaagaggctacattcacaaactttttactactatataatgtaacaattgttttatttaattattattgttgtcaatctcattgtgcctactttataaattaaagtttatcataggtacataagtataggaaaaaacatagagtatagttcattccttcacaacacagatttgaactgcgtggtccatttacacacgaatatttttcagtagtaaatcatacagaactacacaatccaaggttgattcaatctacaggttcagaacctctgatacagaagaactagagataccgggaaacttcagatacagaggaaccaatggctatggagggcagagtataatattcagattatttacagcagctctaacccttgtggttcaagggtcaactggaaacaggattcaatactatccaaagtttcaggcatccactgagggtcttggaatgtaccccctcagataataggggactacttgctatacacatagggtgaaaatcagtaatacatatcagatgaacagattagtacctgaggggaggacaaaaggcaacctattttaaaacaatacccacaggagttctgagtgaccaagaccaaaatgtacacattgccttgtctggccgtt

SEQ ID NO: 35512 - DNA, 1257 bp, Bovine  19866880643520
cctaatatattgtttaatgcttaaaacagtcctgctcacaagcatttctgtccaccttttcagataaaggaactgaaactaaaagagtccaagaccccatgactacacagtgggagagctggcatctgagtcattctttcttgtaatggctcctttgaccatcattttcccactctcctgggcaccacacatccacccttgtgacactatcttcccctaagatatggcaagccccccagtgacagagttttttttttttcttttccagtgacagcttttgttgttgttgtttgcagctgtagcgcctctgtgacctgggtcatcaatttaacagttacataaataggattaattgtctgtgtaaaagaccatgtctgggaattatgtctgcagcaccagtcttagacccgttagcccttactctaaccacgtgctcttgtccctcaccactcattcaaagctggctaagaaaagctgtgtacttcactgaggtctactcattcagttcaggtaactacagccatccacatgcaggtctgagttgttgctctctgccaataaggacgtttatagtcatacttaccttttctattagcctggattttacgggtgaggatggggtcctctaacatcactgcttgtactcttcatacaatcagtaggagacctgctttgcgttgtcttccctgtgggggaaatgacctccgttgacttaacccatactacttttgttttcttaaaaactttttcttattacacttataatgcatgtttcatgtaatctcctgcaaattcaacagatttattttttgtactgaactgaatgatttaaaagttcatatggaaaaacaaatgcaagaattctcaagaatgtaagagggagaaagaataatgaggtgctacagtagtatgaggtactggaatttactttaaagctaatgtaataaaaaaaaatgctctttgcacaagaaaaagcaaacatagcagggaacaaaatcaaattgagaaacatatataagtaaatgtagaacgttactgtatgataaggagggtgtttcttatgtcatgggaattagaatttatttaataaataatgttggcagtatttggctatcaaagcaaaaaaatagtttgaatgttatgatatatttaaacaatttggttttagatgaagaaagtaagaacactatacatttatatgtttacattttgcttgttataatacatattaccttatgtatataccttatataatgt

SEQ ID NO: 35513 - DNA, 1388 bp, Bovine  19866880679705
atgggaagctttcaggaagtcacaagatgggagagaatttacaaaataagatctatgtgggaaggttaagagaactgtagatgctccgtctggaggatataggaagacagagtgaaacatcaaagctgtcaacatgtatataaaaggatatcagtgcaacatgttattgccattgactaaaaccaggaggaatggagttaaatggcagaagaaaaattctggagaaaagaaggcctcacttccaccccaccttcaacccatcttaaatcagtgctgccaaattctcatgtaaagaaatgagaagaatctagccattattcacattcaataaatcctgaaacagttcaagtctagccatgacaatgtaaatagattagccaatccaggaacttgttctaagtgcccagcatccatctctatgtttggttagctgctcaggtgaaagttatgttgaaaggatactctggattttgaaggggttgcgggggacaggatttttcagctctgttatcacattaactagtctggggctactgacagtgcatgcttctgtatagaggcctctggaaaagacaaaggtctctggccaagttgctgagaggactgagctttggttctgatacacaattaaatggaagatcctaccaagaagtgcagaaaatctattaagttcccttccagctctactgtccagaaaaagaggcagttgtttggagaagagcctctatttgttttattttattctcttctgttagagcagttatgaactactgtctaagtacaaagcctataattgacagcactttgaattatacaagttgccctcttcctatattttattttagtggattcttacagctttttgagaaagacattataatcctcattttaatgactcagagagtttcataacagaacattattagtaagagcagatccaaagaggatcagagaatagaagtcttgaaaggccatatcaaacatgagagcaaagaaatccaggggatgtgaagagagagaagtgacagatttatgagaaaggcagcagtgactgagctgttgaaataaatgtgattttattatctaatttaatctaactttgtattctcaccaccaaatcagatctttatcaagatattagcagagtcatcctgttccttgagattgctgcaaagtcatttcaaaaccatcctcttcaaatggaaagttcaatgtcttctccaacatttctactaatccctgcagttgcaaattcacttgcatgctcctgatgcgtccttaattttctactacatatcttaatgctgcttatttattgagttgcccttaggacctatttttcaactcttgattccatgttccctcaccccaaactaccattcatagaa

SEQ ID NO: 35514 - DNA, 1414 bp, Bovine  19866880693747
tccatgagacataagaatgaaatagtattaatgttttgaatttctaagttttatcctattatctttccccttatctccaggagttggtgatggacagggaggcctggcatactgcagtccatggggttgcaaagagtctgacatgactgagcaactgaactgaattgagctatctccgattttatactaaaactttcaaaaactatagctttggacatgatacaaatgagcttatttacaaaacagaaaaagaaataaaaatagggggaaaaaagaaaagaaaaaaataaaagatggaaaggcttcaaccccagggatgcaagcgatcatggaaacatttccattcaccatgattccaaacttttcccatacagaactttgtttcttcggctgccatgttaagtttgaacagcttttccatttcttgaggtctgttcatttagatagtaattcaatactgttgtagacatctactctagcgttggggatgtggggaatattatttttgaaaagggtttaggaatatatggttcactttaaaagagcagaaattctgtcttatcaatttatttacactaagggaaagcatgttggttgcttacataccttggtcttgttaggatctttgctttatatttgttcacttttacaattttgacttgaagtgtcacgaaagaactattatcttatgccctccaaatcttaatcagcctttgaaatgtacacctctcagagctgttagtaaacacagatttttgcttgtttgcaaaaacaagaaagaaatatacttttgaagaactgaaaaagaaaacctcaacagcaaggagcagaagtaacaacaaaagagcaaaacccaaaggccagtgacctggactgatggagacaatcaggtaaggacgtaagtcaaggttaagactgcagtgatctggactgatggagacaatcaggtaaggacgtaagtcaaggttaagactgcagtgatctggactgatggagacaatcaggtaaggacgtaagtcaaggttaagactgcagtgatctggactgatggagacaatcaggtaaggacgtaagtcaaggttaagactgcagtgatctggactgatggagacaatcaggtaaggacgtaagtcaaggttaagactgcagtgatctggactgatggagacaatcaggtaaggacgtaagtcaaggttaagactgcagtgatctggactgatggagacaatcaggtaaggacgtaagtcaaggttaagactgtacgaagttactgaacttgaaaaattatagaagctagtgttctggagcaaggaaaagactagagaaagaggtcatgacttctgagagagtcaaagaaatgactgaggtgactctgagacacactaaaaataaatgctcataaagcatatatact

SEQ ID NO: 35515 - DNA, 2918 bp, Bovine  19866880764199
aaaagtaagaaagggagagagggcaagagcaagaatgcaacttgtaaagcaaaattttccatgaatgctcacaagttccacatgagtgtcagaaccaactagatgccctcccaccccactggttccttctcataattctacctgtctattaaaaaaccaagattaagtagcccttcatagaagttaagccctttttctctcttcttgttcaccttttccacctgaagtgagataagttgagatcttgaagaattagaggaactcgcaaaccctctgctgacgctaactggaaccacacaactgagccattcatttagctttaatgctacaaaagctggaacgcctggcaaatcaattctgaagctaaagtctaaacagaactcccagttaagagacaggctctaagaatctgtttgttctgttcaacttgtttgacttcatgacaaatttgtttaaaacattcctaaaatgaatgagttgaggtttctgcctcagtgtggtcactgagcagaaaagaatgtctcagaaatgtccctcaagccttatcacgctaggtgtctctgaaggatatcacaaccttctgctacagacagctgctgccttggcctcagggctggactgggcgtacaattcaagttgtgccttttgtgagtctgtataaagtccaccttggaaaccttccatgcctttgtttcttcatctttaaaatggatgcagtaactattgctgtgtttaccctcccgagctgatgtgaagatgaaccatgagaccacacacatgaaagaatcttgtaaaccatataatgctttatatcaagtcacttgtcccaacacaaagataccagacatgaaaaatggggaaagaaataggatcttcaagatctgattccatgaatgttggaaggtacttgttcaggaaaggtgtgtatggttgtggatgtatggagtgtgagttgcagtaaaacatccaaatcaaagaacactaagctatggagagaaggcctgagagcctgaacagtagggtaagaattgaggtacagattttggagtcatcaacatgggagaagcaggtgaatccatgactttggaaaacacacctttgaaaatttcacctcccttttcatttttgtagccatataattctcataccaatcccagctgtctttcgttggggttatcaaaatgcacaactttattaagaaaaaaagattgctttcattgctgcaaaatgttaaatggttcttttgagtccctattctcttactgtatacattatccattcaaaatatcatgaagatcaggggcttttcatggccatataaactacacatgtggtctcttctttcatgtaacctaaactatttcctaagttactgttttgagtgcataaatatacctaccgtataatttaaagtaaacagtgagattttaaaattgtcaatatatacggcaatatttgaaaatcacaatctttcatattcttgaataaagagatttacttaagtgttttttatgacctgagaatccctttatttggcccaaaacagcactattgcaaagtcaagtttttttttttaagacatttatgttgtttgaaatgtagctgggactgaactccaggacttgtcagtctgtgtcagttgcctttcccctgatgctaaaaccattaacaatttcttccacctttgacagttctcacataccaattcattgctggttttcttttttaaaatttcgtaccatttacattagaactcttgagacctttggagttagttaaaagtatccctgcttgaaataggttagattctactgagactatgaaagtcacacattagttttctgaagtacattattaaactgcaatgttgcttaccttaataattagaatttaactgagagtcaatttactttttatttaaattaaaggaatgagtagatgctaacagtttacaatttaaaaacggtataaacggggaaaagcccttattgtaccattttaatttaaattttattgattttgctgattatatgtgttaaataagtattcatcaatccctttgcctagtttcactaaattttccttttctataagaagatacaacattaattagtcatatagcattttaaatctctttctaaatatgtgtatcatttgtgataaggttaacagcacaaacttcatgtaaaacatacttagagcaattatgtttgtaggtaagacatactttaaactgtacagtaactaaagatgtacataatacatgaaaagaaaaaccagaaacactgtacattaaaaaaggagagagatactagaaatcatttttcattctctttatcattaatgacgtcatggtacagatgagggatttggggtttttaaatgaccagcccaagacacacagagacacctgtgtatgtatgtacacacacacatatgtgtccttagagcagttccattttgtttactgctatgtcctcaatgtctgctacagtctcagcgtaaagtcagggacaaaatagtaaatatttgttgaaaatgcaatttacttataaataaaactcaaatctttccattgttctttccaatacacaaatggaaacatttaacatgtcattcttgcaaatttattgggagaatagaattgataaactgtgtgaaagaaacttgaaaacacgtaagtatatacaaatctaaagcagcattattattgcagtttaaatttataaaatctcccacttttcttactgtaggtccataaattgaagaaaagcaaaatttacaggaatgataattttaaagacaactattttaatttcttgaatgatctggctaggaaaaagcttttgggtctaaatggtgaagtattcatttttaatggtagttctataaaggaaaagaattccttattacataca

SEQ ID NO: 35516 - DNA, 1706 bp, Bovine  19866880855848
aagtgctgccctaataaataagactgcgctctgcctggaaggctggggaataaaaagccactcctacctgttaaaagacacttatttcttggaaggaaagttattaccaacctagatagcatattgaaaagcagagacattactttgccaacaaaggtccatctagtcaaggctatggtttttccagtggtcatgtatggatgtgagagttggactgtgaagaaagctgagtgctgaagaattgatgcttttgaactgtggtgttggagaagactcttgagagtcctttggactggaaggtgatccaaccagtccatcctaaaggagaccagtcctgggtgtacattggaaggaccgatgctgaggctgaaactccaatactttggccacttaatgcgaagagttcattcattggaaaagaccctgatgctgggagggattgggggcaggaggagaaggggacaacagaggatgagatggcttgatggcatcactgactcgatggacatgagtttgagtgaactctgggagttggtgatggacagaggcctggcgtgctgcgattcatggggttgcagagagttggacatgactgagcgactgaactgaactgaattgaacctgttataagtttgggaaaaggaattttgtctttttgtttttaaactttttatttcatattggagtatattcagttaacaatgttatagtttcagatggacagcacagggactcagccatacatatatatgtattcattctcctgtaaactctccttctcatccaggctgccacataacattgagcagagttccctgtgttatacagtgggagattttcatactatgtgaagtaagtcagacagagagggagaaattttgtatgatatcccttatatgggaacactaaagacaaatgatacaaatgaacttatttacaaaacagaaagagactcacagacttaaagaataaacttatggctgccagggggaaaggccaggggaaaggaatagttagggagcttgggatcaacttgtatacaccactatatttaaaatggataaccaacaagggataaggaatttttgaaatctggtctgcagaaagccaactgaatattaagaatggttatctgaacttgatcaccgttatggtacacaccatcttagatattgttcttgactgcagatctacgattcaggttttatgtttcttctgtcctagagtcggatgtttcttttgctgtttggatgagatttacgactttgatggcaaaactcaggctctttcagttgtttcctataatcctggtgcccatgacagagctcttctcacagtagctatcactaaatgagtcaagatagcaaaacgaatgacagtgatctcaatttagtgaattattcttttgatcaaaaatcttgccaagttcctgactgtcagaaaccacttgacctgccaggcagttagaggaggaacatgtggaagtgtcatcattcagctggaatttgaggtgaaagctcaagagaaactgctttagtgaaaaatctggcaatggagctccatccaagtacattagaaggcatcaaaaggaaaatgttttctcttgtgatttttccttttactattaactgaacacttgtaaaactgatgatgatgaatcttaccagtcacctagaattctctgtaccacgggagaaaacaaaatt

SEQ ID NO: 35517 - DNA, 1736 bp, Bovine  19866880911416
cccccagccccacatccagtgatattcagtgaagcatgaatgcatctgaatgcaaatgaggtccagcacaaacaatatttgcaaatcagcacatatcttatatcaaagtgtcaaaccagaagtatttgctttctaaccagaagtatttgctcaccactaccattcttttcctcatttctcctttgcaaaccataaggaatagagaaaatggatattatatctttaaaagtattccaagtaattcagattatgtttttgttgctcttcctgctcttacctcccacccccttacctggaggcactatcctacctcatgtcaaaattcaaagtttgagcaatggtgtgcttaaatgctgatatccttgacagtttccctttcttttctactttaaaattagcagaaaacaaaaaccctaccaaagaacaaatcgaaggaaatggttttctacattagggatcccaagaccacagaatcaatactactgcttaattatatcaaaatgtcataccacagtttataacagaggaaacaaaatgtaaggaaaactttatgactttatgtagcacttcaaaacaaacctattgtaaagtgtggttttaagatataaattgatttgtacatttcagaagggaaaaaagacactccctgacctctcaagtacctaactagaaatcttggcaccatctataatgatttggccccaatcctatctgtaataggaaaactagaggcaccagaagctgggtctgaaactaggggataattagttccatccattagtgaacattttatgagttcagtaaatgaggagtgtctggttgagtgcttagaaggaaaaggggaatttggcaccataaaatcataatatactatttattaggaactttcccaggaatttaaaggtcatctgcctcccagtcccaaagaaatacaaccctgcagaaacctccctggccatttacaacctacctggctaagccttccctcggggcctgaaggactgacctatctacagctcaggcagcagactatcctgaggcctgctctaaatcttcatatccagcctcttctgtcctacacgggctacgaggctaacatactacccatgcatgtgcccaagctgcagttgtcagactgagtccctgttccaggaggtggtatttgggtaggtaattataaagtgaataatgaggttcttcacataaccatgagaaagtcacctccatgagaattcagaaatctaaagtccagtgtgatgagatatgatcacaaatggggtgggattcagctattatgtggttctgacaaatcttttcaataacaccttttctatcaacttggaaatagttctctaagatgcccaattctgatgtcagctagtcttcagggaatgcaagcaatatcacagtgcaccaaggaccacctagggggcaaactatcttgaagatccttatttatttattcatttattcctttgacattgcctttccttcctttccatgtatttatccatctgtttattcattcatctatttattcatctattcatttgtcattgcctttccttcctctccagctttatatcagaacaggtttgaaccacagatgaacaaaatgaagaagtattttccagattaacaaaattctctccccatgctgctgctgctgctaagtcgcttcagtcgtgtccaactctgtgcgaccccatagacggcagcccaccaggcttccctgt

SEQ ID NO: 35518 - DNA, 1402 bp, Bovine  19866880924119
acatctaaatcatcatagtatataaatgattataaaattccatcaaagtgattttcttttggtcttattgatagtcaactacaaagcttattatacaatcagccagtattttctcacaatagttaatttattaataaagtatttcaacatttgatagatattacataagcacctcctatgttccagactgtgctaggggttggccagtcattgggaaacaagaattttagggtgaaaaattcttgattttctcattttggattttggacatggggccctctttatcttctctactcagaagagagattcttattaatagatgccaagagtttctttagctgtaacattgggaggcaattcctttttcagtctccccagtcctgcaaactcatgataggccgtctaccagcaggcactgctagaaatgacctatgaattatgataagtctggcttagcaaatcaaacagatatcttaaatcaacaagtctttggctgattcccagctataacaggactcgttccaaatcatcatctgtagtcactagtgaaaaatcaatgagcagctcactgggatatgtaatgaggaaaaagacatgaattgaaaggaaaacaaacaataaaaacattaaatatttagtgtgaaagaaaatcaactgcctacagtgttatcagcaatttatagtcttaaatttatgtaccatcttgttatttaaattagtgccttcccctaaaaaactaccataacaagatgcacttgagtctagtaaattttggcttgcagacataaggaagcaggcttagtttgtgctgcagcttttatggttttgccagcatggggcatgggcttttccaggggtaaacatgttctttctttcattatttgtgaaagagtaacatagaactagctaacagattattttttttttttctactgaacaactgtgaaacagttatattttgctcaaacatcaacctttggggaacttggacttgaagcagtaatttgtaactggctgcaactcagtatcatctgtagagggtttaaaaacttcaggtgcctgggctgtgtccctggatattctgaaaagttcacaagtgagtgattctgttggttcattgggattggggagccccaggcagcagcatgaacccagttggagggagctatgtcaggggtccctgaggaccctgagagttgggtaaaggctgaactagacatatccagataaagagaacaaaaatggagaactcagttcatgctggaaatgaagagaaaggatacaaatgcctttaataaatgatgcaaacaaaatgttaatttaatatgttttaaaaaaagatctagactaatgctgtccaatagaaacatatgtgaaggatgtatgccattcaaaatttaaa

SEQ ID NO: 35519 - DNA, 1317 bp, Bovine  19866880979111
atttccgtttgaggtgatgaaaaggtttggaaatagataatgatattggttggacagcaatgtgaatgtattcaatgctgctgaatcgtacacttaaaaatcactagtaaattttgttatgtatattttaccacaattttaaaatatttttttaaaaagagaagctgtggacgtcccaggtagcacggtggagaagaatccacttgccaattcaggggacacaggttcgatccctggtccaggaagattccacatgctgaggagcagctaagcccgtgcaccacagctactgagcctgtgctctagagcccaggagtcgcaactactgaagcctagagcctgtgtgccacaagagaagcctccgcaatgagaagccctcaacaaagagtagccccactctcctcaactagagaaagcccatgcaaagcgacaaagacccagtgcagccataaataaatgaataaataaataaagttattttaaaaaagagagaagctgcaaaggctgcttgtaggatttaagagtgagagtaaaatgcaattcgtaagggaccctccctctcttcttcagggatgctgggccccacggcctgtactatcttcctgagatgctgcaagaccacaactggaactaccagcccagatcccagcttcccctgtgactctcgccgtcagtcctctgggatctgagtagctttgttgttgattggaactagctccaccaccagtcctgccactagaacacacacagggcccagtgctggtttctgcagctttgagtttggtagaatgccagcaaacacagcttttactgtcataattggtctaaatttaaacgctcccacttgtttttgtttctcattggtatgtgtatatgtggacacagcctaggtttgtgggtataaagagttttgtcaacatggagagagtgaatcagagttttctgttgtctaaaccagcccttattttctatcttgatttccctatgcattgataatgccctccagcctttgagtcaaggagaggttggaatccaaccacttaattggaggttttccagttcatagcagttaacttttctgcaacttgtctccttaatttagaacaacagtcaaagaataataagcgctctacctcacattagttagggcctatttctagaactctgtgtggaatattcaggacacatttattgtctttgaagagtttttagtaaaattgtgaagggagaaatcaaagctgtcttgaattttatttgtgattttccatcaaattgctaaatggggttatttaatatttttcagtgaatgcagcatca

SEQ ID NO: 35520 - DNA, 1991 bp, Bovine  19866880999636
attaaatgttggctctcttagaatcatcggtttttcatatagatttttcaacattttatttaatgttggaaggatagttaaaagaggagtgattctcagacttaagtttttgaatactcatttgcaaattcactgctaagaacaatctattactgcatttgaggtggtcagacgatcgctgtaaaaaatgcactagattttgtgttacctgtttatatattcatttgtgtgggggataccggctagctataagcaatgcattacacagttcagtcttaacattttatatagttgtttttttatttcattaacaaactgttgtgctgttctttggaaccactttctatgtttaattccggtctatcaagtgataaaatttgttgatttttgaacgtttacagttaatttctctaggattttgcttatgtttggaaatgtgaaatctgagtcattcctgaaagtttttgcattattgaagtatatacatctgttcatgtttttatcacaacttgattttatgtaatagagaaaaatttttaacaacttattttaaaaagcattaatctaattctggtttttttgttgttttgttttgctttaggaaaggggactaccacaggtatctggctgaatttgccacagggaatgacaggaaggaggctgcggagaacagcctagtggcttataaagctgctagtgatattgcaatgacagaacttccaccaacacatcccattcgcttaggtcttgctctcaatttttctgtattctactatgatattcttaattcccctgactgtgcctgcaggttggcaaaagcagcttttgatgatgtaattgcagaactggacatgctgagtgaagaaagctataaggactctacatttatcatgcagttactacgtgataatctgacactatgtacttcagaataaggaagcactgcaggatgtggaagatgaaaatctgtgagacataaaagtcaacaagagaaaccatctctgaccaccctagaccttccccatcctacccctcttggaattcccccattgtcactgagaaccaccaaatctgacttttacatttggtcttagaatttaggttcctgccctgttggttttctttctttctttctttctttcttttttttttttttaacagttttcaaaagtgccgggagccagcatgggagtccccacccatgacaaggtcatgtgggagagctctgatgggcaaggcgagtcagagttcgaggcccccgcccccctggacctgcctgagtgtctaccccaaaaccagaatctgtctgttttattatttcatgaccttcaccaactcctctgacatttacgggggctatccccgaccacctttctctgtaagaaaatcaacttagagctctagttaataagtctccagggtataatgggtgtgttccaattcaaatcccttagaaaactttctaacctgcctgaacaggtttccggactcttacagctacgcatgtgattgttcgcagcctcccaaccatgagaagcacaggaagttcaagatatcctaacaatgcagagcctcttggggagttagaaacggttataatagaactaatagaggatttctttgttgaaccaatgcctgctgccaagtttccatatctcctacccactcactgtaccccgggagtgtattgattaatatagttagcatatagaaatataagtagtaactttaatgttaataaccttagacctttgagctaataaattctttccttgattatcccccactgcaccttttgccctataggaatgcaactctatctagtgtgctcagggagtggcgctaaactctatgaaaaatcacctgaggagaaaataagtttttctggttaattaacccttatcagaagaagaatgttagcaggtctcctgaccagaagatgatgtaaatcacctaaagcctttgtttatgataagtttgtagaaagaaag

SEQ ID NO: 35521 - DNA, 1399 bp, Bovine  19866881000868
aggtggacacgactgagtgactaagcacaagtacagcacatagtcatacaactgtggtaagtgtcagagccaggatttgaatccaagtctgcctgacattacaactcatgtttttagaaactgaattatagtttcaggatcgtttgggtcctagaaaaactgaagcatcccgagtaactggggtatattttatcactgctcttgcttcagatgggtgacctccagctaattgttaaattctgtttagttctcctaaaacaggtgctggtggaatttcctttcaaatcactagccctctgccatgttcagaggacccagctcacagagaattgtccacatggagtaggttggttgcaaaccagtcaggatttcaaggcacaaacagcttgatagcctgtctgattgatgaacagtgatgatgtcaaaggcagattctccctaaagccaacaaaagtaaagcccccataactctttggtgcggatgacatactccattcttaccaagagtttaggcagcctataagtgctctcaccacccgtgtgcctcttggcatggggactcagtggtctatagcttctgaatttgttcttctgtaaagtcagctcagatcttattccccccttattttacccaccaactcatttcttactttcccataatccattcaaccgtgcagtgcagtacagtgcatgcatgctcagtcatgtccgaatctttgtgaccccatggactggagcccaccaggttcctctgttcatggaattctccaggcaagaaaagtggggtgggttgccattccctactccagggaatcttcccaacccaggggttgaacctgcatcttttccatctcctgcattgccaggcaggttctttaccacagtcgccacctgggaagccacagacttaggaactaaatgatttatttgttgttgcatgatgatgatgatgttgatgaatttagttgcttagtcatgtccaagtctttgcaacccaatggactgtagcccaccaggctcctctgtccatggaattctccaggcaaaaatactgaagtgagcagccttttcacttctgcaggggatcttcccagcccagggatcaaactctgatctcctgtattttaggcagattctttatcaactgagccactagggaagccccttattgtgcatgccactgatattttgtcgttgttactcaacataacattataaatagataatagatacacccgcttcataatttctgaacactccatttgtgattgcttttagttgagtcatatggacaagaggggcattcagaaagacggccaggtgaacccttgctcagattgtgaataattgtggtgctcagatggcaggtataatgagttcagagatggcttctaattga

SEQ ID NO: 35522 - DNA, 853 bp, Bovine  19866881045162
attgtgttaatagagcatggtatttagtaagagaaaagcgatagcataaagcatttgcaggcaatatacacagatgtcagacaaatggtctttggggtcagacaaccatttatcagatcccatttccagcttatcatagcaactcttaataagtgattcctaaaactatcaaaagtagagtaaaccttttaacttgagctgtaaatattcattctttacaaaactgttggtgtagggtcaagccttttcctgtgctagtggagcggaccttcccatcagaatgccctcatatggccatagctatggtttgtggcttgtctccattctcttttgctaggtgtgtgctcctattgtttataataatatttggaatatcatcctcctgcgtttaggtcccctgactggagtttttcattttctcatttaaacaaacccatccttaattatctaagatttctagatgcttctttaaaaaaaaaaaaggagtataattgctttataatgttgtgttagtttctgttgttcaacaacatgaatcaactatatgtatacatatatcccctcccacctttctttctttttaatggagcaattacctaaagacaactctcaatcaattcaaatcttcctagaatttttacattttttccttttacagttttcttgctctcacttatttcaagagaaatattttaagagactcatctgcagcaagtttctcaagcattcgagttgattttcgtataaatagtaactcttttctcactcatatttcatcagcttatgtaatattgtattaaattatataattaaaatgaccaatagagaggcatcaacaggatgaggacaaaca

SEQ ID NO: 35523 - DNA, 1607 bp, Bovine  19866881061754
ttgtggagtttcagtgccatatgaaagaagaatatctataattatctgaaagaatataaaatatttctccttttcaaatatacagatggatgagaccaaattttctttatgttctttatccaaataacagatgtcaaggggttgaatgtagaaatgtgtaatatgcaaaaaaatatgcaaaatatgtcatttttctcactattttttgtttttaacaatatagttaatttttcctaaaaatgttatactaatacataatttggtattgtttaggcaccaagtcatgtctgactcttttgtgaccccatgaactgtagcctctccggctctgtccacaggatttcccaggcaagaatactggagtggattgccatttccttctccaactaatacataataggcttgttatttttaaatagagtaataaagaaatgctttagaatttattttagctttaacttctaacacagtaaatgtccataagtataatcacatttttaaaaaatctctttgtagtcctcaataacatttaagagttgaaagaggtcttaaaaccagtttgagaaccactgcactaagtactaagtcaaaggagaatcagtgactctattctctattctaagaaaatcaggaagagaagaagaggagagttaccagcatagtcaagaacaaagaaccattcatttttggtttatgtcctctaattgaataaattgtgaaagagctataccaatttttagtggcccaaagggtaacaaacactcagaggtcaagtcattctaagaagagggtaggtgggagtgttctgcagcactgtgaggttagacctccttccatttggactaatccatcacctttgacaggaaccgagaaaaaagacagtgatttctggggaaagaagtaaagtaatccaaaccaggatgacaaaggcaggaaacacaggtaggcaaactagagagaaaagagagctgtcccaaagaatgagaagaaaagtgaaaggaagacaaaacactagtatttggagggtaccttttaagggtagaacacaaactccacccttcatgtgtatcatcttatttaatctaaagggcaagaccaaaaggccaatattgttattacatatgtagcaccaaacattcttctttttgagacaccttactcataaactcttctcggattctctgaaaacacaggagggacactgtgctccctgaactcctctgaactcctagcccaggactggggattcaatggaatcatgtttgtattcctgtgcttattcatgtttgtcttcttaaatgcatagctgcttatgaaaaggcgtttatatttttcctttgatagtccagatatatgttaggcagcatcattacactttcaaattgtagacctccttgtggaggataaacacagagaatgctaaatttgcccaagccatagggagtaaaacaacagaatgtacaaaatgcagaacacaatgagttatgtcacaagggaatagcataaatatgaacacctcttatataggatcatctctgcagcataaagactctcagcagccacttttggaaattgatgggttggtgcaaatgcggagcatttctgag

SEQ ID NO: 35524 - DNA, 1928 bp, Bovine  19866881101631
aaaaaaacccaagtaagcactaaaaacaaaacaaaacttacttgtcgaataaatgaattaataaagtgtattcaaacttaggacagtcattatctgacccatttcattgccttttagtcagattagtctcatatgaaagtatttttgatttgtaacatatagttcggaagggagggataaaggtatcttcatttctgatctgaaggaagtgatgtgatgcagagttagcatattatggcttactgtttggggtagaaacttcatggggtgaaatcccacattgacaaaaccccagcaatgattaatgtggctcacctgtaactcataaccagcaatttctcatagttctcatgagcaactctgctgactctcagaaattatcctagtaaacaataaatcacaaaagtaattaaaatgcccccttagagttcagtagacttcttatattcaattccacacccagttatctgagagacattattgattcagatttaggaccagaaaataatacaaagtcatttacataaaatattgttaagatttgttatttgccatttttctctgcctttgtttggttcctatattcaagagtacgcccttgacatagaatgacttagatgagtgttgggtatagaatggccaagaaataatctactccttgaaggtataaatctgtcttcatagaactggaaaataaaacttgatctgaatatcagacttataattgagcccaatgtcaccttagccacaaataagacattggaaaggaagcacattaacagagttgatgtgtttcataatgttggctgcaacaaagtctgtgaggccaggtagttcaccagaattccaaaagaggaggaatgccttttaagttccttcccccttctccctttgcctctctttttttccctgtccagttttctccacacaagcattgcaaaattccaggagttatgcatctccccttccatcatcaggccagaccaactgcctttttaggatacacacttgccttgaaaagtcttcttttcctttgctgtgggggattgtgagggtttttctttttttttttttctgtgtctatttcacatatgtcctctaagatgcatcctttcttttgtgccaggaccaagaattgcttgagagtagggcagggaatgagaagaagaaagccaaaggaagtgaccattacaaggacactggactcctgaatgttgtatgagaggggaggctttcttctggaaacctgggagttaggactcttattggaacctcactggttgaagcccttgtttattgcacctctcattgttctcagtttttcaagatgtcaatatgcctggaattatagtacattctcctctgccccagaggaagttactgggcactgaactgttgatcaattgccttttctttctcccatccatattcatcctccccacccttctacacaggagtgaggggaaaattagggaaaatcttttatcatatcagattctcattataaaaattgtgaaaggatcaactgaataataaatgaaacacgactctttgagataacaaacaaaagtgctatatctataaaaagtaccctgtcatgatttcccttataaaacactccatgctgtcataaaacaccccaagactttagtaaatgtgtttattatttctgcacacctccccaggaatatttttagctgcttcaaacctcctcttcttatcttttcttcttccttcttctttctagcttgcttattttaatttcctcctttagaagtcttgttataagattttttccccagtttgcagtttaacaactaggtcaatcagataatgtaagggttagaaaagactttagaggtcaccaaatgcagagaagagggaaagcaatagatgaatcttggaaggcaaaacttattgtgcagtta

SEQ ID NO: 35525 - DNA, 2397 bp, Bovine  19866881174492
gagaagaccctaatgctgggaaataccctagtgcaagaggagaagggagcgaccgagaatgaatggttggatggcattactaactcaatggacaagagtctgagccaactccaggagatcgtgaaggacagggaagctgcagtccatggggtggaaaagagtcagacatgacttagcgatggaacaacaacccttttgtaagagacatacatgtataagagaaatctgcatttttttaagggtataccaggaagagggggatgaccaaatctccagaaactcttataagtggagaaggtacccacaaatctgcaaaccaaacccttgttttctgtacttttctagtaaccttgcataagtggctccccattgtaccacatgtcaccccctaacatctttcttttgtctttagctgatgacagtatgtaaggtgatggctcaggccatttaagggagttacttttcctgggtatctcccatgtatgcaggaggtattcatatcattaaacttctattcttctcctattgatctgtttattacagaagcatctcagccaaaaatctagaagggtaggcgaaattattttccctttaccacacaggcaatgggagaatagtggagataagaatggaataattttctttaatggtaaaactggaagactttgaaaacttaatagatatgatttatagaagagaacgatattgcacattttcctgagtctgtcaacagcaaatgggaggtcagaaggtgattgattttgtgtagcatgtgataccttgggttttaggtgcattgagatggaggttgtcaagaaaggtgaccagagacacttggcacatgcattggagccatgggtaggaaaggtggaccatcaatttagaggtgataaaaacaacatctggatgagtcacgttgccaatagtttcagagcatatgaagaaaaataaatctggatgggggcataaaatgatggtgtgaaagttctgacactatcatagtgtcatagtgttttacagaagaagatgatgttttgagtccttcaaactccctatgtaggcaactgccatctctgctcataaggtagagagtggacttgctaagactccatctgcattgcagtggagccctgcagtatgataagtcccaagaaatctaacatttggcagaaaaaaatggcccatcccagtgtctatttggaggttttgttttaatcaagcatttcatttcggattcctatctggtagccttgaaggcaagcagtcacccttctgaactctgtttcctgacttccatcagggtaggtcacattttcaaggaaagttcttctacctgaccccattaacgttatcctagtaggtctggcatcaataaatcattgttttagtctgctaaaggatacataatgtagtccatttaaattctgaaaggtttagactttggccttagtccctgaaactctattatattaattgtctcactcactctgccctacttgttaccgtgtacacaatggaaagccaatgttgtaattcaaaggaatgtgacattatctctccatcttctcactaagcatccagtgtctctttcccctttccctttcctgctttggaatgcaatttattctaagtaccctgaagagaggcttcaacatttgttgatactaactagttctgatcttctctgtccctctccacatgctcggtggaaaaattccaatcgcaaaatagcaaataaaaacattaccaaatctctcagggaggctaaataaaggatcagatgctcaggcagcaaactaaaataccagaatcctctcaggcatatgtctgactttgacaaccttcctatttctctgattctcctattgaactgacctttgaacaccaagtcaaatttgtgtcttttcatgtaaatcagtatacgtcattatcaccggatgtcccagacttggattaccagaaaacccgaaaaacagtgttcaacactcaactacagtgtaagtgccatgcagacaccctcaggatttaagatcatcaactgtgccgaaataagcatgacaatggcttcattgctgtatttgcatttattgctttggagtactgagttatatgataaaatcatccagcaggtaaatagatgggaactactgaaatggaacaaagggaaaggattatgtatagaaggatgtgactctctttgcaaacacgcaaaaagccgtgtttactgacagaactgaggtgaacatttcacaggttgatgaagatttggagggcatcaggaaacagttcattcatgacaattcaagttaaaattttaaaacccagcaaatagaagaaaagcatcctaacaggaccaaggcatataagtagccaacatgttttcccttaatagaaata

SEQ ID NO: 35526 - DNA, 1112 bp, Bovine  19866881177805
gtgtgtgtgtgtgtgtgtgtatatgtatatatgtatgtgtgtatatatacatatatatcttatataattggactgctttaacaattctgtcctatatcctgtagttaaaataaaacaacgatctgctcagcaggaaggaaaaaaaaaactctgttatgatcaaacttagcttcccattaaattttctccttgtaaacaaatcttggaaagcattttctctgggtagaaattttgcagactacatctctgctaacaaaagaacacgtatttctggacaacatagaacactgtattgatgattagtaatatggcttgccctcaaatcatatttctggggctccattacagaactgtcacagcagattaaaagaaggatgatataaaggggatgaagaatgacagaatcaaacatgtatcaatgtattaattgtacctattaatattttgtgtcataatgtggcagtgtttcaaaattcattttgcaagttgaaaaacaaatgattgcttaggagaacaaagctaaacaatggacaacctttgtgctgagagcagcaaattcattttaccttccagatatcctttaataactaccctttacatttttctaaattgatacaggaactaacaggaaacataaatgtgaagacagaaatcttagcagtaagagccaaaaagctagattgcaatgcttggcagtagttttattgctaaggttaaatatggcaattcttattttatcttgaagacagtaatctggaaaatcaatgacaaatgacataacctctgcaaaaaatcttacacacaagcacacatcctgacacgcagaactatcatgtgtaaaaatgcatgtgtgcatgcacataccataatttctataaatatttcaaagaaatggtgtgatactaagtgatggaagccagagtgagaaagacaaatacaatatcacttacatgtagaatcctaaaaagttgatacaaatgaacttaactccagaacagaaactgacctacagacatagaaaacaaagttttctacagttaccaaagtggagaggaggggaggaataaattaggagtttgggattaacagatgtacactattatatataaaat

SEQ ID NO: 35527 - DNA, 924 bp, Bovine  19866881185021
aatgctatagaattcctgacggctcagtccatggggtcccaaagagtcgacacgactgagcaactaacacttatcagacatatatccccaccctcttgagcctacccgccaccacccctccatcccaccctcaaggttatcacagagcaaaaagctgagctgcctgtgttatatagaaggttcccactagctagctattttacatatggttgtgtatatatgttaatcccactctcccaatttgttccactcctcccttccccacaccgtgtcaacaaaaccattctctatgtctacgtttctattcctgccctgcaagaagatgtggtacaaatacacgatagaatattactcagccataaaaagaaacaaaattggatcatttacagagatgtggatggatatagagtctgtcatacaaagtgaagtaaatcagaaagagtaaaatgagtgttgtgtattaatgcatatgtggaatctagaaaaatagtacagatgaacatatttgaattccatatctaactggtagttttgacatcttccctgcaccaaactatttctccttgtccactgtctctgtatctaaaaatacacaattttctcttcctcttttgttttattttctgttaactctctccttgtagttttctgtatcctacataaaaatctcatgcaattgcccttttcacatactattcaggtggggatcatgctgtttaataatgctaagctatgttttgaggtaaaatcttcttaggaaataacagtcacataatattgatcacagcaaggaaacatcatgcccccaacagtgatggccaagaagctgcacagcaaaggaaaatcttattcaaaacccagaaagcaatagattcataagaaggctgctgctaagtcgcttcagtcgtgtccgactctctgcga

SEQ ID NO: 35528 - DNA, 1612 bp, Bovine  19866881230530
tgctaaaattttggcccaagcccataagggaagtaaaacaacagaatgtacaaaatgcaagaacacaaatgaagttatgtcacaagggaatagcataaatatgaacacctcttatataggatcatcctctgcagcatgaagactctcagcagccacttttggaaattgatggtttggtgcaaatgcggagcatttctgagtgtcctgtattagtgacttagagctactgcatgcacacaccagtgccttacaatcatttaatataaacatagatttatctttcctgtctgaaggttctagaagcctaccacacccacacatgcatctaggatttttttccagtggtaggaacatggataccctggagctgcctgtgttctccatctttatactattgagctggttacctgtgctaaatggcatgccctatggctatggaacaaagtttacctaagtggtcaaggcagagatcaaaccctcatttgagtcctaccttggtagtgaaattgacataactaaaacaagcagccaatataatcaaagaattctatgaaaagtatgttagtgtattaaaatccagcatctttattaaatagctactcacagcagaggccatcatgctgtcaagtaattaaacagggactaacattaggggtgattttcagctaatgtcagaggcattcctctcattaaagcctgcctaatcactacatcatgattgccaaaaaaaaaaaaagtgatattcaaaattgctgaaggcataaaaaatttattttcatcttgcctaattatctgaggtgtgaatatgtctgatttcaggactggggagaacataatctccatgatgattctatgcaacaaatttattttgataactgtgaaggaagttccccaaatctagggaaaaggtgtttaacatctgtattcaaaatgttgggagttcacttatgcaaaatttgcacctaagtcctgagcatatcttgctgctttatcacaaccaagattactcaattttttaatctttcacttcctttcagatccctccgttttcttggttaaagaaatggcttctgcatgtaaatttcttaagctcaatttcactgcacatggcaagcagaatacatatttcagaagcttatatatttccccaaatagcaaacaagttcagtgaacttggcttgctgtttacctctgcataaccttttgtgatgctaaaaaatactggatttccctggtggttcaactgtaaaaaaaaaaaaaaaaaaaaatctgcctgtcagtgcagaagccctgggttctatccttgggtcaggaagatcccctggaggaggaaatagcagcccactccagtattcctggacttccctggtggctcaatcggtaaagcgtctgcctacaatgtgggagacccgggttcaatccttaggttgggaagatctcccggagaaggcaatggtaacccactccagtattcttacctggaaaatcccattgacctagaagcctggtaggctacaggccatggggtcgcaaagagtcggacacgactgagcgacttcccttcctttcccagtatttttgcctaggaaatctcatggacagaggagcctgg

SEQ ID NO: 35529 - DNA, 1720 bp, Bovine  19866881233503
taccatttggtgttaatttgatctaaaggctttcttctccatatttagacattatgttggtatagctggtaatttgcataagagaaataaattaccctcatattaaaaggagttagttgaagtgtcttaaatgcttatgcagcagccacaagtagaacagttagaaacacactgcttatatttcttaattattgatatttatttatgagagtaattttctgcttaccaattgtcattaatccttacagctttatggttcatattctctcttatgcatgtggtattgactttgtttaacaaattatattattcgtacagttttctaaatttgctgcagaaacttggcattctacaaagtcttgaactgaagggaagaattttcctgatgaaacttgcattggcctaacagaaccatgaccaatgtgcatgatcaaagcccccagagagttaacaataacgaggtaaatggggacctgagaggtaccgcttaagggagataagttctgagcagactcagtgaggatcttattgtctgggagcttgcagttccaaggggaaatgaatatttctcttcatttccttgtccccggagccctaatcactggtggaaatagtatactctgtgattttaccaatctttaacaatatttttcagaacaagttcatatgtttaacaagaaatacccctgagcgctgtttaaatgcactcatagttctcttatgaagtcactcagcaaagactcgttatgctctgattagcttattagttcattctggatctgatagagagttttggggcattgtctatcaacttgcaagaaattaggacagcaaatgcctttgaattgtctttgcttatttaagcatgtctctgcagatgttcactattttaatatgtcttttatttggaaagtgcactatttgtttaatcaattagagatgtacagttctgaataaatgaagtttataagtagattaaaatgctaaagagacatactttccccctcaaatgagtgttcaaccctgcatatcaacatatgggtaatcctgaaagtcaaaagatcattttcaggctcccttagttcatggaatgataataaaaaattacacagtatatagtttatgaagggcaacccataatgatagcttcacttgtacttaggttatttacaaatgatcataaattaatttttctgtaagaaaggaaatatgagagctgtagctgctgctttatggatcaaattattgtaaatctgtggactcattagtggtattttcaagaagtgcaatgcaaaactcaactctcactactctttatttccccaacttctgtttactcctgttattttaatatgaataagttagtgagatggaaatgtggtgcaatagaagaaattagacttttgagttagatacagggctgtggccctggatagctccaagggttgccatcctataggctccgtgaagggcattcctgggttgtgcagcatacatcgtgcctcaccatagattaatgttggaaactcgattaaatagtgttgggcaaagttcttggctctttgaaccttcatttccttgactataaaatggagattattttacttaccagatattgttcttttggtcagttacaaaggaatttaccttccagatgtgattcttttgtgaagatgggggttttacaaggatttattcccataacagcacttaacatagt

SEQ ID NO: 35530 - DNA, 1177 bp, Bovine  19866881238693
ccagtaagtagataagatggttctagcctcatactatcccctgtattaagagcacatctaatgtcaaaaaattataatcttgttgctgtgtttaacaaatggctgaatacaatgatcctatatgatgacacaaaaactctccttcaagaggagaatttgacgatgcaccagatgtaaacatttaccttgaatttagtgaaaacagcaaaagtggaacggtgaacagcatgtgctctggagccagcctgtcttggtccatattctggctcaaccactaaggagctttgcaagcttggtcaagttacttaaactttctgtgaattggcttccttatgttgtatatggcagggatcatattagcaacaaaaattctggatgtaaagaaaatgaaagactaaaactctatcaataaataagattgcatatatactagaaagaatggtctttaaaatagacaggaacctagaaaggatgagtaaagaaatttgagggaaaaaaggaggcactctgttgttatattaaacttgaattgactgtcagttcacctcacctttggtttttatatacgttattattcatccatacacatctaatctttgtagtgaccctcaaagggttatcaactcccgtgcaactcttttgctcactgaataatacttcctgtttaaatttccagaaacatatccacatatcgtatcatagtcccagttctatttgtttatatgtctgggcaagaacatctgataaacacatgctgttgtcctcaagccactctgacttcttggtattcgtgagcacactcaagagacttactaagtgaatgaacgcctgcggaatccatactttcacctactgcccttatagtaccagagatagttaccagctcttctcaggactgttaagaagcatgtttacacgaagatagtatggaaaataatttctcattcacagcggtattaaagtgctccaaaagggtcatggtgaagaagcatagtacagctgtggtgaaatttcttaattcatcaagaagtctgttttcccaatacgaaaatctaggcttaatatgtgtcccataggcatataactactacttctgcttaacacactcttcatattattgcaggatggaaaggggggggaataaccctcaaacatcaggaaatcataatgcttttgt

SEQ ID NO: 35531 - DNA, 2083 bp, Bovine  19866881238861
tcaggggatgagtgaagcagaagacttccccagcatgtccaatgtgggatggcgtttttttttttttttttttgtctttgactggaggttgctccagtactaccttaagaaattgctacctagcctcctgatagacacggcttcagctgtgtttcccgagccaagaaaattgaagacatttctatgtaccaccttggttttttattcaaaaagtgtagtgttaatttcagtgtaccatttcacacaaaaattattcatagctttagaatttttgagtttagcagcactttggagctgcaagcacattataaagactttattgaaatgttctcaggtaaacaaatgtgggcctcagctcagtgaatttacacaatgttcaagtacacaactgaattcaacctctgaattgtaattttcatctaattcaaattcttgcattcttcaaaacataaaaggaagactataaagtcatgagtgacgctaattgggctatgattttttttcagatccacttcctggttagaaatcaacattttgagggacttttttccaaatgtctcttagattgtgttcaggagtctttattaaaagttaatgcttatttttttaaaacagattaacttctgaagtctgaaatatctattttaatttatttgacttttattaatcaagataactaaatatagaaaaatggattaagtacatatacaccaaccttctctctctcacatttttaagttacttttttgaaagacaagcaaagattatatgtacttgatctttacaacttttattatttcaaaaatgtaaagatgataacacatgatatttgaggtcttaggagtgagaatctctcagatggccaggggaattattgaaattcagttcaaaaataattctgggtttattcacatggccaaattattttgtcttctttttgcatcataattttgattgctacactccagtttcttttttggctctgaaaaccatccagaaatattttggttattgagtatcataataactgtgtcatgagatagttgctctagcagtcaagtagtcaagttcccaatcacggtactgtgcctctggacacgtgggctttcatgtgtgtgactgcaggttaacttggtgtgttcacttattaatatttttaacaaaattatcctttaaaaaagtgggggagaggggagaaaaatgctgcggtgagacctctttgctggcttaaatttacttctcccatgtccaagtaaggagtgcttttttttaagtgacatcatacataagatgaattctccacttttcacgttcagcttgttttccccaaggggtcagataggtgaaagaggaacggacatgactgctgaagtatgctttagttctttgaatttatcagattgattaaggcgaaagattgtttttttttcattttctaatttttcagtattttgtttaagcaaaaaaattgttcaaggcccaaaactctaatcaatgatggtagaactttctccaaaatgtctcactattaaatatgtgttatgaaatactttggtgttagataaatcagagaatggaagagaattttaagaaaacaattcaagtgttttactgtctctttgtgtttgatagtcaactctgttttaggaagtccttttaagctctgagaatataaaacaattacctttcaaaccactgaagtgcaacctgaatatagttaacacctcatatggcttccaggtataaattaaccttgtatacaagccattaggaatacttaatgatcttttatttgtgaatcatcaacattccaaaatttgactaagtgtaataaaagataagcaatgcaataaaaattcttgaatgcaattaggaaacaaggcattatttttatgattttattataatatgcaacataatttcccctgatccccaagtcaatgaatttctgcattaattcctctttggaagaccactctaataatataaggaatcagtacccacccacctaccatcacttcaaatgcatacccaacaataggaaatccaggggctcccaaatattcccccatcagcccacagg

SEQ ID NO: 35532 - DNA, 1310 bp, Bovine  19866881272898
cagacaggctgcagtccatggggtcacaaagagtcagacgggactgagcaactaagcacacacacacacacacacacacacacatccatttctccctgcatcgggaaaccttgtttaatcaatgtagactgcctttgtcacatgtaatcaaaacacacctactttgatactatcataactttcctgaaatacatttgctaatgttttcttttgacaagttttttgaaatgtgagttacaggtgtttacaagagaggacagtcctacaaataagaaatgacctcactaaagtataccaatatgcatggatttagaagtgaaaatatacgttaaaatataattgatgtttgtgtttgccatatccaagtaatactggttgtttttttcaccactaccttatctctgctgctgctactgctcctgctaagtcgcttcagtcgtgtccgactctgtgcagccccatagatggcagcccaccgggctcccccgtccctgggattctccaggcaagaacactggagtgggttgccatttccttctcccaatgcataaaagtgaaaagtgaaagtgaagtcactcagtcgtgtccgactcttagcgaccccatggacttcggcccaccagggtcctctgaccatgggattttccaggcaagagtactggaatgggatgccattatctctactgtcctatgaatcattctgttcaaggccagtctctaggcctcctagatatctttggaacctgtacttcagaaacactgttgacattgcaaaactggagtcaagatttatagtaagtcacttcccaggtggcactagtggtaaaggatctgccagccaatacaggagacataggagaagtgggttcgatccctgggtcaggaagatcccctggagaagggaatggcaacccactcccaaggattcttgcctggaaaattctgtggacgtaagagcctggcaggctttagtccatggtgttgcagagtcaaacgtgattgagcgcacacacatacacgcacatacttttttttaaatttgagttcatctaataaagttgacttgctctgggcccaacatcaaggacagatgtgtgctccctaggagtgaatgtagtttcagccatgtgggagatttgcaccgctcctgcatgtgtcctgctggggtctcacacacactcctgtcacatgcatacatcatgagatccaccgtcatcagtggctgctcacgttgtgttggaaaccttgaggcaaaacctttcctcttatctaactatgtgatggtaccaggtattttcaaataatattca

SEQ ID NO: 35533 - DNA, 818 bp, Bovine  19866881583777
tttctctacaaacctcacgggcaacttgtaatccaaggaacactctaccctggtagtatgctctgttgtctaagcaataaggtaccatctaaggctaagttattgatttcagtgacttttagtcatgcttatcttcacagtaactgtacaagtaaagtattattgggaccatttttgcagaaggcaactgaagtccgaagggttaaattgcctaaagtaattcaacgaataaattgctaaatgataattcaaactaagtcccagagacagcaaaaaccaagatcctttcattattctaacttgattgctttaatcctgaaagctttagtacagcaccactcctgtcctttatacggcctctagaatgtataaatcattcacttctcttagtatgaataaatgataattgactgtaacttttcaaaactgtccttcatcaagtgccaaaatgccagatagtctgtatttagtcccaacatggccttcatctaatcaaagtgcttattttgggagcagtcgcttttgagtgttaataaactatagataaatttgatgggatttggcatattttggattcagataaaaagcacctgtatgccatttctggttttttccttagtgctaccaaattaattcaattatagcccttgtcaggcagaagaacactgaactgtggatggctgtgtctttttataaatcaaaggcacgattttagagttttctcagtactctggacttgatgtatacatgaagaaagcagcaaagtgaaagtaataaagcctgtcttaaaaaggcgtttagtcaccatagttcttgtt

SEQ ID NO: 35534 - DNA, 778 bp, Bovine  19866881901516
cacgactgagcgacttcactttcatgcattggagaaggaaatggcaacccactccagtgttcttgcctggagaatcccagggatggtggagcctggtgggctgccggtctctggagtcgcacagagtcggacacgactgaagcgacttagcagcagtggcagatttagtggtctaagctgaatgaagcctggagttaagaggtgaggttcaggacctcagctctctttctgctttagtggaggacttgcatcctccggtagccgcccagcacctgcttgcactcccagctctacctgtactacttttggtgatgggaagaggggaccttgttggggatgcaggggtaaccctcagctcaggggctgttctctttggcctttgtttggttcttggctgctcagcactcttggcttttccatcattctgattcactcttctttacatctttcagagagtccaacattttgtggacccttggcattctttcctctttgttgcaccattaagcattcttgtttttgaattcctagtttatttcattggaaatctgggagggagacaaggcgaatacattcactcagctttcctctttgcaacttgaaatcttttagtcatttttggctcatctttcttcatcccctacaatatccattcagttacaaaatcctgtgaaatttccttccaaatccatctgtaaactgtctctttctctccacctgctgccatttcatcactgctgcagcgtcctagctggtctattttattccaccatgagcc

SEQ ID NO: 35535 - DNA, 1890 bp, Bovine  19866880081989
taagccaacttttcactctcctctttcactttcatcaagaggctttttagttcctcttcactgtctgccataagggtggtgtcatctgcatatctgaggttattgctatttctcccggcaatcttgattccagcttgtgcttcttccagcccagggtttctcatgatgtactctgcatataagttaaataagcagggtgacaatatacagccttgacgtactccttttcctatttagaaccagtctgttatctggatctcaattttcctacccttaccctctctacatcagagttacagttaaggtcctatgaggatacacacgaaaagtgctttgtgaaaaataaaatgctcttctggcaaagtaagactgggtttggtaatagtttttcaaacttctggaatttctctcagagctctacgaccaagcaatactgcaaacaagaaaacagtactgaaacagtccgacagaatgaggctctcagggggttatttgcaagcctgtcagaactgctaatcaccaagacaatgggagagacttctctatggacaattggattagtccataatggagccataataaggctgctcatattctggcacatcctcacaggactgggctgaagaatgatcactccaggaaacaaagctgaatctataaaccaggaggtctggttaaaagatcatgtggggaaaactatcttttgtacacacaactaatatattcaaagctcgagacctaagagaagcatggcactctgaggtatcgaatcaaccagatagttgatagtcccagttctctagtcctaattctctcctagcatttactagtccttttagcccttgaatctatatatatatagatatatataaatgcaatgcttagacctaggaatggggaagtaaaggggtggcgagagatacagggtgaggtctacgatagctacaggcttcctttggtggctcagaggtaaaaaatccgcctgcctatgcaggagacatggggatcgatccctgggtcagggatgatcccctagagaaggaaatggcaaatccagtccagtatttttgcctgggaaattccatggacagaaggagcctggcatgctatagtccacagggtctcaaagagtccgacaggacttgacaactaaataccaaacaacaaaacaaaaaaaattcctggtgctatgattcacctaccagggccctgctggatctccctaaggttcaccttctgtcttcttccatcttaccaattgttaatccagacttacctgcctattccaggaccctcaccagcagagtatttttcatgaacaaatgttacaggtattctaactattaatttcagttttttgtagtaaagcagttctaatttctcaaagatcaaaggtgacaatggatagtttttctcttaatgcttaactttggcatttctagcaaatttctaggagagttaataagtaccatttattagataatctttccatcccaattgagctgtaatgcctcctttgtcacacattaaattccttcataagcttaggaattctgttagaaaatagctacttatttttaaagtgctctgttgctccagaaagtacaactaaaatttataaccaaaagtaaaactaatgagacttaaacttaaaggactcttcctacgtgaactgtctaattctttactcttaatttttttaagtggattccccaacttgtatatatttacaaaacctggatccacccactctctacttccaaacccatctaccatgcctcagctacgcaggaaagcaagtgcaagcaacagtgcccgttctagggaatgtctccatgctctccctgtgtggtccctctatcccaagttcctggattcctcatgcatact

SEQ ID NO: 35536 - DNA, 2408 bp, Bovine  19866880319996
cctgggttctagtcctgacctgctataacctagctcaaacattctgagcaggtcaccagtctatggaatctacttaacacgattatttggagaaacaaataagatatagatccaaaaatgattctctaaaaatgttcaatagatctatcaattatgaagaaaatttaaagcatttgatgtatataaatttgtactggttacaatactatttcctttccctgtgccacatactagaaaactcacaatgctggtctcagagaataagtagcttgctctcccccaaatcctaagtccaaagaggtcaagtgactcaaccaggatcacaggagaaatttagggaagagttacttctagaagtgaacacaaatggttatgccccctgccctccccagaagtcagaaaaacaccattcttcagagttaaggcttcctaaaagtgaactttaatcaactgtctgtatttgtatctttacactagaaacaaaaacaaactactatctgaaaaaattagagcttataattagaggtgaaagtagacagagccaaatgagagtgctgaatttcaagttattggttcccaccttgcttccgacagcctgggattttgataaaggctccatagtccgtgaccatagcaacctataaaaacacaaaaaaagaatctttatcacacaaatgagctctctcctgtagaatttaacctcatctctttgaatttccacttggtactgactgcctgtgtctgttgcaaaactgcctaaaagtgatattctgtcaaacattctttctgttctttttgagatttaaactgacaggtatgtatgattctaataaaaacactggtgagactggagttatgtcagatgatatgatggtacttgttgttcagtcactaagtcatgtccaactctttgcgaggcttctctgtccttcactatctccctgagtttgctcaaattcatgtccattgagtttgtaataccatccaaccatcccatcctctatcgtccccttttcctcctgccctcaatcttccccagcatcagggtcttttccagtgggtcggttcattgcaagtactgaagcttcaacttcaaaatcagtccttccagtgaaggttcatggttgatttcctttaggattgacgggtttgatctccttgctctccgagggactctcaggagtcttctccaacaccacaatttgaaagcatcaattctttggtgctcagccttctttgtggtccaactctcacatctgtacatgaccactggaaaaaccatagttttgtcagcaaaatgatgtctctgatttttaatactctgtctaggtttgtcatagctttccttctgaggagcaaatgtcctttaatttcatggctgcagtcaccatctgcagtgattttgaagcccaagaaaagaaaatctgtcactgcgtccatggtttccccttcaatttgctataaactgatgggtctggatgccatgatcttagttttgaatgttgagctttaagccagatttttcattctcctctttcaccctcatcaagaggctctttagttcctcttaactttctgccattagaggggtatcatctgcatatctgaggttgttgatatttctcctggcaatcttgattccagcttgggattcatccagcccagcattttgcatgatgtactctgatagaagttaaataagcagagtgacaatgtatagccttgtcatactcctttcccaattttgatacagtcagttgttccatatctggttttaactgttgcttcttgaaggttacttcaatatccttatttcatagaggaagaaagtgaattttagactttctgaaagtcaaacagctaatcattggatgaaatatactgaaagacaaatggatcccttattctaaagcaggtgtcaacaaaaccaagcctttgtgccgagtctggccggctgcctatatttgtaaataaagttttactggatcagaagcctgctcattcatgtacaagttttccatggctgattttcctatatgacagagctgagtagttgtaacagactatatggccccaaagtaaagaatatttgccatctggcactttgcagaagagattttaaagggttgtcaacttataatatgagtatattacaagttctagtgatcattatcataacagaacataaaattaaaataagctttaataaaaattaatttgagctgtgtgcttgggaatatagttttctgaaacaagtattcagggagagaagtaagttgaatggaaggaagatactaggttttagaatggagattgtgaggcaaaacaatctgtaggggaaaagagacagaagagtattctatcatggggtttatctaaggttgagaaataagcatgtgacctctgag

SEQ ID NO: 35537 - DNA, 1282 bp, Bovine  19866880392828
cgaaataacatggtaactgtattttaaatgaaagaatcaatagctcaatgagattgagcttcttggagacggtgattctcagttaactggcccaggaccctttggagtttctgggagatctcaaagaacaatgggagaaaattcactggtctcacagccttcttcacatgccctgtgggggcctctctgtgccaggcctcttgtgtggcatgctttgagaacacggacatgaactggatgccatcccttcctttcagccctcccagactagtgagggatacagggaaataaatagatgaaaacacattggggaaagtaaaccaatagcagtagcttcaggaaccatttaaaggatgctgaactctgtggggagtttgacaaagactttctgaaggatattgggttttgaaagatgacatagagcctgccggagaagtcaatggcaccccacgccagtactcttgcctggagaattccatggacggaggagcctggtgggctgcagtccatggggtctctaagagtcggacaagactgaagcgacttagcagcagcagcatagagcctgccagaaggataaggtgtcaggaagggcattgcagctagagggagcaccttgatggagaaacaggagcagtcaggtatgctggaggaactagaggcagttctgggtggcttgagcaggcgctgtgtggtgtgggtcatggaaggccttacagggcctcggcggccagaacacatccttggggcttgactccaagggcactgggaagccttcagagggttttgaggagaaactactcaggctcatcttggtattttacaaacaccacttgggcagttgtgcagtggaatgcctggaggctagaagtgaggctgacgggaggctagatgaagaaaatgaccccagggaagagggaaaagggttttcttgaaatctgtcagagacatgagtgtcagccctagatcttctgactccagtgccgtgaatttctcgtgattcttaacccattttacagaagaggcagctaagacccagaaaaggaaagtcattgtatctacgtgatagaaatgagagtagagcctggtggttcccccatgccccgtctgtccgcatctcctcatgtgggtgagctggacataaggggctctgttggactgtgcctccaggtggactgaagaatgcatgtggccacagggagtgctggtgaaacacagcaagaacgtctacaaagcagtgggccactacaatgggccattccctctgacgtctcccacttcc

SEQ ID NO: 35538 - DNA, 1811 bp, Bovine  19866880436445
tatcccccattttgcagatgagaaaaccattgtttagagagatttgtgcattccatctctctcagggcttccttggtggtttagtaaagaatctgcctgcagtgtgggagacctgggtttgatttttgggtcagaaagatcccctggagaagggaatggctaccacagcagtattcttgcctggagaatcccagagacagaagaacctggtaggctacagtccatgggactgcagagtgggacagggctgcgtgactaaccctttcactttctggtctctcagtaaagagccacagttccacatggagccctcatctgagtgcacaaacccaaaccagttgacacagatgacagccagcgacagtgcaagagtggcaacgtgtgccagggctgtgggagcccagcgagtgctgagggctgaggtggggagttcaggggcagcttcatggagggggccactggggttatatctggaaggctaaaggggaagttgtcaatgggagccagcagaagttccaggcagaagaaatggcacgtgcaaaggcacagaggtgagggagatgggtcaggagaggtaggcaacaatcacatcaccaaaggcctcgcattctaggctaattccagggtggatggaaggcgtcttagtagggagagcagtggcctggccagatctgcattttggaaagatgacactagagctaggtagtgactggaggcagaaagaacaaggaagacaatgagatcaaagacaggacaggggacatccctggaggtccagtggttaagacttcacctttcaatgcagggggtgcaggtctgatccccagtcagggagttgagatcccacatgcctaggggccaaaaactaaaacataaaacagaagcaatgctgtaacaaaaattcaataaagacttaaaaaaaaaaagaaagacacaacagttattagatactagcccagatgaaagggcaatcgggactacagataaggaaacccaagtcagacagggcccggcaacctgtctgaggagacacagtgcatcactgcctggggagtggggactcaggggcagagaggagcagagccctccacacaggaaagctctgcccctgaccatggaggtggtgagtctcaaagccctccaggagcctctgctgcagctctgctcttggcgcagaatcaatcaggtgaatattaaccctcctcctcaaaccagatacaaagcaagaaactaagaacggcaaggggggtgggcgggggggatgcacattgtatctcagctggagagatcctagtggagccagtggagcacagcgctgggaaggaggaaggcaggaacaaaggaaaggcacccagagggttttaggtgatgcttcagagaaagcctagcccaggaatgtggggtagggtctgctggcacaaggtcagagacagggggctttgtttgtgtgagcctttaaacccccttctgggaagagctcagacggtaaggaatcgcctgcaatgcaggagacctgggttcaatccctgggttgggaagattccctggaggagggcatggcaacccactccagtattcctgcctggagaatcccatggacagagcagccttggcgggctacagtccatggggttgcagagtcagacacgactgagtgactaagcacaactgggaaaagggctcccttttctagagacctacgccccctccccctcccttgaggttctcaagggggctgccaatcacagtgccccaccccctgcctggggccaatcagagtccttccttgggggggttttttctgattggaa

SEQ ID NO: 35539 - DNA, 2276 bp, Bovine  19866880444795
aattgcccagggaaaggaatataataagagcactgaggaaagacccttggggaataccaacatttaaaaaatgcctagacagaatagcttgcagatgtatctgacggctatgcctgatgaaaagggtagggaagtatactgtcagagcaagtttaaaaaaaacaaagactaaaaggatctactagatttagtaccagggagatcactggtgaccttgaagagaacagtgttaataaaacaacggaggcagagccagactgatgagcagtggtcaggagacatggaatcgagaaatgaaagggagataaggcattaaagacagtgagtgtagaaaatattcaggggatttctcacaggtaataagagcaagactctgggcccaaaccctgggttttgaatcattggtaaaatggtattgtgtgtgtgctcagttgctcagtcctatccgactctttccgaccctgggaagcccattaacagcacttatttcataggtccgttgtgaagcttaaaagaattataacgtaaagctctaagaacaacaggtggcacagtggtaagcaattcacctgctgatgtaggagatgcatgagatgcgggtttgatctcaggaagatcccctggagtaggaaatggcaacccactccagcattcttgcctggaaaattccaaggacgaggagcctggcagggtccgcaaaagagttggacccgacttacggacaaacacgcacagcatacattgagaacagtgcctaacacgcttaagtgttagaggatgatgataacagtattatgattgtaaccactatcaccatctttaaagaagtttggctgtaaaggggaagactgaaagggcaataacaagacaatgtggaactgaaggcagactctttccccaataagagaagacctgagcatgatgaaatgctaataagaagcaatacagttggttaaaaggataggatttgggaaaactgacagcataaggtcccagagacaggaaagaaaggttgaaatctttccatttaagggactacctgtagataaaatgacattccatccatagtaacagcaaaggaggcaaggagagatgggagtacagtacgatttctaggtagaaacaacataagaagttgagtatttacccaataattactactctcatgataaagcataaggtaagtcaaagtctttgaaatacctaaggaagccaataagtaaaagcagagacaaacggagtcgctgccccctccccccacacatttcatacttactggcacctgctatgtccagaaactctactctactgctctactgcattcggctcattaatgcccaagacaactctacgcgatagatattgttaatccccactacacacataaaacagaagttgaaagaagttaaagaactagcgtgaagtcacaaaaaattagagaacagtagaactgagattagacctcaagtcaattacttgaaagcttgagctatattatactatcaagaagtctattgcctcttttcgtcaacatcactaccttctcacattcttagctacggatcccccaaaacttactttctatagtttcaaaaacaaaaacacactgaaagattagggtacagaatcacaaactgatttattgctatctcaatgaaggcaatgcaggttaaaaaaaaaaagtttcaaatgctgttactcagggaatacacccttcatttttcagagttcccacacagggacttctcacttcatataaactgcctggtccctgatggacagggaccatataagttgtaatgcaaccctgacacagaagtcaataaagacaagacagaaagaaaacaagttctagtttatctttcacttaggtggtataaagtgcaaagttaagaagttggaaagacttacctctgtaaatggagacaggtgaaaagtaaatataacataaacatctaaaataccttgatatcattgtctattccaccagaaataatctgatcacttgtatcattggaaagtcacagctaaaacttggtaggtgttctgaaatgtctggatggctgctttcttgcggatatcccaaagctgaaaaagaggacaagacagtctacagtaacatcactctaagaaacaactgcacagtacacccataaatctaaggactgtgggaagtgaaaacatcagtaaagggaccctgttcagaaatttgtctgattatcccatcaacatggtgagaactgactataattttgccaatatatctgaatgctggt

SEQ ID NO: 35540 - DNA, 1454 bp, Bovine  19866880455132
agcagggggaatgagagggagaaggtagaccagaagggctgggaggcccactgtggctggggcaggggtaccgagccctctgagtgctctttgggtaaaggttcacggtgtgggggtggagagcgataagcacctactgcaggggtcaagtgctcccagtcaacatctggaatgagttgggaggtcatttctcctggctgagtcactcttcatgtgacctgatggaaaaaaccccaattccctgccttatttagtggcccctcctgtactgatgctcccaaggaggaaacactgatgtaaaccagtctcactgctatggtaacagcaaccacttctgacttgccatcctgatgagaggccaggtgggaagtctgcctagcaactgtggtgggtgttagaagtccctctccggggcttcagaatcccccttccagcactgtccagaccttggctcaggtcccggcttctccttccagtggggaatcacagccagctgccaacatctgggcagctcttcacagctcagaagaatggtgcaatggatgccaccaccctggaatgggattgttagcccccctggacagatgaagacactgaggctcggagaggtaaaggggggctctggcatccttccttctgtgctgccttcactctcccatatggtaaaggtctgctcatctgtgcaagtctcctgctctgattcatctgtggcacctaggaaagaatggagtgtcactcccccttcctgtcaccctcttcctttcttggtgatctatcggttccaggggacctgcccccagtgttctattctggcccaacagaaggctagaggaagggatcatgtgaggtctgtgagagccagggtggtaaaaaaggattgtgagagaccctgcacaggagggcagtacccctcctgcccctctgggtgacacagctgaagtatttccctttgaaatgcctggctttgaacttcaatactatactaacatcgatgactggtactttgtgtgcacttaaccttgtgccaggggcttccctggaggctcagtggtcaagagtccacctgccaagcaggagacatgagttcgatccctgggtgggaagattccctggagaaggaaatagcaccccaccccagcattcttgcttgggaaatcccatggacagagaagcctggcgggctatagtccatggggttgcagagtcagacacgactgagattaaacagcagctctgctccaggttttgcggcaagtgctttgtgcgcactctctcgtttaaatgagggacggggttttgaggcaagtgctttgtacgcactctctcatttaaatgagggacgggctatcatccttgttctatggagggggagcgtggcctgagatctcagagctggagagggcacgagcagtggcaaacccaggtgggttctggagccagagcctggctcttaa

SEQ ID NO: 35541 - DNA, 1690 bp, Bovine  19866880458551
aaatctcagggatggaggagcctggtaggctacagtcccatgggggtcacaaagagtcagtcagacacaactgagcgacttcacttcacagacggggcacggaatctgaatgtatgcagcaatggacttgtcagcccctggtatgggtgttatcagaaggagccaagggtgacttgtgggcttctgtcttaacatgcccagatggatgaccatgccattgaattcggaggccaggaagaggatcagctgtgggggagacaattacgactttcaccttgagcctgttaacactgtaataccttggaaatagtcaagggggaatttcaagtaggaagtaggtggttagaaatacaggactggaattcaggaaaagggcggcattagagtcactgacatggcaggaagcatactggaacaggctgcagggtgagggggaggtgaagaaattaaggcaggatagacaatttctgaaatggagatatgaaaagaaggaaagaaagctcaggggccactgttgattctgaaggtgaagttacctggagaggatgatggaatgtttccaaggatggagaggccgtccttaccccctccccaagatcctacataatgatagaccaaaaataaccagtcttactgtcctgggaggcagggtcctgagccctggtaatggatgtcatcacagagattgattctgctcatttgctgggcggcaggccagacacagttcctgaaggagggtgggggaggagaggggtgggcattcaacgaaaccttggctctaaggtcttctgggaagagggaactctggactctacagagtagggagctcccaggcacaagatggacagacaaacccactgccttgggctctctgcggcccttgtcctgttccttctgaccaggcaggaacaggggtgagctcactccacaagcctcagctgcccactgaccctgctccaggctggtatgtcccaatccctggtggtggcacagcacagcaccagccatcaatccaggcatccccagggtcaaccgagaaagtcaatatttaatttgggcaccatgttaatgccatcgattgctgactcccctcctccacttcctcagactcatttgtcacttccccacccatggggggcggggtggggtgatgcagtactggaacccaggggcggtggagctcagccagggtcagcttgggaaaactggctgcatgtgggggtgctacccttagccacccagcctcccattctccctgaaaaccactgatctgctttgtttgagtttcctgagctcttgtctccagcaaggagcaggtggggaggtatacattcctcccaggcagggactgagcctgactccctgcagggtccgtatatagagcaggtgtggttgcaggctgagcattgaagggaaggatataaaccatgaaggacccaccgtgggacaaaagtgaggcccaatcctgagacccagaacccgagggccgtgttggctcaggcttctggagcccctcccaggtgcccaccactgtgcccgtgtgatgctgtggaacccacacagggactttatatggactccttctctgggccctggaggtgggcttcggggagagttgagcttagagacctagagcccctctgagcagtgaaagaggctgaggggagggcagagcccatctcaaaactag

SEQ ID NO: 35542 - DNA, 994 bp, Bovine  19866880491518
tcccattaaagtggaactagaattcccttttcacacatgaggaaacagtttaaaaaatattccagggccactcaactaggaagtgggcagagataggatttgaacacaagactcactgacaccaaaagataatgatgcccttcccatcccaacctctcagagtcaacttaccagtctggggccgcttcctgggctggattcttctgtttggtcctggttggagctgtctggccatctgttagtgccctgatcctgggcaccaggcactgggtccattttcaactgtttagcacacttggaatttctctgcctcatggatgggcctgagctagccttgctggctacaggctccaggaagctggagggggtgtcaccaagtccctgccctggcctccccccagacactggtcgagccacgacctccagctcctcctggttgtgtgaagcaccatggccatcaccatcaccaggcctcatgatgtgctcagcttcttgctgtgctgtggaagcctttccagaccctcccaggcacagctcagggctctggagaggatcctgggcagctagctgaagtgacggtcctccagtgggcacagggaagctcacagggtcacaggggctgcctgggcggggtcccaccccttacagtgggcaaatattcaaacttctcaatccctgagtcacagtccacccaacctccacctgggtgtccaggcccagacccagtgtccttgcaagagagaggactgcacgggcctcccaaggacgccacgtcagcaccttgcagggagtctcccacagccttgggcttgtccccactctgaccaagccataagaagctaccttcctgaccctctgagggggtctcagacttcctgcttttctttcttgcccccacacacccactacaaagattcctgggacaacttccagctaagacatcgtgcagaataatctggaccctcttgaggccctgagccctcccctgggcagg

SEQ ID NO: 35543 - DNA, 1548 bp, Bovine  19866880531795
gcatggccccaaagcagtcagaggggttacagtgcccggtcttgcccggcgggcctatggggcctgggggaccggggatgccaggaatgccttgctggcccatcggcccagtcgcacccatcttgccgtaccctggaggaccctggggacctaaggcaggaaggagtcagagaagggggatcaggaaacccaggtcataagaaaagaagaaataacagtcatggtaaataatagcaataccttacatctgatgactatttctccagctacaccatattttcatgaagacttgatctgatcctgacattgacagaacagtgacaataataccactggctaattttattcagtttccacctgccaagcagaagccaagtgctttctctgcattattcattgaatcgtcacaacgactccatgagaaagaaactattatctcattttggagatgaggacacaggctcagagaggtcacacacctgccatgtggtgaagctacatctcagaaccaggctatcaaacttcagtcatttctctcttaggcttgtccaggtaatatagccagtaagatgatgagcgggacctaagcttgcattccctggccccaccacatccgactctcttccactctgtcacgctcggccacgttaggacttgagaacaggcacgggatgtcccacctaaccctcaacactcctgccccaccaacgcacacacacgtacacacccatgccctagtagagtctcttatactcagtgtcattactataaatgctggttgataggcctatggttatttgggacactacacaactatgctatggaaagaacaccaagaaaggagctctcagccgttccagattcacagtctccaagactgacttttcctacctggggggccaggaagaccaatttctcctgcgatgccaacacccgatgtctcccttttcacctttggtaccaggcaaccctgaaacaaaagaaataagataagacgtcccatcctggagtagaaaaatgatctacctggtcagattatttgaaacacacatatacacgcaaacacttgattcacaacagacctcgtgcaatgcttctgtgtgcccccaagaaccaggcatgtacccagagggcagacctacctctcatcccgggcaagccctgccgtccttctctgccaatctgaccggggagtcccggtgatcccggggagcctggccggcctgggggaccatccttccctgggggccctggtcgccctggagctgctgccatctccatgggaaactgcatcctggaggtgtagtaagccatcctctctgtaagaaaggacagggacaggtcacagggcaccctgggcactcagaacgacaggctgccagcatagagtccaagacagccattcttcagagggacgtcagagcaaggaacacacaggtggatctcttaaatggtcgcctgtgccctctcccccacatcgctccccacagtgatcttcctgaagcccagatctgattccagcatctcttttctccagcagccttcatt

SEQ ID NO: 35544 - DNA, 1496 bp, Bovine  19866880700653
ctttctcccagtcttaaatctcttgcgagggaccagaatcactctgtccttcacacctccaagggcaagactagagtcagcagctgtgtgattctggcaaatcactcattctcttggagcctcactggagggttgggattctggatcaccacagctcttccaaaccatataatgccatgtaaactatgtccattgagagaaaactgcagtgatcatttggtccatccccctgtgcccatcacccagccgagacagatgctaaactctccagatcccaaggaagcaggctctggcttcttgggccactcaccccaagagttctcttatctgatctcattggggctcagttttcaaatgtgcaatatgggaataatcccctgatcaagcccctggtgccccctagtatctcccaaccatccttgcccatctctctcaccatcctcccatccatggggactcagatgcactctggctttgagcctcctgtccccttgccttcgctctctgcactggcctccacttcctgcttctgacccatttacagagcaggactgaagctatcccttatgaatattcacgtaggtaatgagggcttgggattgggagagcatctggggagaggcattaatgagacaccatccacctactgtccccacacacagccccctgtcaaagctgccctccctcccaaagggtgctcgggagtttgaggcaaaggttgaagtaactgcaataataatatccacagcaactattttcaagtgcttacaacataccaggcaccctactaagagcatctcctgtaagacgcttttcagatgggaactattttcccatttaacagataaggaaatcgatgctccaagaagtaacactcacataagtcatatgtgaaacctgcacagtgattacgtgcagagcaaggatggaacccaggttttgttagactccagaactggtactgttaactcgtgccccccgtatgcacggggccacacctggacctccccatcccagcaaatgtgctcacagtggtcttcagtgaccaaggctttaggaaagggctcaggtgctggaagtgactccatctggataatgggaagacacgcagacaggcgtgagactgtgtgattcacacacacacacacacacggtgcactgtgagtctagagtgcgttgatacaggtagagtgtgttgtatgtacctggcagtgagtgtgtgtgacacagatgcccctgaggttgcccagagacgcactgttctgccactgttccttttccagttgaccagggggcctgctgggtgccaggtcagggcacgtggtgtgaaaaggtcaacaccgtccgtgccctcctagagcgacagtgtggtggctttgtacccaaatgtggcaacaccgcagaaggagcctttgtgggaggtcttcttcatttgggaggtcttttttgtgggatgcggctgaaggtaagggacaagactgtgggagagcagaaaa

SEQ ID NO: 35545 - DNA, 768 bp, Bovine  19866880722515
agagaaacttggagagcacccagtgtgtctcctggggttgagcagacaacagacaaacttgcagatcaagagcacacgacctcaggcagttctgggtctgctccctgacagtgatgacctagatctaagacctcctggacagtccccagggaagacatggtatccttgttggcgagtatgtaaactttcataagggaaaataggtgcacaaatttttggcttcatttaggtttcaaaagagttagatgggggactttgcaggctccttgcccacaaatccctcccattctgtggccacaggagagggaatttaaggagccctatttcaggagttgggacacagcacaatttagaggaaagaggatggactgtaatatatcaggcagagctccattcagtgttgaaagtcacttgctggatgatatagacaagtgatttaacctttgtgaattgcagtttcctcacctataaaacagagattataactgtattactttctaggattcttgtgaagattaaataataacttgtaaagagtttagcatagaatctggtgtagaaaataataagttataccattattattacatttgccacaggcttgcttataataacaaaaacaaatgggaacaacttaatgtcgatcaatggggaattggttaaataaagatgttacatccatggcttccctggtgggctcagtggtaaagaatccacctgccaacgcaggagacagcagttctatccctggtagggaaagataccaca

SEQ ID NO: 35546 - DNA, 1354 bp, Bovine  19866880764313
cctggtggaagagaaaggaggagatttgtcttgagcacctaccctgttgccggtgatgatctggtgatggatatttgtaagggtgatatcatcacaggaaagctagtacttactgagtctttgctaaggggcaggcactggagtaagtttttctcctgtgttacatcattctgtctctgcatgtgataggtactgtttcttattccccacccttagatgaaggatctcttattattacccttttacagatgagcaaactgaggcttagtctaggaaacttgcccaagggccacatggcaaaaggggagccgagatagtagcctgagcgggtagattatacggagaggaggaagggagcacccccagctgggatggggggacgtggggagcagtgtggaggctgcgacctgggaactgccccctcagccccacctgggggagatgggatgattttattacttttaacaaataacacttactctgagtgtttattatgtaccaagcagtatgccaagtcctttgcatgatcacctcctttaatccttactagaacctacaaggtaagtattatccctattttagagatggtaagacagaggattagcaaagttaataaactacttgcagaggggctgtcttaactccagagcaggccctcatagcctcagctgagctgcctctgatgtctgtcggcttgaagcaggggggctcaggcttccgtctgtaatacagacaagtcagagatgagcatgtacagactggtgtcactctgggccccttcgggcccttagctaaacacagtagagacattgagagcaagcgatgggggccttccagctcaggggagcacccagagctcctgctgtgctcctgccatctcgggcgtctgtcccgttttcgccttggtgccggtcccctcgaggcccctgaactgctgtgctctgtggggctgatggatggcagtgctcacggcaggtttttgtctgctctgtgtgcccctcctctccagctctgtcccagatgggctacaacctgagcccccagttcacccagctcctggtctcccgctactgcccgcgctccgccaatcccgccatgcagctggatcgcttcatccaggtctgcacccagctgcaggtgctgaccgaggccttccgggagaaggacacagctgtgcagggcagcgttcggctcagcttcgaggacttcgtcaccatgacagcctctcggatgctatgaccagcccatctgcagagtggggagcgcgccaggcgacaacgtttcctggctcctggggtgggagaagcatgtgggcctctcttcctttcctgccccttctagaaaaagaattctc

SEQ ID NO: 35547 - DNA, 1890 bp, Bovine  19866880777703
taagatcatggcatcttgtcccatcacttcatgggaaatagaaggcgaaacagtggaagcagtgtcacactatctttttggggctccaaaatcactgcagatggtgattgcagccatgaaattaaaagatggttactccttggaaggaaagttatgatcaacttagatagcgtattcaaaagcagagacattactttgccaacaaaggtctgtctagtcaaggctatggtttttccagtagtcatgtatggatgtgagagttggactgtgaagaaagctgaacgccgaaagaattgatgcttttgaactgtggtgctggagaagactcttgagagtcccttggactgcaaggagatccaaccagtccatcctaaaggagatcagtcctgggtgttcattggaaggactgatactgaagctgaaactccaatactttggccacctcatgggaagtgttgactcattggagaagtccctgatgctgggagggatcaggggcaggaggagaaggggatgacagaggatgagatggctggatcacatcactgactctatcgatgtgagtttgagtgaactctgggagttggtgatggacagggaggcctggcgtgctgcgattcatggggttgcaaagagtcggacatgactgagcgacttaactgaattgactgtactgatggctttttctcctctgttaaagaacagttgactatatctgtggaaagctatttctaggctctcagttgaatccttttatgtattttcttttgtcaacattacacaagattactgttgtaagtcttaaagctgtgtagtatcaatcctccaacttttttcttctcttttagtattgtattggctattctagttcttctacctctctatgtaaactttagaatcagtttgtctgccgatatctattaagtaatgtgctaggattttgattgggattgcactgagtctgtagatcaagctgggaagaattgacatcttgataatgctgttttcctattaatgaatacagaatatctctccatttattcagttctttgatttaatcagacttttgtagttttccttatgtagatcttgtatatattttgttagatttacaaacatttaatcttggagggtgataagtaaataatcaggtatttgaagaaaatgggcaccactttcaaaagaatcttctgagatggtcttgatcacctgatggaagcataatagcagctggctcagtcaacatgtttatgtttgtgcaggatttcagaaacaggaatattttgtgagagctgcccaaccatgctgggtccatcagtccatgatgagtccatcattcactcatcatccagtaacaagaaacttatatgggggagattcagtgaagatatggaatggaagacttgagggctccttgaccttgatatctcagattgcctaagtgacatcaaatggtgcccaggccagcatcctcccttcatatgaagatcattactgacaagaaacaatacggccatcttccaatgaccacatgtattccatttcaccagaatgattaaggcaagcttccagggctctctaaaaaccagctgccacatttcaaagactattttattttcctcttttctgttctttaaataagatttcttcaaaagagcaggttttgctttgtctgtagtttactgttttctagtccaagctgaagacagggactgtggttaaaatttgttgggggattttttcaataactggctttctgtgcttctttgagttattttgtcttaaaaaccaaatagatgcctttcttgccttgtaggcatttttagtttcaaattttaccattcattgagaattcttggagttgtccacactcagcctgcagcaatttgt

SEQ ID NO: 35548 - DNA, 1636 bp, Bovine  19866880782483
ttgtgtccaactccgtgcgaccccatagatggcagcccaccaggctcccttgtccctgggattctccaggcaagaacactggagtgggttgccatttccttcatccaatgcgtgaaagtgaaaagtgaaagtgaagtcactcagtcgtgtccgaccctcatcgatcccttggactgcagccttccaggctcctccgtccatgggattttccaggcaggagtactggagtggggtgccattgccttctgcctattcagtgcctacaatacatcaaattctatacaaatatgaccccatttatactcaaacattactgggtgaaacagctggtactatccctattttacaactgaagaaacaaactcagagaagttaaatctctaagtcagaaagctgttgaagtagtacccaaataaggattaaaacccaggctttctctaacttcaaacctcatgcttttattattgcctctcaataggcagagaggggcacactttaagtgaaaaaagagctacttttgtaaagttttgggaaattcagcttataccccccgacactgtcatccacctaaatgcaacaaaagggctctatcgacacctcagatgttcagctgcctgatctttttctttttcaatttctctccttagcctcacttcttgtggagagctaacaagcaggctgtaaagggaaggaaaaaaaaaaaataataaggtgaagcttcctagaaatgccttacccgcaggcaaaagtacttctagacaatctttgtgaaattgactcctttaaaagatcttttcttgggtctctggagacctttgggatgtcccaagagtcaaagaaagaaaaagtatcctgtaaacaacacagagaggtgacctgtttggttcagagtcagatgctgacaataatcattatcttacccttttgggtttccctttgtctttataatgaggattatcctcacttaacaggtgcagaaatcctgtccaacatcacaaaattaatgacagaggaggtatttaaacccaggttattctgtatgtcagttagcaaattcaatcagtgttgtggcatttcttctactataacttaacctttccttttttggtaggccttatcacaaccgtattgtaagtgccaaaggatgagaactgcttcttaaatgtatgtctgagaggaaaacctgagttttgaagctaaacagaactgggtgtgagtcccaactctgctacatgcttgctgtgtgatcttggggcaagttgttaaacctcagtcttgcttcttacttttaaaaaggaagattttttttttttaaacagaaaaaagatttcatgaacagaaaaatattaatactagagaagttagaaaaaattatatacagattttattaactggcctggcttaactaaaaatgactatcatgtacaatccattaactgaacatttaataaatgctacataaggagcaagacagtcatgatttactgactaaggcatccagagatagtgtttctagaagggcaagattcacaggtatctgctccaaaaggtcaggtgtcacgcccttctccagaatatcaatgtattcacttcaaacatctaacaacagcactcctgcccctgctatcaaccattt

SEQ ID NO: 35549 - DNA, 702 bp, Bovine  19866880830435
tggaagtatggcctgtggccagaggacgggcaggcagttgatcagggccccccatggttgttggggccctaattactcctggaggcctacagcctgtcctggccaatctgcaacttctcagaaacccctcactccctcctcgaacccctcatccaatgttttagctgatcactcgctcactcctggtttcctctgaaccaggcaacaccagacctcgtcctgggtccttcctgctttatgctttgggttacaaggagtcctttgcccatgcgtgaagtgaggctggcatctcatttgcccctatgcctagcacggggccaagcacagagagggtgccaatgatttaagaatgatgagtgtgtcaatcaatgaacggcggtgtgtgtagctgagggggctggttaatgtgcgaagaagtccctgaagagcagggcaggagcacctggatgaggcgacagctgtgtcccgagaccagctgggccctgacccggaaccgcttgatgcagaacatgtccaaagacccctcccagggcagctgggtgggcagggccctttgtgggcccagcaggcatctggagcctaggagggagagagagacagggccaggcagaacaggtcatcagggcttccccagcagctccttagttttcagagaaggtcttgtgactccagtggggtgctggaacactggtccaagtaagg

SEQ ID NO: 35550 - DNA, 1133 bp, Bovine  19866880840977
actctgtgagaaacaggtactatcattctccacttacagacgggtgactgctgctcagagaagataaggagcttgccaaggccacataatgagtggaaaagcaaggtccgattgatcggcccctgctctccctgaccagtgaaccagggtatggatggatgggcagaagccggggggtgggaggataaggcactggtcagtgcagaggatggagacctggtcctgggtataaccctgaatcagccactgacttgctgtgtggcctttgcaaaatcctgccctctctgggccttagtctcaccattagtaaaatgagcgctctgagctcagatctctgagatggtcccagcacagagtcgccctgtgtctgaaagcattttctgtgggtgatatccacaaggacagagcagacactgagagctgcagtggcttaaaggaaaagcgctaccttgaagccagagagacccaggctcaaatccggctctccactggcttgccatgtgggcaaatgacctcacaggacaaaatgcggttagtgatagacacacaagccctcagaacacagcacagccccgggaggtgggacatgcgagggcagcccttcagggtgtgccaggtgtcagaggagggggagtaaggccttaccgactccacaacgcctcctgcatggtgcggaccacggtgccccgtatcccaatatccaggggtggcttctcctgttggggctgaagctgagctgtggggagagagtgtcatgggctcccaggggatgctcaggggcaagggtgtggggcaactcaaggctgaggggcttcaggaggtaaggaaggggtcccacctcagggacccaaggtgtctaggatgtctgtctgctgagcccaggcagccagcagccccacccctttggggaaggactgcaggcagatggtggggggaggaaaaaggagtcccagcaggggtcaggccaggagctgggcatgagcccgtgtgtccccagaaattcctggaagacaggcggctgctgaggggcaccctccacagcccctcacctaagtcctcgccccctgcttgttcaccaggttcctcctcttcagcctccactgggcttgcgctgtgggggaaggggtgaagga

SEQ ID NO: 35551 - DNA, 1418 bp, Bovine  19866880914656
tcagctcctgccagcaggtatccacacctagctgggaacctggagggtgctttggaccaaaggcaggaggctaccatggggccaaggctagaggaaggcctagggttcagtggggcctaggactttgagtgaggtctagaacccggtcccacaccccctggacccctctgcagcctctgggagctgcaatggacatctctgagaagcacctgtgtccccagccaggaaaaaggtccaagaggctgcgggaggttccggacggatcccctgtggccatcgcaggctcagccctccttccttacctgggcctgccaggatctacagcagacccatccacgtccctcctcccagggactcacctgggtggtggcaggatgaggcccagggtgcggtagagcacagcaccaatcacaaagtaggaggaggaatcctcggggtctgccggcaggaggcgctggtgggagtggccggggccagggggcacggttccggggcctctccctctgcccaggctgcccgctgccccagatgcggccggcttccctggggaggagaggctgagcacctccttgggtaggaagaggcggtcctctgagtaccgcacccagtccttcatgccccggcggccccgcatggggaacgtgatgtcgctggaaacagcggagacaggctctcgctgaatgctgatcactgccatggaccgagagagataagagacggagagaaccatcatggggaagagacagacgtgggggagacagagcaggaaggcagatgggagacgtcaaggttggtacagacacagaggtggggcggacacatagagaaacaacaaagaaatgggggaatgggaagaaaatatggagacaaaaaattaaggagttaaatgagggaagacaggaccggagaacaggagagtaaaacaggaagagccctcggaaaccatcccctcccctatggcatcctgcatttggccccgtccagcagcccctccccggcctgcctctttgtacccaggttatctgtgacaatcagagagctctggaaggccttgagagcatcgcccaccaggtgaatgaagtcttccaccacccggagcaggtgcacagagcctggggacacctggggacagaaagggtgtaaggggccgaggtgggagtgagccacgggggaagaagcctggtagcccagcccctcacctgctgagcgtcatcccacttgtccttgttctctgcatctaccatgaagctcaccacctggaagaagcgctggggagacagcagtgggggtcaggaggtcaccaccccagggacagtagcttccccgccacagccacacctgccacaccccctgcagactcagctacaggggcttggcctcccccacttccaaaagagggcttctaaccttcagccccc

SEQ ID NO: 35552 - DNA, 1356 bp, Bovine  19866880921830
tgaggtatcatggcacctaagatggagacacaggtagtggagacagagaaacacagagaggcaatatttatgaagtaaacaacaaaaaggttcaggcatggatttcatagggtgggcatagagcagtgaggcaatagatagaagttaaagatgactctcagattcctggctgtgtggtgagtttggggatgctagtccctaagacagggaacttgggaggagaagcaggctggtggtgaaagcaacggggagaaagagagtttagcaagacacgtttattaaatgcctgttttgttccagcctctgtctatatataaagacagaaatagttcctgcacacaagggggacaggcataaaaaattattataatccaaatattacacaggcctcataaccctgtgaactcaaacaaagccatacaaacactaatcattccaagttcctgttgttccccctacaaagttcccttcaagtatcttggggacacttctagggacttttcataagcgactgtcagactaagtgttggggccaagtcattgggcacatcagccccacactgaccccctttgtccctgcccactgaccccaggaagggtgccttctgtaggaatgctaagagcacccctggactagagtgaggcaaacaagcagcctggccctggaagtggattcctccttaagtgttgctggcacatgatgctctcaagtgctggagcaagcctgggtctaattgaaggagttagtttctcaagtcatctgagccctgaagcagcactgctagtgctgcaagtgtgagttctactggggacatggtgagtttgatgggtctctgggacatcaatagggggatgtaacaggatgcaattggctatctgcatttggaacacagaagtttgggttagagatctaaattccagatcatggagtatggatattaggcacaggacccaggtctgaactcccaacatttaaaatgccctgcccccacttcacctggcaactttcatccaaatctcaccttccctcatttatgttggcagttggccagtcactccttcctgtgcattccagcagcccttggtatagtcctttgtgattaagcacttttcacactgcctgataactcttgatttacatatttgtcctcttcactctacagtaagctccttgagggcatggactcttattcagtgttggccatcatgccattttcatccaccacaccacagaggcaaagaccaaaactacaggaaggaaaataaaggagatgtagtgcatatatgcaatggaatattattccaccattaaaaagaataaataatgccatttgcagcaacatgtgtagaccggag

SEQ ID NO: 35553 - DNA, 1139 bp, Bovine  19866880939661
tcatgaagttgaaagttgggactctcaactctgtctcaaatgacagatttggtcatttggttaaaattggagtttcaaggccagaaagccaggactgaagcagccaagtcagagagcgaagatcagagtaacaagattagaggccaggactccggggacagggccaagggtcagaattgaggtcagagataccagaactgtagtcataaactcaggcttgggattatgggattgaggttcagagtcaagactaaagtcaggtgcttcagggtcccagagtcagggaccaggaatgaggtcacagaatcagaatcacaaggttagtggccagagtcaggtcacaatattacaccaggactagggtcagggttgtaactgaagtcagggtcaggtctacagtacaaggtcaagaactgtgtttggggtcttaaggcctgaagctgaagctccaattctttggccacctgatgcgaagagcctactcactggaaaagaccctgatgctgggaaagactgaaggcaaaaggaaaagggggctgcagaggatgagatggtccgactcaacggacgtgaatttgagcaaactctgggagatagtggaggacagaggaggcctggcgtgctgcggtccctgggtttgcagagtcagacttagcaactgaacggcaaccacaacaaggccaagtgtcaaatatatcagagataggactagagctacagggtgagagccagaggtgaagtcaggggtcacaactggatcctaaggtcgaggccaggctcactgggatgatggtgtgttccagacctggtgagacccggaagatgatcagcacatggactgccgtgtgggtgaagatctgcgccagctggacggggctactcctctatctgtggaccctggtagcccccctcctcctgcccaaccgcgacttcagctgaggcagccccatgcagctggtccaacctggtgccttggggctggtgatagcaggctgagcccccacccgcccccagggcttgcccctgagctgggcccctctgttcttagtgccttcagggaggacaagcatcagatccctccctgccactgccccagctctccactcaagctgccgcctccttccccttgcccctacttg

SEQ ID NO: 35554 - DNA, 1768 bp, Bovine  19866880998548
caaaagggcacctgaattcacccctgtcaacaccactttgaaatgttttctgagctatatcaggacagttagaacgactataacagctgcaagttccctgaggttgcaaaatagatacttgggaaaaggttatttgaatcacctttcaaaataacctacagcacaggagcagcatgcaaagcaaaaacttccaggctattgttagcattatttaaaatatatgtttcagagcttagcagtttatgggtcagcttaactctttcatttccccattctgtctaacctattgagcatatttaaaggtcctcttcaagtatccaccactagaagcggggaaggaagctctctatgtacaggatatggaataaaaacattccaaattacatcttgtcagcataagttttgtttgagccccagaagcttttctgctgttagggcattttggtccaagtttcccctaagtcagttacacttcacttcctctcctaaacttcttataaatcacattatacttctcagccatctctctgtgcactgagtatagtacaagataaacagacaagaacccaaatcattcaatttggatctgctggtggccttttaaaacatactgtctatccactaattgcccaataatgacttgatgtttattttcataaaatgcaacgttcaaaaatcttcagaaaccatacagtgaaggcagctgtttcacattacatgtaaatgtgaagtaaaaagggtgaaatacctctataatgccaagggattattattctttgctcaccagcttagttcaacatggattcaccttccctctcttctcacttaaagaatgcaaaatttcatctttcatgtcctcttcctccaaatgcttactgaagtgagagagaatacaccagttcggaatgatactaaaacgcagtcatctactcttacaacaaaagcatttgtggggctctgtgtgcataccatattaatcaggatcctagagaatacatgtgggtgaaaaatatttgatggtgggtattacaatttcattattaatgctacatactttgaagacacaaaataagcatgagtagaatggagtgggattaagacttaggaaagataaaacttttatgacaagactggcagaaatagtgacaggccatggtagcacgacttgagaaaggaactaagtcttgggttaaataactctcaggaggccttgaccatgctgagaatttcacaccgattcaaacgcaataaaagctctcagggattttaaaagcagagtaatagtaactctttgctcactgagagaaaacaaatattgccgtattggtgggcatctcctgatctactaagcggctccgtaattaccagcaagcttcacaaaaatagcctctcagcttactaaaatctacctgacagttgaattcttttcttagtaaacagatacaaatttaactaaattctacttgtggatgatctctaaatgaatatctcatctcactagaaaaacagttcagagttaaggctatggcttaaatttgatgtgctcttcatccagaaagatctaaattatttgaatgatttaaaccaattaccaagaggaaacctggtttgtaaccacatgtgtggaatgaagaatgccactagaatctattgtttttccatcatatccttctcaatttgctgacaaatcctgctgatgactcatatccttctgcactaaccaaccagtcactctgttccctcatgataggctttcactgataatgga

SEQ ID NO: 35555 - DNA, 3301 bp, Bovine  19866881108269
attggcactcagaggttctaagagggagtcctggggagatgcaggggtgaagggagacgctgggctacaggcctggggcccctacctcagggcgtccctcctggcctctgccttgcttgagacactaggcctaaggagccagggaggctaccagtgtggtaaagatgggctgccttggcctggctggggaaagcagtgacttaccggaagacctggcaaacccaggccaggagggcccacgtcgcctttggcccctgcagaaggctggagatgctgggccgctacggcaaagctgcaggacgagcaggactccccctggggaaggaagagaagggatcagaaaggctggcagtgatcagaggggggcagccagaggacggggtccctcaccttctctcctttgaggccttggatgccagggtctccctgcaaggagaagagatttatgggctgagagactgggtacggtagggcaccccaaatttcccagccatctatgaggacagcaatgtcacataccacaaacccttcaaacagccaggagtcccaaggggctcaaggtcagcatcccagacttggggctcatcaacccacgtgacagacagacaggaaagaaggccaggctaacctaccccactggaaactgcctgtacatacccgatcacctttttgtccaacagctcccagactctcctgaaaaaaagcatctgtgagggagtggagcacgcagtccaagccaggaccctaaccacccctgcccactcctttcttccaccctcaaccagcatccaatcccaggaggagggcacagcctcactcactataagggttggctccaccccagcatgcccaaaaggcatcttaagccttggcttaaagaaccctctttggttgctatggagacctggggcagccttctagcccagccctaaactctatggttcagtccccacccccatggaactaagatcctagactctctgctcacgaggtctctatggccatgagaagtttccagcccctctctccaactcctctccatgattatgcccccaggctttttgatggagacccacaggccaccctaggcactcaccctggctggtgcaggatcacctggttctcccttgggtcctggctttccagggagccccacaaagttctggaacccttcaggtagtgttgggcacacttcacaggggtcaccctagcagaagggaaagaccatgagcggacagggtgaggctgaaaccctggggaagacaaggggtgagccagggcaaagtgggcagcaggaacactagcggggtagagggtgctttctgttcacctgaatcattcactcagaatacaatccctggacatcaaaaactacctcctcacaacaagccataagaaatcattgtgtcccatttatgggtgtggaaacttgggcaaaaaagagaagctaactgacttgtcatattcatgtatgtggcggaggtggggatttgaacctggctatgtaactccaaagccaggccctttatttagtagtcaaaggcatgccattggaacaaaggaggggtgggggtcccccaaggaaggtctcaggttcagcacccttgatgcttaccgtcccttcagagataggcttgccctcccaccccacctcggcgtaaccaggcctgggactcaccttctctcccttcagcccgggcacccctggtttgccctgttggagaagcagcaggcgttagccgtggcagagagggccggaggacagaacccccctccctctggaggccttggtagaggaggtctgggcatggtgggcagccgtgctcccactgggtcactcacaggtttcccgccaggaccttcctttccaggcaccccggagttgccctgcggtcagaagaagggttaaggagaagggtgctggccctggcctcagcccatccaccccttcaccctccagtcccctctggatagcaggacaatcttgccaaatctcttgtctcctctcggtcagttttgtcaacactcccttcctgttgcctgtccttctccgtgtctaacccgagtccttctgcttgcacaggaagggggatcacgaggcctctgtgtgtccctgccccagggcatcaggatgggtggtgacctgggtgagcccagaggaaccacagcagacagacatttccaggcctcctgctcttcaaggcacaaggccctcacatgagtttgggccctccagttggaccactgtggtcattaaccagacttaggcctgtgaacccaggccaaggccttcacatcagcaagcactggcatggggacaccgcccactgaggggcccagccccttagccccttccccaacctgcccgctgcctccctcctgctgcccccagccccattttcctctctcctttcaccaagcagggggttcccgccgggggttcccacatgggcccccactcttgtccatgcttaccttgtctcccttggggcctggagggccacctgggtccccctgagggcggaaacagggtgggtcagccaggggcctcccattacagtgaggtccactctggccctttcccccagcctagccccctgggacccagccccacctcccctctggctgagagggagaagggtctctgaggggaaaacaggcaggaggagccaggggtactcaccggggtccccggaagtcctatgccagggggcccagggaggcctgggggcccgggctctcctgccagcccctcaggcccaacaaagccagggtctccctagcacagacataaggtggatgtgagagaaccaccgcctctgagccccccctacccgctcctccccgtcagacagccacagctcaccttctgccctttgggccctatgacacagacttctcctggccggccctgtgggcggggggaggctgtgagaatggctgaggcctggcacctcccaggacagcagccgcactgggacgtggaaatgcccaccctcactgccctgtcccaaagccagactccacccagtgccccaaggccatcagatgtcaactcagggcttggaggtcaggggctcctggactgggagtcatgttgcgctaagtcgcttcaggtgtgtctgactctttgcgaccccatggatcctctgtccatgagattctccaggtaagaatactgcagtgggttgccacaccctcctccagggaatctttcccacccagggatcgaacctgcatctcttacatctcttgcattgacaggtaggttctttacccttagcaccacctgggaagctgg

SEQ ID NO: 35556 - DNA, 759 bp, Bovine  19866881124475
caaagttgtggtgaggggtccaggccgagggcatggagctcctaacatggtgcacagcaggagaccaagtactgcaggcaacagctaatacttaaacagctaatgtaccaggcacttactaagctctttatatctgttacattgtttcattctcataacaaccctatgaggtaggtactgtcaccatccccatttcacagatgaggaaactgaggtcactaagctctgcctggcctctaggtctcagtgaaaggcagccatgcccatcacagccactgaggaagtctggcttcaaggggccccaccctacattcccaatctgcttaccctataccccaacaggggaagggatgtgtccagggtcacccagagagtcaggtgtaaagatgaggtcatagcccaggccaccctcccctcccagatggaccccatcacaatgtgttaagaccaagagaagtgaatcacagagacagaggaacaaagctgagggtcccagggctgggccttctcctggggaagcaagcagctcagaagcaaaatccacagagtgaagtttattcccaacaaagttcccctcccccctccccagccagggacagggacagacaggctgggggtgaagatggggctccaggagctgaggggcctctgagaaacagggaagagccccggccccccgggcacaccgtgtctggctcccccagcctggccgagtccactgtgcctccctgcccagccctcgggagaggggagggggcg

SEQ ID NO: 35557 - DNA, 893 bp, Bovine  19866881174386
acattaataaaccaaggaatagaagtatgagtatattattcatagtcacatgaataaaaaaagaaagaaagttgttcccaagagctgggcaagtgagaagacatttttaggttttaatttctaaactttctgttggggttgggtgttgcatgttcatctacgtgaattatatttgagacaacaataattaaaataagtaattgaggaaaaaatctagatttgattctgatattcctctagaggttcaggtactttcagaaacgccccattgccataggatcaacatgaaactctcacgcaggcattcaaggccctttctcgtcaggcacttcctcccggaagccctcgggtggaagagggcgccctctgccggagcagcgacgccagcacgcccgaggtcccgccctttgcgtatcaacagactccgcccccagccctcgggggctcttggcatcatgtgatctcagcccatttacacctgggtgtcgaaccccgagaaggggagcccagagaccccagaccccaggtgagagcgagtgggtcggtgggttctgggttccctgagcggtgggagactgcctggtcaggctgggaacgtaattgggaatgtctgtcaggcgcggcccgatgtgagcgtgatggacaattaacatgagtgatttagagctgggctttttttcggggaccgaatcccggcgtcttccactttttatctgcgcgtggccttgggcgagccactggatatcagtttcctcgcctgtggctgccagcatgaaatgaaataatgcacagaagtacataattcataaatggtaactgttgcctttaaagctcatacaagcaaatgtgtgaactctcagaagaggggaagactttataaaaggtggctgtag

SEQ ID NO: 35558 - DNA, 1825 bp, Bovine  19866881207733
tggcctttgcttatccctcttcctggtccagcagttggttcaagggtgaacttgtggcacttccctggtggtccagtggctaagattccacattcccaatgcaggggccctgggttcaattcctggtcagggaactagatcccacattgccataactaagagttcaaatgccacaactgaaaaaaaaaaaatcccacatgccacatcaaagacagtagatcctgtgtaccaaaaccgacacctggcaccaccaaataaatttttttaaaaaattgtttttaaagagtgatcttgtgacccatgcagagccaacaagaatgctggatctttgttgaatccatcgggaaagatatgaacctggctttggacgtgacactgggaggctataagtttggatttgctgggggttgccaggtagagagaatgcctgagtgccatgcaaatccaaaggaatcagagctgaagaacagaaagagactgaaacctgcaaactctgagctcttgcctaaacacttgagcagacacgtctaaagtctgtacctcaagcttcaggtacttgaagcaataatgagacaagaattcacattctctctctctccgccttaagacaaccaaaaaatccttacttggcaaatgcatcagtcagggtcccagctgaaagcagatggcacactcaaattagaatcatttgaagagggtttatttactatggtatagacagtgtaaagtggaaatgagtgttagtcactaagtcgtgtctgactctttgcgaccccatggactataacccaccaatctcctctgtccatggaattttccaagcaagaatactggagtgggtagccattcccttctccagggatcttcctgacccagggattgaacctgggtctcctgctttgcacacagattctttaccatttgagccaccagggaagctcagtgtaagagaacctcaatgggaagcacggtgacctgggactagtaataactgaggagttatcactacatataggcctgaagaacagaggagaaaacagtcacctggacccagaggagggcctttggtagaagagcagtggctgtccatcacagagtaccgccagcttgcagagggagccaggggtataaatacctctctctcctcttgcctgtcatccacaggctcctcaatgaacaggcctagcaagaagccagaaggcaaaaagtctgtaggtgtagcaaaaccaggcagacccaaggcaggatgggagatggatacagagaggcagacaggagatggcccaaaagcctcatctggcggtctctcggataaagtcccatgaagaactttggaagctgagttttagttctctcatagttccctgtacagtgctcacctcccttccctggagaagacccccaggttggcacacaggagataggaattctgagcatctgggaagaagagataggaattctgagcatctgggaagaagatgctaaccttgcagagagaaagaacctgccaggccagtggaccacgtggccagagccctggatcctcaggtcctcaccccgccagctcctttgaccccatggaaatctgtctgccagccggtttggccccaatctcaggcaccacaggcagcagcttggtgacttccctttctctccataggagatgtctgcttccttctgcagccaagccagagaagcttctgggattccccaagactggccggggcccaagagggccctgaggacagggctgagctgcatccaagtatcttgttttggccacacagacacctgttccctcttcttcctttacaaaacaactcac

SEQ ID NO: 35559 - DNA, 1691 bp, Bovine  19866881245601
tggcagctgtccctctcacactgtaagttcagggagtgcagagctgtggctctcctgttccccctgggtccccactgagcccagcacagtgctgggcacaggcaatgctcaatttatttagagaaagacagaaagggagagatgaggaaactcctctgcagcatctgaaggcacccagtgacatcagagaagagaaatagatatatttggatcctctcctatgggtctcaaagagccttggtttattcttgagcactgctgggtcaactgccctggggaggagacccagaaaggagaaggggtgaggggtcaccattcatggtgtgtgaggcttaccatctgttatttctttccatcctcatgacaattcagaaaagtagatggcctccctccatttgggaggaaaggagactcaaaagggggaaggcactagttctgggtctctagctagtaagtggcaggcttgggatttagaagccaggcctcttcccaaagatactgcttctgaacagaccatgcaccaagggaggggtatgagggtgtggagggaaaggttgtctaagacttgatttcatggcaggcagaggcagagaaccccaccaccataactagccaaagaggaaaattcccagttattgggggtgggctgagggtggtcagcatccacagacttaggccctgacggggtaaagggagggtctccatatcctgggtcactggagcctccgagctcagcttctttggcctctacctctcgcatctctcctgtgccagcagcacatcccctagcgtagcggaggcgtccagatggcagggagggccagggaacagctgaagatgctgagtaggcctccgtcgcccgccttcccatggccccacggatcatccggtgctgccagcccatctcattggctctctcctggttactcatctctcctcttctccatctttccagcctgtggttgctgtggaaacacagaacagtgacatcactatagggcgagggctggggtgacgctgctcttggcagggactggttcctgctgcctgctagatgttaaatccacatctggatttaccaagggcgacaaaacggggtagggaggacaggaaaagggacagagctcacacactccctccccttgtgccgctttcccccagtgtagtgagcacaagagggcggggaggatgcaggtgatcagagggatgagaagctgcacacacctaggagggagaataaaagttaaggagacagggtatggcttgggagtcaattccagtgagccaggtctgagggtggggcacggggcgggtgaagatggggggtagagcttcgagaataaagggtctggggtttgtctagtttctcaaagcaccgtgctgttcagcttagggcccacgaaaggatgcaaaagacttctgaagatctctagagccccctcctcacagctacagcagtttttaatcctgtctcataaataagaaaactgaggatcagagaagcaaaacaatctgccttgtgtggcccggcaggtcacagcagagctgagagcaggtctcagaagtccagtccagcactaaccatggagataatcattatcctataatgataataacagtagcagcattgaacactgattcagtctaccctgcttagcatttaagagcctcctacacctcggtgtggtaaa

SEQ ID NO: 35560 - DNA, 846 bp, Bovine  19866881263297
gtttcacagttctgggggaggggcggtcggatgctttgcctgataactgggaaacagtcattagatactgaaagaaggacaattaggcctcagcttcaggggcacagagagagagggagggagaagagggcaggggagaggaaaagaaaaaaaaaggggaaggctctctaagcaggaaagaatttcagtgcctggacctggaagcaaacagctgattttgggctccattgcctctctgcctcctgctgtgtcttaataaaaataacaatatgcaacaggtagtgagcgctttcgccctcaccagactctgttctaagggcctaggggctttatctctcaagtctattactctgatgattctgtttgacacaaggaagttgagagttagggaggtgaagtcacttgcctggggcacccagccagtaactggaagttctgcgacatgactgccaaaaacctgtgttctctaccccgtgtgactccgcacttctgaggttgtggctaggtgacccacaaggtggtgggcttggccaggggcctccgcgatgaagctctcagcaaatgcctggaaacaagcttctctccggctcgggtttctactgggaaggaagggacaggatcctctcagcttcttctgaggctccttgtcacctgagacacccttccagagctccctcccccgagcgtctaagcccaggaataaagggcctattcactgggcctctcctagctggcttgggaagtggccaggcagcagccctgcggtcagtccccctcctccagcctggcccctcctctggactcgacacctggtatctctttcttgtgtccctgagcccagggccc

SEQ ID NO: 35561 - DNA, 957 bp, Bovine  19866881275750
gaagattcccctggaggagggcatggcaacccactccagtattcttgtcaggaaaatctgatggacagaggagcctggtgggctacagtccatggggtcgaaaagagtcggacatgactgaagtgactgagcacagcacaggaggaagaaaggtggggagcttggccagatttgtgtggtgctgcatgtggggcttgtgtgtgaatagtgtacatgtgtgtacatcttaggggtgattctcaccctcaactccacgtgtccatgggtatgcatgtgtgcatgagttctctcttctgcaggggcaaagcagagttctccctttctcccagccccactcaccaccccaaccctaacctccatccttgtctgggtctcttaaaaatggggagaaggcagagacctcagcaggaatggtggcggagggcccgggcccggttgtcccctcttgtccagaccctccccgggtctgggcagatagtttccagcggggagggggcgcgaaagtggcagcaaggactggaggggccagacacacccaggtggacagggacaggctgcggggaacttggggacgctccaggagccgacgtgagggtgacccctccagctgctggggatttctctgttaatctgggactgctccgtttgcatctcatttgcctatatttgcataacaaggacctggctggcaccagaaattgaaattcctagcctgggtaattatgtgaaaaagtctctggagaccagcaggaatcctggggccagggaaacagaggcaggaagctggatgtgtcgatgtactggtacccattcaatcccagagcctccattccttccctaatccctgcagcaggaggggcggggatgtcaatgagaatggggtgggagggataacaaggttaagaatcaagtcacccttgagagccccagcacccagacagagcgggcacagccttc

SEQ ID NO: 35562 - DNA, 974 bp, Bovine  19866881288003
tgaatgagtcagctggcccaggctcacctggctggaccagtcgaagctggtgcccagggcggccaggacacgcagcatccaggggctgctgttgcacttcccccgcgtagaagggtgagacccgcggcagggcctggcggaagacctggtggcggctggccagcacgtccaggcggccaccatgaaagcatctcggcagtcctgccaggacagtgaaagagaaagagaaggctgggtagtgggttatctcacctgatcctcaaaacaacactatgcagtaagtgctattgctgttgtcatttcagatatgggggaaaaaaggttcagaaagaagtcactggctcaaggtcacagagaaagtactggctaggatagaagataccagatcttctaactcttttttccagtagtcgtgtatggatgtaagagttggaccataaagaaggctgagagccaaagaactgatacttctgtggtgctggagaatactcttgagagtcccttgaactgcaaggagattaaagcagttaatcctaaaggaaatcaaccctgaatattcattggaaggactgatgctgaagccctaatactttggctacttgatgcgaagagccagctcactggaaaggaccctgatgctgggaaagattgaaagccaaaggagaagggggtggcagagaacgtgatggttggacagcatcaccagctcaatggacacgaatctgagcgaactctgggagccagtgaaggacaaggaagcccggtgtgctactgtccataggtcacaaagaattggacatgacttagcaactgaacaaccacaacttctaactcttaaaatagagggacaagagggaaacaatctttgtagatcaagaaaggggaaagacagctccaatcctcaaccaggcagcttggcactgggtaaaacccccaagcggggcatgggagggagctagaagggaacagaacga

SEQ ID NO: 35563 - DNA, 1122 bp, Bovine  19866881296611
aacctttctgctgaggaccctcaaagactatctaagctacctctgaaaccaccgatgggccgatatcccaaaatgaaataccactggactcagaaggcctcctttctgaagaacaaaagatggccttggcagcccccacccattatgctagacagtctgagactggaaactggaactgcaccttctaccaccacttcttgaggtcacttagtgacctttcctaatattctcctgatttgcataaaaactgatagcactgaaataatgataacaacagccaatgtctgatggatatcagtaagccagacactgttttgtgttcacaaacatggtctccatcttgagaataaatccaaaaactgttattgtccccatttaacatctgagatgagagaggcacagggaggttaaggcactttcccaaagacagccagcatgtaaatgcaagagtcgagactctcacccagggaggctgacctgggagcccacgctcttggccccagcctctgtgatggagagacccggctcccagcccccaaggttcctacaagaaatcccacacaccgaggggcctggtttcaggttgggcagagacaggccgggctctcacctggatcttgggcagaatggcaacgatggagacacagacacagagagtgaggttgaggccaatgaaaaccttgccctcgtagcaggcaccgggctgggtgtagtagacgaacagcagcgccacggccgtgatcgacagcgcgtagaagaggagggtgaagaagaagaggcctgggagggaagggcagcagcaggtgggtctggaggcacaaggacccccgtccctcatcgggcagtcatctggtctcgggtcccagcttcctcctccaaggagtgcctgctaaacttctgtcctcatccagtctttgtaagcacccaccccaccctgaactaaaatgattcacgtgccacaaataaagtcaccataagtataaagacaatgaatagagaacagtctttcaaagcgtgaactagatgagtggtgatcagggaggtgggacaaccaaaccaaccccaagtgagcctttcttctcgaccgattcagaaaatcgatctgaagaaggacccattctg

SEQ ID NO: 35564 - DNA, 590 bp, Bovine  19866881306820
cccccccatcccccaggggctccctaggcccccaggaaaatgtttcagctccccagaatggtgttcccagtctggccctacctacgtcttagaactcagctcctcccaccgccctgtgctctggcccaaatagtttctccactagtcatgagctcacatcacccattctagcatccaagcctttgttcatgttaattactgtccccctccccatgtcttccctcctccctgcctccccaaatcttccccacctcctcagtgaaggaggccttgcctgcctctgctcctgccacccccaacccccctccacacatcccgccttgtcagcccactttctctcctttcctctataaccttcacttagcaaaggtctgagcaaacctcgtcctcagcacaaacagttgttcaaagatctttaaaggagaactgtaggctttggcttaggtcagggaggagagccggcttccaccctgcaggggctctgagggggccaggccagcagagcagcctcctttgcagctatcttgactcggccaatggagtttgttgttattgctccaaattaggcaccaatttgcccgtgtaattgt

SEQ ID NO: 35565 - DNA, 2399 bp, Bovine  19866881353639
aactgtttgtcttgtattagtgcttttaaactggcttttgaatcctgggagggttctgcaggggctcactcacaagcttgcgagggagggcttgcgagcctgcctcattgaggctccagaatcgccacctccaaccacagcagctttctcttgtgagtttttggatttgtatttatccaaaggttctttagctaaaatttaacaaaagctgtatacatttcttgtaatctgcggaacaattcagtgaggaagggattattatgtattttgcttgtgagagaacaggcttagagagattaagccactggcacatggtcatggagtcagctgatgggagcagagtatggaactgagattggcctgtggcttcattatctgtgaaggaggcttgccatgagctctgggcagcttccagggcagaagagcgtccacgatgctgagtggggaaggacctgccacccaccctccctcaagaagcttctcttccttgagcaggcagtccctctttagatcaagtgtgaatttggccttggccttgaaggtaagtgtccaggaagccatcaaacacaattaaaagagaaagtccaagttcacactggcggttggtctaggacttgtctggatggcagcatcctcaatttttggagctaggcccagttgccctctgtgcccttgacctcagcccacctgccgaggccttggctgtcctccactcagcctttggctgtcctccactcggcctttggccagcctccactcggcctttggccggcctgttagggagatggagcctaacgctctgagtctcagggatccctggctagtggcgtagggacacgaacaagagcgggagtgctcccacgcaggctctactgtacccatggcccgggcttagcagccaggaaacctgcattctggccccagcccttccacacggttttgtgtgatttttctggacttgagtttccttctccataggggagcgctaatactaatagttaatgtgtattgagtgctttgtactagggtctctgtccgaactcttcacgtgataggcctcatttcattctcatactaattggtaggccggcactttaaaagcaaagaatattgaggtttagagaggctaagtcattggaccagttaggaaatggcagaaccccaacttgaactggtctttttcactcctagccgttgtcctgtaatgctttaggaatagggtcttgcctgcctgtctcacagagccgtgggtgagtccggggaaatgtttttgcatcatgagctagagtccagtaaggaagatgtgctctgggtgaatccatgcaccgtgcaccattggtgactgggagggtcaggggcattactggagatcgcgtttggctgggaattctgcaagtagaggtgggggtaccatggagtgtggattttgaattcagtttgattcatttgcctgctcactgatacagtcaatactcacggagcatccattctgccctgggggtggggataaagtggcaaaccagtcaggataccagcccttgtggagccccttagtgggcagggaagggcaggtttccagggcagccaggagagcaggtttccagccctgcctctgcaggtcatgggcagtgtgactgggtaagctgaatgtcttctggacgccgcaggttccccatctgaaccatgggatcatgagtccagcccagcctgtaggatcagttaaaagaaaggccatggcagggctttgtaactgtagcctgccgtgccgtggctagtttctggccctgtccttctgaccgatgtcttctcttcttgcagggctgcccaggagctgggggacaagcacccggagcccctccgggtagctactaccctggaccccccccacggtggagggcagtatgggagcggggtaccccctggtggcggatatggaggaggtcctgcccctggagggccttacggaccaccagctggtggaggaccctatggacaccccccaccctggggggctcccttctggaactccaggaggaccctatggtggcgcagccccagggggcccctatggtacaccacctccaaattccttcggtgccggaccttatggacagggaccacctcctccaggtaagtaggggtcttggactccagctgccttgagccttgttccgagttatccagggccctgtatgcccttcttgtgaatgcacaggcagcctgctctctggcttctaagcatcttgtctctagctttgcttgcattagcagaatgagaagtctgttaattagctttgctgtggtgacaacaattctgaaatctctggcttacagcaacaaacgtttatttctgttcctcgctcacactatttactctgctacacgtcgacagctgcagg

SEQ ID NO: 35566 - DNA, 1020 bp, Bovine  19866881398165
cttggctgtcttcctccgagcccgcatctgcttcacctcggccggaaggcgcgggcccgaggctggggctctgcacccaggccttgcccctgctcctccagctggactgagggccgcttccagttcctgaccagggctgacgtggtgccagggatctgtccagcacacagacagcagttgtgggtagcaccttgggaggggtgttctgctttgctgggctggactctggggcagggcagaagtgagcaagggaccaaacccttgcagtaggaaggaactaataatcatgataaagaccaatatcctggacttgagtatacttccgtttttccattagctcattgtgagccctcccacaatatacctcttgggaacatgttattggcctttagttatagatgaggtaggggacgctcgacaagtccccaggtcacagcctggggcctgaacatcctcctagctacccatccatcttcctcagtggtgagttgtgccttcccctggcccatgcctgactcgaggaggcccgagcaaggggtgaacaggtgggcagcatggaatggcctgggcctcagagcacaggtcccagcctaggtcggtgcctgtaggcctctgatgattctgggctcctggagcagcacagataccttcacagcctctcccacactagacacctgaatcaccctacagcagaagggcatggggctagagttcaggaaacctggggtctagggccggctcagccgttcatgagctgtgtgaccttggtatgtgactcacttttcttttctgagccttcgtgtttcctgttggtcagacaggactgagcaactttcactttgcacaatgtttgagaatctatatcagaactggagaagggaaaggctacccactcaagtattctggcctggagaattccagggactgtacagtccatggggtcacaaagagtcgaacacaactgagtgactttctctcactctgcacttgttcctgttgactgggggactgtgaggagca

SEQ ID NO: 35567 - DNA, 931 bp, Bovine  19866881416473
tgggggtcatgctcttctgtagagcatcaataggagcttctaaaatggtgtgcgctctaccttgcacacctgctctgtgggaccagtgcccctggtggccagcctcctccttaccatggagccgggcaccccgggcaatccggggctccccgcaggccccggagatccagggtggcctctctctcctgcaggacccggtggccccgcaggtcccatggagccactcttgccgggcccgccaaggcatgccagctcttcccttctctcctgcctggcccttctgtcctgaaggccccgggtcaccctagaggacaggaagtctcacagtccaacattgccaagagccgtcaagtttatctcacagtgtctcaagggtctgccccggcttcagtgccacacgcagcccccagcatctccctctggatcacagcatcttgacaggctgccccgtgtctctgcccccaaagcagtccttttaaaggatggttttcatgttcttactccctgctgagaaatttccatgtctcccagttgccctcagcataaaggtttaattcctcggccgggcattccaggccatcatgatggggtcccgactatgtcttctccagcctcgttttcctgcccgggtgcttccagccacgccttgctggttatagttctgactcagccatgtgtcttcgtcctcccggcctggaatgccttccctctccccagtgtcctcctcccactcggctgtaaggtccctgttctctgtgcaacctccccgacgccccaggctgagtggatcgctccctccctctgattccatagcactgcatctaaaacccaacaggctccagtgttagtgtgactggactaagtgggcaccgggcccaaggctaggagagagggccggcaggtgagtaaagccaagcggatgctcgcagaa

SEQ ID NO: 35568 - DNA, 794 bp, Bovine  19866881555919
cagttcagctgcaggaacggaatgtacatcccaaacctactggggaggacagtggtcagggcaggcctggccatgggccaggatccccaaccccttaaccacccagggaatcttctttcctccttgggctttagctctcctggctgctccgaggggagattctaccagtccttaaagctatccagcctcccagccagtgatcagtcattcaacacctgtgttagccccgcgcacggaacaagccctgtatggagtggcgggaatacggtaggagacaagacccgagtctcagccctccgagtctactgctgtgcagcagaagtcataacaccacacattccctcggcacatcctgtgctccagatgctgcactaagtgctttacatgcactctcttctgtttctcctaactctgtgttaggtactgttattttgtgcccttttcagcagaggaagctgtggttcagagaggtggaggaggggctctggaaaagtcacacagttagtaaggaagttatagaactgggattcaaatccggaactggctggtacccgaaatcaagacagacactcaagaaacactaaaagcaattcattaattaaaaatgtacatgcttccacaaaagagaggtagatgtggccaagagtgcctataagggcagctcttaagtttacagagagggacagttcaggaacaatatttgctgtgtgtctattatgtactaggcactgaaatagacccttaaacagtataaaccccttcctctgaggcttaagtaaccttaagttaaggga

SEQ ID NO: 35569 - DNA, 3470 bp, Bovine  19866880282727
atatatataatggaatattactcagccataaacaagaatgaaataatgccattagcaatgacatggacagacctagagattatcatactgagtaaagtaagcaaacacacaaagacaaatatcagatgatgtcactcatatgcagaatctaagagaacaaatgaacttatctataaaactaaaactgagtcacagatctagaaaacaaatttatggtaatgaggaagtaaggggtggggaagggataaactggtagactgggactgacatatacatactactatatatgaaatatgtaactaataagaacctcctattagctcaagaaaccctactcaatactttgtaacagcctatatgggaaaagaatctaaaaaacagtggagatatatatatatatatatatatgtatatattactcactttgctgtacagcagaaactaacacaacattgtaaatcaattatactccaataaaataaaaaacctcacacattctcaagtctcaccccatactactgaataataaaatctgtggctgggacccaggaatctgttttaataagccctccaggtaattctgacatgtgctcaagtttgacaaccagtgccctggtaatatagccccttgtgttatatatatattggaaaactgatgttcagagaaggatttaaaagacttgagagacaagaaacatttttccaccatttattcccacagtgtctggcatgtaatatgggcatacaataaagatttgttggaggaaaaaatgaatgcctcctccaaagagttgtgctatcacctaatgatggtgctagtccaaacaatataaacctaacttaccagaaatatacatattcctaatgagtgtgtttctttgaaaagatatgttcaccatgacatcaagaattataattttttttaaattttattttatttttaaactttacatatttgtattagttttgccaaatatcaaaatgaatccatcacaggtatacatgtgttccccatcctgaaccctcctccctcctccctccccataccaataatttaaaaactattacttttgagtgttgcgtaaaaaaggaagttaccaaaggtgaccactaacaaaactattccgtttttccataccttgttattttgccgtagtttacttaactctagtttatacttttctgcttcttctagagctctatttaagcgaacttccatggcactttgactagcaacagcctgtttttgtagtcttcttttattctctaattcctgtacagcaaaagagacagataaaacatttataaacataagttctctctgatattttcaatattttccatttctatattcctcgctttctcctaaattatacacagacacatacacagccagagactgaacactgaatgatagaggtttcagggaattcccacgctgaattggttttaggaaaatatatccttaaagatatagtcacaaatcaggctttcagattgctttttgtttggaattttctgcctctttttactgatcccaagatatagtatacatttcttctgtatttactttataaacaactttttataaccatagttctcttggaaacctcccaaaacaccaatttaagacataaattctctcattaatattgtgcttgtgtaaacccgataaaatatatcatttaagaaatatctgttaaatacagaacattctacattagccagataagaaaaccccaattctgagcaaaaacaacagattttaaggatatttttcacatcctggtgtgggtttagacctgcacttcttcaaacagactaagagctgctgttgaagaatctacaggccacacaggaagaaacatgaacatatagaataaactccaaattccatcccaatctggcaccataatctcatctactcctacaaatgtcccttcagctctatgggcagtacttgcttggatctctcctgaagagtcatgatgtttcttgcctctgaccttttgctcatgctcttccttctcccctgatttctctccacccctcatttttaactggctaacacctattcatcctttaaccctcagttagggctatacactagggttttaccttctcccaggagcctttcctcactatcttctcaggctggatgaagtaccctttctttagagattctatggcacattgatacatatatcatagtgcctgcttgtgtggaactgatctccatttacttaatttccctcactatcctgtaagctccttgaagataggaagtactttaatttctatgttcctagcacttcggtggcaaataaaaagcactaataccatgtttactgaactgaatttattttgtaatacttaactcactctactttgcatgccctacaatgtctagtacatcgcattatacaaagcagataataaatatcatggaattgaaatgatgcagttaataacagagttgtctgttttcttctaattttttctcctggctatatcactatgttttatttgaaaactgatctccttggctctgagtaattaaggggaaaacaaaacaaaacacatgctgctctttatgcaggtttctaaacaaatcaaactgtgtctggataccatctgctctcaccagccttcttcacagctttgtgggtggtagcgacactaagagcagcctgacttctctcactgttcacatggaaaaggcagattctcattagctaccaaggccacagttcttgctgcttcatttcagcctcttctcataagaatacagaaatcaatctttgcccttctctttcttgctagagactctgtaacctactccacagaaaaatgaaaacccttctttactacatgatggtcccctatcaataaatcaatactaaatcaatactgccccatttcttgggaaaagtgaaaaagaaaaaggatacaagaatagtaaagtaggaaataaagttttcctatatgagaaaatccactaagcaaagggttaatcttatcaaaaacttgaaaagctttctgttttcagctatgcttaagtactttttacaaaagaaagtacagacaagataccaattttattattgagtatttttaagatgaaaactctctcctacaacaagtttattattaccctataaattaagaagtttacatgttgctagagaaaaattttataaaatcacaagtcctgaagtttatactaactttaaaaggaaaagctggatagcttatagaaaatcaagtctaactttaaaactcaaatactaagatatccaagaagaaataatttgtgattgttccataatttttaatgcattcataaggcactgggagagtacaaaaaagaggtatatactggtaaccaagtgaaatgaaagtcactcagttaggtcccactctttgggactccaggactataaagtccatgcaattctctaggccagaat

SEQ ID NO: 35570 - DNA, 1331 bp, Bovine  19866880351270
agataagattcccatttggatcctctaaatgaaattgtcatcttcaaaagatgggtgtgaattttagactctgtcctctggcttttctgtaacttttgctttctatttatcaaaaaaatcatatatgaaatgaggaactggagcaatatacaacaaaatgtctgaatgccattaagtttctatggaaatggcactgttttatgaagaagactagttctttgttttacttcaagaatttaggccttccagaaggtgaaccagccctccaggatggaccataactttagatcatgaggctctgagtgaccatgctttctcagcacactgtggagggactgtataaaggaacaaaatgagaaatatttagtccttgtgtatcaggctgacattttagcctattaaataattcttcaaaccctttaataataccaatctttctactcactataaagcaaatcacattgtgggtaaattaaattgcacagaagcaggcctgtaaattaagagagaacttttctttccctgcacaaaggctgatttagatagcatgggatcattagtgaccaaacagatgcccctcatctataacccagagacagctctcagctgtacagagaacctttcttttcctacagagaggtgaactcaaaacttgtcactgatttttgcaccctcttaatcttcctgtttattctgtgcttcattaaagtcaatctccatggggcagactgtcatccgagctcagcctgccctgctgtctgctctctccagagagcatccttcatcctgataaacgggctgtgagctgaacacgtgactgagctccttaaagtaaacagattacagaaagcaaccccttccacactcactcagcagaactggataagtaggagctctgacgtggtcatcgtggtggagacaatgctttcccgatagatggggtttcagatttactgttataaaatgatacagaggatatttatctttatcactgtgtcatcccatacctttaaggctgcattagctaatgtcattcattggccaaatgtttccctcaggatttggcattgttataggatgtctgctgaagccaagctctgtgctaggcatcgcaggcacgaatatacatagaggaagagaccgtgatgactgcaatgggaaacacagtgaagctctgtgggaagccagaaggcatgccaccatcacaagaccagccgtgttgtaagcttagcgtctgcctgtttgttggactcacagaccatattatcccggagcaagtgttttatctgcatgaaaaggcaacactggagcccacgacggttttcaggcag

SEQ ID NO: 35571 - DNA, 1610 bp, Bovine  19866880432515
aactccctaaaaggggagacaccttggtcaagactgtgaacagagaaggatgcaaaagtggcagagaggtcattaagcaataagaaacaaagcagcaatttaaggtagtctgtgccagttcttatacctgggcggaggaactctctaacaaggccatgagtgactattaactgagtaacagccaatatctgaccacttagtccttgaaggcatcttgaggcatgaaggtaattttttctttcacttgccttcattcttaatgattagcctcagaaagcttggataggttagtaaacgtaacaaatgcataaatgaattattcctcatttatgactaattagcagcagcagcataataatcattacacatgtaaatcaataagattttcacagaatcagaatattaaacataaacttcatgatcatctaatattaatacaaactgctaaattttcaagtgaagacattgctattatagagggactaagcagtatccctgaacccagttaattatagttcaacattaactatgttcatataaactcaactgtattgttttttatgtaaatagaataggtggcacgtcataaattcaacaattttagaggcactaccggtaactaacataatgtttttgatgactcagactaagtatttttctagtggtatgcagagaatgagtttgtaagaaagaaatcagtatcagggctagtgcactgggacgacccagagggatggtatggggagggaggagggaggagggttcaggatggggaacacatgtatacctgtggtggattcattttgatatttggcaaaactaatacaattatgtaaagtttaaaaattaaataaaatttaaaaacaaaacaaaaaaaataaataaaagcataaaaaaataatattcattagaaaattcattattttacttgatgctaatcaataattcatttatcctttaacacatgttaatctaatacacaataaagagaattcagtaacatcaaatgaaaggaattcaaagagacatttttaaaaaattatttcaatgttttaataataagctatggggcatttatttaactttagttgaaaatgggtcaatgaaactaatcctagatagttctttttagttttactttttataatagaaaatatcaaacatatataaaagtagtgagactggttcagtgaaactctgcttacccatcatccatttttaacaattacaaacttaaaagcaattttatttcatctatcaaacaaatgcaaaacatcacaatacattttctaaatacaagaaaaattgttctcagtgttgcttttttaagcaattgtgatagaagaataaatataaacaaaaaacctacctgttccaatgtcttcactaacaccagaaaaaatatcatcatttataaaatcaggtaagccttcttcctctagttgcccttcaatcttgctaattgtttttgcaagagaaaagtctgagaaatcctctggaatggcaacatcactggcagtctgcacatgagagtatttcaattttacactaaaaaaaaaaaaagaaatatatatatgtgtgtgtgtgtgtgtgtgtatatatatatatat

SEQ ID NO: 35572 - DNA, 1211 bp, Bovine  19866880444185
gctggtctgcaagctgtctccactcaacaggtctttaacagtgctgctgaaatctaactgttgctctccaatttctgattgtgcttgattatccccaggagaaaaactgatctgatcggtgctattacttttggtgaggtaagatggtgcttggaattcataaatagaagtgctggaatcaatcatattctgcggattggcactcggaaagacagtggacgtttccaaaatctgagtgagattcatccgggcggtgtaattggagggcagattgttcatgcccaaacctctcacagcatcatcattgtcagaatcaagtttactcaacaaaacattggttattttcttactgttcgtttgcttttgaagagcgtttgggaaggctgtttgcatcatgactgtcaatggaactgattgacttctttgagctatgttgttggcacatgcatctgtgtggacatttgtgaaaacatgaacttcgggggttactggacttccaaagggggtcacgttggatcgggggatattagatactgggtagagggtgcttccactaagattacgctggcgatgaacagcagggctcacactccggcacctgaaagttgctgctggcagatgaattagttcctttattatcaagaggggcagggaccgcaaaaccctcctgtttattggtgttatttacagtggcaccttgatgctgcacaggagagacaggagtcaaacgacaaaaatgactgtcatgatgtctggattgagactgataagactgcccaggcacagcgaaaagcgtgaggttttcctgaaacggtcttccactagttcctgatagcttgggagaatgccatggccagaaacagatgaattaccaaccccactatacccattattcatccattcaagcttggttttgtcagggtgtgtggccatgggtctttgcattggtttcacaggactacttgagacaatgctggcatcatgatacgccatactggagcttattggggtaaatgcaaaaggattcctgcattccacggggctgggagggacactactgctgcagttagagtgtggcgtaccgatgggtgtatgtcggctacttcccaaagcactatccacaggtgttgtctgggccagcctggagcaagggctctcccgtgacagactctgcgacccagcaatcatttcagatgtgggggtcggggttg

SEQ ID NO: 35573 - DNA, 1085 bp, Bovine  19866880596399
atattttaagaaaggcaaattttgaaagttgaattaataattatgttttgatttattgtgagaacaataggggaaaggagcattcaccttatatttttaaagtatgagtaagttgtataggccgcaggctgaagtgtttaataatgtagtggagtgctcttttggtaaatcatgtgatttaattattctttaattgataatttatatttatacatctattacaacttaaccgctgattttaatgtgaggaaaacttctaaagtacaatgtacttcagtttttggtacttactctgaaaaaacaaaatgacaacaaacaccttaatccccaaatgtacacttttataacttcattttaaaattgtactggcacactagcatttaattttcagctttagaaatcctatttgcaaaattatttatttatatttaaaactttaaacattcgtggatcataaacagtgttagtggctgtatttatgtatagcctcatagcccctcctccacaacactggatgtatgttattcattaagtgactatataaaataaagacattacaaagtgaaagctctttcactcccatctcctcctaagaaatagtatgtgcatgtgtatatgtataaaattaaaatgacttaatagataagattgcagttatttagatatctcatttcacattttttgaagcaacagtatctttttaccaattattttatcacttgataatgttctgaaagatgatcagttttggactatgtcctatatcaacctttggtatcatcactaatgagactttaaaattacattatacagaagtgtggtacttaataattatcaaatgagctttgcatttaggttgatcatagtttctaaattattggacttcatgtcacaaacaagtctgaacttgtcctcatattttacagatacatagtatgtaatgtaggcctttagctagacagtgaattgtttattatctgttcataattaatctattctgttcattaaagtaaaatactgttagataacagtatgtccatggttatttcaagcattaaatgagtgtttggaaaaaatattgagta

SEQ ID NO: 35574 - DNA, 3031 bp, Bovine  19866880612960
ataagcgtcttttaatttcctggctgcaatcccatctgcagtgattttggagccttaaaaagtaaagtctgtccctgtttccactgtttctccatgtattggtcatgaagtggtgggaccagatgccatgatctcagtttctgaatgttgaattttaagccaacttttctactctcctctttcacttttatgaagaggctttttttttttttacttaaatttatttattttaattggaggctaattactttacaatattgtattggttttgccatacatctacatgaatccaccacaggtatacacatgttccccattctgaacccccctcccacctccctccccagtaccatccctctgggtcatcctagtgcaccagccccaagcatcctgtatcgtgcatcaaacctggactggtgattcgtttcttatgtgatattatacatgtttcaatgccattctcccaaatcatcacaccctctccctctcccacagagtccaaaggactgttctatacatctgtgtctctttacctcagtctgtataatacaagaggctctttagttcttctttgctttgtgccataaggatggtatcatctgcatatttgaggttattgatatttctcccagcaatcttgattccagcttttgcttcatccagcccagcatctctcatgatgtactttgcatataaattaaataagcagagtgacttcagcaagttgtaatctttttgctggcggaatgtcttgcctctgtgttgatagctactgactgaccacagtcatggttgctgaaggctgggatggctctagaaatgtattaaaataagaaagcaataaagtttgctgtgttgattcactccttctttcaggaatgatttctctgtagcagacagtgctgtttgatagcattttacccccagtagaatgtctttgaaaagtagagtcaatcctcttaaaccctgccgctgcttcatcaactaattttatgtaatattttaaatcctttgttgtcgtttcaacagtattcacagcatctttaccagaataagattccatctcaagagaccagtttctttgttcatccataacaagcagctcctcatcccttaaagttttaggatgagatttcagcaaatcggtcacatattcatgcttcacttctacttctgattcttttgttaatttccaccacatctgcgttacttcctctattagagtcatccatgagtgtcagatcaggttcttctaaacccctcttaacattagtagtttgacttcttccataaatcatgggtgttcttcatggcatgtggaatgggaaattctttccacaaggttttcagtttactttgttcagacccatcagagaaatcactatcgatggcaacaatagttttacagtgcccttcttaaataatagactgaaaaatggaaactacttgatctgtgggctacacaatggatgctgttttatcaggcacgaaaacaatagtaatcttgttgtacacctccatcagaacttgggtgaacaggtgtattgtcagcaaacagtaatattttgaaaggggtttcttttcctgagcagtgattctaaacaggcttgaaattttcagtaagtcatattgtcaacagatgggttgtcaccaaggcttagttgttccattgacacatgataggcagagtaaattagcataattattaagggccctaggattttccaaatgacaaatgagcattgatttcagctaaatgtcaccagctgtattagtctataattagagaattagtctgtcctttgaaactttgaagccaggcattgacttctttctagctatgaaagtcttgggtggctgggcgcctgggcccccgccccctgacgtcgggtcgctgctgtttcttgggctctgtgcaggttgctacttagccaggtcttgtgcctgtagctgctttcgccatctgctccatggctttcgtgaccaggcagttcgtgcgctccatgtcctcctcctccagcgcctcggcctcggcgaaaaaaatcctcgtcaagcacgtgactgtcatcggcggtgggctgatgggcgccggcattgcccaggttgctgcagcaactggccacacagtagtgttggtggaccaaacagaggacatcctggaaaaatctagaaagggaattgaggaaagtcttcggaaagtggccaagaagaagtttgcagaaaaccccaagggcactgatgagtttgtggcgaagaccctgagcagcatatcgaccagcacggatgcagcatctgtggtccacagcacagacttggtggtggccatcgtagagaatctgcagatgaagaacgagctgttcaagaggctggacaagtttgccgccgaacacacaatctttgccagcaacacttcctctttgcagatcacaagcctagccaattccaccaccagacaggaccgattcgccgggctccatttcttcaacccagtgcctttgatgaagcttgtggaggtcattaaaacaccaatgaccagccagaagacatttgaatctctgctagacttcagcagagccctggggaagcatcctgttgcttgcaaggacacgcctgggtttatcgtgaaccgtcttctggtgccgtacctcatggaagcggtcaggctgtgtgagcgaggtgaagcatcgaaggaggacatcgacacggtgatgaagctgggcgccggctaccccatgggtccgtttgagcttctcgattatgttgggctggatactacgaagttcatcctagatggttggcatgaaatggactcaaagaaccccctgtttcagccctgcccatccctgaataagctggtagcagagaaaaagtttggcaagaaatctggagaaggattttacaaatacaagtgagcagcttccctggctcaaggacgaagccccgtaagcacataccagcagctccccaagtgcccacgcgaatggtcttggtcagatgttccctcccacagcacgatctgttcgatgtacgt

SEQ ID NO: 35575 - DNA, 1992 bp, Bovine  19866880709194
tatagtgttacctgaagactaatgatatctgcgtcacagttaacaatttcttccataattccctttttcctgtattcccagtttaatgcccaggatgggcaatagccatatagctgccgggtggcatatttatcacataacacattgtaacacataaccgtgaatgatgctaagaagtgggagaaaaaaacaaaacaaaagggagaaaattaggcaaccttttctaaagcaatatcacatgtacacctacacgatcatacatgccatacaaacacaactcaaatatcaccactgtgaaacgccttgggcaagattctgttaaactatataaaaacttcaccagagtccatccaccttaccaaagttcttttaccagaatcagacttatagctcatatttgagattttttaaaggatattttaataaataaaaattcaagtttcagggaattcgctggttgctcagtggttaggactctgcacttccactgctgggagcacaggttcaatccctggtcaggtaactaagatcctgccagtcatgcggtgtggccaaaaataatctaattttaaatcaatactaacttttttacacataatttgctgagcaaaacttttctctataaatggcataaaagtaaattacaaaagtaaattttaacttttttatctttaaaaggctttcattacctttcattaacaaaattttcacacttagtacttctttgagtctcttacttctctcactgctctgagccagaagaatacagactaacaaagtttagttataacagaaacctttttaaccaaatcaaacgctcatttttaaaattaaattctcattttaaaattcccttgaactgtaaaaggactgtgtgcatgctcagttgctaagtcatgtccaactctttgcgaccctatggactgtagcccaccaggctcctctgtccgtgggattttcaggcaagaatactgcagtgggttgccattcctactgcagaggatcgtcctgacccacggatcaaacccgcatctcctgcattggcaggtgggttctttaccactgaggcaccaaggaagccagtaaaaagactacaagtaaactaacaagaaaacagtttgtatcccctgctactcaaaagtgtgctctaggaaccagcagcatcagttatcaccttggaactcagaaatgcaaagatttttggcttcacaaagacttactgaattggaatctgcaatttaacaaaatcctaaggtgactctatgcagaagcacaccagtttgaaaatccctgatttttatcactaattctctatcctatctattcattagaatcacattatagaactttttttaaaaaaaaagttcatcactccagactaatttagtatgttaggattggggcattaatatttttaaaaagcatcccaggtaattacaatgggcagacatgggtgagaatcaaatacttaataaatggtaaggaatacaagaaatgaagtaacgctcaactgaagttgattcagagtcagatgataggaaggtattatgagaaacttagttcagaggtctcctggggatctgactggtggtcattatgtatactggtacctttttcaccatctaggattaattcttaagtttaattaccattatagttttggggctataaatcacccttttaacaactgaacgtccctaaaattaagtatcagcatttggttacttcatattaaaacagtaaaattttcatcttcaaaataaaattaggtatcataaaaactgtgactttagtaacaacttattttaagcagaattctgaactataaaatgtctaataaacagtacgaagccctataaatgtcaaattatcattggtctgaacaaaaagataaaggtttatattttctgcatttactgaagttcaagaaatgctgaatcctgttattaaactgctcaaatcttcaccctataccatttctatacccctggc

SEQ ID NO: 35576 - DNA, 1623 bp, Bovine  19866880709707
tgtttaagttagcttacccaattttaaagaaaaaccgtgaaagtatatcttttagccacacaaaaggcagtcaaatttaatttaaaaacattaaaaagaccattttttcaaaagtatcaacaacaacaaactataatattaccacaaaatcaattctttaaagaatatttttatatatatttctaggtcaattatttgtttcaggttaattatttcattaaacgtaaaatacatttgcaaggtacatgtaattcaattagcaaactactaatacgttttttcacagtatcacttaattgctttttttaggagacaaaataattgaatggattataatctcttaacaattagtgttttaaaagttttgcaaacggaattaataattctaaaacatacattggaatgtgaaatgtgatttttattcatcctcagtaaagtagttgcttatattaacatctgggcattggtaataagaattattatattcatcagatttcaaaagagagaaaacaaactagcaaatatttaatattttatttgcccagaaattttaaaaaacactttaattttgatagtaagtgttatataaacacagataagcagataagtttctttgcctcaaactattatgtactgtcatctagaattggtttagtcagaaatactttttttaaaatttcctaaaatctggcaagatcttccaaacacagaaattttaaaaatctattcaagttcaaaacacttaaaatactttggaatggccaaattacacaaaaaattgttttggttaagattcactggagttaaattactactataataaagcaaaattacccaaataacaaattaataagataactaggaaatgcctagcaattgaaaccataaaaatataaaatttagagttcaatattattgaaggaatgagttacattttagaaggcattcttaactggtagctaaagaaaaacagggtggaacaaaattcctgtggttaagggtatatacaaatgcaaataccatttatttttcctctgctttaaacattcagtataatagtttttatcaatgatcaaataaatatatgtatttcaaagaaatattttctctatgttcacttataagaaaagtttcacatttaagtagactttttactgtttaatactttaagtggctttcgatattttacttttttcataaagcttaaagagggcttaaaagggctttttttcaaaatgcttaatgcttaaagcatttataatgctttaaaataaatactaaatgagcatttttgaaaataagaatgaaatacggagttagactttaaaacaccatgccactcaaggggaaaatatactaaggcaaaatattataaaacaaattattagttaaagcctgttcttatgctacagaatgttttatggcttaaatcactttggaaaggttttttttttttaatgcatattttgtatgctgataaaataataaatagagtgaaaaactattaggcattttttagattcataaatatcaagttcatgactacaaagtacttgctagctaaggaccaaaaaaatatataaagcagccaagttataataaattttaccaaaatttcacaga

SEQ ID NO: 35577 - DNA, 1581 bp, Bovine  19866880765262
atggactgcgtcacgccgggcttccctgtctatcaccaactcccggagtttactcaaactcacgtccatagagtcggtgatgctgcccaaccatctcatcctctgtcgtccccttctcctaccttcagtttttcccagcatcagggtcttttttccagtgagtcagttcttcgcatcaggtagcctcagtattggaatctgattgtttgctgtatgcttttctatctaggatgtgaaagggcaaagcattatctaggccatttgcaacattaggtctgtaatattgcttttcaaagttttcatactcaaagtttctgaaaaaccacctgtataaagatatgcttatgtaaatgggatgattgacacgcaaggtctgcttacctacttgggaataaacaagatttttgccaaaaattcttcagagtggtttcctagaatgtatttgacatctgaatcaaacttcagttccaagattccttttggatatcttcttgcaaagattgaactataggggagaagcctcataagcttttgggcaagattttcaactgcagtagtgggaacttatcaccttagttcattaaacaaactagatagtacttgaggttccccctaaacttgaagacacttttaataactttgctttgagaacttctctctttgttgagaacttcacttcttcaactcaagaaaatgaagacttttaagcctaataaatagggatgttgataattgtcactggaagtttcaggtcagatgctcagatatgtctgccacatatatcaagctctattaaaaattgtaatgtttattgttgttaaatatatgtaacataaagtttctcattagtactatttagcatattcacagtgttatgtaaacgtcacctctacccagttctgaagcattttcatcaccccaaggaaacccactaagcaatcagtcctcttactgctctctggtagccattaatctttctctcaccatggatttgactgttctggatatttcataaaagtgaaagcatttgataaatggttttttgtgtctgacttctctcacctagcataatgttttcaaaggttcatccacgttgtagcatatattaatgcattattttattttatggcagaattttaaaattataattttttaaaatgtatgcagtttttttcctatcctctaaaaataaagcagcaaatccatctcgcatacttctttttgacaattaatggatctccacatggaacaaaactttattttgatgtttaaatctttatacagtatatcaaataatctgatgtttaacatacttgccacatgatattcttgccttgatataatcaaagttaaggtcttatacaccatggatcactgttttggaggccagggattagcaggaagtgacaggtgtatccaaaaccaaaattctcatggtaaactcagcttcactggactagaatgccatcactgtacacttaagtcattttgttctcgtttgcttattagaattctgatgtcagttttagtgaactctcagattattttcttctgtgtgtggagtcccacataacaaaagag

SEQ ID NO: 35578 - DNA, 669 bp, Bovine  19866880770478
ctgggtcaagatcccctgggtggaatctgtacatcccagtgtgcctagcacctggaatagtgatctctacacacagtaaatatttaaacaaacaaataaacctcccaaattgccttcattgtatataaattcttttctttttcagatcttccatctaataaatttgggcttcagagagaaaactaaaaattaatgtatcttcaaactgttcagtgaaactatgagacaaaaaaggattcaatttattttacgagcaatatttcataaacacatatcttttaaataacaaggctaatattctatttctatagaatcatacggttttgtctaagaaaaatactaaaagccaacctatattctacagaatgtaatcacatttccaaaaagtttaaattcataccttagtttctgaatgtaaatgaactgtcccttcagataatggacgtctacagataaaaaataaacatcatatattaatagtagacggtactaaactgagacagaataaaattcaacagcaattatatctgaaaggaaaatatataaaactatcaagtagactttgctataattctaattatacacatgttaacttactttgagtgagtgtcacaaacaagaaaagtgctttggtcaaataattcatctttgggaagaaacactaaagtg

SEQ ID NO: 35579 - DNA, 1409 bp, Bovine  19866880849457
aaatagttattgtttcttcaactgcagtgaaaaccatttactataaagctcatgactttagagtttactttaaccataagcctaggattttcattttgctttaaaattagagactgaccagtagtaaatcatctggctcttaaatattttgagtagttgtttgacatgctacctgccctgagttgtctgtcttccatacctacaccaaaaatttagagttcttttggcttgtctatattgaggccagctgtgatggtgcatcctagcactgtttctggttccagaaagaaggcagttccttgctctcctctataatctaaaactgatgtaattgtcttcccctgtgttcagaaagcaagttaagcagtttcaagcccctcaactttacggccttatttaacttaggtaatggatatatgtgtgtataaataattgaccaatttgctctccccagtgagaggtgtcttgaatgatgtaatgtgcagaactgatttggtttctgtctcactattagtttttggtattattgagggaaatgaacttcacagtggtaggaaagacagaagtatggcttgttgttgttaaagatgttttgaagaagaacttaggttaaatcactttttatattagaaaaatgttatacactaaaattatacaaatgaaaataattaaaatgagcattgtcgttcacttaaatttgaacaagaacagtgtgttaagtgctcacctgaagtacctgctgtgtataaagtagtgtgctggagactggcatttgaggaatgcccattcacttgtaatattaaccttgtaatgttaacctaagcaataatgtgtactaaaacctctcttttattcagttcaaggccagggaatgaggtgacaagtgctaaagcatgggaaaagtagaccccttagtttctttgtggataaaatgcaaaatttatactagatgaccttgcaagttcctttagcttaaatttctatgactctgtttcaaaattaatattgacagcgatagaaagtataccataagtacagagaaagactaacatttaactaatcagcagtcagcagaacattttcattggacgaattactaggtcttgctggtgtttccttgggtgctagcccatgaggactacctgaaggtgtaattcacttgttacctgtgcaagacttctcttacatgagattcagtctgcaaatatttattgagtatatattacatttaatgtattctaagagctgttgttgattatgcagaaatatgtaagactatgtagtactccctgttgttggggagtttactagttgttggttaagagattgtactagttggttgtttgtgtgactgttttatttataaagaggtgctcaaacttataagcacctcataggaactttttttc

SEQ ID NO: 35580 - DNA, 760 bp, Bovine  19866880953589
tatccctctatcccctcatatccaaatacttcaagacagagctcaagtgacaccttctctgtaaaaccaccaagtcccccaggagaccatcactccctcacctgagaccccctcatgcttcttaccttcctcttgggttccctcccttggtgattagggcatgcatcctattttccatgcctcagtgaaaggtccaggagagccaggcccctctcttgagaacctctgtctcctgcacagggcatggcacagtgccttgaaagtttccttagacacctgtggagtaaatacagcatcaattctctggatccatttcccattctaagagagaagctatatcagctttcctagactctactattttgatgcccaaatttaaagtattacttattgcatgcctgaaattgcaggcacatttggagggcaggggtcaagacaatactacacatgaaagaattataaacagaataaaatgttaattgtaagcaagggaaaacaacaaaggaatgcatggagggaggagataaacttggtcaagagatgccatggaaggttaagaggaagagaatttccttgaacttgcctttgaatctccatataaagagactccttaggtcttgggcattttaagcctgaaacaaaggctgagtcagggacactagagggagccaaggcctgcagactggagagaaagcttccagggtgttagccttgggttcacagattctacaacatttgcttagtagattgagaaggctat

SEQ ID NO: 35581 - DNA, 1602 bp, Bovine  19866881172371
actgtgaagaaagctgagtgccgaagaatcgatgcttttgaactgtggtgttggagaagtctcttgagagtcccttggactgcaaggagatccaaccagcccatcctaaaggagatgagtccaggtgttcattggaaggaatgatgctaaagctgaaactccaatactttggccacctcatacgaagagttgactcattggaaaagaccctgatgctgggagggattgggggcaggaggaggagaaggggatgacagaggatgagatggctggatggcatcaccgacttgatggacatgagtttgtgtgcactccgggagttggtgatggacagggaggcctgtcgtgctctggtccgtggggtcacaaagagtcagacacaactgagcgactgaactgaactgaccaggacaagctcaaaatgaccaagtgattgacagtcatagcttcagggatagtgaaacctattactgtctcctcaaggaagtatccccataccccataatgggaactaggactttgaatacagcagagcctaaattgtgggagctgctgctaagtcacttcagtcgtgtctgactctgtgcgaccccatagacggcagcccaccaggctcccccgtccctgggcttctccaggcaagaacactggagtgggttgccatttccttctccaatgcatgaaagtgaaaagtgaaagtgaagtcgctcagttgtgtccgactctcagcgaccccatggactgcagcctaccaggctcctccgtccatgggattttccaggcaagagtcgtggagtggggtgccattgccttctcatagtgcaattacaagttctaaggattaggacttgctatgttcaggtagccattactcagtttaatatattggggtttcaaatttctcaggctcttccaaccaaatgtccccttctaacgttcacagaattgagtccagtattttctccattaagtcctaactgttgaaaacatgaccaacctgttgagactctgttcagtttcctgtgtggcgctgccactcttgccattgaagcttggacttattttcatcacaaccttccttaaagctgcaggagatactctttaaacactgccatggaagatttctgacttttgccattctgtaacactgctccttctcctccttccctcaataacattgacattacctccatataaacccaagaagacaagctggaaaacaattagaagttcaacattttatttaaaaagtgaagactatgctgtaggtaatgcatggtggtgtgcgtgtttatgtgcaagtgtatgtaattttatcttctctctcttcatgccacatttctaaggcaaagaagttatttctgagttacacatggcctggaatgtctaaaccattgggaaaattctcattttcttaccaaatatagattaacattccactttagttattaagagatagtgaatgataacatgaatggcttgaggggtttgcaaggaaccacttataaattgagctaaaggtcttatctacctgcacgaacttgtttatctttcaataaagatagagaagagattcgagtgcagataaatatttacaagcaa

SEQ ID NO: 35582 - DNA, 2520 bp, Bovine  19866881189751
gtctcccacactgcaggtagattctttaccagctgagccaccagggaagcccaggcagtcactcctaatttcccctcaacttcctcaatctcagacaacctctaatacattttctgtctctacagatttgcctactatagacatttaacataaggggaatcctacaatatgtggtctttaaatatttttgaggttcacctatgttgtagcatgtgtcactacatcattcctttttataattgaataatatttcattgtatgtatatatcccattcatttgtccattttgtttgtccattcatttgttgatggacctacaggctgtttctacttttttactaaatgaataatgatgctatgagcattcatctacatttttttgtttgaacatctgtggtaagtagattttaaaataaaaactgtgtcaagttacatcaactaggtaagtatttttataggcatataaaatgctataagcattttataaatagaaagtatcttcacatttttatgtacatgttttgtgtcttctttgtttctctatatagttatttcttatcaacaaatataaaaacaaattatagatacacaaccatggagagggggaattcaagcagtaaaaaaagatacatagaacatcaaattataaatctttcatctttgtcccaccctcagagaaaatactgtgaacagtttcttaggtcctgccagaagtattttttcaaatacctgtatatgagagagttgttctgcttttacacaaataggtgaatcatacatacaacgttctgcacatttgttccttcatttagtatattttgaaactaacactctatcaatacataaacatctgtctctttttaaacagctgatgaggatttcattatatggctataccatactatgaaagtgaaagtgaaagtcgctcagtcatgtctgactctttgcgaccccatggactatacagtccatggaattctccaggccagaatactggagtgggtagctgtccccttctccaggggatcttcccaacccagggcttgaacccaggtctcttgtactgcaggtggatgctttatcatctgagccaccagggaagccccaacctatacttagtgcttagtcaccccatcctttttcctagctaacagaattctaattttattgaaatattggatggcaatgcatgtcagggataccagcagctactccccccacctcacctcctatgagcttacttctgattcctctaagcttcccagtaattccactctctttatccatgactgggttagaaatatacacacaacataattctggcccaagagatatgaaagtctcgcagggaaacttttgaaaaagggttcttcactttttaaaggagactgatagggtctacctctggacatcatcattggaggctatgtcgtttggaactgctgcaggcttcttgtgaccaaggacagaaagccaagagaatcccagagaagctgggcttcacatgaccccgttcagctgctgcagtcactacctctcttctatgcctgcttcttgtgaggagaaataataaatgtaactgtcatttaagccaattttagctgttacagtgactctgttactggaagctgaaagcatcctaaatgatacactacagaagggcctactttaaatactttacatgtagggactccccctaaattctctaatatcccctgatattcactcacgagcacccgtgttttctcttcagaaggttcagcacattggtaatacttttgagaaactagttcatagggctccacagtagatagtaagcctggttgagggtagggactgtgagtgagtgagtattaagttgctcagtcgtgtctgactctttccaaccccatggactatagcctgccaggctcctctgtccatgggattctccaggcaagaatactggagttggttgccaggataaatttatggataaaaatacataggaaaaaataccagactatcacacaattagtggtggctttatggaaattaaattacagctgacttttatttttttataaaaatatctaaggtatacatgttgcttctgtaacatagtactaatatatgcatgaacatatacacattatgtacatataacaagatgtgtgtgaataccaaagatacaaactgatcaccatgggtgtacagggaatgagtggtcctttttcagaggctcctatgctatgctgatgcacagcatatgagtatatggttccctaatgtgtcagactgttttccctcctgataatttgcctctcctggtctcacgtgagcaactctaagtgcagattttactatactttgtgattgaacattaacttcaatttggagttgtcctgtctgttaatttaccagtaacatttctggttcaatagtaaagaattagcctgcccatgtaggagatataggttcaatccctggttcaggaagattccgtggagaaggaaatggcagcccactccagtactcttg

SEQ ID NO: 35583 - DNA, 4764 bp, Bovine  19866880490444
atggccctcagctttgtttcctggagtggggacgccatcaaacagtgagcatctgggtcggtccagaggcttaggctgagccacccaactcactataaactgggcagacctgggcaggtgattcagcaacttttcctggatgagtgaaaggctacagagaagaatcctcaccctctggacaattaaaaggaaaacttgcagaagtctttaagggatcagccttgaattttcctccccataccagcctcaaagagtaggaacatggaccaagctaaagacgtgggaatatttactgggggtgatgggatgtactccccccaccacagacatgcacaaactcacaatcagatacacaggcatcactttggtcttcttcaattatccatcatcatctgacatccatgaaataagcttaaccatttcagaaactgtattttcagcttgtcccacctctaggggctagatgatccctaagtttacaagattctgtatgaagtcacctgttctctcaatcttaaactagcccccataaaatcttcaaagggaactatttggaaacaagcagatataaagagaacacagggtgggtacatttggactcagaagtaggcaacaagcccaccagaagtgaagtctgaaatccctgcaggttgagggttaagggttgagtggagagtttagcacaggcaaatcagaggagttttgtgtttctggagagcaaggctgggacagccatcctgccttgtcctcccattgctcctcaagggcatcctggaggaggctacacctcctaagctgctagaacacagggtggctctggcagctagggccaggaagagcattctagacagagagctggaggtggaaggaggaagatggaatcctagaacaggaggggcattgccacaggcaggatgggtatttctcggctcttccactctgccggcctcatccttgcagcagcaagacctgggatcatgatgaccccttggcccacaaaggaagcccacctgcagaaccagttctggaccaccacagcggtggcccccggctactccctcccatgcacagggacacaaccctccttgtctctgggccactcctttccaaaccaccacccagtgccgtggtgctcctgctctcccagcagctgccggtgtgaccttgtgaacctggggtcccaccagacaccttggcctgggggccagattgttctcgagtttgtcccccagaccacacccagggactgtggccggtgggggcaaggcttgtgcacagacctgtataaaaatacagattctcgcagacagttccagagctcaggaaagaccaaaggagaaagagagctcagagctggacagatggagatagttatactgttcacccactggggactggggggattaaagagaggatgcccttttagagcttagcacaggggctagcttgtaaataagtgcctagtgaatggcagccagtagcttggagccctggaggagtcacctggcttcagtcatgtgaccaactgaggcgggatttctgtacttaacagagctcagctacttcttgtttgttttctgctactgggggctgtcaaaggtgggctttctactaagggaaggaagctcggtctctggggagcatgtaaaaggagaaatgaaaaatggaaaatgatttagtgagtacttcgtatgttccgggcttcctgggtggtcagttgtaaagaatctgcctgctgatgcaggagatacaggagacgcaggtttgatccctgggtgggtaagatcctctggaggaggaaatggcaactcactccagtattcttgcctggaaaatcccagggacagaggaggctggtgggctacagtccattgtgtctcagagaatcgatcacgagcacccaagcatcatgcatgtgccaggacaaagtcctcaatgcttttagcatcaccttttttcttgcatgtattatttttgcctttttggggtattgtaattatgaaaaatttttcaaatatacatagaagtatagagattagcctatgaatgccattatgcccatcacccagttttaacaattactggaattttaccatctgtgttcatttccacctctcacttagcccttgccatcaagaaacagcccttgagctgtttctggcttgtaagccccactcgcaaccccactggatcataagctcctaaaaggcagaaaccatggacttgggatcctgtcatatctgagtcttaggtcagttcctggtcagctccctgaccagggatcgaactcggggccccctgcattgggagcgcagagtcttagccactggatcaccaggaagtccccattcccccaactttaagcacactgctctttatccttatcacctccttgttaagtcaggatacttgctccaagtgaactgtaagtcagaaaggttacatggtgtgccaggtccccacccaccaggaatcaaccaagccctgccagtgtgtgccttgcccacgtgctctcctgatgccaggctgggggtgggatggcctgggaaataagggcagaatctggttgatgtccccccggccccgacacgtgcgtgtactggccctggttcgctctggcaggcaccatgagggttacctgatagctgtttataaagcccagaatctgcttagtgaacagcactatggtgtccagagcatcctaaggctcagatacgacaggatcctgagtccatggtttctgcctttcaggagcttatgatccagtgtggtttacaaaccagaaacagctcaagggtgatggcaagggctaagtgagaggtggaaacaaacacactgggaggtgcagaggagggactaggggagtggggaaagctgctggggaaagagacgcagggctggtgtggcaggagagcacaggctgggtggccaaagacatgagctggaatcctagttcttctacttaccagctatgaaacatcaggctctcaagcctcagtttacctcatgggtaaaatggacacaattatgcctcttcagggcacgtgaaaggctgagctgtgaatgataagcgtcactgcttgtttccttctcctgtgttccagtgggggtggggtagcaagccctggagtgaggcagagggctgatggcagtgcaaggtcgcacccttggcctcaattccctctgcttcctggggcaggaatcagcagtcagtgatgctgctgccattgcctccagtcttagactctgctctctcttccaagtccgtgtctctcttctgagtcaggaccctcccatctgggagctggaggaggttctggactgtcattctggagctgatgctgacccgaccccctcctttcctccctagacaattaaaaagcctccacatcggtccccaccagccgggtcgcacgggaaggctgccgcagtcgtcacagacagctgtgtgcagaggcagagtgggtgtctgctcggggggctgagtgtacgcgtgcgtgagacaccagggaggtcattatagccttgtcttggatgcagacaactaaccgtaagaggcattctcgcactaatgtgctcacagaggatgctgaaattagacttgaaagataaagagctgagactaggattgccccctccccagcagccctgcagccttcggagtgatcagcctccattgttagggctgggaaagaaggtggcacttagccatctatgtcacaagtgatctctattcgggacccttgggtcaaccagctcccagtcctggcatccgatcagaccagaattacttggcaggatggcaggagggactgagatgcggcctcgccccgactggaaacacacaatctcatcttgccagttggagtggttctaacctgattagctacagaacgcgatgtgtgtattcccctctctctattataaaaaataaagtaggggtggaataaataagcttttgataaaagtatggctatgtgcctgggttttgtattcttttggttgaagccagaacacatctgtgttcatggacacacacgtgcgcgcgcgtgcacacacacacacagagcaggaaacagatctcatctcagttcttatgtgacacgtctcagtgagttgcagctcccgggccgcactgtgcagggggaaatggagggtggagaagacccggaaacagacacagaggaggaggcaggggctggcctgcttgcggaggccaggaaggggcgcaggcaggcgtgggggagaggtctgtgtaagaggaaatgaacgttggtttgggggatgagatgtgatcagattcaagaggtattttgaaggcagaatgaggaaggttttctcatctcatgggtgagatgggccaaggattaatgttcaagtttttgggaaagtgtatgaacagaccagaacccagaggctggctttgagccctaaccatggcacttgtcctgaaggattcggagggaatcattccaataaatttaagcctgtctgtaaagtaagagcagctgccttgcattgcctttcggtgggaaagccatatcttaatgtgagatctcaaagtagtctacatgtgaaatggtcatttccattgccacttttccctcctcgtttttctctaattgtatttcattttctcccatttctgtcacggatctgtttttgagcatctgctgtatacagtgacatgggcctgtactcacgctcaaggtctggatgctctaagaccggacggtctcagaggtttccagaccctcacacgga

SEQ ID NO: 35584 - DNA, 1980 bp, Bovine  19866880515137
atttgcataaagtttgaaaacatgcagaacagtatcctgtgttgtttctggctacatgcatatgtagcaaaagtaccaaaacactcaggagaatgataaacaccatatttagggcagcgcttacctctgacgaaggaggcaatgggctcacggagagaaacataactgctttcagaatgtcttcgttcttaaaatgtttcttctaaaacagaaacacaagaaaatatagtcaaagtaagcttggatattttcatattatttttttcctttttctataggcatgatatatttcattagagaagtacccatttcaacatcataggcaaaatgccaggagagggatgaggttacatacaggctgggtgcctctgtgatagtctaggtctgggggattgggagcagagagcagaggttggtggtgaaagtgaggtttgggggctgatcctgggtgggcctgagttggtgggattggggaggagcgagtacacagcccgcacctcagctatgccctctgcgacctagttcctgccacctctgcctgggccaccttggccaggcttggtgctcagcagctattaaataacaacaatgaaacggtgtaaatataagaggaggagagatgtgtctgcctcgggatcccactgtaatccgtttcccgatttaatgagagtctggagacccagcatgaggccactaaaagttaagaatgccgggagtattcatagggctgtgagacccccttgctctctgaagctgggaaccaaggagcatcctggcagtcttccctctgtccttctgtcctgaggggcagttgatcaatgtcagaggccagctgggtagggacaagtgagttgcgggtggaggagggaagtgctcaaataattacccattttgagaagtttactcccaattccagctcaaattacagagaaggctgggagcccaggtcatgtcaacagggaaacccgagaaagaaaagtgatctcccggtgctcctgaggcctggagaacacagggtgtgctggggagagagcaggcagggatcaccagatgctgccttctagaacacttagttctattccagtttgcctgaaaacaatgatttcccctgtcctgcctttcctctgcttccccgaccctcttacgtacccaggttcccaggtggcacatgcggatggtagaactgacatgtcagggctggaaggggccttggaagccccggaacccagcccctgctcattatatagatgcccttggtagccttgaaggagctggggcccagtcctcaagaagcatcccactgcaggatgagggcagatgtcatcctcaacaaggtggctctggggtgagattccccaaggtctggaagggttgcgagacggtctagcgtgtgtgtgtatcagggtgtgtgcgcaggacagcgtctgtaccttgtttatcataagcaggcagataacagacgtgttcctgaaaagtgaagtctcaattctcatctgaatacggaggagtgctctttttaggaaaaaccttgaggtgatgttggcaagcaagggaagagttgggcaggctctgctgataggaggagacaccgggacagcctttctgggaagcaatttggcagtaggtagctgaagccgtaaatgtccatatcctttgggctctatccttgaaaagtaaccaaagatggccatgaagatttctgttaactgctgtgttatttacaaaagtgaaaaaaaaaaatcctatatatccagtgataggagaatgattaaataatcatacaataatagaattgaaatattctaatacattttcaattacatgaaaaaagatcataatatgatcttaagttgcaaacacattatatatgtatggcaggatcccaattggttaaaaaatacacacacacacacacattcatacttatattttagacggatattttgacctacttcaaagctgttagtgattgctatggtt

SEQ ID NO: 35585 - DNA, 657 bp, Bovine  19866880621306
tggaggtgagcacagataagcgtagactatggctcccaagggtttctagctccagccagggctccagagatgcttatccttcactgcacattcacgcgtacgtgctcacacccaaaaaactccctccagaccgctttccttccttaaattgagcccatttagaaagttttctttcctctccccactgaagacatccatcactttccccagcagaggcgagacggccacgactccttccccgggtttattaaatccgttcaagagcctatttgtagctgtcacagggaagccgagggggaggctgggagctctctcagccgtgcagccggcatcacaacctctgggccggggatcaccctacatatgtttctccgtaacaggcagagctagaggggcaccgcaaggtctaatgtgcttgacgctggggattacggtgggggggagggggttaaggaaactcagctagggctggctggtcaaggatggagcccaccccgcaggtcacccatctcctaggcactggaccccacctcgaacggcacagtgaagagcaaatacactgccaccctgtcccagaccccaagcagccacctcggtgtcacagacgggagctgggagccctaggtgtggggaccatcatgcccccatgcgggctgt

SEQ ID NO: 35586 - DNA, 1590 bp, Bovine  19866880676469
atgagtttgataagaaattgtcttgttaacaggattagccacggaaatctctcgtcccctcccattcattctgtaatgctcctgtctcatgtcctgtaattttctgctggtatcagaggccccggaccacctcaggaatattcatttctacttgttctttgatcgtgtgactgctgatatgccaggacaccccccacagccgctgggcctccaaggccttgtgaaattacaccgaggccctcactggctcactccctccagagccagcggctttcagattttctgctgctgtgacccaccccctcccaccccaactccttcccacatcagctgccagatctggggtcgggattacctttagcttaaagaccaaggaggcagatgtttctgaagctttgttttagttgccaagtcgtgtcctacttttttgcaaccttgtggactatagcctgccaggctcctctgtccatgggatttctcaggcaagaatacgggattccattcccttctccaggggatcttcctgacctagagatcgaacccagtctcctgcattggcaggcgggttctttaccactgagccaacagcccatgctggagcttacctggcagaagagtgcgagatgagtgccccagcccactgccttctttctacccctcccccacacgcatccctcagaagatcctagaaaaggagaatacagaagtgttcagtacagtggatgacagtatcaagctttgaacctgggttcacctcctgggtctgtggcacaatttccccagcctctctgagcctcagttttctcatctgtacattgggaatgacgatgcttgtctgtaacacacggagtatagtacctgatacacagtaggaactcaattcatgctcttctccttctctgctctttcaagacaggaatgctactgagggtggggcatacttgggattgaccaagaaattattgtttcggctttgactcacatccccagactctttcctagtaccaattccttctgacctttgtcctcccaaatttctttctctttacacactttcagggacatgtgcagaggaatcttgatggccccttcaacattaattaaaagaaagtgcagcatgtatggagaaggtgatggcaccctactccagtactcttgcctggcaaatcccatggacagaggagcctggtaggctgcagtccatggggttgctaagagttggacacaactgagcgacttcactttcacttttcactttcatgcattggagaaggaaatggcaacccactccagtgttcttgcctggagaatcccagggacgggggagcctggtgggctgccgtctatggggtcgcacagagtcggacacgactgaagcaacttagcagcagcagcagcagcatataaggtgaatccgaaggaaagatagcgggagaagaaaggaattgcctgtcctgtgcccctaaaccatgggttgagagcaaagcagagggtcaggctaggcagaaagcccgcctctgcatcagtaagcgattttcatggagaggcagatgcacaggggggcggtgccaggaggatgtaacctaccca

SEQ ID NO: 35587 - DNA, 2831 bp, Bovine  19866880742281
ttttcacttcacttcactgccacaggctgggctcaactcttgatcaggagtaggataagagcccacaagttgagtggccaaaacaaaaagcaaaacacaaaaaaacaggacagttttcatgcagttactcactaggcctagtcccacttatgtaattatacagaaatggggctggagcacatatattatttcaaatgagtgaacttcctacttggccttaggaatcttttgtttgatgtagattgaaaaaaaaaaaattattttttattagagcacctattctagatccacattcatcttcagtttccatcttcagctctggagattctcacatactcctatgctctggcctagtcccttgttattaaaagtgtggttagtgcatcagcagcaagggcttcaactggaagcctgtagaaatgcagactcttaggccttagcttgacttattgtatctaagtgatttgcatgcatatcaaagtctgcgaagcagagttctagccacattgaacttcttaaaattctctaaaggagtcatgaagcctttgtacatgctggtcttcccaaatgggaaagaccctcttccccatatgctaggaaaattggcttcttatttagtctccttatttaattagttagtgagggaaccagcaagatggtaagtcgagttcaagaaggatacaggagactggtaaacacatagtctatggaaaaaagattgctggaataagattgaaaattaaatacaacactgctttttattgacacattgtgcttagtcactcagtcatgtccagctctttgtgaccccatggactgtagcccaccaggctcctctggtaatggggattctccagacaagaatactggaatgagttgtcatgccctcctccaggggattttcccaatccagggatcaaacacaggtcttctgcattgcagacagattctttaccatctgagtcaccaaggaagcccaagaatactggagtggatagcctatcccttctccaggtgatcttcctgacccaggagttgaacaagggtctcccgcattgccggcagattctttaccagctgagctaccagggaagccctattgacactactattactactacctgttgacacattagcataaaacagtaacatttagcataatcttttctacctgacaaagtcatttatagctgatcttctacaagatctaattttacagactctaggctctactgggtaaataataagccatataagatgacagcccctagaatttgatgatccccttcaggtttcttagagaatgctctagtatgactttacaaaagcagatagtaatattttgctttatttccaaatttgggataatttttcttaaaagtttaaatttgatggtgctggagaaaactcttaagttccttggatgcaaggagatcaaacttgtcaatcctaaaggaaatcaacagtgaatattcattggaaggactgatgccgaagctgaagctccagtactttggccacttgacgcaaagagctgacttattaaacaagagcctgatgctgggaaagattgagggcaggagaagggggcgaccgaagatgaaatggttggatggcatcaccaactcaatggacatgagtttgagcaaactctaggagatagtggaggacagggaagcctggcgtgctgcagtccacggggtctcaaagagtcggacatgacatgagcagctgaaaaacaaggacacctgacttctgcttctggccaagatggagtaatggagaccagatttcctatcccacctgaaacaaccaaaaaattcagacagaaggaaaaaaaacagtggttttcaagaaagaaccatatgaaaggattagagggagctgtgtctgatgctcacacagggctgggaatactgcctgttcccaccagccagactggaaaagtcgtaattcacagggaagtggggagagcacttaggaaggtcttgtctcagaggtggggaagagttagtcctagacagtattgctaaaaacccacctaataaatcttcaagcaagacccaaaaacatcagttggttcccaagtaatttaactgcttcccagaagaaagttcaagaagatttataagaatacaaaaatatccccaaatcacaatgtctggcatccactaaaaattaccaggcatacaaggaagccagaaaacataagccataaagaaaagaataatcaatcaatggcaactgacccagaactgacacagatgttagaattagcagagaaggattctaaaacagcttttataactctattccacattttcaaaatgctagagacatgaagatcggagaaggcaatggcacccctctccagtactcttgcctggaaaatcccatggacggaggagcctggtaggctgcagtccatggcgtcactaggagtcggacatgactgagtgacttcaatttcacttttcactttcatgcattggagaaggaaatggcaacccactccagtgttcttgcctggagaatcccagggacgggggagcttggtgggctgccatctatggggtcgcacaaagttggacaggactgaagcgacttagcagcagcagcagagatgtgaagatagacaaaagacccaaattaacttttaagagttgaaaattgcaatgtctgaggttaaaaaatacatcgagagtgatttgtggcagattagacaaggcagaagaaatgttcgtgaacatgaaggcatagcaataaaaactatccaaaatgaaacaggagaaaaagtgtttttaaaaatggaagaacaccagtcagctgta

SEQ ID NO: 35588 - DNA, 872 bp, Bovine  19866880751720
cagccatctctccttcccagacgctggattctgacctgagagactttgtttactcacccctggtggcaaatattgacactgaaagcaactctgcttctgtggttgctagttttctggtcccaggaaaccttggttcccaagtgacaactacattttaggcccattagcgagcctaccaccaaaacacaaaatataaatctctcttctactcctgaccttttccaatccctggaaatcaaggtttcttcttcggtcgccagccttactccacccagaatcttctctctctaaaggcagctgagtggaagtggaagccaacctgttaccctaggagatggtaggtgccctgaaggtagtaaatttactggatggtctataggcctggcctggaatctatacctagaggcagcccaataaatgatgggggtagagagaaatgatgacaatgacaatgatgataacaacagctgttaccactacccccgccccatcccttccccgcgtcatagaacatgtcaggtgctggttcagttcagtagctcggtcattttggactctgtgactgcacggactgcagcaggtcaggcttcccctgtgctaaattcttcacttgtattacctgggttaattcttacaagaattattatgcccatttatagatgaggaaactaagctttaggaggttaaacaacttgtctaggatcacacagcagacctcaagcttcttgctcctcactcctacaaagaaagaaaaaatgaggaagagggagaaaaaagaaaggatagaaaaaggaagtgacagagggagtaagtggggaggaagggaggaaggatttctaaataggctgacctgaagcaaaccagagaagacg

SEQ ID NO: 35589 - DNA, 1846 bp, Bovine  19866880858712
cctggcttcttcgagcgcacagattaccaggtctggagtctggcccccatctctgctcacttggtagcagttgcatccatgttatcattctcaacagttctgaagaactctcgtctctctgtttcattcatcccactcatccaagcaggttttgtgatactcatggagaagcagaccctcacagtatgtagatatgttagaacttgaaccccagtctacaggacagaaggggaaccctgctatcacaaaaaagggcacagaggacctgaatggtaataaaatattaataatgtggaccaaaaaaaaatgttgcctgccgtttcagtaaagaatgctgccctccatcaaaccagcagccactgctcacgacagtgcaccctgagggaattcagggtagagaaaaacagcgtattggccctagatagctaagatgcatatcgaaggaatgatttcaataagcccagaatcttgcatcttcccatacatagaaaggcactaagatccttaacttgggatggctggtttttatgattaagcagtgatctttccacgtttagctacttttttttttttccagtagaaactcctatatatcctggtttctctcttacctctttgcaacagttctcagagctacttgagaggccatctcccagactacagtcctcagtaatttttcattgttgttcagttgccaagttgtgtctgactcttcgtgaccccatggattgcagcatgccaggcttccctgtccttcactatctcctggagcttgctcaaattcatatccattgagtcagtgatgccatccaacaatctcatcctctgtctcccccttctcctcctaccctcaatctttcccagcatcagggtcttttccaatgagtcagctcttcggatcaggtggtccaaggattggaggttcaactttagcatcagtccttccaatgaatattcacagttgatttcctttaggattgactggtttgatcttgctgtccaagggactctcaagagtcttctgaagcaccacagttcaaaagcatcaattctttggtgttcaaccttctttacggtccaactctcacatctgtacattactagaaaaaccatagctttgactatatggacctttgttggcaaaatgatgggtttttaatagtcctcaataatacccccaaataaaacataatcctcaacttttaggttgtatgttttttttcagttgacaataacataatatatacatgtaaatttttcagtatttttatgtccatagtctcactttgaccctgtgagggaacaggaaagatactgatggacccattgtgcagttgaggaaaccaaagctcccgagactacacaggagcccagcttaccccatggctaggaaagacttcattttacagagacagaaactgacaaagatgctagggtctggcccagatcacacagctggagggaacacaaggggtgtcctgagcctttttcagttccagcaggcactggctgggaggcaggaaccccctctgcacctctggacggcgcagagggccaactgcccggcagcccctaccaccgtgagtccttcaggacacctgatcgcagcatcacctgctctgccatcactgccttggccggtgccccgctattgtgcaaccaggcacggggctggggctggctccataaaatcaacagccagttggcttgatctggctgattctgcccccctggagttcaaccgtgacagcaatgaatcaggctaatggtgagaggtggccgttcttcctctctgtggcctggagacaggtatttccaaggctcctccccggctcaggcaaacaca

SEQ ID NO: 35590 - DNA, 2121 bp, Bovine  19866880905824
attccttcctctctccgcaccctctgcccctcggactgcctcccagctcaagcctgctgaccgtggggactctgtgttcttcagctgccatgccatcaactcatatggggaggaccggggcctgatccagctcacggtacaaggtacctcacctgctccacgtccccagccccttcctctgggccctggtgctcactgccaactcccctcaagagtgggggacactccacacccaggggcagtgacaggaaacagctctggggaaaagcctcagtccactctccctcctgcccagagtggtgccatagggtccttccaggacactgcagacagtgaggtctgtgatggcagaaagccctgtggagcacactgctgcccccagaagtgggagacctggatttgtgggcccagaccttgggggaggtgtgcggagggaaagtcaagatggaaaacctgggagctctgcatggtgggaagcaggccatcagctgtgaggggtccctccaaaaggggctgaggaagagaggggaacagagcagggacccagcacgcccacttctgcctctgagcctttagatctaagtttctcctccatccctatgctgccttgcccaaactccagggctcaggaccctcagatagaccgttgtgtctccaatcctcccagcacagatcccttgatctctgcagagggtcggcaggaggctaagctctctgctgccatcctcacccctgcccccttcccttgccactccccagagccccctgaccccccagagctggaaatccgagaggtgaaggcccggagcatgaacctgcgctggacccagagattcgatgggaacagcatcatcacgggctttgacattgagtacaagaacaaaacaggtaggtgagggctcggcccaccatagcgccttgcaccacctgcctggacggtgtccctccagtgtgacggcccctggctgtcagggctgcccatctcagacagacacacaagcccttgtgttttccaaaggaagggacattggtcaggttaggaaaccagggggcaggtagaaggacctctacagttgatagggaggaaatgtcagtccgtccttcccaggactgaccctgggcagatccatagggtggtctgatttaaagcaacttaaaagtcactgagccaggagctactggctgtatatgtggggtcagagacatcacagtttcactgggtcatctaggcactccaggtttgggatgatggggttgcttgggagtcagagaagctggtctttcccaagaatgagtcactggggaggtaggagtccctggaaagtttagatctaagtttcttcttagaagccctctaaaacccctcccttgggactctattaatagcttctaagagattgccttccactgtgaagccgcttagagcaaagtgaacaatggactcctgtgtctctggggaaaccagggacccacaatcaagtggcaggaatggcaaggaggggacagatgacctgaacaagaggtcaagccaagaaagagccataggtgatcacgtttgtatctgcgtgactatttctaaaaggtacaggcgacaggggggctgccccggagaggcccctgggtgacttcagtgcaggtgagagaaggagaaacatacctctcctctagggtcctttcatactttcagaattcaagaccataagcccatataagcctttcaaagtaattttaaggtaaaatacagaaagcaaatctggaaaactgaagcctccccaaccgtccttctcccaccaactccaactcatcttccaggactcagcatagatccaaggttttgtttcctcagaagccttccagacccttcctctcttccttagcacagcacagtcattggctgactgactatccgctcccccaaagggttagccccaggatagcatccacagctgtgtttacctcttgagaagccgccctgtccagggcactgggtgcatcattcttgaggctggtttctacaggaaggaaccctgccctcagaagcttacagtctaattggggagaaaagtcagctcagagccagacctcccgaggtcactgtcagtgcagaaggagagccataga

SEQ ID NO: 35591 - DNA, 1624 bp, Bovine  19866880938614
ttacctatgaaagactgtggggagaggagggatgagaggctggtacatggtccatgttcccgggattctcaggggaccagacttgagtgagcatgcgtgtgggactcttatttcatgagctgcctagacgtcccttcagaatcctagctggcctcatgctgtgccaagagttggagaaagaggttaataccatgttgtaggctctctttgttagaggcactgtgattgcagtcccttcgttgctggttccttttccctatgcagagttgtccctttcacaggaaaacaggtctggaaaccccaagagaggacctcagatcctcagaatacctccaggcctccggttacaaaaccatggggtttttccatcgctccagcatttctccctgcattgctgtactttgcagaggccctgccacgtttcttcctttctccaccaagggccttggttttcctttcctttcctttccacttgaccagattgctcgctgagtgcccctccagcacgatgacccatcggtgggatataggaaatggttctagttggcttgagttctgcaggttagttgaagaagacagacttctgttcatgacacctgtaaagccggagttccaaatcttgctatacagctgaagtccaggggagctctttgaagaaacaccagtgcctgggccccatcccagatcagaatctctaggggcagaacctggacatgaacagttttaaacctcctccttatagggtggctccaagatggagctgggagaccagtgcttcagcatcttgacagccaaggtggtgtgatacttttttgagacattaatttttgttttgcctttggaactttttcctgctctcggtcccacgccgatggccaggccattatatctcctggtctcagatcttgtacaggaatgagaaactacttgatacctgctcttcctgccttttgtaaaaccataagcaaacagcaaagatgaggatgggtgttctggctggggaggagagcctccgaagagggcagtgaacaagcaggagacaaacagatgccagaggcagggtggtgctgcgggctgctcagtgggtatggctggaggaagtggtcggacttcacagggtctgctgtgggtagctccatggggtctgggactgaggatagggttcttatattcaaatgaagcataaagtacacagcctttgacccagagtgatgatgcaggtagggacaacaggctggtgagcaccagaaagaccctggaccttggtgcctcctgggggaagccccagtaaggatggagattgaatgtcctgtctctccagcagtcacatggaaagatgatttaaagaatgtggtattttctcatagacctgaatttatagaccaataattatattcattaaaataataataaaaatttttgagtgtttactatatgcccagcactgggctaagaaacttttacatatgacctcattttatcctcacaaaaaatctgtaagtgtatttttttcccttcacttttctgaagaggaaactgaggatccaagaagtaaagagactttgggtcacacatcttatgcagagggcagggctgaacctagggctgttttttttagcctgtg

SEQ ID NO: 35592 - DNA, 1282 bp, Bovine  19866880962769
ccatcgtgctcacgctgacttctcctggccctaggcagcagagtaataatacatgaatgctgaatgataaatagcaccgtccacacaaatctatcagacagcgctgcgcagatttaaaaatgctgacaccacatttcgcccctgttttccaagcaaggagcagggatgggttctttgaggatggcccagaaggcagcctcatggtgggagccatcagccatcgtgggctgagccagagggtctggtgttgggacgtggtgagtggtcgcggtgatccaggaaaccccttctcggtgcagtggagatcattgtggtgggctcagagccatgatgcaaggaggaaatcagagatgcaggatggacttgtttccccagcacaggcagctgaatgctccagatgtggcttttgtccaaatgctcccccttctacagtgaatatgtctcctgaaataccaaagcccccaggtcccctcccagcaagcagcccactaagtagaagacactgacatctccccagccgcttccttattttttaagaagaatattttgcatcataaaccctttgatgaagaaagggagtgagagcccttaatgaaatatgttaatctggataagccaggctcatatgaaagggaatattaaaagagacaatattcaccaaagccagctcagtactctgagagctgaaaaggaaaggggagaaaatagggccactgatttcagctattcaggtcagagagatggcagtgatcaagtttggaaaatcagcgagagacctccaaatttgactctgatgcatgagcctgcaggggctgtggggagagagctgttttgtgccaacatcaaaggtgatttgggaacacaaggacaaatccacctgcaaatgactggcaatagcagaaaaaagggggccactctctgggatcccccagtcttcctatgattggcagctagggaggaggcaagcaagggaaaagcaaagggtatttactatgactgcagaatgtggaggaaccacaggtccaacatccaggaccacaaagtgggcctctgatctaaaaccaagagtgggttttaaatgcccagcgtgtgccaagtgggtgagatgggcaaagttgtagatatggttcctgccttcaaggagcttctctgtgtataaatggaaatagaatccaggggtgggaaaaatgtatggagtgagaggagagcctaagatggagccttgaagaacttgaaccataacgtaagaaagacgtacctgcaaagtgaagagataacccaa

SEQ ID NO: 35593 - DNA, 1361 bp, Bovine  19866881002924
tggagagggttaaaggcagggtgggcctcccaggctggtgtgttgggtgcagggacaagggacagaagtgcagtgattccagaagtcctaaagttgtctgagggacctctcctctcctgccccagggttatttgagagcctctttccttcttttccttcccttcagtttggcacaggggcggggacacacatggctggcagccatcagataagagcatcagttacagactccccccggggctggcttggtcttccacattctgttacgttcagcggaggtggactccctgggctgtggtgcccactggtgaacccccaggagctcacgcccggactgcatcaccttcttccctgagcacttacccagaatcaggaacatgccagccagagcccaggaaccaagctggaaagacctctattcacccaaattttcagggaaggagactggtttcccttcccagccaccagcccaaactctcgaggctcattgagtcaggagggcctcccacttgtgtgacccgaggttcctctggccgggcagcagggtcctgcctgcacatgcgtgttgtcctgtacctccctaaccaggccctttggctctcccctccgcagtgcccagccagccccctgagaacgtccggggccctgtccatcacttccgacgtggccgtcatctcctggtcggagcccccgcgcagcaccctcaacggcgtcctcaaaggctatcgggtcatcttctggtccctctacgttgacgggggtgagtctgctgggggtggtggccggctcgcggggtgagaggccaggggttgctggaggcccacacttagagctgagcatcttcccgtgggatgtcgagcggaagtccagcctctcccctgcacccgttattcccatgccagagccaggggccatagtgagaggtggtgtgcacggtcacctttctgctggggacagacaccagctgccctgttcagctgtatgttgggcagtggcttaaggggtgagatggacacactggcttttctgatggaatgtgttggtatgaggactttgtggccatgtcagtcaggaaacaggtggtatactcaaacgggacaattgagactttaatgaaggctctgcgttcagaggagtgtggcgggaagttggggtcccagggactagcaccagcaggaagctgtcaccgcctaggactgaggggcaagaggaggaagcagggtcccttggccagatggatggcgagacctgtattctgtgcagctgagctacccaggacctggagacgagcggggaagggtgcacagtggagctgcgggtaggaacagcatagggaggagagccaagacagtggcccagcc

SEQ ID NO: 35594 - DNA, 1265 bp, Bovine  19866881031828
tcccagcatcccccaggacccagtgggcatcccagctcccccagagtttgccctccactcctcagtctggccgggtgtcttacctagccatgcacgccgtcatgagcgcctgcctctgtaatgaggagtgatgtataattgatgaaagcacaatgtgatacagtcacagaaacctcgtctgctagaagacatctgttcagcacgtagaatccactcagctactgtcacaatgcatttactgtatcgtatccgagcggcaggaatatgcgagcgccatgcaagccgcgatcggtaatattatatgtctggggacgtgcagaggtaggaacccacgcttctgtttttgatatttatgtgtctgggctgcgctccttctccttcccctgctctgcctgcattgcttcagcgtcctcctcataaattacctctgctttctgacgggctttcagtggattctggtgctggcgtctaacttctctccttcaggttcctgtgtcactgaagcctcggggagccctgctcactgcacattctggaaagagggaggcgcgcttgccagggaggcggctccgggaatttcttctttccctaggactctgcctcctggtgtagcctgttcctggggtccacctccattctgaacgctcctaatcagagactacgggctcttaggtctttgacctcggttccaagtgggtttctctaggtttggacagaggggaggcaggcctgggtcaagggggcatcccacaaggacctggcaggagaggccacagcttgggggttgggccacaggccccggctcagataccctgggccaggttgggcccaggctcctgatctgagctggtcctctccaccaggggggcaggaggaggacccctgggccagggtgggaactgcgctgattgtgagggccggggcctcagacaccagtcatcaggggcccagcatacccaaccaggttctccacagctctgggctgctggttttgccatctcacattctctcctaagccttagcctatcatccctctgctccctaactcacagtgtacctcctcctggacgccgagtcagctgagaacaccagccagcctggatggagccatggttccatggctcctggagtgaagtcgtccggcaggcacacccagagctcacactatcatcattcagggtgggtgggtgggtgggtgggtgtgtgtgtcctgccatgcatgtccagggtctttcattttcctgaaagccccctgagagctgggc

SEQ ID NO: 35595 - DNA, 2895 bp, Bovine  19866881062011
tgatgtgcgcggccagggtgccccaccccccaccatcacctgggccctggacgacgagcccatcgtgagggacgggagccaccgcaccaaccagtacaccatgtccgatggcaccaccatcagccacatgaacgtcacggggccccagatccgtgacgggggcgtgtaccggtgtacggcacggaactcggtgggcagtgctgaatatcaggcgcgaataaacgtaagaggtgcctgtctacatttaaatatcagaataggcttttaagttcctttgccatctctgtggttaccattattcttgtggtgattagtacttattattaatcgtcattttgattttagtagaggtctctctcctgtccccctctccctgccccctgcaaatcccatcatccattcttgtgtgtgtgtgtgtgtgtctggtacagttcaccctctttgcattcccattctcctcctccctgcacccctcccacaatcctgccccctaccccgtccctccccatcaatctctctggctccaggtacattgagcactccactggcatctgcgtcccacccaggccttgcaaggacaggcacagggcagggggcagtggtccaggcatgccctttggtagagatgtccaccaaagctttatccccatgtgcccccacagagccacccctgagatgctccaggagctgtgagcagccaggagccagggaaccatcttctctcaatccaccatctcctggctagcctctaagaccccagccatgaagactagggggttctggctgggtgagggtgccccaaggcaggcacctccatgagtggaggaaggagtcctcatagtgaccttccccatgcctcaggtctccaacttgctttggtgagaatagaggctcctctgaagcactctgtagccaagtggggtcagactagtcctcatctgaccctaccagtgagccctgacccaagagcagaagaggctcaggggagtgggagggccctggtccggggccgctggtggctgccatggaaacagggaaggggagaggcgaggtcatgctgaattcatctgtgccaggtctctgacccccacatgagaaacgtggtctccctttgaccaccctcctgccctctctgaattggaagaggacagagctgcccagtcatgggagatgccttggcccagcccctcatctgctgggtgaggggggagctggaagcccagagtttcatatacctgctccagcactaaccctgcttggtagcctctgagcctcctttgcaattcccatgtaaccatctgcccactaacgcagcctacgaccctccccacttccgccagggtaatcagagcccctctttgtagccccttcccaggggcgcagagaacacatttattgttgaaagaagagcatccaaggaagaccttcctattgtcctttaagtagttaatatacgtgagatcgtttttggtctaagaccattgtgagcaaatcgaatgaaagtaacagcatctcgacatttccattttaacccccagatcttaatctcctcctaaatgaggacttaccctcccagatccccatcacttcttggtgaggcatcggtttgctcatctagcccatcccagtaggggaatggattctcgccccagggcatgaatgaaccgtctctgtttgcaactgtttgaagctagtaacagtgaatcctggagagaccccgggtgcccccagttccagcctctgcttcgtaaaaaaaaaaaaaaaggtctccctttccccctgccgaatttccatcccctaagagtttctgaggccaaacgactgagaagagcatcccagggcgacgcctggctgtccctggctaaccgcaccatcacccatcctctcctcctccctcccgactcctgcccaggcccccccagcatccgggcgatgaggaacatcacggccgtggctgggcgggacacccttgtcaactgcagggtcatcggctacccctactactccatcaagtggtataaagacgccctcctgctgcccgacaaccaccggcaggtggtgttcgagaacgggaccctcaagctgacggatgtgcagaagggcatggacgagggagagtacctgtgcagtgtcctcatccagccgcagctctccatcagccagagcgtccacgtggccgtcaaaggtaggctccccccgctgccaccctgaaccggagcacccccctggtcacccaggactgcaggctcctctccgcagccgctcaactggcagcaggcagtcctgagtggaaagccaagaagagaaggctctggcctggagtttggaaaaagtggggcagggagattgcacaggggcagggggcacaagaaggccatgggtacctctatgtccagttccggctgtgggctgcaggtcaaggcagcgctggccccaggggcatgaggggtcagtgacacacaagaggagtcaggtcacctggtcagaggtgatcggctatattgttcccctgtgtcagcatggagccacccagaactcagcagggcccatcagagaccagcaggcactcgaggggcaggactcagaatggaagcagcaggagggagggttggaaggcgcaggcactgggtgccctgactcccttccggggttcagacaggcgaggctgcttttccataattgacaaggacctttcaactgctaagggcttcactggtgactcatatggtaaagaatctgcctgcagtgcaggagacacaagttcaatctctgggtcagagatccccaggagaaggaaatggcaacccactccaatattgtttttggaaatcccatggacagaggagcctggggggcctagaagtccgtgaggtcactaggagtcagacacaactg

SEQ ID NO: 35596 - DNA, 1653 bp, Bovine  19866881072630
acttgtcgcccatgtcagcctcatctctccactatattgtatcctccttgagggcagggactgttaaataggcagcttttcatcattttctcccccttgccctgaatgcacaaaacatacaagattaaatacattgtgtgtatatgtgtgtgtctgtgtgtgtgtacacacacaagcacgcacaacagggtgggccaggctatggatcttcaaagttatattggctcaaacacagtagaggtttatgtccaacgtgatggcctggtctgtaggtgactctaggcacccaggccctctcccatcttatggttcccccacccctagggtctcacgttggctgcatcccaccacagaaggggaactagaacttggatatccactgctttggagaagtcttggtcccagaacagctcagagagggctgggaagtgagttctatctaatgcccaggaagcagggaggatgctactgagggtttacccataccttccccaccagggctcgggtcgctggaccctgcctcttcccctgatgaagcttggattccattatctcatttgcctgagctcctggtgcccagctgaagatcatttgactcgggagctgggtcctgcccaaggctggcattaatcctcagagcttagcctctcccctcagctgccacatgtggaaatctggccttgcagctggcgtggagccaggctggcggggagcagacctaatcccactttgagcttttcagggagcaaggccccagcctcagcaccagcttccagctgccttggccgggggcatccctgtattttagctgaacctccccacccccaacacatgcagggttgtgggcctcagtggtccctggggtcggtaggcagagtcagcaaagaactccaccatctgccactgggcactagaacagcatttccacagtgtgatagtcagggaaattgtaattggtctcacacacacagtgaacccattctttacacaggacttctcagagcctttaattgctcagtcaccaaaaatataatgagcacctgccaagtgccgggtatgcgactagctactgggaatgggtggtaaataagacagacaagttttgggctctcacggggcttgtattctagtggaaggagatagaagataagcaaatgagagctttaaatagtggcaagtgctacgaagcaggtaaaccagtaaaggctagaaactgattgatgtgttagtatgtgttgtgaatccccaggggcaggcaggaccaaattttctatgaccagttctcaagaccaggattccttggaaaggtcttgaggaaacaagcactagaatgatctttctaaaactcagattaaacatgtcagtctttagcgttaagccccctgagttcccccatcatctccaaaacagctttcaaggtcttctcttggctggcccccaccattcgagctcatttgtcttcttccctctctaaaggttgctggtttgacatgctccctcacattcccaagtttgcccagggtggtctcacttctcagaaagtcctctccactttctttgtctttgcaaacacatccttcagggctctaacagaaggtaagcaatctgctgtaataaacagctccaagatctcaatgacttagtaccttacaa

SEQ ID NO: 35597 - DNA, 1625 bp, Bovine  19866881076826
tggtgggtgatgaagtagctggtgtgtgtgtgtgttttaccaatgccagttgaagcagctatatgaagacgctgggaggtgaaccctttccaattcaggttaatcatggatattttggggggtattattttgccatgttatattaggactagagccatcatgagaaaccacagatgtttttattgtttaactcaaacaacagcttatatactttggatacttttcttcaaaaacaaagacatataattattttagtagagccttcctatgtgctctgaaattctttaacaactcagtatgatcatggttttcataaaaggaatcaatactgaaccaggtcagtggtacaaacttgacatttggggttatatagctaattcaggattgaccttcttagtacttattcattggttggaggagaaaaaaataaggatttccttggctttttttttttcttttttctccaatctgtaattgattttaatgttatatgaagagttctgggttctagtcttatttttgccactatagtcagctgtgatcttggacaagtcattatttttctggggcttcagtttcttcacctctgcacgttctctaatgtaggcagagacagaaatatgtattttcacacagatactcagaagtaaactgcacaaaggaaaccatttttgctgcaaatgcatgcacgtgtatctagaatacttctgtcttcttgagacaagcttgttattatagtgcagttgctaagtctgtccaactcctttcaactccatgaacgccaggcttccctgtccttcaccatctcccagagtttgctcgaactcatgtcattgactcgatgatgccatccaaccatctcatcctctgtctcccccttctctttttgccctcaatctttcccagcatcagggtcttgaaaaaggtgaatcattgcaattcatagactatgctgctgctgcagctgctaagtcacttctctgtgcgaccccatagacagcctcctaacaggctcccccgtccctgggattctccaggcaaaaacactggagtgggttgccatttctttctgtaatgcatgaaagtgaaaattgaaagtgaagtcgctatgatgcctatacaaaaaggcagtgctgctgctgctgctgctaagtcgcttcagtcgtgtctgactctgtgcgaccccatagacggcagcccgccaggctcccccatccctgggattctccaggcaagaacactggagtgggttgccatttccttctccaatgcatgaaagtgaaaagtgaaagtgaagtcgctcagttgtgcccaactcttagcgaccccatggactgcagcccaccaggcttctccgtccatgagattttccaggcaagagtactggagtggggtgccattgtactgtcattaaattacctgggcgtttcttaaaccgaagttctgtatgcttaacgctgaggatgtctaggtacattttgtcacttaccctctccacatcttggattctagtatcatgatcctaagctctctgaacaaagggccccaatctttgaggctcctcccccacagatggcacctcccccacagatggcacctctgggggcccacagaccttgtacagg

SEQ ID NO: 35598 - DNA, 1630 bp, Bovine  19866881080451
tgcccctaccggccgcatccgatcctgcccaacagctcgctgctgatccgccacgtcctggaagaggacatcggctactacctctgccaggccagcaacggcgtgggcaccgacattagcaagtccatgttcctcaccgtgaagagtgagtttcgcccccatgagcccctcccagcactccctgatcgcaggccaagacccatctctgcactcaccctgcctccccacctggtttcccttgctccttctcggagagggaggcaggaaggattcctaggcagaggtgggcttaggaactctgaggagggattcaaaatcactctcatctgagacaatggcctcactgtgaatggccccagctcactctgctcttatcatgataaataggtgaagtcactaagtcatgtctgactctttgtgaccccaagaactgtagcccaccaggctcctctgtccatggaatttcccaggcatgaatagtgaagtgggctgccatgtccttctccaggggatcttcccaacctagggatcaaattcgggtctcctgcattgcaggcagactctctactgactgagccagtagggaagcatttactataccaaagtatcatgtgacagcctatttattttgctctgtaggttggcaattccatctgaatagtcatatcgaacaattttttcttctgttatttaatgtatgcctgcttgtgtataacctgttagtggcttagaaaagaagagatcatatacacagtataggagaaaggcctgtgggatctgggttctgattccaggtccaccttttgatcttcctggctttgggcaagtgacttcacatctttaggttcctttactcacctgtgctaggttcgttcccagcccactaggctcacaaaatcattgtgcttagcccaggaaatgatcgtggaaaagggaagacaattcagaaagggcaaaagagcaatacaactcaccttagctcggtgccatacctctggcttctaaatccccagacctagagtcggaatcaatcgccttgaagtctggaatagccttgagttctgttaagtcacccacagacattcctactgggcaaacctatcccttcatgctgttaggggtctatgtagtaggcccctaagagtcatgtcaggacagtgtctgaaacagaccacaggccacagagaagagcagttaaaccctgagttttagcatctgaccaagccagctgtgactctgggcataatcactgtgacctctctgggttttcctggcctctgtatctcatgttcctgctgtacaaaaatgagagtcatgagagcaccttacctgttatgttttatatcaaaagcaagtcagatggcgtgtgtaacgcaaccagtatggtacctggcacccagtaggccatcggagagtcagccaccagttttggttttaatgggagaccctccagggtacatgtaggaaaggctgatgagagcagtgcccagagtgcggtctgcatctccctggaggccccgcctttaagagtcatagtttctttatcgtttgccgaacccgtgttcagctcagcacaagacggggaaaccccggccatcgatcgatgctcagggagctccaggcgccggaa

SEQ ID NO: 35599 - DNA, 1804 bp, Bovine  19866881295975
tggagggaataaaaagtgaatgagagagtttggtcttaaatgataaggttaaggcacatagaacatacctaagataatggtgacatgcatcacaactgctgtcttcatttcctttctgaaaggtaaacaaaggtccctgaagacctaggggccagaaaggttccctctgctaaagcaggtctagcatcacaggcttgatcaggccatcagccctagtttgacacttccattgttaaatccagatgtctctctggggcccagggcccccatggtctggcccgtaccattctctgaccccatcttgtgccacagttctcctgattcattgagcgatagccacacctatctcttagtttctcagtcaaaccagggtgtttcatcaaccccagggcctttgcatagactgttctgcctggaaagcccttcccctacacacttccccattggctccatctcatctctgtctgtcttgggcactggtatttccccatggcaccaagaatgtcctttaaaaagttgttgaatgagcaagcaagccaacatagacagcttggactggaagaagctacatcaaccctggcctgcctccatctctcatcctcacccagctcaggcagatggagaccctaaagttctcccaggaccagatgccgcagccaaccacgtgcagcagggttttctcagaacctgcccaggggtcctgcccagtcatatgcccacccaggccagaactgccagggccattgaggctacccttcattgaagaggcttgctttgagggctgctgtccctagtggggaaccctctggctctctccttttatggggaatctttgccgatggattggctgtaattgtcggatttgcatttgggacacctgcagccagaggccctgggggcacctaggcctttggaaatcaataggaataaacaaataaatatattcatagactgggacctggagaggaggggtggctggaaaggaggagaggaaacaaatcaaagtccctggcttaccatctgcagcaaggggaccccactccccacccccatccctaccgcccccaccagacccaacgcggagctccgttctcaagtacccgccttctatccccacagtgaaactgagactgtaatttcagtgctaacctgaatgggtttgtttccttttattaactccagcgttggggttttaggcaagttggctattgttcgagccacactcctctcctctctactccccacacttggaagcagtaggaacagccagaaggagatggcattaagctgcagaagtggctggtgtgagcccaggttgccctgcagtcagatggaagccagtagcagagcaatggaggggcggccagggagagccagctctttctgcttagaagccagtgttgttcagggtccagcccaggtgccttcctgggtgcacctgctggggccccacatttagaaggggacttggccagccttgtaaggacccactggactccagcatcatgaggcaggaaacaacagcacactgtgctctacggcttacaagaagcctttacacacccgtgtgtgtgagccagctcctgctgagagcttgcccagactccgagacatccagctgctgggggctgggctggggggctggggggatgcgctttggcatgaactggccccatgggatttgtaggctgtaaagcaccctgcggagaggtgccagcctttcctcctgtggcctgtgagctcccaggaggacagctgtcttatcatcagtgtgctcctgcttccatttccggcctgtcataga

SEQ ID NO: 35600 - DNA, 1105 bp, Bovine  19866881365446
actttgcatttcatcagcataaacttcctatcgtgtttcttggatttcagacctcagactaacttagatgtcatgactaagagcctggactctgaggtcagtcttcctgttcacattccagcccctgcttcccagatgcaaatccttgagcaacacactgaccatctcagggttattttcctcatctgtaaaatggggatgatgataccaagatagtgttggtgtccttcatgtccttcaagcactcaattcttgtcagcttttattattctggcttgctttgatttttcctctctcttgccctcaaaagctgatcagttgccaacttccaagcacacctcagctagcctggaggggctcctcacatggctatgtatctccagcaccggggccagattccttgaagaacagctagggctcctgacacgagaccccacttgtgccctgcacggaccctcttccacacacttcttcctttctttgaccatttagtcctctctccttggttccaggcttacgtctcccaggtctcctgctcccagacaggacctggctgcctacccagcctggcatccccccaggccacctccttgcagaggttctcctagcctgctcacctggccttcccaggatgcacatacctccacaaagcctcgcccatccatccatctccctttcttttcttccgctttctgagtttaggtctggtgtgtcttcaccatgcctagctaggtcactacttggtttcccaggcagtgcctctgcctcttcccttcggtcgcatatacctgtgtgtgtggctatcacatcattcctgctcctgctccatctgctaaagtccctccaggtccctccagagtggccccagcctggccctgagcatggcaaacccacatggaacatgcactttccagactcagatggaaattagaaatggcagattgatcagtgctaatgaggcttaaaaaaaaaacaaacaaaaaaaatagacctagagattaaaaaaaaaaaagatgaagaagaatcagctctacttcaagtgtaaatctgctccacagagaggaggtctaggggttttcactgatataggtcatactctggaagt

SEQ ID NO: 35601 - DNA, 1221 bp, Bovine  19866880406795
ctgctcaattcaaaagcatcaattcttccgtgctcagccttctttatcgaccaaagttctcttaccttctgtttttttcttggggtggggtggggaggaggggtgaaaaatgagaaagtagtagcacctacttcacagagttattgaggagatgaaatgagacatttactgatccaggtgaccaaatgcctttccattcattatgcatttaatttttacaatttctaggagagtaactaagaacatccaatctaagagataacattccttaggctgatgaatttcctctggttattagccacaggaaacaccagacccaaccaagtcttgtgattccaagccttacccattctctttccactacactgtgctgctacttaatgagatccccaactctctgtgtctttgccttgcctttaacaggatccgcattgagggaactacacatgcaaattattattagcatgaagacgggtaattattattttttacatttgcatcatcacagataatctttttgttacacattctttagcagtgaatgcctgaatgagagggctttcggttcattcagatggtcattaattctaaataagaaattcatttactgtcactcatgttgcttaaacaatgcaaagcaaagagtgagtgcagagcaatttcagactgtaaaggctgggacggaagctggaaatcacctagcccaaccttttaatttacatatgagcgaaatgaaggcctgaatagagaaggtcatacaattaattagtggcagagctgggactagcacacaatttctttacctctatgccaaagtcttgccattaaagcatgaatgctgatcatcggaatgctatttggttaggaattccctgattacttaaaacacattgagggcttaggatagagacacttaatgtgctaaaggttccaaaatgaaaatatatgatgaatctttgacaaattccccttgtgttgtattaattttaatcttcattatttctacaaggcacttgtagaggggaaaaataagtatctgtatctactaaatggtctcatttgagttctgccaatgtaaaggtatgaactaaaaacattttacattaaaacagagcaaattgcttatggtaaccattgcataatgaaggaacacaatgaaaaattaagttcaaattacttatcaggtctcttccattttcttaagttttaaagtagaaaatt

SEQ ID NO: 35602 - DNA, 1658 bp, Bovine  19866880446277
ctttgcgaccccatgggactgtagcctaccaagctcctccatccatggaattttccaggcaagagtactggagtgggttgtgcagaagtggttgttaaaaacccagaactctggaccccaccaagacctgctggatcagagtttgtgaaagcggactctggatgatgtaaatattctaatggttcttttttaattttttaaaaaattaattttgttcacttttggctgtgctggatctttattgttgtgtgtgggctttctctagttgcagagaacagtggctgctctttgttgcatacgtgggcttctcattgcagtagcttctcttgttgcagagcatgggcgctgggtgtgcaggtttcagaagttgtggaatgtgggctcagttgccccttgatatgtaggatttttctggaccaggggtcaaacccatgtcccctgtattggcaggtggattctttaccactgagcccaccagggcagtccctctgatgactcttgatgctgccattctctggggaacagggtttcacttctttagtatgtataagggctccctaatatccccttctttggggttcttgaacagatgttccccaaacagcacagaaaataggtaccatctggctctgtgagggtgtccggggttgggctctgcagagatgtcacctccaactgctaactccccgcagccaggggacagaggtacctgccagggagaggagagagccccttgggcccccattctagcattttcatttatcatgcaaatgaacagagtgaaattaggtcatgtcagggctcgcaaatcaaaattgtgtcagagagctcttccatggtcagagtcgggggctggctgtggattcttcagatgcttctaatttggaatttcccagccagtcaagaagctcctcgtgccaggcttcttcagcatgaggggtgtctatggccaaggtctctggatttgcagcagtgatttgcagccaggtctcagcttcaggctctgctgaattcagataaaggaccactaagtgtcctaagagttcagtgaaaaatgctgtgtgtccttggagttagagtcctgcctgaattagatgtaactgatgctgctccaggctaactgcttatcttcacagaacttatcttccagagagcacaatctgggctccactgcttatggataggggtcatggggcaagtcccttggccgtctaagtctgtcttgctgtgcaggtattctcagtatatatcagtatatgctcttgaagaaggcaactcctcatgtttgtcaatggatgatacattagggatatacatgcataggccaactttgacttataatgctccccttattaatttagttacacgttcattcactacacagttacttgcttctggtaggagcgtttgtatggatttgcatctgtccttaaccttgaaactgcaaccacatttctgactccattcctaagtttctgaggcaagacagtcaagccctttgcacccagtcagaatttgctacctgctgctgaaccactgcctgaataaatgaataattcgctatggaagcagttggtctttattcaaaagcaccagcttccttcgatgggttggctttgccagaataaagaaaagttacccctcccaaggggcagagg

SEQ ID NO: 35603 - DNA, 1523 bp, Bovine  19866880563651
tcctcctctttccctgattgtcccccacccccactagatgaagttgtcctctctttcctttgtgtcaatgactgttcctttcacatatctttattaaagcatttgcaacacagtattgacataatttgattatattctgccttctctgccagactgatctctttgaagatagagaaattttgtttgttcattttagaattcccagtgctcaacttaattcttagtgcatgacaggcatacagtaaaggtttatgaaatgagtgaaagaatgaacagagtttcatattctggcatgctgctgctaagttgcttcagttgtgtccgactctgtgcgaccccatagacggcagcccatcaggctcccccgtccctgggattctccaggcaagaacactggagtgggtcgccacttccctctccagtgcatgaaagtgaaaagtaaaaatgaagtcgctcagtcgtgctggactcttagcgaccccatggactgcagcctaccaggctcctccgtccatgggattttcaggcaagagtactggagtgggttgccattgccttctccaaatgttctggcatctctagccataaaagggacttttcctcccatctcagcagctagctatcgtcctcaactaattatcatcttggtttatggaaagttgtctcattctcccttataactgtactttctaggaaagttaggaatgagccctgtggttataaagcaggaaaggataggaaccacattcactgttagtcgtgagagtctgaagaattgtagttaagagtggacacagtaagcctaacccagaagcaccttaccaaagttttgcaatcattcaggtagctggttcttaggcatctctcttttaagctgcaaaggagattagatatagagggagactcttgcaagaatcggagatgctgccttagcaaagattcaagaaccagcagagttaaaaagattatcttcttcctaaagacactatttcctaaactaatcagtaggattttgtttttcttcttttatgcgtttggagaaataaagaagtcatgtctaccataagcagctataactttttttttaatgcgataaactaaaaatacatacaatgccacataatacacttacatcttaggttgtaattaatgcaaattatgcgagattcatatacaatgtgattagactcctctagcacataatttatggttgaattcacaaagaagctgattaaatgagaaaattgatttctgtcgctatagttttttttctggttatgttttcagtaagaacatgtctgaggacttaaagaaattagattatggagttggagttgtggttcaaagtattcatgtcattctttgaccttcttcttacagatcagctaacctgcaaagccacatgatattttctgacaatctgctgcgggataagtttcagtaaaacaacacaaggctcttgtagcttcaaaataccaacacacggatcattcagcaactcacagaggagatttttttccccc

SEQ ID NO: 35604 - DNA, 1119 bp, Bovine  19866880565444
tgtaaatagaatccaggactcctgagatcaagtccagcatattttcttctagagctcatcatctctgtgttcttccaggaacaaggagcttcctactcttggaggcacccagttgtgtaatagaacagtttgtcggttggaaacctgcatggtttccaaccatgggacttcatactgtccttgcaaaggttaaaaaaaaaaagtataatcttcttccaaatatctgatgacatacagtaggaaagcttattcttccatgcccgacttccgagttaccacctgtgcattctgtctgccattttacacacagaattagcatagtgggtgctcaatgaaggtctgttgaatgaatgaatgtgaatgtctaggatacagtttctacttttttcactgttctgatccctttgccctaaacacactctcccctggctttattctttcagcatcaaattctgagcaaaagctacagcaagatgatttattaagcacctaatttattctctgccaatgtcttgaaatgtttcagatacttgtggtaagcctaaccatggactttttctgtgtgtttgtgttctgggggtggagtgagtggagcaaaggcggaggggtaaagtagtgaagtaccactagtgggaaacaacaccgccttgtgctctgctgggccacagaatgcagcttcctctttcctgggtagactttctcagctcactcggctttttggatgccctaagaagtcaggctgccttgatcccaccctaccatttgctttattctaattttggaaactaatttattcaactgagaatgacacctaaaaacagaagaagacagcaggctcagacagggtaattaatgccacactgcattaagtttctgcagctgagataaatattcacacatctcctgcttgccggagtttagcttcaaatacccatcacaacagcggtaacgactgcagtcaactctcaattatccccactaatgaaggggagcactggtgtggaaaaccccaagcagcagataatcccaaagtctgacactctgatgcattatacgttttggaaatagctttaccttccttgttacagaatcttaagactgtcaagagctagaggggaa

SEQ ID NO: 35605 - DNA, 3226 bp, Bovine  19866880578256
gagccttcgtgttgaacccatagtgaggcccaacccatgggtcatcattcttattctcattattatttggggaggcggggaggataatttccttaggacactgactccatgtaccctagccctacaacagtgaaggcagagagtacttcctggcaagcaagagttaacagagggctaaatcccactgctctgaaggccatcaaggccaaatgagagcactgaccttcattcattcaagctttgtacttctgctaagggaccacagtttgcctgatgcatctgctctttctaatttggcctgtttgggtaacaaagctcccagtgatcatctaaacctcatttgatgcacctgtgaacaattcattatattaatataacagcaggggaggagcagaaacactaataaatagacgttagctgccagcaccccttgttgcagccgtggaggacctgcattcttctcctcccgctctctggccctggctacactgggaaggtcctgtataccgcagggacggtggatctcacactcttcagtccctgcatttggccagagctaagcacatcagtgaactgtcttttctcaagctctgtagaatttccaccttatccaattaaaaaaatgtgttctcaggtagaactaaagagcctcttgatgaaagtgaaagtggagagtgaaaaagttggcttaaaatacaacattcagaaaactaaaatcatggcatccggtcccatcacttcatggcaaatagatggggaaacaatggaaacagtgtcagactttattttcctgggctccaaaatcactgcagatggtgactgcagacataaaattaaaagacgcttgctctttggaagaaaagctatgaccaacctagacaacatattgaaaaacagacattactttgccaacaaaggtccgtctagtcaaagctatggcttttccagtagttatgtatggatgtgagcgttggactataaagaaagctgaatgatgaagaattgatgcttttgaactgtggtgttggagaagactcttgagagtcccttgaaatgcaaggagatccagtcagtcaatcctaaaggaaatcagtcctgaatatttattggaaaggactgatgctgaagctgaaacaccaataatttggccacctaatctgaagaattgacttattggaaaagaccctgttgctgggaaagattaaaggtgagagaggatgagatggttggatggcatcactgagtcaatggacatgagtttgagtaaactccaggagttggtgatagacagggaagcctgctgtgtggcagtccatgggattgcaaagagtcagacacgactgagcaactgaactgaactgaactgaagacatggagcatgactgttgctaactgaggttgctttgtttaggctgtgggaactctcctcatggctgaatctctatttatcacagataaataaatctctatttatcagcagatctgttccacagcagcccacagagtgattggtcaatgtctttactttgttgactctcagcacttctgtgctggcctagagagaattttcccttttctatcacttgagaagatatctgtgtatgtttgccaatgctctgttttactgcttcttctaaaacatggcttatttttctttattcccccctcaaacagctcagtcaacttcaaactaaaatacatagttctggaagccaaaatcaacctacagatgttccaatatggcgtacatcacacccctcccccatcctcccccagaatgtgaccctgacttcctctccagcccagtctctcccactttctgtcttgtgtttcatgctctaggaggaaaagggaactggtggcaattcctcatggatattatgctgttacctgcccccatgtgtttgcccaggctgtgtcctctaccacaaatgccctgaactgttcagtgagccttgttacctcttcttcatcctagacattttgctcaagactggattaattatccctgatctgtgttccctgtgcccacctctgtcattacatctatcccctcttattataattacctgttatgtttctatcttttcccaccacctccccaggaatgtgggctccagaaatgtagggactggtcttagtcatgtttatcctcagtagatgaataaagccaggtgtagctttctgctgaggggagatgcaggtagaggagaaaggaatatataaagatggtgagacctgaacttcagtggtgtagatgggaacactggccacaaggccagtgaaagtgaaagttagccactcagtcgtgtcctactctttgtgaccctatggacggtagcccaccaggctcctctttccatgaaagaattctccaggaaagaatactggagtggattgccatttccttctccaggggatcttcccaacccagggattgaacccaggtctcctgcattgcatgcagactctttaccaactaatccaccagggaatccccgaggccagacctcattgccaatgattagctgtgtcagcttagataagtcagttcacccatttaagcctctgtctttcattctataaagaatgttggatgatctttggagctcaaaggattctggtggggtgagggttgtccccaggcaggtgggtaaaacagatgaaactctagtacctcctttcctcagattcagcttaatttgaagaatgagttctaggtcttaaactattggcctgagaaagtagttagcaactactacaacctcccatgatgtttgatatctactaactcacttcctccttacaataataaccctatgagagggtagtactgtttccatattttaaaagaggaactgaagcacaagagaaatcaaataatgtgcaaatggacacacaactcaagagtgatggagttaagatttgaactcagagtaaggggcctttcaggactaatacttggtggttttatattgagctgaggagataaataaaacacataactatgtacataatatagtatttgcaaagcactaagccagtgatgcaaatctaatggctgaaaagcagggtccagaggatggtgtaatcatctggcttggcttattcaggaagggagcttggaggaggtaaaactctagcagaaaccccaagtgagagcgggattcagataaatggacaagtgagggagaactatgctttagaatcgaatctaaagcataaa

SEQ ID NO: 35606 - DNA, 1294 bp, Bovine  19866880603456
actagaatcagaggcccagagaaaggtaaaacatatgtccaaagtaacccagccaattaaggtgcaaaccagaaatctaagctgttcaatcaaagctgaaacacagggcttgacagcaagagactagtagacaagggctcagcagtggtgtgccacgtaaggggctgcgcccgccctgtgtccagtgaaggtgtgtgttatctccagagattttaaaatactaagaaagcagaatagagtcagtctttttactatatctatatcactgataggccagtgattctgcacaaagacagagctgtaatacttcttcctgccagagcagagtgcgcccaacatcccccttatgctgctgagtttagcaatcattttggactaattaaaaccacttatgtgggcaagatagatatacatctgttcattgggcgtgtcagcctttttcagtgcatgaaagtgaaatcttcagaaacaccctgtgtggcatgctttggtttatctcagtttcccataggtcatggacagcttggcattttgttcccaagtcagtgggccctccagatgactctcactagagggcagtaggctggccaggacccagaggggccagtggggatcagtgtgcccatgtctggaaggctacttttttccatctaagccataacatacatgtctgggtagcctcatccaaatgccttacaaacaaaatcagaagaagcagaaatatgttccaccgtcatgtgtgtatggcttctgaatacctatttctagacccattttctccccagacttctagatgtatagtgccaactgcgtatccccatttgaatgcatactgcacaattcaaatgccaaatgctccaaaattggttattaacgtctcacctttttgtcctggcatggaaagcagtctgtccactctgcccagttgtccagctggcaggagaccgctgtgggggtgaaactctgaacagctcgactgactctcctaaagagacggaagacctcgattcagtttttaatttatcatgatcatttgaatttctgtaattataaatgtgaaaaggtgttttaatatgatggcatcttaataatatgtaaacagatgctgaatttttccccagctttattgaggcataactgataaaaaaaaaattgtatggtatatgtatgatgacgggtgtgatagtttgatatgcatatacattgtgacatgattatcacaatcaagggaaagatatacctcacctcccataattaccttttttccttttttggtgtgctaagacatttcaga

SEQ ID NO: 35607 - DNA, 2353 bp, Bovine  19866880631252
catctccaggaggagaaaagtggattttctttttctgaagagggggagaaagtgcctagtgaatagaatatcaaatgcttattgaattttacaggtttttgccctttaggtgctatttctccacctaaaatagatacacaaaagccctgataatacccacaacctccattaactagcaggttgctactaagccttcctgaatcagttcaagaattacatcttctttgagatgctccctagctcccagggaagatgtacaaattctttactgatcttattatattcatccattctattggagaaaataattattgcagtaatttagtgtatttgattcagtatgacaaatgcattattaaacactcaaacttttatttaccaataaatacacacaaaaaatgaacattcatccaactcctgagcctctggattaagcagtgaggagacggagcaatgtttgggctttgcatagtattttcacattttgcatgtttattttgacatgatggcaccatcacagttcagtggattctctgccctttagagcagcacaatctgtcaaggtcatgtataaaaacaggctcttccatcaacaaccgacatgcagactccatgtccacatgggttgcatctgtcccacatctcctgtcccttgccctctaacaactgcaggttaaaggcctccctgtcattagcattggggatccccacctgtctctccatctgggagactctcagcggtggtgacagatcttactgaatcacctcgtcttctttagaaatgttgtaaggccccggggcggctgctaattactagacctgtttctactgtagatgccactctccttccccaggaacagcttatctggagagcagtggggggagctatggagatgggcatctgcatcctggcagcgctcacggaccggctcccaggaggtaggatcagcagctgaggactggcggagggcaaatgtgggtcagcagcagcagctgcagacaagagctgctggctgactcttccatgacagcttttctactcatatatttggaatccaggcacttcctctacattactcactgatgaatgatgcctgcttaggctaaagcatcttgaagccattgaaagtcctgcctctttcccctgcttctttctctagatattgtctgtctcttacaaacaactgtccctcccctcaacatgcaaatacttggcgtgacctctgtgtggcacatcagcttacaagttttctttggtgcatggatgttagaaaagtctttaacccacactacctcttctgcttgcccacctcccttagagatgctgaaaaagccaaacacatgctttcttggcttcccttctggctggaagtggtgatatgaatgcattctggcacataaagaataaacagggatggaggtctcttgctttttgagagttcttcctggggaatttctggggttttttgtctgttttgttttaaatctatgataaaagaaaggagacaaataatgaaagctctactgtagcatcctggctgtcatggcttctttgtgttttcagtgatgtcatatgaagggatgtggtacttggtttctatggtagctattctgggaccataaagcattaatctaagtatgacacacagtagaaagaacttcagcacctgatcacatccttgaactactacactgatcttgggaccacctacctctgaatctctgctatatgagataacaaaatgactttcttcctgatcacttgcaaccagggtttcattttgctctcactaacagtttcacattccactccaagtttctcatgctaacacgtcttaaactttacaaagtcagagagaagtgaatgaaggcacagatctcccccataaaaacatgcatactcacaagttttgcctacaatttcaggagcatcacagaccccctacaagcccacccatggataatgcattacttttgtgctcatagaaaaaacctgtctatagattatgtacatacacacacaggattatataatcaatattgatatatacagagccccaagcactccaagacattttaaatttctttgtcttacaagatacatcatcatcttcatcatttgctgaatgcctactatgttgatggtacctaagcaactttctaagtactctctatataatctcatttgatctctaagccctgtgaggtaggtattactattagctccaccttagtggagaggaactaagacttagagagactaagtaaactgctccaagtcacaggatgagcaaacaggtaaagttaaaatctaaacccagggagtgtgactacacattccttcttttaacat

SEQ ID NO: 35608 - DNA, 1514 bp, Bovine  19866880632725
gaagacagagttacattaaacaatttttaaaacatttaattttaattttgttatgaagtatttaaggagtttttccattaaaattgcaaaaaaaaatcttgattttttttttttttcattttaggcaattgcagctaggaaagcaagcatttgccaggctcattatttacttatcagacacagtcttttaatcatactttatatactcttataaagcatgcagagtatatttatgttgtctttggaagaatgaggttttgaggggagacgttactgtcatttcatgaaagcaaactgcacaagagaagactaattattcatgtaacttactcattgatacattttttaaatgtttatacagattgcagtgataaacttaagtcttctttggtgaccagtgtctgatcttaagttaacagaattctgtgagagaaaatataaaacagttatcattgcatatataggagcttgggctacatagcaaatgctgtaaacattggatagtgatttttattgaaatggattatactgttttaattggaattgtagagatatactgtattacctgaggcttaggtttgagtttggtaatgtgccatcagggcaattttaacactgtagaaaggtgagagacaaaagggacagcattctaggcataggttttctggataaaggtcgtctcagccccatgagccaccaggttatttgaatgaaagtagtagttatgcaggataatgtgatatagcatgaataccatgaaagagattgctatagaactagttaggtactttactatttcaaatattctttaaaataggtctgttgggcataaacattctattttttatacattgtcttgtcttttaattgctttatgtaagaagatttagcctatacactaatacactatatagtattgcttttcttaaagtttatggtcatctactttgatgtttctatcaaaaatcaaccacagaaagttttatactttttaattagtaagttcagtttagtttgtgtcaaatacacataagtactgttttctcttgggaaatttgaatctcaatgggttagaccaattgttctctctggagaccaaccattgagtgttggggagtggccatggatttcattaaagagcttggaaagcaatacatttggagtctgcactgtgtctacaggcgcatagagaagaagtagggtgcgtgcaattgagaagtgacacttgcgcttcagttttgtgctgtcatcttcccctaggctgtatgcaggtcctgaagtggatatctggagctgcggtgttattttgtatgctcttctttgtggcaccctcccatttgatgatgagcatgtgcctacgctgtttaagaagatccgagggggtgttttttacatcccagaatatctcaatcgttctgttgctactctcctgatgcatatgctgcagggttgatcccctgaaacgagcaactatcaaagacataaggtgaatattcttttttgtgactattaag

SEQ ID NO: 35609 - DNA, 1916 bp, Bovine  19866880645816
gctgccttcatctgtcatccagaccattccatcaccttcctgagcagtcctcaggttttcagagtcatccatctccaagctcttcctgacagtgctcactaatgggaagatctgatcagttcctacctttgcatcagacccttctgcgaacagtccccactggcctcaggataaagtccacgaggtttatcggggcttcagggaagccctgcctggcctgtccccttcttatctttccagtcacatccctcaccactcttccagaatgatactccactccctggcttaactgaattcgtttcagtctcctgatcgtaccatggtatatttcacatttggaattttgcaaatgtttttttttttcttccaagaatagtacttaaaaataattctcttcaaagcaactccacttctgctttagcttcaagttagctattacatccctggaaatattcggggggcccattgcaacccacccaatgcgatccccagttgtgatcatgaccagtctttgtgctcacaaagcacctcattttgcccatcttaatacatggttttaatcatcttttggttcctctttatccctccacgctgggagttctgtgagtgcagggactatatctggcttcagtttaaaaagaataataataattttaaaaatttatttatttttgaatgtcctgggtctttgttgcaacaggctttgctctagtcatgaccagcagggagctactctagttgcagtgcttgagctttcattgcggaggcttctcttgttatagagcatggactctagggcactcgggcttccgtagctgtgtttcccaggctctagagcacatgctcagtagctgtggtgactgggcttagttgctccatggcacatgggatcttctcttaccagggatcaaacccatttctcctgcattggcaggcagattctttaccactgagccatcaggcaagctcctaacttcacttttaccactaagcccagtgttggaagatgtaggtgtgcagcctgttgaatgaataagtgagtgaatgactaaaaaagcctctcatgcctcgatttgtgaaggctcttatagcacacttcatttattcaaatcatcacatctaccacatttttcttatacttttttgtttatttctctgcctctgccactaactgtgagttcccagcacagcatttggaacatggtaggtattcattagatgtttgttgaattaattatcataaagtgtgggggagaatgatttgcagaaagaaagaaataagcagaaagaaaatttaaaaccataaacatctcccttaagagcttgctctagagattcttattatgtggcattgaaaattcctcccattcagtgaaccacctctcccttttgcaacgtgtgtccaatcatgtctggtgctataattcagcatgatgtgggccatattggtagtaagagctataagatttgccatattagttcatcccactgcttcattaagctcagtgtgctgcctctggcagtggctgggcttgaattttgatgtttggaagaacaaagcccttcatattagccctctgatttctatgagtcaggtaaagttacagtcctgcccagtgtctgagagtcttcatctttgcagatagtcagtaagtggcccagagcatggggttttattatttgcgtggattttctgagcagacaaggccccaggtgtgtcaggatgtgagcaatcccatcctatagtgacagtttctgggatggtcagagtacaacatgttgcaggattgcatgtttctgcccagtccatcaagagagcgcccgtaggtcaaagggagaggtgagggtggagtggagatgtctcctttaagcttaacacaagcatccccttttttcatagaagcagctaggctcag

SEQ ID NO: 35610 - DNA, 1283 bp, Bovine  19866880690267
attgaacgtggactggcaactcgtttcatactcaattctgctcactctttgctctgttgcctccctgtttaggactagtgccacctgcttgatgtatctatattcatatatatatatatatatattatatacacatatttcagatgcttatgacaactttaagtcagtaggatattatttatgactatttatgtaatgtttgttttcctttagttcagttcagttgctcagtcatgtctgactctttgcgaccccatggactgcagcacaccaggcctccctatgcatcaccaactcccagagtttactcaaactcatgtccgttgagtcggtgataccatccaaccatctcatcctctgtcatccacttctcctgccttcaatctttcccagcatcagagtcttttcagatgagtcagttcttcacatcaggtggccaaagtactggagtttcggcttcaacatcagtccttccaatgaacacccaggactgatctcctttaggatggactagttggatctccttgcagtccaagggactctcaagagtctcctccaacaccacaggtcaaaagcatcaattcttcggcactcagctttctttacaggatatcaggccaagtctaattctgtgccccatactcccaagaaggcaagagcctcagaaagatatgtcttattcaagggtggcgaggaatatataattaaaagagcaggagtcataaactaaccctaaagtaacaggctctttccagtatgtgtggctaaattctgtaaactggaggcaaggagaaactggtgttcacatgctagttcccaaagagaggaaacaggctaagcctcttcagtttatcctcttctgatctgggtgtgtgagggcccggacttatctctgatttgtgcagcagtggaaaggtgtgccgaaagataggatgatgctaatatgacagggtgaaaataattttcatatccaaatgtgtcctgctctttgcaggaccaaggtcactatgtacaaatatgctcatgctctccttctcccggccccaaaacagcaaaatggcagtactcagtatgctgcgatccgtggattttctcatttaaatagtgctattgtctctcttgtttatgagtttgtttctcatctcaggaaacttcaacccacacatcagctacaaatgtgctcccttccatttttttcccattactcttaattagatagtaaaatacaatccacctacatgaacaagaggggtaaaagaaagtaacagctaaatgcatttttt

SEQ ID NO: 35611 - DNA, 463 bp, Bovine  19866880701093
ctgacgacagaactccctgggtagactcttcatggaaccgggagctgcagtcagacttcctgtcacagagggaaaatgaagacctccaggacatgggcttggagggtaccggcagagctgtttcttctctgtgctgccctgggatctttcagtgtgcccagctccaggtaggtgatagttccaaatgacttcctaatcaataatatgctggggaatataaagccatatcatgctgaccctctctccttgtcacatgcctattgaataaggaacatctcctgaagcaatttacatgcatctgattacactatatcaacaactcttcaaattattgaggaacccagccaccgacttcaacaaaagttctcgtaggaaactgacgcatttaaaggtattttatcacgctaagaagaataggatccttgctctgtattctgaacaaagcctcagcatacttgcttaa

SEQ ID NO: 35612 - DNA, 2136 bp, Bovine  19866880718872
ccactgcatcccaaagagcatggatctaggttcctcagctccttttgatgctgagcacaggaagtaagtgtgtgttctggggcagagctgagttgttgtgacatgagtgggtacccagagaagatgctgaacaagagacaagaacaagggaaattcatcactgaatgagagacagtttaaaaagaaagaaaaaaaagagaggttgtggtggttggaagaggaaacacatcaggaaatgttcaagctgatggccgtggagtggtgggcagtgtaaaccctctgtgcctctgtacgctgtagtctgctcactcatgcttttgtgaaaatctcatttgggaagggaagtacttaaagatgagaataagaatacagttgatctttaggttactaagcaccaaaatatttttattttttagactgagtcaagtgatcatttaagctttgttgttctctttcattccatctcattagaacatccgttaatatttctttgctctcaggcacttcctgttggattgcataacatcatgtgaatttgttgaaatcaaactggtgggggaaaacaaaacagttgattgaaggtgaattggttcatcctgtgtattttcaaccgatttgttttcagccacgtgatctgctgtaagtttgccgctgggctaggtatggacccaagaccataaatgtccatgacaccaaagcacaggtccccagcacccaccaatcatgccgcctagctctctagaattgagtcagtagaacaatgtagaataagccgatcctttactgctcagggcttgctgcagcaagcatgtccagtctgtctgccttctgcatcctcatgtcccctgcaattgaactgacgggtccaggcccttgtttggcttaatattattgctttgccgtctgctgttatttcaacaggctaatccaataatgttttatctctttcattataccgagactgtataattttcttgtgttataatctatcttcttttaagattccccagagacggggaaagagaggttctgtcttgggttgatggcaggctcccatgaagctgatacagggacgtggaaggcaacactgccaaattaaattctgaatctcaatcacagccaccgctttctaatgggaaatttgagttgattatggagatgacagcgcaggttcacgtttattgcatttagcagaaattgtttatcctattaaatacagtcttgaaggagagacaattgaattgtagagcaccggtgaatacccgggtgacgcccaggcacagctaaactgtgtaataattatattcttatttgtgggctgaacttccccttgtggctctttttgcaaacaaatgcatttaggaggaggctgaaacagaatgtaagaattaaacaaaataaatgcagactgtgcttttggaaaaccttggcaactgtagctcacaccggcatccccatgaaggagctgcagcatccgtggggcccggggccaggcagggtgtagcctggcagtggtcctggacgcttgatcacagcccaggatacctggaggtgggtgggttttgcatctcagggtgtgaatctctgaaatgctgggggctcggccatgtgcttgatgtcaagacagggagttctgtgtctacacttcctctgtgaccttgggataataatataacttctgtgggaatagaaagtattataattattttcacaatagtagtaataataatagctgccaattatagagcactactctgtttatgaaatcttttaacctgcaccatctcgtttaatctttatttgaatttgatggggtagatattaatacagtcagcaggtgacatgtagggaaagcttcaaagggaaacatgatacttgccaggaacaggctgactatgaaaatcaacatagatgctgaggctgggagaagagcatctcctggcagagaatccagaggaaaatggtatttttgttttaaaggagaggactctggtctgctcccaagcacatatacaaaaaatcccactggaaagagtggggctggagcagaaagccctcaggacacttggccaggtctccctggggacctttgtaattagcatttgttggatatattttgttttacaggtcgaagat

SEQ ID NO: 35613 - DNA, 2441 bp, Bovine  19866880738268
tagatctatcaggtcactgaaaaaatgtctaaagacatttctaacacctgttagaaagtgattgcaaaaatccaagtagataaagatgaccagctagacaagggataattggtggctcagatagttggtggctcagtattcttgcctggagaatccctgtggacagaggagtctggcagtctacagtccatgggatccaaaagtgctggacatgactgagtgactaagcaacagtagcaagtagatgataaccagctagacaaggaataattatggtaacagctgccattcactatgcttagagttaggataattgttgtgtgtttttcttcttctttaagccttgaaaaaccctcagaaatgaataggaaccagtccatgatttcttaaccataattccaaaatccaataaacactaaaaaccagtgttttttttctttttttaaactcttttggtgtcagaaacctacctgaaccaacacaagccattttacagtctttatttttgctatattagatgaacattaatatgtcttaccacagaaatagtaccatgtttgatcacagcctactgcctcagaccacatgtatagaatttgtaacataaaacctttctaaaattgcaaattttctggattccaaagtacacctggaccaagggttttgctgtagagggattgtagaccaaattagtattgttttgtaaaggtggaaaccatttctgaaagaacccacttaattttccaaggaaagagaaagaaaggggcctgagtgcctgtaaaggggaaggcacagatggaagggcctttgcagaggtagagctaacctacaagattccgtgttgagcacagggagatcattatttgtgttggtgccaaagtacaattgggattctggaatgaaaggtcgaatggctctgtaattagtgatggttgagcagacaggctctcatgaagaaaaggacgtaggcagataaagacaggaaagcagcaagggggttggatattaaatccaccaaaaggctctctgcactaacatatcatctcccttttattgcccatcaaatgcaacttaaattgcttacatctttgagtgaaactttgagtgaacttcgcagcactaagtgagaagggcttcagggacaaataatgactttctccttccacttcgcctgctctacctactcgcttgaaaattcagtgtgcccacatgcctcccgcctctgcctatgctgttcctttgaatgtctccagagccccacttctctccaatgaacacccatttgtacccttcaatcttacctccttgggaaggactccttgaacagaccagtccaaactattcaaactaatttttcacttccctgtattttcatgaatcccatacatagactttgttaggttactgtttagtaagtgtcttcactatccaaggatcgaatgttttgaattggtctgtttaactagcctagctatcagcagaagatacagtgatggaatgacatggtctttgccctgggaaaagatcgaatttagtgggagagagagaccagtaagcaattatgataagctggagtgtgataagcactgagacggacgtcagcagagggaggcatttggcttggaactgggagaggacaggaagtttggggaaccagtgccacgaatgagacttgagtgcataggggttacctactgtgtctctttcctgcttgcagtcctcagagaatttccagtacctactgaataaaatcctaaatccttaactccaagtttttgcatgcacccactctaatagagaattccagtttttatacactgcaagataggagctaccaagagtagaaacagagtttaactcgggaattctagcacaagtaatgtgaaatgggagggaggtaagagagataatatactccacagtgattacagtgcccatgcatgggatctaatttgggtatacgggggaaatgaagacagcaggaaagagtagacagggaagaaatgttggggcctgaggattaatgtgctggggtcaaagaattgctagagttgaggtatcagagtaggcaagtggctgaaataggaggtgatgatgcaagaataggatacttgaaattgatgtgttagagatggcccagttattggtaaagatgaatgaagactcgggtgtatccttggaaaccagtggctgaggttgggtggagaacaaagtcatcagcaatgaatctagggtgttgaaaggattatctatatggattctaaatttgcttattgtcatggctgtcgtagggaagagaggggagtaagccagctgctaaaatcttcagtaaagaagaggaatggccagagcattgtagatgacttccataagaagcagtgggtttagtttggtatcctgttaggtgggagttggtatctctaacgaagaagaatgatctg

SEQ ID NO: 35614 - DNA, 1929 bp, Bovine  19866880738960
acgctttctcttttttttttttttttctgctgctcctgctgctaaattgcatcagtcgtgtctgactctatgggaccccatagactgcagcccaccagactcccccgtccctgggattctccaggcaagaacactggagtgggttgccatttccttctccaatgcctgaaagggaaaagtgaaaatgaaagtgaagttactcagtcgtgtccaactcttcacaaccccatggactgcagcccaccaggctcctctgtcaatgggattttccaggcaagagtactggagtggggtgccattgccttctccatgtagctttactattattcatataatagcaagaaggatgcaagaaataccaaagtgtcccccatcagcagtcctgatggcctgctttcaagagcattacagactcattttcaactgtagcatccgtttgtatgcaaacaattaccgtgcagtaggccttctcagtgtggaaggtgctagctgagatctcgtttacattattaatttgcttagtaaacccttttgagtcaagttcatgtagaggtgagctgggaagctgccacaggagccagtcctgcctcaggaggcagaggccctgagtgcagcatgtggcaagcagcccagcacccagcctgctcacatggagatagaaaggcctcaggtctgtgtctttggcagtctttgctcatctcaaaaaatatcttttttttaatgacattttttttttaatgtggacctttttttttttttttcaagtctttattgaatttgttacaatattgcttctgttttatgttttgttttttttttgcctccaaggcatgtggtatgttagctccatgaccagggattgaacccacaccccctgctttggaaggtgaagtcttaaccactggtctgccagggaagccccctaaaacatccttggtgttttgaatttttaagtgtttatttttccttgcttcattgttctaaataacgtctctgtctgtagtttcctagggctcacataacaacgtgtcacaaactgagtggcaaaaaactgtaggaatgtattgtcacacagttctggaagccagaagtccaaaatcaaggtggagacagggctccgatctctccaaaccctgtaggggagaatccttcctgtcctcttcctcactcctggtatttgccacaagccttcatgctccttagcttgtaaaaacatctcttcaatcgtgcccctgtcttcaaacaatcctctttcccctctgtgtttctgtccttctagaaggatggaagtcgtagtggaatcagggcccaccctactccagtatgacctcagttgaacttaattcattacatcttaatgaccctgtgttccaataaggtcacattctgaggtaatgtagtgggttaagactttaactttttagggcatgcacaattcaacacataatctaacttaacattcagttttacttctatgtttattgtcagaatataagcttcatgagagcaaggattctgtcatttttccccccagtcttttgatcaatcagagtttggaacataaaataataactcagtaatgacgtgttggattaaaggataacaatctgccacctggggcaggaatataaagataaggctttgggggttggacagtcttgggttcatatttcagctaaactactctattctgtgcttttatttcttgtttttaactttttattttagattggcatataattgattaagtgttatgctagtttcagatgtacaacaaagtgattcagttatacatataaaagtattgtcatctgtttattttcaaactcttttcccagttaggttgttacataacattgagcagaattccctgtggtatacagttgctgctgctaagtcgcttcagtcgtgtccgactctgtgcgaccc

SEQ ID NO: 35615 - DNA, 1093 bp, Bovine  19866880740924
ctctctctctctctctctccggaaactttatatgctcttaactgctcacttggattatcgcccagccatgtgttgttaaaattttatagcctctgagcatcattaaggggtcatggaagctggtcaggggaggcagagggatggagcaaacagaccagcagctaaatgtgtcaatcagtgggcatcttgatttatttgtaaggtagccatggaaggggagagaggttgaatttttcttgtaaaggggatgaaccaagaagtttattatacgttcgtcttaaaggtcacgtgtatgagcggagagagttcttgaggacaatatcatattatttcaagataatctgccatacatactgtgcatgttggcactatgaaagccaagtgatagtttctttttttttttcttctgtctgggctcttcagcctttggcgggggatggggaaacaaccaaaataaataggagcttagatgtattatcttgaaggcaagggctgtgaaatccctttcggggagcttgtgtgccaaagcatgctgtgttaagtcagccggaggtcattactgtttttattaggtgattttattataaatatgatttgggcctcaatcataaacagatcctttatgtgtgtttctgaacattctggtggctccaaagcactaaattccaaattggaatattgattgtctgatggttgaattacagccttcttcaaatcttgaaggaggcctcagggcccatgtgtctttctggagataagttctcgtaactgagagatgtaaggccttaaacagtgggtcccacaaggtggaaaaccaaaggcagactggagtactgttctccccctggtaaattaggaggtattaaacacaccattttatggcatgtataagaaaattgtcataatttgtaaatgtccctgaatttcctctcgggtaaggcaaacattaatgcagcctgcacatgtttattatttccatgcaaatccaactgaataggttttttttttgattctttagatttttttttttaacttaaccacaggcatctttctcaattttccaattctataaatgtcccttagttttaaagtt

SEQ ID NO: 35616 - DNA, 1079 bp, Bovine  19866880742364
ggccgacctgggccgtgatgttttttgtccttaactttgtttttctaccttaatttcttgtttcagttttcagagtgtatgtttacaattatgacattttcagtacttcccggggtcttactaaggtgtgcaatactgaatatatctgttttctcaggacttcttaaaagatttgctctggaagcctgtgcatcccacagtcccccactgaaatgccacctcttcgatatgccagtttgtgtcttctccatcagaaattgagattcttccctggccctcacttttcacattggtggcaccttcatttgatgaaacaccacctttgatgaaactgcacttcttccattagactatgatcttcttaaagggagtaattccatttactcactttctcagggagaaaacttatgcagagcagaaatatatacagatatggaaacaacatagctggagtgaatcctgtgaatcaaatctccttattggctatgtgaactctgggcaggtttcttgatttcagaaagcttcatctgtacataggaaggtcatagcacccattagggctgttgtatgagatagatgaaaagtaatgtatattaaaatgttcatcgttgtacctggagcacagtaggtgtttaatacatggcagttctagccccaggcatggtatcaattacatgaaagatgctcacaaaatgttggctgaattaaactgaaagggatttaatacttatttgttttccattgatttgttatatcctactattgctgattatcaacatttgtcacattttctccctggcactttactacagtggtttaagaagcattaggattgtgcttgcaatcctatgttgagctctttggaaaggaggtgctttgttgaaatcagcaagaccatgtaggcattcaagcttttgttatccgatcaaatagacttatctatttttccttgttagcagaaaggagacaaaaagaagttgcttagaagataattggctcttatacataaaattaactgaaagctaaagttaatctccaaagagataaactataaaattaaacaatttgtggcctgaaat

SEQ ID NO: 35617 - DNA, 1589 bp, Bovine  19866880753959
atcccctggagaagagaagggcaacccactccagtattcctgcttgggaaattcctggacagaggagcctggtgggctcacaaagagccggacatgactgaatggctaacactttttctttctttcatggaagatgttgccatcttgtaaattgaatagcagattcgggccaactctatctccatccctcaaggttggggtaaggatgacacagggtagtaaacgaggcccagaggcaggcttattagaaatcaggattcgaatgcactgaggctggatctgtattctccagttccagcatgttcccaagacttgtcttactaaacctgcctgtggcctgaagtgaaatcaatctctgttgtagggtgaagggagtccaggagagtctgaggcagcgattggccttccaggtctgttgggaggagtaaatgaagaattcctgccatgcactcacaaaataccgtctggcacatggcaattactcaacggagttcagttttctaaaacaatgatgaggaaacaacagttctcgtcctctgtgaattgagttgcaaatgtccagttttactcccatttgtttatttatttatttctggctgtgctggggcttcattgctgcacttgggctttctctagttgtagcagcgggggcttctcttgccattgcagtggcttctcttggtgtggagtaccagttctaggcacacagggttcaggaattacagctcttgggctctagagtgtgtgggctcagttattgtggtgcatggatttggttgccctacagtatgtggaacgctcccggaccagggatcgaacctgtgtcccttgcattggcaggcggattctcaaccactggaccgccagagatgtctttactcacattttttcagccaaaagtttttaaaaaaatgacattatgtaccttaaaatgttgaagttttatgaaatcaaggtgcgttctaaaaaactgcattaagaaaaacatatacacttccagccaaaaaatccttttaaaattggagctaagtttgtcaaaatacagccttctaaaactcactcaagagttttcatacagatactggcagaaactatgctctggaataaaatatttttgcgaaagtggcaaatgcttgctttctttaatgaattgccaattttctaaggttaaatacattgtctatagcattttaattttttaagaagatttttctctttatcttgggaaattgcagagatgatgaaaatctaaatataatttaatgcaaatgtattcaaataattataggatgaaaaatgggcaacaagtcagagccccctgcatgtgttaaagacggatgatggcaaggcaggtgtttttgccttgagaagatgggtttgctgtgttcaacagcagtggtggcagagaaaccagggaatatgtcagacagaaactgtttgctgacaagcagcaatctttccctaccatccctttctccctcttgccctccctctcctgtttattcctccatccttctttcccaaaacatatttcttttcctctcttctcccccacatctctcttttcccctctacctctttctttctct

SEQ ID NO: 35618 - DNA, 929 bp, Bovine  19866880766527
cttgacttgcattgtcttatctagaacatgaacatttgtagttgcatttgcattttacttaggttaaaaatcaagtttccaacatgcagtaacaatccattccttctgacctagaaagcagggctcatggcttctcttgtggctttgattcccagaaaagtggagtcaacccacactctctctctctgctctggacctctctccggtcctcagtcaccaccttgagaatcttaccaaggcaatggcatcaaccctcatgtcttggcagagcatgctcaggtccacacctgtcatcctgactactctctcaactcccaagctttcatggccagctctccaatggaccttttctacacagatgctaaaaggtcacttcaaatctggtgtctaaatacacctgaaattgcagaatcttagaaagggaaggggagaaggcaatggcaccccactctagtactcttgcctggaaaatcccatggatggagaagcctggtagcctgcagtccatgggatcacgaagagtcagacacaactgagcaacttcattttcacttttcactttcatgcattggagagggaaatggcaacccactccagtgttcttgcctggaaaatcccaggacgggggagcctggtgggctgctgtctatggagtcgcacaaagtcagacacgactgaagtgacttagcagcagcagcagcagagagggaagggaccacaaaaagcagatggtaagagttaaaagattatggtttagaggtcagaaagcacggggttcaaatcctagctctgagcccattacttctgttaaagtggaataactgtcacctttattaaggctgtagaaggattaaacatgataatggatacaaacttgcttaccgtagtacctggcacatgtcacagacactcagtcacagcagtcacat

SEQ ID NO: 35619 - DNA, 2148 bp, Bovine  19866880774208
tccagggccagtgacaaagcttgattgctcagagcttttgtgtaataaagttttattaaagtataaaagagatagacaaagcttctgacatagacatcagaagggggcagaaagagtgccgccctgctagcctttagcagtatgttatatacctatcagcaagctgttaattagagaaaggagatgtctcaaaactcagagtggcaccagatcccccacccgcaacatgcattttgagataatattggcacaaggtgagtcatcccaggccataaaatgattgacatgaatcttgaagaaaggcagatttccaagcaaatgtatggtttcattaacatagattaagagaacaactgtatgagtaaaacatactggtttgtcaagtgggttctgagtcttaggtggaaccaacttaaagacagagtctagggtaaatacatagttcattaacatagcttaagaaaaacatttccataagaaaaatgcattggttagctcaatgtttgagaaaagttaagttcaggtggaatcaggtatgtgttatggcaacatagaattttaaaagacaccttttcaaatttgtatagagaagggggaaaaaaacttgcagctttttccttctgccacttaagagagagagagagaaaaaaatgtctaacacgtgcagcctatttcctcacttgcacacccgtggctttcctgcctgttaccttctctagagcaatctaaaaataggcaagtggggggttctctgtggaggtagttaaaatttaagctgagagatgaaggatagtgaggagggagaaaccatgtgaagagcagggagagtggagaagtcagtacacactaggaaccccaggggaaatggcttgtcaggttcaaggacctgcaggacggggacagcatgagatcagaggattgtgtcccgagaagatgtcagaaaggtggtcaggggccagatcacagagatcctttggcaccttcatgaggaatttggattttagtctatgtgtagtgaaaaacaaacaaaaaattacatggaatgtcttctatagggagggtattatctgatttctcattttaaaatgtgtctgtgcagagcaaagattggaggaaactgagtggaccatctcagaccatgggaggccaagcaatgatctgggtgagagataatggtgtctaaaattaggacaaggcagtctagataggcagagggaaagatattggagatacatcttgaaagcaaaaccgacagacatttccaaaggactggatatgggtgtgaggggatgaaaggaattaaagaccactgctaggtacctggcttgagcaagcatgtgttagggtggttctaattactgacatggataaaactgagagaggaacaggttaaaagaagaaaattaagggtttaaacgtggagccattaagttcaccatgcctgagaggcacttgtggagatataaaatgggacaatcgaataaataagacaagatttccaagcttgaagatctcaatctagaggcattaccacagatggtatgagaggcccaggaaatggatcctactttctcaaaaatgagaaaagccaaaaggcaagactgtaccctgaaggattctagttttcagggacatcaaagagaactggccacagaggtaagaagggagcaaggaagtctggtgctgaagaagtccaagagaagaaatatttcaagaaggaaattctggttaacagagggcaattaagaccaagccagaaagctttccactgaatttagcaacatggaggtcactggagactcagcactttggaagtaaaatttccaatacttgtttcatgaggtaaatttccatggaactgaatgggagtggctcaaggttgtataattagtgacaatcagccttgaatataagcatagccaatttattaggatgacccactggaagtaatcggggttgggctttctgatcttctcacctgggatgggtagctaattaattattctgtgatctacattgctaagatggccacattcaattccaggttttaggccttttgcccaatatgtcaccctctaaaaaggcaggtgggaagcatatcactagtctctggcactccacagagtgggcattcaatctgtttttgat

SEQ ID NO: 35620 - DNA, 1282 bp, Bovine  19866880809857
atgtagcatggagaccaccatgtgaagacagaggcaaagactggaatggtgtagctacaagccaagaatgcttagtgttgctgacaagtgcctgaggctaggagaaagaagagattcccttgtggagccttcacaagaaagcagcctggccagtacacccagaatgggatttctaatttctagaagtctgagtcaataaatttccattgctataagccacccagtttttgatactttgttgtggcagccttcggaaatgaatacaaccctccagaaattagccccgttgtccatatgcgtctcagtctaaaactgttctcatctgagagagggtcccgatggtaggaagagagcataagaacaggtaaacgcaggggtcagtcatagagctcagaatgtgggttcctagagcagtgggcaagagggcacagagcagagaggctgggaaccccaagaaccctctgagctggagtaggctagaagctgagtgaggatgcacgggccttaccctctgactgcatttgctcacaggcaaggccctggtgacccacggggcactgacacttgcagctggtaccctcaaggatgggctccccattgttgaagcagggcccacagcggcaggcgttgaattccatcaggtacttgtccagggcccgccgcaggttctggcgcttggtctccagggaccccaggttcgtgtgctgcagtatctcatggattggcttcatctgtgggcacagaaagaacagaggactgcaccctcggctctgtacagcttcccagagcccaagaactggtcatcaagcctcgggaaggcctgctgcatgccagacacagagccagattatcctgctgcattagatccaagcagccactctgtaaagcgggtattaggtttcccagaccatggataaaaaagcagagtctaagagtgtttgagtgaccagctcaggaccacacacaatggaccatgctgaacatggagctacataactttgaaacctgtggtccccagatcccagaggaagacaagaacccaaaagctatctgtgccaactcatccaccccctccagcattcttaggaggcaggaagagtataaagtacttacatgtctatgtgtatgttttactgtcacccttcaatgcagggattaataaaattcttgacaggcagttgtgttgccactgctgagcacaacccctaagggtgtgagtgtggggtttgcctgtgtgtatgactggggtggttttatatttgcagcagcccattctaggcag

SEQ ID NO: 35621 - DNA, 956 bp, Bovine  19866880830872
aaccctgacttagaaattctacaagacttcctaactaccgggtgcggggagacttaataaaagaattttaataagagcagtgcaattttaaggcaaaaataactgtaattactcagagccttcataacatctaaaatctgattaaaatgtaccatcgtttatgagctgacatgagatggttatcatgtataacagccctacaattactgctgacgcatgtgcacagaaaagactctggactgtttctttttcacacttgcatggtactctaatccctccataacagagcgattttacggcaaaacagatacacaagggaatgagaaatgaatgtttgttgagctactattgtaggtcaggaactgggaggcacgttagtaaaatggctaatgtagaaattaacatcatcacaggaagaatgaaaaccctggaaatgtgacggtcacagagctggaaaatggaagaggtgagtgaggttggacctggatgctgtttgactgccatggaaatgtactttcactcacaaaagggcttaactgggctgagcaatgtctacatcatggcttcaccatggtcagctcccatgtggcagttcttacccatttcagaggaggagggaaaagctggaagaggaatctacacacgaggttagatttgagattcaacttaagttcataggtactagtctgaaagcattctatgcattttacttgaagaatgctatctcatgggtattttgatgcagaaacaattgggattttaaaactttcatcctttcaacaattactgattgcatcttcattcatcagacagtgaaaagtcaattctgagagactttcttagccacatgtagaatggaacccccatacttcttatctctggtttgcttgtctcctcatattttaattcttatcccacatatacagtttcaaagttatatatttatttacaaatat

SEQ ID NO: 35622 - DNA, 4003 bp, Bovine  19866880831833
aattctggccaaagggcctgtgtttggggtggggatgccaagagcaaatgctagggattggcatgtggacaggtgagggggtaagtatggagataccatcacaggtaccaagtctgtaacgcccgtaactagatcctgatggggttggtgggaccgcaaagtcccaagtcagcctgattttctcaagtacccttctggggagcttcttcctttgggtttcagtctagcatgctgccaggtaagatcattttatcaaaatttttatggcgaggtttgccaccagacaagaggattcttgcaaaaggaaccaaacataattccaatcctagaaacttcttaagagcagtgacggtatcttactcatttttaggtctgtctctttaaaaagacaaattggaaattccataagtttccagactttaaacagtcaaaaacctcagggtcccctgcgtggactgaacttactgtgatgcttcctccctggggaaaaaatacactttccagttgttggcaactctgttaataggaatcaaatcctctttattaaagccatgtctaaacaaaaaaatgtttcttggaccctatgccaagttacaaagaaaagaagtgaaatgacctttatgaaatgcggagagcaagaccctttctgtgttagcttgctttaatttaagaaagctgtcttgggcgagtcacagaatgcagtctccgttctcttgcttttctctctggcacttagtctttctttctccacctgcttttctttctggcagttagtctctctctccacctgggggcttttttctggctttaataacccatgatttggaatctgcatacttttaaggggtaagcggctgatagcaagggccaggtgcctccgatcactatgcctgtcacttacagcactgttttcctgatgtcaacgctcaatatgaaggaccactccttgggaccagtcatcagtggcagcaggcagatcaagtaaccagagtttcattatggtcagaggttatatagcagaaagggcacagatgggggtcattagggttcaggttcacgattcagctcccattcttctacctttgcagtttggccagatcacttcaccttattgagcctgcacctcttcatcagtagacaagaaagcgttatgtcttctcttttccatgaaattgttttgaagatgaaatgagctaacatggccaaagcacctgtgttatgaattgagttgtgtacccaccatcccctccagttttcatgtgttgaagtcctaactcctggcacctcagaatgtgaccttcctatagtaaggttgttgctgacgtaattaattagcatgataccattagggcgggtcctagtcctatatggctgctgtcctcacaaaaaggggaaattagtacacagagacagacacacagggagagtgctgtgtgaagatgatggcagggattggagtgattcatctgttagccaagcagtgccaaagactggcaataaaagctaggcaggagcccggaacagagtctctctcacagtcctcacagggaacaagccctgtcgacaccttgatcttggacttctagcttccagaactgtaagactatatatttctgttgaaagctgctcagtttgtggtacttcattccagcatccctaggacactaatgcacatgtcagtccatcttagttcctgacctttcttccatctgtccctcctcctcctcttgttcaggcgcgcagtcgtgtccaactctttgtcaccccatggcctacagtcatcaggcttctctgtccatgggatttcccaggcaagaataccggagtgggttgccattttcttctccaggggatcttcctgaaccagggatcaaacccacacttcctgcttggctggtggattctttatcactgagccacctgggcaacctctttctcctcctgtggcctcctttaaatgtatccatgtaagtgtgccgcaggacccttttcagggacatccatcttgggtgtgctgaacatgacatttctgctcctcctaagagcacagagaagaggggtcatcttttctcagattgtaatgtgtattttttaatcacctgggtcgtgcgtgcagtcatcttcagcacagacatcctgctgcaggagatttgacaataagaacagactcatgataccagcctgaaaaggaacagatagaaacacgttactgtctttgtcatagagagctgggaaaagagagcaattcttctaggcctcctgttcctccactggcaggaaaagatatttacaggtgtgtggaggtggctggagggacctaggagagcagcttccctggaaccatcccgagtgatttgcattgtacaaagagagcaaagaacgcttcactttgccattcatatttattgagcaattttttaatgtaaaagggagttccttgtgtgtgcatagtcaaggccacgccccagtgtgtcactggacatttccttgatattgtctttatttggtacagcttcactttcaagttggggctacatggaaaaacctccaccagactggatgatagcgtacttgtcaccactctcagcagctttctcataaagaaactaagactctgggaaccagcaaccccgatcccttgactcagaggagttttccagccacaacgcaaaacagtttctcttttctcccaagccgtattgaaccctttgccttgatctgagaacctaggattttagctccttcaagtgttcaggtagctctgagggagccagggctcctgcagagcgagccgcctgcaggctgcaaaattccagcagagaaagggtttttgaagtatcaaaagctccccacctgtgggtgatttccatgcagagactgagagcaagagtagccaacccatgacctctccaaaactcacatctattccagccctttgaggaacagaaccttcccttttgttttcccagacgttgcaggaatataaagaagatgaagtgtgtatagattagggagagaaaagagacaatggggccatctcagagggcactggagctggactcagagatgtgcgttccaattctgcacttgccaagttaccaggtagggaagcttttcaaatcccctgtagctgctagcatcatagtatctttatttgtaaaatcagtttataagtacctggcaggtctattgccaggattttgtgttgcagtgtgtatgaatgcaccttacacttttgtatggatctgtcaacctgttttctctcccccatctatcatctgtcacatttattgaatgattactttatgtcaggcactttgctaagtatatcatattcatcagttacatacttaaaggaggcagggtgttgttaatagttaaaaatcacactgctgctgctactgctaagtcacttcagtcgtgtttgactctgtgcgatcccatagacggcagcccaccaggctcccccgtccctgggattctccaggcaagaacactggagtgggttgccatttccttctccaatgcaggaaagtgaatagggaaagtgaagtcgctcagttgtgtccgactcttcgcaacccccatggactgcagcctaccaggctcctccatccgtgggattttccaggcaagagtgctggagtggtacttaagttcaaatgaattccagctgcctgtgtgaccttggccaagccctttttacctctgtaagccttggtttgggcttcccaggtggtgctagtggtaaagaacctgcctgacaatgcagacttaagagacacaggtgtgatccctgggttagaaagatgccctggaagagggcatggcaacccactccaatattcttgccttggagaatgccatagacagaggatcctggcagggtacaatccatagggttgcaaagagtcagatatgactgaagcaatttagcatacacacatgcaagctttggtttcctcagtctgtgtaatagagagaataacagtgtgtacactga

SEQ ID NO: 35623 - DNA, 1299 bp, Bovine  19866880872723
cgttgacattttgtgccagataatgtacagtataggatggcttgcagtatccttggcctgtacccaggacatgtcagtagcatctcctcccaccattctgacaaccaaaaatgtcttcagatgttgtcccctgaggggtaaagagcctctggttgagaatcactgccttgaagtggtgtccactcaaagcacttcgaccattctaaacacagagcaaagtgacatctgagagtttaaaaggagaggcaaactcaaaccccagggatacaaacccttgttcatatgttaacttctcctcgagcaagtgaggcctgagggcagggctggctgtgtgttttctctatccccatggcctgggacttcgagtcaagtaataggcccctaggaaatatgtgctggatgaagaagaaaccaattacctgtctaaatatgtatttagcttccataagcatattcttttatatatttctgtatgtgcatatgtatctatccttccataaaaacttggctgagaattttttcttttctcttccagcatctaatgaccagcacatagcagatactcagtagctataggttgaatggctacctggcatgtaaaaaatacattgaaaagatgaattaacaaaacatccatggtcatgtgccaccatagatgcatttttgtggcatttacagtagtctgaggttgaatgtgggatactccacaaatgaacacttaagaggccagatactttgccacttttgaacattacactcaatgccttgggggcccaggtccagggaggcctgatgaatctttttgaatctgcactggcaagatggagaatgttatggttcagtgggggatgaattatttcattttacactcccagatcatcacatctgtgcatatagccacttcccattcccagaactgccctggctgccctgccagagttgtggccaatctcaccatgatgactgtatttccaaggactacatttaaagttataaacaagtcagagcatcacaaccattccaaagattggtgctgaaacagcacaaaagtttactattattggaaggtatttgagatcactttttaagctttagatttaaatttgtcctgtgggcttgaccagtacagtggtgtgattttaaatggactgtaaaaaatatttacaaggtccagtggatttctaggtcggggctcaaagcttgaggaggaaagaagaatcaaaaggcacttcagttaaaatcagaaaagatggttgaaataacctggttcagccttcgtgagttacagatgaggaaatt

SEQ ID NO: 35624 - DNA, 2070 bp, Bovine  19866880889732
gtgaggggaagggggttagaggtggaaatgatggggctgagtctgcatgaaggtctggctccctgagtggaaatctgctgaatcatgaaaactccttatgtccaagggattcagagtctcaggtattttatggaaaaagtctccagccaaagactccatgatgcctggtcaagcaggggcagttcttggttctggggagaaagctgtccactcaatttgaaagtggtcaagaagcttcagaaagacagaacaagggctggccagagcctttggagtgtgttaagggtccagtcagtgatcagcacgctatagaaaaggccatgtgttgtatgtaggcttacagagaaccggggggcccgctgcacctggacctcatctgctagggggactcctggaagtctgagatacaaaggaaaatactcagttgtgtgtcactgctgggctcagaaccatgtttgagacatgtttcagtgcaactgaagttgcactcagaaggcgccttctacctaacccaggcagccctgaggagccagtgcaggctttgagtggggggacctgtgactttgcctcagcttgtgtaaaaagaagtggggtgtttagtctctgctgacttcattcaaccatgggtgggaggagcaccggttttgaagtcatactgaccctcaggaacccagctgtggtcctaacagagctgttgtgaggctaaatgaccttctctggaacactgttatcagtcctggaccccacaccatgagagacatagagacagccctgtatgtttcaagataagattaataatggggtttgaaacccaatttggtgaacaagtagcagaaggacctgaaaacctttggcttggagaaatgaaaccatgactatggaggtgggcatccctaggaccatgaaatggaagagggattatactcttctgtatctgccaactcttggaactcagacgggggtggccctacaagaaagtcatttctaactccagctaagggtggtctactgatggtcagaactgctcaagggtggaactctggcacctcagagagtaagctctccatcactggagctgtacaagcagagccttgaagaccacctgtcagaaggatgatgggatgaaggtgggggaggggaggggattcagacattgaatggccagaggggcaagcctttgataccctttccaaacctgagtttctggattcctccaatcaggagtctttctggccccttcttaccctcccctggctccactcccctttttcctagtgaactttctttctgacttatttccatttctctacccactcttccagtaacttgaaaccatcctatcccacctaaagacggcttccaaaactcaatgcatgttagttttagtaagaagacatatctgagtactagcccctttaaaaacaccgagtgtagaaacagtagaaggcatgcagtatagggccgttcagaaaaagcagtttttctctcagaggcctttgcatttaatcaggcctgcttgtcaccaagacaccgggtctgctcttcgtgtttcaatttggtccagcccccattacacagctccctccaattcaatttgtgcctaaattgccttacttgcccctaacaggcttagatacgtgaggaaacatgctccatttgctgcctttggtttttgtgaatttattaaccagcctggccacaccacctccatgcttagtagctccaaaaaaagaaaaaatccagactctcaacctgacatacacggcactcgggtcccagcctctgctgtatctttggcctgcctcatcctggtccagctccactggactcctcagcttccccaagcagtcataccctccccagcctccctgcagccctcccccaacatcctgccttgtgttttggggagtctttcttgattctcccaacagcgtcagcacgtcgccctgcatttgcgcctccacacctgtcattcctccaggagtagaccacacagtgttggaatccttcttcctcaggagcttctgggagcttcctggggttgttgtgttaccagaagcaagcccaggg

SEQ ID NO: 35625 - DNA, 1152 bp, Bovine  19866880918947
ctctgaaatgaaattattggactggtctggattggagtttctcagaagaagtgggtctgctctgaaaattacttgctgccctttgcaagggtggcagttaaataactcaacaagaggtcccttggagaaaatcaattgcacacaaaattgcaaaaatgtggatgcaatttgtggggaaagtggatttgatatgagtcagtgttggctgccagcatggagtcactctccaggtggattaaagcttgttgcagcccttggttccaaatgatggctggcctccagcatgctctgccaacctcttctccccagggcttcagataggttgacctcagctcaaacctgctccaggctatgggaccaattctcccccaaggtaggggcctgacagggcttcagccatatctgatcctgggcatcaagccccctaacttatgatggagagctcaccctagtgcagacttttccttgtgcttcacttggagtcttggttctaagaatgggaatcttgttgtgttcctcgttttcagagtttctgccctggtaacctgcctacactggtatctaggaaaaggctctgtttgcccttacttccttccaatgccataggctgaaggaaacagcttttgaaaggtgtaaatgagatcatatgactctcttccccagacttcacattgtatttatagaaaaccttggcctgtgaggccttgtatgacctggctcctccctatgctccaactcatcttatacaaacactctgttcagacctcacacagttctctgtatttctccaacaggtacttgcatccatggtgctctctgcctggaatgctgttccccaaactctctgcctagctggcttcctacatccttcagggttcagctgaagagcactaagtaagtgaagactttcccatcatcctttctaaagtaccacttgttctttactctctgcgacctcatgggctgttgctcaccaggctcctctctccacgggattctccaggcaagaatactggagagggtagccatttctcttctccaggggatcttcccgacccagtgattgaacaggagtctcttacattggcaggcagattatttcccactgaaccaaaaagtagcacccctcccccattatttctgtcaccacgt

SEQ ID NO: 35626 - DNA, 1074 bp, Bovine  19866880938596
ttgggaagtaaaattaaaccagattctttcaccagggacttagaatcttgagggaagtgacatgctgtgacagaatattgaaataatttgaacccaagcattttttctgcagagtccacttgctcctgcttttgtgatccactggcctgtccgtgttccttctgtcctcgcttggatgttcaatccttccttaactctgcaattttcagagtaatcccctgctctgcctttttttttttttttttaaagttagacaaagccatcgctctccactgcttacaaccaacaattgtaactcgtactgggatcaaattttgttcaactttgatgcctatcacagtgtccagcatatggtgagctctggagacaacaatattaaatgtttgttaagtgagtacatttcccacccgtgccactgtccactgcatggcctccctgagttacggccatctctttgctttccatcagatcacggccaatgaaggcaaactcagtctttcactaggcggctcaggcggctatttggaaaatgttcccaactgaatgcaatcatacatcccaaattgttagaaagttcttcccaaatgagttattattcacattgccctcccccagctattccttattcttcgctgggaccatgagaattcttccatcagataatttcaaagtcagggcgaaccacatctacagggcttcagggtttgctaaaaggtctctaaggcataataatatttcacatttgaaaggcaaataatacttagagcgttttcaaagctctttaccaaccaccaggtaatttattcttacaaaaactctgagacacagattgctgtgggattaccagttctccatttcccatgtcaggagacgccatcccagaaagatcatctaattcttttttccaggtcacacagctgatacagggtagagttgagactcagtgcctaatcattatggctgaattcacccaccttttccattttacctggagtcccttgccagaggattataatcatcatttcagtgatgaagatatgggtttaaaagaagtgttctatttcagctactttt

SEQ ID NO: 35627 - DNA, 2995 bp, Bovine  19866880955785
cgccacaggtatacacgtgttccccatcctgaaccctcctccctcctccctccccataccatccctctgggtcgtcccagtgcaccagccccaagcatctagtattgtgcatcgaacctggactgacgactcattccaaatatgatatttctgctttgcaaatagggtcgtctgtaccatttttctagattccacatatatgcattaataaacaatatttgtttttcttatcatatcataatttttcttatcatacatttattttcctgtttttgatcctcatatagatggaataatagtaatgtccttttttgaatctggttcgttttattcaattctttaaaaaccatttatccatgttgctgtacctatcgatagtttcttttgtttcttgcttagtagtgttctactgtatggatagtctatagtttgtttactcattctactgtggaaaaagatatgtgttgtcttcagtttgagctattatgaaaaaaaatgctgctataaactttctagtgtatatgtttgtgtgtgtgtgtatatacatgttttatttctctggggtatatgagtagatgcctacaagttcccagagtaaatgtagacttattgtttgttgtttaatcactaagtcctgtccaactcttttgagactctgtggattctagcctgccaggctcctctatccatgggatttcccagacaagaatactggagtgggttgctatttccttctccaagggatcttcccaacccaaggcttgaccccacgtctcctgaattggcaagtagatatttttactgttaagccacctgggaagcacagatgtacccttaatttgattttttaaaaaatgccaggcagtttttcaaaattgtgataccattccttatgattaatgatgtacatctttctgttcagttcagtcgctcaatcatgtctgactctttgtgaccccacggactgcagcatgtcaggcttccctgtctatcatccattcctggagcttactcaaactcatgtccatcgaatcagtgatgcaatccaaccatctcatcttatattgtccccttctcctcatgtgtctttacatatgcctattggctattcagtttatctcagtctgtaaagtgtctgttcaagtattctgttcattttaactaggttgtctttttactgctaaataagaatagtcatattttctggatttaagtcctttgtcagatatatgttttgtgaatattttctccaggtttatagtttaccattcattttcttaaatgttgtcttttgatcagcacatgttttaaactttgataaggttcaattgatttttttttaatttatgttcagtgattttctatcctctctaggaaatctgtgcatcccttcacatcatgatgatactctgtaatgttctcctttagaacttttaccattttagcaattatattttggtctatgtatggtatgaggagggtttcgaggttaattttttccccatatgtttaaacagttgttctaataccatgttttaaagacttttctttccttaatgagtaacagtcgcacctttgtatataaaaaaaaaaaagtcaattgatggcctatatgttggtctatttctgattctctattctgttccactgatcaacttatctaaccttaatgccagtatcatactgttttgactatcatagctttatagtaagtcttgaagtcagatagaataagctctctaattttgctcttctttatcagattattatagttattgtaagtccctttgcatttccatatacattttagtattagttaatcaatttcttgaaaaaatatgctgagatttctattgcaattgtgctaagtttacagttcaacttggggagaagttgacatcaacactgagcttcccaaatcgtgagcgtggcgtgccgctccatgtatttgggtcgcctgtaattgttttcatcaacattttgtaagttttggtggagaaaacttgtgcaacttttattcaatctactcctaagtattttgtgaggtgctgtcataaatggcatctactttttttcattttccagctgtctgattgactgtataactttggataaggtatttatcctctctgagtttatttctgacctataaaatgtgagttcatgttcttcttagaagaaggtcaggtgtaaatatgcacaaatagtttttaggggttcttttattattgatattaaaaaggataacttagaaagttcataattaagttcttggtatattagaaattattctttggctcaaaagtgaaaaataaacaaaaaaaaacaactcaaactggcctaagtaatagagggaatattttggctcacataactgaaaaatctggagggggatgtgttagttgggctgaggcatgactaaaccaaagcccttcaacaatgccctcataaagctctattttcccatcttttactcctgtattcttctgatgcagtttcattctccaaaggcttctcttatgaaatgggtttctgcagctacagactttccagtgtccagtccaacggtggagagaaaacattcttcctagttgctctgtcacaagtaaagaggtcacccatttgaccatccctgaattgtggccaagaaatgtgtggcacctgtccatccctcgagctacaggtagagtcagctttcctataactaaatagaaaaaaataatattgggtaggggaatggtctcccaggagaagaaagaggaatggccccaaagaggcaaacaacaaatatttgtcatatctttaacacagtagccacaaaatacatggcagctgtatcatatggtgggcatattctctgcctctgatactctctaggcatcagagactcaatcatttttctcatagcattcagtctacttctgtttcaagcactaatatcaccttaagctctactttatgagtgaaaaaattgggggttgtatggaacttaaga

SEQ ID NO: 35628 - DNA, 891 bp, Bovine  19866880989223
atggcaggtgcttagactgagtgaacacaggaatcatgccatgtgatgatcttgttatggtatacattattatatgttatctgttattttatagtgtgttatatcatactactttccttctctgattttttttttttttcatttgtaaaatgggaacgagaccgttgccaatagctttcaagctctaacattttaagaatcatttccccaatcttcttccctctttaagtcccaccagcccaaggaatagaaaggagagatgaggatctgagttttgggctcccccggaaggtcaaagggaagctgcccaatggtcctggctttctctggaactaagagtcatatttatccagggcagtccattctgcaccagtttcctaacagtggggccaaattccctgcacttccagtaatggtgttctccccttggcagggggcccagccaataccaacatgaccagcctggtgacctcagccacggcccctggtcacaggacaaggtttgtttgccacaggtctttctgtacacatttccaggaacccactcaaagcatggcgagtgccctcactgacctctgattcttgagaagtaagtttgctccagtggggtttggtcccatctcagaatggctctgtgaccttagcaaatccttcctctctcagctcctcaggttcctctcctgtaaaatgagagacctgggaaagagtttttattttatgtttatgtgtttaaaaaatagtgttataagcatattgaagatgaccatatatacatacagtttaaaaaaatgtttgtttttttttttgctatcatcacatctaacaaataaaaatggggctttactttatactggtcttcctctttgcaatggtatcttacattcattattt

SEQ ID NO: 35629 - DNA, 1728 bp, Bovine  19866880994042
agacccctgtcgtagggagaggtctgctccccatgagaatcgctgcagaagtgtggaaggaaaatctgagccacacgccccagggggctgatgacctggttcagactctggactttggatggacctggagggaagacagaggcaccgagggagttggtggaaagaagtggattccaggcgtgcctcccagagctgcccctagggtgtccagatataacaactcccatcacatccacatgtcagtaaaagcattatgaggtattagtcatggctagattacttgaggaaaaagtaaaaaaacagagttttccaaataggtcagaaggattgtaaaattacagccaagaggacccaggagtcaaaacaaagacagggaggaagagagacacagaaatcagagactgggcaggtaggggacggggttgtggtttctagggcctggaataattggtattcacctctgtcaaactgcaccttaatctctgaagaactagaaataataacaaccgaggaccttgtttaaatctccacaattaaaccaggtacagatttcttaggcatgcaagctattcagtacattttttaaaaataattttgagatgaataatgagagtactggccaatcctgctaatgatagaatctgatgattgctgaggatatcaagacagttgtctattcctgaacagcttaacttctctggatcttcatttcttcaactgcaaaatgaaatgaatcatttccatctcataaacttagtgtgaggattaagtaaaataagacaaatgaaatgcctgacacacgttcaattactatctttctatctaaccatctgtatgtaattgatttatgactatgtctggacgagtgagagaaggtatgtagacatggtgtcatcaatccagtgtgtggttgttgttacaattctagaggatgtttctggagatgtccatttaaggcatctggttccctgaagacacaaatatgctagaaatattgtatgacacttatatgtggactctaaaaaagaaatgattcaaatgaacttatttacaaaacacaaacagactcacagacttagagaataaatttatggttgccaagagggaggaatagggagaagggagaattagagagttggggataaatatgtacacactactatgtgtaaaatggataaccaacaaggacctactgtatagcaaggggaactctgctcaatgttacgtggcagcctgtatgggaggggagtttggggaagaatggatacatgtatatatatggctgaatccctttgctgtctacctgaaactatcacaacattgttaactggctatactccaatatttttttttaaaaaaaggtaaaaaataaaaacaagatggtaatgatacccaatgtctggatgagaggtggaaagcccattcaattacccacatttctcagaccccagatgtttggcaatacattggagaacttccccatgtaaccggtagcatttcctgtattttgctggctgtttatggctgagttgaaatgccagtattagccttatttcagtcttataaaacaaattgatctgacctcagaaattccaggagctacttgaaaagatcatgaattctggagctatatcttggtttggtttttgcctcattctgaaaataagatccctctgctcagctgatatcggttattataaatatcctcctttcctcaaccatgtgtat

SEQ ID NO: 35630 - DNA, 1371 bp, Bovine  19866881042130
ctgagtaatatagatagaacttgaatcccatcaggccttctgattcaactccatattcttttcactatgatgagcttctggaagaatgttatagtctatttaagggggccatgtgggacccaaaccttgattgtctatagtgagacttcttgaagaaagtttggtatgtgttaacagtactacttaaaatagcagatcacagaggcagtattggtgtaagggttaagaacattggctttgtggtttgcactctggccctctatgaaaaggtgtatggctttgagcaaattactgacatttgttgcctcctctcttgtttattgaggtataagtgagttgatgcaggtaaagaactctgaaggtttctggatattattattatcaatagctaataataataaactattgtttttatcgttcttattgccatgctggtttatcttgggacagcggggtatccaattgaatgtgtcgggaagtatagggctactacaaccttctttcatttgaagaacaatttagttataattgatacagggtgagaagtcatctgttggtccagaaattatctgagtgtactgtgcagttgcttgttgccatcttccacgtgttacttctcccctccctccatctcttcattgtttctttgttgacttgaggctggaaggataatgggatgaaagagaaaagataataggagttattggggtgggccaaaagtttgtttgggtttttctaagatcttacagaaaacccaaactttctggccaatccaattatctatctatctaaaatgggcattcccagcacaagaacatcatattagaggcatggcagcaagaactaccagaatgtgtctcccctggctgtacccacaaaatggtgccatattactgtccgtggtgggcttagatggtgggaggtagacagatgtgagcttgcagtcggaggcagggagggactagatccccaagtgccttgcattctgtcctggagagttcagactccgttgaaagtcacgggaagctattggagctttgtcatctggggaattaattgatcgcatttgcttttggaatcagtcttgagcagagggtgtgaagggcagatggaaattgacgagaaaaaagtcagagatgtgggtgaggggcgtcggagagaaataattaggacgagagccaagatagtgacaacaggaatggggaagagaggatgcgtgtgtttggggtgctcaaaatgaggttccaactatgcttcctatttaaaacaagatgaagggttgaggcatgaatcgacagttacccttgtggcgtaatagaatatctttgaaagtttgtctaaaagaatgacattaaaaggaggcacacacag

SEQ ID NO: 35631 - DNA, 1600 bp, Bovine  19866881085596
ccactcagagtttcaaattaagtgtgaggcagcaagcacagaggtcttggttggctacacccaggcatttccccaaggagagcttatagaccactctagggcggtgggatgggcttcactcttcactatccaagctgctgctggtatgctaaccttgttccccgggaaatcatccatgcaggagctcaggcggatggtcgttggagctgctggagctcctggtctgcttgcagatcgggcacccaggagaggaggagagagtgtaacaatcccgcaccccagaacggaggtgcctcgtgtccaggccacagggtgcagacccaggcatgctgagtgcctccgggcacaggctggagccgggacaggggatgtcactgcttgtgctgaccaatggatacagacctcactcagctgacagaagatacccatcagcacggactttttctttgttctggaccagactgcaccatcaacaaccaacagttctatcacccacataactcagtcaaaactgggtgttgagaggtaatttgagggttagccactcatggaactttggatcatccaaaaagaaaaggaactttctccatccatgtcttagaggaacttttaggatggtggagggacaaggcaggcagatacttttgaaaccatcaattaccaataaaacaaagtaccatgagaatgatctcagttctttgataacatttgttcatttggagaaccattattagttagcaagataactgaaacaaacagaaaaattaaagactgattcaagttccttcaattttccttcactgggactcaacatattcttgtattccttcaattaatctctcgtgtttgcttgagttcttaccacaaatatcacctttctcccatttattttctcatagcactctagtcttttctttcattgcctttttcacaattagtaattatatactggatcccacatttcctgtgactatttttgacctctctccccatggatggtaatctggaaggcagggatcagctttgtctcattcagcactgcgtccccagaggtcagggctgtgccttgaatcagagggaattaacaagcatctgtgggtgaagggagggactgaacgaagagtcacttcagaaatgtggtctctcctccactcccagagggaagtgtgaaatccatgcatctgccagacacctcaggcttcccttcggtttcagctggtaaagaatctgcctgcaatgcaggaggcctgggtttgatccctggatcgggaagatcccccagagaagggaacagctccccactccagtattctggcctggagaattccatggattgcatagtccgtggggtcacagagtcagatgggactgagtgattttccctgtgctgtgactttgcccacctgtggaagagccagtcatatcagcctgcctcactgttcccacggtattccaatcagtcctcaaagagtgaacatgggtgttgcattgagttttctgttgacccaaagattgtgagctccttgagggtaaaacctgccctcccagttggtacaaaaactgtgtattactcacacacacacacacacacacacacaca

SEQ ID NO: 35632 - DNA, 2536 bp, Bovine  19866881088254
cagcacagggcagggattgcggctgtctttccacggccaaagtccagggtctagaagagtacctggttttctctgtgtttttcctctgcatgcttttaagttgagatgattaggtacaaccagtttatagcctacttgttacatttaacacaccagaagcaattctccacattgtgtccaatagttcacataataagtgctccatagacattaatttccttcttcctatcttgacttccttcctgaaaaacacttatacaggtacccatgctgtgctgtggtttttgtttagctgagacagagcaggccatttgaaagactttgaaagatgtaagcaagttattaacctctccagacctcaatgtctttatctacaaaatgggaacaataaaatctgccttgcctcattttcagcattgttcaaggacctaatcagatattggagcaaacatctcattatacattggggtgaatgtctttaaaaaaaaaaaccatggcactgtataaggggaataaaatttacaggagaagagatgacatcaagtcatttgtaaagcaatttgaaatccatgagtaaaaagctattggcagtggtctctactgagccagacatgtcctaatgtttgtatttaatatgccaaacagttgccaatgcctaattctaggttggtaccctgcaatagctttttttttgatgttttttttttacaactttcagctgtaaaactggggtcaattatttttagccatttcttcagcctgtctcattagcaaagtactttgaggtaatgacttgggcatatttgatgattgttcattttgaaagatgtcattttcagacttttctggaagtttcaaatctgcctgtgggagatctgttttatgccaaaatgtcatttcagattcaagcctacatactgccttatgcgaggcccttataaatgtttcacagcacctgcattttttatcatggcccttgcatgtgaacttggatttcttgtgcttcacctccactctccgtatgaaagggagaaagtaatatttttaaatggccttttttcccattcgtcagaggagataaaatcccctaattatttccccttgtgcatagatatttatattaatattttaaggaatgggttctttatagtgttattcatgaagccatgtgttaaatttaaaacaaatgtgtcctaaaattaatatttaatccaagtttaatacctgaaaccagattcatgttgacttaatttctttggtcataaaagaaatttatgaaatgattccattttttttcatccattcaacaaatattttaacagacttattgaatatgtcccacattatctcttttaatccttatgataacatggcaatggaggtattattattgtcattgtcattttcctataatgtggatgagaaagctgagatacaaatagcagggctataagttatatggctctctgctgcattttagggtctgaggtgtgggctgaagatactacctgatcaaaacccctagggtaagcaccttggaagagaaccagagatgccaagaacagtagcaaaaatgagagagaaagagacagagaggcaaggctttgtagaaacttgaagagggattagcatcagagagaatctggattatagctccctaactttgcttcactttgggatcatctaagaatcccatctttgggatcttcactttcggatcatctaagaatgactgatgcctggcttctccccacagacattgtgatttcattggtataggatgcaatgtggaaatcagaaatttttaaaggtttcccagatgattctaatgtataccagaaatttggagacgctaatacaggtgatgtgtgatgtgctatggaactgaaataacccacactccattttgtccatccaggttttttgatgtcccagtgggttgggctggtttataggtcttgggaggaacataatgtttacatatagaaaacacaagcttcatgccttatcagaggaagaaatgcagcaagtgttaatggggagagagcaggctttagtcagactgtttctctgagccttggcttcctggtccccagcatggcgcccgtctagtaggtttgttgtaagaattaattccaatgaaattccttttatctaatggtatcagggtctttgggcttaccaggtggtgctagtggtaaagaacccacctgccaatgcaggagacaaaagaaacacaggttcaatccctgagtcggaaagatcccctgcaggagggcatggcaacccactccagtattcttgcctggaaaatcccatggatagagaagcctgtcaggccgtagggccacagagtcagacacaactgaagtgacttagctttgcatgcatcaggattcttagccacttattggggaaaaaaaggataataagttaaaacatgtatagcagatagtattttccaaagatggccaactattctcatcccatgggtctacttggaatgtgctactgaggcaggatcccatgctgtgtc

SEQ ID NO: 35633 - DNA, 722 bp, Bovine  19866881128718
ccctcctgggtgattatattatccaaatctggacattattgcagaatgaacagtcaaccgtgaggatggagagaatgttccatcttctccatctcaaaatagtttatcaagtgggagtgaattcacaatggagaggtctccaggagaaaaggagataaagactgaggcattctttatgtttccactttgaggcaaagatgggctacctggtctcctcaatattttcaatcaagttggcttctctgattttttgttagtattcctcaaatcccttgacattgctcaaagggttcgtgtaaagccttataatcttttctggaagttgcatttgatccagtgttgttttaagaaaatgacaatttgttctctgcttgcttcataccatatataaaatctcatccaccagaagccctactataatcgtattctctctttgctattgtacatgcatcctttttcactttggctgccgggaggctgaaagatagatagatatagaaataattttttttcaatcgtaacagtcgtatgacccatggtttgcatgtgtgtgtatatatatatgtatgtgtgtgtgtaaaaaatatataatttaaaatatattttgaatttactatttctattatctatttaggcttacatattcctggccccatttatttaccacattctgtttaatttattttactgtaaatgttttaagtcattcacaaaaatttttt

SEQ ID NO: 35634 - DNA, 1285 bp, Bovine  19866881179359
ctgattacctcattatattgcccctctgtaatgaaaattgggtgcaaaaatgagagatctggtggttataactactttttactaagttccttctgtaagtgatcatcttgcccattaacaggctttcaaatctcagagaagaaagtaattgtgactcttaatagcatgtgtacacattacttatctgctcagtctccactgtgggccaaaatggatggatagttgctaaaaacacaatgtaacggtttcttagtgaaaacaggaagaggatacctgcagcgctgtcaaatgcatacttaaggtgaagccaaatcacagagagtattgttttgtcaaacctgggaaaattagtagataagagcacagttctaaccacctccccccacccccaactgctgtgcaagtcctgcctcaagtaaccattttaaagaacccacatgtggtttccagtagtctttgacctttcattaaacattcaactttacgaggcaattgatttttgctggtctctggggtggtcatggagatggatttcactgtagttaatattattctctttttaggacttttgccaagtgagaatgtattgttaatgaccttgtctgaagtgatgtgctagtggagattatgtgatgcctctgcctaaggactgaatcttggacaaggagatgaaggaggccttgcctggagatggaggggactggtagagggaatgctggccctgttctttctgggtagtgtacggaaatgaatgcagcacagagactagaggcaagcagagctcagctcggacccccacgtggctcttgaccatatccctcatctgtctaggaggttgctgccttctagcattgctgtcaggattagataagatggcaagggtgaaacatctcatgcaggacctgacaagtcctggatgctcaacaaatcttaattctctttcttttctccctttatgccttgaaaagaaacacaaattacaaagaattttacactgctatacattttttcagatggaagaaaaacagaaattataatatacccatcgtattacacatggggaaactggaggcataaacagattaaagaacatgacctttctttgcctgttttactcaatgtcccatgagtgccagggactaaacaaaaagtgttaccttattttctagacagatttcaggtttcatgttgtttgactgctctgcaggtgtagcaccacctacctctcccatcccccactcacctctatgtactatcttcactctagcctggcagacactagtct

SEQ ID NO: 35635 - DNA, 1266 bp, Bovine  19866881187645
acacctccctccataaaaaggggaactgacaaaagttgctacagtaagtaccttccaaaggatcctgtggtattttccaattgttaactttatggtgattaacatttaaaatgggcttccaaagtgaaaatggtgatattatttcactagagaattcaccaagaaaattaagaatcctagaatgggacctccctggtggtacggtagataagaatccgcctgccaatgcaggggacacaggttcgattcttggttcagaaggatcccacatgccacacagcaactaagcccatgccccacaactactgagcccacactctagggcctctgagccacaagtcctgagctcgcatgctgcactactgaagcctgcgtgccatagagcccaggatccaacaagagaagccacctcaataagcaagtgcagcacagggatgagtagcccctgcttgctgcaactagagaaagctcgtgcatagcaagacccagcacagccagaaataaatactttttttaaatgtggtgctatatggtgcataaaagcagaccatttagaccaacagaaaacaagagagagacaaaagtagactctcacatatatggtcaattaagaaaaaaagaatcccagaataacgttggcagagtctctcaattcatccaactctttcagttgagacatctgtgtgtgtgtgcgtgtgtgtgtgtgtctgtgtgcgtgtatataaatatatgtatgtatatataactttattaagtttagtttctttattaaatgtgaggcatcctgaaaggaattgaaaaataaaaagaccaggttccttccttgagacgttctaactctctccctaaatgattagcaaaaaaaaatagtaagagttgtcacttcttaaatacctgctatgtcccaagcccactattaggttctatatatatatctcatctctaattctaaaaatcctcattttctgagtgagtaaagaggttctgcaggttaaccagcttgtccaaagttttctcatataatgtggagccaggtttgaaacaaaagatcagttaggggccaatcagacaaacagagtccttgccaagttttcaaagagagaatttcatgtggggaacccttacaatggtgttagaaaagctgaaaagccagggaaaaaggaactgatccagggattagcgagagcaggaagctgtgagcagtcctgggattagaccaacaaaaaaaggagatgctgtgaccaggatgcaagacaagggactggg

SEQ ID NO: 35636 - DNA, 1053 bp, Bovine  19866881244605
aatcctttattggggcacctgctgcagcaggggcgaatgagaacaaacaataggttcccttgctggctggctcccatagaggggcaagctttttccttatgtggagtgaggctagcggtgtgtccaggggtcaggctgggtagatggcttatgtgttttgcccacctcttaggtggtgttgcatgcagagggcatgcacaggttgctgctttttgctccaagctcttcaaaagtagcagttgggtttttgttctccttgtatctttggggttcagaatgtgccccaactgcacatgcatgcagttccatacagtttctttgtgtttttttgttccaggagaggtatgttcagttgcacgcattgcagcacggaagaaaagggtccctgtttccaggcctgtctcaaaaggagcttgtggtgatttctggggttaattgattaaaaagtcttaaagggcaattcctggcatggaggcaagtctggagggggaggtccagggctcaggaagagagagacctgcttgaaacaaccttggtcaagagacttgtgtcaagtcaagcattccaggcagatacaggatgaagttgaaatctataataagaactgacagccataaactaattttaaactcaactagccttgggaattagaaagcagtccatccagggagccggaattgggtctgagatttttttttaaaaagaaaggtgttgccagaattggctttgttacatacttgggtgtgttatggtctgagctaggcttttttttttttttttttaatttgaagataatttcagaattacagaaaaaagtgtaagaacatacaaaaaataccctacaccctttacttagattcacctgctaatagttttatctcatttgctttagtatttgtgtattctctctgtgtatatccatagatatacatacacatatgctgtatacatgtccgagatttgtttttcctgaatcatttggatggtgcatgtagcttagccctttatacctaaatatttggtatgtattctctaagaatgggcttcccaggt

SEQ ID NO: 35637 - DNA, 937 bp, Bovine  19866881287164
ttagagttaatttatagtattttatggtatgcatatgattaatactcattaatatgaaattctactttcttggggtgctatgtataatttttaagtggctcattaaaataaacaagaacagaaagagatcaaaggctgcaaccagaacttgtgttcaattctcaaaggtcaatttttaatgtaaatgtaaatgcatgtgtaagttggtaggatgtggggtgggtagaagcaaaattaatgctgaaattttagagtccatgaggaagcaacatggaatagtgagaaaaatgtgctcttttggagtgaaacaagtccctcaaccattctgaagcttggtttccttttccacaaagtaaggctgttcttactaaggctttatctaataaggctattaaataaaaggagggatgggggattccctggtagtccagtggttaggactttgtacttccactgcggagggccctgcagattcagtccctggtcaggaactaggatcccacacgctgtgcaatatggccaaaagaaaaggatgttggcaagtgcttggtacatggaagcatctggtagaactattaatagtcctctgagccactacctccacatattaagttgatttggaaaatatgactttgtgggagtgaagacaagttgacgtagacaaagagttgattttttaaactaaattttctctagcatatttaggaaagaagccatagatacaaattccactaactctaagacttataaattgtgagctatctgctctggaaatgtgcgctcctggcacattgcagatatatttgtctttggtttccaacacacacataactaggtaaattgctccttttaaattatttcaagtatgatgtaaacatttacaactttaagccaaaataaatcccagtgccataaacttaaagacacagctttgaga

SEQ ID NO: 35638 - DNA, 1015 bp, Bovine  19866881332380
tcttttttattcccttttccatcctccaagctttaaaagattttacctttgtcaagtgcagaaattgccttgatttcttaaagtgacaaaatatgcttgggtgtttgacaaggcattccgccagcctcgcagatagaaccagcaggcacttgagtccctgaggcatctctgcagaggcagctcagagagggactcaaaggctggtagacacctctcctgctttggctcagaatctaattttcttagtcacagcccactgtggcagggtcaggaaatgaaaataccctgatctgaacaatgtcaggcaaccctgtgttccagtgccagttcttggagtactggctgagtgaccccaggcaagtgtcctcacttctctgggctccaacccatttgtaaaacaagcatgataatacccacatcataggactgtgatgcagatgccataagttggccataaagcacccatgtgatgcttggcatgtaactgatactcagagactagtagctataattatcatcaccggtccaggtttcgtggctaaatccctgtacagtctgagcattttctcatgcaactccccttccttgatcaaatgagggagatcagatagaggtgaaaggaagagaggggatttgaattcctaagtactgacggattgcaaaaccccaaaagcgagaggatcttggcttcaaatgttggaacagttggcatcatacagaagagtgggcttccccagtgactcagcagtaaagaatccacttgaagtgcaggagctgcaggagacacaggttcaatcccttggttggaaagatcccctggaggagggcatggcaacccacttcagtattcttgcctgaagaatgttatggacagaggagcctgggggacaacagtcagtggggtcacaaagagtcagacacaagtgaagcaacttagcacgcatgcacagaagaagagtaagacttagtttttgggccctgaaagaaaactcgaccaaagagtagaagttacagg

SEQ ID NO: 35639 - DNA, 1380 bp, Bovine  19866881354091
gcgtgttaggtaaatgacttcacacagcatttgtgtcttagtcactcagttgtgtctgactctgtgttatcccatggactgtaacccgccaggctcctctggccactggatttcataggcaagaatactggagtgggttgccatgccctcctccaggggatcttccccacccagggatcaaacccgggtctcctgcattgcaggcagactcagtacccggctgcaaagaaacattcaatatatcgagtatccctgaccttgagaattccaggtcagaagagttttcttccctcatccctcctgacccagagacagactccctagggtcacaacgagacagatgcatcccacccctgagcgtcatttattttcacctcaaagactgagccctttatgcctgcactccggcagcccctccagacaagaaggaagcacaagtcacagccagtgagctttgctcacaaattcctccttcacgactgactgagccccgataccggaaagaaacattctgttgaaacatgtaaatccccactcatctccaaattgggtgctggagtgcctcgggggaagtgactttacaagcccactgactccagccaaggtagatgccaattgctcttgcgagataattcagcctgacccttcgctccccaccaccccccgccccagaagcaagattgaggggctccctcccttcttactagaggaatggccccctgagctgctggggaacagccccgtctcccgggaggcagaaggagagaggccgtaagccgcctgcttctagccgtcctccccagacagcacagggggagttcagtgactcctggctttcattgtcacttgaacaaaggatctctgatactggtcaggagggctatcttgagacaaggtgtctggactacaaggtcaagcttgcctgtgctttctttcataccctcctggattccagaggcagggggatgctatggtggacccagccaccattgcaactccgtgcaagaaaatgctttctagcctgctgtgcctctggggagaactgttatcttttcttgtactgctgcctttttaaaaaatttatttccagagctcagtttcaccaatattcaactcacagccaagtgggctgcatgaagtgcccagccagccctatgtaactcaagatgctatatccacctcatcatcagtagcaagaccacccatgttagttggaaagattatttccctcctaagtctttgggagcctaagtccaatctaatatttgggagcaaatattagaaaatcggtcagcagttccactaatactcataatcataaaaattactatccacttctgagagctcagtctcccaggacttaataaccactctatcatg

SEQ ID NO: 35640 - DNA, 2306 bp, Bovine  19866881364754
aaatcaggaatttgggtttaacagatatatacaactatgtctaaaatatatgaacagcaaggactgtatatcacaggaatctatattcagtatcttgaaataaacctataatggaacagaatctgaaaaagaacatacaaatatatgtatacatatatgtgtgtatatatatgtgtatatacacataactgaattaatttgctatacacctgaggctaacacattataaataagctgtatttataaaataatataaaaacacagaatctactgtgtaccactcgagggaaggacatttagtatattttgaagagatatgggaacactggatgttttattttgcaagaaaaaaatgctgttttgatgattatttttaatgagctccacaaggtaaaatgtttacagcaataagaacataaaatattacagctcacttttaagtgttgtctatgtgccaagtaatgtgctaaatgcttaataggtattatttggtttaataatcaacatttcagataaaatagatgcaatttttatttctatttcacagatgagaaaaataagaggttgcaagattaaagaaatggaggaacctggatcaaaatccatgctggtctgacctcacaccacagcctctttatcttccactcaaaaacactaacagtgattgcctctgggtagaaatattatatatgacttttttgtcttttgggcttccctggtagctcagctggtaaagaatccacctgcaatgcaggagaccccagtttgattcctgggtcaggaagatcccagagaagggataggctacccactccagtttttctcttttacacttttttgctttttccaaatccaataaacacagattgcttctttaaaaaaatttttttttgaaagaaacattcattaaagttgaccacagccacgatatggttaaaggagactgctgtatgcaatggatccttactgaaaacaggataattatgaacacaaggagctttcatattctgctgaagcttctgttcaaatctaatttctcaaagtatattgctagacgctaatgaaaacccaaagagatacatgcattcaggagatgtatagccaatgaattttctgttgtttttatagtgaacaacttttttatatcctaacagttttatgccagttatgaaaaagataaataaatatttatgacattcactcaattccacagtaactactaagttgctcatgttctcactctggtttgaaatgtgcatattttagtggctgggagtctcaaccctcaatgagaaagccacagaacactgtcattttcagaccctaaaactactcatttgactcactacagggatttgccttggtagcagcacataacaagcttaattaaggcagctgtagacacagacagatacaaagcccagtgctgcccaacgaacagctaagaaaacaccagaattgccatggacactggttttacaaagcctcaccatgtatcagaagcatctgatcaagaacaacaaacaaggagactgagggaacacacagaaataaataagaaccaatttccactgtttaactgtcttgcagaaactttcctttaccaaaaaaaaccccaatttactccttggtctactgactgaacttccacctgaggggagatttatgtagctataacaggctaattataaagaataggccaaaattcaccaatgggtaattcatgagctaaaagcccataggccagttatcttctgcctacacacatttttttttgttgttgttatttgtttaaactgatatagtgccaaatttttggacagaagtacttctcattaaaagaaaaaaagtttctagatttttttggaaaaactgaagaccaggctacattagtccagcactctcttattgcaaccatcagttggagctgaataatggcttacctagcatcccctctcgccactccagactattctaccagctaatgtcaactgcatgactcttgcaggcacctgagcatgaagtgcttgtaacagggacacctgaaagactattaaaatacaccacacctgacaatccttgtttcacctaaatgaacataaccgtatttctccaagcactgctctttgaatccaggcaacaggagaagtgagggatgcagagaagcatcctctctgcaagtgaggtctatcttgtcaccatctaccgaaccatctactggtcatccttggacttccctggtggctcagatagtaaagcgtctgtctacaatgcgggagacctgggtttgatccctgggttgggaa

SEQ ID NO: 35641 - DNA, 4651 bp, Bovine  19866881600133
ttctctgttatgtatgtcttatacagttgtttaaaatgtgttgtaattgggtatgtctgacagcatgctttccaatacagatgtgcccttgggagcaggaaccatgaattttcatcagtgtatcctcagcgttagcacacatcttgcagatagtaggtactccattaaaaaaaaaaaaaaaaaaaaacagttgagtaacagaataaatgtagaagttatctattatgacaatatcaagctaatacatcaattttataaaggaaactcaaactgtgaaaggaaaagtgcccagactaaatcgtacaagtagttagtgtccaagtcaggattgaaactcaggtgctgtcagctccaatccagaaatactcttttcatcatgccagcctttatgtgccatcactttctacatacaactcaatagaaccagaggagttggatgcagataaatgaatgtaaaatgccatatcttaaattaaaaatgatttcagaagactgaaaagagggtggaaaaggaagggggggataaagaggctgatgtaagactttccctgtgatatagtcacttttcatttgctttttgtttttttccaatctcttgccatgtaaccaaaagaattggaatggggagattgattgggcaatcagctgtttcccaagggctgtaacagaatcccagtcttttaggtaatttaacctggaagggggttttgctatagggaacagcctacgtggttggggatggacaagatgatttaataggcctcttcctgccctaattactaatcttccttgtgagaacccccttcttgtgctgcattaaagactccattaatttgtttgtatataaattcaagccacttcggttctgtcacacttctaagaggctcccattcaggagtctgtggcttgcatcacccattaggatttactgataagaaagacgcattatatattttattaccttgtctgtggagcacatgtgacaactataaagtacattcacgtatagtatgagtaactgtcagggtaattgataaagtagtctgtaataaaggtaactagaatggcattcctaaatgttgaggtctctaagtgctgaagaggagggggtggggggcactaaataaatccagtctttcagaaattgctggcatttaaaaaaaaaaaaaaaaagccaaccagaatccttaggcctgcatttcactttcaagtgtaattattttatgttgcaattcatatctgctgacacattggaatcaactcaaataaaggaatgctataaatcttgcattgtttggattaagcacatgttgatactgggagaagtctaggaggaggctgctcctgtgtgtaaatagtttaagaaaatcaaatggctggaaaagatgtagatgtagttaagataaacggtctaccagcagacttccagcctgtttaagcatccaaagatgtgagaggctcagtactttatcctggaagtgaatggtagcaggccattataatcatatgaataataatactagctgacactatcaattattgggcttcctctacatgtctgctacctacatatattagcattttatcctcaagacagccctacatgggaagtattaccagttatgttatctggagcatgctatttaatttatctgtaacccagattattcatttggaagtggaaaatgattacaacaaccctcacaaatgtcacagggttgttgaaaggattcagtgaggtcaatgaacatatggtgcctagaacagtgcctggcacatagtaagtgctcagaaagtaggagctggccgtatcattttcactttaaagatgagaaagtcatagcaaggttctgaaacttgcctacttggaagatatgaacttgggtctttttcattccaaagtctaaattcacgccacccttgctgcctgtatgctacatgttttctgtgttaacatcatgctttggtctttgttctgacttttgagcctgagatgcagtagcttcgtcttcccttcatccctgttggtctcccagcctgtcgaagctgaggaaggtgatggagcaagattccttggtagaatcttttgttttcaactgataacccgctggcatgctacagtccatgaggtgcctgccatgctgcagtccatgggattgcaaagagtcagacaggactgagggactgagctgatctgatacctgctagtaccttaccacagcttgtgtcttgtccatatgtgaattaatgtggcccctcaggtggtgcattggtaaagaatccacctgccaatgtgggagatttaagaaatgtgagttcaagatcccctggagtaggaaatggcaaccaactccagtcttcttgcttggaaagttccatggacagagaagtctagcaggctacagtcatagggtcccaaagagtcagatgtgattgagcacacatttagacttttactcttttttggtttttttgaaggataatgctttaagaattttgttgttttctgtcaaaccttaacatgaatcagccataggtatacatatatcccctcccttttgaacctccctcccatctccctctccatcccactcctctaggttgatacagagcccctgtttgagtttcctgagccatacagcaaattcctgttggatatctattttattttcactcttttttgcagcatgatctgtctacacttcctcaccaccccaccatgaaaatccgttggcggttgtgatggcagctctatactcttaactagaaagtctgtttgaatgatgacagaccattgttgactttggccaaatgtttttcttctccagctgtttgtaattttactggttttatgaactagaaaaagtactagagaaggggtcaggtacaggattgggccacctcatatacctttatctaaatgtccaatatcaaaagacataataaatgccagctcttcctctgacaggctgtgtatcctcgaagatcactgggctacagtttccccagatgtgccaggctatatcctcaactctttctgcagatgtaccaaccagcagaactgcgggttgcagagtacaggctgaggacatgtgaggactgactcttcacacccctttccctacattgtgttgaaaatctcacccttttcataatacttttataaccagggctggaaaggaagtagactacaacattctaggaagattttcaatgtgagagtgtagataaaatagcttaggaacagaacgaatgcttggtatcaatacagaatcagaagggaacatacagggtcaatcctagttatacttgtgagctgcattgtcttggcaggtgatacaaatgctctggaaactcagtgtcttcagttgtaggtaatgatacatattgcactgccctgagggtttgaactatactatgtgtgtcagaaatgccttgaaaaccgcaaaatcccatgcaaagtgttaattgctgcaaaagtggaaagagggtggcatttaaggactgagatagaagctcaaagagcagctttccaactgaccagttgtgtgatcttgggcatttaacctccatgagcctcattttctttttctgtaaaatggtcaaaataatctacataccctacacctctttcccagagtggttgtcaggctccagtacaatataagtgaaagtgtttgtttcagacttgaactctacaaacgttaacaggtttacagttctacaaacgttaacaggtttattatagggatggccaggccgcggagtggctctgtcgttacaaatccaaaggacatctctgtaaacgcagttaattttcccattgagagccccttactttttactacaagacaatttccagctttctcagccaaatgactcttctcatctatttcataaccttcactagagaaagtatagagaggaaacagaaatcaaagccaggaatcgctgggcttttccacataggtgtgaattagaagagctgtgactgtcttggcctctcattttgctgtctgctggacggtgtttgtacaggggtgggatgaagtcactgagatctctattcaggataaatgctagttctgctttgtagccaaagatatatgccaggacataaaaagaattctttccatggtgctcctattaattcatagcagttatagagagctgtaaaaagccacctaattactacttcttcctgtgtatatttcaaagatggcaagtatcttagtagttcaaggtaagtctagtattaaagccattgggctataatcttctttctttctcctgtcttgtaaccatcagctgagtcagtgaaagaaaaaagcaactccaagaaccatttttatccttgtgctccctttatccttgtatgagcagatgagtccctgagttgtcctctttgctcctgcgggcatctgtttggccacttgtaaaatgaggacaattgttggaatagcttctaaagaagtgtagctcatgcaggcagtagggctgagggaccctgtgaaggcctccgcctgccttttgagctaatctgtgtacaaaggcaaagcactctgagatgagaaccatgtccctaaacaatccctgagcacagtctgctcagctgggaaagagtatttacacatgttgttgacatgtatgt

SEQ ID NO: 35642 - DNA, 701 bp, Bovine  19866881602245
ctagtagtgactggaagtagaagacactttcttttgtcatttctagtatcagagactttttttttcataggagctacattattttggccaagcttatctaagcctcagttcctcatctggaaaacagggtgaacagctgggtgctgagtgaagatgagatgaaagatggtacaaagcaaaccctgacacactgtccctctcagtgcctgtccatcactgtgtttctgctcatctcctccttcccgacttatgaaaacatagcacttctttttaaaaaaaccattgccaaagcctttaacaaagcactctgttatattcttattactagactgccatttctaaaggcacgtttaagaaaggtaagtgggaatgagaagtgattacagaccaatgatttcaggctgacacatgaatttagctgacacatttaaggtacttatgttctcattttttaaaagccatattttaatcaaagtccaacatgtatttgctgaacctaccctaggtgcacactattaggttagacatggtaagaggtttcaaggactataattagaaatacatggcgaattaaaatgagatatgatcctttataatctagttatgacaaaatgacatgtagcaccaaaaagtgctttgttgtatcaacaaaaggttttcaggattcagcaagagatccagtttttctgaagcagcactta

SEQ ID NO: 35643 - DNA, 829 bp, Bovine  19866881764008
gcgtgtatctagcaactggtcttagtttggattctgtagaagtcaagtttgagacaaggattcttggagaagcaatctactgagggaaggctcccaggagaaggggagagaagagcacaggctggagaagggggagacagctaagcaaggatgtgggctcgactgaggactggctgcatgctggagcatgaatggaggccaggggactgacctcttgtatgctggctgtcaggcattggctgtggccagtaggggtggtgatgacaaacaacctcccagcctggtggctctccccagcagacagctattctagggggaagggagcagctgtgagtcaatagcagccaacactcagcagctgggaggtatgtgcaccagcccagtaaagggcatctgggcagggcaccaagaacacccactactgtacacagtgagagaataatggtcccctggcttgttagcatcctacatatagcccagccagctcatttgacaggcgagaatctgatgccaggaagaagagctgaagttttgacttctataccacttcctttccatactcccagagtcttccatggtctgatcctgcaccaactctactcttctaccttgctcagagcctagctgacattccagtcctacctatgcctgggtcctaaggcttcaggtccttctcttgctggcattcttttactcctgcttctccttctgtggcagcctgcaaagtaccttacctttctctactgagcaattctaaataacatgtagcctcatttcataacactggaacaggaggtctctcataggtgacctatagagtgttttgtcc

SEQ ID NO: 35644 - DNA, 1256 bp, Bovine  19866881863092
catttaaaagcaataatgattcaaaattgaatcatccaacaagaattttaataaaatagctctagttgaaattttcaatgtttaggagacagggactcctttaaaactatcccacaggcaaaataagaggctctttaagcactacaaaatacttgatgttaagattaacaacaacaacaaaaaaaaacacatgaagccagtttgggatattcaagaaaaaggaaagtataaaatgcagcatacatagataaatatctcatccattcattactccagagcaaaaggttgactttctggaatgaaatgactcagtatctttatagtctcttgtgtttcccaagataattttatatactttatctaattttatcctcccccaaacactatgagatgtgtattcttatacttcacaaatggacaagcagaagttaaattgttcaatatcattcaagagaattatcatttattaagttggatatattttatatccaggatcttatttcatgttcattaagctaatggtagaactgacctgacaatgcaggagacaaaagagattcaggttcgatccctgggttgggaagaccccctggagaaggaaatggcagcccacaccagtattcttgcctggagaattccatggacagtagagtttggtgggctacagtccatgcggtcgcaaagacttggacatgcctgaagcaacttagcacagaactgtggtaagcaactcttacagaagaggtattatcattttaatttgaccagtcgagaaacaagtgaaaagagattaggcgatttagtccagatgacccagctcctaagtcttggatttgcacacaggcctatctgacaccaagtgaatgctctttttactgacctggagtccttcactgaattagtaatagcatggagtccttcactgaattagtaataaagttccatcctataacagcctgttgcaaaaaagacagcagctcatttcccggctaagtaaccctttaaactgcaaattttgcagaagcttttggccaactcaccagttcaccttctcctgtatggttaccccaggctgataagtcatcaaaaataagaggaaaaaagcagcagcaaacatctcatccaggagctaccaacctgtattacctagaaagtaataaaactactcagggagttggaataaaagacatctacagtcttgggatctatctaatgtttgaaactaaaaaaaaaaaaaaaagacaactcacttgatt

SEQ ID NO: 35645 - DNA, 826 bp, Bovine  19866881945213
cccgcactgatgctatttcttacatctgttgatctgcgcatagagaggctccggctcctacggacagagggacaaaatgagacccgctcttttcctgatagggttttctaagacagcttgggaaggagggtttggaattagaacagaaagatgacagtttatgatgaatgatcttaggttattttgggattattcagtcatggtgcatgtcattttggcatccttttttatccttaagaagaacaactcacccagttgtgcccttggttttcaagctgagcctgttagggaaatcacagggtctagcagacagagctggaccagctgtgtgatatggacaagacacttttactttctgagccttagtttccccaaccatgaaatgggaataattccatttaccctacagggttcttgtgagaattagagagaatatatataaagcctctagcatagtgtttggcaggaatgttcaagaaaataagcagtagaaaaggctcttcagaacatggtaacaatgctcatacatcaagtcaatgtttttccaaggctgttttatgaacgtccacttgagactgctgaaattctgtctcaagctgctctttggtttctgcaagcagtgatgactgggcgtgctttagagcgagagaacagcaaccacgccattagctcttagttaaaagcttctagggcttgtttccatccactcctgctgcagtttcaggttgggtcaggcacttgcctgcaaccctggggcttgtcttaagatatacacaaaggttttcacccaatatatgacacagcaaaaattcaatccaaatgcaga

SEQ ID NO: 35646 - DNA, 1357 bp, Bovine  19866880172548
aatgaagatcatggcatctggtctcatcacttcatgggaaatagatggggaaacagtggaaacagtgttagactttatttttgggggctccaaaatcactgcagatggtgactgcagccatgaaattaaaagacacttactccttggaaggaaagttatgaccaacctagatagcatattcaaaagcagagacattactttgccaacaaaggtccgtctagtcaaggctatggtttttccagtggtcatgtatggatgcgagagttggactgtgaagaaagctgagggccaaagaattgatgcttttgaagtgtggtgttggagaagactcttgagagtcctttggactgcaaggagatccaaccagtccattctgaaggagatcagccctggatgttctttggaaggaatgatgctaaagctgaaactccagtactttggccacctcatgggaagagttgactcactggaaaagactgatgctgggagggattgggggcaggaggagaaggggacgacagaggatgagatggcttgatggcatcaccgactcgatgagtttgagtgaactctgggagatggtgaaggacagggaagcctggtgtgctgcaattcatggggtcgcaatgagtcagacacaactgagtgactgaacaacagcaactaggtgtatcaaacagaggagttagtataggggattggttacacagatgatgaaataactgaaaaatgatagaggggacatgagtttagaaatagttaggaagctagtcctagccttaggactggagagagaaagtttccacataagttatttggtataagttagcagagcccaatatctggggccatatgctggaagctggaatcataataggctgccaggcaggaactgaggtcagggagagaggagctttcctatagaaaggaagctatagagcagacacaaccatatcagaggtaccctgtgactcagagagtccagggaaagaatagcagcttctgctgtcctctagtccttcggccttgcaccagtgcctcccattggccaaactgcttgaaagccagagggcaacagagcctgaggaatgttgctgcctaaggaatggagctgagagcaaaaggcacaggaccaacaagagcccagccatacacgctactcagtgtcatctcttggggtctcctggagtgttcccttctctggttaagcactatccttgtggtgtggtggttggttgcttagtcctgttcgactctgtggccccatagactgtagcccaccaggctcctctgtccatgggattctccaggcaagaatactggagtggggttgccattcccttctccagggcatctt

SEQ ID NO: 35647 - DNA, 1210 bp, Bovine  19866880417263
aactgactcttggaaaagactctgacactgggcaagattgaaggcaggaggagaaggggaggacagaggatgaaatggttggatgacatcattgacttgagggatatgagtttgagtaagctcggggagttggtgatggacagggaggcctggtgtgctgcagtcagtggcgtcacaaagaatcggacatgactgagcgactgaactgaactgaagtttattctagttatttagtatttagtcattgtttctgactctgggttgtcttttccagggccaatttccaattgccttactgctttgttgcctcctatcatagagcctgaaaaaactagatacttctattttcagacttccttccgtaggcttgaaggagatctctctcattcgatatcctattcattgcctttagacatgtctatgtgaggatttatctaaatgtgtagcagatatctcatgatgctgaaggaaaagaaaaaccagaactatctcagaaactcctacccctgaaatggttaaaccagtcaatcaattctaagactactgctgctgctgctgctaagtcacttcagtcgtgtccaactctgtgcgaccccagagacggcagcccaccaggctcccccgtccctgggattctccaggcaagaacactggagtgggttgccatttccttctccaatgcatcaaagtgaaaagtgaaagtgaagtcgctcagttgtgtctgactcttagtgaccccatggactgcacagcccaccaggctcctccgtccatgggagactgctaatgcccagacatcttggtatgtgatcaattacattgttatactatttaaacccctgttagttataatactagttggcagtgttaattcttaggcaataactgaacccttagtaaacatgcctatatttaggccttgtctctttaaagacattgcgaaagacactaagacaaaaatgtcctcacaatgtctctctaattcatccatagcgcatagtaggtgctcagtaaactcaagggtgctgaatgatgtctcactgctcctaggctggaccatgggcttgcaaatttctcttccgaaactctctaatcttagcctttgtgaaaaagtgtgtcattttaacatcagcaacacttcaatctatatttgtacctgaaagttacactggaaaggggagaaaggaagaaatatagttcttgattttta

SEQ ID NO: 35648 - DNA, 1697 bp, Bovine  19866880785386
agagcagtagcgttcattccctccccagccgacttcatgtcttcccttaaatgtcattcctgccttgagcatgccctgtgctgtggctctccttctaaactctgtgtcccttgctctgctcagtttttcccacagtacttgcattatgacctagtctgtcattttctaatgggtttcaattatgctatgtttctctgtactaaattgcagggtccaaggggacaggaatttctgggtcttcctggtttactgtggtgcccccagaacctagaacagagtttcatcatcagtgctgttgacactttggactggataggtctttgctgtgggggctgtcctgggcgttgcaggatgtttaacagcatcgcaggcttacctgctcaaggccatagcatccctcctcaagttgtgacatccaaaaatatgtccagacaccaccaaatgtccatgggacacagactcacccctgttgcagatgaaaaggcctagaacaatgcctggcacaatagtgttttgttgtttgactatgtgttgttttctccctttgtatttaattctggatgggctatttgattctggtttttgcatttaaggctgccttccttttaaaacaggtatccaccgtgctgtctccaaagaggagtttatatattcttcatttggattaggcttagatgtgcaagtgtttgatgaggaaagacagtttcattcctaacccagacctcctagactttaggaatgtgaagccaatggatttaggtgatggaaccccactttggtcacgacgactggagaagctgtgtcatagagagacacacacaagagtaaagggtctcctgaagaaatgtttgcagtttggttcctccccaaaggtttttgaaaccttggtgtattctcctggaaatgagccgcgaatggtgggtggcagaggaaaggtgccaagtatgagagcgtgaacccagatagcacacacgagcacagtcaggtcagggtcagatgtggaaccactgaatgggtccctctccaggaagggactctctgtagggctttaggtcccgaaaaagattttttttaatatgttagcatctttcaggttcatagttcttttgtttcatttacttggtgctaaattctgtggctttgtagctgctaatgcccttttcctggacagacttcagaattgatttaatctaattccagtttctcctcttctcaaagttttgataatggttctttaacttcccacaaattagaaatgggaatgaaagtgagtattaggtttatattggcaggatgagatagagcaatggttcccagatgctgattcagagagaggtgtgtgaaattgttgcagatttgtattcagatgagaaagaaaagatggttgtgtccaactcatgctcacatgcatgaatttccatgtaaagccactgccatttcttggatttattctgagattttttcctgggcttcccagatggcactagtagtaaagaaccggcctgccaaggcaggagacataagagattcaatcccagggtcaggaagatcccctggaagagggcatggcaacccactctggtattcttccctggagaagcccgtggacagaggacgccgggggtctacagttcctagggtcacaaagagtcagatacaactgaagcaaccttgcatgcacccatatcttcctatta

SEQ ID NO: 35649 - DNA, 1216 bp, Bovine  19866881012079
aatgccatgaaactcacgttggaggatttggggcctgttctttttcaagagtcggcaaaaaaaaaaaaaaaaaaaaaagacttgcaagggttgagcatcctcaggagctagcttgcacgtgtaaagaaaatttcggggatgtgggaagcgctggtttcacacgctgaagctggaaacaggtgcaggatggaaccggtgcacagaggaaggctaaatgaaaaaagttgtaaaacttgtctgtggagcagacacatgctctttgaaataaaccagtgaaataaaatctgtgaataaatatatggggttggcaaaatttccctatagtacagttttccacagttgtctgatgtattgtcatcgacatctgttgtgtgactttgcaagggctgcatgttcagggccccctccttgtggctttttgtcttaagtctttgactgggacctcccttcttgtaatcttggttggaaaaagttgaaatcagaaggggaagatggctgcaactgccttgtctatcagttgtattttctggattgtcttttggagttgaagatatgtttagaatcctcctaaaaaagaaactgttaattgctcagttgtgtccaactctttgtgaccccatagactgtagcctgccaggctcctctgtcccttggattctccagacaagaatactggcgtggattgccattcccttctccaggggctcttcccaacccagggatctaacgtgggtctcttggattacagccagattctttactgtctgagccaccagggatgcccctagaatctgcctacttgtcatcaactcctctgctcccactttggttcagactgccacctggcctccctggctaattatctcttacctgttctcctgcctttatccttgctgactctcagtggatttttcaacacaggagccacaatatctatgttaaaactggttttcaacctgaatggtggcttgccccactcaggggtcattcagcaatgtctggagacatttttggtacaatggatgagagttactactggcctctagtaagtagagagtggaaatgctgctgagcattctccagtgctcaggacagtctcaaatgaagaattatctgtccccagattgttactgctgaggttgagaaacctcatggtaaatgtatcacatcatgttctctcttcagaaccctacccggtatcagtaaaactcgagac

SEQ ID NO: 35650 - DNA, 760 bp, Bovine  19866881073110
cttgttaaggtcgtccatggtggtcataataataatgataccaataccagtagctttcattaattgaaggcttactatgtgccaagcattatctgtaggctttatttccgatgatactttgtgcaggtatttctgagctcaatttttcttttctgacaaaaccaagctattaataaccacctgccccttccaatgtgagggccaaatgagataagtgaatgtcctttgaaaattgtaaagtgctcaacgaatgcagtgtcattaatttctgctgaaatatccatctgggagcaagcagagggatagatattttcattcttctctgtaaacctttgctggggtgccctggaagtggtggaaacctgtatttggaagacaaaaagcatttctttggtgaaattgaaagggacaggttgcttattgcctcccaacctcccagattttgaattttcttcccctttattcttttctctgtgtgctcatcatttgcaattttatagaagcctattatggcttcgtctgagagagtggcaagggagaagaatatttaccacccaggcttgagccagagtgaaaatttgtaaacaataaaaatgctgtatttcaaataaagcatcattttttcccctcaatgtcagaatttaccggctttttctgatgctaaaccactgaattaatctcttaggaaaacacacaatttggaggttaaaatttttcagctgttggaacatttcaaatgccattgatattcttctcatgc

SEQ ID NO: 35651 - DNA, 1796 bp, Bovine  19866881221576
ttttttcttcttcttcttctttttttggttacctcttagatttcctgttcattccctggctttcattctaggtgtttccacttaatttcccccttcatctgtaactccctctctgtttctctcagtttttttttttttggctgactcccttatacatgcctcaggtctttatgtatgtatgtgtgtatgtacctatgtatctgtccatttgggtttccctaatggctcaatggtaaagaatgtgcctgcaattcaggagactcaggagatgcaggttcgattcctgggttgggacgatcccctggaagagggtgtggcaacccattccagtattcttgcctggagaatcccatggacagaggatcctggtgggttacagtctatggggttgcaaagagtcagacacgacttagcgattgagcatgcacacacatctatctgctatctatctgtctatcgtctttaatttcttgcctccctccctctgtccttccgtctctctctttctccttatctctctgctttctataattccccaatattaatgctcacattctgactgttactacttacttattcatcttccagcttagattttaagctccactaaggagagaccatgtttgttttccttttccagcacctgtgtagtatgtatgtagtgtcgggtgtaacgtagccactaaataaatatttgttgagtgaatacatcaatgaagtacagtttgagcttttggctttcttattctcactagatatttaagttctttaatggaaaatactgcattttaataaagtatttgtgaatattttatgactattttcataaaatattaagagcatttagagtcaaagttatattttaaagtcagagaagtaatattagaatctgtgggcattaaaataggttaattttcttttaaaaattgattttaaaattttctaacaactagcacatggtttgggaaaaaaaatcaaagaagagtgagtgtttcaaatgaaaatcagcattcatcagctttgtgtttctaatcctgtgatattaatagattaaaatttcagtaagattcaccttcaagaagaaatagatatatacatatgtacatcagaagactgcagtgttctcagaaacgtgactaccgttgttcagttgaaggtatgatgggaataaacagttcataccgaagggactttttaagccttgatttgtttttttaaaaaaatggcatatgaagggcacagtgcctcttccaatgttagcttgtgtttcctttaaccttcttcttcaaagacccatcctaaaaaaaattcagcctgttttttttttttttccctcctctctttcaaagacagtatctcaaaaatggtactaatttaagccctgctaaatgtccagatgcagcacctgggaaaaatgaagttcagaagttcaggatttggaacttgcttaagctaggagaatcttcttgctgtggttgcatgtctgattctagaagctggtaacctctttctcgtgggcatcgttccattgtaacagatggccccaagtgtggacgtgtcagagtgaagcccacgtgtgaacttgtccaagaagttgaaacactgctcagaatatcttctcctgccaatgatagctttgttgttgcaattagaactttctggattggaagagtgaacttaatgaaacataagagaagcctttagagctctgttgtccaatatggtagcccaggccacacatgactcttgagcacttgacatgtgactatttcaagctgaggcgttctccaagtata

SEQ ID NO: 35652 - DNA, 737 bp, Bovine  19866881468215
aactatctgtctgaacttgaaagacacaggctaacgctaattcacaaacatgaaatcccagggatcactgaacaccttgctaatttctagagagcccaacaaatagataaactgaaaactaaagtgttccatccccagtctcagtgggccctcctgtgcgctggacaagctacccaatccaatgctcttcatgatatgcctttttatgatctgtttaccaatgtgaatcccctgttatgctttaattaatttcctggagaatcaggggtgatctctataatcaccaaatgcgggacagccattttttaatagcattaatttcatacagaatcatttcagagaaagaagaaaaaaaaaaaagcaaaattgtgagaaaagaactgttgaaaaagattctagcatttactgaaatggtaactcttactttccagttccccgtatttccacagttaaatctaagatggggatagctcttctcttaaaaccacaaaggctgaagcaggtgtgtgtttattacatgccatctgtatacacctccccacttgccaatggtgcactgttggagaaccatttgggaccattcaaaaccattaagtctattaactgtgactatggccaagtctagtaaacaaatgtcatcccaacaggaaatgagttaagctggccttcaaagtcacataagcaaatattcccgcaagtcagagggcctcacacaaagcttctcatgaattcttctg

SEQ ID NO: 35653 - DNA, 1043 bp, Bovine  19866881759126
actatcatcaattagtcataacctaactattctctctgctgtgtctggctgattttacctcccatgggattttatcaaacactttttgcttctatcccaatccaaccttcttcttctttcccagagcatgaactctgcagttgaacagcctgagttaaaatctaagatctgtttcttactggcagtgtacttaggcaagtcacttaacctctccatgcctaagtatctgaatctgtaaagataacaattgctactgctaagtctcttcagtcgtgtccgactctgtgcgaccccatagacggcagcccaccaggctcccccatccctgggattctccaggcaagaacactggagtgggttgccatttccttctccaatgcatggaagtgaaaagtgaaagtgaagttgctcagtcgtgtcggactctttgcgaccccatggactgcagcctaccaggctcctgcatccatgggattttccaggcaagagtactgcagtggggtgccattgccttctcccgaaacataacaatagtacccacataatagggtccatagggctgcaaagagtctgacacaactgaagtgacatgcacacagtagggccattgcaaggatagtatgttaacatatatatgcgaagctttgggaacatcctgctatgtagccagtcgctgactattatcttttagtctgcaccaaaaccccaagaggtaagcattataatatcattttatagactggggtaaggatatactgctactctgggaattgtgtagacattgatttcatttatattaggtaccaaattcccatagaggttttttaaaagggacttaggcaatatccaagtttatttttaaagctggagcaaattattctctaagtataattaagcacttttgagagtccagtagggatgattattcactaataaatggtaatcttagtaattcaagataattaaaaaaaattttccctctgactgatcctcagggagagacagctttttcaaacagctggaggatagtctataaagctcag

SEQ ID NO: 35654 - DNA, 4198 bp, Bovine  19866880183231
tttttccagtggtcatgtatggatgtgagagttgaactataaagaaagctgagtgctgaagaattgatgcttttgaactgtggtgttggagaagactcttgagagtcccttggactgcaaggagatccaaccagtccatcctaaagaagatcagtcctgggtgttcattggaaagactgatgttgaagctgaaactccaatactttggccacctgatgtgaagagctgactcactggaaaagaccctgatgctgggaaagattgagagcaggaggtgaaggggacaacagaggatgagatggttgaatggtatcaccaactcaatggacatgggtttgggtgaactccaagggttcatgatggacagggaggcctggcatgctatggttcatggggttgcaaagagttagacatgactgagcgactgaactgaactgaactgaactgaacacgttggacgttggtaaaatgcaaatgctgattcagtaggtctggggctgagcccaagaatctgtatttttaacccatttccacataatgcccatgccactggtccagggaccacatgttcagtaatgagagttcacttggctaatcacttctcttggaactcaggaaacctatgttacaactctcactcttctagcaatccactgtctgatcccagggaaattgtttgatcagtcagggtctcagtttcccatctgtgaagaagagataccaaggttaaagagttcttattgattttaaaccttgaaaacagttatgatagtaaatatgaaacttgttctgtgaccaggtttgaacaaatgtatttcagggcatgaaagacatcagaagaggaaaagaatgatccttaaaggctgagaatcaaaagtaaacacacaaatacacagggcctgtgtgtgtgcatgggtgccaagtcgcttcaggtgtgtccaaccctttgcgaccccatggaccatatcccaccagggtcctctgtccacgggattctcaggcaagaatcctggagtgagttgccatgccctcctccaggggatcttcccgacccagggatcaaacctaggtctcttatgcctcctgcattggcagaaggtttctttaccactagcatcacctcttattggaaggaaaaacaataaacaagagaataagaagaaagtagagtcagacatgactgaataactaagcacagcacagcacataagtaaaggaaaagaaaaagagaagtgccagagaaagagtcagtcgaaggaacatcagacttcagcacagaggaatagaagataatgtgaacgtgccatattctttagtatctagaaatgatgactgcagcaattcacaagggcagatccctagagaaccatggagaagatgacaatgtagtgtatacaagaaaaagaaaaggtaaggaaacctttggatgaagtacaacaaattatttaaagtagataataaaagaaattgaatcacctctttctctaaaatgctggctggatttttaatgcagtgttttccttggccttttggcattgttttaagtccaagagagatataaagcacagcttctggtcactgctccatcatatattgccaccaacaggagatgaatcaagtggccaaaaatttccaaatactctaaaggctgtctgtattggatccttccaagaaaaacagtctgccttcatatccccaaatcctccattatgacagggaattcctagcagaactctcaggggcaaaaaagatggagcaaaaagcatttattttaatttacttttttataaatcactaactaattgaaccattttcagcaaagccagaaaatcctgccgatcaggattgacagtcacttacgctgatagcgttcttgaacttttccaaggttgaagctactgatgattcactgctgggaacacccatggtaactatttcagacctgtgaactatcacaccttctcaatgtcagcagatgcctgcatccagcaaatacctttccaaaaggctgtaagattacattttatttttggaagtgaccattcaagtcaccaaatggtaacactctctctgagcctgccaagggccctggctgactttcttcaatgtacaggcacagtttgcttaagactaacattgcctgtgaatcagtagttcctggacccaaggccgtgtctgaattccagttggctttttttgacatatttatatctacagacagaaacaaaggatcccatttaaaaggtttccaacccaaggagagccagttagactccttgcagcacaatcaatagtacaatcagctgctagggggaagagatagttagggactttgggaaggtcatgtacacactgctatattcaaaatggataaccaacaaggacctacttactgtatagcacatgaaagtctgctctatactatgtggcagcctggctgggaagggagtttgggggagaatggatacatgtgtatgcatggctgaatccctttgctgttcaccggaaactatcacattgttaatcggctataccacaatacaaaataaaaagtgtaaagtttgaagaaaaaacaaaaaggaaaaagtagtacaactgggtagaggagatgtagttttatccacagataaagacagtagatctgaccctctaaatttaccaagattcactccggattctactgcagtacacacagacttttatctctctgacaaccgaacccaagaggtttgccaaaatagaattccagtgtagggagaaagaagctaaagaattatgcattaataacacccttacccacaggcggaacatattttcatctgcacacatcacgaaccagagatcttaggttattaaaggtgaaagaggctaatcgtctttgggatggctctcttgggatgcctatttgcataatgaacctaatacatggcaacccaactcagcagttctttgggatcagctacttgtagtcggatgtgatatttttaattcactaactaaattactttgtgaaagagttgttcgtagctaatctcaaaactatgtctacaaataatttatgactatatttatcaatgaagaagaggcctaattggtaaagatgtatggtttaattaatctgtcttttggaaaattccaaattatgcaaagatcaccattgacaaagatataaaaactgctgtgtgtgtgcttgctcaggcacttcagtcatatccgactctttgtaaccctgtgaactatagcttgccaggctcttctgtccattgacttctccaggtaagactactggagtgggttgccatgtccttctccaggggatcttctcaccccagggaccaaacctgagtctcctgaactgcaggcagattctttttatcactgagtcacaggggaagacctaaaacactgctaaagtcatccaataatctaaactcagggtccagggtttgcctttctctggatgaccagaatcaggacacctagatcagggagcagcttctgcctagacctatcctatatcaagtgaaagagagcaaaaacttttggccagaatcttattttgtatttagtgcttgcagagccactttatttaaaatatcttaatgatggaacccaaactgcaggaaaaagtttagcataaaagatgggttaaccctatgtccattggtgaaaggttgcttttccagacagactaagaacaaagtatgcctaacctgatgttcttgcagatctgctttaatgaatatgtatcaattaagaacccttttaaattagcatatttaatgcttgtatataaacaaatggtgttaaagtttttttaaggatccaatccaggccctggcaatgaaagtgctgagtcctgacagagaattccctaaacagtagatgttttaagtggacttaatagttgccctgtgatcattgttgttgttgttgttgtctttacattgtttatttgtgtaagtaattaaaggtgaatctttgcccaggaaaaaaaaaaaaaaaaaagatgggttaaattgataatttatcattatcaatttaaggattaaattgataattttgctttaaaagagagaaatggggttaatcactacatagaaacaatttaatattaatattttgaagttaattcattgggtaactttggtatttttattgtgaaatgatattacttaaaaaaaaaaaaacttgttta

SEQ ID NO: 35655 - DNA, 1868 bp, Bovine  19866880377985
atgacttgcaaatattccatttgaggatttcagacttgatgtcatcagagcgtctttctttgtggtagtttctgtttaatcagtgttccatcagtgtttctaagaccctgtttcttttcactttttaaaaacctttttagtttatattggagtatccttgattaacagtgttatgttagtttcacgtgtaaagcaaagtgattcaattgtatgtttacctgtctctttttgcaaattcttttcccattttaggttgttacataatactgagcagagttccctgtgctgtacagtaggtccttgtaggttatccattttaaatatagcagtgtgtacatgtccatcccaaacccctaactgtccctccccctcttcgtgccccccccaatcaacaataagtctgcaactctgattctgttttgtaagtaagttcatttgtgttgtttttttaggttccacatgtaagcaatatcataggatatttctctttccctgtaggaccctgtttctccataaggcatgtaccttgaatacaatttatagtcatcaaatgggactgcccagtgttaggtcaaacaaaacttaacaagtatctttactgtggcactttccagagcctttaatacgaaaatttgttttgaatgccatagaaagaaatagatttttactccccaaattatctgacccatttttgcacagctgcaacctgggaaatactgctttctctaaaatggcaggagtgacctcctgagaaataggttgagctggcatttcccttgtggttcacaaccttcctgctaagatgccaggctgttcctggagaggaggcctgagtcaggagtcatacgaagcacacagcatagagttttgtgtgtatggggggcgggctagaatgggaacagtaaaacaaggaaggtgaaggattgaggagaacctgctctcttcttgagggaacacccaggcatacagatctcctctagaactctttctatctaggcctcaactgcctagatggaatcctagtgcaaatgttgtaaaagctgttcccatgtggctgggtatttatagcttgtcattgacgtaagcagatttctgtggctgaaaatagtgacatccaggtatttgggccaatttgtgaattttcctcagggacatgtgttcagggaagtaattttctggcaagaagaatgcctctgcaaatggttgttttcctgagaagttatgcctttttatttacccttaagaaggacacaaggcctttcaggattgctccagcccaggcatctcagatacagtgggtgaattctcttccctgacttcgtgggtttccagggggttggtcatattgccaggcgcctgacattgctgactgaaagggtctgaaccctggaggtttggggggtctatgaaggcttccacattctccaccaaaatcagttttttctccctggactgggggaagaaaccacaccaaaagacccctgtattcctctcagactgcctgggcaaacctcaagaacagtgggaatgttggagccagaaaagtcatacaacatacccgttgtgaaaaacaactggaaacagagcttaatgagttttttcctaaggatggccctcaccaaatagattctcttttagtgatttagtaattaaagaagcaaaacctcccagcctccaagagctgaagccagcagctatatcaggtcaaaggaccttgggaagagaacaggcttgtttattaatcttacagtatctctttcctaataaaaccccaacagttggccttgtgcatgttaccatttacattcaaaccaggtctgttggttagttatttatttaagatgtttggcctgtttggaaattaaaca

SEQ ID NO: 35656 - DNA, 1353 bp, Bovine  19866880422459
catagggtcccaaagagtcgaaccactacggagcacgttaagtgactcaaacaggactaagcgactcaaacaggactaagtgacttagcacgcagacaagtatctagcccagttctttgttcggtgagtctgagttctttgggtgggtgaggggctccttctataaaccttcctgtcctcctcagagaatcagcaggctgcctagttcaggaacaagggaggaggaatggctttgcaaagtgtctgctcacattctctattcaatttctgaaatgcctcagtcatctttcccagtgttggatccagtttctcccactcccaggtgattctttttctcccctgctctgcagcagtgagcaggtgagctgacagggccagagtggacagtttaccctctttctgtgtccacgtgccctcctccttgacgtgagggtgtggaggagagagttcgtgtttgttctctgccagcatgggaccctgggccaaagaccatgaagagaaggggaggtagctgatatcaatcagcacctacctggtctgaggcatgttcgaagtagtttatatgttgcattgttcaatcttccacaaaaccgcacaggctagtcatttctctccccattttacagatggggaaactgaggctcaggtcaattacattccctgctcaaagtgaggacttgggacacttgtttttgtgactgtaaacctttgtcatttcccccttcctcccacttgcagaagggttaccaattgcctctccttcacccacatgctggacagtttggggcaacctgaggtgcagacctgtcttaggcattttcccctatagaccctacaatgcttaacacatagtaggtgctcataaatccacaataaactgaattacaaacggagtgatggaaggtcgttttgattagataatttcttttccagtggggccagggtggaggagacatggctctaacataatttaccttggctctcatcctggcattgtttctcacttttcatctctttggcccttatatgagtagatgtttgatggcccccataagttagaatccaatcaaagcactgcagaactcaacccttagatgccccctctcagcagcctgtaattttcagaattgctttcttgattggctattgtagctaggtaagaaggggctggtgctcaggtagagatgcttctggaatttcaatgtgagtctgctttggatgctgtgtacttattcatgagaactcttctacacagaatcacacttccctcacaaatgaaaatatttatatgatggtattcatgcaatttgaaaaaaagatcgcagcctgcaatgcctgccctgcctctgtgcc

SEQ ID NO: 35657 - DNA, 812 bp, Bovine  19866880491694
tggcaatctgctggggatttctgggaaaatctttgctttcttaatataggtgtttttcttcctttcttctagacccattttccctccctcttgtctggaatgtctataaaatgtctggaactggagtatccatcttgtgacaataatataaagaataagagaattgcaaaaacttttctctgatacgcttagtgaccaaaccaatgccaggaaccgtctatctctggacttctttcatgaggaaaaataatttccacttatccacatcactgttaagtgggctgcttatgtgcagccaacttgatccctgggtgatatagtgtgctgctgcattttgggctaaagagttatttggagctggaaggaaatatgagccagggcagggagggaagactagcacagcagagagccctgtcattcctgtgtatgtgtcagactgggcctcttctcatattctcccatggcttagctctttattggtgttctggataacttgtcagaaggattctctgggcttccgtgcccttttggggaattgcatttaatgaacttctgctttgttcatttcctctctaattttccatttcttgagagaaaaaggaagctctgactgagataatgatatcctagtgctggttaggagaaaactgtgtacttctaagtaagttggggaggaggaaggatacatttttgtgaattgaaaatgtcattttgtgcacaagaagtcattccaagtaaagacagatacattcacaaaacctagaaaagtggctgggcgggatgatatcttttcctgatgtagttaaaaaaaa

SEQ ID NO: 35658 - DNA, 805 bp, Bovine  19866880514198
taacatacagggtttcggtctgagatttctcttgaaactggttttccagaagaccgattgttcccaaggtacctagaatggaagagtcctaattcaccttgtgtgctcagttgcttagttgtgtctgactctatgcaactccctggattgtagtccagcaggatcctctgtccatggaatttcccagccaagaatactggagtgggttgccatttcttactccaggggatcttcctgacccatggattgaacctgtgtctcttgcatctcctgcattggcaagcagattctttaccactgtgctaagtgggaattccagtaattcaccttactccagaaatttctgaacttctggcaaggatgctaaaagctgaaggctcccctgaatgaggtctatgggaataacatgtgctttcgagtgaggcagagggagatttattttagaactttgttccaaggttctaggaccaacacccacctgctcacaccatttgtctttccttagcaagtctaaatcctatgcagtctttgtatgatggtttggagccataccttttccatagattctttctaccaagtctgatcttcattgatttaagtatctaacagtattaattatctaaataacaatctaatattggaatgagtaagctactcatgtaaagtattggcctagatgtactttgtcgggctgcgaagatgaaccagatttaaatccttcgtcgaagagtttacagtctaccaggagagaagtcaagtatagctgggaagggggagggatacaaataagcaagacgttactcta

SEQ ID NO: 35659 - DNA, 1143 bp, Bovine  19866880528321
ttgggtgggcacctgtggggtttaaagggacaggtcaggagacttctggctcctgctcaggtttccctggtagctcagctggtaaagaatcctcccgcagttcaggagatccgagttctatccctgggttgggaggatcccctggagaagggaatggcaacccactccagtattcttgcctggagaatcccacggacagaggagcctgctgggctataatccacggggtcgcaaagagacatgacggagtgaataatgctgctactactgcaggctcaagaagggtctgggtaataaacccccatgtcagtctcctgactctcccctcatccccctcggactcccttcccctgactggtccttctcaaggctcgccgcatcatcggggacttcggcatccccatctccattctggtgatggtcctggtggattactccatcacagacacctacacacaggtgagtgagccccgacaccgtctggcagctggttctcatccccaaggccttgagagggtggctataacaggtccccactgccccagcagccagtcagggctggaacccagcttccctagtgcagctgctacatgctggtgccgcacaggggtgggtggggggtttcagaagcagctgcagaggacagcagggggtctggggctgtgtgtgaccctagtcaagactcttgggagagccggtgtgggactgggggcagaaagacagatgcccccagagcaggtctcctgacagctcctctggggctcagggagaaggtggatcatttcctcattcactgccacacccttggagggacaatgactttggaggattacagaactaattttccccaaagctgttcacaccccaattccctggagccctggtgctggggacacagagccgggcaggaacagctgctatgtggagtcactggcgtccctgaacccgatcttccttctggccgtgcagaagctgacggtgcccacggggctctcggtgacctcccccagcaagcgcacgtggttcatcccgcccctgggcagtgcgcgtccgttcccgccctggatgatggtggcggccgcagtgcccgcgctcctggtcctcatcctgatcttcatggagacacagatcaccgcgtgaggg

SEQ ID NO: 35660 - DNA, 3242 bp, Bovine  19866880556667
tgcatttatatatgtttattaagtgggggcttgacagctttatgaggaagcagtggggtttgcaatggaggaaggccctgtacccctgccaaagctgatctcggcctgtgccatgcttgctctttaatagaataatatttgcgcagtgaaaatgtcattttaaatgactggtttgataatcctttaagcttttaaataatctgcaaagtctggaaactctaccccagtgtttaaaattgacgggaacattaatgaacgcacacgttaaaggatggtccccagctttgtttcctgagtcagacgttgcttactggggtgcgctccttttgtctgtctgccctttctgtaacacaagtgtgtttgctgagcagctgcagtggggccttctctgcggggatgtttttgggaagtggggcgccgcagcctgtggtgggatgtggagggaccagggttgctgcgagcctgaagtccgtcatgcagagtagaaaaggcactccctccaggagggagtttgtggaaagggccccctctgagcagagcaattagcaaaaactcacttctctccagctggtggtgcctcctaagcccagggtcttagctcagtgatcagagaagaggagggattttcgggccccctgcaactcttgcagggtgcatcctacatagccctacccagcatccctggtgaggtctaccttgtttgctcaaccttcttttggaccaggatacaagcctctccccagagaagtaccctgtgatatatgagatgctgggaggagctttccttggagggacagagccccactcctttctcccttgagtgactctggaataggataggaaggctgacatagagaggaccttctcatgagttgagcagtattatgtaagccatatctaactacagctctacagggcccaattgggcccactccctgtgttttaaaaataaagttttattagaacacagtcatgtccattcatttcttgtctatgatggctttcctgctacaatggcagaggtgaatagtcatgatggagactgtatggttcacaaggcttaaaaacatttgctatctgacctttttatggaaccctccctcagaatactcagcaaaatgaagtgaaattcctggcttaaatcctggttctgtcaattcctgtgtgtccttgaataagttacttaatatctctgttcctcagtttcctcatcagtattaataaaatggggataatatttctgccctgcccacttcatgcagctattttggacacaagggagagtgcagtgcgtatgtgaattattatccatctgagatatgccatgggttagccatgggatattggggaaagccccttggcctctttcaaactgtttcctcgtctgtcaagcaagagtggtgctctagatcagccatcctcaaagtttaatgtgcataggtcacctggggagttcggtagaatgcagattctgattcagtaggtctggggagggggctgagattttatatttctaaggagctctcaggtgaagttgctgcactggggcccacacagtatcagggggccgggtgattttgctgacactccttggtggcatgaacagtgagctgttctgcaaacaccattgtaagcgtatcagtgacagtcccttttctgggcacccctctccagtgtatgtcttggcaggagggtcctatacttgtttctgtttgtagcctagccctgcatctgatatagggcaccggtgagataagatgggtttttcccttttcctgagtgcatgcatgtgagcgtgtgtgctcagttgctcggatgtgtctgactctttgtgacccccatgaactgtagcctgccaggctcctctgtctgtgggattttccaggcaagagtactggagtgggttagacttctggccaaaaccttcttctggcagccaggtggtttgacagagcagctggtggcaggccagatatccatcagttcagttctcagttcagtcactatgtcatgttcgactctttgcaaccccatggactgcagcacgccaggcttccctgtccatcatcaactcccggagcttgctcaaactcatatccatcgagtcagtgatgccatccaaccatctcatcctctgttgtccccttctcctcctgccctcaatctttcccaacatcagagtcttttccaatgagtcagttctttgcaccaggtagttccttttcggatatccctggctggcctcaagttggcctgagtgcagctgaacctgggaatgatagggcagcaggagggtacccgacctccctgcgttctgccccagacagcaaactagtcagttacaccttggtgtgtggatattgcagaagtctaatccttttgcaccaaagtgaaatgccttctgggctccaactgtctgccagtgctgttaaggaattctcttgggtttctgttttcaatcacattttccaccagcctggggaaactgttggtcccaattgccatctgaagccacttactgcagctggagccagagccagggttcccccatagagtggggcaggtgggtgaggacagagctgggagtacgcagctggagggggagcggggagagagacacaccagggggattgttcatcaacagttgcccacaggtcagggtcctaggttagtcctggatacactgaggccggtacagtattacgacgtaaaacatattttttagattcaggtaaacctgggttcaaattccaccttcccctcttttttctaggagtgcttgggccggattcttaacttctctgaacttcagactggagaagaggaaatgaaatgatgcaagttttcctgttctgaatcctctggggctctctgcatctcgtcagctctgaacattttctggaccttgcttcctacttagctcagactctggtgataacagaaagtcagaaatccagtcgacaaaaattgggccgtgaagactgtacacgtacgtttttacaaaaggatataaggagacttaaaactttcattcggtcagttcacaacattttggtccttctactcagaagatgtgggaatgccgctgattccttaacttcctgtgtctcaatttattcatcagtgaaaggagggtaaccactggacttgtttgatgggattgttgggaggattgaaaaatataggtgaagtgttcatgcagacttggcacacagtaaacactgtcatctcttaactcttca

SEQ ID NO: 35661 - DNA, 2229 bp, Bovine  19866880585703
gaaccttgagatgctagtataaatgtagcacttgctcaggaaccaacagtagaagaacttgagtaaaggaagagctggtgggagggacatgaaacactcttcaaatatcccttttatagatacacccaagagccaaaatcctatgcttaacatcaatgaatcattcatgtttaagagtgctatcatctttcatttattctctttcaaggaagagatttcaaagtgtatgaaagtcttcaaaaggagaaatgatatatgaaagatataaaccaaagccttccaaaatgcattttgcttgaaatgcctcaaaagtacacctgaactgtttgcaaagcagccatgattcctaacacatatttttttcttcaatttttaagagaaattcctaagaaggaaggtaattagagtagtataaaagtattctaggctaccttaatgtaaaatatatagaagacatcgtttgtatgctactgggaatcactgtgaatttttgacttaggtttcaacaaaaatatcctttctgttagaggcttcaacattaagactatcctctttctttgaatgtgaagttgtacatataaatatatatatattatatatatatgcatagaagccagggaattttaaatttactctcaaatagcatcattttgcacctcctaaacagtaaagactgagttaataataacatcaccacaaatgtcaaagaacattcttttgctcactgttgaggaatttcaaaattgaaagtaaggtaaatgcatcaacatggcaaagtggaaataagatgcatttttatcttgccttccagaagttgtatcactttctgtaattgtaaagttatcatcacagataactgctagagaattttagcagactcaggcaataactcttcagaggtgggagtaaaggatggggagggagtggaaggtccccctccaaaaggtcacaaaagtgagaatgtgtgtgaggacaactgtcagcctagctgatggccagagtctaaaaccatttctgaatgattatgaccttcctcttcatggacaagtgaggaatattccatgaggggatgagggtgagggtcacatcagccattatttcttgtcccccttcttcaaggcatggtgttactggtttttttttttttttttttcctcatctacttcttaattaattatgagttactgacatcaggtaaacttgtgtgtgactgaagaaatattttggcaagtttggggggatgtcttttctgcatatttctgaatgttgaagcttcgtacttgtgacctttgtccgaaggcattagtcatattcagattctcctctgtatcagaaatagaagcagtaggtttagtgaattttggagggagggtggttttaattttgccattcactttaatttttaggcatatagagttagaaaaatcatagaagatgagtttcaggaacttgacttgctgaggcttgctgtgatattgagcaaaacattgattctaggttcaaattacgatgggcagaggctgccaatctgtggaccatccctagcttgtctcatatcttcttaaataatgtacgttctaaaggtctcctctcagttggcagacacactcaggagcataaaataaattcaatctcaaatcacggatacattcatgaatgttcaggactctgacacacctcccattacaatcccttctcgagagtctttcatatgaaaaggatgtttatttggaactgaaaaatgaaaaaaaaaagatagaaaaatattcaaaagtgttttttttatttcctcaagattcattttcattctttattctttcctacctggaaattcctttaacacccatttttaacgattactcagcacttatcttttaaaaccctaaactggaacgtgtcccttatatatgaactgatatgatagaagttacatctgacaacactttctctctgcaagaaaatattcatcactgtttcctatgccagtgattcatttcaattctggtatcaaatagattttactttacacctctccttgtcaaatgcatgcgctacgcttcctctaaatttaaaatccagtcaggggaatgaaagcgataacacctcttttattacagtttgggaaaacaataaaaatcattttggatattgaaataagcccatgaggcacttggaaaatggcagacaatatattcaaagaagcagataaagacagttaaagcggcaatg

SEQ ID NO: 35662 - DNA, 2225 bp, Bovine  19866880607360
tcaaaaatgcttttctctacaatgattttgtacaatttcagtttttctgatcagatgtaattacctaaactatgtatatagttttctccttctcttagcataatttggaaacactgtcatatgaattcatggtttgcacagtccaggaaaatgaaatcttgaaatagcctcttggaggttcagttttgcaaactacaaatactctctcctgtgcacgtgtgtgtatgcacacacatgcacatctatatctgagagagaaaatttcagcaggaaggcggaagagtagaaacggaataaaaacaacagttgagctgaagcaagctcccagaaacagcttgtctcatcagggagatgttttcttgtcatttcctcagttcaatattgaattgctccactgttctggtgggattgaattttaattgaatagacactttggttggaaatagttctcccccagtcatgcagatttgccttctctcagcatcattactcctcctttctccaagtgagtcatgagaattgtggggtgcgagtccgcacttggttgagcggaagaatcagtcagaaagtgatgtgatgggctcttcatcctgaaaggagaagcatttccaggtaggaaagaggactgctgagttaaaatgagggggtgtgcgtggtttgtgtttgcttcctggcattacctcaaagagaatatcactctgaagagctctaagaggggacaggcccactgggcgattgctcagggtggtaagacgtcaccagacacagtagaaatagcggcccagttaacaggtcattataaggggccagagaagcagacagcgtccccagtggaacttggagaataaaacatcttacagtgtttgctatactccactaaatagatacatgactttaaagaatatcagcctgaagtgactccagactgttaggctgtctggtgttgctcacatgactgggtgccactctggccagagccactcatgtgttcatgtgcttctctgaccactgcctgtcacaggccacagcagcccaagtgtttccagagcaggagacgtggcagggaagcccatcttggttatgcaccaaacaaactcttggccctagcccccacctctgagatattaataatttaagattattttcccattaaatataacgattaatatgctgttttctccaagtctgtttcattttttctgcctagaatcactgaccatcttttccttctttctacggtcacattctgtgttcgtgatgctggtctcgtccctagcttctctctcacccatttctcttaactccatccttctatccttcagccccaccctcacaacctctccctcttccagacaccctactgcactgcttcacctatgtcccgcccgtgtggaggataagctcggccatggagtggaacttggctggcagactgtaatcagagttacattttaaaagaactatttccacattttgataagaagctgctagagtaaaagggtgagttgtaattgtaaatttttatctctctggctgttgagctctatggaatcttacataaactatgaacaaatatttccattgtaacagcttagacatagtctcaaattggtcacagtaagaaaagcaagatgcatatgagtgattatagaactcccactgaactcaggtaagtttgacctgctttgggccactggaaagcgcctgccatccactgagtgaggtctctgttccagacctctgtctttctcagcttcaagttagatttcaaagcaagcatcacattctaggtcagatggatttaaagatgcaaatgatcagaaccctccccaaaatgttacatgatcataaacttaagggttagctctggtctgtacacttaaatattcctggaaaactcttataggtgtgtatcagacccatgaatggaaagaaatgaacaattactgagttattatgacttaggagttttataagtattatgttgtattgttgtttggtcgctcagctgtgtccaactctttgtgactccatggactgcagcatgctaggctttcctgtccttcaccatctcttggagtttgctcaaactcatgtccattgagtcagtgatgccattcaaccatctcattctctgttgcccccttctcctcttgccctcagtctttcccagcatcaaggtctttatcaaaaccctgtgtacaggagaagtgttagtatcgaga

SEQ ID NO: 35663 - DNA, 1198 bp, Bovine  19866880634335
tatttatggagaaccaagaacagcttttagctgacactgctgtctaaaacaaagttctcaactcctggttgggtgaaacttgtttggagagaaaaaatttgctacccacacctgtcgaaattgatctgttccttagaaatgtgtttaattgtcaatgagagtgggtgcacaactgtcaagctaactcgctgaagtgacaagtggatgagattggcgttctgtgccttcctggctgattttaattgttcttttggttggagtgaatacaactttctttctaaggttgataatgagagccttctattgctccttatatttccatgaaagatatatctacatttttaaagtccattacatatacatctgtggtttctctcttatttttctaaatgtaattatccagctaggctaaattatggaaaaaaaattataaaaatcttttcctgccaacagtctgaatctggccagcacattcttggtggtttgaatgttgggtatagtttctttctctctattatttcttctttccccactcctgcctccagaacccttttaaactccaagaggctttttagtgaactgacatttcttaaggtggttccttgagcagagcactattgccaagtggtctgtttgttcatacattgtaaggataggtatattttaactttcgtattaattttgaggtattgttatacagaaagcaaaaatacacatggtagcttttatatatatgagttatacacagagtgaattcatgtgtaaaatcataactgggatttggaatgtggtattaactagctgatgtaatacataatcaaactatttttagcatgaataaaaataattgcaacaattcttaagaaggttggcataagctaaaggggatttaggtagaaccatatcaattaaagaataacagactctaaattatttttagttattcatttttgcttggtcactgagcctgtatagtactgttcttactcatcgaccatgggtaggaagctagccttcttggagagtaaactgacagtgattagtaaacttaacagtatcatcaccttacgcctcagaagattcactcatgactggacacccctgaaactcttgcaaacatccacaagagataagggcaaggatgcttcctgttcgttagctgtggtagcaagattggaagtaatctgcatctccatca

SEQ ID NO: 35664 - DNA, 1148 bp, Bovine  19866880668690
aaaagatctgaaattctttgaaggcacattttttgttttgttttatatggaaaagaatgtagatactgaattaagaaattagtaagtactaatcagtgtgcattcaagatttttttaaacaaacataagactaaaaactcaagcagttggatttaatataaataatagaaatatgaataatggaggaaatatattccccaaactatatatatatatatatagttttcttaacaaaagaaccctttacaagtataatctttaatacgagcattcaataaacaaccgtcaattagctaatctgtagaagtgcgcaagtcatttccctcatttgactgctctttattaagcacctgcggtatgtcacacactgtgctgggcattaggaagacagtagctaataaagtcagacatcttcccagtctttccagaggtttgtaatatcatgtagaagccagacatcagtcagctattcataccagtaaatataaaattacaacagcgatgagtgctacaaactagaggtagatggtgctagtagagcattgtttttcttaaacaagaattctgtttccatctgcatagtagccaaattcaacttttttgaaaagctcaaaccaaagaactaaaatcaacattttataggcacaacatgactcaaccaactctgaagtatttggtcaaaaaggtgcctgattcaatttaaatatatttattcagcatctatgctgtatagagcagtgcttctcaaactttaatatgcatggaaattacttgaggggaattgtccaaacacagattctgagcctgtaggtccagtcttaggtgaggcctaagactctgcatttctaacaagccacccggtaatgctgataattccagtctgttgatcagaccctgagtagctccagttcaggccaagattctgaactagcatgactgctggatcctcacttctacagccattccgttctccagggcatcttctccacccagggactgaacctgggtctcctgccttacaggcagattctttactgtctgagccatcagggaaatcctcctcaactccattgccccttccctaccaactccacaagaacagaagagtaaagagaacattgtaagaagcttcgagtttactcgactgt

SEQ ID NO: 35665 - DNA, 1476 bp, Bovine  19866880669642
atttgtacacttattttatgggaacatatctggtttgtcatactagctgataactgctaatgttcagtaagaggaaattttacttgggtaaccctgttctctgcattttattagtcaaaattttaatattttaaagagaataaagatttgctccattgtaaaaaggttccatatggccctatgaattagttctaataaaatgatgaatgattcttcactccattagcaaatgatcattaattttaatttatatgtctgacatctgttcctgatctttatcctttcaagtgtaattaaaataattgtaaatatgcaagccatcactgaaagttacaggtgattgcattgtactgggtctattctccagccagtgaggctgtatttcctcgagggtggggtccatcgcagctgggcactcagtcaatatgggggaaatggtaagtgttataagggaacagagatgatggtactctgtgtgagaggcaactgtttaaagagatggcttgaaaatagatttctttcggatataaccatgaagcagttctccaaaggataattctatgtctgtggcctttttcttttggggccatgtctaagttctggccatccatccagaaaatggtagcatttcatggagtaggaaaagtcctccttctcactctttccccccaaaaagtctaatcaaatattcttgagattttctcagaaataatatttctcacaattagaagggttatacattaacatgtgtatggcagaggagatatttgaattttcactaaagtgtgaatgactgacatgaggtaatttcctgaaaaggagttttgatatggatagtgtcctgactacctagagtaagaaaaagcactccccaaagggaggcttaacaatactctgttgcttgagcatttccagaactctcaggtttcataccttactgtgtccttccaaaatctggtgcagatagtgtgtggaagaggttagctctagggtcagaaatttgtgctaagggtgtccctaggctcagttctaggatgattcttgagaaatccatggaagatgaccttccccatgactgctgaagttcctggtccctagcgcactggagaaaactggcctccataaactgagtcagcaatactgcaaagccactcccttattaaacctctcatatctctttctgggagaaaacagcctttattgtggataaaataaaaattttaatacatttgggaaaaactatacaagtgaagtgttttccatatacctgggtttaaattgttacagggaaattttattgtcataggtcccatgatctcagaaaccaggtttttatccggaggctattctgcttttaaaaccacatcaaatcggtggaacatatgagctgatgacaattctggttttcagatccatggagttcatgaagccgatttctgctcttgatagagattcagccatgatgttgttggagtt

SEQ ID NO: 35666 - DNA, 805 bp, Bovine  19866880724377
tgtttttgcctggagaatcccagggacaggggagcctggtgggctgccgtctctggggtagcacagagttggacacgactgaagcaacttagcagcagcagcaggatcagtagtaaagaacatgcctgccaacgcaggagacaataagagattcaggtttaatccccaagtctggaagatcccctggagaaggacatggcaacccactccagtattcttgcctggagaattccatggacagagaaggctggtgggctacagtctgtagggtcacaaagtgtcagatatggctgaagtgacttagcatgcacacacagtcactttctgtgaattaagaaaagatccctgattgttttgatagtcctatgctaggatgtatggtttggtagcagaacacaggccatattcagcctcagttcattttggtggttgcctttatgcagtgaataacctgtacaaccatatgtggtaggcttggctttagctcctttcagcagattctgagaaagacagtaatccttttatggtccagcttctcttcacaagagaagacaggatttttaaaagctatgtcatccattcttgggaaagtatgctgtacaaagatttccaatatatgaattcccaagaaaattactaagaagcattatgctcttacaatctgagaatatcctcacttatctgcaatatttcaaatcaatagtatcgttatttataagcaattcccactgttcttaatgagtttaatgaataaagaatgagcataataagtgagcttaacttcaccaagaaatcatttcttata

SEQ ID NO: 35667 - DNA, 1067 bp, Bovine  19866880734567
ggtgcctatgtagtaagataaacatcctggaacagcagggcagctaaattcatgcttcttcattggagttggaacaccagaatatttgaaactccacctctgactggcaaaatcacttttatttctgcctttaatagacacataactaaaggcaagggctaatgggatgtcaaagcagtcacggccccttaattgatttgaaggtgcttgcataactattcaaggcaaaatgatgttctcactgatgggagatatggaatgtacaatttgcatttcataagaaaaaaaaatccttggtttcctctacaaagcactaatgttttcaatactgctgactgtggtattttgagaaatagccagtatgccctctgcacagttagacagtaagaggaaatattgcctccccaggtgtcaaatttcctttctctaatggaaggatgtgtgggacagcatttcaaacatagtcacagagggaaaaggaggctgacaagtaagatggatgaatgagagggaaaacatgtgttgagatggaagctgtcaagggtagatcctgtttgtgcatcagaagtgtcctaattaaaaatgcccatcataaaagcctttggggaggaaagaggaaaaaaaggaagccctcttctgtgcaacacaagagatttcatagaagagccaagcctctggagctctagtgaactgcagtattcacatcagtggctgtattctgtcatctaggatattaactatttctataactcaactcaaaaaatctgcatcttcttccagaatgcctctgttttgaaagaatatcacagattcacctgaaatacagaagttggagacaacggggtgtcactatgcaatttggggctcagcttttccaaattctcatcagtaatgatttccttctttcccataactggcgtcctaagccttctaatgtttacagtgacattagtcaattccttatatgcactaagccaaattaaataaaggactgcagggaaatttatctatagaacatgaatctttaatgagccttcatccctataactcttatagtagaaagaaat

SEQ ID NO: 35668 - DNA, 878 bp, Bovine  19866880742666
ccctctttatacagatctaactggctcaacttccattcactgatgtaaagtagcattagtacacattacttttaatactgcttccctcaaatattgatttttaattttttttgtcaaacagaacatatgctctcattttatactgtcagggtatacacacacacacacacacacacacacacacacgcatgcacgccctagctgagagtcatcacatgtgtgcatgttcagttgtgcccaactctttatgaccccaaggactgttgcccgccaggctcctctgtccgtgatatttcccaggcaagaatactggagtgggttgccatttcctcctccagaagatcttccagattcagagatcaaacccgagtctcctgtgtttcctgctggttaggcagattctttaccactgagccacctgggaagcctattgaattgtacctcaagttaaccagattaatttagaagtagctttaagagtcataacactttatttaatttcctaataatgtaggagccataatgcatgaacatcaatattatttaatttattcttgtttcaaggcttaaatataggaggatagaaatgacgtttgtagagaagatcccatgttatcacttagaatcaaacgaactaaataacatgactgagaaagcaaaggagcccagggcatctcctggcctcagcaggagataagaaactgatacatgttgaatatttgctatatgtctggcactgttctatatattttaaagatattttctcatagagtcctcaaaacactatcaccaagtagggtgatttcaaagacaaagaagataggtaaagagaagtaccttgcacaaagtcacagagatactaagtagcagagttgact

SEQ ID NO: 35669 - DNA, 2624 bp, Bovine  19866880756036
cctgactcagggatcgaactcaagtctcctgtgctatataggcagattctttactgtctgagccatcagggaagaccaacatttaagtggtagcttacaaacagcaaccatttatttttctagctcacaattctgtatgttggcaatttgagttgggttcagtggggtggcttggctgatcaaaacatggggattggccggtcttgactggggatcaagtcatgtgcctgctgttagcagctgattagcttaggggctggctgaccatcagtggtgtcttatcctacttcctgtggtctctcatctttcagcagagcagcctgggcaagagggtgagcccctgtggacatgtacttctcaagcttctgcttggggcatactggctaacattgagttggccaaaggaaaccccaatgccagtctgatccaaggggtagagaagcagactctacctcttgatgggaatcgctgcaaggatgcactctgtagggacatggcaacagggagggaaagaatttgtggccagttttataatcaaccacccttccaacgtcagtcacgtgctgtacaatgctttcaactttgcaatgttcacctaccatcctttttaattttctttaccttggtttaaacaaaatgcctgttttagcctcctcctatgtgatcttatccttgaaatcgcaatatgttggttattgttatgggttgaattgtgtctctccaaaattcatgaactacagtcctaacccccagccccttagaagatggggttatttaggaataacgccactgtggatgccattagctaagatgaggtgatactggggtagagtcggccactaatccagtatgacttttgcccttagaagaaggtggccatgtgaagatggggagactaggagaacaccatggggtgtcaagggcagctgcaaaccaagggtgctaaagattgccagctaataccagaaggtaggaagaagcaaaggcttcctattggcctgtgggggatcacggccctactgttaccatttcgaatttctagtgtccagaagtgtgagacaatacattttgttattttaaaccagctaatttgtggtattttgctatggtagcctgaggaaactaacacatttatttttttaaaataagataatagcttaaatcatatgaaatttcaacctttgtatttttcagatacaaaatggttgagtaacagcaatttcacattaaataaatacctgactactgaaaaaacttgtgggctacctaaaattatgtgtatgcaatctttggtacattgctacactatggaagatgtcaatttaaagttgtctgttaaaaaataaggcatttcaatttcggtggaaaggtcaggctcagttaatgcttctccctcagaaatcatctttcttgcttctacatccttgcagaggcattagaataaaaagctgtataattaatttgcaaattttctaaaaaagtttttagtactgaacttgattttaaaaaaatcattaattagtctctgacctcgggatcataaaaaatcaaggagtggattttctaggccagacaaaatgtgccttttggcttctaaataagatatgtggattgcatcaaatttccttcatcgagacagtccagattagcttgtaactatttcagtagaattgaatttcagttacttttgcatggaaatcaaataataaaaaagtcatgaaatctaaaatttctgagtcttgcgaataccagctaattaagagactttatctgtcatgattattttgagcaactgattatttccatcaatcaaccaagcaactctgataagccaatcattttttaatcgatgttgagccactgaaaaagttaccatagataccaaattctacagccatcacaacacaaagtcaggttagaattggaagtgacaggtgtattcatcacatagttaaccagcctttgaagggaaagagagagtttgtcagagtccttaggctgggtataaaagattgcagagaacactcaaacaattcccaaagagcacttcaaaagcaggagaaagggtccgtttttcattacaaatgcaggaagatgtttgcttgaaattcaagctctaagtaacaagttccttgaagttttgcttgcctgtcatttaccaggggtcaccagtaagttatctttagagcagagcttccgtttttttcttttttctgcatcagaagtaataaggatggttgagagcatggggcaatgattactgtaaaaagcagtcctgattgcactgtttatacatgtagaaatgtgaatatatatgtgtttacatatacatgtatatatatttacctgtggtcaatgctgtcagaataaaagcatagaaacaaaaaatatattttgagatccattggacataagccagtgtctgtttcaagtaagaatattgcatgctcagagcttcagagaataaatggggagaaaaagagagtttggagtgaaatatatgaatatatttcaaaggtataacacataccttccagttttttggggggtagctgaggcaaacccaggtccatgtccagtgagctgtcctcctcatacataccagcacttggactgcgtggagg

SEQ ID NO: 35670 - DNA, 1323 bp, Bovine  19866880758816
aaacggtaacccacttcagtattcttgcttggaaaattccatggacagaggagtctggcaggctatagtccatggttgcaaagagtcagacgtgactgaaaatgtgcacgcatgcgcgtacacacacacacacacacacacaggttggaagaatatgcattttagatcacatggaatctttctggttttgtaaagaataagtcctacttctcaaacagtgtattggctcatacttgagtatatattcttgcttttttttttattcttgcttttttaaaaaatatatttgccagatctatttagtaatgctaaaatccacagtccataatggctaattggttacacacttctggtcagcatctgcatgataggagtttggataacactgaagtgtttaaacagacacatgtgaggcacacaagactccacatcttggggtttcctggggtgcacactcagaacaggatgggtattaggtctcacagagggctaccaggatctgagaagaccccaagccgatttctggaagctgctgcagtattcatgggctgcagaacaataaaatagtgattctgttgttagttccagtaattgactttgcagcatcagaggcaaagcaccccctgcagaggacatcaataactcagttcctgtaggggaattcttgctgacgcctgggtggatccgtgacctttgacagatggagcagtatttgaatataccaaatcagggaaatgaaaacaataaaagaaaggcaatttgctaaatgaaatctacatgaactaaacttcctgcaaccattcatcagaacttatgagggtcacacaggtttttaaccaccaccacacctccaaaagatccagtaatttcctatttcaaaaaaacaaaagcttacttcttgaaaatatgtactagaaagagtacatagaaatgtacttggtcctcacccatttcaacatttcaggtctttgttctgctttaagatgtgcatgtgtgtttatgtatatttattatcttatacccattgcaatatctatctgtttaaaaaaagcaaaactaaatttcttttcctctcaggaaaattttccataaaaccttttttgcacagaattttagtggaaagaacaaatcatgcaattatggaccagctagattttcttaggattttcttagattttcttaggattcagtttccattatcattatttgtacctcaaaaggaaccctgagatgcatcctctctccacagtccccaatgatgggaacactgaactttgtgaaaattgccagagttgaaggagctcagagggtttatgtggggct

SEQ ID NO: 35671 - DNA, 948 bp, Bovine  19866880758817
atgtggagtcttgtgtgcctcacatgtgtctgtttaaacacttcagtgttatccaaactcctatcatgcagatgctgaccagaagtgtgtaaccaattagccattatggactgtggattttagcattactaaatagatctggcaaatatattttttaaaaaagcaagaataaaaaaaaaagcaagaatatatactcaagtatgagccaatacactgtttgagaagtaggacttattctttacaaaaccagaaagattccatgtgatctaaaatgcatattcttccaacctgtgtgtgtgtgtgtgtgtgtgtacgcgcatgcgtgcacattttcagtcacgtctgactctttgcaaccatggactatagcctgccagactcctctgtccatggaattttccaagcaagaatactgaagtgggttaccgtttctttctccacggggatcttcccaacccaggaatggaacctgcatctcttgcatctcctgcattgacaggcaggctctttattatttttatacttttgatatcttttaaggagtaaatgatagttcccctgattcacacatacatgattgagaaattgaataaggcatatcacctaatggcttaattccatctttaataaaagtaacaataaaacagaccaacatttgttattttaaacacaaatcagttttgttaaagataaaataccatctggagcaaggtttcataaaattatacagttggaaaatacttgagatattactatgtctgacctagcttaaaaatctcccctagtaatgacctctgaagacctgtacataaaaaggagcagccttgtggaagttctgaattctaggagttggttccaaagctatccagtgtcacctgctcctaagtctctgtcttttttcctcccaagtcaataccttttacttgttttcggctcattttcctagag

SEQ ID NO: 35672 - DNA, 1807 bp, Bovine  19866880771050
atatgactgaccactcagagtccagcccaccttaagtcatcgccatgttccttgtcccagaaccaacctcaggtctttacccccaagatgagtgtgagaagccctgtttctatagcccttacttcctctcccagactcttggctatgtaaatacttattgactacctttgctgctccaagtccaagatgcaaatgaacaagaaatagttcctgacctcaaggagctcagcatccaatgggagaaatgtgtaaacaaataattacaaagctgtgtgatattatgttacagaagaggaatagatgactcccgggactgggaagaaaatgatcagggatgagagaactcctgatctaaattggggaaaaggaggaggaactttccaagtagacaaggagggggaagacatccaagcagaggagtcaatgagcaaaggcctgatacagagagctgcacctggggagatccagaagggaagcactgaaagatgagctcaaaggtaagagaaagagaggccacgtgagccttcaccgtctggttaggagtctggtctctattctgtaagcagtggaaccactgctgacttacaggggagggctacaagcaaatttgcattttagaaatatcatccttgcaatatgaatgacgaacatggggacaagagaagcagaccaaggaggaagttatcagggtgattcaggtgagaaacaagagactaaaccagaacaacggcttggggaacacaggtgggagaatgcctttgacattgttaagagctggttagtttttagagtgcagctagacaatttggacaacttaccaagtatataggccttcccaggtggcacaatggtaaagaatttgcctgccaaagaggcagaatggatgcaagagattgatccctgggtcaggaagatccctggagaaggaaacaccaacacacttcagtattcttgcttagaaaatcccagggacagaggatcctggcgggctaccttccacagggttgcaaagagtcgacatgacagagcagctgaacatgcacacgcatgcatgcatcaagtatactacaggttaaccaatgttttgcaattagggttagaggcctaactctgtagtaaccctgtgtccatgggaaagtacacagccttctaaacaatttccttacaaatgaacgtttggacccagcccattctcagagaacgtactgtttgcacacatctggttcctgtcctctatgccaacaaaacacatatttcttccaacaaacacttttgtttattggtatcacgattagcacatcttaatgttgtgaaacacagctggattttcaattttgttttttagcaaatgtaattttattaattgatttatttctgattgctctaattaaaaaaaaaaaacgaaataaaatccttcctaatcacctttgacagattgtaaaccatgagaagtgaccataagaagagaaggcagtggtgggaagttgccctgatgggaagcaaagagaagaaggaagtcaaccatttctcccattagatttaaacttttgggatagggaggaaggaaagacatcctaagatgcaactcaaaagggaaaatgcttagagtataagctctgtgagcataaagaccctgcttatggtggttggtgatggacagggaggcctggcatgctgcggttcacagggtcgcaaagagtcagacacgactgagcgactgaactgcctaactggctaccactgtaccctccagtgcttagtatgttgtaggtatgccacaaatatttgctgggagggagggaaggag

SEQ ID NO: 35673 - DNA, 827 bp, Bovine  19866880771136
gtggtcagggcagagtgccagcagtgtccatcacactgacctgatggatcaccgtgttgcagcagtgatcaaaacctcgggctgatggcatcagtttagaatttcagaaattagtgtttagagttcttttaatatctgtacttacctaaagctccctaattcaactatgtaaataaactttaaatggttactgaactcatctattgttcctggaaaatcatcatgagccaaaaagtttagttaagtttagttggctctgtagtacatataactgcacgtgatttcatctgtcaagccagtatttgtccaactatatcctgaactaaccttgatgttacattgtctttgtactttgggactatttcttggtgatagagcaataaactgacagccccatcacgcttccatggatgcacacatgtcaacagggcagctctggtcagactggcttcaacagtcttcacgttaccataaactcagctttttcatggcatagggagcccaagaacctagtaaaatgcaagctcaatctgtgtaaacaataaaccctccctgtgaaatctgatgtcctagaaaaaggacttcagataataaaaacaaatggtggaatgagatcctcaccacataccatcctcacccacgtggggctgtgtgggctggcagcttggggcaattgcaacatagggtgaggccaagtgggaggatcacagcaagtaaattgcaaacaaactcttctgggaattgtctgtgcaaattcacaagctgaattatcactgaatgggcattttcaacattcataaatggattggcctgctgcgactgggtgc

SEQ ID NO: 35674 - DNA, 1420 bp, Bovine  19866880773944
tcctggtgcatgataaaggctcaatgcctacttgttgaataagtggacagatggacaaatgcactggcatatttgtctccagctgtccatcaacccaaatacaagattcattcttgagttataaactataagttttaggagaaacttttaaaccttgatggaggaaacatcccttttgctttctttattctccacatcccaacaaaatggagttttactggaatctcatcacaatgtaaatgcaggcccctgattgtcctggttgaattatggatcttccagttagacttagattgctgttatttttgacaggttgaaaatatttttaaaatagtcctttcttcagtgtcttagtgcctattctagatgagaaaagggaaaacattgaaactttgagtaccattcctcactgtaatctcaaaacaaaggattcacgtctttattttttaatgtgaattgaatttccctgcaactccaccccaaatcacagaatggagagaactgacattgaacaaactgatgctttcaggtgtaacctctgaactggaaaatctgtattagtttctcagggctgtcataaaaaagtatcacaatctgttgttgttcaattgctaagtggtgcctgactttttgtgatcccacggactgcaggcttccctgtccttcactgcatcccagagtttgttcaaattcatgtccattgagtcggtgatgccatccaaccatctcatcatttgttgccacctttttctcctgtcctcaatctttcccagcatcagggtcttttccagtgaggcggctctttgcatcaagtggccaaaggattggagcttcaacttcagcatcaatctgggtggcttaaaactacagaaatgtattctgtcacagtactggagtcttgcagtctgcaatcaaggtgtcagcagtggttggttccttctggtggtgctggaagaatctgtttcatgcctctctccgggcttctgggggctgcgcgctgcacttggtgttccctgacttgtagtgtctcactccagtctctgcttatcttcccctggccttcttctctctgtgtctgtatgtccacgtctcaaatctcttcctttctcttagaaggacatcagtcattggatttggtgtctctctgtgtgtgtgtgcacgcacatgcacactcagtcatgtctgactctttgtgaccctgtgggagcccatcttaaatccaggatgatctcttcctgaacccttaactacatctgcaaagactctgtttctaaataaggtcacattcacaagtaccaagggttagaactttgacgtatctttttgggggacacagactggatggtgagatccagagaggcaacatgacttgcccaagacatacagctatttatcgataaatcagaactacaactcagac

SEQ ID NO: 35675 - DNA, 1864 bp, Bovine  19866880775601
ccaaagagaaaggttataaaaaagagaatcagtgctaggaatgagaggaagcactggagtctaggaggttctaggatcaggaaaaggagtagggcatgcacaatgtctcaaagggtccaagagcctgagagtgagagcctccaagagccacagggcagggaagcccaggagaaggattggcaggctgaactgggcaactgtagagggattgggtataaatagtggagggggtgaggtgacacagactccttggagacccagaatgtgtcctgaacctatagaagggctcttcctcctgcccactctgcaattgttcagcccagagtttggaggtggaaagagagggaccatctggcttccatgcctgcctactacccagccattctagggggaggtgtaaaggctgcagagcataagtcctgccctgtttctgcccaacctggaactcagacctccaagcttcctttgcacttcatccagccacctgtaatgctctgcctggaggctttccctggatgctcagccaataaacctcacttccctatctgaagttctgtacttcttgctatagagtcactgggcacctactccactagaccatctggcactttggtgcaaattagaaaaagttgtgccttcctctaggcaaagcagccttgcaccaagctctagagtttggcaagtggagcatggactggatttcagcccccacttgcctatccaaccaaactccctcgtgtcctggacaaccatccacagcagcactgattactggagcctgcctgtatatatatctccatgtatgtgatcaccatttagctccctctaatatatatcgcaggtatgaatatgccagaagtctctccctcattagacattatgccccatggtaagggaccatgttaactcacccttctaaatgtttttggtgcctacctagaatagtgacccaaacacatcttcaccacaatagctattatttattgagtgtttattattttcacaacaacctcgtgtgagacaaatatcattgtttccactgttcatatgagaaaactgaggcttagaacggttaatgtgcccaaggcattgtaattagtaaagtgcagaaccaggttcaaatccaagcacacctaaatcaaaacctgtgttctctaggatctagagtctaaatgatctacaaacatgtacgggatgaaaaaagagaaaagacagatagttcatggtaaagttccaaagaaggtttgaggtgcctcagaaaaataacttggggaaacagggggggcccaagtaaggaatgatggggtcttaccgaagaagcagtagacgactccaaacagacagcacatgatgcagacgagcgctggaagtgcctcgtacctgcgctccaggggctgttcacagggtgctccccagaaggcatcatctggctccgggggcagcaactggaaccgaagtgttgccacagtgcccggcatagtgctgggaacagaagggagtcaccctcccacgtcagcctgacagagaggaagttgggggtcaaggaggagtcctgggtctccaccaggatgagggtgagatgggagtggagaactaggcaaagatacagtggacaaagggagtggtgcccacattacacagctctggaagcatccctgaagtaagggacaaaagacaaaagaggggaaaagtgcctggctagagggagctgggatgaagaagttaaaagggggactaagttggggggagaatgaaggccagcgtgctgcccggtgaggagacagccaggagactggtctgtgggcggttaaatctgggattatccaagatctacctgggcttggaggcgacctgagcttctgag

SEQ ID NO: 35676 - DNA, 1642 bp, Bovine  19866880815670
agctcagtcaacagaaaagggaaaaaattaaatgtttccttccacctgcccctctatgaacatcaggcactgcccactgcacagttttcatctctataaaatcactcctttctgtaattctactacaggagaaatatgtgcacagtttatttctagatgtcatgattattttcagcttttttttttcttttcaaagaattctattcaatttgaaatctgtttacttataccagagagtacgtgcatgctcagtcgctcagtcatgtccaattctttgtgaccctatggactgtagcatgccaggctcctctgtccatgggattttccaggcaagaatattggaatgggttgccatttcctcctccatgggatcttcctcacccagatgtcatgattgttttcatcttttattccctttttgtaagaagtctatttgatttgaaatctgtttatttataccacagagtactgtttagtaataaagaggctggaaagtatcacttatttaatgcataatgtaatggtgttttactggggaaaaaatcaacgttaaggaaggaaaagcataaatatagatggagggttaggagaggtggatgaagaaagatgaaatgcgggggggggggggggagagacaagacttgagaaagagtaaaataagagaaaagtgagcaaaagaaggagaaagggagcaaagacagaaaatgaacttgttgggcagcagcccgagacctggtaccaaccatacatccaggaggagaggaagggagacagccatccaagaacaaagtacagaggacaccagatttatgaacagaactttgttatttggtctgaattcatcacccagatcctcaaacaaacccatatttatatgcaagtatggcaaatgcacatggagtatttagcattaacaatgtcattcaaaaggaaaacctctagctttcctgaacctgcatttgcatttattattttataaccgaagttctggcagatttcattcatcctcatgatgaccctgggagaaatatgaaactcttaccattgttcacattttctgttctcacgctagaacttatggaaaataagaggccttattcaataaatgtgaccccagatgtagagtgtatcactttaaccacaagataaccctgtttatcagagtatggtgagggaaaaattgggtgtatctctttgtttaaaacactgattttacattaagcttctcatctgcttcctaagatttctccacagcgctaagcagcacagcaggacaggtgacttcctgatctttacacctaggatcacctggtctactctaaggaaaaataaattctgccatgatagtgctccaaccctgaaacacagggacctggagctaagaatgtggcttcatggggtgaagtcaagataaagtggtgaagaggtgaagagtggttctctcaaggtaaagatctggtgaagaggtgcagagtgtgctaagccccagtgccactctttcaacaaacaggatctaattaaggagacttcgtccacctcttcatctatttcctaagactgttgtgcctactgctattaacttctgctgaaatctgggggctaacattggactttattgctatgcattaaaacagaatttgta

SEQ ID NO: 35677 - DNA, 1073 bp, Bovine  19866880860953
cttggagaaggaaatagcagcccactccagtgttcttgcctggagaatcccagggatggcagagcctggtgggctgccgtctatggggttgcacagagttggacacaactgaagcaacttagcagcagcagcagtttgttacttctggctctaggaagataagaagaaaacatgatctgaaaaatgagttttcagggagttttagcaaaactggaaccactactgaccctgtgatatagtggcttgccctctacaatgcttataaaggtgtctaacgatgcccaccaacccaaaacatgaccttcaggtagtcagagaactgaaacagaatcttgttcctaattaggtcagaaatcctgagatcctccctttgtctgatatttccagctacattcaagatatttttagttgcttaagagtgttaagcatggtttaggattccttagagggaactgaatatccatatgacacttttcatggccattaaagtcaagtcgaaaggtggattctcaatctgggaagggagatgccctctcagaatttcaatcttggtggaaggggcagcatgaagatgtccctacctgttgaagtttttggtatgtcttttgtaggatggaatcaagaaccctgggatttccttttattgttgagaatcacacttgtgggtctgaggtcttgggagagatagaaaatctcactgagttcatctgttcagactgggacaatcaagggttgctggccacagaaatgtccttatagatgggtggcagtcaatttcaacaaatggaaaattcatgttgagtcaactgactgtcttcatgtaggcctcagtgggagtctaactgagcatgatgtggccttttgatcatccagcagctgaccaaaccaattgagtttttgcaactgcagcttttcattaggcatcataaagacacaacctaaataaagcattagcctctagaatgtgtttaaattgaatttctggatactttggcatgtgtccagttttaaatatgttctgatctaactgtatctaatctcaatcaaaggatcctagtataggaacattcccg

SEQ ID NO: 35678 - DNA, 3404 bp, Bovine  19866880867780
ttctttgccccagtaaaattacataaatgctctagtgtgcatgtggtttatatttaaggtgtaatgagctgttcaaatagagaagggcaggcaaccatattaaaaataaacatcaaattttaacaaagacacatccacttagtttgcaaatagtcctaatggtttcagtatactgcaactagtccagcctacaacatctttggttgaaaccaatttccagtttcagagtcttccagttaaattgtgatcacattgtcagagaaagaacagtctgtgatgagaggatagaaataagagtaaaatagggtagcagggataggagtacttaagactgtctaaccaaggctagtggatcaaaagtcagcctcaatctatgcgtgatgtgcatcgtagtggtatcttcctgactggtcctgggcacctccctctgcgttttgacaccaacttcttacacagtactatttataaaaccttaggggaaacaataagtcactcctctctgcttattttaggtttaaaacacatgcaggatagatttcaagtgcttaaagcacacgcatacacacacacacacacacacacacacacccctcatattcatcatcttctctatttataatggcaaatctgccctgatatttgcctcaataagtggtctttgtaaccagggaactaaccttgattctcagcccaaagaaatgctgggattctgtctttgaaaagatcaaaagtgagatctatggttccaataaaaccctatgttctagtttatagtttataaaccataaaatgttaactctccttggagtcttccaagtttcaaccgaaaaaatgccaaccgatcttgaaataaaacagctaatctcggagttttacattgctgagggttgacaacttcatctctctttttgcttgctagagactaggagttggaaagcagttatatcacccacttggacttgacttacaaataagtagccaaagatattttgagtggcaggtttccaagtttgcagaaacaagatgatgaacctaaacaaaacaaaacctagttggagctatacactctaggtcatctaacaccagtcagtgcattaactagattttcaaattcgttgatgatgccaatatttctgtcagtatgatcattaaggtaagccctgtttcctataatatcaaaatgacttcaaatcctgtctttggttcttatgtttcttgtagatttttctttccaaaaatcagatggtacttttcacctacccatcgagtgaaactttccctaactatctgaaacatctctggtttccaaaaactacaatgaaaaacttgtaaaaacatttcaagaaaaagataacatggaaacatgggctaaagtttagtctgtcacaaagatgaatttcacatctggaatttgcttggacccactttctgcaggctaggacatggagggattttgcagaaaaataaagttgactatcctagggttatttcatggcatatctgactctctgatgtcttgaaagtggttgcagtatctcagaaaggaaattccactatttaccctctgacaaggaggaatcacaaacttctaagctttttgcattttacaaagagttggaggcagtgggggctttataaggcatttggctgaatgagttgagtccttaggcagataattagaaaaaaatctgaaagaggtcagtttaacgtagaggtgggaaaaatataaaaataagaatctctcttagaaattttacagttttattggaaaacatttgagaatgggagaaaactacatggctatctattattaggaagaagaaaaaatgtttcatcctctggctaataattaaaattgccttgttgcttgttctgttagatgtctttttttcattgttaaagtaatacgtaccttaaaaattccaaagatatagaagtgtatggagttaatgatagtttttcttttgtcctctacttttcacttttaaccattacctctttccctcattttaataatggtcaaaatcaaagaaagtacatattgcgtaaacttgctactcaaagccttgtccacaaaccagcagcattgacatcctaagaactaggtagaaatgcagaattttagatcatattttggacttattgaatcagaatctgcattttaataaggtccctagtgatttgtatgtctatgtattaaagttagcatgcattgtcctacaaccctgaactctcacttgttggaatctattatacagaaatacaatacatacataaagctacaaatatatatatacacaaacacaaatatacatatgtgtgtgtatatatatatatatatatatatatgtataggcttccctgtggctcagcagtgaagaatctgcctgcaatgcaggacacacagattcgatcgctgggtcaagaagatcctctggaggagggcatgacaactcattccagtattcttgctgggaaaatcccatggagagaggagtcaggcagtctacagtccatggggtcacacagagttggacatgactgaagcaactgaacacacacacaaaaacatatgtgtatatgcttggattatatattataatatttatatttgggcttcccttgtggctcagctggtaaaggatttgcctgcagtgtgggagacctgggttgaatccctggattgggaagatcccctggaaaagggaaaggctacccactccactccagtattctgccatagagaattccatggattgtacagtccatgaggtcacaaagagtcggacacaactgagcaactttcactcactcactcatatttatatttaaagtgaacaaaatattatatagccatttgtaagagcaaaaaattagaaacaaccaaaatatccattattagggaacaatcaatcatagtgcagtcttaaggttgaacacaacacagagtgacgtctttcttcgagcctcaccgatgctcacctgagatccacctgatgctttggggcatttcatttcatagccaaaaagccccaaaacatgttttactaaatggatgaagataaacagataggtgagttatatctttcagatatagaatcatccagagtcaagttttccaattactttttccaaattgtatattgtacaactatatataataattttgaggttatataacatatatgatatattaagtaatgagttaacaatgctaaactggcacttagcatttagcatttataggaaatttggtatctctcctgggtctctaaattcctctcctcatccaatctcagccccttagttgatcaagcaccatgggatttgcttagatcaaaaggagtcagatctactctcaaatgacaaattgaggaagaaccagagcgtggatcagttccctg

SEQ ID NO: 35679 - DNA, 1041 bp, Bovine  19866880872086
tgagaacacggtggccaaagttgatgaggtgaagtccactgtcaagttccagatgaagaaggtgctgtgtctggcagtgactgttggccacctgacgacgacagatgatgaggttgtgtacaacatcgtcttagctctcagcttcctggtgtccttgctcaagaaaaattggcagaatgtcagggccttgtgccttagagcacctgtactaaagcacagcttaataaaccatacttcactataaaaaaaaaaaaagaaaaacttggatgtttttggatcagttgatgctgaggttttcattctcaacaatgtcctactcacacatttttgggtttcccatcctatagcagctggtttgattcatttatttattttaaagttcaatttgtgatacagttagaagagactgtcagcaagggagagtcaaacggaaagtttatttatttttctccaaagggtaaatggtggacaagtaggggactgctggcatggggcttattggatttatttggtttattttttcctaaaatccttccctctaagaggacaaagttcttcttttctctttaagtgcaaagcccaaagtgagaaaaatttgaaatctgatttaaatttttttgatgtggaacagactaaagaaaacactgaggctgactgaattttctttaatttaaataggagagagattggaattcccacgagaggattgattgttgaaattcatatttatttttttaaaatctgtcattggggatatgctgattttgaaggataaaacagagagttaggagctccagaaatatgtgtgagactgggtcatgaaaggatgagaaagagctgaagccagtgatagccaatagccccaccaacacagtgagactggctcttgaagccacctgcaaatcccctgtctcaactgatgtgctgttaggctttatatttcctccattagaaatatttcatgatttgagtatgaattatataaaaacaaaaaagaaacattaagacccccaaccaaaaaccaattaaggaaaattcttg

SEQ ID NO: 35680 - DNA, 2549 bp, Bovine  19866880881749
ccatggtgatctctccctctttgggaactggggttggggtttgggtttttggttgtaagggccaagcttccattgagtcacctgtacattctgggtcttcttatacgtgtaaatagaggaggttgactatactctcttcattccacacccctctccctgacaggagaaaacacaatgtaatcctgacctttctagaaggatcaatcccagtaatcaagggacagcctttaaaaggtacaaaggcttctctcctgaatttttctcccaggatggagctgagaagaaccgcccccaccccagcccatattgcgttttgggggggatcatgctggggaaggattaagtttctaggaactttacctggccttctcctgtgttatcattccttgatgcaatttgtcccaacgcttcaataaagaacttcataaatacctgtccagccctgtgtcaaaattttggggagactgaatagacagagggtaaagggataggggactccttgctgatttcagtgaggagggcccatcctaactgttgaatgacctacattcaagcttagaggtggccctaggaggagctggagaaagattgccaggtggggaggagagcttctcagtgggaattccaagaggagcagtccaggtggcctacgggtcatggatctcagggtcctaagggaaaaattgcctggaaatccaggcagagccatagtgccagcctcagggtagggtgggattggaggctggacccagagtccccaaggttgctttggggaccgcaagggtttgtgaacttggccctttgtcccttcacttatttcagggactcttctctccacttgtctgccccttagttgctttctctattgcctttctccccagcatgaatagctttgtttacccctctagatcctttttccattcttccctgccctgctttgtgggcttccctgatggctcagcaattaaaaaacaaaacaaaacacaactgtccacctgcaatgcaggagacttgagttcaatacctgagttgggaagatcccctggagaaggaaacagcaagtattcactccagtattcttgcctggaaaatcccacggacagaggagcctgctgggctacagtccctggggttgcaaagagttggacacaacttagcaactaaatgacaacagccctgctctgtgccctgggaggcacaaagaccattaaaacatagaaatggaattttaaaaaaaaaacttgccaggtgaatgaacaacaccccagtgagttaatcctctgcgttgttcccagaggaagaaaagctaggtttaaaaaaagactcagtgagaaggtttcagggtggtaatggatcagaaatgagccctctcaataggtcggagccaatcagttgaaattagtcccgttattaattggtgaggaagcagacagcagtaagggttcagtaaggacccagcctccactcagcgttcatagtcggtggacgacttcagccggtcagaaccagccttgacaccacgcagattcagtgttgatctcctttggggcaaagcacccttacagggaggactctttccctccccgcttgaatggatcacccactggctctggtttgttttggccagtggagacggggctagggagcccgggggcttggaggaagatggaactgaggcctcattcctccagctcctttccttccagtaggctgggggtggctgactgcttccttggccctagacagcctctccatgcaactcccctctcctggttctgatgacgtcaggcctgagggtggcaagatcccgctgttaccagctctcaggtactgcatcatcctttgttaattttccttaaccctgccccccactttgaacataatctctttatccagtctttctcaaattactcagtttgagtgtagaatccttttcctgccaggaccttgacaggtaggttgacagatacaacctacactgcctgatttttttcctgccttcttactcacattttttacatcctcccaactttagctcgcatgcagcttgcatcgtggcactgttatctgccttaaaactttcagtgttagcttccactgcaaagggccttggtcagttaacatttctgagcaagtatcagatgggctgagagcctgttcttatgtcagggccacatcattcatgcctggcaagcctttaaatcagctcatttgttcagatactctcagttccatcggccatggctaaaggtggaaggaattctacggtacagagtgccgggtggggactgggtggggttagatgctgtgattgacacagaacttttcatacatttatgtctcctctcccttgtaggccaagagcatgtcttaactgcctgtgtatctacccaagtgtctagcctggggcttgccaggtggcactagtggtaaagaacccacctgccaaggcaggtagacgtaacagatgtaggttcaacccctggactgggaagggcatgggaatccacttcagtattcttgcctggagaatcccataaatagaggag

SEQ ID NO: 35681 - DNA, 1640 bp, Bovine  19866880910487
atgcacgatactggatgcttggggctggtgcactgggacgacccagagggatggtacggggagggtggagggtttaggatggggaacatgtgtatacctgtgtatatggattcatgttgatatatgacaaaaccaatacaatactgtaaagttaaataataaaataaaattaaaaaaaattttttttaacttgtttattttgggctgtgccgtgtctcccttgctgtgtgggctcctctgtcgtcatggctagcagaggctcctctctagttgtggtgtgcactcttctcattgcagagacttctcctgttgcagctcctggactcgagagcactggctcagtagttgtgacaggttttcccggactagggatccaacccgtgtctcctgcatcggccgacgaatccttcactgctgagccaccagggaagcctaatacataaatattttaaaaataatgcaggagataatgttcagaaggaaataattgtgaataaggcgaaggcaaaggactgatagtctgacatgtgctgtgcttaatcactcagtcatctccgactctttgcaactgcatgggctataggccaccaggctcctctgtccattggattctccaggcaagaatactggagtgggttgccatgccctcttccaggggatcttcccaatgcaaggatggaatctgtgcctcttaagtctcctgcattggcaggtgggttctttaccactagtgccacgtgggaagcccagaaagtggcagagtcagatgttaaactcagacttgtctgattccaaaggatggtagcatccatcatgctacgatgccccttatggggcactgcccctaaagccaagtggacaaatgttgggtggcagcgggccacaagaggatctgaagaactaagttatgtaagagttaaaaagaatcctaccagggaggttttttcataagtcttctccaaaggccagagctcagatttatgatgttggaatattcatgagttgccgcagtatgcagtactagagggaaaagttgcctgtgatagaaattaaccttaaggaagagctcttctgaatgaaggttcagatatggaagatgtgatcaagcaggcacacaactcatctgggaggctatggattcacgtcttaaaacgatgatgattgggaacgtggcagtatctattttcatgtatctatccatccatccattatctgctgtttgtgcaacccttattgaagcctagagagttgtaccaaaaccgaagcaaagcgaaccaaaccctcataagtggctttcagtcactctggggaaagacagatgcatgtaagaatagacaaaccacacggcaatgaggtgtccggttgagaatcaaaatgggtggtccagaggctggtgtttcctagtgaccctagaagaaggaggtcttgcaggatgtggtatggcccgtctggccatattggttgccttcagggaccattgtgaaacccgtgagactgccaggagtccagttaattctagtcttgagacaggctgagctgcaaaattggatatatagtctacccactgctgagatacagtttgggtctctgttgctctgtgtttgaaaatgagatgtcacctttaatcttaaacaccagta

SEQ ID NO: 35682 - DNA, 3162 bp, Bovine  19866880916010
tcttttctttcaaccaagtttggcaacattgcctcaactggtgattaattattcactcagtagtgtgggactctttgggaccctagactgtagcccaccaggctcctctgtccaaacaattctcctggaatgcgttgccacttccttctccagtggatcttcctgaccctggaatcgaacctgggtctcctgaactgcaggtggattctttatcatctgagccaccagggaagccccagattactgcttattttacattaagtattgtacaacagtgtcttccccaagaggttctgagaaataccctagtcagcagcaaatttttaaaacttctcttaggggagattttcatgcatggttaatctccctcatgttaggttaactcttgttagtctcccttccagccaggaatgcatccgaacttgcgtcttaattctgggggttgtactccgttcggatcccacagcccctgtgcaggcgacattccacttgcgtccgatcactaaatgaagcaattgagtcactgccacccgcagtaataacacattctgacaaaaacatgaaagatagcatatctctgccttaactcatgtgggtatcagtagaggggaagaaagtaaattcttttaaaatacagacagaatcttttatcgatggaaaactgtcatccggtctttcttatctctttgtgcaatgacagcaggatttatctttcttagaagcaagcctccaaatgaatatcatgcctgttttgccaaggtgagtagtttctcattgttgggcccgcagacatgttttacatagatgttgtagtgcacgcacgccatctgtcatcaatccccatgccctccaagacgtcctaaagctattagcattagttagcccatttctctcccaaaaaggagagtccatgtgttcaaagcctgctctgcagaccccaggtgagcaaaaattccatattgcaatctctgcatccggccatatgtgtgcttctgtagctgcttcgctaataactgatggtaagcttagctagaagcttctcctccactggatgcaagagtccagattgggatcaatgttacaaagaaatccttccatctctctagacaccagcaagtagcagtttcttcttttcacccttcagttcattaaaaaggcttttatttctctgtaaacccaactttaggttttctcctaaggattagctcctttggtaataaccgaagagtaatcagtctcaagaaaataacaacagcaaatatttaccttgtgccaagtaccattctgagtatgttacaagtatcttaactcattcaatctttgtaacagcctatgaggtactactagaattgtccccattttacagatggagagactgagctacagtggccctagaggtcccatagctagcaagcaacagaaccagtatgtgaagccaggtaaatgggttccagaacctgcaacttcaaccacacctttgtcctgttggtcaagaagtttcaagacggtgactgcatcattatgtgactcttttctaaatgtcccggaaatgttacaacctgacactaaggacaccccctcccccactccaagaaactgccaatgtgacttctctactttgctcaaagtgggaggcatcattcttcttaagtccaatgtgagaccaaatcatatgactctaatcacagggaaaacttcccccacacaggtcaagtcgcaatgtcctcacagtggagagtttttctaactaaaaaagcttggaagttctatcagttggaatctggggcattaagtcaaacaggacatttattagaaggctatcaagagatttaacagaactgaaggcagttggagacccaggctgcacgaagaacaggagttcagagatggtctctttgggacagatccatggggacacccaggctttcactgcaatctgcccttacatcgctcatgtatcaagtggtgtcttgtgggcttagcctgagtcatgtacccaagctcagggtccactagaggagcctcacaggaaattctgattcaggggattgagtggcacttgctttgaaagaccactacagctcacttgttacctatacatgctttttttccccactttttggccatgcctgatggcatgtggcgtcttacttccctgatcaggggatcgaacccatgccccctgcatagaagcagggggtcttaaccactggactgccagggaagtccctaaatgcattttttaattccatacaaaggctagctgccaccgaaagtccaagaatcttggaagagatggaagacaagaatcattttcctttctacagatcaagatgctgagataggaaaggctatgtaatgtctggggaacactctagctgagtagcatctcaggtcttctaagtcctggacttgctttccaccccacatggtcccctggagacataagtgtagacttcagttcagttcagttcattcactcagtcgtgtcagactctgagatccaatggactgcagcatgcaccatctcccagagtttgttcaatttcatgtccattgagtcagtgattacccaaccatctcatcctctgttgccctcttctcctcctgacctcagtctttcccatcatcagggtcttttccagtgagtcggctctttgcatcaggtggctaaagtattggagtttcagcttcagcatcagtccttccaatgaatatccaggactgatttcctttaggattgactggtttgatcttcctgctgtccaaggaatgctcaagagccttctccaacaccacagtttaaaagtatctattcttcagcattcagctttctttatggtccaactctcacatttatacatgactattggaaaaaccatagctttgactagatggacctttgtcaacaaagtgatatttctgctttgtaaacctgagctgagctttgttgatggtgatggatccccaggctgcaggacctgctctctcggcagaaaggcctggggatatgatcgcctgcatcttccgctctcccagctcccagtcatgtctgttttcctagagcaggactgggggagagagaggttttattagatgcagcagggagcatggctcaagaaacacttgagtgattctcagtcaggcatgaacgagtgtgca

SEQ ID NO: 35683 - DNA, 1022 bp, Bovine  19866880956887
aaatcaaccatccgttaagaaaataatacagtgatgtataaattcatatattctgccagccaactcaaattccttcaaatctaacactcatacaagaaaatcctgattgaaatgtccagaggaggctatgaattctgtcccctggcatcagacttaaaggcattcccctttacatgttttcatatggtcaccttcaaaaagaaagagtccgggagggaggaagggagggaagcagaaggaagagaggatgataacctaaagtcttgctttggcaagaaaaattcctttctgcaaacatgagagttagaacattctccctgcataacaggcatggttacataacattcctgaaacagacgaaccatgaattccaatgaaagctccattctttcagaatgccataactactagaagttaatttatggacttgcctgaagtgcagatgctctatctgggtcttctgacagccttgcaattttaaaagcaagttggatcccagcgctcttgaagatggagaggcagccgagacccaccttccctgattgtctgatcaagatcccacttgagtggagataccagcttactagttattgtgtctaatgagtaaattgttgagcctctagctttaaatgagttgtatgcagttattctctaccaatgaagggatggggtaaaagattttccaatttaacctcatgttttacacatttttagataaagcagtgaaaaacaacgtttaaaatctgattaatgagttctattttttttttttttctgttcttggcagggaggttactaaaatagtgcaccggggttctttgtgtggtttctttgccctttaacagttatttaacaaaaatactccaatctgcatttgatatctttatgctattgacattcaaactcctaggagctgtctagcccactgagactggcttttatcttttcctggtatttggagactaaaatggacaatgacagcagccccagccttactgaagctcatcaaactgtctcattca

SEQ ID NO: 35684 - DNA, 1455 bp, Bovine  19866880958687
catggggatgactctggcatgacattccctttagagaaagctccagagaaggaaatggcaacctactccagtcttcttacctgggaaatcccatgaacagaggagcctggcaggctaccctccatggggtcgcagaagtgttgcacgtgacttagctactaaatcactagagttacatggctcccctagaataaaaggtgggaatacctgggaagggtgaggggctcaaaggagggcctgcttcccgccccccccacccccaccgccacacacacacaaaccttccctcaccctccagtcagattgcttcccaaggtccctcctgggctggggctgagtctctagccctgcacactcatgcatgattctaaccaccttggatgctaattaagcaccttcccacagagaaaattcctctgttgttttaaatatttatctgtgtttccagagctacagaccttgaatttcttgctcccaggggatctataccagcctggagtttgtttgtatgtggtttcgtcgtagacatttcgttgtgggctgtccagtgatgcccaggaacaaggctactcatgcattgaggtaccatgccttatttagatgagtcatgggataattttttgagacctctgagttaatcttgagttagtacctgaaaacagaaagaatcataaagaagagagcattggtcgtgaagtcagaaaatcaagtttaatggctttgccatttctagctatatgtcttggggtgagtcacttagactgtctctatttcatccatatgcctaccagagtttatgtgaagttcaagtataatacatacataaacagtattatatatatgtatgtatatatatagtatataatatttagtgtatacatcatatagtattcattatactatattatataatattttaatattatgtacatgtatatgatatttgtgtatatatgttaaagtattatatatatcaatttgggaaaagtactgaactgcatgtgtattcgggattcttatttttgaaataatgtagttttcatatcccgttacatttagttctgttggagcatgttcccagtgatgtttgaattttaaacaagaagcactgtgatataatagctcagttgttttaaatggactgtcccgtctcctcttggggaaaatgaaagtcacaccagaaaatcatctagtatgctcctcttgtttccaactgcaatttactgtggaggcaaggaacaaagagaggtaagtcgatcagctataaaggggacggtgaccttcattcacttctactctctctctttttttgtgtgactgagggacaataataataaattctcttcccttgcctatttcaagacagagagattttaggggtgttttatgactttggcttatctcaagccaatccgctccactagtggtgatgaaaaaacccttgatgcccattag

SEQ ID NO: 35685 - DNA, 886 bp, Bovine  19866880968071
ggttctccgtctcttctttctcctccttcattctttggcttagaacatggacatggacaaggtggccagacatcttggactgtgaagatgtgggaacagtctaagtttggcagagcaacagcacacaaggtgcctgggttccctgataatatcatgagagcaaagccaccatatcaacttgaccttctttgtaagaaatatatgtgagaaataggtctttttaaaccactgttatttttttacttctgttttagacagcagaaattatgtcctaactaatgttgcttgtataatcatgaagttccaaaacttcagccttatgtaatttagaaagtatccagtccaacccttcatggtacatatgatgtatctgggacttgacctaggtcttctgactcctcccctctcacttccagcctcagaactttcccatcaaactgcattaattgatcttctccactaagcaggtaacagagattcagctatgaatgatcaaatttggtttttaaagacttttccccacctataagatgatgtgtgagtgaaacaacagtaattgcctccttctaaaaggaacaaagaattctgattcggagtctgattgtggctcagtcggtaaagaaactgcctgcaatgcaagaggcccgggtttgattcctgggtcggaaagatcccctggagaagggaatggcaacccactccagtattcttacctggagaatcccatgaacagaggagcctggccaggctatagttaatggggtcgcaagactcggacacgacttagcaactaaaccaccaagatgatgtgtgagtgaaacaaaagtaatcgtctccttataaaaggaacaaagaatttctggttctgagtctgcccacttttatt

SEQ ID NO: 35686 - DNA, 3504 bp, Bovine  19866881062517
ttgcatattgcccatgttgctctcctgctacatcagagtttcattaccgcacagagaaggtgacgcacaaaagccaaaaatatttactatctgaccctttacagaaaaagcgtgctggcacctgccctcaatcacagaggccactatgatcaagaagttggcttttctcagaggaacacgagaagccattaggggacttggagcagaggagtgacatgaccagactcacaatttagaaggatcagggcagctgctgagtaaagaataaattgtaggagtagaagcagggaaatcaattaggaggtgagaaatgaagatggtttagactggaaatgtaatcagattagaagatgtgcagagtcgtgtggtgctcatagcacagtgagctggttgcttcaccctgaccctgagcatttgggtttatgcaggagaaatggggagtagtgaggggaaaaatgggtagtttttcccagggcaggagcaaaaccacagttcctaaaggttgccatgagctaataccctctccaagtgatctcctattgttgtgtgttctgggcttgggctggagtccaggaaagactctgaatcacttctggtaccggaagccacgtgtgctgttgttactgttttattgcctgtgcctggcttccttgctaagacgaatgcaaactccaaatggcttgaggttgggggcataggtcagaggggctcagccagaggaaagacagtccttagagtgatggctgttgaccagagactcagaaagtcaaaggctagaaaaggaggtggctccaagaggagatgctcaaaaagaaggtgtgagggtcttccagtcgggccaccaaccaccaccaacaggatgagctttttcctctcgccatctgtctccctccaaacaccacacacacaggtgccccctttaaatgagacctgttttctccatcacctctttctcaatgttattttaattagtctctaccacacatgggtgtgggagaaggctcagcaagatcatggggaagcccattaggtctttctcagcaagaaagaaaataaaaaagagtatgggaatctaggatcctcgggcttgaacctcctaactgtaacttactcactgtgtgaactagagcaagttacttaacttctctgtgcctcgattctctcacctggcagataggggatgagaaagcagtcaattatacaactgatgagaaagcaattgttatgaggattgcaaatcaacatataagaagcccctgacccttatcagtagccgttaccaagactagaattatgtgatggaaagaggacgttttgtttaccaactgtgtaatcctgagaaagacaaataacctttctgagcttcatagtttccttgcctataaaatgaagagcatacaacctctatcacagaaggggggattaaattcacccaaaataaacagcagatgtaaagtatttaataaagaattggcatagagggcgcagtgcagtgatacctttattatttgcaaaaataaagttctgaagtcatgaccttcaacaagagggtaggagggagactgacaaagcaaccaaaagatttcaggcccatagcaggctaaggccaaagacgaccaaaggccaagtaagggtgcccacccagagcagagttgccacgcctgttgattccagctcaacctcagtcaggattggttccaatgggcttaggtcctggactggaccttccttcccctacaacttccagtggtgagaagttgtaatagatgatcaggattccctgggagagagaaagaagactcccattcctgtctgcccctctacctcaggcctcttcccaagaccactgacgaaggagcgcagacaagcttggggcgctgcaaggaccaacagacagtgagtgtttgtgaattgaaatccatcgtggaatctgaagacgagaaaggatctgcgcggtcagtagggattctagcagaactggacaggccactgactcacttaccctgagcctatttcttcatctgtaaaagggaataaattgttgtgagctctaactaaggcttgagaataggaaattaattaatcaagactctctccatccaatgtaccacaagtcccatctcagagccagaaaaatggaaatgaaatgggaaggaatgcagttagatagcctcccaagctcccagttggtcccagagtcagtacagcaacccacactcctgactcccaactgtaggcctcagaccttgctgcccactctgtcccggtgcttattagagtgacaggctatgtgcatctcaaagcaagtcactgtgtgatcctggggaataggacttgtctggacctctctggggaccctggactgaaccagcatctcctgaagaagtggtttcattggacctgatgtacactctaaggagatatgggagaagattgcatatggtgcttagagatacagaataaagagtgacacaggactgatgagcaagctcaggctgcatgactctggtcctcatccccaactccctgcaaatctctgaaccctagatggactctggagctaccagagtctattgagctcttctctccttacaggatgtatctaaggcactctccacaaagtttacagagcaaatatgggggctccataaatttcaacttgttaaatgagtgaagaaatgaatgaagaaataaatactgaagttccaaaaaataaataaatactaaagttccaaatcttgatggctgattcctatataccttgactaatgcccatctcacaaaaatgacactttgttatccaattgctagtctaaaggccgagggcctttgggttcaacccaacctgtgcccttctccacaaaatgacagtggcaatggcttctcagtttattccacaagataactgagagaatcaagtcagaatggacatgaacatgctttacatggagtaggatacacaatagtaagcgaatatcacaaagatttcaaaatatcccatttatctcaaaatacctcagtttatctcaaattatctcaaaatgtctcaatgatcttgaatatcacaaaaatcttcagaagcttcctcaggcccctttgaggtcaaatggggggacaccacatgctggagaggaggaaatagtgctttgattctcatgccagcaaggtctccaacagtgcacagcctattctgtgctttccttgagagtctacatatctctccacactgacgacaggagtgtagtagtaacaagacattgtggtaacaacagcagcagtagaaagagccaccactgtttaatcagtacttactatgtgcgtggctccaggccaaatgcctctcaccatcatctctctaagtcgccaaacatctgtttaagctggaagaggtaactagaatgtgtgtgtgggtgctaagttgcttcagttgtccctgactctttgtgaccctatggaccatatcccaccaggctttctgtccatgggattctccaagcaagaata

SEQ ID NO: 35687 - DNA, 933 bp, Bovine  19866881073499
ccccactgtggctcttcccaccccgtggctgaccgctccttcctgggcctgctgccttctccctaggccactgttgaagacagagtcttcctcggagcctccccggttcttctaccttcgagtgttcctggttgaaggtgagatctggcccgggccttccagccgtccagccccttggcgcctcttcgtgcctttgtagtaattcagtgccaggatgtagacttccacccagtagcagtctcagtgtcccggcctctctggagggtccagggcatgccatggggtgtcttgttgctcaggaatctttgctttggggcccaggctttgtgggaagtagagcagatcatctcagtctgccctatcctacccttttggtgaaggggagagtgggtgcatctttctgatgtaggggtgggagtggggcaggttctctctgacttgggcctcagaggttttggaggctagagatccctggagtttgggaaagtgagaactgtggtccccagaggcacaggccttgctgtggccgcctcactgtggtcactcctcctctccgagcagcactgggacaccagcccggggatctggctcttccatggccttctctgggcctcaccctgtctcttgtaccctaggaccggctgcctgccctgtgtccctgttgctgactctgtccaccctgtacctgttagatgaggaccctgcagggtcccaggcagagccccctcctccagcagcgtctggcgaagcatctgagaaggccccaccccccgggccaggcccctcagtgagcgtcagggagcagcagcccctcagcagcctgagctctgtgctgctgtatcgcgtggccccagaggctctgcggctggtcttctacgacgaggtgtggagcgaacgagagagaggggtggggagggggtggtgaggggcggt

SEQ ID NO: 35688 - DNA, 899 bp, Bovine  19866881080348
tgggacagataccttgtttactgggagtctagaagagggaaggaagagggaggccctgaactggaggcaaggagagagagcagtgggcttctggactgtggaggtacggggaacactcctacagtgcttccaactctagtgctttaggaactctgcaatctcctgactttcctgaaacactcagctggcatcaccaggtcagaggacaggctggaggactcttacaatccaagagtgttggagctggaagacagatgatctcatctacttcatctcagttctgcaataagtaaactgggaccatgggagtgaaatagcccctcccaagataataggctgttatggggagccagaactattctctggagcacagtgggcatctttactgcatctttactctttactttagtgacaagagtggtgcatgtgtcagagaaagatgtcaagtcacaaaagtcaccacaactgatttgctagacacggaaaaggaaaaaagttggtcgatctggttacctagtgtttgacacagcccagaggctgttggaatataaaatcctgtgggcagacctggaaaatataaatcagaacaactgggtataataatttggctatcagctgttagcccaacagaaagacatttccttaggaggaggggaatagaaagaaagctttgttaaatgcactcaaacctggtgaaaacatcaaaataatctcattaaagagtaatacacacagacaaaaggagttcactgcagtcttaaaaatctctttaaggaatttcatttaattctcccctcggtagacttggtttgttttttattttcaagtttgcctataaggcaatacttacatcattatatttagagtaagggtctatccctgcaaacacttatttaggt

SEQ ID NO: 35689 - DNA, 1758 bp, Bovine  19866881108284
tacctggatacaagagagcctgagaaaagtcactttattctaaccggccatctgcttaactacgagttctagttttataggagaagaaaacagagtttgggaatagctatcagtttttgtcatacatcatgtctgagacagtgtagaggacaggatctcctattgcttgcatcggtgctcagtgaggcatggggggaaccaggtggggaagtccttgatatccttgacaaaagcccaacttggaggaataactgtgggtctcagagacctggctgctcaagctctattattcaaataagtgagcaatggttaaaaactccttgtgggagaatctgcccagtcccttatgttcccctttctctgagctttacacgttcccctttctctgagctttactccttgctctccagcatggtgggcaatggtagccatgttggtacctaacaaacacgtagccatgtttcccatcaggggccacagactgaaacaggggtggacagctgacctaggctgggctcacctgctttctcttgggtattcagagctgtagctgagagactcctattagttgggggccatttgcttgagcctgagtgttatcaactcaaaagcggtgagcattatcttctgtcatttgtgtggagaatcagaggaaggcagtcctcagacagagaaggacgagacagcgtttggagagggcagctcccgaacctgtagggtctgagagagaaattgggagccggtggctgattcctgttggtgccacagtttcacataaagctgagatgcattcactcctgttgagtttattaaaaatacatcatgtatttatagagagagcttttttttttttttaaaagaacttctaatctgaccagttttctttctttttttaaaatcaaatcttaaaatctcacatatcattttagcagctaatggcttgcaaatttcaattttctacttgtcactaagagtgacaactcagaagggactatataaattgattcacccagccaaacttatccaaagtggggaagctaaataggtcagtcaatggaaaccataaaccatggtgtcttttcccaaataaaacagcaagaaatccatataggaagagatgaaatgcagtgcatttgttcagaagggagactgaaaacaacccctctttatttttaaatatctccctctctaactccagggaatgtggttttgaaaaagatcgtatatgtgggtcttagaggacagaactcactctacatttataacctgacttcaaaggaaaaaaaaaaaaggtaggcaagtcatcaacttgcttaaataaaatttaagagtggaaattcagatgaggaatagagtccatgctgtgaaactcctcatatgaaatatgaaatccactaacagaaatatgttagtgtaagagttccactgactggaacctaattaatcagagctttcagtgattatcattcttgaaaccttaaatcagggatataataaaacaaatgaagtccttgggagagtcataactttaggcttaaaaattgtttttacttccaatacttatctagagccagagaattgaccaaatacttgcattttagagctagtaagactttaaaggcggtcaagtgtatggggttttcatccttagctgcatattacagccccttggggaacttttaaaaatctggatgttcaggctgtaccccataccaattaaatttaaatctctggctggggggatactgggcatccgta

SEQ ID NO: 35690 - DNA, 973 bp, Bovine  19866881122420
cgtgagtctgtgacagcctgtggttgtccctactctgcagaacccccagtgcgcatcctatacccccaggacgaggtgaccttggtggccgtgagcttggagtgtgtggtgctgatgtgtgagctgtctcgggaggatgccccagtgcgctggtacaaggacgggctggaggtggaggaaagcgaggccctggtgctggagagcgacgggccccaccgtcgcctggtgctgcccgccgcccagccccaggacgggggcgagttcgtatgcgacgccggagacgactcagccttctacactgtcactgtcacaggtgggcagtctccgagacccccttggagaggaagagaggcaggaggctgagggacagatacccacccctcccagttcctgcaccttcaggacccctgtgtgccacacacaactttccccctgtccaggcttccctccctcccagcctcctcattctcagccatcagagagccctgagttgcccaaaccaggtcaggacagtggccagaggcctggtggagagagcccaacaattgggagagctcattcattcgtgtattcaacaaacactgatctgctcagcactgttctgatgctgagggattcggtaatgaacgaaggagagaaaacctgtctttatggagcttgccttcttgtgagagcagacagacagcaaataagggaaacaggtggtttttcaggtggtgatcagttcttcagaggcaaaacaggaaaaagggacaggaaatggaggggtagggagggctgtgcattagggttagatctgtgagtgtgggtctacctcttcctgtccatgcaaccctgggcaagtcagttccctataaagaggcttcaggtcctcatctataaagtgaaggcagaaatagggagtgtcaggagtagctgagaaaagaactgtagtgtccttagcatgacacctggcacacagtaagtgcctacg

SEQ ID NO: 35691 - DNA, 963 bp, Bovine  19866881150769
gtattctaaccaggacctggtgacatgccccaactcctgattcctgttctgtctggcagccttttgccattcctccacggactcaaatttacccatctactcacgggggctcagtacaaagtacctcgtccaggtcaagattcccttccacgattgcacaacagcacaaaaatccctggggaactaagacaaggatggcagagtgggaaaattccagactagtaaatgagaaagggagaagctagcccatgggttcacaaaatctccctcagcaatggagtttatctgcagcttaggccccatctttatcccttcagagagagtgagcgattccagacctggcttgactttttctggtttatggtgaagtttctgccttcgaggtaaggagcagatgtttcctaagctcctagggatttatcggccttgttcacaccttcaacagacagttcattgtaggtttaatttatactgttctgtttcactggtgggacaataattctggctccatcttaagtcacaaaatggcggtgtaaaagaaagccaaaccgcgcttctccaggcttgcatctctgcctcggctcttctgtacatgtgactcccttccactacagttcatatattctctgaatccatacaataaagtttatctcagctttgcaatttgttgccaagcaaggctcagtggcaccgcaggaagatcatcaactgggaagccgggggtctgggttcaaaccctagttgtgccagtaaattgcttcccttctctgggcctcagtttattcatctgtgacctgaggagattgagcttaatgatttatatagaaggtccctcccagctgtgacattctattaaactggaaggttttggtgaagagaggcgcttgacatctactccagctgtaccctcccaatttcccacaatgcccctctgctcctccccctccactaggcttaacccgc

SEQ ID NO: 35692 - DNA, 1041 bp, Bovine  19866881170048
tgaaatctggcaacagcagtgggttgtgtggtatattcaattacagcaaacacagacgctgcccggggggaagaagccagtctggacaccaagcaaaagtaggaccctcctggtaaccaccagtagagaaaggaaatttgttaggatgttacaaaaatggggagttggtgaatgcagacacttcaagcaggatcgctcctccacatggctctcacataagcgttctcaatacatctccaactctgagcgcctccagagacaaagcccttagaaggccagatcttggatttcctaccacctcttctgtgagctgactgcaagccttctagaaaccctcctgtttcgtgaatgtacgcatgcctgaagggaggaggttttctgtccttttcactgacttgttctctcccctcctcaattcagtaaactctatgaagccacagccaccaagatggagccagaaacatcccaaggcactttactttgactggtaagccaggatgacacccagaccctggggtgggagagaacttgagtatgggcatgagggaaacagaaagtaaagatagggaggccagagagagaagagactctggacaatcaaccaagattaatctgtgtaaccgaaaatccaactgatggcaaaagtaaagagatgtcatacactcacatacacccatatgagttcataatcagataacactgtttcatttccccctgaaatctctttcactcttgaaggaacataatatagggctgcaaatgatcaaacaagtcaattctaaaggaaaccaacactgaatcttcattggaaggatggatgatgaaactgaagctccaatactttggccacctgatgcaaacagttgactcactggaaaacatcctaatgctgggaaagattaaaagcaaaaggagaagaaggtggcagaggatcagatggttagataacatcactgactcaagggacatgagtttgagcaaactccaggagataacagacttctgaaggacagggaagccggcatgcagcagttcagggat

SEQ ID NO: 35693 - DNA, 2667 bp, Bovine  19866881210816
ataatgaaaataaacttagctaaaaaaaaaaaaaaatgacttttcgtatattgaaaagaggattgaatgcaccacggaccaagaaatcccctcatcaaatccaatcttgatgttttacctaccacctgattagtcccacctgtcactcagctgttctatctcccaggttcagtgtatgagcaattttactgtggtttgtcaatttggtatcagtcccccgagactggaatactgttcaaggtggtaagaagaaaaaaaaaaaggatcttattattgctattagcaaatatttgaatcacattttaaaagcctcgacttcttgaagaaattatagcttactctacagcaacaatgcaaagataattatgaaggactggcacttaataaaacaattttatttatatagacctcaaggtaaaacttgatttgaaaatacaagtaattttatgactccaaagccaaaatactaatacatctttgtagtccttgagtatcctgagagtgaaataaatttggaaagattcatcatgagcagaaaaatcattctggaaaaaaaaataatggttttatgtttttcattagtattgtacctttgaaaatattctttcacgtctcacttatgttttatcataatattttcctcttgtttgttctgctgatactaattatcttgatttatgaacactgctagagaagttggacaagccaaatacctttccatattaaagacactgtgcttgtaaaaccactgggtgaggaaaatagatttttccaacctaagcactgattatagtcttggtttcatagaatagtaaggagtataatgacctctcagttatcctctgttgacaagatataatcaacattttcttttttcttgatctccagctgaacatttataaatggtcaccctattttaaataagttattatgaaatgagaaatatttatagaacattccattaggagagaaagttatacccataacattaaagtttgtttttctgtacactgcgtagggctatctcaagctcaatctcttccttatgttttgaaaatatggtatgcagttcatacacagatctctatgtaatacttctgctaaacttatttgtcaatgcaataaaatgtatccatccaaaaatattattacttagcattcactaatagcactgattattcaggcttgaagttagaaaagcatattctatatacatgatttattctccttcttgaaaattccatgcaaaggaagagatgtatcttatttttaatttgaggactagtaaaattattcagtattaatcaccaacatttaagtggctgtgatatgctaagcccctttgttgtacatactgaacttcattgtggccccagtttacagatgagaaactgaggaatgggaaacattaggaatgctttgtttaaaaatgagaacataactaatatggctaacaaatacattttatttttcttctcattaaaaagcagtgaaagtataaagcagtttggagctggtccattggctcagtatcatcaagaatgtactatctttctgtgtcagcctctcagctggttggaatattgctgcagggttgtttaagagatggaagttacagggtttagcatcacattttctgtttgtatcagtcaaggccattggggaaaacagaaacttctgtagctattttaaatggaaaggggatttcagtgtttatggaattatcgggatggtggtctggaagaatggaggtctgcataagtcattgctggttccgagtttgcaactagctttggggattaggaagctgcaggaactacagaaataactgatcatgattgccctgctcagcgtcaaaactgctgacactaaagaaaatgaccagcacgcatatatgtttagtcactcagtcgtgtccgactctgtgcaaccccatgaactggagcctgtcagactcctctgtccatgagattctccaggcaagaatactagagtgggttgccagttccatctccaggggaaaatgaccagaaaccactgcaaatatctctcctctgctgaagactatggatctgctcactgctgtccaaggaccaatgaaatggcttttgcttctcttctgcattccagatctcatataagtgctggctttatgtagaaactctgctggcaagaaatctgagaaaagtagttctcaggcttctggccctatagctcaggaagagcatcaaagggagaaaatggtattgagttgccaatagacaatcatgcatgaggatccgaggagcaaggaggcaaggaggatccactgacaaactccatccctttactggaaaagcaaatatttttgcttacatttcaaggtccagaactatgccaccttttgctcctagaaggcaaagtaatgaagaagaacctactgtgtcagagttccctttggtggtgtattaagactatatagattgtgtcctgcagagtgaggtggtgcaaattatacccacagggttggttgatctttctcagtatctgaactcatactctggggaggtgaaaactccagggctgtgttgattgaagatacatttcaatacattcaggcaaagaaagtgaaatcaccaatatgttacttaccaatcccaaaaatgacggtggggaggcaggggccca

SEQ ID NO: 35694 - DNA, 1467 bp, Bovine  19866881279153
acctgggaagtctcctcacctatgaatttagaacagacactactggctggcctataagcgcatgttcaatgattcacatattttgtatgtgagtagttgttcagagtttggattctagagacggaatctctggctagattccaatcttagctcttccattgattaacagtgaccttgggcaagtggcttcatctgtctttgcctcaacatctgtaactcaggaataatactactcacccatcaggctttcagtgatccccacctacaggtattcacagtgttgtgtaggaccctcctccatcgtgccagagtcagctgtgtgactgagtacagcagaagtgatggtatattgctcccatgttataaaatacactgtggcttcaacgatactgttccctgtatttcttctctgtctgtactgtctctctctctctctgtgcctctccttcttttaggctaggggaagccagatgtcgcgaaacaaggacactcaggctcactgttgaaagtctcatgaagggagaaagaggcctgcaaacaccacatgaatgaacttggaagtggatcctccagccccaggtgatggcaactctggccaagagtttgatcctcatgagagatcctgagccagaccacctagctacacttctccccaaatcctgacccacagaaactgtgggataacaaatgtttgttgttttaagcaaataaataatggacactgtatcttatagcattgttaatctttataaaattctagaagaatacctgccacatagtaaaacaccatgtgtgtgtctgtcaaatacatgcatttacacatgcatacctaacttgggggttagtggaaggaaagtggccttccagttggtcaaaacctagtcaagccttagctgttttaaactcaaaagctcttgctttctttgaggcagtcttgcctgttttcacaacaatctgaaatgaggaagagaccctgatttatatttcccacagaagagaagagagattgaaatggtaagtgccagagaaattaaaagtaatttcggtttttcaattcattacttctggaaaaaaaatttgagcccagcttcattactagtgctctgttttagtgctgatgataattgcaaaggcagtattttaaattagaatgtataagaccacatgtatttaacctgtacagaagggctgagacttcatattaaactattaaatcaatcccagcagaatcactaatgctgagcaattgatttgaaaatactgtaagggcagagtaaagaagcaggatgctaattaccatccaggagcatttagcacacactcctcagttatagttagagtggcagactttttcctctggcccttaacccactcagaactgaggatgcagatcagttcagaatgaatacttaaaacaatcggagtttaaggcaagagagggtttttctgccactctgtaatctcatg

SEQ ID NO: 35695 - DNA, 1090 bp, Bovine  19866881301896
tcatctctagctggggccctggagtgacaacgaccccattgcgcagccaagtgatgtcggcatctggtggggagacttcacaccggaacgtggcgtcatccccctcatggacagtgagtggtgtcagctccgagattagcttcaccagcgggggttctgggggcagagggcaggatcagacagtgaggggggctgggtctttctaccgccaccctcctcagcccctcctcatccccagtaacaggctttcaccccccagttattaaacagaatcttcctgaggaccagctgtgtgtcagtcatgagctgttttgaaggacaagatgtcaactccctgcctgccactcctcaccacctcgtctccatgctggccgggcacccacctttctgactccctaataaagacagatcgtttaggacagaccctgtcaatctcatttaactgtcacaatagccctacaggccaaacgctatcctccctctggggacccggggctcagacagtctaagcaacttgccagtgtgtcacacaactactgggaaggagacttgagactggaacctggggggtagactccagagccctctgcccctcctttttgaggattcctggaaaggggagccctgagccctcatccatgcgatagctgtgcatgcattggtgggcagcgaggtgggtgggggcgaatggtggggggttggcgtgaggcccttagtgggggggctggggccccaggggagtaaggacggcactgttaccttccacgctgacgaggaagatgcggctgtcctggggcgtgtcgcacaggtactccccagcgtccctgctccgtgccccccgcacccgcagcacctgccttgccccgtcctgctccagctgcacccgcccctggctggccaggcgctccccgtccttgtaccagcgtacagggccccctggcccggagaggcgcaccgccagctctaggtccccacctggggtgctgcgaaccctcgtctgggcttgcctcgggggccaccacccgcacaggggggctctgtggggtcaagggccgggtgtcattggggagggaatggctcaagggctggg

SEQ ID NO: 35696 - DNA, 915 bp, Bovine  19866881424177
ccagtgcaccagggtttttgactcccaagctgcactccagatgaagttgaaaagccacctttctgaagacaccacatctgaccatctgtttgactttctgacatgatcaatctgtcctgacaacctccccagcagaggaatcagtgatgcaaacacgtggcgtgcactctgtgatagaccacacagacagacccacggacagacagtcagcccacagacagacctggactggtggcacaggggccagagctggctgctctgagaagtgccccaatatcctgtggctagacccttcccccactggtctgtctattcatccaataagcgtcatcaagcacctatgaagtgtcaggctgtcagctggagagggaggaagaaagataaaatgttccttccatccagaggaattatcttgccactccctgccctccatccatttatgacctaactgaggagagcagctggaataagaaaaataatcgcagccccgtgtacatcaagtgtcagatgagtggcccagaccaggaggatttcaaatgttctaacaggggagtgatcctcaaggtcaagaggtttcatgtatggaaggactttggctttgcagtgtcagtggggctggaaacctaacatatatcagcaagtccaggagaacccacctcgtcccaggtcagttcaagcctgagcagggctagcagcttaagcctgtgacccagctcccactatggacaggaggacgctgatggaagagagggaaaccaattcagaaaggccagccatccttggcaggtaggtgacaacagagcagcaggcatctcctgccccatcagatcccctcggcaggcataaagacctggttttctcacctggtaaaataagacatgagtcccttcctcccagagccagtggaagatcaac

SEQ ID NO: 35697 - DNA, 800 bp, Bovine  19866881430807
gctaatctttaccccaaaaattatgaaagccttggatcatttttaatcttatccatgaatgctttatacttattttaaaaatttactcctcctttatgattttgatcacttcttggtagttccaacagttttcaaaactacataaatttgaaaactgttatcttgacattgttgaaaattttctttggaaaataggaggtgcggtttcattttattcttcaagttagattttcctttgattttgaagctcactctgggtctttttttttttgcagcactgggcaatctgtggggcatcttttcatttaaataatattgcagtaaacagagaaatgtcagagaccagaaggagaacaacagggaaatatcacttatgatattcagacagatcttctatagagttaacaggttttaattctgaataaattcaacagtgagttttccaaaaaaatgtctgtctcccactttgatgattatgatatacttacaaataaatcacagttgaattcatagacccaaattatttatcgtaaagaaatgaacatggcaatatgctttctatgtctttccaattagagtttagatcaatttatctttgtgaagatattgcctggttgaatttttttcaatacattatgacatgttattggagccaactagctggaacacaaggttcctgagactcaacattcattatttatccatttatactaataaacctttatatcccacatgtccccagctcagattgaacagggcctcagaagcacaacctgctttaaatttagacacaacagcaa

SEQ ID NO: 35698 - DNA, 1398 bp, Bovine  19866881492248
ctgctgtatgatatacaagaaagttgttaagagagtcctaagaaagagttctaagggcttcccttgtggctcagctggtaaagaatctgcctgcaatgcaggagacctgggttcgatctctgagttgggaagatcccctggagaagggagaggctacccattccagtattctggcctggagaattccatggactgtatagttcatggggttgcaaagaatcagacacgactgagtgactcatgttcacttttcaagagttctaataacaaggaaaacatattttccttttttgacttttttttttactgaagaagtgcaaatcttttcttttattcataaggagacggatgttagctgaacctactatggtcatcattttacaatatatgtaaatcaaaccatcagagtgtctgcttttaacttatacagtgatacatgttaattatttctcaataaaactgggagtggggagacatttttccctctctgcataatttccatttcagctgctgcaagtgatgatccagaacttctggaggatccgaagaggtaaccaagagaacagtatatttaattaaagcaatgggtggaagggaaatggaagaatgcttacctgccaggcatacctcacacatcctcacagactcagaaaattccattctgaagggcactgaagctattactatctagagcagccagccagtgagaaattatgctctgggtttcagctcagccagctttcattactgttgtgaaatagcaccatataattcaacccagctcaagtcttacctcctctctcaagactttcttgactatcccagtccccagtgattactccccaccattgaattcctgtaggattaatgtgataacatatgaaatcacccaggactgaggccagcacattagccactgctcaaaaaccatctcccagccatcttgtagtacttattattggcactggtcctgtggctcccagaaatctccaccgtgtgttatcatttatctttttatgtagtcattttccctctccccaactcatttgtaagcctaggaaggacagggactcagtagtatatttccacttttcccggcatcatgcattcctctgtaataaggtgctcaggaaacacttgtttatgtgataattcccatcccatattctttgcagaatatatctgtgaatatgtgggggaaagtaatactgtaatagtattccatgttaaggtctgttttgccatttagacctccaatcaaagctgtatgaatagatggaaaaaattgatttttaaaacagcaggagtgggacaaacttgtgcttaggagagggcaaaatgtacataaggaaagtttaacactaacttagtagatccaacccttcccaaactccatca

SEQ ID NO: 35699 - DNA, 1440 bp, Bovine  19866881651419
gaaatgaacttgggcgaactccaggagatgttgagggacagggagggctggcgtgttgcagtccatggggtcgcaaagagtcggacacaacttagagattgagcaacaacaacatattatatatataacattaatataataataaaattatatatattaatatgactggagaaggaaatggcaacacactccagtactcttacctggaaaatcccatggacagaggagcctggtgggctgcagtccatggggtccctaagagtcagacacgactgagcaacttcactttcacttttcactttcacacactggagaaggaaatggcaacccactccagtgttcttgcctggagaatcccagggacaggggagcctggtgggctgccatctacagggtcgcacagagtcagacacgaatgaagcaacttagcagcagcagcagcatattaatatgataataataagggctcacttacattttctaaacaaaaagatgcatgatagattcagagttttgtcttccttttgcatccacatatgatgtttatgtagagtggtagactgaagaataatctgatttacatggatttatcaaactttggtaatgcttagttcttaacagaatcctacttggacaatattttaaattttctttaatgagtggtaaagaaaatggattcataatgaatgcagggcagactcaatccacaagagtcttttgatccttgactttccattgggaagcatgaattggaaaatctggaagactcatgttttagctatgttttataaaagatacttattgttttcctctgagttccttcatccaaccatagttctggtatcattcattatttcctcttttaacgggagggcagggggagttgcccaatcacttttatttaattctgatcggggagactactgcattaaccacaagggcatagaggtgattatgtgacctagatctgctttatcatagcaccccatcccctgggttagggttagggttagggttatagtgattggcccagggatgggtttgagacccaaaccaagtcaatgagaatttttgcatggagttttctacatggaaacactttttatcccgtcttaggttgctagctgaacaggtaccagcctggagttatctaactgtgctttccccagcactcgcttggcccaacctcattcatggagaaaatgtactgtaaggagggagtgagggcaacacctgatgagaagaagaggtgggaggggagagagagacagagaaggagagagagatagagacacagacagagtacaaacacgagagcgagctaatgaaaatgtgtaaacgtccacattccaccattccttgaagccagaccctcttctgcgctccccttgttttgtatgctcatcacatttcatttgtctttaagttagttttctgtcc

SEQ ID NO: 35700 - DNA, 600 bp, Bovine  19866881786451
cgccaacacacaccccgctgctcagcactaaatgttaagatcctttgattctgtgataatcttcatcctgtgatctaatgtattttgcctatagcctggttttggattaaaacaagcaactcatcttttgtattttttaagtctgagaatttaagctcagcccccacttttgattttatagagaaaagagacaaacacaggttagcaactcctcacaggttacatgaggtttcagggagaagagagcagggtaagaccgcccacgcgctcagttttcccgcttcttggggaggcctggtataagaaactaattttagaccccttttactagtcattgttctcccattaagtggcttcaaaaaaatactcttacataggcttgattcagacatttataaggtgttggtacattttttttaaagaatacaattggagaaatgaatttggcttgcctattaatactaatattagactcttggcatactaattgtataaactcccttatgtatctgcacggccatttggatgcctacctgcccaccatactcacatttctctatcgatcaagagggaaaaataaaatcttaaaaatttaccaat

SEQ ID NO: 35701 - DNA, 773 bp, Bovine  19866881858727
acatgtaaaccttccccagtgcgctgtcactgagatttggggtcagtttgttactaagcattacttggcctaataaaaataccttctgcagagaaataatgcttcctgcctggattttttcaacacagtgtgctgtgctgggctgtgcctagctattcagtcatgtccagctgtttgtgaccctatggactgtagcccaccaggctcttctgtccatggtgatttaccaggcaagaatactagagtgggttgccatgccctcctccaggggatctttccaacccagggatcgaacccaggtcagacccaggtcagattctttaccgtctgagccaccaggaaagcccaagaatgctagagtgggtagctgatccctcctctaggggatcttcccaacctaggaattgaacccaagtctcctgcattgcaggcagattctttaccagctcagctgccagggaagctctttcaatgtactatctgaatttaatgtggatatttaccatagaagcaggttgcatgtccttttgtatggaaaaaggagggaaacatgacacctgaacttacaaataatgtcattgccaaaaaaagctgcctacatctacatggcttatcatgataatgaaattaataaaaaaatcttaaaaataaattaataaaaaaagcttaaaataaggaatacaaagaatataacatattttctgtctgatttttcttcctttctaaatatactacacagatgtaaaggcacctggatgtgctagactcaaaat

SEQ ID NO: 35702 - DNA, 640 bp, Bovine  19866881932295
tttacgattgactggtttgatctccttgaagtccaggggctctcaagaatcttcttcaataccactgttcaaaagcaacagttcttcaaggcttagccttctaaggaaggagccttgcaggtatcctttgtctacagatgaggagaaaaggctcagagagatgacgtgagctggattgagactcaaacttaatccctcacttatttctttcacaaccacagaataaaaacccatgggtgaaataaaaacagaacagtccagtgattaaacctatgtcgccaactttgaagtaaagtatcatggcaccatccaggctttttagtaagcagtgctctgtgtacatatctatgaataactttacatttctcattaatggtatatgttttcataacgatcaagcctcactggcacccctctcttggcatttgcatgttaacattaattctcaataagaaattctttcctagtaagtgttatataatgatgaaataaaggctgcagcttaaattcagccctcacatcattctttttcttctttgctgatctcccactttggtcaaaactggatatacccatccaggtctcctgagtcaagatgtcaccgcgctgtgtaattaaattctaaaataaatagcaagac

SEQ ID NO: 35703 - DNA, 861 bp, Bovine  19866881978723
ctttattcctgaccatgaccctggggaggagattatcaccttccccagtcagcacaattggctggtactgaggttgttaacttgagaaaatcaccagagatagtattgggcaacttcaaaagtccactgtctttttcaatgagcttgtcatgaaagggcttacacagaatactaataacagctaaagatctaactgcaggtggctgtctaattccaatcaaaataatttccccccagtcttggtggataaaggagggcagaattaaaaagggaaccaggagtgatttttggcacgggcaccgagtctgttgtggaagaagacaattggtgttggcattgtgcacttgggttctttctcagcaacaaatttccctctcccctccatggcctggaaggtccggacacaaatgcttgtgtcagttgtccacagctgcacacaccatggggcgcttgttcagctcatgggatggcagggttagggtagattgttgggttttgaaaaatcagaattattaaaaaccaatatgttgcctcttctagaagttttcacgtgctgcgctcagttgctcagtcatgtccgactctttgtgaccccatgggctatagcccattaggcacctctgtccatggggattctccaggcaagaatattggagtgggttgccatgcggtcctccaggggttcttcccaacccagggattgaacccaggtctcccccattgcaggcagattttctaccatctgagccaccaggggagcccaagaatactggagtcggtagcctatcccttatccagaggatcttcctgacccaggaattgaaccgagtctcctgcactgcaggcggaccctttaccagt

SEQ ID NO: 35704 - DNA, 1023 bp, Bovine  19866880271543
tgatgggaccagatgccatgatcttagtttctgaatgttgagctttaagccaactttttcactctcctctttcactttcatcaagaggctctttagttcttcttcactttctgccataaaggtggtgtcatctgcatatctgaggtgattgatatttctcccggcaatcttgattccagtttgtgcttcctccagagcagcttttctcatgatgtactctgcatataagttaaataagcagggtgacaatatacagccttgacgtactccttttcctgtttggaaccagtctgttgttccatgtccagttctaactgttgcttcctgacctgcataaaggtttctcaagaggcaggtcaggtggtctggtattcccatctctttcagaactggcacacctggctttcccgtgcttcactttactctgccttcctctcagatgaaccgagtgtgggtggggcctgcctgcctcactcaacacacgcaccaggcataccaatcggagctcagggctggcccagtgaaagcagtgagactgctcagtgggcgggcagcctccgcccccagtccatgtgactggccccgcaggatgagaaggtgtcccccatactcacagctcgcgccaccagcgtcatcagcattccggtgagaaaggtcaggtaatagcccgggtacaccccgtgccagatggcagagaggaagaaggtctgggtggtgggactcaaggaggcacgttcataacacaccctggaaaccacgacacacgtgagttgtaagaagcctgtcacccccacaaccatcattctttcagtcccagtcaggatttaggaaaacaaccacaccttagcttggccattagcctcagggaggttatggctcctatgaggtttataaaaagattttttacttctgtcttcttactggtatcaccaaaatggtcatttctagtgtgtggggagtctgtactatgtacagaaaaactttaataaatataaaagttattcttatcttacattattttat

SEQ ID NO: 35705 - DNA, 1212 bp, Bovine  19866880462265
taaacatgctggggaaaccattacaggcctatactcccttatctagaactttaaaattctgaatatctctgaaaaatttaaagttcaaaagcaacatttttagtagtaaaattgacctaaaataaattgacatgactatttacagtcttgcttcatcggaatatttatgttttcctgcaaactataaatatacttgcttatggagtatggccccagacctcactgggcatgacttagaaaatctagtgtatgtgctgtattaactctctaaactctgacaaatttcgtacacatctcacctcaggggttggtttcagataagaggttgcaggattgtattattaaggaaagaaacatggtgttgcagacttatcatttctaaagaagaggaaagaaactcttctctcaaaaatgaaattttcagcagccctttgagattggccaacagcccattttccaaaggaattttctaaccctagtagttctcaagaacctgagatttttcactctgaaatcaaggtttaaaatacattcttatctctgaaatttgcttgagggttggctgacttaacacaagacttagccagttcacttgctgtaaatgattaatttgtaaatgatttttcttggaaaggaaagatctatgtcttaaaagaactatggtaaacagtgtaattaaatagtaaaacaaaaagaaatgctcccccaccaccctgccctgagatgtgaacatgtaagcttaagcagaagtttcatttccatgcttaacaatattctccctcagtgtttctgaagggacccattatccacaaagtgagagaaatttgaatacacttaccacagtgatcccaccttagcacttgaaggggaaaaatcagcatgcagaaactattttacaaatgaaaacttaggttctgatgtcagctttgcttctctgtgactttgaataagttataataattaacctccctggactcagcccatttgtaaaatgaaggaagctggacgagctaatttcaaaggctacttcctgagcaggcatctcatgattccatcatccgtattctgtgttagtttaggcaccagagggaactgctacaagggccacattgctactggggaaatttaatcagtggtcctattcgcttgagaacaggcctgttttagatgacattgggggctaatttttgagaatgttgtcattttgttaag

SEQ ID NO: 35706 - DNA, 851 bp, Bovine  19866880582980
atgttgttagcattcatagtattgatagaaagtttccttataaagcattgtgataaatagtaccagttatggacttcctttgtagcttagatggtaaagaatctacctgcaatgcagagacctgggttcaatccctgggtgggggagataccctggagaagggaaccggctacccactccagtattctgacctggagaatcccatggacagaggagcctttcggggtacagtctgtggggtcacaaagaatcagacacaactaagcgactaacacacacacacagtatcagtgacactgagatggtctgacacaaatatagaaacacaaattccagcggaaggaaacctaggttgcatgcaagtggatgtgttttgtgaccttgctgagcagtcctgacctggttatgggtcagggcacttgccagttgccctgccttgcctcaggcaccctgaacgaaggccctcttttactcagcaggccagcgtgcaaaacgctggtgcagctcactttatgaaacctgcacattttaggaaagttgcacttaaaacgattgagcttctacaaagtaaaagttcgtatagatgtttactagcagtgatgtttagtcctttaagtggaaaaaaaaaaaagacagggctggtgagaaatccatcagctcttttgtgtcacggccagagaataagtaatggccttgtccccacggcgatggctgcccagaagagtattacgaagcattaaagagtatcaagggagtgattctaattcaagactcatagtgccttaaagctgtcacgatgagaaaatgaaaacttacatctctatgtgctgacaaagaggctttgagagagt

SEQ ID NO: 35707 - DNA, 1852 bp, Bovine  19866880612237
ctgaaccttctgagtttgacactctaacctctctggtcctacatccctttgcactttactatctcccatcccaccctccttaacaacctaatttattcactagctaaggactacagtctttcacattcccactttcctgaactttctcttcccattattctactattcttgcctgaattactcagcctttctttatccaaactcgaccgatttttcaaactagttcaaattctaccttccctcaaaagttctccttaatgccctctttcaccacctccagactcttatatttgaatcttcactaggcaatcaaccatacactgctgctgctgccattgccttctccacaaccatacactatctgatatcaaaagtgggcatcactttttatgttcagataaaaacgtaagtttaagtataaactaaatgaactaaaaccttccgaattaaaatacatgtttcgtacaggcaagagatccatgttaaaagactctcatggcatttggcataatgtttattagtttgattcaaaaatggatttgtatacaaggaaaaaactgagcagaaatacagactgtccaacagcaaaatgggttgtaaagaacagatttttcttttttaatctaaagcttctgacatactgaataaatttacaacttcaggagtgcttttacctaaaatgaataacctttatagctctgtgagctgtgactgccttaaacaaagtccataggcgctaccaaggggtcctgagaaaggcaagcaaatgggggaaaggagatgaaagactaaaacaaaacacaggaatagaagaacaatacacggatgaagaagacaaacagagggagaacactaaagaaaacaagtcacacacactcaaagtgctgccatttctcagtattataaactactaatttcaggattgaatatatttagacattaataagggaggtgtacttgaaaaacatgagcttctttatggttcaattctatctaacttgacattaatacagaaatttcaaaataatggcagtgaaacttagtaatacaggcatccattaaatatattagtgtttataagtttaacttcataggaaaactcaaagaatgacattatgatcaaccaacatatacgaccaattacagtcatagataacagtctgtaatcacacacacctgtcctctaatgtcgatatcagcatatttttggagaagtgctcgaacaatttccacatgaccacctctgacagcaccaattaagacagtatctccactctaaaaagacaaaaaaaaaaaccaaccatagataattgatgaggaaaacaaaatatactgtttttaagttaagattaatcatatattaatacaataaaatgtttttggaaatgtcttgggaaaaaaagtatctcagatactttctgtaaacaacaaagtttttaggtaactagtattaatacctgatattaatagcctgtagaataagggagagaagactatacatcaaaatgaggacatttatatctgaaattccaggacaaaactttagaaaggtaagtcacccacaacaataagccattctattttgaaggcaccctctcattacaaatgtaaattaaataaaatgacgccatgactgtcaatgaaccagatgaatctttggaaattacataacacaaatcccttggaatcatgctatctgacaaaagccactgactctaaaggaagctgcaaagctagagccatctgtgggtttataaccacatttaattaagggagaagggtggttcccagaacagaatctatattctacttggcattacaggccaagagtgcccaggactgactcattcct

SEQ ID NO: 35708 - DNA, 1291 bp, Bovine  19866880617949
caagaggtagtctttcttttcctttccactttgtataatcattaggcacacaaaactactgtaatcacatctccctctgcacaaagtggaacaaagtcaagtaatgctatttcttaaaaataataatgataataataaaaaacaggagaaagaacaatttactgtatgatagatagtcctaagtttttagagtttacttttcttcattgtacatctcaatcttgttttattttgaaaattaattcagagggcaaactccactcagcttgttcatattagaataagcagctgtgaaagcaagatttgttttaaaagctgtgagtatagttcagacaaaatcaacattacttcatttgttcaaagaagattaaaaaaaaaagacaagttaaaaggaacgttaagatcagagaggaaggcagtctgggaaatgtaaatgagcaaatattctcatttcttttttgtcttttaagaaacaattatgaacttttgtgactttatagaaagaaaaacttaatgtaagattaaactgcaattactattattccaactttatttagaagctcttcatgtacatttataaaccttacattgtaataagtaaggtacacccctaacatgttctattttgggctttttcacttttggttttatataaacatgtccatgtactgatgttagcacacttgtcatcccaacatcctatcctgttgacataacccctacatacttggtaattggagagtgagtgagagggtgttcataccattacaaggcctttctccaaccgcaaattgacttcgtatgtgtagaagaacagccaagtggagcagtataaacaaagaggaaggaaagtcattatgtgaagaattttattatggttgttattttcaggaataagttctcagtaacttctctttgtgaggttttctttaaaaaaaaaaacaaacaaccaacagaggcaaggtaataattcatttcaacatgttggaggaataggcttaagagacttgtgtgccagttactaagttattgtctattaggtgaaaatcaccctttcacactctgtgatgttggagctgagactctgaaaaccacatttccattttgccagcagctccatgtctggctctgtcctcaggggcattaggggaagtcttcaacactggaaggaagaaggaatttgtctcttcctagttgtttcctggtgacttcctgtttacttcctgtgtggcttttgtctaccgtgtgtgacttcctgtcttcttcctggagactccctgtctacttcctg

SEQ ID NO: 35709 - DNA, 1670 bp, Bovine  19866880743064
ccctgggaacaggggagacgggcgtgtccacggtgatgttggtgccaagctcaccgagggaagagggcgtgggcccctaagtgctcccagtgttttatggggcagccctggagggtggcacacagagggacccgcagagaagagaagaagcatcgagggcaacctgcttggaaatggtctctggttcactaccggagggagctccagagaaaagggagcgaggctgaggaattgactctgtaagtttactctaaatattcgtctgtggctagtggctgccatcctggacagcacgggtctgaaaaggacaagtgtgtgcgtcctcccgggaagatgtcctttcccacgctgcacacagccctggaccagccatggactcagaggagagctgcttccgtgaataaataagaactgtggctattaatacaacagtttaggggatcaaaagagaggccttaaaagtggttgtagacagttgtttattttcctctgaaatatctgagacacatccccacagccttgtttatgtgataaatttactctgtgaaatttgctttataaactaaaggtcagctgtggttgggctcctcagaattaatgagctttggccagacgtaggctgttgcagggtgcctgcttagggctcaattgtctattagatttttgcttgtttatagtttttacatgcaaattctggttgtaattacagctttttttttttctcttttcctgagctcgtgtagattttagagagggcagggtgtgggtgagggtgtgatctggttagaaatctcagcccagttggtacaagcttttggttccttgaaactctcaaatttttattatttttgttctaagattcctgtgctgtttttatatataaatgacagaggctttttgcagcactcaagtctttatcacttgaacttctaagttcaaccttaattatctgtaaatatgcaccataatgaggggtgtgtttttgagtggggcagtaattgcatttccctcttgtaattttaattaaaaattacctctaccgcctacctcacctttacttccaggctcttcctaacagactggaaaagcagctgttactgcttatctgctcttttctgagttcaggaaacagcatggccctttaatgacaaggcgagaattccatggggcggcatatttttacaagactttgatcagagagggtgtgtcccacagtataacctgggaggagaatgtcagagtttaaccttgtgataaagcctgtttcccctgctgtcagccttccacactgaagttcccgtttttctcagtgtgatcgagccaaagccttcgtggacagattactctcttggaggaccagcggctggagagttgaagcctggttgagagaagatctcagtggccactcgcagacctttccagcgtgtctgctgccctgcctcgaccttcccactgtggggcccggccagtccgccacctttggttgggctttccctgaatccactcccctgcctgcccagatccatgttcttactgggtccgcatgaccttctcctcccctctgccctctgccaagaagacttcagtggctgctccttgtctgtccttagaagagaacattaaagaacagtaagattagttttatttatattttacttaacctagtatgt

SEQ ID NO: 35710 - DNA, 1217 bp, Bovine  19866880827484
ctttgtctcttgtaatgttttttggcttgaagtttatttttgttggatataagtatggctacatttgctttattgggctctcatttacttggagtatcatctttcatcccttctcttttgagcttacatttgtctttagaactaagtgttctggaggctgcatttagttgggtcttgttttcaaacttatcagctactttctgtcttttaattcatggattcaatttccaggatgattattgataaatgaggacttagtactgccattttaccttttattttctagttgctctatatgtccattgtttctttttttgtttgaatttttgtttgccattttagtttcatggttttctattttgtttttctcagtttcctctttttcactgttaaataaggcatcggagaaggcaatggcaccccactccagtattcttgcctggaaaatcccatgggcggaggagcctggtaggctgcagtccatggggtcactaagagtcggacacaactgagcaacttcactttcacttttcactttcctgcatcggagaagacaatggcaccccactccagtgttcttgcctggagaatcccagggacgggggagcctggtgggctgccgtctatggggtcgcacagagtcggacacgactgaagcaacttagcagcaaataagacacaatagaaaaacagatggttgatattttgtacattgcattttcttcagaaaatctagagcaaaggatcgtttatatgtccataatagttcaacaccacagattgaaaacagaactactgagaaaacagctgaacttgcacttgaagtcaacttccccttgactgcaaaattcaaggtttctcagatgtcagtacagtgttgaaagcagtggataaaactttacagattgcttgtgcttgttcgaggctattgtactagtaaacccacaggctgtattcttcatcattcacatctgtagtcttcaaagccaataagctttttcctgcacccagatcgtcaccataacataccatttggatgattaaatacagagcacacccatgtaaaacatcatactgatctgatgtggatacttctataccaaacttggtaacctgcatagtaaattcttcctccaaagggacgaaaggcaattttttatcttcctgagtgacttctttataatttatcagttctagtagcccctcaagactttacc

SEQ ID NO: 35711 - DNA, 558 bp, Bovine  19866880855790
ctggggtttagttttctttggatagagaacaaagaaagtaaaacgaatggtctgaagcccttccttggggagaaacactcacatccccagatgctgaaaataagcaggctctgagacccccggcagccgcctcagtccgccgagagctgttcttgcctttggctgcccgtccctgcccccaggtccagccgcaccccaccagctcgcctggctctgtggccgcctcttcctgcccgtccctgcccccaggtccagccgcaccccaccagctcgcctggctctgtggccgcctcttcctgccgagttgctggctcctctgaaaccttacctttccctccgccctgacctggccggtcccgcggttttgtccaagctatgctctccactccccagctaccccccccaccccaccccccgcttcctgggtgagagagtgccgtctgggggtggagtggttcaaaggcagaagaaggggtgaggccctctgcccccctgcggtcctcctctctggtcccagctggggttcagtttgctttccgtcgtggtggaagccatcgt

SEQ ID NO: 35712 - DNA, 1826 bp, Bovine  19866880905746
ccaggtgctccagtcaaaggtggcagcccaaggcggggggcagggttgtggtccttgttgttacctagcggtactgacaggtgaggctggaggaatagaggccctgctgagcacagtcttacaggcttgagtgaggggctgggaaggtaggaagatgtacagaccactcctcccggggagcaggtccagagggcctgagactccccaaagtggggtaggggaggggctgaaggaggtgagggcacaggggggctgtgccagtagtggggcatccaggctgtgcccagtgactggccactgctgttcattcacgtgctctgcaggagtgtcttgggatgattccacgatggcccctgtaagtgttattaatgcactggagaaaacagcgagaagtccatttataatgccttacgggtgttccccacagtaaaccccttctgtagaatgatgttactccgttagaaagcagtgtttagggaagagaccgcacctgactgtcactgtcacgcgtgtactctcagcccagtaaaatgtggcttacctttacagcttcattattttgtccgccgaagaaaaaagttcctttgtttttcagatgtcaacaagtttcaagatgtttctcgataattggaatattcagacagctctctggctcaaaaggtaagctccttccagaaccgtcttcagctatgctttggcctctgggtcttgagactgagcttcactgggtttacattcttgattagagtaaattaaatgaatgctgtgactttgtgttaaccaggaaacacacttactgtcctccaaagcagggtggtaccaagcctgagaactgtttagccttgagtcctaaatgcagctaccacagacctctccatttgcctttaaaggtgcccaccaaggtctgaaatcgccagtacgtccctcattcatgggagatttgaccaaacaaaagtggctacataaccaccatacgtatgcattagattttccacaatagttaaaatattccagtagaatagacctttatatgttgggtgcaggatatgaagactgaacctctgcagttggaattcaaggtcttgtagagtagtctccacatgctgatccttgtagtaaggatgatgatgagagggcaggaggcgtgcaggcacggggggcgggggaagaagaggcactggagttaagaatcataaagaggaggttgtcacgggcacagggggaagacagaggactgattacaggaggcaaatttaggacagtgcacagaaactcccaggggtcctgtctccttgttcccgatgggatactgccaggttttgagtttatttcataaaacactgctcttgtgatagggggactctaagcaccattctctgtaatgccctttgtttatttatttttttaaatttagatttattttaattagaggctaattactttacaatattgtattggttttgccatacatcaacatgaatccaccatgggtgtagatgggttcccaatcctgaacccccctcccacctccctccgcatatcatccctctgggtcatcccagtaatgccctttatttatgacaaataatgacctttacttcttgaaacacccaaaatatattctcgtcacttcatggtgccttgaagtctccccagtggctgcacattttctgagctaattgttatgttatttttgttggtatattttaaatttcataccttaagaaaatctcattttcatgtaagttctccacctatgacaggaagacttttaagcacagcctgcttcccagtagagtacagttagatcaattgaaagtcctaaa

SEQ ID NO: 35713 - DNA, 847 bp, Bovine  19866880915299
gggtgccctttgcaggacagaaaaataaaggtggctcaggccttgctggtgctgatctcccagtggggagaccacgtccctgcaaggggcctgttacagggaccagtcagggccagactagctggaaaaccggactgcacacaggcttccctgctccgccagccgagcccatagctgttcatagttttctgtcgctttccctcccacatctcaagcaccagcaggacaagtgagaaagccacgggtcaccactgttaggggtgaatggtggtgccaaggcggccagtcaagggagcccgaggtggcacggagctgtcctgccatttcaggaaggcctgaggggtatctgcccggacgggccagcaagaccacgatgctgtccttggaccgccagccccagacaggcctccgcaggtcgtacccctttcactcctttcaggtcccccttcagcaaactgtccagagggaaggagattatgttgttcatgttctgaatctaaaagacaaaaaaaacaacagaaaaatattcttatttcctttttaatctaaagcaaggacagtaaggaggttaagagaacacgtggtaataaactttccctaaaaccccatcatccttaacattctctgtaacgatgtcatctcatgaatgaaaacctaacagtgaaacgtctatatctgtttatgtttcacaaaatattaacctattactgggctatgaagtctgtggaaagataaccattacaatgaaggaaaaaatcaacaacagaagcactttaaagatccaggaatgggaacccaccaacatttcctcctctcacagctccatccacggcctggggctgtggct

SEQ ID NO: 35714 - DNA, 1359 bp, Bovine  19866881075467
atatggtagttctattttcagtttttgagtacccacatgttgtttcccacagggggtgcaccaatgtacattcccaccaacagtgcaggaaagttcccttttctccacagcctcaccagcatttgctatctgtggtctttttgatggtggcctctctaacaggtgtgaagtgataacactgtggttttgacttgcatttctctgatgattagcaatgttgaacgtcttttcatgtgcctgttggccaactccatgttatctttgggaaaacgtctattcaggtcttcagctcattttttaattgggttgtttggtttttcaaaatactgagttgtatgagctgtctatatattctggatattcatcccttgtcggtcatgtcatttacaagtattttcccccacttagtaggttatcttttcattttgtcagtagtttcctttgctgtgcaaaagcttttaaatttaattaggtctcatttgtttatttttgcattttttttctttatcttcagagacagatccaaaaagagactgacaatttatgtcaaagagtggtctacctatgcttatttctaggagttttatggtttccagtcttacattgaggtctttaacctattgtcatttctggtcagcaaaataacaccaataatataaacagtgcatgtcattcatatttattgtttataaacgaaaattaactttcaaatatacatatatatagataagcattctacatttcacttgaaattatcttatgttacttttatattaatattctgtctgttaatatataaatagttgcttgttatgacagtaaaatgctattacaattgatgagtataaaaactattaacaggaaagcaaatgagttaacgtgagtgttgagaaaggttcatttatatgacaactttaagaacattatatccactgaggaaaattttataaatgttttaaaagtcaggaaaagattattttataattctcttacttgtaaaattgtttagtgtactatcataaaataaaaaaaacctttaagaaccatataggatttttacttatttagttccttttaagtcatgaaaaaatgacctttttaatgaaaaagctctatttgggaactctacactaatgaattaaaagcagaataattagctctgtcatctcaatttcacaaggagaaagaactctaaactcacataccatgatatccataatgaatcatacatacataataaaaatatgtaagaaatacggacaaaacaaaagtgttaaagtgaactggggttcccaaaacatatttccttctcactgatcaaacctgagaccaatggtcttcgtaagaatgctctaagag

SEQ ID NO: 35715 - DNA, 862 bp, Bovine  19866881223622
actgtgccaagaactctgtgaatgagaattaaatatgtatttttagaatttaatgaatgaaactgtttaagcacctaaaacaaaccgcaagaggaagtgctcagtagatttaactgatttagttatggcttgaccaggtaatcttgaaaactgccagtttatatcatcagcttctgtagtttgatagatacccagagtgtagttacagtctcttgcccttataattttggcttatttctctgaataagcttgactgtaatggcaaatgtggattgtaaattaactgtaataaaagtgacattgaccatatgtgcttagtgagaggttagtatttctagggtttggattcttttggagtaagtttagatttacaggaaaactgccaagacagcacagttcccaaatccctctgcatttccatgaatgccctcatgtaacatgaccgtggtacagatcacacatgccagaactaggtctgattctggatttccccagctttcatctatccaggctactatgacatttagttgccatgtctccttagtctcctcctatgaggcttctttccttggttttgttcacatattctaggttaggctgagtttttgaataccaccagaggtgaagtgccctccttcacatgtcagggggtacatgacatcactggctgatacaaacctcgatcacttggttattagggtagcatctgccaaggttctctgctctagagttactgtttcctgttttccacactctagaagacagtcattaaatccagaccacgttcaaaaagcaaagggaggattcagctccacttcctggaagggggagcatctacatgtactatttggaattctgtaaa

SEQ ID NO: 35716 - DNA, 876 bp, Bovine  19866881410686
accacctatcatcagcaaagaagctggtattttatctcctaccagatctagtttttttcaaatgggttccaaattcctaaagcagaaagcagctttatttattggtctgctaaaattcaaatatgctgcagctattttcaagtgagactcctttattgtatcataatgggataatcatcaacatattcatgaaatgaaaaagcaaggtgcaaaagagtacaacgtaccagacacagacaaacacatgctatacatgcataaaatatctctggggagatgtggatgaaactagtgacatggatgtctcttgggaaaggaactggtttgacaacaggtggctgaggagacttacttttcactggcttttgtaccatgtgtatatattacctattcaaataaaaactttaaaaaggaaatgcaaaagagtaaaagaaaatggaaaagggaaaaataattcttagttttatacaagtactataaaagtgtaacatttattaaaagtatgatacatgacttcaaaagcttttttctttttgttctctatattctacactacagaacctgtaatatggctactttagtacaaacaacctgataaaagagataatttccttaatttacatgtcaaaatatctgtccaaagtaataaccaatttcagaatacttgttaataacaagtcgtatcaatttggaacaatttttattacgtgatataattaggatgacattaatacatcagtgatggacatcattaacagataggaactcagaagattcttaggaaaagagatctaatggttctatatgtataaatgccttgaaaacatacacatagcattgttgaatgaattttctaaggcttcaacaatgtgttag

SEQ ID NO: 35717 - DNA, 738 bp, Bovine  19866881428688
cactcctacccacagctcatcacaacgtctgatttttcactctccatttcccaccctaccaccaactgttcagccaatattttcacctgtcctctcagtctcattcctatttctactacccagaattaaccatatcatttcacttcaactaatccaataatctaactgatctaccaggttttaggttttcttctttctctaacccattttataccctgctgtaagattaataagcataaattccattctgggtatgttaatcgactgttcaaaaaatcctaatggcctgttaaagaataaacttaaagcctagcgcacatggtccatcaagattatactccaaacctagagcctttgactaacgtaagtgataagtaagggctgatgtcctcggccatcacagcagtgggtgaagctgggggagagatccaatttccccagtgtgccatacagtatggctcttcctgtatgccacaacacaaagaagctgggaagcactgtctcgggtgactgacatccaagacatatccattatcaccgctcctgcactagcaggttcaggttcacttcagttcagttcggtcgctcagtcgtgtctgactctttgcgaccccatgaatcgcagcacgccaggcctccctgtccatcaccaactcccggagttcactcagactcacgtccattgagtcagtgatgccacccagccatctcatcctctgttgtccccttctcctcctg

SEQ ID NO: 35718 - DNA, 806 bp, Bovine  19866881601079
tcgcgtccctgcccgaagctattggaagcggcggcggctgggcgcagggggcacaatgccgtgggtggggcgtggacgtgagggcagcgcgctggcgtcacaggggcggctatataagtgaatacaggcgccgcccctccgccccagtcactgagccgccgccgaggactcagcagcctcccccttgagccccctcgcttcccgacgctccgtcccccctgcccgccttctcccgccgccgccttccgcaggccgtttccaccgaggaaaaggaatcttatcgtatgtccgctatccagaacctccactctttcggtaagtcccagacagtcccgaggggaggaaggccccggtggggcgctccggtctcaaacagggccaagaaagctgctaaacgttgtaggtcttcgtaaacttgggcggaggggaactgtcttggcccgcgggctgtagggccacggcctgggccttagagttggcccctgagcgcgaccggaaggagcgggcgggaggtcagcccttgggcgggcttcgcgtctcgggtggcgcatttactaatggctcccgggcctcttcgggccacacccgcccctcctgccacccctgcgtcacgtccggtacgtcaccgccgttgtcacggtgtcgggagggagaggcggtgccagcctaagtgacacccgcgcgcgccaatggggcgagaagtgtggccccgccttagagctcgggttccggccggttgcatcagctgggtggggcgccgccggcctgcccggctcccccgacacggatcggcttcccagggcggg

SEQ ID NO: 35719 - DNA, 762 bp, Bovine  19866881621164
acctatttcctttcctgcaactgaagacactcctaaaaacagggattatatatatttattactttgcttttagataaaataaaaattacagtcatgatccaaatgatcaagagcatgccattatgtctatgaagacttattttcaaaaaagattcaaatataaatcattaacataaaaaagggaaagtaatttaaagttctgcttcaatattaacaagtagtgcactagcttttaaagttttgctaggcaggctggggacaatgctcctctaagccaacttacaaactagcaaaaaatcaatattctcacctaaataggaaaaccacctggagactttagaagacagacacagatacaattttaaataaaacaatgagttctgacattctctacatttttgaaaaggataaaaggcaaagacttactaaaaaatatatacaagacagccaagaagctcaatgacactgcaattccaagatttaggtctactgtaaaagcaaacaataaaccaagccctccacaaaggagcagggtcagaaacaccacaagccatgaaaactgaaacagaggttcaatctgttgtcctgcaaaagttttcatttcatctgaaagagaaattaataagaaaacattatttaagaaataaaacatttgaaaatttcacattttcactataaacatttacctagctagaatgttgctacttaaccatgctaaccaatgttcactttgctaagtatctcattccttaggggcacatt

SEQ ID NO: 35720 - DNA, 798 bp, Bovine  19866881706500
aggctaccgatgccatggaggccttgccccgtagcagcagcttcaggcactccgcactgtcggtcaggcagcagtagtgcagggctgtgctgcccttccccgtctgtttgtccaggttcccgctggcaaggacggacgcagagagagagagagagaggaggacagggaagtctcaggtcagagggctggggtgctgcgcaggggactggggttcgtggctggcagggcctctcgtcctccggagcgccagcccagctggtggcaggaggtggcctggacttaaggccaacagggaataaacagcgatggcagagccggccaaaaaaagggggcgaggcacctgtacacccctgaccaggggctaggagagggacaggtgaactagggtctctcccactgcactgctaaggccccaccagtgtgtcccactgcaccgaaggctgggctgagctcttttcatcctactgacaacactcttaccaggaaggggaaaggccactttttctaaaattcagagtcaccaggctcctctgagctggcttgccctggaccaccctgaaaacaggctccgggggaatgagaggaccacatgggttctgccaacacagaacggactgggcaatcccaggacaagccactcagcccactggtggggcggccgtagtcacactgtgagcgggacagcagggctccgccctggacagacacgtggggacacggagggaccactgggagacgatgccccaggatcccgacaggaggaaaccagccacgttcactgttcctttttccaagcag

SEQ ID NO: 35721 - DNA, 616 bp, Bovine  19866881833210
tcacagatggctggcattaaggatcatgaatctatcatctgtcattatttcagaaagccggggatatgatttcgctattatgtttgtgccctgagattattctccctgaaagtgctcaggaaaacactttgaggtcgctagaagctgatctgggagcccgtgttcccagctgatcaggatggagtgcctctgggctttggccagggagcattttgatctcagggagcccactgccctttgacctcaaagctggcccagcatcacgtatccccctacgcgggtaggggtgtaagcccccgagtgtcccttgcagggaggggcagctgccccctgggagccgagacccagggacaccctgccaggtgcctgtgtcgtgacttccagagaaagcctgccttctggtcgctgtttctgcagccctgagagaccctgttctcgctgcattttgatgaggaatgatgctgtcgtttcccattcccttccacccagatctgtttttgttttttgtttttgtctttcaacaggctaaccggcctcccgcaaagcttaacctgttaacctgccaagtgaaaaccaaccccgaggagaagaagtgttttgacctaatttcacgtaa

SEQ ID NO: 35722 - DNA, 1431 bp, Bovine  19866881836044
aggactttgcaatgaaaccccccgaatttctcattctttcccggggagggaggaggactaggaccagtctctaaatgataggcagtctctaaattcctaagggcagaatttgccatggggattggctgccatggggattggcttccctggtggctcagctgtaaagaatctgcctgccagcgtaggagactcaggtttgatccctgggttgggaagatcccctggaggagggcatggcaacccattccagtattcttgcctgggaaatcccatggacagaggagcctggcaggctacatacagtccatggggttgcaagacacaacttagcaataggtaacatgttttagagataggtttttcaaagaacagactcagaggcttttagaagagaaatacatgctttcactcacattggccgcagagctgagtgctccccttgggattctggaatgtttctgtttggtcttcaggagccggatgagactgccctccaccttgccgtcaggtccgtggaccggacttctctccacattgtagactttttagttcagaacaggtaggtgtccttaaatcagggccagtgtttgattttgctcctgggtgtttctggggaagggatcaggggttgcctcactgcttctgcggtgtggccaacgtgctggaatttcctcaggtgtgactaggattacgcgacagcgaaacggctgcaggtgtggggtgttcccgtgcagtcttaacccctcctggtgtcaacagcatccagcttccagtgtcgggggctcagggggacgccccgtgaataggtctgctgaattctaagcccctggaaagcagcctctggctgcagcccccttgactgtcaagtgggggagtagtcccccatgacgtcaggcagagcagccaccagcttgtcctgtgaggttggagtcccatgacatcaggcagggcagcccccagcttgtcctgtgaggtgggggtcccatgacatcaggcagggcagcccccagcttgtcctgtgaggtgggggtcccatgacatcaggcagggcagcccccagcttgtcctgtgaggtgggggttcccatgacgtcaggcagggcaccgtgagcaaagggagagggaagcaggaagcagggctccacctccaacgcgggctgaggcagggttgtgggcgttttgcttggtaggaaaagctgttattttcaattagagcatgcctgtggagaggacatgcatgggcagtttccttggccccagcgctcccatcaggttcgtcctgccttgcttggtgcagggctggcctgacggtcggagtctagtcgtgaagcccagtcgaggtgcatcgtgtctccctgagcgtgggtctgggtgggggtcagggcagggaaggccagaagccatagaaactcttcagcaagtgcaaagcgag

SEQ ID NO: 35723 - DNA, 987 bp, Bovine  19866881915901
ttcctgcaagagtctctgattgcaccccctttgacggattggtggagggtctgaccttggtgcagtgaggggggggaaatgggagggcggccggccaggggagaactggggtctcacctgctgtggtctcagggattcacattctcatcctctcaagcccgtcccgcgtcggagtttcttggccctggatcatgaatgagaaccagtgaagatgcagctgagcaaggaggaggtggggagtgagctcttctgagagggacagccttcacagtgctctaaataggagatgagagacccaggttgggctctttccagaaacttgattcccaagccatttattttaggttcctattttaaatttagttttggcaaaagaaaaataaagcagctcaatgactttctctagtaggaacatctcaaactttgggtgatgtggaccagtaggccagacagacaatacatcatgtgtgaagagtttaccgtcctgatggtgggcaccaggcccagctgtttcagggagacgcccgcatgggctgtggtcatttttcaggaagcttttcaagtgtgtttgcaagaagagaaattggtcttaaaaacctcacctcgatcagtgtgtgaagaggttcctgttgacctaagctgggacagttttgcacatcaaaagacagtgattgcagtggatcagaacgcttgaagtataaatacatgaggtgatggtgacagtgatggtccagaacgctcattaatcaccatcggggttgctgggatcagtgcattatttttgaaggttgaaaagggaaagaatttttatgaaaaaaagtgacctataccaggtggtcagttaaaaggcccagaaggaggaatgagaggaagtgcgtctgtccttcctggccttgctggctgtttgtcctctgtgccgggttggttgactacccctggagagaaggcagcatcctttctcccaaggttgtcccaggctgggggcag

SEQ ID NO: 35724 - DNA, 1208 bp, Bovine  19866881938876
catttttaaggacttggactgcatttatctcataagagacattcaatcagttctgttacaggcaaaagacccttccagaaccaaggaaggactaaatttcctctgaagaaaaaaaagcctgaagttatttctaccactcactagaatattgagtatgagaatgtaaaacatttcatagatgtgaaatgcatgaaagaaaaatacatgttcaagtgcatcctcatgcaaattcagactgacaaagctagtccaaggacttgcgtccagagacagtcccacggtgtgttaagaagcacgaacaagcaatcagatgttacagagcagctggggaaacactgtacaaacgggattccaagaagggagggagggagggaggcagggagggaggcagggcgggagggagaagaagaaaagaagggcagcaaggaagcaggctcaaaggggctgattttcaatagttattaagtgactccaaaaatttctaacagaattagaaccagtaaggttgctcagtcgtgtctgactctttgcgaccccatggactgtagcctgccaggctcctccatccacgggattctccaggcaagaatactagagtgggttgccatttccttctccaggggatcttcctgttccagggatcgaacccaggttttctgcattacaagcagacactttaccatctgatctaccagggaagcccagaattagaaaatgctttcaatatcggcatataatacaacaaattttattctcatatattcagaaattttacaaaagtcaatttaaaaaaaaggttatttttgtgacttacacatcactataaaagaccactttccaagaagaaaaatgttaaatttacaaaaagaattttaaacgagtttttcatttgaactactaaatggaactatattttgtctttcaaccaacatgttaggattaaataagcagacttctgaatcaaagttttcatcttaccctgaaaaatcagcagaatactgtccataatcaaagatatagactctagtgatttggcatactgtgaggtatcccaaagcaaacacgaaacagtacctggaaaacaaaaacaagctagattagcgaaataaaaagattcattttgttaaagaatacattttaaactaacatattaactatatgagatggttcaaaaattgtaaacatcatgagatctacgccgcaaatgg

SEQ ID NO: 35725 - DNA, 949 bp, Bovine  19866880430163
tggaggagcctggcaggctgcagtccatggggtcactaagagtcggactcgactgagcaacttcactttgacttttcactttcatgcattggagaaggaaatggcaactcactccagtgttcttgcctggagaatcccagggacggggggagcctggtgggctgccgtctctggggtcgcacagagtcggacacgactgaagtgacttagcagcagcagcagcagggaggcttctggtgggtttaagcagagaagcaagagaactagattggcatccaacttggaccacgtgtggcgcagggtcctaagggccctccttttagccctgctcctctgtgcctctgcactgttacctctacttcctctctaattgttgtctctttccttttaaaacactgaaaaaaataaactgggcactgtttgtttccagaactgcttacagcactaccttcgtaggcaatttgtttttcctggtaaatccaattctccctttctgaattatggtttgggtgtttggttgctgtgacctgtaattcagcactgattttcagctttaaatcttcacagtggggtccagcagggcaggcacagactcttctggccttgtcagtgactggctttccttggaaagaagctgcccatgtgttcaagctgtggccctgttttgggtctttggtgtatccaaagcatacctagcttgtatctccgaggcatgtgaccaccctttctgactcacagatatctctgtccttggttcttccaatggttctccataccagaaatctgaatcagcctccgaaggtataaatcaaagtcttcagtctcctcttacacctgttgtatgcaccccagggcaaacacattgctttgctttgtttccttctactaaagcagtggctccaattattttgataccaggaactggtttcctctgactgcaggtgggggg

SEQ ID NO: 35726 - DNA, 3648 bp, Bovine  19866880517544
cttttacaactaattcttgagtatagacactatccagagcaatccaaaagagattctacacaatatttagggatggaatcagctccactcctaatctcctctctgaatcatagctctgtatctttctttaagtggtccattgggtcctgactttgcatatacaaaatcgaatccattcatctttcccaaaaacgagctttcctttttgactttcttttcttataagcagtaaaaaaaaaaaaaaaataagtaaatttataacaatagttcacaacctttcctggttcatggcatccttagtattttgttcattttttcacagtgcccctggaccaaaagaaatacttaatagttccattaattaagtagctagatccaaataaatttgtaagtatgtatgtcctaacaatttaattatattttaaaagcaatacatttaaaaatatttaaaagtaatacaaaattttaaataatattttgttttttaaccacatttacttaatagcaggacatatgcacctgttgggaccacacaacttctgcaatcttggaaccaacttggacaccaccatactcacgtcctgctttacaatcattttcatgcagtgcttgcttttaatcacagaaaccaccaaaaatccactttgcaaagatacaacaacaccaaaaggagcttatcattatgatgttgacattgtgacctgcatcaagctagtagtttttgtgatgtccagcagtcttagaatatagttatgtttccctcaaaatggtgaactatcctgcaacagtccctgagaattcactgtggtgtcccaggccacctccctcacagtttagggactgcagggttagaatgacagcttggaacatgctttgatagatgaatgcagtaatgactcccatgagttatgcctccttgtacccctactctcaagccaacatgacttgctttgaccgagacattagtaaatgtgacataggcaaaggcttaaaaaatatatgtactttggggtttctcctctctcgctgctagaaaaccttctgctgccatgtgggtatacccaggctatcctcctgaaggataaaacacttggtgggcagagggtccagtcattccaaccatcccagacatgtgaccattcagctcaagccaagataacccagactgaaagagctgcccactgaccatagaaaatcataaaacttttttcattttaaactactatgtttggggcattttttttaggtgattaaactaaacgatacaatgttaaaataactgtattttatactttagtcaataggaaaatcaacaagagaactttcttaattgaattgaatagagttattaaataaacgaatgcatgatcatttaattatccctttaaaattcttttagaaatatcttatgatttctatagtctcagcaacagatcttgaagtttgataagcatttcattgacaacaagattagaaacttgacttcatttgtttgaaccacagttcctaaaattataatgtaagtgattattaatctataaggaagcctgattgtaaaggaaaactgtgaattttaatttcgttgtcaaaaaggtgactataaattttgttgcaaagtataagaatagccccttcaacaaggtcagaccactgaccactataactaagtggccgaaacccagctgcaaactcagaactaagtgaaaatggccttagagcaacagaaatgtttgccacaagatgctgaaccttgctactaatcagagccattcccaaccaaatgcttttttgacatagcatagtctcaaccacatcacacagatggtcagatggaacggctgtcagcagggaaagtaggccatgaccgtgaaggtacaacatggagctgctctttgggactacctgtttctgtggactcagagaacatcaccattccacagcacaataagacatgttcttcgtaagaatgagactgcatatcaggaaaatattgaaggcttgcggaaataaattgaaagcccttcagtaagatttccattaaaaatgatgaagaaaaatagtatacatttttgaggtagtaaatgctagttatctagaaacttaacttgtgtggaaaattccgtttcccaggagccattgagaatgatgatgatttgggcacctccatgaattagaggtctttatctgcaccagctcaccctgggcttgttagtatctacagttttattttcttgagtagaagaattctcccacccctcaatggccccaagatgtctgaggcactggctcttctcagacttcagcccatcttcccaggaaggagaccaaatggggcagcgggggaacaggatgaatatggtctcatttcggcctacgttcctttctgaccaggtgaggctctgcagaaaatggaaaggaatggagtcagtagccacagatcatgagggggctggttcctgtgtgagcgtccacgtaaggaggtgtccagatggaaagagatgacccaattccagatctcctccttgtggccaagaccctgctcatgccaccaagaaaatcaagacaaaagaagaagggaaagcacacactagccaccatgaacacagaaagcacagtggtgaaaacagcctgaaaaaactgaaaacattaattgctcagttatgtctgactctatgcgaccccatagtctgtagcccaccaggctcgtctgtccatgggattctccaggcaagaatactggggtgggtctctatgccctcctccaggggatcttcctgacccagggattgaacccaggtctcccacattgcaggtggattctttaccatctgagccaccagggaaacccaaaatactggagtgggtagccattcccttctcaagggaatcttccagacccagggaagcctatacagaagcaaacatgtaatgaacctattttatgtcattacagaaactttctaaaatagagatgagaaaagagagaggaaaagagcaaactgtatacatagatataataagtgtgtttatacatgaagtactatattagaatctatgtgtcaatatgggcaacaatggattgttttgaattgctacatcatatccaattttattgacacaccttttaaatccatcccatgttttttaatgtttgaattctattttgttgttattgtgatttcttgcaggcatcaggaagccccaattcaaggctatttgagcaataaagaggagactgacaggtggaaatcaagatatcaaccttagttttgatttaaattgcataaagaacatgggtcaggtatgcaaccctttgagattcctaaagcagaagctggaattaaacagaatttcccaaaaatgcacagacagggctgggaaacctcagccttcccagtggaggaacgccttcccataaaagcgccccctgcaggaagctgatgagagcatatgctctccacaggcagacattccaaagcctcctaaaagtgggattcctagtcaaagctgaaagcatttctgaaactttgcacacatactatccaactgcagagaaaggtggtacagacatactcccaacagcaatgatgaaagtgcttcctcttcacaccttttgttattgtgacaggttcaaatggtatcacgttg

SEQ ID NO: 35727 - DNA, 1713 bp, Bovine  19866880394742
ctcgatctctaactgtttttacaaatgcttgttgctctttatctggatctttttcgtctacataaaccccatgggaagtacaccaaaaggtaccttcttagtatatatcttttgagttcctctccctggatagatattttgatatcattcacctaagctctggcctccaaaagagcgacactactcaagtcgtactcctctagccacaaggtcagataactggagatgggagttgtattgttgggtgtgttgcctctcacataccgagacatctgggaacgactgggactgagacagcccttgggaactactgctggcgctgatgctatctcccagttcaatccttttcacactatgaacatgcaaaacagctaatactagtactacaagaaatatacctggacagcaaacccctaggctgatataaaacacacgtgtagacatggctggagctgcatgtacaggatcataaatgggttcttccgctagtcgttttgtccaaggctgaagttttccttccttaatttctggatggcaacttttcctttgtttcaactctaagatgtgaagctttttgaagttactgtcaagttgaggtgcatttagtgtcgtaacttcagaatctactttgccaggacaggacagctcgagcccaaacactgatacagtgggtgggagttctggggccaaggggcgctggggcggcaggcagcctagcggacccaagcggtactggcggcagcctgccggatccccatcccagggagaccaccctgcacatccatcctgctgtgagtgcctgcctctaccacccaggagaagccaggccacctgatgctgcccacctggcctgagcccttgaaaggtgaatagctcctaccccggccaccctgctggtgttaactgatccatgataaagagcgctggtccttcaagggcctagagcagtagagaagggacctattccttcagcagtagtaagaagggatcagagagcagtagggaagggacctacttcccttcagcagtagtaagaatgttccagagagcagtagggaagggacctacttcccttcagcagtagtaagaatgttccagagagctgtagggaagggacctacttccctaagtagtaagacaggaccagagggcagtgggaagggacctgctggtctttcaagggccgagaggagtatggaagaggcctacttcccttttgaagtagtaaaaagggaccagagagcaatagggaagggacctgctggtccttcaagggccgagagcagcaggaaaggggcctacttccctcagcagtagtaagaaggaaccagagagctataaggaagggaacctgctggtacttcaagggccgagaggtgtagggaagggacctacttccctcagcaggagtaaggagggaccagagagcagtgggaagggacctgctggtccttcaagggccaagagcagcagggaaggggcctacttcccttcagcagtagtaagaaaggaccagagaacagtagggaaattacctacttccctttagccccagtaagaagggaccaaagagtcataagggaggacctgccactccttcttttgccaagaacagtatgtaagggggctactcccctcagcagtagtaaggagggaccagagagcagttcagaagggacctgctatccttcaggctagaacagtagagaaggg

SEQ ID NO: 35728 - DNA, 1349 bp, Bovine  19866880459231
atgcgaagagttgacttattggaaaagactctgatcctgggagggactgggggcaagaggagaaggggacgacagaggatgaaatggctggatggcatcactgactcgatggacgtgagtctgagtgaactccgggagttggtgatggacagggaggcctggcgtgctgcaattcatggggtcgcagagtcggacatgactgagcgactgaactgaactgaaatgaaaataaaaaagtcagaatgtaacaagtgttgacaagaatgtaaagaaaagaactttcaaagactgctggcaggaatgtaaaaccgtgcaggcactttgaaaggcagtctggcagtacttcaaaaagttaaacatagaggtaccatttcacttagcaattccactccactcctagatatagaccaagagaaatgaaaacaaatgtttatgtacaaaattatatgtgaatgttgataatagcattatttttattggaaaaaaattatattttggaagaactcaccaataaagtgacagaattccaaaatcaaattgcatgaaaatatacgttgcaatttctttgtacaataggtgagaaaactctgcagtatcagaagaatagaggcaaagaaatgtgaagggctaaggagaagggatgaggataaatagcatttttaatagcaaacccagaagttaagtagaaagcctgtcgctatgcctgctttattcatccatccttcacattaggtaactgagggcaaaaataaaaccaaatcagagttttgtgttgggagtaaattgcaatcattttaaatctgaattgaatccagaactaactctttttagttcctagggataatgactgaattcaagagctctcaacgacaagaaaatgttattgctgtatccaatctgagagatgggtgcaggtacaatacaaaagggacaaagcacctagtgatgaccgctcctctgaagtcatcattaaaaatcaagtagttgcttattgagtacttcggtatttgaactaaatgatttgaaaacttcctggcagacacaagagataaaagtaaaggggagtgtgtcaaaacaaagaagatacaaaagtttagtaagtggaaagagtttaatgaagcctcaatggtttaaaggaaattaaatggaaacttttaatcctaattgctttttatctgacatgctttaaggagtcttttaaaactgataagaaacaatgaatagggaaagaaaacctgctaaaattttttagaatttacacgattcttattctactacaagaaagcattatttggtacaaggtgtatttgtggatgtacatgaacagtatatatattatccggatcatg

SEQ ID NO: 35729 - DNA, 1861 bp, Bovine  19866880461471
taagcccttgctgttactctaccccaaatcctttgtcttatttcagatatctcttctctttttagaagactttttgtctctttttgattgtattgtgcccttctttgtgcccctccaaattcctgtgctaatgttggaccatttaatacatattgtaatcgcctttttacttctgtgagaatcaggagctaatagtcaagtgccaggggatgcactacagactacaagtatgattaataggaatttagcagaagacaagattatttggtaaattgtttagggaaggcctcatggaggaggaatatggtacttgaattggaccttgaagggagcattcataaaaagtatgataatggttggcctctataggtagattaaatctgttaaatgtccatggatctaggctatgaggagccatgctgggggcaaaaaccatgacaaaaccgatatgcatggacatctttcagcattacttttgtattacttaatgaaacaagcagtaggcacagtcactcctgtagaagagaagaatgcaaagaacatgtaaaagacttttctagaacttgtgtattgatgaaatatataatgagaagcaataatatactttatggaaagtagaaggaagttttcaagggtagttttgaccatatatgctaatttaacaatctatccacctatgtttataaaattccactggacttctaatgcaagattcaataactaggtgatttctggacaaattataaaatctctgcaagactcttacagctattgttggagaaagtggtctgagtaatatactagtgtttgtccagagaaaggttagaaatgagataactcagtgtagaaatttcctgtccagatagtgattgtgctctagtcgcccctcagttgacagtaaaaatgggacttgcagatcttttccggaatgtctgcagcatattttgcattcataaacaaaataaccagattgaaatacaacttctttgcattttcagtatttaaagaatgtcttagaatggctgtttaaaagtaaaactgcatttcttatattttgcaacacggtactgatttaaaactatttataaaagtctgctttgccagttaggcaaaaatattagacttagaaattaaaaaaaagaatttccttcaaattttgagaaaagaagccattcatgtttaaatgtaaataaactttcacttttggctctctctgggtttcactggcatgttggggtgttaaatcttagttgttgaaataaacacctctgattcctcaaaaaattaaatattttcttcttagttaataacacactttgttcagttttttatggcactctgagttgtgttgcacttacttatcatgagaccaagcttcttgaggaggatggcaggaattatgtgagaattagaaacctgttcagccacctagcaacttctctctcagttgctctcttgggtgctttgtcccctcttctcagtttgagccaaccagtgcctcttgttggtgattcatatatttatacacaacacacacacactcaatcatgacagtggtgatgacttcacagctgtgtatatatatcaatgtgtaagaaattatataatttaaatgcctacaatttactgaatgtcaattatatcttgttaaagcttttttaaaaatcctaacatgatgcccaccatcgatgggtcattactttattaagccccgtgtctccaggaactgttcagactttgctctctttctcacctgctcctctcaggggccctcatggcctgcgtccccctacctcactagttctctgcctttgttcttatccccagcccccatcattctctatccatgctagagcactgt

SEQ ID NO: 35730 - DNA, 1667 bp, Bovine  19866880504528
tcacctggaaagccctgaactgctttctttcacacccaaagtaaatatgtcaggaaaatggagataagaggagaggattaaatctgtaaagaatacttcacatagtaccagggactctggtagtggtgggaagggtggtttttatattaataaggaaagattaataatagtcatctccatactcctggtgggtatccttcttgacacaagcagatgagtcattgctgttttgtctgcttactttctgcagttgttacatttactttagtttctccaccactttgttagcttgttgcttcttcgctcttttcacgtaaggaataatgattattaaataaatgttttggccactaagtgactggtcatgtcttctgtttctagttattttggacacctggaaggctgtggtgcagatctacataaagaaattcgagacacttactatcagtttgttctgtttttggtcaaagcagtcaaaggattcaatagcaaaaatgacaggtatgagagagtttaatgtgatttctagagaaaaataattgccgttttttctgacttttaaagaaatgcatgtctaatgttaaaaatacagaaaagcacaaagcgtaaaataaaaataacccctaatcttgctatctagagctagttgctactgttaacttatcagtatattttctcctagccttttttctctatggtatatgcagttttttaaagcagatgggtcttggttcatctaagaatctgtaacccgttatctcagttttaaaaacttgaaagccattcgccagtctcctccatagtaagtggtgtagacataaaccttaaatcaaatggttcttctctgtacctgagcggcatgacccgggctcgttgtggttggccctgatcttgccgttgatcagagctgagcagtgttactcagtcctttcctgtaaaatttctcctgtggtagtcttggcggggtggaaaccttgctacttgatgctttcagaactcttttgcttaagatgttctttgaagagggtttgtatggagtctgggaaatttgaaaagatatcgtaaggaacccaaaccagcagtgtggggttcccttccgctttccgctgacagacataccccgtctctgactcccactgtttctgtcatccccgtgggtgatgggcagctttggtaactttcaccttcatggcctcttcaggtccttgctgcctgccctgtcctgcatccagacggccctgctgcaccttttggacatgggctgggaacccagtgatctcaccttctttgttgacattcagttaccagatctcctcatgaaaatgtcacaggaaaacataagtgcccatgacagtgtgatcaggtaaggatacaatctccagtctgcagtttcttcaggaacttgtgaagttcaggggtcgtagcaatagcacagggctttagagctcaggcctggagccaggctctctggggggtatcccggcattgccacgtcctcactggatgacctcggacaactttttaaactccttttacctcagtttcctcatctttagaactggaggtgatgacagcatgtcccttagaggatggctgtgaagagtgactgtgttctcctcagcgttcagcgtggcgtctggggcacggtggtgtgtatgagttggtag

SEQ ID NO: 35731 - DNA, 785 bp, Bovine  19866880537414
tcttcttcagggcacatgagggctaaataaaagcagtgacaagtgataaactgccattttagtcagttcctgcctgttgccactcagaatgtgtttgagtctaacagagaagtgtgggaagaaaaaaaatgtcaaagttgtggaggataggtaggtgaaagtaggcgtacctatggcagaaactgctgtttcaaaaacacgagtatatacacgttcattgagtcagcgttttttttttatatcttttcctttcattgattcttgtatttttggctactgaataaattgtaacatataatcaaatccattttcatcctttgatccttggtcacggctttggaaaattgtttgccagggtagaaaaagactgtggcagaaatgtggaatttcctgtggattctaatcacctcctgctgtgagtggtcctgaactgggcatgtccagaattgacacctcttctttttcatcccataggactcccttacacttgtccatcatggccaggaatgaatacgtgttcaatcagctgctgcagtgtaaacagtacgtagggagccctggagcaatgaaaggagctgttgggagggtgggattgtgagtaaaagataatgctcataaaatgtcttttagcactatcaattttaagaagtaaaagtaagattaaaaaaatgtccttcagaatgagactgttgacagtacaaagcatctgaagacagttgtactcggtgttcacattgcttcctcatttcaggttagatttagagcgaaagaccacgagggcagca

SEQ ID NO: 35732 - DNA, 1211 bp, Bovine  19866880601168
ccccacccatgtccctcccttccccctccccttttcatccccagcgaggcagccagcgtgtgtcctggctggccatcagcttcctggtgctctcctggctcttcacactcatcgccctgatcatggctgcggtcggggcaaccacatggctgcagtttctcttctgtttctcctacatcaagctggcagtgacgctggtcaagtattttccacaggtaccttcaaggtctgcccgccttttcccgtggctgttagcatgagagggacacggatcccttgggggcagcttctgactggggcaagatgtgggttggaaagctaccaggaggccagcgagcccagcaggagtgggacatcacaccaagccagccgtgacctctgcctgctcttccctgggcccagaaatcccatggggaagttggtagcatttctctgactcgcgctcagctctgagagtcggggtcatgtagatcactctcgtctctctcctttgccacctttctaatgacttcagtcttgcccgccaccctaccaccgctgcccatgaccaccaactgatgtccctgacaagccacggcaggatactggggagatgagctgggaggaggcagcccaccagcacccagggtcctccttgtgggccctcaaaccctcccttgagtgctcaagacagtcctactcagagtcggggactgagagtcacacagcttccgccacagccagaatggcctaggaccagtccaggtatgaaagaactgacaaccacaggctctactcatgaatctgggacctcatttaactcgcttccccagcacagggaaccttttgttccagggactcaggaaggagaaccttttggccagagtcagggccagtcccctggagggcgtggaaacagagctatgcccttaaggatcagcagcactcagtcccatggaccagggaggaggggccactccaggccagtgctttcttcacaaaggtgctgtcggaggaggccttgctggtggagcagtgtgaagctaggaaggtgggatcggggtccagggggcttgggaaggaggcttcagagtaggggaagggtctgggggaagtagggcctcagtcctgagtgtgggaaggctcgggcctgggaaacctgggaggcaggagcctcagttagagatgtactaggaccatccaggacggagaggggcagcaagcacgaaaga

SEQ ID NO: 35733 - DNA, 725 bp, Bovine  19866880601799
ctttcaccgtgggcgccggtctggcctcctccattcgagcggaaggagagcagccggagtcgcccccgggtgaagggaggccgccgggtgggagtggaaggtgacgagggctcctctgctgggacggaggacacttccaaaggcaggagcgccactgctggggggcagcgtgggctgcacgtccgggccggggctccggtctcctgcagtagggggtgctgcttcggtgggcgatgcggaggcttggaaatgctcttccaccacagagcttgtcctctggcgcttgtccagtggctgcaggtgatctgtgtcatccacggccaccgacctgtcacagctttcttttgaacctccacccgtgggcaaaaatttcaatagtagaagactcttctgataacactctttcgctgaacgcgaaaaaaagcaagaaggagaatgaagaaaaaaaagtccaaatgaaacttgttgcctactttggaactgaaaataatctacttaaagtctacaatttaggacaggaaataccttcaatacagggatgtacacatctaccgagagaagagaatcgtattttctctcattatacacataaaaatctaacactatcagcacacttcaagttttattgtgcacattttcacacatattaatataatatagacagaacagtataaggagtcctccatgtacccctcacccagatttaacagctatcaatccaagga

SEQ ID NO: 35734 - DNA, 3201 bp, Bovine  19866880630537
ttgcacaggggtccccaagccccaaagaccaaaataacagaacttggggttagggaagggagccgacaagagggtctcccactctgcacagctggggatcagtctttctggcccacctgcaaggggtctgtccaagtgggcgggatggggctgagacagtggacttgaaatccttgctcagcagcagcatcttagggagcctgggacacctgcccgctggaccccagtgaccccggaagaggaagtgaggttcccaggtctctagggctgtttgcattcaagtcaaacccatttacaaaccaaagtggggcagctacagggcaaccccagcccctctgtcttctctaaagaccacgcccctgccctagctgctccactgctggcacgaatgcgacagacaggaggactcgggccccgagacgggcaggcacctacaaggccttgtggccaagccagctttgcatggcatttccttaggcttctctggtggctcagatggtaaagaacctgcctgcaatgcaggagtgtgatccctgatcaggaatatcccctgcaggaggaaatggcagctcattccactcttcttgcctggagaattccacggacagaggagcctggtgggctacagtcccagagccagacgctttcactttttcccttggcctgaaacacctttccctctcctgttccttcagatttcagcagaagcgtgccttcccccagggagacctcctctgatctccctgtcctccccaccatatcttcaaggcatccctggaacccaccgcctgtctctatgtgtggttatttgggatgaatgacttgttcccttctccaggtgaactcaggggaacagggaccctttccccaaggtctggcactgttcctggtggatgctgggtccttgataaatatttgggaaggaaggaagggaagaagaaaaaagaaaaaggaagggagggagagagagaatgagagcgaggaggggaagctgggacaacaagagggtgggaatccagtcctcctgcctccaactctcccaaactctggcctggcacctgtcccctgaactagagctcgagaccctcccagcttcaaagtggagcccccattgaccaggctgtcccatgctcactcccgggccttgaaggaggtcttcccagctcagcagctgaacgcagttgaggaaagccatccgcacaggaagaacaggactcacagtctgggagtttcagccaaagctccgacttggcttccttgggtcatgtgcctgtttgagtcccaacctctgcctgggcctcagtttccccttgtgcacaatggggagataagccttgatctacggggcctccttcagagccagaagcatgcagggaagagcatgaatacacaagggtggggaagccaaggaactgagtttccaaagttgggaaacactttagggaacagagctggagagcacgtgaggccggagaacagcctggacaaatggctaaaactagaatgtgaaaggccggtttgtagagttgtggagagaccggtccgctgggatatgtgtgggagccagatgggaaagaaagggctgtgacttctgggttgaagggtctgggttttatcctactggtcatgggtcacagggagcgaaggaaggttcttgagcagagggatgaagtcaagaaatcaccagctcaggctgatgataaacagagagaagtgtggaggcagggaggccagggaggaggctgttgcaaggcttgagagagaaggtggggccttctctgagcaggggcagagacacatgaagcgcggcaggaagagggaagctgctggagaacgcctattccactttcacctgcaggcccgcaggaccctcacactcctgtggccccagatgcactcctagcctcctatccccagccgctcctccgcgacctcagggctaaacctcttacccaccaggagttagctgtcattccttactttctctcatcctggaatctaatccacaaccaggtccttttccatcacagcccactctgacttttggtctgacttttgacttttggaggtgaagtgtcagttgctcagtcgtgtctgactcttttcgaccccatggactgtatcccgccaggctcctctgtccgggcaagaatcctggagtgggttgccgttcccttctccaggagatcttcccaacccagggatcgaacccatgtctcctgcatggcaggcagattcgttaccgctgagccacctgggaagcccatacctcctcctttttcttcagaatatatgcggggtcctttcagcctctgttctcccctttagtcctgccctcttaacagcttctaggagggacgccattcttaaaggcaaatgtgacctggaaccctcactgcttaaaaagtcaggccattaagtgatccatcaaggttctcagcgtcctagccctgcctctctgatctactctcctgaccctcgtcctcgtgcttcttatgatccctccaggcagagggactgagccactgtctctagcacacgactgagatttcccaccttctacgtagggtgttttttttctgtctgcaacagcttcttcctgtgtccagatccagcagcaaagacttacctttcccccatgctccaccttcccctgcttcaggtgagtttggcaggcatgcctcctgccacagaggtggtaagctctgccatcgtctgtcctgtgggggatttagacagcactgggactgggtgcgaggcttggagctctcagtacctggcagctgggaggtggggaggacagaccagccctttggacagcgtacctgtgcccacgtccccctggccaccagctggttgtctaggtgaagacagagggtataatggggcacacagcaactgggcaagaagctggggtgtgagatgactgtgtgtgagtctgtgacagattctgcggaggggtgcccagaagttgtcatgagggcagcagagcaggtgggcatgctgacgggtgtgtgaacctgccaggtgggggggccagagttgctggcagttgctggccctgcctggggtggcttcagaggcagggtggggtggggtgggctggagaaacggaacatgggccaggctgccagagcaaacagacaagccttctggcgcttccttccagcaaacaccaactgacagctgagggcggggtgg

SEQ ID NO: 35735 - DNA, 1718 bp, Bovine  19866880661996
cacatcccacctcaaattacagttgcacgcacccctgtcttaaaccctcccaggccacaggcctcatgagggcaggagctatgtgtccatttgtctgacctggtccctgcttcatccccagagtctagcacagtgcttggcacacagaaggcactcagtaaatcagggaataaacaagataggaaattagataaacaagatgaaggaaggatgactttcaaagtagtatcagtactatctgaggcagaactgagaaaccacgcacccccgggtgctaaccagttataaattgtgtgcaagagataattcagagatgggtatgtgtgcattttaaaatgaaagagatcaaggtaattgtcaaagagtttttaccttggaagtcctgtaggtgtgcaggcatctgcaggtgagtctgaaatttgaggtgggcaggaaggatccttccttaatgatacaccttcactggccttacttctctgcttgcaatctaaaggtctgacttccttaggaccatctctcttcccctaaaaacaaattggagagtgagtaaacttttatgtgaaagaaatttttttacattcagacaatttaaaaaatcactagccaaggacttccctggtagtccagtggttaagaatcgccttccaggggcttccctggcagtgcagtggttaagactccacactcccacattcccagggcaggaggcgtgggtttgatccttggtcagagaagcaggattccactcccatgcagcagagccaaaaaaaaaaaaaagactctgccttccaaggcaggagatgcagaaaccgcaatttgccacaaagaagactaagagagcgagccagggcagggtacgctgcatgcacacagctactggtaagaggacccaaaaggtatggatacctcaggaatcaaaagaatgccctgggggttccttagaaaaaggatgagtccagtccctaggcagggaaagcctaagataagcctgaaacctctttctgtatcaaaaattaaagaagtgatcaaataatcatcaagacatagccaaggacacaaaagccagctggaaggagcttccactggccaaacatgggacaacctgagcatcaaaatcaataataaagactaagcttttaatccactaaataaaaaaattcaagtccattttgataaaaataagtgaacaagtagatacataaggagtgctgtgctgattggtagcacattataagctgctgggggctcaaaagaagatatgattactctcgggctcaaaggcgaagagaagattgctgattcaccctgcctctgctgataatgttttccctgtcccaccacaatccatatgggaacagtgctgcctggagaagggttctgcggtcaaaacaggcttgaaggttatcacatcgcctgtccttgtgctggctctctggctgaatgaagctaatggaattttcaagcttttgccatctctgcttttgtcctcctctaaaagacgacaggatcccagggaacgataagtaccaacggggatccttcatgacagagacaggggacagaaacagcagcagctcctgaggcaaagccgaggcgctgagagcaccaactcaggctctgaaggcagcatcacggatgctctgcctgttcttgcacaaaacgatcttcagtgtcactgtcacgggttccgtctggacccaggaaggcttttcttctac

SEQ ID NO: 35736 - DNA, 3594 bp, Bovine  19866880680977
cagcctcacctgcaagcaggacaggcactgactgttggctcctttcccctcctgcctgttgttctgcgtacaggagggcctgagtctttctctgattcatccatcaggtagaaaccttgctgcaagaagtatgcccggccacacacaaccgcacttccaaccaacacctacgcatgcatcccatcagtcagcctccatccactgaccctaccgggtggccagcccagtgctgggggcacagaaaggaccaagaccccatcagagacagaatccaggggctggctggggcaaggggaaccacaggagggcccagagtgcagaagacagcattgtggaggaggtgacagatgagctgggcctggaagtgaaacgaggctgggctgggactaggggagagggtgaggagccacagagtaagtgatgaagaagaagtcagcggggtcagaaccagatggctgtcggccttgaatgccaaggtgcaggatgtggacgttatcgctcagatggcaggaagccatgagaagcttcagaagcagggacacaaggcactatctgtgctcccaggagacaacttcccatcgagacctgttcgtagtatgggggagcctattggcaattaaagggcacaggaggctaatgagaataagagcagttgatgatttgagtgcatgctctgcaaaggaaagcactactctaacccttcacacgcactcactcactttattctcacatctctaagaggtaaatgctttacagatgagggaactgaggcacagagcaattatatgactcacccgaggtacccacagttaggaaaatgtggaacctggatttgatccctggccccagagcctctccagcactctaccacccttcccaaaggctcaggacgctttctcagacatttaactcagccccagacctcacactaagacccagaggccaatcaaacctggtcctcccagccctggggccaggcaggtgggaacaatgctcttccactcagcagccccaattctgtagcaccctcctcctcaaaacaagcatcctacaaagctgaaaacctcaaaacaatacaaataaggctcaggccatatgccaggcctgggtctcccaggaatgtttccccttggacaaggctggctatagaaccaggaatagacctgcttcccaactagcagctttaacagctctttaacgagagcactcgttagcaggagccaccacaaacctttcaatgatgttcttttatacacctttgcctgtttctctgactggtccagatctaaccaaatgtagtaagcgtgaagcagcccacacagtgcttccagtcagtcagtcaacagactctgaatctgccctgcaggtactccacctgattccctactggaaaccaaccttctccctagacagagggcaggacaggaactaaaaggtcaattgctctagactaggagggtgaataggcttctctggtggctcagatggtaaataatccacctaccattcaggagacatggatttgatccctgggtcaagaagatccccttgaataggaaatggcaacccactatagtattcttgcctggagaatcccatggacagaagagcctggcaggctacagtccatggggtcacaaagagtcagacatgactgagtggctaacacaacacttaagaaagtgaacagggacaaaatactttgcactgccaggactggggtgtgcccagcacggatccccagagccatgcacctgtcagagtcaaacatgctacagagatgggggaatttccatatttaagggtgtttgatggagatggtggttctgtttaacacaagattcacaaactcaccaatcaggactgaagagtggtcttgagaaaatgaccctcccagcaaagatctggtttggcttcagggtctttctcaactccagagccaggaaggacactgcccaccagctgggacaagcctcccttcctctctacccagtctaggtgagacatcctgggatacaggtctccccgtcacctctctgcccaaagcatccctctgcatctggcctccctgcaggctcttgggagccggtccagggcccaaccctgatcatgctcatcccagcatactacctaggcatttcctaagaaggaatgcagggctgaggactttgcacccatggatgaagagccagaggaacccaaccaaaaacaggttagacaagaatccaggactccttcctcctggcccagaattccttcacttcagagaggactacacactgaattctccagccacaaaccaactgccagcctctgctgcagccaaagcctcttggccccaggatgcccctggcacagacaatagcagcctccattgtcacttaccaagtgttcacgactaggcaagccaagtgccctactgtgccacggcctttgaggaagccactgttattacccccaattttcagatgaggtgccgagaggctcattgaatgacccatagtcacacaactagaaaaggcacagcccagctttagacagctcactgtgccatttctgaaagcaaacgtctgcattggccatcccactacaaaagggactcaccagctggacgcaggcacaccccagaccctgcgggtgcagcgagcttgaaggctgttgtgctccaagggagagctgagctggtgtggcgagaagagccgcccctgccctgcctccgtgagggtccttggcccctccccaggccacggctgctctgactggcagggacgggctgtgggtacgctctggcaatcaaagaaaatgtttccagcaacagcagcagctgcagttgccgaggctccgattcccagaggaccccaaagcctttcccatcatttttgccctttgttcagaaaccacttagctgctgcccctcctccagccgtgccagggccacagtgcactcagccacacacagcccagaaccagctagagctggtgacttcagctctcaaggaaggagggaggtgctcaggcctcccagatctactagcctggcagacagggtggtctggggtaacagctcaacaaacagcatgaccagagatctcaaagccagggctctaacactgctccatttcccaaatgcggaaggaaaggaaagggtcgtgtcacccatcacacaatcctgacctggcaatcagggatctcctggttttgggtgctgcctttgctaccaacactgagtgacccagagccagtccctgcctctcaaggacctctcattccccgtgtgtccaaatctgaggtaggaacggcagcgggaacacttttgggtccagcctttctttctcgactggagttcctcccggaaccacggaacacagaaaacgatgagggtttattttctgtttcctagtatgaccctaaaggaacaggaaaaaattcatcaggtccaatagggcttaattcccttccagaaactgcctgaggaaaacctcaaagtttttcccagtgtgcataccttataaggttgtataaggttcactagggcttcccaggtggctcagtggtaaagaatctgcctgccaacgcaggagacgtgggttcagt

SEQ ID NO: 35737 - DNA, 1523 bp, Bovine  19866880743459
ccccccggaggtgggcagcgtgcgcccctcctcgagcgtgcggccgctgagccacgcccacctggcctctgcaggcttcccgctcgccttccttgtttcctgcctcctgcccctgggccttgccaaccggccgggctgggtttctaaggcatcacgggcaccgagcttccccaaaggatgagtcccgccagggagagccaggacgaagagaaaggccttgtgggagccctacccaccccctacaccccaggtgacacacattccgatcctgtccctggacacgtgcgcgcggaggtcatgcagacgggggaggagggccgggagaggggccacagtccttagccccctgccggcagggtcggctgttggcatgagggcggtgggcctttggaggcgcgggatgagcgtgctgccgggcggccctgggcgcatgcggggggctcaggacgcagcctcgtcttcttggacaccgggcagctctgggcttttgcctccttcgccaaacccgtctttcctgttcaggggacaccaggggcagagggacctcagaggtcagaacatgcatgcaggaggacacgctcatatacactcataggcatttttatccacatctctcaaatcccccaagctcagctcagtctcgccaccctgcactgtggtcccttgctggttccccacccatagtctcagcccaccaccctccatggctccctattgcttggaaaggaagtctagacttcccaccctgacttctggagccttgccagatctgaccagacatggcctggctcaggccccatggtccagggtaggagggctttggttttgctttttctttgttcacaggacagattctacccatcagtcttgggattctgtcccatattcagtagattcccattatcatcctgatatcacccccccccccacaaccccgtgccagggcctttaaaaaaaaagattaataaatgggttttggtatctttaaaaaggatccatcccatttacttctactatagagttatcctaaagcataaagaacagagtcaatcaaggataaatgttgggactctgatggggtaaaacctacttttcaaaactaaacctgtgacatgtgtgcatgctaagctgtttcagtcatgtccaactctgtgaccctatgcaccatagcccaccaggctcctctgtccatgggcttatccaggcaagaatactggaatggcttgccatgtcctccaggggatcttcccagcccagggattgaacctgtgtctcctgcagctcctgcattgcaggcagattctttactaagccactggggaagcctgtgtcacagaattagaatttttatatctaggaaatgttaagccccatcctttcacagtccagatgaaggaactgacctgtctccccactaacgtgtccataaaagaacaatggctgccttgctcagttgtacccttggcgttcagccctgtgcccgtcattgacctgggctgcatgtgtccttagcctgtgactgg

SEQ ID NO: 35738 - DNA, 905 bp, Bovine  19866880828660
ctacatggactgtagcccacgaggctcctgtccaagggtttctccaggtaagaatactggagtgggttgtcacgccctcctccaggaaaaagaaattcagagagctataatttgttttttttttaaatccatgtgcaggggcaagaacaaagatattttaactgattttagcatatacagaaaatttgctctgattcttagataaaataattatgcttgggacctgttttcctcttccgggttttgacatcgacgatcacagccctgttcttttcagtaaagtgcttcaagatgatcacattatgtggttcattggcattatccatatacacacagcgggtccccacacagaggacctaaacacgacagagaaagaaagggaaactcagaagtacatagaacacagtctcttttgcttgtgctgctgacttcaacaggcagtcagggtcaggattcttcccatctgtaagccgagggttggcacaggcctggcacagaactggtttaagtgcttgctgaatgaagccatgttttcacagtcttcattgttccaactagttgaaaattacaaatgagatcaagctgaaggccaaagtgaagaacaatcatactttgaagttctctgtaacttattaataggggggttagttacctattattcaaagccaactactggctaataaaatgagtcaaatggctaaactgttaaaaatgtacgttgaacaaaccatccccaaatcttgagaatataccagtaccgtaaaagcaaattatgtaagggaaaaaaagactcccaaggatatatgctatagggactttgatatgcctgatgaagacaggaagaggataccaggccttcagacaggtgtacctgggggaagccgaccagcaccagcagtgtgaag

SEQ ID NO: 35739 - DNA, 1020 bp, Bovine  19866880924835
accccactggaaaccctgaccttttctgactcaaacccctcacatgccatagaactgacactgaaaacttgctgggttctcttttgaggtagaaagcatgaaaatccccttcctgacacgaggtgtcatgactgctttgtgtccttccagtgataaggatcctggcggccttctgctgttacctgagaaaggcgacctggctgacatggacatcagcgaagtgctagcggtcatgaacaccctgctgtctgttgccgctcgagaggtaaccagtgctgctccatttccttggcttctttaggagacagggaggagcagtcatggctccttccgctttagccctcgtttttggtgtgactgtaactccatgcctttgagcacagagcttccctgcctgcctttgctccacgtcaagtaaggggacgttttgccccgaacaagtgaggggacgcttccctgcctcgtggtagtcggccagcagtaaagacccgaacgtgcccatgaagactgcctttgaagaagaggaatgggtacttaccgatgccctggtgtcagtccagtgaacccagcactgagtcatgtatttgtgctgtgaattctgtgggaaatcacttacaactgtttttaaaatttatgattactttgcaaatcttcaggctgatcaaatctgaaaggatgatctcttttctgtgctaatgatttttaaaatatttttttccttttttttcaacatgaagggggaaagcttgagaaaggctttttggaggaggtggtactggagctcctcatgagcccactagtagcgtctgaccaggcagagagggaggggtgttcttgctagaacagcatgtgtaaccggtgacaagatggggaggagccggaatttgaagaggagagtgataacagctagactttgagcatgttgggtttctggtctggcaggacttcatgtgacaaagtctggttgaacacttaagctgagtcagtgctgggaaggagatttgccatcataaccaacca

SEQ ID NO: 35740 - DNA, 1238 bp, Bovine  19866880959745
tcactttcactttcccctttcatgcatggagaaggaaatggcaacccacttccagtattcttgcctggagaatcccagggacgggggagcctggtgggctgccgtctatggggtcgcacagagtcggacacgactgaagcgacttagcagcagcagcagactctgaagtagtaaagtcattcacaatactgagtatgttgctagcatactgagtcatactgactgtgcaagtccactgaaataattaaaataacctttgttaacatcaacagtaacaatgaaaatgctggtatctcagctgcaattttttttaaaaaggggtggggggagaacctacttctaaacaacagacacttgaaagtgaacaagtcttgtacattttcttaataagtcacagtgactcatgctcgagtaatcacaatttgcacatattcccaattttcactgtttccttcaaccccaaatggagatcaaggggcacactgttgatcaccttcacttcttcagaataaaacaatgagcaagttagcattcccgaaacattcacgcagcaggtcttcactgtggcacatgcagacgacagagcctgtcagtcatgatctccttcttcagtgaatctttttctagtctacattacaactcactgacggaagaaaaacatcttcaacagattttcaatgattaacaagaaaaatcctcgaacacttttccctcacacacacaaaagcacacatggtaaaacagatttctactgagcacaaaagaagcttatccaaccccaaaaagaaacgtctttgagcctgcaaatgaataatgctttttccatatttcatgccattaataaagctcatttaacagcatgtcttgataaaacaatttcactaatcacttgttttttgtgttgagaataaattttgatgttagccgctttgcaactggttttacccatccatcttctcaaaaaacaatgtggttttacttacttttaccacaagtaaaggcttttttaaagagggaaataaacgagacaagttgcaagggtagctcacagacataaataaaactgaatcaagtacacaagccactggcacaatgaaaactccgtcgtataaaggaagtagcagacctgatattgataaaaacaaatttatgaaatgaaagataatctcaagaaaatttcctagaacacagcagaagagaacaaaggaagcatttagaaaaatatacaaaagacagga

SEQ ID NO: 35741 - DNA, 1259 bp, Bovine  19866881074012
ttaccagctgagccacaggggaaacccaaaatatagtggcgtgggtagcctatcccttctccagtggatcttccccaacctaggaatcgaactgggatctcctgcattgcaggcggattctttaccaactgagttaccagggaagcccttttacaagtttaagtttacaaattatgaacatggcatttctaagtggtctcctgttatacccaagagatggttcacattctgttttcggtttgcttcatggcttagttatttcagagggatctcgcctgaacctgtcatacggaatggcagcatttggggactgcctgatggttgcagctcaccagggtgtgtgtttatgaagggtcacagttaggttctgctaagtgtggggaattccctgcaagtcttagtggccaggtttttttgtgtgtttgtttttttttaagcctttccttcatcagttcaaagattctcagtatattaagggaaaaatagaactctcataagcctccttcttctctttgcagagttaggcagtaacatggcagtacctcaggcaaaaatggcattagtcctaaactcccccttgtggaaacctgtcttcaggcaccaaatacatccagagttgggattagaagcaagctggcccactcacccaccccaggataataaggaggtatttacttttcgcttatctgtgtatttggaatgagaaatgtttactgatgtttgttactttaaattataaacatttgtgtatgtatcttatcaccccccacgaagctattagctcctcgagggcagaaactagggtcctcacaggggccagtgtaacgggtgttcaaaagcatcaactgacagactctgcagtggtaatatagtaggtgctcagtaaatctctcttgatggccttgtttaaatgagttgagtttatttcctgtgcctgctgagtcacacttaagaacagatggtgtatgctatgcttatttgttctccacgggacagtagcacattatttaggcttataatattataaactaaacaagcttttccactatgtctttttcatctctgtccccctctctcagttctactacttttctcccttcttcccactttcccccaccccagttcttcagtaattagtggctggatccagggactcttcttaacttctctgctccttcagaccctttcttcttgtattccatggcagtccactgtcttctcttacatgtctccactccccctgcctcctttattgacct

SEQ ID NO: 35742 - DNA, 1510 bp, Bovine  19866881088275
gacggaggagcctggaaggctacagtcctggggttgctagagtcggacacaactgagcgacttcactttccttttcactttcatgcattggagaaggaaatggcaacccactccaatgtcctgcctggagaatcccagggatggggaagcctggtagtctgctgtctatggggtcgcacagagttggacacgactgaagcgacttagcagcagcagcagcattgattttaagattgctttctcaattactatacaatatttaattaagatggttgtaaatatatataaataatactacctactcatctccacacctaagaaataaaaagaattctcctttacttatcatttccatgcacttgtgtaattttactgcatatttatgtacatgacagagagatctggctagtgtttaagttttatttgaggaataccatacctacgccttctacagcttgctatgttttgctcatcgtcacacttgtgagcgccgtccatgctgataacggcagctctactccgtctactctcaccgtagtatgggactatatggtaatacaatatccctacgaatgggcgtctcgctctcccaagttcactgctgtcacaaagaatgccgcagaatcacttctccaaaatgcagaaggccctctcctttgagaaaggcctcctctctgccgaaaaccatcatcagttgcccagaatctaccgcaatgcttcttctcctagtctaccaggttaggttccaccaagcagcctttggggtacagaagaaggcaagtaaggggggctcaactgactcctgtgtactctgacaatctaacttcaccaaattatgatttcaaggctcctaaattattttttatcctttatccatgtgcatcactgaactttagttctgaaaaacattcctaaagttatattcttgagaagagagctacttaccttaattcaaagatatggtagaaaaactcaaaatatataaaaatcgcaaaagaacatcttaccatccatattcgaatcccatcagccaaggaatacacctgtgcaaactcctcactcaaggctgtcttgcccccgctgtttactggggaaaggagaggttacactcagttaacacaattcactactgcaacattaagcccaaagtcacttcccaatctctgcacaggaaacctcttcccctgacacttgcacattgtctgtagtaagagaggactggggggaaaaccatcagtaaactacaaacacctgtaatgggttcctatgttacttgaaactgtttttcaaatgaacagcatctgaaatggatgtactattaaggtaaaatataaaaaatagtaaaagcaaaataaaaattattaacatgatagaaattcagggtatatattaagtgaaaaaggttggttatgaaacagtatatacaaaattatattatttaaaaagagtatacgggacttccctggtggtgcagtggataagaatctgtctgcaaatcaggggacatggg

SEQ ID NO: 35743 - DNA, 901 bp, Bovine  19866881097221
ttagaaaggctgcaggcagaaggagtgattgggtggcaaaatagcaccattgatgtttaaggcagagaatgatacgactggatccccggcttattgttggattagatgggatttgtctagttaataatcatttattggatggacgaggatgaggccggaggcagagtaaggaggcttccataaccaagccgagatgcaggaagggaatccagcctaacaggaagacttgtttctaaccgggaattcattacagcccctaaagccctgagccatgtggttccaaaactgctctcatagttaccttctgtatcctcttaaactgcaggtttctggggaaattcacagccatgctggtcatgtaggaatcttccccagagttagtcaggctaatgttcatggtcagctcctttgtgaggcccaccaccaattcctgcctgcacagggtaggcaaagagataaatgttaccagtttatttaatctgtgaaaacctcagtgcgatgcaacgatgcaacagcaccttcttaacttcttagatactattgcctaaaggatacatttagcctagatcttcttccccacaacagaagcaagcacctggactaccatccccacctcagttgctgtgtgacatgaccatttatttagtgtttaccatgtgttggggactgtgttaaatgtttcacactctctgctaatcctggtgataactctgtgaaattgtatggttactctctgtgctgcagtgaagggaacagaagccaggggaggctcgctcacttgcctgaggtcccacagccccgaaagagagttgggagaatcagacctaaatcctctttctatcaccaactcactgtgaccccaggcaacgtactttgagacacagattcatccatttcacgt

SEQ ID NO: 35744 - DNA, 1217 bp, Bovine  19866881136174
ccgggagagagtctgcaggtctgtgtaaaaacattcatcttctcaccaggcatgtcagggccgtctccgtggcctctcccaccttctcatacacacccttggcctagaggggcccaggtacagggagtcagggtcggggcagcccccggtctcacctcccattcaccgcctgagccttggagctcccaggcgctcctgcttccctccctcttctctccctgaggcctcatatgcccctgcctccagcactcttcataggctcacaacagccagtgcccacccaggccactgctacctccctcttgagccccatgcccactcatgcagttgctgcccgttgggcttgattcccttccgaccctcagtctacctccatctctctgtatgtgccactccagtgactgttccggccaaaatggcagctagaagctacctgagctcctccctctttcacctaactggtcaccaagtcccaggattttggctccaaactctctccaacccatgcctactcccctcttcctgaagctccagccaggactcagctgacatttctcgggcccagatgaccacacagggctccctggccctggtcttgcccagtctgttctgtcctccacactgagacttaggtgatcttctgtgaatgcagatctgaccatatcactcccctgctctataccctttgctatctgtctgctgccctcagctgggcatcagactgacttggtctggccaagtgcccccattcaggggcaaaaagcctcccgtgtgcaccatgcttctgctccagccacaaggaagagttcactgcctagatcacatcaggttatagtggcctgtggaccgtttctgggctgtgccttttgctttaaacacttcctagtgtttgtcccctacacctcttctcccaggcatccctggcctttctgccttttacattacagtcccccacagcccaagagccccagagcaaggttctaaagccaaaccgaggaagaagcggggagcagtgtggatggcagtgctcctggggtgtggcactcccaagcggcagggacttccaatcctgggagcttggatactctgggagaaaggtctgttctgagcacctggatactagggaagtcactgaaagtgggtagggacccacctcgttgtagtccagtgctgaatcattgcacagggcacagatggtcgccagctccaccagccca

SEQ ID NO: 35745 - DNA, 1480 bp, Bovine  19866881281277
cagcctctgggactcccactggctctgtctttgcctcttaaatctaaagtgaacctaagtaccgagcaatctacagattttagaagctgaggtttttatgcctgagccagggctctggtctctggtcccaaggctgtcctcatttttcttgtctacacagtctcctcattcagcttcttctagaaacacttgctcgtggatttcttacatcagggtctcccagcccccagtatccaggtggaaatgagtgcatttttccaccacttctcagggaacaaagcataggcaaggttcaccattcacatattcaaacatcatccaagtcttctggtcgctttcagtatcgcttttggtgttggcgccacctcagttccccatctaaacctgaaatgttgaggaggcccagggctgggggtgaggggcctggggccaggactgggccctggaagtgcacgtggagtgctgcttctggatcaagctctgcctcatggcccctctctttcccccaccaggactgcgtacagctgaaccagtacaagctgcagagtgagattggcaaggtaggcctgggggcaggccaggagcagggggaacttgtcttgggggtttgcagagccacgctgtctggatcctccacaatcccctctcctcctctggggaatgtgaggctgagccaagaaggtcctaccctggatatgcgggaagttttgtcctctacaggggatgggagataattcttgattcctgactccctggagttttatatgtttatttatttattgcctgtcctgggtcttccttgctgcatgggctttctctggtcgcgttgagcaggggctactctttgttgcagggcatgggtttctcattgtggtggcttttcttgatatcgagtgtggatctaggctcacgggcttcagtagctgcggctcacaggctccagagtgtgggcccagtagttgcggtgcctgggcttagttgccccatggcatgtgaaatcttcctagaccaaggatcgaacccttgtcccctgcattggcaggtagattcttaaccactgaaccactggggaagttctccccagattttttgatggacgggactggggaaggcatagagctgtgctgagcccagcaggggcagtgaccggggcatggagccctctccttgcctgcctgaaatttatgcccactggaggccagggtggagatgggatgtgggaggagatgggggggcaggagcagctcaggctccccttctcttctccccctagtcctgggggaggctgccctgtccagcaggggctgacctctgcctctttgcagggtgcctacggcgtggtgaggctggcctacaacgaaagtgaagacaggcactatgtaagtctggggaaaggaaggaggtgtcgcctacactgggccctagatgacttgggggtgggcagaagctgtgccaagacggtggacaaggctgcctgtga

SEQ ID NO: 35746 - DNA, 3098 bp, Bovine  19866881284876
atgatggagaaacgtcttggttcaagagttcccagaccatcagggacacaggagcccttagaggtccatgaggaagccccatgcccccaatattatatagaaggggaatcgttggcaggaatccaagcctcatttcacgaatgctgtattcaaccatcaccctaactcctgacgttggcaatttccccagccagtcctggccaggtgggcctcaagggaatggagagccggggtggggctcaggcctctaagcttgtgctccctgcttggccaaccccaggaggatgggagtttcccaggctcctctgctcccctcctggggacacctgcttgatctcaagggatgatgggagtagaaaaacccgcagggccccaaggaaagatgcgctggtgggggcccggcaggcacctgaagttgaagccttgagacagttttttctcctcgtacagcccgtggaactcgtagatgggtttgcagtgccgcacgtgccagtccaggtcacagtgccagtcgatggtgatgcccaccaccccgccctgccagggacacaggagctcaagatccagggtgtaggatcaggaactcctgcctgataactgttgccagcagtctcttgaagagggaatgtttttgtttagctgtttgtttgagaagagaccctgagaagctgcttgagggtttgaggtcctgtcaccctctctggccccagctcccacccatcaccctccagtttctagaatacaccaaattcttcccacctcagggcctttgcacatgcagtcacccctcccccagctcccattcctacaaggctgcctctttctcatcctttggtcacttctcctgagagtcctcccctaaccaccacccttagtctcaaatgtgcccctgtgagtccttctaaagtgttttcttctaaaacatgttttactttatagccatatatttattttctgtggttattcacccatgaccataaactccacaagggtgggactgtctcatttgcaccaattcctgagtcctagcatgggaggcaaggaaatcgctgttgaattaaagagtgagtctgtagggacttccctggtggctaagaccctgtgctcccaatgcagggggcccaggttcgatccctgatcagggaacatgccaaaactcagagttcgcatattgcaactaaagaaaccgctcaccgcaaggaagatcgacgatcctgtgtgacacagtatgacccggcatagtcagataaataaataacacatactttttaaaagtaagtctgtaaagacatgggctgggaagaaagaacctgagaccgtgaagctcctctgggcgagacaagaaccagggacaggtcggggtgggctgagcaagaggagagttgtgtcaggtcagagcaggcgtggagctaggcaggtaagtgggaggctagatgcttgcagacaatggtgatgggtgagaagttcccagtgtgggtggcagggagatttttaggaaaagggaaaactataacattcagctttctggtcctgtgtgttgctacagagtaaaccccctccgggggttggcaaactgaggattgagggccaaatgtggtttacctattgtctgtggttgcctttgccctgggttgttggaacagaaaccatgtgacctgtggctcatgcttattctccggccccttaaagaaagtttgttgacccccatactagttaaaggtatagtgaatgagggcttgccaggtggctcagtggtaaagaatctgtctgccaagcaggagacgtgggttcgatccctgggtcgggaagatcccctggagaaagaaatggcaacccactccagtattcttgcctggcgggctacagtccatggagttgcagaagagtcagacaagactgagcgaccaaacaaccacaaggggtgagcgagttgttttggcaggtgatgtcacagaaagggactgatttccatctctgagtcctgcaggagcctgatgatacgaatcatgggggaacatgtaccttggatgcctcgggccaggcagtgctgaagtgccatcctgtgtgtgaactcacttgacctcaggacaaccccgcaaagacttgtacttttatttctcccacttcacatgagtacaagctcagaaacacggaaggtagggaatttgtctgaggtcatgtggcttgttcaggccagagccaggatctgaacccagtcaggctggtctgtgctccttataaggttcccctcctctcggaaccccacgcgactgcacatctgagaattcctccagaatccccagtaaccccaggcaggcacaggacttgtcaagggcatggaccatggggtttaagttgcttttatctaatacttaaaaggcaggacttccctggtagttcagtggttaagaatccacctgccaatgcagggggacatgggtttgatccccagtctgggaagatcctacttgctgtgggacaactacgcctgtgtgctgcaacttctgaagcctttatgccctagagcccgtgctccccaacaagagaagccaccacagcgagaagcctgctcactgcaactacagtgtagtcaccactcgctgcaactagagtagcctaagctcgcatgcagcaacgaagactcaacgcatccaaaaattaattaataaacgaaaaagaaaaacagcaggccctcagaagatatccaggtcgtatctgcctatggccattcattctgggcacctcctcggtgccaggtccatgccagggcctgccaaggacacaggcctgcatctcaggggccccaatattaagggacaggtctgtatatatggtcaaccagaaccagggacttggagggatggggtggttaattgggcctgttaacccaggtcaaaaaataaggcccagtgatctggggtccaggcctccccacgcacccggcattataccttctcggccaaggtgctgaaattctggcctgactcctgtaccacgtagccgagcttgaagactggacacagagggtgcagggtcttgtgaaagaggcaggtcttcatgtagcgggcatccacctcctccaccaggttgcgcctgcg

SEQ ID NO: 35747 - DNA, 1057 bp, Bovine  19866881287737
cctccccaagtcccacccccatgtctgctccttctcaccaggtcttggatgacccagctgaggacaatctctatttgggtgagtgacccagctcatccccaaagtagcttacccgggtgggtccaaaggctccccagggacacacttgaccttcagatgggccttgtgaaatgcactgacctcctggggacagggaggaaagacatgttctcaagccccagattctctccccagccctactgagccagactcaggatatccaattagagtcaactagtattcccaaacccccacgccactgatcggagagacagtggatcaggcagatgcaagaagtaggccatgtgatgtgggttcccaggccctgtctgataactctgtgcctcagtttcctcacctgtaaaatgggggtagtaatggtatctacatcatagggttgatgtgagaagtaaatgagttattacgtgcaagacacattagctattattgttagtaatagtaatactgatgctgttacttaagtccctggtgcctgattcagggttgggcttagaggctttcagggaatgggccagaagcaacagaggcttaggaattagaggccaaggctttagcctccactccctctcatacctgccccttctctgagactcagtttccctgttaaaggggttcttgatgatgctcctcactcggcacctaaagttccagtgaggcaagttcacagtagacccattctcagccatttatcttctctgataccctgggacccctctcctgtctctccctggatgcctggatgcctgccccctctcccaccctccagaaggggcagagatcttggcatcagctgtgttttcagcctggctgcaacttacctactcttcttttcttctcttttctttcagtgtttgacctcctgagaaaggggtgagttccccatcgcgttcaggcaggacaggtcttcctttccctccccgtatccctaatcctagggtcagctactctagtgaaagaaagaggcccgggctctgtccttaggggagctgtggtctgg

SEQ ID NO: 35748 - DNA, 1416 bp, Bovine  19866881296878
cttgtgggcattgatgtgcctgctcccaacctttatcttcaagtcactgaggaagaaaaatacccacaggtataaaaagaaaaaatatcattataactaggtatagctggaattcacagccaatcagtatgtgagtactgactgaccaacatacttctgtgaaagaaaaaaaaaaaatcacagcaaaagtatatctctatgctagcactgatgggtcatatttataatgcattgctagacatgtttcctatttctaacttctagcttttagttcacatgggatgctctgctttcaaagacattccctaacatcacccccatgatggtgcagcctacaagttacaaaggatgactaatattcatataaagagtagaagaggttttatgtagcaaaaatcaagataaatcatcagggagaaatagactgaaagactaaagactgtgataagagctctcagcctaccatgctatgatgctccacaccgtattaatgcttaagcaaggttaatccaagaactataaataaattactttgataaaacaatcaagaatatgaaatatgaaacccaatatctggactcctgttctcatcagaaacactcagacctactattggccattttttaactcaaccatttataaagaaaaggggtgaggtatcttttcttcaaacatgtttccatatatatgacataccattatatgaaaagagctttccaaatagttattcatacttaactctgaaatgtcagatatcaaggtaggacagcatctgggcagttaacaaacacctaaggatgacccactaggctggcagaagcatgtgccatatggctaactggcagcaacccacagtcacacatcgtcatctccttgcttgtatttgtggggctttttacttgcatatttcccttgaaaataacttgttaggtcggaaagcctttagaaactaaatacttaaaaactattatgtacaagaaaaggaagaagaaaaaaaattttacatggattaactcatgcacttaaaaggagacaaacaagaatacggtttcaatacgatgcttgatgcagacacatttcgccccacaaaagcaatctctagaacatacattataattatgtgagcatatcaacaattccagttctattaaagaactaaccaagctgcaacgaattatcttagattaaaagaacagggtatttattaatactgttaacacagaacattattcacaaagaacagaattgacattctatttaaagcagaacgtaaaactgtctcatatcatatcctgtgataaagttaaaaaaatataatgaaaacaaagcacgaataacttttaaactctgaatgtatttacaaagtattacattctaagaacataaagaacagtcactgcttactatttctactat

SEQ ID NO: 35749 - DNA, 1428 bp, Bovine  19866881316891
aatggacatgaatctgagcaaactccaggagacggtgaaggacagggaagcctggcgtgctgcagcccatggggtcaaaaagagtcagatacgacttagcgactggacagcaacaacaggtcaaaggaactaaaatctaatagagggatttcataacacccccacccccacccagccctctttctctgtccccgcccccactgaagccaacaaagagtgaccagagcactggaaagatcagctaggctgcctgttacctgattcggcagctagggttgtggagttgatttcaaaacacaaacacacattcacgctgctgctgaagccaatgggcagcgccttgggagtgaagttcatggacaccttcagatgaaccacaggtcttgagctaaagtgaaagtgaaagtgaagtcgtgtccgacccttagcaaccccatggactgcagcctaccaggcttctgcgtccatgggattttccaggcaagagtactggtcttgagctaagtaagacagcaaaggggcatatgagaagtgaccacaggacttctggattagtgtctggctctctcattcattcagtgaatatttactgaacatctctcatatgccaagtgctccttctgagtcctcagaatatagcagagaaagagacaagccttgctctagtgggaaaacagacaactatcaaataaacatgaaaaaacaggaaaatcctctgtgccggaaaaggtatgttaaaaataaaataggataaggtaatagagactaggggctactgtgaagtaggtgcattgttattcacatttatagatgagaaaactggaacttagagattctgcccaaggacacacttaagttcaagcttagattcaaacccagttcaacagaaccaatgctcttaaacagggcactccctccctcccatcagtgcctggtgtcctcttggggtcatttagggtagggcaagggggtgaagctgctcagaaggcagggcagagccctacccggagtacagccgcccggcccagcgcacccacggtgatgtcagcaaggccatcgccgttgaaatctaagccaccggccaccgaggtgccgaagtactggagtcctggggccaccgccgaggctctgatcctctgtgggggagaaacacaggatgtcggagagggaaggggtttcctttcagttctattcagtcaacagattggtccactccagggacactgaggcactggaaagaaaaagtaaggttctcccaggggaaatggcattggaacagaggcttgaagggggtggggcttgaccgagaaggtaaggagaacagggggtggggaaacagtcaggggtcagtgcagtgggaaaggggagactgggtgccggaggcctgatgtggggccggggtgttctacagaatacacttcagaaccc

SEQ ID NO: 35750 - DNA, 1231 bp, Bovine  19866881336311
gccggtcatggaagtaccctgcgacaagcccttccccgaggagcaagctcgcctctacctgagggacatcattcctgggccttgagtactgtgagtgaggggctgcctgccccccctgggctggggacccgagaaggggacacgagaagggttggaacccaggctgagccggctctgagccgtacctgtcagtcagtgtcgatctgccaatcatctttagctgggggcgggtcaatgggcctgtgggtggggccgaaaacctcctgaacaggtagggtagcggcagatttcactgggcatgcgccaagtcctcctgggagcctgcttattaccgcataggtggatgttcttcctgtatctcaagcttagcctctcacagggcatcaggagctgtgagaaggagtttgtgtccagctggtcgaggaagagtcagtcctggcatggaatcggtgggtggcagcagagtgggtttattgtgaggccccctaaggtgatggagagctcagcctccaggttgagcatcacctccgggctcagcatcacctcctctccaggtgatgttagcttagcctctgtctcgaattcatttattcattcatttgtccatttatgggtacctagtaagtgccagttgggggcatgtagatgtcaaagacccagaagagatctccaggatctcacagcctagtgggagagacaggaacctaagcagtgcttgccaaggctggggaggcacaggagctgtcagagaactaagggaccaagggaggcttcctagaggagaccacttataagcagggttctgaagggtgaataggagttcactggccagtttgaggcatggtgggagggtgtaccatatggcagcagcatagaggggagtaggcatgtactgtctgagaagggagagttcagtttgtttgactctaaccagggagccggggatggggaaagatgatggaagcaactgtccaggccacaccttgagggctgggaatgtctctgcaaaggactttcatgatttcatcctgtcagccttgtgagacccagagggcttcgagcaggggagaggagtgatcggatttgtgtcttagaaagctctgtctggcagctgtgtggcggctggatggagggcaagaggtggccaactggttagggaggaggctggttttgcagcccaagtgacagatggtgagtcctggattagggctgcggcagtgggaagcagatg

SEQ ID NO: 35751 - DNA, 804 bp, Bovine  19866881414244
aagagctggggaggaaatcctcttacagcacgagcccagatgcacacacagagcatctcaactcttctcggcctcacaaatctcccactgaatgggacccagtcagagcagccacgatccgctcacagagccgccaccattcgctcacagagccctcctttccagtcttcactgcccccaagaataattctaaatgcaacctcctaagatttgctttgtgcctctgcagttatccaaaggtgagatttaacggtttcacaagaagccattcgggtttctagggtcaccattcacatcaggaggctgcccaggtctccatcaaggagcaggctgcatgcccagctcagagcatttcctgtcacagcccggcccctgtaagagccaacctccaggacggggaacagacccaatggtgcgtgctgccctgccaccccagaaggaagggaatgcttgaggcccttggcaccgcacacagggaacgcctgggaattaccgttatttccattctcatccacagcagcaaagtccactccattctccaagaggactgagcagatggtgggaaggtcctgctgggcagcaaggtggagggcggtctggcggtgcttggttaattcattcactttggcacctgcaagaagctggatgacgttgattacatgagcagctgctctaccaccaccaaccaaggtctggcataagggggcaagcctgccaatctcctgcccgccagggtttgccctcctggctaagcggggagctaactcctggggagcctcaggaccacaaaatctgtcccaaggg

SEQ ID NO: 35752 - DNA, 1339 bp, Bovine  19866881417793
caaagacgactaaactaacactcaatgcaaacagtattcgctcctctctacattagaaatcacttgtggctcacttgttagagagtgccttgaaaaattctgccagtttataagctcttgaagagcaggagtgtgccttactcatcatcatttccacagctcctagtggtgccttgaacacagtggacattcaggtaaatttgttgaatgaatgaatgtgttaatgaatgcctttcacagatatcatactttatgtatgtagcctattcaaagaagtgcatttcttatttctctatagctttatataccttatactttgatagtttaacgttcttagtaaacagccttagaattgaaattttaacattgaaacagtccatgggattgcagggttggacacaactgagcgactcagtacagcgcagcacagatactgtatacaaaaaactattaacttgagcatagagttaaatactgtatgcttttaagtaatatagaaatactcctagaaactaatagcacaggctcactattttaaattttttcacgtttgaattaatgctaaagtattaaagtcaatcagcagcagttgtgatatctgtagattttaaaatgctcttatgacgatgaaatgtgaatgagaaatgagggctgattgtaaaggtgacattatgaataaatcaagaaactctgaatggtcctttgtccactgagagtcacccacacaaagcatcacaaagcttcgcgctccggtacgcccacttgttctgcgctgaccccaggaagccaggagcctccttcagacctctcacacgcccccccagaagctcatgttctttcccaacttggaaggcatgtccttcccagctgtcccttctactctgaaagaactcatttgtccttcttcctgaccaatgtataagaaagtctctgggctccagccgtgtaggtggtaaagacagagctgagggcagtggacgctagtagaaatgtgacccaaatccgtctctggttcacaaatgcattcttttaagacattccctcctgtcctaaatgcccaaatcccccactctcaagatccttcttaaaggtccttggtctaattttacacctccctccctctccaatccttgcaagagcctctcctcccctctctcttaggccatggcagccaagtaaagaacattttatcccatgatttggaccccaaggaaacccatgtttacagtttcaaatatatttacaaaatcatactaatattgtcattatctgtaacatgtatatgtctatatatataatttcattcttgcaaaacaaatcccattagccaatttcattc

SEQ ID NO: 35753 - DNA, 1106 bp, Bovine  19866881455392
tcagtttttttattattttgaataatgcttcgattttatttactggttcacatgctttttgtggacttatgctgtgtttctgtggacatattttcagaaatgggtatactcagtcagaggatatgaacatttttaattggatagaaactgtcaaaccacctccaaggaattcttctcaagtaaactccttccaaaattaaacgagagtggtcatttctttttgatattctcaatgctgactattttgccttcagaatatttgttgttattgttcaatcactcagttgtgtccgactctgcgaccccaaggacttacagtccatgggattctccaggtcagaatactggagtgggtagcctttcccttctccaggggatcttcccaacccagggatcgaacccaggtctccaacccaggtctcccacattgcaggcggattctttaccagctgagccacaagggaagcccctcagaatatttatctctttaaataactagttctttcccaaagtttctagaaaaggagtctgtagggatgtggactacattgcaaggcatctttaaaaaaccacttaaaaaaccttaaaccttctctgtttctctgatttcttctccacccacagggttgctgctggtcactctcccctgccccctgccctctccacaagattcatttcctcctcagctgcttgttccccttccattttcccaaaatttagaagtagactctattttagacattcaggcaatacagaaatgaatttggcttattgctctatccctatccccttgaataaacatcttgtcccgttggcttcagatctaatttttaatgtaacaagaaataagacattgcgggattaaacgttgctcggattttggaaagctataaaaaggagggggacgggagagtggagttctgtaatcattattattgagatgccagtgagtccagacctgccctcacacctcttgggggtgcagccctccatcggagccccctttttagggcgcccttgacttctttgttgcgcaggctgtagatgaaagggttcagggtcggggtaaccaccgcatagaccacgcggccaggcggtcgtagcgg

SEQ ID NO: 35754 - DNA, 933 bp, Bovine  19866881471226
atcatcactccagaacccacaaagcagcagggccacacagttgcctgccattccccaaatatggcctggcctcccagcctctgagcctttgtacactgctcccccacatctgccctgtaatgccttctccccagagtcctcatgccaacccccaccctaccacagttggtaacatctctaccttccagccttcctaacctccccccatccccaaataaaagtcacctgtcttctgaacatgggtctgaccccaacatcaggcccttttcacagtctatcttacagtcttgatatctgtgtccatctcaaattcctaccagactatgacctcaaagagggcagactccctcatccctattagctccccccagggccccacaggttgaaggtgttcagaatacacctgctgattcatcacctggatggatgaatggatcaactgacaaacagatggaaagacagttggatgaaggactgaaggacaataagtgggtgtctgaatggatggatgagcagttgggtggatgagagatggcaggtgattgggtggatggatggaggggaggggaagacaggagggacactgagtggctgggagtgtagataaatggcagagagatggacagatggatggagggatggatacatgaagtaggtaggataagcctgcttatttatgtaaatctaaaattaaacaggaaacgggtcccacagtcccccagcagcagtagcagacagagcttgctgccccccgcctgcctcgcaggccagaccaggagggttcagtgacccactcacctctttcacagaaatgaacatggcccagatgagcacaaacatccttcctaagagctgcagccaccccatcttgtgcgtgagggccaaggggtgggcagggcctacggaggaagggagaggaaggataggtgcggg

SEQ ID NO: 35755 - DNA, 914 bp, Bovine  19866881552909
tgcttcactgcaccgtaggggttacacagctagagggaggaccattcaagcagcctgctggtccagacctgtgaccctctgctgctgctcaggccaagggcgtggtcattcagaaagtgggtatgaagagtccctggggctgaagggggcctgaaaggcagatcttactgggaggagtgggcctcacctctctttgcttcccttagaatcgccatgacatgctcttggtggagccgctgaaccgcctcctgcaggacaagtgggacagatttgtcaagcgcatcttctacttcaacttcttcgtctactgcttgtatatgatcatcttcaccacggtcgcctactacagacctgcgggaggccgggtgcgcctgaggcttgggcctcaagggggaagagggcaggggatgggcgttcctagaagaccccaagaccctggacccaggcggggcccaggagacatggaagggtcgcctggagatcttacattcctgttctcagtcttccttctcctggttgtcctgcacctgcttcgtgttctcagccccttcttcggcctcctggttctgagaggctgagcctgtggtcgctgaggtacctgattgtaggggcgggggtggggggggactaatgttggaaaggatgcaggaattagggggctggaagcagctctctgctatgctgggtgtcttcagggtcgtgggtggtgcaagccctgagcacattgccaactctctcttctgcccgcttttgttcactcattcacacatgattcattccctggacacagactttgagtactgcaaggccctggaccatgcatcagatcaacctaagatcagatttttcctgctatcagaagccataggctacctcaagtttcttaactgagtccttcattcaatatcccagca

SEQ ID NO: 35756 - DNA, 782 bp, Bovine  19866881702328
ccccagcaatgtcactggctatgtgacactgctggaaaatgccaacatcagtcagctctgtgagtcaaccaagaggcatcttgcccttctaactaagaggactggaggggaggaagaaaggtcctgttttttggcaggaagatctctgaagtagaaagcctgtttgtttttcttggagatctgatttgcgtctcattgtgcacataaaagtggttgttacttcacctattcggtgttttgaaaagttatagaaaagcagtaaaatctttttaaattaaaaaattttttttcttattagaaaattagaaatattgacacaaacaaaaaattattcaaagtcccactactcggggattgtaactgtgaattcattggtatggatccttccagtccttttcttattttgtgtatgtatataaatacacacacagacaatatatatatatttttaagaatacttaaaaataggtttgcatatatatatgtatatctttatgtatctttttacaaaagtggtgatatttcattcatgctcttttgtaactttgtaacgtgttgtctcaccatacattcatgcacacctttacttagtgttgttaagactgtgccttaattttaagaagctttttcttcttaaatttcagttgtttccatttttatactattacaaccttgcttcacacatagcattttggaaataatcacgattctgtgatttctttccaggcttatttcattcagggagccggaatgcttcatgttttgtctcatttctcctaatg

SEQ ID NO: 35757 - DNA, 1339 bp, Bovine  19866881724104
catttgcattactgtcatattgtacaatttatagaattatcaagtagcttagagacaatgaaaggtggcgagaactcaaaagagtgggttaaataaacactttggggaggcttcccaggtggctcagtggtaaaggatctgcctgccaatgcaggagacgagggttcaatctctgggtcgggaagatcccctggaggaggacatggccatccattccagtattcttgccaggagaatcccatgcacagaggagcctggtgggctatagtccatgggatcgtagagagtcagacatgactgaggacacatgcaaacacacacattcttttcttgcccattttgaagactcacaatctttcctgacagtatttgagaaactaattcctctctcaggctttaagtctgcttgcctctaacagcccagccaaacatcagtcgtggttttaggaatggttcagaaagatgattaactgtctagtcttttgtctctttgaattaaagtcacaatctttatcaactttttatttcttttttttttttgtgtgtgtgtgtaataaagttttattaaagtataaaggagatagagaaagcttctgacataggcatcagaagggggcagaaagagtaccccaactttttatttctttattgttgcctcagagcagggttgcctgtatagttgaaaaggttatgctctgacgaagttatacctggcccattatctgttacctggtggttgatcagcggggttgcatctgcctggagaggaattctttttctaatttttatgagaggaccagatgggctagatgcctctgcctcaaagggtatgccttggttttgttggtctgagttcttagggttattacagatgtatcagtcatcctaatgttaatttttattttttgtaggttttcttacagagactggaaaaaccagagcaagtactattttttctacaggaactgaatctgccttccaagttactcagatcagaattatggtaattcttctgctgccttctttcagaaatgttactactagttttaaaaatagggttgcattgcagaagtccatgtcactggcttttcattgattttagtgatttttctgtgtcaggcctgtagcagacacaggggcaaaaagatgaatatattttaagtctgtgaatggtgtgagtataaggatcaaaaacggtgaggaatcctttcttgggaagcaactttcttacttttccaggatttcatgtatttgagatctctctctgttggtttcatttttgctttaagctcttgaatcgaccacatactgggaacagaaggccacacaattccggccc

SEQ ID NO: 35758 - DNA, 982 bp, Bovine  19866881970217
ctacacttggttaccgtttggggtcgagatgtcctacgtcccgggccagccggtcaccgccgtggtggtgagtgcgctcgcgcgggctcctcctcgtcttggctagcccccactttgcagataggtaaactgacaccccaaacaggttgacacagcgtcgagcggggctcttgcaaacttggagccagagctccgattcccgctctgcctgagccgggccgcggtcttccccatccatgcaacagaagagtctgggacccagaaacctcctgaagagccaggatccaggccagaccccgcgtattaccgccgccgctttggacttctctcagccagccgggagcagcgaagattgaggagaaaggctccggctgtgggagtctgggaaagcgcccctttcctggatctgtgtccccagctgggcagccgcgaggggcgggcgccggccccgacgtctatgagtcgcagcctctggaatgaggaagtgcttcctccgctctagccggcgccgccgcccagagggaggcttgcggggtggaaggtggccggggccagcgtagcagccagaccctcacccctcctgtgcagcctttccgtctcggacccaccgccgcccgggccagggtgaaggttcatgcaacgggctcgatcctgatcgaactttccatggattcccagcccttggggcaaagtccaggccccctagctggactttggggccctgaggagaccttttggggtccgctcaggccctactctcctcccttgggtcgtctcgggtgccaagtactattagaataggtaaaggcagacggggacattagagccagatgttaatgccacagctggatgggacctgcaggccccattctgtggctgaggtggggaaacagacctagagagaagtctgctgctgctgctgctaagtcgcttcagtcgtgtccgattctgtgtgaccccgtagacggcagcccaccaggct

SEQ ID NO: 35759 - DNA, 1379 bp, Bovine  19866882015047
ccgaggagacccagggtgaggtggtaggtttcattcaggtggcctgcgtttgagatgacgacctggaacatgagcgggagcacatgctccaggtctatcagggggactgtgggatcctgttaagagaggagaaaaatttgttcaataagacatctaggtaaccacaccaactaaacactccattgtcttcatgtattatttaccactggcctggtgccaggggaattatgcagtgtctttcacaaatggcttaggtacaattgactgtaaaataaacattctcaggcatcatcttacaatcttactttcaattcatattcttaccccagggatatacagatgattgcaattaacatttcagtatatggctttccaaaaattttttctatgcataacactaccctctcatgcactctttctctctttttatttactttctctctctcttttttaaatgccattttgtctcttaccgagtttaagggaggtaacatggctgctagtaatcccaaaatcctcttctgggaacactccgcaaacacctgctcagggcttggaataactgccttttcctcaatgggcttctgagaggacgcttctgaattttcagcatctgagttgtaaaatagcaagctatcagattttgccaggttccatgcatgtatgaagacgcaggtagatcactgtactgccccgtgccactacagcatcgatactttaaaaacctattactgaacacgtcttactcaaggaagcctgttccgatcaccctgttttaatgttgagcctgacctcccatctccccaaacccctctgccctctccattccctgctcttttgtgctcatggcatctaattaccttttaacacaccatatcctttttttacttgttggttattgtttgacttcccttctagattccccccctccccagtaatgtatcacaaacacctagaaatgtttctggagcatagcagcaactcaataaatccctgatggctaaagcaactgtacgtgactaggatgctgatcctcagatgggatcagacaagagtgagttttgatgatctggattgacatggagtatcagaccgcttcctgaacttagaatcatgatctgcagagatgagcatcagccccttctgggacagggcaggacgctgggtgctcagccctgcctcggtcacagaatgggcaccagggaaggaggctgcctccccaagctgccctaaggaggaggctgatgtttgctgccagtctcctcggtccacagcacctccatctcctggctcttcaatcgtcctgcagtacagctctgaccttgccgccgttccgagcaggcagcccagggcctccattgcaggggtgaagcacccct

SEQ ID NO: 35760 - DNA, 2396 bp, Bovine  19866880186564
gtgtccgactctgtgcgaccccatagacggcagcccaccaggctcccctgtccctgaaattctccggcaagaacactggagtgggttgccatttccttctccaatgcatgcaagtgaaaagcgaaagtgaagttgctcagtcatgtctgactcttaatgaccccatggactgcagcctaccaggctcctccaacaatgggattttccaggcgagactactggagtggggtgccattgccttctccagtatctgcttaatagatacttattcaatggatgaatgaaattatatacagaggcaatcaggtatgagtggcatacctggaggtataaaatttggggggtataaattactgggagatgtccagcatgcaaagaaaaacaagacagagataaacgggctaagtttcagtttcatccttaaagcagagccaccaaaggctctgagtaggaaagccactcggtttggtttgcattttggaaacaacactccccatggtcatgatccaggtgaagcccgcaagcaactggacactggaggcatttaaaacatgttttcaaaagggctactgagtgcccagcataatataaccttttacatatttgagaaatctccaagctggggcaagcaccagccaggatcagcatcagcctctggacacatcctctgagcagtgatgggtcgccctggtgggacaccccagagccactttttcaagggaatcggtacccactggttgttcaccggcttctccccctgtatcagcagttctgacctgtgggagcctgggtgggagggaggcacccacccagattcaggaagctgaggagtggattcttcggccagggcagatcccttcaaggagaattttcctccttttgctctccataaactccgtgccattggagggcctgggctcaggcttgcggctggagattgggtatgtgaggggcttttaggcatggcagttctctccaccctccaccctgagtggggctgcggttactactgcttttccagggcagcccagggactcttgctgtttgcagccctctgccctcaggctacccgcaaagctttaccctgtctggccagcaggccaccaggcagcgtagatgaaaggtactgttcacacttacggtgactggaatgctctgtctgtaaactgggcgatgtagagaccagctcataagcacctcagtctgttggtggatggtgggtccctggtgtcaaccctttcattggcttccctccaggcacaggcttcttctgacacagtcccaggacagcctggctgggagtgtccaggcccagtgctcaaggatgcctgaacacaggttcttccctttctggccaaagcctacatcctgcacccaccctcatcctatcctctcttctagaaccatccaccacctgggaacctcctagtactaccccagccctcacctcattcctctgactaaattctgagtcatgcacagcttgtacccttctactttcatccctcaatcattcatgcactatttgtcaagacttgccctaaacctttgcaagaatttgatcatgtaaatctcaagatctatcagaacttagtggctgacttggatttgtatctctggggccagagggagtcacacgcactcctggctgcaaggagagctaggaggagctctgagatttggcttcccagtttccatttgggaggtggcaatgaggtgggaggggaagaaggtggggaaggctttaaagaagtcgatcagctctgtttgctccactgttagccccgtcatccccatttggcagattcaaaaactgagttgcatggaagagaagtaactttctccagatcatccagctaaagagtgatggagacatgattagaattccagcctgacagctcctgagtctgctcttgtatccacccatcttctgtggggccctcatagtgatggagaagtaggggcattcatgataggaggtgcaatggttccagtagaggcctgttgtcttggggagggagtggagtcaaggacaactctggaatttctgcctgaaatggggcatgttggaaatgtaaatgatactgtcaaatttttgaaggacttccatggaccactctcttcaatgtcttggttgtaattctgataacaagtgggcatacctgcctttgcaagatgaaaaaaatcgtagctcactgagattatgtgacttgtccaaagtcacatggatggtaaataaaggtgacagctggatgtgacctgggtctgcgtggcctcaaagtcaagtcgatgaccacgtttctccacgctgccttcttacgaggaaaaacgggaatgcgaggcccggccggcttctgtgaatcgcgagttgttggattcctgtccttcttcgaccc

SEQ ID NO: 35761 - DNA, 2536 bp, Bovine  19866880457676
ctgaagaaggctttcttatctctccttgctattctttggaactcagcattcagatgcttaaatctttccttttctcctttgcttttcgcttctcttcttctcacagctatttgtaaggcctcctcagacagtcattttgcctttttgcatttcttttccatggggatggtcttgatccctgtctcctgtacaatgtcacgaacttctgtccatagttcatcaggtactttgtctatcagatctagtcccttaaatctatttctcactttctctatataaacataagggatttgatttaggtaatatctgaatggctagcacattataaatcattagtagaaacaggcagtccttgccattaattaagagctgcatgttgagaaaaagataaaataacaatgagttttatttttttatattgatagtttagaatttgtcatatcagtttcctattatatgtgttcagttcagttcagtcactcagtcgtgcctggctctttgcaaccccatggactgcagcacactaggcctccatgtctatcaccaactctcggagcttgctcaagctcatgtccgtcgagtcggtgatgccatccaaccatctcatcctctgttgtctccttctcctcctgccttcaatctttcctagcatcagggtcttttccagtgagtcagctctttgcaccaggtggccaaagttggagtttcagcttcagcatcagtccttccaatgaatatccaggactgatttcctttaggattgactggttgaatctccttgcagtccaaggggactttcaagaatcttctcccaacaccacaattcaagagcatcaattcttcagtgctcagctttctttatggtccactcttagattcatacatgactactggaaaaaaccatagctttgaccaaatggacctttgttggtaaagtaatgtcttttttttttttaatatgctgcctaggtcggtcataacttttcttccaaggagcaaatgtcttttaatttcatggctgcagtcaccatctgcagtgactttggagcccaagaaaataaagcctgccactgtttccattgttttccccatctacttgccattaagtgatgggaccagatgccatgatcttcatttcctgaatgctgagttttaagccagctttttcactctcctttctcactttcatcaagagactttttagttcttcttcactttctgccacaagggtggtatcatctgcatatctgaggttattgatatttctccccgcaatcttgactccagcttatgcttcatccagtctggcatttctgtagtcgcatactttgaatctgcccaggtattagatctatacattaataaaactggatatgagtgtttctgttggaaaatttcactgaatcattgcaaactattcatgatcctctatgtatttggctgtctggcttgtctaatcaataaagacacctaaagagtaggcagatctccttacatgtattatatgaagcattaaatgtcttactctgattaattttaaattgtaatattttctttactccaaaaactatctatgaaatatatcaggaacttttcttttctccatacatgtttcaagcaaatgctggctttttaacttaaaatgttaatataggaatgtttgcacatcacttctatcatctttgatttaaattaagtggaatatatcatagggaaagagaggaagagccttaaatattactagtctctaaacttcatgaggacagagaccttccccttcttgattgcactatatcactaaaacaccccaaaagaatagtgttttaagaaaaaaaaacacttaaattgagccaagtggaatcaaaggccctattttctggaaatgaagcaaggacattcattctaaggacattgctgctcagaagggaagaaatccaagttttgtgatattgatatgaagatagtttccatggagtgcaaactcaagcaaagaacaaataactctctcctccatagggagcttttgtgctttccctaacaaagtgttgccttggacttcagagaggacatattagttctactcaagggactggaaactgtccttaggggaaatgaaagttaacttgaagtactgatctcattgattctcttttcaaatgagttgagaaatggtcaccatgacctgccttgagtggatctgcccactggccctatgccttaggccacaaagactctaaaaatagccaaggcactgtaaacagcctgttctttaatactacttctaataataataatagcaaaataataaaatgaaacataagaattataataagagcttccaataggggccctcattacatgccaagcactacttgaagcatttgacaatactctgaacaactgacaattctctgaacaactcctgtgatgtattattgttttacaaattttatatttcacaaatgtgacaacccaggcttgaacttgtccaaagttaagaagtaaaaacaaaatgaaatgtttgttgaattgatgg

SEQ ID NO: 35762 - DNA, 1706 bp, Bovine  19866880461465
ttttgcatttcacgtattatccaaatccagtaagtcccctacatacaaaccttcaagttccaaactttcaaagacgcaaacatgcacgccagcgcctgtatgccagctgctgtactgtcgtacggcacttttcaaggtactgactgtaagatcaaacaggttttctttgttttttgtctttctttttatgtttgcatcatacgtgtgacaagtatgatagacctattacagtacagtactatatagcccattatgttagctgggtacccaggctaagctaactttgttggacttatgaacaaacagagcttatgaacttgctcttggaatggagttcattcatatgtagggaacttactataacttaccatatccagcaaggcccccttgccagggcatgtcctgataacttccaggccctaaccacaccacgctgcttccatatcctcaaacacaccaagttatttctcactttgggatcttaattcccatattcacccattcctctaatctagcttcacgccaacctgattaagaaatggacagaagacctgaatagacatttcttactttgggatcttaattcccatattcacccattcctctaatctaacttcactccaacctgattaaaaaatggacagaagacctgaatagacatttttccaaaggaaacacaccacatgaaaagatgctcaacatcactaatagttggagaaatgcaatccaaatccactatgagatatcacccaacagctgtcagaatggctataatcgtaaaggctacaaacaacaaatgcaggcaaagatgtggagaaaagataaacattgtactctattgttgggaatgtaaattaatgcagccactctaatctaattccatcctataggcttgttagtatctacccatcctccatcatgaatagcactcaaaaagtctttctctgactcctggattaaatagcccccaagttacactgtctctgaggaggctctgtgtttccttatgactctctattacagtttggtactctgtgtttttatgtatgtgatgccttatttgaagtctgtctcctgaatcagattacaatgcccacaaaagcagagattatatatatatttttgttattgttgttcacaactgtatccccagtacttagttgcaaatgcatataaatatttaatatcatgaaatatttgttaaatgttgaataaacaaagctgtatctttaaccacttctaataaaaatcaatggtgttttcatggtaacaatgtttcattactttttcagagttaaacctcaaaaatactgggaaaacaggatatctccaaattgaattttctagacctttggaatcaagggattttagagttgaagggaaataaaaagtcttctcatccaatttccaacctggaatgagagtttttaacttttctaatcttacaatccttcatttataaaatatattagtatctttcagtgatgaaatggtggaactaaagggttttttttttaactacttcccaattgactgctattttattactgttcataatgcaaataatatttataaatgcatttcaattctctggtttatgcagggaatctatgtgatagggaaaaggtttgtccagatttcatgttactatcagcatcattatcataagcaaacttttactgatcaggggcctatataatatgaag

SEQ ID NO: 35763 - DNA, 964 bp, Bovine  19866880501181
cgcccagccctgggtctatcccctggaggcagcatggagcagtagggagagtccaagctctggagtcagggtaccagccaggcctgctcacttgggaaactctgtctgcatctcattacagcacagccctgtagctgagcgatcaacaggcagactgcacatacgagccaggggacccagacacccccgggtctcagtgtctctgtctgtgaaatgggcataatattaatagcaacagcatgcctttgcagggttcctgggagttaagccaggtatctggcatacagtagcacctaataaaggtgtgacactttctattgttagtattcacctggctgagcaggtattcccatcagtgaaaaggagattaaaagcacacctgccatgggagattattaagaggattaaatgagcagatgctcataaagggcttagcagtctctgacacttaataagtgttcaacaaatgagagctctgatgattcaagtaggaggagaggtccacgtcccacggacgaagtttttccaggaacccgggctgtgggaggaggggctgtactcagcctgaacagggagagtctctccagccagtgactaaggctcgggggcaggatccagctgctcggcaggcggggcggagttgggccgatgcctcggctggcccacgttcagggtgatgcgtttttaccgtaaggcccggggaactccagagccagcgccggcctccgggtccctggggcctgacactcagcggccagcaatgagcgatgcttcgtaaaagaggctgaaactccacagccctcaacactgcaaatggtgagaaagatgaggatggagctggcgaggagaggacagactcgcgggtgtctgtccattcagactggcattcaataaatgccaccctctgtttgtttaaccatctgaggtgctacgatagcacggcaggtctgggtgccaggctgag

SEQ ID NO: 35764 - DNA, 1331 bp, Bovine  19866880594163
tcaccaagccaagcacttggtgtcttttttcttttttttgcaaatttgtgaaatgacaaaaagatttctcaggctgtggggaacagattgtccctctggcccaagtagaaggggggtgagacactgactgctgagtaagaaacatgcctaaagtacacagacatgatattttcatttcaacttcagcggtttgaataggatgactgaggctttttatagaattattgttttggccttgtaaattggcaaatctgttttcaatcaagtgggatcattgtctcttggagtgcaatatttcaaaaggaaaaaatggtacagtagatttagatgtgggcatctcagcatccttctctccacggagacttagtaagttgctgtattggaataggcgtgtgattcatctaaagataacagacatgtgtcttgtaatctgtctgggaaactgacttctgatattttagaatacagaaaagagcagcagattgtattcatgtcctggctacttgacataagcaccattatgtaatagaaagcaagataagtagcataatctcacattagcaacattatcatttttaccaaagctgttcttcagctttgggcaaacagttgtggtctaaaaaggaacttccagatttgatatcccaatgacttgttcatttgcttatttgttactttctgtttcttacttcacctaatgctgcctgatagcattttccaggtctggcctcccactggacaactggtgagggttgggtaggtcttgtacatcttgctatctcaccctgtgcctgatgctcgagcttcccaggtggctcaatggtaaagaatccacctgccaatgcaggagatgcaggagactcgggtttgattcctgtgtgtggaagatcccctggaggaggaaatggcaacccactccagcattctagcctgggaaatcccattgacagaggagcctaatgagctacagtccatgggattacaaagaggtagaagtgactgagcgactgaacacgctgcttattttgcaaacagtaactacgtttaaagatatttttttcccaaagtgattttgacaccccaaacaaccttgtgtgttatgtaaggcaagaaataatgtctcttaattaactgagacctaaagagataacagaccttgtctgagggtcagcccctccaccactgtctcctttgcaggtgaacaagtcacaaatgcatttattccacctaaagtcttcttcttcacctgagtattctcagataattctgacattccatttagggagcttcctgtgctaaaataatatatgagaccttggcatattctatat

SEQ ID NO: 35765 - DNA, 2194 bp, Bovine  19866880657893
acgaaatgagtgatgtctcagaagctatctgttatgcagtacagtatattctagaaaacacagatgactttggcccatgactcacccctgaactgggagctcaaggctggggccatcacaggtggaaggcagaggagacacacctccaggggaatgctgagtgtcagagtgaaggcacaggtcacagggaggcggtaaagctcaagttcaggcagacggcccatcctgttcagtgatctggggtctctcactttcttcttgcacaacctgggctaagaaaaacccacttcccaggtgggagtcctgctccagaggaggacaggaggtttcttttcaccctagcatgctctaagtctaaactgaaatccaattcccatacaattattccccctaagttgaatgcaggctctcctaccaatgtaagccttgctcttcattagggacaacaaggctctttaatagccatcctggcatctcccaactggccttagccatcccagggaggaaggttccagctggggagccaggcgaggacgccaggcaccaatgacagacaggcagagttaaacagggcttggaggagcctcccagccccacaggatgtggcgaggtgaagaagtaagaaaatcagagaaagctatctagaaacgcaaacagcaccacaaataaagcgacttaacaggaaacagagagacttttcttcatttttttttttttaaagctaggaagcccaaaaatagttgaaagactatgttgcaaagctttccgaagacaaatcttgccttgttccgaagacaaatctaggggaacaagtctgacgtctaaagtcatgaagactacaggggcaagtgcagattgcaagcagaactccacgacacacaggaggagctgggggtttcagccccagtgtccaaacccagaagcccgtgtgctgatcagcagttcacacaaaggctcgattttgaagctcactcattttcagtaaagactgagttgcaactggctcagcttgaaggcgttcacatggaaagtcatgaatttggctgcaggaggagccaacatcagcactccccaagagagttggtaaacaagcagatgaaaaaataattggcctcattaaggataaaaaagtataaatgtaatgagagaactgttctgcaccgattgaattataatttttttcagctaataatacccggtgttgatgaggctgtggtgaatcgggcaggtccacatattgatgggaagagcatcaaaaaaccttatttgagagtaatttggcagtgttcatcaaactcataaaactgtgccttttgactcgtaatccttctgctgagaatgtgtccaaaggattttccaagaagagaagagttatacacacaaagcatctcagagcacccttaagtattacagcaaactcctaggaaccttcatttgtaacaacacagcactggtttagaacatgatgatctttttttaaaagtgatcattagtaaggtgcttgaacaaaatgcttaggatataatgtcagattacagaatagtccctacacctttgtctatatcaaggcactatataggcacctatccttatatcccaggtggctcatggtaaagaatccacctgcaatgcaggagatgtgggttcgatccctgggttgggaagatcccctgaagaaggaaatggcaacctcagtattcttgcctggaaaatcccatgaacagaagagcctggcaggctgcagtccatggggtcctgaaagagtcggacatgacttagtgaccaaacaacaagagattgttaatatatggacagacatatcagatgtctgaaaacaatctgattggttagggggagagtggttagtgatttccttttctatttcatttctgttctttgcaatcacaacattatctgtgcaacaaatgaccacaataatgatgattttcactggtaaaacttcactaatgtatggaaaagcagtgagcagaactccagggcattagaaacagcactcaaggtatgagaaatgatcaaacccagatgcatctgaagatcaacacaaagaaactgtgatctctaagcagagcatggaaaatacaggcagccatggggccacgtatcagcaacgtcaccttccagtccccagagagcatccggcagtatctgatcatctgagctttctgagagtcag

SEQ ID NO: 35766 - DNA, 3843 bp, Bovine  19866880667222
gtgatctctaggtagaaaagagagaaagggaatccagacagagaaattagcctaacatacatgtcaattgctaatagtcacaacattccagagccttaatttcttcttttgtcaattaggatattacactctacctacttaattaatgtggggattcagacgagataatgcatagggctttatgtttctgtatgttatcatttatactggtatactcttatgctaggagcacatcgctctctttggaagatgattcaaagaactgaatctttttttttcaggcaaggctttattggagcccctgctgcagcagagaggaaggagagcaaagaacagattcccttgcttgctctctccctgagtgggagaaagtttctttttgatttgaagctcttttcatcagaaaactcatgctcatgataaatcaaaatggatcagtaatgttggggtattggtcttagctctatgttttggcatcacacaaataaatcttttttcctagggatttcttccaacgtctgttctgttattatggtaccagttaagacatagttttttcaggacatggttattagcagttattgaattggacttagaaggacacaacaaagtctctcttgttaatgaccaaaattattctacctaaatcagtgaattcaatcaaatataagataaacagtgtttactaatggcatgaatgcccagttacacagtcatgtctgactacttgtgatcctatgaactctacgccgtcaggctcttctatccatggaattctccaggcaagaatactggagtgggtagccatttccttctccaggggatcttcctgacccaaggattgaacccatgtctcctgaacctcctgcactgggagatggactcatcaccactgagcccctgggtagcctcttattaatggcacttccctaataattaaacaagaaatagttaaggtatatcctgaccttgaaaaactcccagcctactcaagaggcagacaagtgacaaagaaaaacaactccatgtgatggatgctataatagactcaatatttaatacattgccatgagaatataacagtaattattccaggaggaaaatggataattagttaaagattcagagatgaggtcctagtcaaggtaggcgatctctaggtagaaaagagagaaaagggaatgtaggcagagaaattagcccaagaaaagatataaaagtgggaatgtacttagtgtcctacagacataggaggtaaaaaaaagaccgtcctccaaagacaatcatggcctccttcccaatgcctgggaatatgttactttatgtggaaaaagaaactttactgatgtgaatatgtaagatttttaagatggggagtttatcctatatcatcctgatggacccagttataaggatcctttttatttatttatttatttattttggatcctttgtaaggatggaaggaagcaaaagaaggtcagagttagagatagatttgaaaatcctgtattattgactttgaagaaggaaaaatgaattcataagccaaggaacagcaggtagtctctagaagctggaaaaatcaattgtacatgtcctcctctggaacatcaagaaggcacacaaccctgtacttagtacaagaagatttgtgttggccttccgacctttatcactgtaagatgatcagtctgtgctttgttcagccactaggtttctggtgatttgttacatcaggaatgggaaaccaacacagtagaaataagagcatggctgagaggtagggcagagtgtgagtgtgtgtgtctaaggaccgaggaaagagaagcgggagatggcagaggtaaagaaggctggggttggttgtaaagggttttgataatcagttctgaatctaagtggtctgagttttccatccttagagaatgtgatcctgaaagtaagctctcatatgcagaagccgccattccattagctcattggtctggttcattccccgagcatgataattgaaacccgtaaatctcccctctcctacctggatctccatttgagaattttgaggcatcttctcatcttggcaggcactattgctcacacacacacacacaccacaaacatatgtgcactctcatacaaatccctcactgtattgtactgaacaccatcatttttacctactaatgggcatttcagggctcaagagtggtgcccatagttataaaaatatatttgcaaactttgataagaactataaaacaaaaaagtaggctgctatttagacacatttgtggggaggttgtagatatgtaagataggagaagtctttctgaagtctctgcctctctcctccccttctaatttcctgtgtcacctacatcctcagtttgtatttcctctttcatcactttggtggtcagaggaagtgaccagactacaggaggatctagaagatgttttaattttctttatctcctcgtttcaaatcctttcttgtactctcagctcttttgtaaaacaaaagggttagtatgtgcatgactaaattttccagttatgagagttgttaaggaaactctcaaaatagagagtagaccaccaaaattaagcctgagaaagagaatatgtgatactcaaagtccttggaagcataagaaagaggctttttggatgtcagcagaccttttctgggactggagtcgtttctctgctgcgtggaacattgcaaaacacactgtttcataatcacggcatggcttgctgtgaagtcactggtggcccctttgcttcccaaatcacttttcagtgaacactttgatcctctatgatatcagtctcttgggttactaattgcttccaagtgaattcaggcttgccaagactctgggtggtgtctcccttcggatacaattctttgtacttatatatgtgtttgcttccaaattcctctgaatactttaacaactgaaattctctcaaaccaatcaagttgaaagatacaactggatacctgggatttttcctggcactgtagctgactcccaggggaataccctaaaagcatgcatctctaaaactctggtttgcatcccaaagaaaatttctgtctacctcaatggattgcaagataatggtatgaaaagaaatctgaaaaatactcaaaccattcaaaaatcataagatttttaagacccattatataagacccaggcttttcaactctctagagactttgaattcaccactgactattcatctttctcattattacatccaactgataacaattctattggttatgctttctaaacttcccccaatatgttggatccttacttttatgccctccttaccctgccctctctaataccattattctggcattgacctacttctggtctctcctagaattttaagtagtttctctacttctgatcatgattcccagtttcaagaattagatctttcctttaaaaaataaacatgctgtgttctcagttgcttctgttgtgtatgattctttgcaaccctgtggactgtagcccaccaggctcctctgtccagggattctccaggcaagaatattggagtgggttgtcatttcctcttccaggggatcttcccaactcaggggttgaaccggagttcctgtgtctcctgttttgcagacagattctttactcactgagccacctggaaagctctgaaataaacatactaatgcttttttttgtttgtttgtttggctcacaaggattaaatgagggaacttcaatatatatatgaaagcatccagtaaattttctggcacatagtcatcactcagtaaacattcccttc

SEQ ID NO: 35767 - DNA, 707 bp, Bovine  19866880676965
aaatgagcaaagtgaatgaactttaatttaaagcagccgcaaattggttgtcacaccccaaatttcaaacgagaaagaaaattccccatacaagatgatttgtctgagtgctttgtttccttgtcatagtatgtcagggatcaaaggatagcattttttcctcttcaagtggagaatagctttgtttttactgccttttcgtccctcctattaaagggagctttcatcatagactttaatatgacttgattgtctctatattcatatcccttgataccctgcttttcactgtaagtcagcaagatcaaaatcttctcctaattatcttcactacctgctgaagtatctgctgctgggaatgtgtcagttgctccaacaattatgctggtggtaacggcacacattcccatgaggcagggaggtgatgtctggacttcaaagggcctacgtcaagtggtgatgtatattgtacttcaattaaagtataattaaggtggcatgctatattcagacttctgcttgtgtcaaagataatccatttcagtagttcatactgccacctctatggcagctccagagttacacagcggatggcggagcactgctaactcctccagtgcccattcatggggagagtgaccctggagagtcagtgggatcaggtttatttcagcatccaggtaaagagctgaagctttgagccagac

SEQ ID NO: 35768 - DNA, 667 bp, Bovine  19866880695079
tgccgcaactgctgaagaccacacacctggagcccatgcttcacaacaagagaagccgccgcagtgacacaccggtgcacagctgcagaggagcccccactcaccgcaacaagagaaaagcccgcgcacagcaacgaagaccaagcacagccgaaaatcagtcaatgtataaaagtgacaagaccacccgatcataaatgaagtcaaaaaggaacaatcgcgtctttccacactggatcagagcaaagagaagttctggacagagcactccatgctaagcatgagaaaaaaagggaggaaaatggcatttcaactatgcaagcattctagaacacaaaagggaaaggaaagacaaactgcgaaagaacaataaaaagctcagcgtgaagtcatttatacaagactcgaaaacaagatgatgaagcaatatgctgggataaaacggcagattaccaggttaaggaaacacttgagggtcaaagcagcatctgtacaaatcaaataaataaatgtaaaccagtggagaacaggctaggtgcaactgaaagttcaaacaacagcaaaaagaaaaggctttagagcctcacagtgatgaaaaaggaaaagataaatgaataaatcaattacagatgatgataaataaagacttcaaagctgtcccacatta

SEQ ID NO: 35769 - DNA, 5870 bp, Bovine  19866880699526
gactgatactaaaggtgaagctccaaaactttggccacctaatgcgaacagcccaactcattggaaaagaccctgatgttgagaaagactgagagcaggaggagcaggaggagaagtgggcaatgagaatgagatgctggattgacatcacccaactcaatagacataagtttgagcaagctcttggagatagtgaaggacagggaagattggcatgctggagtttatggtgtcacaaagagtgggacacgacttagtgactgaacaacaaccagcaggccatgtgtgagaatcaaataattacacggaaaccaggacattaaaagttgttattctatactacataatatgtaatcaacagattttactttctttctttatctaatcatttatcttttaattctgttgatgaacatagatgaaattatctgctcttccatcacatgtagcataaagattttatagccaaatcaatatattttcaagttgtatctgtactgcttagtggttgcataattgtgcataattacataaattctctgaccatttatttctatgtatttgaaacagaaataatatccttcagaagcattgtaagaccaattgcattatatatctaaaatcaactagcaagtaaaatttatgtccagcaaattcttgttttcttctactttccattattatttattagacattgtgataggtatagtggagaaaaatatgaattaattatcattaattatcattaattatctcctcatggaattgatgtactcatatggggaaataacacaaataattcaaatatatcctaatatgtgcatttttacactaagaaaaacataaagagaaaaataaagtataataaatattcaaaaaatgaagtaactaaaatgaagaaatagtattgtcttccagagaaaaatatttttatgtttctgtttatcttatttgtatcaacatttatttgtattatcttgttaataaaatgcagttaattttcaagaaactatgcttgattcaaaatagggatgttagtttagtatggtaaatgttttgttaaaaataatttggtgaatttagaatttaatcacagaaatttgtatcctcatactttatatcatggttgtcaactttatttttgatgttactgtcaaataaaagggaacttcaattttaccaaaaggcattatttttccgttattaatttcaacttctacctattatataatatggatgatcaatacagttaagaactaaaaatggtggagaaattacagacacaattttaaggcctaagagagctgtgcgagcaacaaggagtagagggactaaaaatttacagaggaaagcagcatttaagagtaaactcatgatttccaacaccttttttcttggcagaaatttactgaatcttgtgcatttggcttagctctcctggagaacagagaaaccagcaaagttcttggtagtcagaaagtaatggaaagtggtaagttccacacttgaagggtctaggcaacaaggatacttcaaatattcaatatctgaataatatttcattctgtttacaacccttggttattcttattgtgttagtgttatgtcaggacagaagatctgaagggagaaggggtgagacacactgctttaaaacgtaaagttctgtttactactaggattcaggcttccctggcaagtctggctgcctaatgtgatagacctttaaagacctcttggcataatggttagagaaaagtgaaaaataagttattttaaccaaaaggaagttgacaaacactttgggtcaaccaataaaacatttttagttgtcagagaagagggtctcttataatacttctataactgcaatatacactatgcaatgaaagaggtatttaggattctattttatggtaaatatcaaccaagtgatcatttgtattaaagatagctgaataaaattttactctatatcacattatctgaggaaggacaaagctggctaagagaatgctatcttagcaagtgagtagagtaggcctgtagagagtgaaaacaccattattaaaggaaacggtaacactgtgcaatgcacactagaataaagaaatatgcccacaaccaactgctaattaaattttgttagaaagtaaatttcaagttttatttagcatcatgctttttctaatattttaattttctgttaatattaaaatattaatatattggatattggaaactaaaaacacttttctgattaagtacatatcaagctcattctattgctctgatgaagatattgtagtaaaaaatttagacctatatcatttttttctttccaatcacagctatataaagttttgtatatttatacaataaaatgttatgcgtaaaatgaaataatgtattaggaaaatatataatgacatttggtctttaattttcctagtagtagccccatcccattccaacctgaaatgactgaaatcaagaaatcagatgtcagtacagaggtgcagatggagagagctctaagtaaagccctctagcataggctgaattgttggagataaagcttccaaaaaagagactacattactgttcttgtttccttccttcctttttccttccttccttcctactccattctttcctccttcctcccatcctttcattccttctttctttcctcccttccttctttaatatttttctctatttcagccccaagaaacatcatggtacggggggcagcattcaggaatgtgaacccagtggagtcaaattgaggaaagcaaaatttcttttcctttgatggagctacagttccaagaaaattgagtcaaccttccctatcctcttgcttattttctctctgtgtctttttacaacttaagagtcacaaatttctgttcaaaggaacaaaaagggatcccaagggaatcagaagatatcatagagattacacagaaggatgagatcaggaaatatggaccaataagatttatgaattttggtgctcacctccaaggtatacatgcacaaatgtgatgctaacgaacacacaaaagacactgagaaactgaactaagaaagagatcatcttgaggttgttcattgaccatgaggtggaacatgtccaggaaagatttgaagagctccacaaaggctttgagaactaaactaattttgaaaccatagccaaaaaaaggggaactggtatttttgttctatagctaaacaggtaacgttgcctgaacacacacacaaacacaaaaaagacattttccataagatttaaatgatgcagggtttcatagtgtaatacttaaataatctagaaaacaatccaaagttatttggcaaatgaaacaccatctgcacttctgttcacatagttaaagataagcaatggacatggatacattctgacaaacaaagcagctattacaagcaagctcaaatgagcgaccaggaacactcttaataccaagcaatgatagaatcttttaacaataaataaataaataaaggatataaagaagaaccaagtagagatttagaactgaaaaaatgcaatacctaaaatgataaacttgctgggtggatttaataacaaaatagacatggcataagagtcaactaacttaaatctagatgagtgcaaattatcctatctcaacagtaaaaagaataaaacaaataaggggaaaaagtcttatttatttgtgaaactgaaagtgttagtcactcagtcatgtctgactctttgctactccatggactgtggcccctcaggcctctgtccatgggattctccaggcaagaatactggaatgggttgccatgctcttctgcaggggatcctcccaacgcagggatcaaacccaggtctcctgcactctaggcagattttttttaccgtctgagcctcctgggaagcccataacaaaactctagcatttttgtcagagaaggcaatggcaacccactccagtactcttgcctggaaaataccatggacggaggggcctggtaggctgcagtccatggggtcgctaggagtcggacacgactgagcaacttcactttcacttttcactttcatgcattaaagaaggaaatggcaacccactccagtgttcttgcctggagaatcccggggacggagagcctggtgggctgctgtctatggggtcgcacagagtcggatacgactgaagtgacttagcagcagcagcatttttgtacaagttctttttccaattaggtttctttttaaagaatctttcgcaggtctctgcagctgaaaacactgaaaattgtggctttactccacagtccatagactcaacctccgagttgttgatctgggcaataagagtccaaggtgctcaaagcctgccaagaacagagtgcttaatttggtctgggtgtttccaagtttgaaatggaagacaggaggcttgccagatatttcaagtagaaagagacttaacaccatgaattgaaagttggaacaatggtgggatgcgctacagtcaaaatttgcaaagactagaatgcaggaagtagtgctgaagtgaattctcaacagaatgagtgagaggaagccaatggcaacatcccatatgtattgacacttactcctggacaggacagctgctacataaaataaaaacttcttctcctcggccttcaaaacaccaaactggcacctctgcctagcagaatctaaccttaacccctgcgagcagaaaccgagggaatgtactgtcagactagcttctcccaagcagaggaggatgtagaaggaagcagggaacaaggtggggttggttttaataacccaactttagaggagattcaagaagacttcctagagaatgcaatgccagacacaaggttttgaaagaccagagttggccaagccctggccttggtcaatgattcatcaaaggagtttccctttctaggctgcaagatcctgaataagggaagtaccaccttcccaagaagtgttcatcttttgcaaccagaagatgtggctataaatagcccaagtttctcagcctcctgtgttcaagatggatcattgcaagcaacttttccacagaaagagagttaagaatgagagttactgaatcaaacagcaataccttcctcaatggaaatgtaagtgggaagtattcctttgaaatctcagaacagagttcgtaggcactttggagtcgttgtgtcaagagaaagaaactgttgacttcaagtgggtgtcagagctagcctctctaccttgaccttaaactccatttccctgatagccccgacctaaccttcccaaagacacgttggaactctccagagcaccagcccactggcagctcatctttcatctttccctcaaagtttagattgacagaaactttgcagtcctgggaagataaggggagacatcagggaagcacctacagtttctcttgctacgttagatgctttatgcccctgatgcgttgaatcctttaagggacctttgagataaacctattacccctactttccagatgaggaagcaaaggccaagaaaggtaaaataatatttctgaggtcacacacccactgctctcctcaaaagaaaatagtgaaagcttcattcttctactataagtgaattctgaattccatggggcattcctgggttacctggaggttgaaacagccttagctttgcaagactggagaagctggacctcatctcgctacccttctttcccccttcatcccaagaaaatatctcgccattgtcagtgacattagccacagtagggtgccacctccaacctggcctctgtctgcatcattttcccaaa

SEQ ID NO: 35770 - DNA, 2659 bp, Bovine  19866880744029
aattttttctgctaacaacgtgaatagctctatgtatccatatatcccctccctcttgagccttcctgccacccctttccccacgcacccctctaggttaccacagaccaccaagccgagctccctatgctagacagcagcttcccactagctctctgtttcacacattgacaggttatatgtcaaagctattctccccaactcatcccaccctcccctcccccacctgtgtccacgcctgtgtctctacttgacatgttttttaaaagaccattctgacttctatatgggaaccaaatcgattgaagacttaggggaacaagagtagaagtagagagtccagttgcgtggcagttatgatcaaatagtaccgcttcttatgaggaagtgggcatgccaacttccaaaagctgctgtcttcccagagatgctgagctattaaggtgcaccaggaagccaagctgcactcagtccaggctctttctgacaccgtctcctgtttcttgttcaggagacactgtaaagtggtcagaaagacgtcggctcttcatgcagacctaagatggaatctctttgggacactcgccaaatctgtgaccttttacaggttccttcccaggaaacaaatgggaacaatatcgcctgcctcctggatattataagtgagacaatggctataccgtctgtgcccatgtgctcaccagattattttttttctttttggatattgaggtaaatggtctttccagacttttgcagctgggtggggccttgtgatgagttctggctgtgatgaaagtatacagaagtgatatgtctgttcctagaagtccacaggccccactttactcctgtcatctttccacacgaactatattaaagatagcagcatcccaaaatagcaggagctggatgcttgaatcactatgtggaagaaagttgcctgaacaagaatatccatgttgaactttgtgagtgagaacaaaacgttttggggttaagtcatattttagaggattatttgttacagcagttactgttacttactctgactagtaaagtctcattaaatgatagctgttatatatggcatattttgctttctctagaatctacacaagcttatttcaacaatactatgaagaccaactctgctgagagacaccgtcaggttctaaagcctttgacttctcaatcattgaggaattcaaccgtgctgcatataatcgctctatagatagcatttgaatttgtcaagtcagcagttgagggagttctcattctttaaaagcattctttaaatgattagtaagttccagagagtgttctagatactatcacacatggtgtcctaggctggctttgccagagccctgtaaggttgcaaataactattatcacagccacaaccactcccacctcgggtagcgtacacattccgttctttccgccaagaataccctggctccagacatctgcacggctcacaccctagctttgttcaagtctctggctgctcagcctgaaacagtgtccctctgttacccacatccctagcctccattcttctctgtctccagtgtgcacgtcttgctgctcattctcagcactgtttgcccctggtggagctgatggaaaggatgcttcttaagtaaggtcactctgggttctgatgttcttattctaagaataggaaagaaagacgctgaaggttatataaaagatacagtatgttgaaaattacataagcagttgtgtgaatcactattttataacaaagtagaaaaaaaaagtatgcctttaggaaagcatgaatggtctcagattttgttacgtatattgttttagaccggtctttaaagatctggccctttctttcagtatctacctgtgaaaaggttatgatgaccctcgctagcatcaggaaccatttccacttgtgttactgatgggtcttggcattgatattgaaaaccagtgtccctcccgaataaaggacacaaagacctggtgatgattctcctggagaagtgaccatatttgcagctgataagaaacagttaataaggattttttgaatgtgcctataaagaaaagcgggcacttggtccccacggaaggcttccttgtgcagcaggccgggtgactgatgaagtgggttttgtgaaaaatgtaaattcacattttgtggaaactggaagttcatccgtctaaatcatttctgttatagtctatgacggcttctgaaaattgccagggtaggtcttttatttgatctttcaacattattggaggtcatataaacaggattatatgaagtctttcactgtcaattagtgtaattctaaatcaacattctgtcaacgaggtgcagattttacagcacaaggaggaagagacaagagctcactcttttcttcaaatggatttccctgcctttggtgagtgcttaattaaaatgagaaaaaggtgggagttccctggtggtccagtgtttaggactcagcgctttcactgagtccaacccctggtcagggaactgagatcccacaagtcatgtggtgcagccaaaagtagaataaaaaagagggaagaaggaaggaaggagagacaggagaagggagggaaggagagaaggtggggaaaaaatctaccaaat

SEQ ID NO: 35771 - DNA, 983 bp, Bovine  19866880808055
tctgactctttgtgaccctatatcctgtagcccccaggctcctccacattaccagtaaaataaggtgcttttttttttttccctctgtagaggccttagttgtgctcaccacactttatgaaaatgaatcactgcttttagactcatgctagagaatggagaataattctagagacttgaattgctaccagccacaacacctgtctttctagaacaaggctgggtaactcccatcttggcctttcattctagactctccagacaccatctccatgatgatccatttcatgtttgatggatatactgagacttttaagcaatctgctcacgtggctatgtgtgtgttagttgctcagtcgtgtccagctctttgtgacccccatggaccatagcctgccaggctctcctgtccatggaattctccaggcaggaatattggagtgggttgccatttccttctctgggggatcttcctgacccagggatcaaacccaggtcttctgcattacaagcagattcttagctgtgaagaatctgctattccttcctatgaactcatccaaagagatttctagatttctgggaagctctggcctttctttttgtccttgctgagatccttaacctttgaggatctctgccatattatgaatactcactcttttttattagcattcttttttctggctgtttgtaagtttccgccctggggggtccagctgtgttggaatttccttctttctctgcctgcctctcacagatgcttcatcagaccacactccatccagctggcagagctctctgcctctctcttctccaggttccctttggcctcaaatgctcattgaagagctcagaaagaggacgtaaaaaagggggcttcctggtgggcatccgtgagtcactgtgcagacaggctgtggcaggtccttcctaccatctgatgagtcatgagagtgtggccaaacagatggtcatcaaga

SEQ ID NO: 35772 - DNA, 1196 bp, Bovine  19866880808563
tagaattatggcatgcccagcacctaatagagctgtgtgtatactcttgagaaagacaaatgggctggcatgtctagctgcagaaatgagattaaatggctccatccccaatcttgccattgatttttgcagccctcccattaacatgagacatcaccataccacccctccatcatttctgggaggtgaagacacggttttagagtgtaaataattagaccctcaaaatccaaggtgacaaatcttacacgcttccagttgctacgaatcaggacccataaatcagagactcttttgaggacgtgtgcgtgagaagaagacatgtttacacagtgagagtgctttgtgtttctatttctttcttttttcctcttttttcctccttaggcacccttgtcattgaatatgaatcagctttattgggtcactgtataaatcaggacatttttgtaaaaaggcaggtagggcactcttacccaatgacgatgagtaatctgggacagttcctggaaagcaaggttgtgtgttcatcctagtttgaggtcatcatgccgtatatgagtagtgtaggtctgtgctttctcatctcataaaatgcatttctgtggaatgttaaatattgccaaagagataatgcaaaaagagataataaacaatactacagtggctaccttttattgagtgcctactttgtggtcctaaagatctagagttgtgattaagaacatcagtttgattctaaccatctggtagactgatcagtccctctgagcctctgtctttagcaaacataaagcactggtacgaagtaggactcaaagaggtgagctttcacaatcgcatgcagaattctttgtacataatactctctaatcctttcagaagcctggtgaagcgaatatcattaacctaatttttcagatgagaacactgagggtcaacaaaggtaagctgctttccaaaagtcacaaaaaaagtttatattcaaactcaagtctgtctgataaggtcttcacttcactattttactgttttccatcataagtcctaaattagtgttagcagcaaaaaagttgaaatgctgtttaacctaggcttacatacctcttaatttactcacttatccattccacactcttcaggcattttatatttctatttatttatttgccagtgacttatacaaagtcaactca

SEQ ID NO: 35773 - DNA, 873 bp, Bovine  19866880854901
cagctggctggaatcctaataagcagagacagaaagtaaaaactggaagtatgtgaatactccacaagaccaaccctcctccaatttagtggtataaacagtagcaatcttttctcaccctcacctctcagttccactcaacttcagttccacttataaggacagcaagagaagtccaaggaattgtgtccattcatctgtatccatgtcttgtgtgccatctacaaagcttgtttacttgtttagtgatgaaagtaaccttaaacctagtcccagccaacattctcagaaatcctgggactcaacccagacctctgtggttttgcttaggcataagggcacaccgattgtaagtggcagaaccagaattttaacacacttctctctaacccatgctcaacctgttccaccttcagctcccttggctatacacaaaaggataaactgtacttcatagaagattctttttctgaaccataaaaggatagttatggggagtttcaactccttaaaattcattcagacccataggagttaacatcatattagtagataatgtatttgcttatctgcttccaaagaaatgagtctaaattaaatacaaatgatgactgttctataaatattgtcttttttttaattggcaaaggagatggaattgatgactacctagttcttttatcatcaaggtctattttattttcatgatgacctcagagtacccagggcatttatgaccttattcatatgggctccctgcccagaagcacaagggaatgaatctttccctaaaatgaataattggggatgactctcaagcacctcactgccccctaaaacaatttaaatattttattgctattaataaatata

SEQ ID NO: 35774 - DNA, 1228 bp, Bovine  19866880968645
atctcctgcagcccatattttctgtgcaaattgcgtggtaactaatcatgtcctgcttttggcaccttttctattattgccttgatgttgtacaataactctttaagtcttaatttttacctaccctgtgaaaatagaaattatgtctttcttttcatttattctataggatcctgctagttgcctggcacacagtaaatattcaaaagtatgtattgctgaaaagttctttttctattatttcatgctgaaatgtacatactcagagttcacaatggaccttggagatggagttacagaggagaaaactgggagacattgcagaagtgaatgcctgcctgcactccccaccccagtgggtagcagatgaggatggaaatctgtcttcccattatcaatgctatgctctttctgctattttcaattgtaccagctacggaataacccactaaaggtgcagaacgctccagcagtagtacttgaaacagtgttgtgtagacacattgtgcatatcataaactgaaaccaaatgaagataggtaatctagcttgaatttcttgttgttattggagaatgctcacaattctccaaactcattctcttattaaataaacacatgagagatgtttgaccaatgaacttgtcatcaggaatccagctctgacaacacccatcatgaagctaaaggaagtcgtccttgtcccaaaacacatcctggtgtctggggctgatccccagggctgtctgaatgctgagagaggactgatgagctcagccacgggttcattagagaatcatggtctggcaaggccttcattctcttcttcatgactctggccctcatcattgccataaccaagagaggcaagaagaggcagaagaggcagagctgcggagccagcagccagtggaccatatggaaatgtttgaggattaggaacagtgccacatgtgctcagctcattctggatgaggaatttctgcccctgcagtgaggaggaaattatttgcagtgactcacatgggaggaagcaagcagggcctgagtcaaaccagccccaactccatcactttctggaagtagcttgttgtgatcacaaatgactgattagccatggagcaagtaccacgtaccattgttctaataaagctattttggatgaatgggagagaaggaaaatcctctctagtcaataaacaacagaacaccttcttccccatcatatt

SEQ ID NO: 35775 - DNA, 2465 bp, Bovine  19866880977900
taagaaataactacatcaagttctaaaaaagaagagactccccaaatcaaagagaaatgggacttggtctattaccattactagagaagagtttccactaaaaagaacttgcctactcacagccagatttggggatctgccttcatccctcttgcaaaatacacttctgctaaataactgtgatgcaatgttacctgaattgaaaccattagacagctgcccaaggaaggcgctttctgcctggaccgcaggttgtctccgttaatctttgtttatagtgtacagaatggcatggctaattagagactttcatacaaaggtgcattttctttaagatctcctcttggtcctcaaaacctcaaatttggctgagtgggtcttgttctgtgtccaggcttaactaggtgtttatgttattcactccttaaatcaaaggtcctaatatatacatcttttcaaatttcagcatctccaaaaatggtatgtgtcctacaatcaatggcacttagaagtctatttgggcttccctggtggctgagtggtaaaaaaaatccacctgccgatgcagtagatgcagattcaatccctgggttaggtagatcccctggagaaggaaatggcagcacacgccagtgttcttgcctgggaaaggaccagaggatacctggtgggctatagtccacggggtcacaaagagtcagacacgactgagcacacacacattcagggctccttcagtgacgttacccagctgaaaagctaatgctctcggaatatttgcagttcacactaactatgataaatccttattgccaaactatttaatgggatactgattcaggggaaaaactttgaaagccacactgcttgccacgttatcagtgaacttctgctcagcaccttctctcgtcacgtctttttaagaatatgttgatgctatacagctgtgaaattgtgtaatctgcatgtgtgtaacctttggtgcttgaagcttaactaagaatgttctattttgccaaaaactttcagctcacttaaatgcattgcaataacactgcactattaacgccttatgtgctacgagaaacttgatgtctagcagctcagaggttaagcctacagtgttggagtcttgtgtgtgagtgtatgtgtgtctgtgtatgtatagtaactaatcatttattttaataggatgctcatttgagagggaggcaggcactctagatttacatagagcttttaaggagatgagtgagtatgcacagttaaattgctccttcagttaccagaagacttattaaatcatgaactggaggaaattctgactgagtaagttacaataggctgacaagaaggtctgagctagaagatactggtcctggggaccttgtttcatttcaaggataattttggaaataatttcaaaaatctagaattaattattctgaacaagaaccgcaaaggcagggatgggtttttgtccaaggtatcatccttggagatctcctgaattatgtcagaccaatatcaaggcctaagtttaccaaagctgctagagaaactatacgaggagtctgtcacaatgtactcccatgtcctgggcaagatttgcagccatcacattttatccattaattaaaaaagaggaagagaagtaccttcaaagtcagctacatgggactggcgggcatatgcacagggctggactgggtgctaaaagtgggcagacttggtgtgtcatacaggacaactcattttcccaggataaaaagagttcatacatgccgtctccctgtacatgagaataatgtgattttcattcaggagtggtttttgcagggcacatagagaataagtgtgagggtcagctgaaagcaacactgtgacaagttaaatgtgttttcaggcatgataaggatgcctcaaagagggggaaggctctgctggtaggacttcagactattgtgaagttaaagttcattttgtttgagggtcttcatttccacttgggtgctttttctgcaattagagggttctaacaccagatggcacctttgttataatcataagatctgaagaccaggaattaaccaatgtgtgtgtgtgagtgtgcatgtgatataagtatctatgtaaatatatatgtatgtgtaaaagtataaatgtatttatacatctcattaagtgtatatttacatatgtactttgtaagtcgaccgtccagagtcaaagttaaagttctgttatcaatttgccttgattttgggcaaaaaacaaacacctatctataccttagtttcctcatgtgtaaaatgaggctaataatagtgcctgttttgtggtgcctattatactttttaatgagttcatatatttaaatacttagtgtctggtatatgataactgtctggtgtaaaagtgttaactcttatcaccatataatttgttcaaaagctgatctatga

SEQ ID NO: 35776 - DNA, 1850 bp, Bovine  19866881018478
gatagagaagagcccaggaatgggagtgaaagagtggaatatataaggaaatggagtgtctggctaatgtgacagccaggaaatccataaagaaaactccagccaatgagaaagccctgtgaggagtgaatctatagaactcttgggagtggatgtcttgttagtagcttctcatggttttctgcatagtgccaccaaaaaacccttccttctcctctgtctgaatcttgaatcaaaacagggaaagaagactagattctgcagttgggttgactcaaactaagaggataaaagccacaagtggcaagtcattcatgaaatcaagaatccagaaaagaaactaggaacaagagaagaatgggaaatttgtgaccttccccaacaggaatccaggcagatttaacagaaggatgtattattgctgggttcttcagtgtatctagatagaagcttgagtctatttatttcagtgttaaaggaaaatgaccaaccaccatcaactgtaggatttgcgagacactgagatgcctggtcctcaggtcataaagagaatatcaaaatcacctaagccctctagcacaacagaaacaacactctttgcacagagttttttccaacatctgtactttcattccatttgctagagtccatcaacatcatgtgaggtaccttctgcagatacactgcgattgttcaggccaccatctttttcttcagctgctacagttctacttagacatcaatgtcatatacagattaagatttttttttaattttattttacttttaaactttacaatattgtgttagttttgccaaatatctaagtgaatccgccacaggtatacatatgttccccatcctgaaccctcctccctcctccctccccataccatccctctgggtcatcccagtgcaccagccccaagcatccagtatcgtgcatcaaacctggactggcgattcatttcatactagttctttcctgctttataacatgttaggtttatttctatgttttaatctattgcaatgattaaaatcattgcaactctgtactattgctacttatgatgttactctcttcccatctgaactccaagctccttgtgtgaaggaaaagatactactctaatctttgttccagaacctagcataggggcaaaatacaaatgttcaataaatcttgaggacatgcatgaccaaatgcttgaatcacatcttgttaggcaactttgttcaaaagtttaccaacaaagctcaaatggaatgcttgaattttctctgcattcttaccccacctcagtcaccatctgtgacagagaagcaatgattatatattccctgtgaggatgatcacaacaataaaatcacaaccttcagccaacagaactcatggaaaccaggtcccactgctttgagcttttgaggaatgtaggactttgattttgcagtttactttcttttctctcctgaaatactggtttctaatttgattgtctcatttaaaaaaaaaaatgaaatcacttcaaacttaacagaaaatttgtaaaagttaagcaaaaccaaattttatatacacttcatccagattcaatcagtttttaaaatttgccacacttgtttttgtcattctccctctaatatatatgcatgtatatatgtacgtgtgtgctaagtcatttccattgtgtccaactctttgtgaccctatggactgtagccttctaggcttctctgtccatgggattctccaggcaagaatactgggctgggttgccaggcccaactccaggggatcttcctgacccagtcctgaccaggcgtatatgtatgtatgtatgtgtgtg

SEQ ID NO: 35777 - DNA, 770 bp, Bovine  19866881104950
ctctgcgggtaggagctaattaaagggtgtacttttctgtctcatctcctcggtttgatggatttggctctgcacagaagccaaagtctggcttggattgcttctgaacttgcccttgcatcaactgtaatcttacattcttctctctgccacaggaaaaaaaatgttcttactatgaataaaaaccccttaaacgaagtgactctaaaacaagtagattggaaaataaagactgagctaaataaaaatgtcataacaggtaagaagcccttccagtagctttccaccaggacccttagctcataatccatcattattttggactttgagtagacaacataattagcatgacaccgtttgctgagacctccatgaacatgaaaaagcacagttctggcttcagagcatcttggtcagcagagcaataggaaccaaatatcaataactagtatcttaataaagacaaggtgtgaggtttcttggagatttttttcaaagcaaatataaagcacaaacagcatgtttacctctgaatctattgttatacttcaagaaataatttgtgggagtatacttctacttatactgtacttctctgtaaaatgagacaaaaaaagagtaagaatgactcagtactgagagaaaaagagggacttgacatttaaagagtgttaaactaaggctgaattatactaatctaatttcttagaaccacccaaatcaacaagcttcattgctaaaagagagtaaagagaaaaaccctctggaat

SEQ ID NO: 35778 - DNA, 848 bp, Bovine  19866881182167
cctacaacgtaaaattattatgaaccacattttatagatgaacatggaacctcagaaggatgatgatttgtcccaagagcaatggttcacaaagggacagtcagaacttgaacttgagagtattgctcttttgaactcactgtggccctctgaactatggcaagtgactatcgtgtacatcacagactcatttaaatggcagctctgtggagagaggacgtgtatttccaatgctgagcccttcatccatctctctctgataggaacataagtttcaaggcacagagaagttgaagctaagatagatgtattaatgagcaattgcagctgctacatttccagttggcctcttggttttgagagttgttccaaattgtttgttctggtttttattcagctcttatctcttcctttcttataagaggaaaaatgagaaaactcatataaacagacaggacaggaagtaacgcaaggaagacagttacagcctgctctatccacagctttcccattctcactaaaaacaggataaaaggaaagtagaaatagaaaagaaaccatattgaagaggaaatactcagctttaagggccgttatgtgcaatccagatgcccttgccctgctaacgtttggggagaaagacagttcagctgtgagataacttagctgtgtcctccagcactaagtaattcgttctaatgagttttccaaggaaaattaatttttcagcactaaaggaaagaaggcatggagtctcagaaaaaatctgagcagacgttgcaacaagggttatctaaagaactgaaactagagaagcctcaaaggcatatccattcggcattcaggga

SEQ ID NO: 35779 - DNA, 1346 bp, Bovine  19866881207853
caacccagggatcaaacccagggtctccctcattcagcggggttctttactagctgggccaccagggaagctcatcttttcagaggactcctccatcttccagaattctcagtcctggagaataagcagttaactctggggaagggataaaggagaagacaatagaggaacagtcttcattcaggggcatctgcttccccaaatgaaacatttggaagttttttgagtgcttgggagtggggctttaaaatgcaacatgtgaagtgaagttatttaaattctgatctaactgtgtggcctatcttcatgcctgcattaaaatggttcagactttgaccatccacccccatcattctgtttggattagccgagggctccacttgtgtggtacgttttaattttgtctgacacagtgttcccatcccatcctccctcaagtaagtctgggggaaaaatgtacttagctgagaattcacaatctctgcttttttgtgcttccaaggaaacttaacaggaaatggatttgctttgccatatttaggatagcttggagtgcagattcacaaagaattttccttgagctacattttgcacagaaaactcaatgacagatgcaaagaaaaaagtggtttcactgtccaatcccaggacacttagagagcgtgattaaagctttccatatgatagctgcgggaactgattactggtgagggaagaggttattcgaaaccgcatagtggaacatgtataatatcatatatgaaacgaatcgccagtccaggttcgatgcatgatactggatgcttggggctggtgcactgggacgacccagagggatggtaccaggaaggaggagggaggagggttcaggatggggaacacgtgtatacctgtggtggattcaatttaatatatggcaaaaccaatacaatattgtaaagttaaaaaaaaaaaaaaaagaatcaggactggaatacaggtctcctgccactatgaagcatgagatagaaattaagctaaaacatagtcaatggagccctttcaagaaaggacttccattttttaactccaccatcccagttcccaatgcaatgaccaaaaatagtatttctcaggtgttgtcacttggatcctttgtgttggggatgagtttctgtaacaatgtcaagaatgtgggctagagtaatcagcactggttctataaaagtaagaataggaagtgaaagtgaaagttgctcagttgtgtcccactcttttaaccccatggactacacagtccatggaattctccaggccacaatactggagtgagtagtctttactttctccaggggatcttcccaacc

SEQ ID NO: 35780 - DNA, 1162 bp, Bovine  19866881212324
gcctgcgtttgcttagtggttttttccgtctggatctatctattgatgtaagcggggtgttaaagtccctcactattattgttactgttgatttctccctttataactgttatcatttgctttatatattgaggtgctcctaagtttagtgcatttatatttacaattgttatgtcttcttcttggatgatcccttgatcattatgtagtattcttctttgtctcttgtaacaggctttaaagtcattttgatatgagtgttttgaaacagaggtgttgcctgagtcatctttgtagcacctaacgtaagtttaggtacatagttggcattctccaaaaaaaaaaaaagcaatcgctagatttataattattaggtcaaagattatgaatggcttcttagttcttcatattcatttccctgctatttacctaaagagttatatagctttccttgacataagcagtatacaagtttcatcacagtaagacagtcatgactattaaatttttataatttccctagtctcatcactgttagtaaaaagatgccctatttagaagtctttgatttctaatgagggttttttccttaaaattttaattttttcttggctcatttttctttctaaaagtcatctctttttaaacaagaatttccttaaagtgctttccatcagcaaattttgtgtgtgcatgaaggaggaataggaaaaagaggaggaggaaagagaggaggggatgaagaaagggaaaagggagaatacaagcccaactgttgcactccataaagtagatttaaatgtgttccattcaggtaagccatcttaataaaacccaagggcatgaaatttaaaaacatatcaagttcaccttttcaaaggagatgttggtaaatgaagttaggatattcatgtatattcagaactcttaaactttgctcccagcatcaaatgctaaaatactatacagcacataaacatctttgttctgttgaaagtgatatcactcaggtcaaaatgtctctgtggcatattttcactcaggaaactgttcaaggaactaacaaggactacagcttcagaagctaaaatcaaatgcctttgctgtgaaaaagcataagattttcctccgtttatatgtattcttaattttaaaattaact

SEQ ID NO: 35781 - DNA, 1349 bp, Bovine  19866881288905
tgaccgtgcgtttttggactccttttcccacccccgcctccctctggaaacatctcttggctcctgatggatcctcccaaaccagccctctctggccatgggtgagagggcattcgagggcaccttcctgcctgtccttggactccagccagccccgggctttagccgtagggtacgtgtatcaagattgcttcctttattcagtgtccacggtatcaaaagaacttctgacccactcggaactctccccttgaaacagaaacattctcaaaacatctctgctgctggcctgttttactattgctgtttcttgtggtttcatagtgaggtttttggctcattgcatttgacctggtgtttatttttagtcgtgaagacagagttcaattaatgtcaaaacgtgagggcaaatgcagaggagggattcgtaagtctaggggaaaatgtgcctaattttgtttcttcatgataacatctgtcacaccagcagacgctgagcttcctcggcgctgcctatgatgggctttgcagaggcagcgatccaagccacccccaaaaacgaaagcgtttctgggtctctttcactccggtttatccagcagctggccacagagctgaatactgaccacagttatcattacgagtgataattattataattaatgagtaaaggccagcctttggaaccttcagttctttttttatgagaaaacttttttttttttttttaatgtggaccacttttaaagtctttatcgaatttgttatacagtgttgcttctgttttctattttgggttttttggcatgtgagatcttagctcaactaacaccaaaaaagtgttagttgctcagttgctctttgtgaccccgtggtctgtagcccaccaggctcctctgttcatggaattctccaggcaagactaccagagtgggttgccatgcctttctccaggagatcttcgcagccaaggggtcgaacctgggtctcccacgttacaggcagattctttaccgtctgagccaccagggaagcccacttagcttcccaaccagtaatcaaaccctcaccccctgcattagaagatggggtcttaaccccaagactgtcagggaggtcttatcatctcccccatgggtttggtttccttctgtctccagaagcagcatccaacttccttgaatatcagcttgtctccccggatcataagtgttttgagaacaaactccgggtcttgctccctctttgtccgcagcttttggcatcgtgacatgcttggggaatgtcctcttagattgcctgcgtttttggacaccgaattggggttagaatgtcagatatgaggcaga

SEQ ID NO: 35782 - DNA, 1415 bp, Bovine  19866881299984
gcccataaaaatacccacagtttgtctttcatcgcagcagctcagagcctcgtggcattctcccgaaaagacagtgctcccaactgggttctaggagccggctacttcccaggatggtctggtatttgcaaggcagagggagcgagtatgaactgaaataacccagcccaggcattgatgtagccaggctgccagggagacacaagtcttcgtgtatggagagattctccctggaattttctggatgtcaaagctctgagtcacacaccaatgagtctgcattcccactctgctattaagtagctgtgtgactttgtgcattttcttagcctctctgtgcttcagtttctgcctctctaaaacaaagtggagatgatatccacttcctagggttcctgtaaggattaaaagggatagtgtagacacagatagaagagatttgcagcacatatagctgacacaggacttgtatctggaatctgttaacaactcttgcaatgcaataagacgaacaagtgccttcctccaaagtgggtaacatttaaacagaagatatatatgatatgtacatgaaaagatgtgaaggtctctatagtcatcaatgaaatgcaaatcacagtgacaagacaccctttcacccccactggagtggccagaatgaaaaagattgtccatatccagtgctggcgaagatgtgaagcaattggaactcttacacactcgtggtgggcgtgaaaaactgatatgaccacttggaaaaacagtttagcggttgcttctaaagttaaaaatacacttaacatatgacccaacgattccactcctaggtatttccccaagacacacatctataaaaagatttgtacatgaaaacacataggagacattcataacgaccaaaaaactgaaacgagtgtccgtcggtggatcaaaggataaacagagtgtggaatatccagatgatagaatattagatagcaataaaaagaaagtcaccagtatacacagatgaatgccgtgaacactacacggagtaaaagaagggagacatgggagactcgggcaaacctacggccgattcctgttggtgtttggtagaaaccaatgcaatgctgtaaagcaattatccttcaattaaaaataaataaatttaagaaaataataattaaaaacgaatagagacatggaagagcagaacttccgtctaaagttcgagaagagagaaacaatctgtggggacagaagtcagagcagtggttgcctttgtgtgtgggtagggtgggagggcacatggaaacagggacaggaaacgttctggggtgatagaaatgtcctgtatccctgtactagggtggcaggcgcatgggtgtacacatctatcaaaactcaccaaaatcggtgcttcatgttatttg

SEQ ID NO: 35783 - DNA, 1489 bp, Bovine  19866881310211
agagaagtaaaaattttaaaaagtacctattattatgaagcttatattttggatatattttggaagagagacaatcaatcaagcaaataaggaaggaaggaaagaagggatgaggttatttatcagaaagagatgaatgtcatgtagggactgaagaatgtgatagagaggcaggtggtatcattgattggacactcaggacaggactcctgaaggaggagacctttaagctagaactgaatgacaagaaggagggggtcatagaagagcaatgggtagagactgctaccaaaaagactgcaaaagttctgagatggggaggagctttaagaatacaaagaacagaagaaaagcccagtatggcttgaacaggtgaatgaatgagggttagagccacacaaaataatgtcaaagagatggataggagccagatggcacaaggctttaaaagtcaggataagcctcattcatcaaatatttgttgaatgaataaatgcacagaccttgaagcactatggaaatgtaaataccaactgcctttcaggagttcagtttgtcaaaagatgaaaggaatctacatccattcatccaagaagtatttactgaggccctagagtgtgccaggcaccatgctacatagagggggcaccagaatggataagccaaattccttgatttcaaccaacacatggctttgaagaaagatacaagaccatagcacagagtagcaagctctttaatttgaggaaacactatgcgagcacatggaaatccaccatcttagcctgaaaaagtcaaggaaaaggctaagagagcatatgaactacatcaagatgaagagctcagagataagttggtctctgaagactaggaaggtcaggaaaatttcccagagagaaaactggacttaaactgggtctttggatgtaagcaggaggggctcccagttgaaaaacaaaggcttcaagctcccagtttgaatcaaaggtcaacaccttggtggggcatttgcagcttcccacaccgactgctgctcctaacttacactgtcttcacacacacacgcgtgcttacgctcccgctggtcctccctctctgctgaaacatagatgaaatgactagctaatcacttcccaaactgcttagcatcttagtcactctgaaagaaagtcccatccccattccaactaagatcatgtacagtttcctgatgatcgaatagcccatggataggagactcctaatataaccatgtgtttcactttggaacggttcattttcctcagcaaagatacccatctttaaatgcaatggaagactgcttccccaatgcagccattccttgattctaattttaatcgcggaagtctttctggtcacctatggctgggtaaaaatcaataggaaaccatagcagcacatgagtaagcattcacctttcatttatgaatatatgggtcgcccagaaagactgtatcgcaggctccag

SEQ ID NO: 35784 - DNA, 1757 bp, Bovine  19866881691801
ccctgagcacaaaatagacactagtgaaagtgaaagtgaaagtcactcagtcatgtctgactctttgagagcccatcgactatatagtccatggaattctccaggccagaatgctggagtgggtagcctttccctttccaggggatcttcccaacccaggggtcgaacccacatctcctgcattgcaggcagattctttaccagctgagccacaagggaagcctcaaaatagatactaaaaacaagcttattatagagacatcattgaattgatgagcattttgctcaactgctactggcaatgaaagatagattgagtatctaagctctccagaatcatttattctgagctcttgtctcttctgttgttgatccagctcaattgaaaaggctttatggtcatttatgagggaaaaatacatcactaacccacatgtttaatgagtcagcaaaactgacatcatgaaacaataagtcggttgagggctaagtcagaaggcaaagcaggttccaggacaaccaagacatttccccggagctcataaacaataatgatgttcagttctatgtctgcaggtgaggacgcagggaaaatatcagtgctcagtacttagcaacatgtgtctctattgcacagcatctctgtctttcctagaacaaggaaaacacagtttagagggcagcaaatggtaaactcttttctgaagcagttgttatttctgatgattttccataactgtatttcttttttatggtggtgtgggaaacttgatctgaataatcatcctttttgtaaagattacatgttagtaccatatcaaataaaagccgttaaaaccaaaccctttgaggttttaatccaagtctaggatggagacaaaatttatctttatttttatttagttcagaatatttggaagattccattatttaatatcttatattatcatttcccaaatggcattctctggatggttggcatcctgagagaaggcaataaatgattcatgggaaagagctgaaaagagagaaaacagagtgttttcaacggctaaatactttaagaagttgtatcatcttttatggtataacaaactactccaatgcttatcaactgaagaccacaggaacttattgcctcacttgtctcagggggccaggaatatggtgtctgcctagcaggatgcctctggctcagtttcccatgaagaagccttgggataatcagtcatagctacaatcacctagaggctcaaatgagacagagaacaaatttatttccaagttcactcacgtggctgtcggcagcatcaaaaggtgtatttccaagtgtgcttatgtagttgtttgtaggtctcagatcttcaccatgtgggcttcaccagagacttcccaagtgtatttgacatggacagtgatcctaagcaagagagaaccagagacagaatcacgttttctcttataacctaatctttaaagtgacatctcatcagcaaaagcatattatcattaaaagcaaataaaaaatccagcttatactcaaagagagaagattctacaaggactgggacaccagggaatgggaatcattgatgatcattttaggaaatgcccagtccaaaagttctgggttaatcttcactacaacacttctcagggcttttaatatacaaatgtgttttttggatcatcatttgagtaggggtcaggaaactttctcttagacagccagatgcttatgaggacctctgtcccaa

SEQ ID NO: 35785 - DNA, 790 bp, Bovine  19866881870686
gtctgttaacttagttgttaaaaaaaaaaaaaaaaaaggttacaatcagcgattttgccacaagagtggaactgacaacccttagccagctgtgaccgaatgatccattattcatgaagcacagaggctctgtgactgctcaccaccttgctcgtctgggatggactctcatttgctctggtctcttggggatattttctgattgtgaccacacagagcaagcccactggatcacttatacccaacaacctccctaggctaaagattcagaaggacaactttctctatttcaatgttatagaaaacatctttttgttgctgttacaagctaaagacatttctcactgtatccaaaatgggaatcatctgcagtatggctttaagccacatggaagcaagtaatagtcaaaaagaagtcattccaaggggacaagtggagtgttttaaattccaacagctgaggccaaggtgattgatcgtagcacaactgtagggactgtggagagatggtcttttcagaaaaggaggaaaatatcctagtaacattaagtatggaaattgttctttttctgtccaaagaaatggagattcacaaaatcttttgtagtgagtgcgtggatgctaagttgcttcagttgtgtccaactctttgtaaccctctggactgtagccctccaggctcctctgtccataggattctccaggcaagaactctagtgggttgccatgccctcctccaggggatctttctaacccagggattgaacccgtgtctcttatatctcttgca

SEQ ID NO: 35786 - DNA, 1218 bp, Bovine  19866880461049
tgagtgtagaataatctgaaattcaggggaaaaattcttggtgccaggaaggaaagctgcttctgcataaagggtgtcagaagtgtaaaattctacaagtttactccaatgcgtaaaatatgaatctttgcttcagttctatccaagtaaaataataaaagccatgtttgattttaggtagtccctggaggattcttccactgccagtgtctctgcccctaatcgcccagatatcaccacaggtctctctccctacctacaattaccctaagaattccttgtggttccactgttcaccctgttaccaaggataaatagcgataggctgagattataaagtagagatgggaaagagcagcacctgagcttgaattaacaaatgagaacagacaactggaaaggagggacatgtagaaaataatagatgattctagtttctttctcccagcttttctatatatccagggtccctcccaagtcacttttacttgagaaggctgtggtcaaccaaatagggatctaaggagaaggcagccttcatcttttcttccccaaaggaccccctcggccactatcatttaggagcccctctagtgagataaagaatccacctgcaatgcaggagacctgggttcatctcctggattgggaagatctcctggagaagggaaatgactacccaccccagtattcttgcctggtgaattccacagacagacgagcctggcaggcaacagtccataggttgcaaagagtcagacacgactgagcaactaacactttcactttcttcccagtaagatagaggggatgtggaggacagaggtgatggacgagagagaggaaacagatgtgcccttcatcttggaagcagcaagtgtgactgccttcttgcctgattagtcctggtctttcagccctcatctctgtttccctcctgggatgagtctctcattcaccaatccctccactccccccattccctctcagtcttgcctatacagttccaagagaattacttacaccaagggggcttttcagagcgctgttggagttgtagggtaggtgaatgaagagtgcgaggtggagaaaacgggctgtcagaggcttggttgctgtgcatagagtcaaagagagctggacaggtgagggagagagagggaaggaaaaaaaaaagcccatgaagaattcaacagccacaggttctaaatataagtc

SEQ ID NO: 35787 - DNA, 1387 bp, Bovine  19866880665130
atgccttatctctgacgggagctgattggtcttcctcagtcacactcttttgttctggtatttggggccatttttaaaggagagtgagctctatagatgccactctagagggttctgtgaactggaaaccaccgagaaccactgtgacagggagactgtccttaggtggtatgagcgtccttggggaaaagcagagtatcagagcaggtgatcatcagcaaatatttattgagtgcttactgtatgcaaggcactggggatacaaagaggtatacgtcgtggctctgcccttaaggagctcacaatctagttggagaaacaggacttacatacatcacagatcagtaacaccacaggggcctgaacaaacgccaagtgaacagtacacataatacagagagggaagcaaggggttgctcaaggctgcagtggggaagggggcgccacggggacgggtacaagcagagtgccccaggcacgggagcagcactcaaagcgaagctcagcctggcgcacacttgtgggtccgagagacgacgacggatttattgtggcgcaggtgaggtttcgtgcagggtctctgcccacaaggtgggaacaggttagctcttattgtcccgaatctttcacagatgtgtctccctttttctcctaatgccaactgtttcctgggtaaggtgtttcactgcctgaatgaaatcttagatctctgccacagcttctgctcactggtcagtcagaacctgggcccacttggatgagcgtgggggctgcccagctcagcatcctggtaaaggtgagtcagcctggccgctggcctgggtgcagccccgtccaagggacaccagggtggttctgcacgtgggggatcacggtcttttccccagtacacacacacacaaataacaagatacaaaggtaaaaaatgttctatcagtttttgaagcaggtatgtatgtgctgcttttggtgttcaaatgcagttaagccccaaatggtttatgaagccaccagatacacactggttttgttcctgctttctaacattcaacctccggacttccttgaactaaaccccctatttcaccgagattataattatctgcctgtagcacaggcaggtctatgttatctgaaaacacaggttctcgccagcccagtacacagcagaatatactcatttaaagctggctgctaaattcctactgagaatgagagtactttcataggaaattctgtgttctgtggactcagtacaaagaattcattttttgagtcgagaaatgggactgtcggcaggccagttagtgctgtaggattttcaggaagacttttccaacgcatcccctttgcccccttcatccacatgggcggtagatctaagagg

SEQ ID NO: 35788 - DNA, 739 bp, Bovine  19866880681987
tactggagtggggtgccatcgccttctccgtttccagatactaggggctgccttcccaatacggctaagtaggatcctagactttccttctgtggccccctccttgcctccactcctccgtggcttgcttccacccgcaggtggctccgcagcactgcgccacaggcagtggagggctgaagagcttgtggccacgaaggtcactctttcagactggcggctagcactgggatatttgagatctgtctacagcattcagaaagcacactgtgcttggttcaagaaccctaaagaagaaactaaggtagggacatggactcttcaggggatggtgaggactttcaggacctctggcccaagacactgcgggagagaggggtataaccagagggcatccccacccaggcagtgccagctcccccacccctaccccgacccctgcctgagggagattgcggaacgccgtggggtgtgaggcaaggatggggttgtgagatgttggcagtttgggaggacacgaacgcgtgacacagaagatgcaggtgacaggggctgatgattcagattaacagggcgcgcagatctcaggaaatgcacactagggatagaggatgcagatggcagagaagcacgggatggaaggatgtccctagcgcagccaggacagcagctcaccttgttcaaggtgggcccgaacgggcctcagctgactctctgtagcgatatcgccgatcacgat

SEQ ID NO: 35789 - DNA, 929 bp, Bovine  19866880699071
catcagtgaggccagaggacaaggtgaagaggatttctttttctcaaaaactctcttaagatgaacaaatttcttactgtcttatgagtacatcaagatagctgaaagactggactaatgcccccatgcctaccccaccttaactgagcctccatactgaagctcacatctctatttcagctccaagcattcattttccttctgccaggacaaaggtcaagtcacacccaagtcatacttggagatcaggaacaaaaccctctaaaatctgaatatgcaccatgtgagaagagaggaggagaagggaccaggaggaacgcagagattccttggtgaccctttgtccttggacacccctcctccttacactctggattaaacagcattagggagccaagagaggaaacacatgtggtggttagagacctgtgcctgcctgttcccttcctacaccccgtcatctcaccacaccctacacctctccttacactccccttcagctcaggaactgggagctacagagaggaggggaggaggaggaggaggaggaggaaacaaaattccctgcccaactccagccccacgcccagcacagacaggaggtaggcaagcctgccgagaatactcagagggagtcctgtgatcagcaaataggtcccagcctggaaaattcgctgagaagagatcaaaggtgaagtaagaaatggagaggaggatggaggagggggtaaaagtgggggatcctgagaagcggaggaaggacacagcagggcttcagacttgggggcaaggtgggatgggggtggggaaaacagctagatggagtaagagttggtgtttccccgatgtctctcagggaatctttccataaccttgtaaggagacttgcacaggtgtgacagggaggagccttggtgctcttcctggtt

SEQ ID NO: 35790 - DNA, 950 bp, Bovine  19866880744551
acttgccctttagctgagtgtagggtctgaagttttcttttgcaacaaagtattaggaaagagagaggaggaaggggagaagagcacagaaaccggctgtggctgttggaacaccgcggttaaagcccagcttctcccagaggtacatctaaataaatcctggcttatttcatggctatttctgtcaggcttctatttctgctttgttaactatgaatttagacctttcatgttccttcagctccacatttgtgaacacattttcctttgctattctattaccatctcctgttagagagttaaaatagaacttcaagaatgtgatagtgtacattcagtagcaaaccaggaagggcttagtggcagaaagtgtgaagggttaggaatcttagacatagaaaaagctcctgcttcggagaaaggataaagcctgccacaaacttcggcttgcttaaactgtacagggaccttgagaatgtcacaagtcatggaaactgggtcaggtcactagaatggaattcaaagaaatagcctgtaatcaggaggggtgtgtatgtttaagacctgcggtgcacaactggaaatgttaagtctaaggagagcgttgtctggtggtggaacaacagagaaaagcaggtggtgaagactagaaaggtcaggatctgtataaagattagctgtggctttctaatcaaagcttcagagttcacgtgaagggtaaggatttaaaataaaaatacagaaaggaattattgaggactactgtacaagtctataagactaaatcattccatttacttaacggagtttgtggctttcattagatccattggtcagtatttctgagaacttttgcagaacgtagaaaattgatgatatgactcaatttcattttgggagaaaagaataacaggtacttctattcccacgatttagtgttaacagatgta

SEQ ID NO: 35791 - DNA, 2197 bp, Bovine  19866880765284
tggatgaagtgggacaggcatcgctccctttcggcctcctgctcaccgggtcagtcactttgattggcctccccacagagcccaggcccttccatagtggtcttcactcaccgctgctggtttgctggggagtggggtccagaacctgccacccattgtatcctggagggagatctttccggatcatccagcactcattccagacatggaaattcctgcagaaggcagtaaggagaaaagggctcacattttcagaagatttgccaggtatcagaccctacacttggagaaggaaatggcaacccactccagtgttcttgcctggaaaatcccagggatgggggagcctggtgggctgccgtctatggggtcgcacagagtcagacacgactgaagtgacttagcagcagaccctacactgagtgctttatatcattgtttctcctatttttttttttacatttgaaagtaatttcaagcttacagtaagttgcaagactaggataaacaccacccatatacccagttcatctattgttagcattttgctctatttgctttcgcactggctttctttcagatggagatttcctagaatagggatcttcctttacatactcttatacagttctcaacttcatgcatttaatatttatactttatctaccttattgtctatatttcagtgttgtcagttgacctaattatgtcctttacggcatttgtttccacccagtgcaggatcacacattgcttttagttgtgcaataccctctgtgtcctttgaactggaagagttcctcaggctgtttttatcacattgacattttgaacatagtcttgattgaccgatttttatcagagtggccctcattttggacttgcccgatgtttcctcatgattaggttcaggctgtgtgttcacagacagaattctgcacaaatgtatgtcctccccaggtacactactgctcattgagccagagaagtttcagccctcgaggagctcagagagggagggagtgctagggacagcagctaattctcatacaaactcaaaggtcttacctggaaactggctggaaaagcaaaaacaggaaatcagatttggggtagaagagaggagaaaggaaccaggggaagcaacgagacatccaaaaataaagggacacacagagacacacacagatgccagccaggagggagagtggggcagggagaggagaggtcgagagagatcagagtaagtatgcagagacagctagtcctggctttgccctgagagagaaacggagaaatgtgcagacagacagaaaggctcagtgaaggaagagtaagatgaggtcagtattcagagggctcacaatctgttcatttggttgccaacctcagagtacattaactcatagtcttctgtgtctggaatgagcttgatgtgataatctgattagctggatcagctttctggctgaggactggctgagcactggcaacaatgtatggggcagaaattccgtaaggccagaaagcatcagaattttcctgccctacctggaatggagttagagatctgcaggagacagtgccccttaccatattttgtctcgtttctgagttggcagcatctctgcatgttggtcatagtaggtgtcaatggtcaagttcgcatccgagttgtgtgcagaacggaaattggaaacaacacgtgttggaacacctaagcatctcattactaaagagaggaaaagcatggggaattaccaaatccatttcaagcagaatcactggtctcaggtacatactttgtcacttttaagctggaggagagaaaaaggccacggtgcttgcagatctgtacctacacctcctttatcctcagagcaccgcacccaggcccagaaaccttgcagcctacctgtgcgatccatggtttccattccaccagagaaagaaatcacttgaggctcttaaaacaatttacaacacttaaaacaattaacaacaactcaattgatcatttagggcttttcccattcagcagctttccaaaccaaaaacagagaacctaaacaattgataatctgaaagaaaagaaaaaaaatgagacctgtgctgtggtcagaagagaagcagtgtgaccttaagtagacggcttaacttctctgggccttagtccttagcttatatgtaacaaaat

SEQ ID NO: 35792 - DNA, 3288 bp, Bovine  19866880770691
tccccccctcctttatttgtcctagcatccacctctgcacttaacagtcgttaatacaaataaaatgagttcatacctctctagatgtgtactgagcgtggtgagcaagttcactgcctttcacggcctgtggttaaattagatgccattaatctgggtgttcctgagcaaagtatgaaaactgagctataatcaggaaaggggctcaaaggaaccaagttaatttgctattatatagatggatgggtgtccctagatgaaccctgttttaatttatatctgagtattttaggagtgtggacttccctcccctgggggaataaagtattgctagatttctaggactcaatcttctattaacctatcggtttttctaaaaatcaagtcactgttttttttttttaggagtgaaaatctctgaatataattactagtggtattggaacatgaatagtactgatgagtgcttctttctcaatttgttttcaatattttaaactagatgagccaatggatatgtcagtgttatctgaaggaggagagtcttttcagaagaaactccaaggtgatgagccagcagagatggaaaacccccctctccccactgagcccactatatcaccacaagcctcgacaccagtatctcagagcacaccagtcttcactcctggttcacttcctattccgtcccagcctgagttttctcatgtgagtattgtagaataatacttttttcctcctaacgtctttttttttaagcaactgtattgaggtatggagaaggcaacggcaacccactccagtgctcttgcctggaaaatcccatggacagaggagcctggtaggttgcagtctgtggggttgctaagagtcggacatgactgagcgacttcactttcacttttcactttcatgcattggagaaggaaatggcagcccactccagtgttctttcctggagaatcccagggacggggaagcctggtgggctgccatctatggggttgcacagagtcaggcacgactgaagtgacttagcagcagcattgaggtataatttacaaaccataaaactcacccattttgtgtgtggtttagtgatattttagtaaacttatacacttgtgggagatggtgaaggacagggaaacctggcgtgctgcagtgcatggggttgcagagtcagacgcaactgagtgactgaacaacaacaatagcaatagacttgtgcacctgtcatggtctagttttagaacatttccagagtcacctactatctgatgtactttttatgtttaaattttatactatgtctttaaagttcttgaaatgttactttgaaattgaaaggcagcattaatcattattctaccttaacgccactaacttctcactaaatcaaccctaggctttctaccagatgttattaatgaaaatttcttttccagatgttcaagggcctcaaacttctatttggagaaaccacttttgggagcctcctgtttcctaatctgtgctattgccttctattcccggtgtagaactgtcacctcccttccactgtctgcagattgtccttacctgtctttgtgttggattcctcttgggctccatgtcttcgtgcttgatttatgccctcattttggtggaggacattctttagtagcagactttctactctcatacttgattcatagtttgtaggagtatagaattttatgttggaaataattttcctttaaactttttgaaagcatagcttcaccatcttcaaagttcagtgttgctgttgaggagtgtggccagtttgatttttggttttagtatttatttactgatttggctacattgggtcttagttgcacatgggatctatatggtgacacatgggtttagttgccctgcagcatatggaatcttagttttccaaccagggattgaacccgaatcccctgcattacaaggaggattcttaaccactcaaccaccaggcatgtccctgtccggtttgattttgttccttaatatgtgagctgttatttttccttactggaatcttatagaattttctctttatccccagtgttctaaaacttccagatccttgacataagtctatttttattttgtatttgttagttctctcaatctggaaagtcaagttgttcagttcagggacatttaattatttaatttcttcttttttttcatggaatacctattatttggatattcaaactcctagaatagtcttgtagttttatttttattattttgtgccctacttcccatctccctttctccttttctttaactttctggatgatttcctcaactgtttttttttttttttaattaaaaagcccccactttattgagatttaactcacgcaccatattgttcagtcttttaaagtgtacagtcaggtggcttttagtataaattgtgcagttattcctgacattctaattttagaacgttttcatcacactccctccaataaaaagaccctatgcttattaaccgtcatttccatttcccctactcccagccctattcaatcactaatctactttgtgtctttatgattttgcctgttctgggtatttcatatacagtattatacagaattatacaatttgtgattggtttcttcagtataatgttttcacagttcatgcatgttgtggtatgtattagaactttattccttttaattttgaagaatactgtgtgtatgctgctgctgctaagtcgcttcagtcgtgtccgactctgtgcaaccccatagacagcagcccatcaggctccccgtccctgggattctccaggcaagaacactggagtgggttgccatttccttctccaatgcatgaaactgaaaagtgaaagtgaagtcgctcagtcgcgcctgcgtcttagcagtcccatggactgcagcccacctggctcctcctccatgggattttccaggcaggagtactggagtggggtgccattgccttctccctactgtgtgtgtacatatcacattttattcgtccatttatctgttgatggacatttgggttgtttcccccctttttggttataaataatgctatgtacattcatgcacaagtttctccatgaatgtgtgttatatctattatatgtagtcataatttatttctctcattatatataattaggagcgcaattactaggtttaaccatcttttaacctttctctgagcaattattctactcttgggttttaatttctatacttttttttttctcaaatg

SEQ ID NO: 35793 - DNA, 1044 bp, Bovine  19866880827575
cccttcctttctgtgtgtgtgtgtgtctgtgtgtgtgtgtgtgtgtgtgactctccatcaaagggtccccttcctttctatgtgtgtgtgtgtgtgtgtgtgtgtaaagggtagtggcaggaatgattgttctctccctatcattacaagatacatttttgtccccccttttcagcattttgacctagggcttgaggagacgtgagagagatggtggcccagcctgtggggtgggcagagaagataaaatagtaagctcctagcatatgccttggagctcatcccagcagcctggttcccttggcctccccactaatggaagctgaaaggaggggcagtgtctgcagctgctctgggctgactggtgtttgtggggacagctgaaagaggagccagcaggggtggggctgtggctgtcttgagccatgtgggtttttccaggaaattatccactattctccagggacatagacaggccaccgtgaaaaatgtccaaacctaaaaaaattcagaagtaagccctgatattgggtataattgtcctaaactccttgaggataccatgctaaaactctttgattgaaaagatccagtaggtgtttgtatatcagtctgagaggtccctgagagtaactatgcatctccctgtaagtattttcccaagcatccccaaatcttcatctgaagaatggctaagttttttggttcaagttctattctttcttacatcattccagaaagcatccttctcttacatccatgtccaaaaagacaaggttcgagaattcagcgtgaattaataacatcagcagatacttcccaaacttcaattgagtcattaatttcatctgctgtcatccctttctccagacttgcaccaaagctcctaggatgaataaagtggtaaaactgtcgattttcacatcgttagagctaatggaggaagccatgatgtaagtatactaaacagaaggaagtctcaaaacagtgactggttagcttcataggaagccaatcacatcaagaagatgccagcctcacatt

SEQ ID NO: 35794 - DNA, 838 bp, Bovine  19866881146020
tttttaatagaatatttagaaattcctcctttcaacaagcagtacacagaatgccagcttcgagcaggagctggctacattctcgaagacttcaaatgaagcccaggtaaggcgttcctttgtgtagcttcccaggggaggcagtaatgcaagtccacttgctggactgagcagcggctggatggtagagattttgggaactgagacactgccaaaatgttgcataaaatagaacttttactgtgtacaaggaagagaagtcagaatcttgggttacatttaatagcattggttctgttgctgggacaaaagcagatgaaaatttgtgtttaacagaaatctttttcatggtactggctaaatatatggggtgtggttgtcccttgagtacttagacccccagaaagctgcaggtgaggcaggaagctgcttgggtaggagaatagactcagtcacattttggatagtatcgggaggtgttcaactctgttttctgtgactcattaaggaagctgttaagcagctttccatagtcatcaccagacccactggttttatgccttttcttccagtgtaacacagcctaccagtgtctcctaattgcggatcagcattgtcgaacccggaagtacttcctgtgccttgccagtgggattccttgtgtgtctcatgtttgggtccatgacagctgccatgccaaccagctccagaattaccgcaattacctgctgccagctgggtacagccttgaggagcaaaggattctggattggtgagtagttgtgagcctgtctagaacagcagacaggaagatagcaagcttccagaggggaagaat

SEQ ID NO: 35795 - DNA, 701 bp, Bovine  19866881205267
tctgcgactaagtggatgggaggatgctgtgtaagagtggttccaacactcccaggaaggggcgtgcatctcacattcaccctgaccttcagaatcctgccttttggagtcctgaaggcctattcaaagcagggctacttgggctgggaggttcccatggatgacagcctgcgggtttggagccctgtcaggtctaggacttcatccaccccctttgggcttctcaccaggctctgcctctgttgtcttctccattctgaagcccctcctcattgtagtactcgtttaccagcaggtccccgcccgtgccctgggctgaggtgaacgtggtaacaactcgggcagggattcccaggcctcgcagcactgcatggaagtgggcagagggtcagggcaccagagggggctgggatgcggggatggggcctatggctagcattctccgtgtctcctctggacactaggcacgttcatggtcttaaatgcccgggtgacattgtggaaagagaaggggcacaggaatggacacccgcccgacctacgctatatgaaggccaagtaatgagaagcagacaggttacacagcgggtggagtacacagcagcgggaggcttcaacagagcgctgggactggcttttctggggcagaggcagggaggagctttggggagtttgggagcagagctcaccagatgggccca

SEQ ID NO: 35796 - DNA, 695 bp, Bovine  19866881223601
gtgcattctttaccgctagcaccaccaaggaagcccctctaaggtctttgggtttttcttaacaattacccgagtggttatggaagagacagtactatcagagctcattgctgtcagaattcaaattcaataaatatttatcaaccacaaacacatggtgactttactaccgtacttacatccaagtgtaacagataaacatattccccacagtttaaggaaataccagtgattactgaaattctaccaatcaggtctgcagctattcccttaaagccagtacttacattgattcgcacagtcaaagggcacacaggtgggtaaatgctcagagccaaatcatccacactaaagggagaaagaaaaaataaccattaaccaagaaggaacaaagctcaactaggtggtctccaggacacaactaaggatgcaacgagtgaggaaataattcccagaaatgcatcagttccttaaactgggcaaccaagaaataaccaattcaactggtatttatggaacacatacataccctgtttcactaagaagttgagggtggggggaactcccttgaccagtaggatgggacattattaattcatttgaaaatgtttggatctgaaaccataagtttaataactgctattgccagggttcatccctgaatgccattaaagtaggtaccacttttaatcaag

SEQ ID NO: 35797 - DNA, 904 bp, Bovine  19866881269449
caagtctggggtttgcagtgagaacagaggaaagaagctttgatgtgatggaaataaccaagaaagaacttccatcccccaacctgttcatgcatgtggttttcctgagctgagcttcacgtgtattgcatgccatccagcttccaaatatcctagcctttctacccacatccgaaatctgcatgaacccctcctcaggtcccaaacccttctccttaatctggttctctagtatgtgatccctgaaatctgctgtttcttcccagctccatgactccctacctctcattcagacgtacaattgcaccccttccctgtggacctttgttctattccccatccacatcccctccacccccgaaagtataagaagagtatgggtgctcaccttattgggattgtgttgattttcccatgggacattgccggctttccgtaggagggtgcgaggtgatttcactcacccagagttggggaatttgtgggaaatctgcaggtgacagaaatagacccccgtagggccctagagttccctttcccgcgaatctgggacatcccacactccaaaagccacggacactcctgatggtgctcagggactctccatgcttcctcggccagctggagtatatccagcaggaataacactgactttgcccatctgttttctaacaggatttgaggggtgctccatggtgcctactatttaccccctggaaacactgcataatgccctttccttgcgtcaagtgagtgaattcttgagtagagtctgccaactgccacactgaggcccaagcacaggcgtctgcaggtatacagaatcctcttatcttgaaccactatctctgcccccactcccatgctccccagagcttgagtggtaagttaaaaagataggcac

SEQ ID NO: 35798 - DNA, 1069 bp, Bovine  19866881290563
tgctgcctgggtttcctcctcgccctctcattttctctcagtccttctccactctcccctgcgcccatccaggactttatctagaataccaggtttaggtttccagctgcctactgcccatcacagctcagatgtcttctgggatttcaaacccaacatgcaacaaacagaacacatcatctttctccccaaacctgttctttcccattggccctactttagaggctcacccaaactggaagcaccatctaggcacatacacaagtccaatctagcccacttctataatatgacttcatttgaaaagttctgctagtttactttgtccttcaattttttcaaaaccttccaacttctaatctgtggttgttggatacacattagatacaccttggaatcatatgggaagctttaaaaattcccaatgccaagccacaccccaagtcaattataacagactctgaccgagagacctaggaatcagtatatttgaagttctccaggtgattcaacatacagacaaggttgagatacatgactctaatatgaccccttccattccattctaccaaaagttctttttcaaaaatgaatttctaatcccattgactcctctggttaaaaccttttaccagctccccattgcccagagaataaaacccaaactcttgagctgcatctacaagccacttcaagatctggcccagtcgggctctcacgcaactcccccactccactcctcccactcttggaaagggaacagagtagaaagactggagacagggggaccagtcaggaggttgctgcaatcatgtaaacaagctctattccactgattctcttgcctgcacattggagtcacccaaggacttaacaatatttttgatgtttgggtcaaatttctgacttaattggtctggggtgcaggctgatcatcaaacttcccccaggtggttcttacgtgcagcaaagttggagaacagctgctctgctgctgctgctgctaagcacttcagtcgtgtccgactctgtgcgaccccatagacagcagctcaccaggctcccccgt

SEQ ID NO: 35799 - DNA, 1767 bp, Bovine  19866881468825
ggatctgtgccccctccctgtaattcttgtaagaccgtggggacagactgggtagcgtgtgcaacagagaaggcaagaatatcttagcaggagctggacagtcatgtctgttctcatcagctgttttcctcgtgctattcttcccccacccccatgccgtcccttcttccctttattgtttattctctgtggccaacgccatacgacttaatacacacatatgcataggttccctggtggctcagaggttaaagcgtctgcctggaatgagggagacctgggttcgatccctgggtcgggaagatcccctggagaagaaaatggcaacccactccagtactcttgcttggagaatcccatggagggaggagcctggtaggcctaccgtccatggggtcgcagagtcggacacgactgagcgacttcacttcatacatacgttcatatatatacatatatatatgtgtgtgtgtatacatacatatatatagagagagaacactgccatttctcttttattgtaacctgagtatagggctgtcttgtcaactctatagggaactatttttatggtgacaaagtgtaaggaagggaagatgagatatgagcacaaaaatggatcaattctctcgccattattcaactcaaaatctaaaatgtatcttgactccagaaggattaatcatgagaagggcaaaggcagatctcagcagctagcctgatctgtcacgagcatcacccaaaggaggttaaccctggctactgggattcacaaaaatccatggtatgcagtgtagcctgaagtccacagttctggagaacaccttttaagggagtctgattaaactaggcacaacaaaccacagagctgtcatcacaagctagacagattaaaggttttggtaacaatctgtattcccttctcaccttatgtagactagcagttccaaaacttttcctgatgagaacctactttgattttcttgaagtttcatgatctctagtgaagagggactgttaaggcaaaaccattgctagaatggggagctcagtgtgcagcagcattcgggtcccttcctgaaagcagcatggaggtaagccatggacaacctcagggccttcaggcggtttaagacagatttactgagcacccaccatgagaaaggtgctggtgtcggagtccgcagcacttggctgccatggttccaagggaggagcagcttactaagtgggatatggcagggagatctaggttgtaaaacacactcagtagtattcaccttgttacagcttaaaaatggggcttcagatgactccacttcttcctcaggtcagccttggtgctgtcagaagcaaagatgtagctgatggattcataagacagatcccacacctgagactgagtcagatgaaatgtttcagccaccagctggtactcttgagaaaggcgtgttgcaaaaacacccttatcatcagtctgtcaatgtaagaaagtttcaaaatgaacgaggaaatgacttaaaaaaaaataacaactctcaacttttgttgagagtattttcctatttaccatgcttttaagagtctaaacaggggcctacaaatgtatccaggcatgtttgttactgaacagtcttctttatcctttttaagaacataaaccaccagagtagtggctctcaaccatggctgcatgtgcaaatcaccaagggagcttttaaaatgcatctgtgcccaggactcagccccgatcaatgaaagcattat

SEQ ID NO: 35800 - DNA, 891 bp, Bovine  19866882115403
gatgcatgtacaaatacatgttgtatgtcctgggtctacactgtcttctgtgcccaccatcaatgctggaccctctccctgacttcaaggctctccatgctcttctcactcctcacatgcctagccttatatttatccatcggatcgtctcctaaccccacaagtcctccagaaagaacatctctgagcctctgtctctggtacccattgcgcccaaagccctcaagtgaacacccctacctggagctcttcctgtctatttagtctttccaagcccaccggctccaatagtcttctttcatttgactctaatctctttaaattccatttgcgttttccttcagaaacacacaggttagttcttcaagtcctaatctgacaccctcccaacttgacttataagctccgtgaaggcaggacctggtctgatatttagcacctacccccaccacatatacaccatccctaaacgtcagtgctaccgagttggcttcagaattgaagacgtttttattcttctctttgttctcccgtgacttccccggcaagtttgaagaggacatcatagatatctgctttgagattctgaacaagagcctgtacttcttaaagaacccgtccaaagactactcgcagcggaacgacgtggtgtacatctgcaggggtggtgagcgccatggtaagaccggaagcttccccggccccaccccagcgtccccagcaccggcacttcggaaactcatctgtctgtcctctttagatcaacagcaacgacgacagcggcgtgctgcaggggaactggggagaggactactcccgggggggtcagccccctggagtggacgggcagcgtggccattctgcggcagtgggcggccaggggcgggcagc

SEQ ID NO: 35801 - DNA, 2883 bp, Bovine  19866880282276
ctctgggagttggtgatggacagggaggcctggcttgctgcagtcctgtggtcgcaaagtcagacacgactgagtgactgaactgaatctactttctgtctctatgattttgcctactctgaacatttcatatcagtgaaatcacacgatatgtgatcattcataaataaaatgatacctactaaatgagtataaataactaacaatatccaggagatggtgaggactgggaagcctggagtactgcagtccgtggggtcacaaagagtcagacatgactgaacaacggaacaacaacaatatcacattattgccttcatttgacaaatcaaatccagacatagtaaagaacaaaatgtaaagaaacaaatagctaggagtaagtcaatcattatgaactctagtactctcctaggctgttacagttaaatttgccttgatttatttttgtctgaaaaccaggaggttacctcatgaggctcgccctgtgaaccagattctgagtttgatgggtgtggtggaaatacgccattctctttgccttccaagcattttgagcacttatcctaaacttggagatttccctacctacaagtctttactttctcaaggtaggcacctaaaattcccttctacctcccttgcatcctcaagtgcatgcttgagccctgctctccaccagtcaaaatcatctatgccagaactcagatcaaaacatttttggggtacactccactcagagcagaaacaccttgcacacaggcagatgttctagaggaatcttcaggactagaatcagaagtactagttggggcaaatagtggtggtggcagatggttcttctgggacagtcctgagtaatttgagcatcatttacagcttaagtttccaagtgtggccctctgaccctcctagagagtttggaagtcactcataaatcttcatttaagtcctattctgcttaaatttgttgggatgtatttctgttaaacaagaatacaattgctaacacaggactctaccttagaggtcccactaatgctgaactgtcagtagaagcttgccccaaattcacttgtgagctttagagccctggcaaatctctctttcagaaaagccctcctttttaggttcgactgggcaaatgctctctaccatttagagtgtaagaagtttcactgatgcaatatgaatcttttgtgatatttgacactaattataaagcatttatttactatgctgatttctaaggtactctctgtagaacactaccttggaatcattatctctttgccaagtccatcagtctaatggtttaggtggtcttattaatcaacctccctgccctactactttctttgacacatattcatgtacaacaacagctttaaagttcaatgtctaatagccttatctaatcatcaaggatgaatggaaagttctaaggaaaaatacgaatttgtgatttttgaactttgtatgtacatgttgtacacttaatgcctaatcaagaacatagtcaaccattgctctcaacaaattccttcttatactttttgatataaagagactccttagatgctagtgggccatctgagagacctaggagaggatggtttctgtgatgttgaagataaattctaggcaataatctgtgaatattcttaaatgtatcatttatgttcaatcggattctttccctaacacccttcatcctcaataggttactgcacataaggaagagaccaagttttgagtttcttaaatcactctgaaatgaaagggctccagtggatgttttgacattttatctactctatgtttggtttgctctagcatgtgggcatccacagaaaatgtcacaaatctcagttgatactttctaaaatatattgaagttgatgtctacaatagctcccaaggcacgcagtgtatgcataccccgtataggtctatgaatatatctgtgaacctataatttcagattgagaaacaccaggcctggagtcttactactgtgcgtttttaaggcaacacatagtcattgcaaaaagagggaccttgttaacataaagtttgtccatgaggactgtatagaattatattttaggatagaaaattttcccaaaacatatgatcttgaaaataaaaataaaaacccatccatgaaaactaatcacagagtatcctaagaaaattaatttggtatatttaaagattactgaatgcaatcatttattctcaacaatgtttaagacaatgcagatacacaagacctgaatgggggagcagtgagagcctcgaggcatataattttattggtgtgaattcccagaggaatcacacttgaaactgactagcaaaagatccatttgctaggaagtcatcttgaaatttaaattcatatcctgagatcgatggctgaaagacaaagtaaacaccgcaggcaacacacttttggagaagtcatggaactatccttaactgagtctttctctgactaaacttgaactattccaatatactaaaaatttgcacatttatgagcatttaacatgctcacggttaggctgaattccacctcagtcctaggtttctatccaatgtaactttccattacagcaatgactagctaaacattgcagccttttaagggttactgtgatacagctccttaattacttttgctcccgcatgagctctgtctctggggatggggtatgtttcaggcgtggaagagtgttcagtggggaacattcccatgagctcaagctggacataacttgtttttaaggcttactttaaatatctggcagtattctcattagcaattccataaagcagcataatgcctcttattctcatttctgcctagtccctctt

SEQ ID NO: 35802 - DNA, 1316 bp, Bovine  19866880454081
caggaggacaagagcactctccagtgacgtgatgacatacgcctccgttctggcaggggcatctctgctcacactgtggtccatgcttgccagggggacaaagatcctcacagctgagggattaacatgtgacaaaggacaccatagtttatcccaacctacaacccttaggttcacaaacacagcagcacccaggaccctaaaatagacaagctcctctgttcaatattgttcatttcattaacaacaagagcaccaatcatattgactggaagggtcaaggggtcacctactccttcccttttggggggatattttctactgaaaccatttcgatttgaggagaatctgtcctatcagagagatgactctcactggccacacactcttagttacagggactatccatgcaactctcaaaaagcccatgggttacactgggagtgtacttggtgtgtttgttctaatctcaaagaagaatgaaacatcttcacatcacctaattagtacatattccttgtactcaatttttagcattctcttctgcaaaatgatgaatctcctccatattatatgaatatacctcctactttaagcctttgtcttttttactctcctataaaattgctccaaatttctcaaagccttattcaactaggaccttgataaaaacccataaaagcaacattaacaattaaatagtctgagatgctcatccatttttctgaaaatcagggctttcttggctaattcagttttttctttagctttactttacagccttaactctgtcagcaggaaacagctacctcatgagccacattttttcaagttttagttctgtgatttacaggtgtaaaaattttctcagtaagggaacaagattttttttaatctcacttttttgggcaaattctgcctcttagtctgtttgctaatacaagcaaaccaagaatgcccttcccacaaaataaagaaagtagtagagacaagggcttccctgggcgctcagctggtaaagaatccacctgcaatgcaggagacctcagttcaatttctgggttggggaagatccccaggagaaggtataggctacccactccagtattcttgagattccctggtggctcagacagtaaagaatccgcctccaatgcaggaggcctgggttccatccctgggttgggaagattccctggaggaggtcatgataacccactctagtattcttgcctggagaatccccatagacagaggagcctggtgggctacagttcatggtgtcaccaagagtcggacacaactgagcaactaag

SEQ ID NO: 35803 - DNA, 860 bp, Bovine  19866880458116
tatgtactaatacttattttgaatatttataaatacttcttatatgggttaaaatagtggtgtactttcttatgagatatagagtttctggagactcaattatcttttcatctttatgcattaatgcataactttgtttgaggggagagtgaagtttttgcaggagcaaaatctaatcaaaacttggagaaacattccatttctctgaacctcattaagtacagataatacatcactttgattcaaattattagacatattttgaaataactgattcactctgataccttacctaaattaaacagctcagctattgacatgatgacctggagctattattcccagcagaaaatttcagtttacaaaaccatcaaaataaattaagctgatgttatccaacctgcctgatgagactgagggcagccagaggccagactttatccctgagagcctgcatccttgtgcttctcatccccagtcaccctactctctgccaacttctctccaagcatccaaagtctgacttgaacccttcaggggatagtctctctcaaggaaatctagaagtttgggaaagtatttttcttcagatgacagcagttgaagtgtgctctcatagtcagactgattgattccgtggtccccaaagcacatttttcccttgccctgtcttcttctgatctgaacattcagctttcagaaaatgagcaaattatacatgaaacttggggtttctaggtggcacaatggtaaagaatttgcctgcaggagacacaagagacatgggttctatccctgggtgaggaggatcccctagaggaagaaattgcaacccactccagtattcttgcctggaaaat

SEQ ID NO: 35804 - DNA, 1121 bp, Bovine  19866880460072
cagatcaactagagggctggaattcctgtgttgctcacatgtctagcatttggctgagtgatgggagtgactgagccatatgtccccagtaatctagcacattagcctgagcttctgtacatggtaactggcttctcaacaactgtaagagacagggcaagccccaacatgcaaatgcttttcaaacctttggttataccacatttgctaatgtctctccagacagagaaggcatcataaccaagtccagcttccttatactctacctcttagggggtggagttacaatgcatctgtaaccatttttatttttcaagctatcataaggttgaaatgaatttaaatatatttataagtgatgttagtattttgaattacagtactattatagagcctaagggcattctctgtgaccaggaattcttaaaactgacttttgtagtggaaataattttgaataggaaaacaaagttcaagattcactgagattccacatgagatatgtatattagctcttgttaataaggacatttaatagctgtgggcaatcaggatgtgcatacttgcaaatgccacctaattgtcatatatttgagcattaataatatctaaggaaatgaatacaaggaagttcagtgactctttctatttttgccaacattatattggatacctgtaataattgaactgttaagttgaaaactttactagaatgttttaatctagttatatatataaatgtataaaatggtaggtattcctatctgtgtataatccaatttccatattacacaaagcaatctgttgtttagaaagaaatcaggtaggaggatattgcccttccacctccactctgctcctctaacaacgacacgtaaatctcattaccaattaagctgcctgcatgagagcccatcaaatgcctccaaagtgctctagtttcctacatgtaattacaaattgcagaatactaattttggtgtcaatcaatctgagaaccagtgtgctgcactaatactcaccggggggcattgaatatcaatttctctggtctgcctctagcttaggtcaattccctatccctgaattggctattctgtttaacatttatatctatacca

SEQ ID NO: 35805 - DNA, 1241 bp, Bovine  19866880567252
ttggttggatgccttagtatttgtaatttcctgatttgtaacattaaggatgttggaccagattatatgtatcttccctttcaacgtatgattttgtgtgtgatttactctcataaatatgtgtctgcaacccccaagacctttctttgtttcagaaaccctttaaaccttttgtatgagtagcaataacggatttgttctctcagcccatataattctatttgtgattttctaaaggtctatagtgaaatttatttctcctctggtaagagggcatatccagaaacacacagagacacatatcctaagtcagccagcagccagcaaatagttctcaaatgcttgttccccagacttttgacactagtaccaagtagaagcaaaaaatggaaattaattttcatctaaaatatccaaactgaggtttatttagtcatcaatagcatttctggttaaatgtacttagaattagtgaaaacatgcctaggaggccaaatttgcccaaacatttccaatacagctttaataacacagataaccttttagataaagcaaacgtgctgtgctgcttggagtaagtaataagaatttgcctgcaggatattcgaatgggggaatccatttgaaagatattacaaaccagaaattgtaaggcacaaaaagctgacttgtttgccagcaaggtctgttgatgtgaaggtctattgactagatacaatggaggatcgatgttgtctggggagagaagatactggagcccaatccttgtggcaagttgttaacatcccccattgcactgtcagaattgctttagaaatcaagttgatggagcagcaggaataagagtggatcatttgggttcactggcctgggggccagacattgatggtaggtgggaaagactgagctcagaatgaatgtttcatcagagctacatgaaagcaatttcaatgatggactgcgtgaattatcacacatagaaactgctgattttgcctttgtgaaagtctgaaatctgagctgttgttggttcctctttggagaggcagacaatctcttccacttctactcacccaactcccttttggaactgaacggcagtagacttcatggttctcaattctgtactgtttcgatgcctcactttgctaagcttaaaagaagtttcaaagtatctatgtcatatacttgtgaaaattaaatgatacaatacctgcgagtactcagcactcagcactgtt

SEQ ID NO: 35806 - DNA, 878 bp, Bovine  19866880601668
cacaaacaaaattacagcaatataaagctagacataaataagaaaataattaaacctaagaaaggaaatactatagttagatacaaaataaaatgttacctccagaacttttcattttaataataagttctatccaacttaagagttaatagagagttaaaaaagagtagtttaaaataagattggccaaagaactaggaaatttcctttacaaaatgctccttcataagcagttaggcaagatgacctgttttgtttttaatttttctaacagagtaaatgtataagaaacaaaaggtcctgttttcacatgcaaattgttccttttaaaaaatgtcaacaggcaaagaaatttagccaacacgtggccctgaaacagattgtttacagatagactgttttccggaatgtccccaagaagcatcagtggagcaaaggacctctgtaaactgaagtatttgagtgtctgcaaatttgtttcatcagatgcccatgacattttttttctctatttggcttcttcaaatggcaaaaaattccaaacaacaggcattattttgggaggaaaaaacttggtactttgtgctgactttttttttttttttttcctgtgaaagtggaaatgttaagaagtacgtgaatacacacaacaggaagttttgaaatgtagaaaggggaaagaagttatatatatatatatatatatatatatgactatataaaggttaaatatattagttgaatttaagggttactctgaataaatattctggataaactcaagtttcatgtatgtgtcctcaatcgtgtctgaccctttgtgaccccatggactgtagcccgccaggctcctcagtcaaggaattttccaggcaaga

SEQ ID NO: 35807 - DNA, 2655 bp, Bovine  19866880701412
gatgaggttcggcaaggtgtcaggaagcaaatgatagttgagcagcaggtcaattaccaccacatacaaagagctgcaggtgtgctaattgctaaagtctagggatgtcgctgcaacaagctggtggaaacctgtggcagcagcagttaaatatggcttccctggagggtccaagctcagagctaaaggtcgattccaacgttacccctggcacatccaactactcgtagaagaaataaaggtaaataatgccaagggcatgggagcatgggcaaccaggtacattgtaagagctgtcgttttagcctgagcgtcttgattggtggggaatggtaatagatgagactgaaaaagcagcgagagaagagaattcttctagagaagaatttggatattttctgtgggtgatgggaaaccttgatgggttaaaagcggaaaagtgacaaaatcaatcttgccacagagatagattattcaggcagatatgcagggggttggaaagtcaaagaagattaatatggaaggcaaggggacccattagaaggctagggcaataaggacaaagatatttgtggcagcactatttacaggggtaaaaacacttgaaacaatcttagtaacaaccgataggaatgaagctgtgccgtcatgaaaaagaataaagtagttctcttggtttccctgagatcaaatctcttaatcgaagccaccgaggcttcagaattagcgtgtagcatcttgacccattcttttagtggcctacagcctctacattctgggtttccccaatggctcagtgggtaagaaatacctgtaacacaggagatgcgggtttgatccctgggctgggacgatcccctggaggaggaaatggcaactcattcctgtgttcttgcctggagaattctatggacagaggagcctggcgagctacagtccatggcgtcgcacagagttggacatgactgagcatgcacgcatctccattctagcccccatccactttctggcccaggtaggagatgacttgggagaatggagcattagaggagcaaattgggactgtgagcatttttgtaaatctccccttacctgagaattctctgccataatacagaattctgccttctttcttccttaccatgcatcccagtgttatggtgataagaatagacagtaatcttttatgtggcatgatgttatgatgccaatatttggtgaataatacatattttatttaaaaacagttgttatgacaactgcagtgaacactgggattttcatgttgttaaggaaaaaagagtgctcttcctccaactcccaagcctactcctccttcaaaccaaggttagttcttccgtggcttttaaaatgttaacttctggatataaatgtgtaaatgtaaaaccaagcagagctctcactcccagtgggttattcatgagcttgccttttgtccaagatacttcagttctctcctgttgcttaaaggctttgaaggaaaaaaatcctagagctccgtggtatagatttttcagtctccctgaagcatccagaattgttttttatttctcttcccttctgaatccacgaagacaaacccttttttttcttaatacagttttattcacacatcattaagctgatttaccatattatacaccactgtaggcttagcaatcgtgcttttctctcattgtgggaatgaaacaattattcagaatctcatattaaaaaaaaaagagattttgcctgatcctgcaagtacacatcactgggaattttgctaaaacctctgatgttattaaagttcacaatgaggggaggcatggagggatggagattaagcaaattataaatgcaacaaataaaatgctaaactgtaaagtaggagtgtgtggtccttggggctcaattggctgacataaaacatttctaaggaggagtttttacctggggtgtcatcatttcttactttggaaagtgcattttgttggatggtttgctctgtgttttggaactccctgatcccaagtttgctctctcaaaacacatgctacaattgttgtttccctcagtaaatgctagagttttaaacattctgtagtcttctctaacacaacgaagaaagaagaatcaaaagtgattatccactaatgtttggcgctcaaaggcaggatcacacacaataacgagttgacaatacacagcatggtttggagatgagtaaacaaggcaccattactccctactatgaacaaacacctggaagtgagacagtggcagaaaaataaatgaccagctgccaggttaaaagctcatcattcaaggagtgtccttcatctacttgaaagcatctggaaagtaacgggcaccagcattaactgcacactcatttgtaaggcttggcggcatctctccacttgacagcaccctaatcattcatctggtggcctgggagtgtgcagactatgcgtgtgaaaagacaaagtgaaaactgaacaccagcaggattttaccacatggatgcctgccagtggaagcagaggcagactggaggaggaactagatttttcagacaatctttacttgccccctttccctctctttcagatcaatctattccaaccgtctttcagcggttgtttttttttt

SEQ ID NO: 35808 - DNA, 1375 bp, Bovine  19866880745325
tcttctgggaggtgtcattgagtaaatgcaaaaataaaggtagacaaatagctgtacaacatcatgaaatgaaataaaagttataaaagacagacatccaaaatctgcttgtggacacagaggcaagaaatggttctgaccagtagaactgaagaggcttgggggtgggggaggtgggcagggagcagcatttgacctgtggtatgaggaatgagaatgacaacatactccagtgttcttgcctggagaatcccatggacataggagcctggagggctaccgtctctggggtcgtgaagagtcagacacgactgagcaactaacacttttacctttcattgtcatgaagaataggtatgattttaacaaacagagatgagagcatgaggaaacaatctaagaaaaagataaacacatgccctggaactacagggtagtaaaaatcaagtttggcaaaaatatcagtttttgcgagatagattgatagaaagtaaaattagttaaaaggccagcttattaaggtccttcaaatggtttgctgttttgcccagcaactgtgatgatcaaaagcgtgttttccatttcatgataaagaggtactgtcaagtagaaagctgatttaggtatgatgcaagaaaaacaattatatctctcagaaccccagtgtgtccttcactaagtgggaatttaattaattttgttcaatagtcactgattactctgtgaacattttaaatggtttgactttttaaagtaagagatatgcacagaaatatgggaataaaataacacactcattagggagatagtaagatagaaaataataaaagtgccccagtattgtaaaataaggcttgctggctggtaacaacagaatgacttattaagattggaggtttattaactcaacgattcatttattcgttcaagtttttactgaccatcctagccctcttgaagatgttagggatagagtaacaaaacaacagcacaaaaaattccctatctttaaggaatttgtatgttcagttgagaggaaacacaatggatataataaacatgcaagtacataaagtgttagaaggtggtaaactgcagagaaaaatcaatcacagtaatttggatggacagaggagtgaggagcttaattctaaatgaagtgcatgtggtaggcttgcctgagaaagggatatttgagcaaagaaaagaaggaattagtaaaaagcccggtggacaagtatagatgaaaacttcctggcataagtaatggacgaacaataagaaagccagtgtgactcaaaagggaggagctgagcagaggaatatgtgatgaattcagacaggtaaaggggagggggggtattgtttgggagga

SEQ ID NO: 35809 - DNA, 1575 bp, Bovine  19866880748993
tgctagagaagccgagtgttggcttcgatctcccagtatcagctttccccacatgcagaaacctggctacgacagctccagactcaggatcttatgtgatacaatgagcccctggcttgcactgtgagcccatcactgtcaagggcagggaggtatgacaatgtccattttgtgggcagctgagcagaggggtggacgggattaccaaccatctctttctataacaaaactttctctgacatctgttaatctggaattcaagagtcccaaactcttctccagacttttccaggtgctaaagagtcttttgcaatgcaggagaccccagtttgatccctaggttgggaagatcctctggagaaggaaatggcaacccactccagcattcttgcctggagactccacatacacagaggaacctgggggctacagtccatgggttcgtaaagagttgggcatgactgagcgactaacatattcaaactcctctctggatgaagaaaacagcaacttgcctaatacttcttattttataattttataagcacttatattaatgtttagccacacatgaatagttgtttaaaagtcattttttacaaatgagaaaatcaaagatctagtttgctgttgtcacatatttagtaagcaatcaagcataaactagacatggctcattttattttatgaaacattgtttccatctattttgctaaatcaaggtattcttcaattcataggcaaaaaaaaagcattgactacagtatgccagggacctggtaccgtgtgtgtatcagtacatatgtggtgaacgaatgagtgtcttacccatgtcacagagtgaagccttagcaaagtgcaggctagaaatgaagatccatgcacaaacgagacccccatttttcttttacatgcctctaccaaggttggcattcctcttaggtactggaagttttccttgttttctttcctgattcagattgccagatccttgtgtttgattttaaatgtattatgacagtacatcctgtttacttggattagttcacaattattctttttgtcttctcttctgtaaaacaagggttactatttcatacctgaccggatccttagcatgtcctttatgtgcttaagtttgtttagttcttgcaaacacatttcgaaactccatttaacaatctaatcccttcatgggtatgtggggcagcagggtgggggagggcggggaggcagcgggggagggggtgggtaatagtgagtaaagtgaaattctacaagctcttgtgcttggctattaatggaatgattcaatctatattaaatgttacaacaactcttaaagggatccatttcactcattagctcaatcatgaggtcctcactgagtttttcatctccaaaatcagaacttgatacatttgagtaaagacttgagaatatggttttgcaaagaacctacttctgtttcagtcctgggaaactgctgaccaaatctcagaacagttagaacataaaccataagctccataattatcagtgaaaccagtttttaaaaggacacctcaccaccaa

SEQ ID NO: 35810 - DNA, 1400 bp, Bovine  19866880784561
tagaatgtctttttgcttatatggtggtggtgatttagtcattaagttgtgtctgactttttgcaaccccttggactgtagcccccaggctactctgtccatggggtttcccaggcaagaatactggagtaggttgccctttctttctccagggattcttcccaacccagggattgaacccaggtctcctgcattgcgggtgattctttaccaactgaaccaccaaggaaagcccatctttttgcttataccttgtgccaattttccttttgctatttttcttaatttgcatgtgtttgattaataatggtacagaataagaaaaattatgtttataatcaaacatctttgagaataatcatgaactgatctctgtggcctaggctgatgggaaattttcaaaggagggccttgaatacacacagcctggagagtggggaggcctggctggtcgggctggccacttcccagatgcttcaaggagacattattttggtgtacttgccagggttcaaacctacaagcctagttgtcagcaccctgagaaaatagctctatctattgtgggttgttttgttaatccaagtcctaagagtcatataaagtcggggtgctaattcattgttacacagaacttggagaggcgctgacacagtatcctggtcctaccttctctccttgaagatctgacatgtgggaaacgagattttattggcagctgatatagggatcgtggatctgagcaaggtaggttagaaatttcagtgcttcatggttctagccttccagagcccagtgcctccatcagtagtacagctaatctcagaaagcagggcaatcccacaggactgtcatacctggtaaaaattattgccataatgtgatggtaaagatattataactcttccttgagataagtctcataccagccaatatgactcctgaatgcttggatggccatctctagcatttgtcactaaaattttccttttcttgcagttttcctttagatatgttaatacatttaatcagctcactgtctggtctccgaggcctgggagctatttggtctctttaaggggtatttttgtatctctccactctgatgtcttgatttcatagcttaaccccagaggacaagcatgcttccgttacttccttgttctcagggatgcctctggtacatcttctgttctctcaacagctggcactagtgagacacccttgtggatagagaaggaagagagaacacatgattcttgtttctgctttcataatctttttttctttccaactaggttttgctgccaggcacccagcacagtcaccattttaactgtttccagcaagttatcaaaaagaattgaaacacacgaattgattataattttggtttaatt

SEQ ID NO: 35811 - DNA, 1624 bp, Bovine  19866880838522
agatttctatgcagtttttagtgagaagagtaaagaatatttttgcttatgtcctggaaacattgttaattagacgtgggatgagagaataaattattgcaaagagagaaataagtttacaggaagcttatgtaatggtttgaatttcaaacaattagggaggcgtacatgtttgccgcaggaaatcatagaaatgaatcatagaccctttcaaattagcagggcaagaaaaatataatccatgcaggaaactatttccatcctccgtagattcttcaattgagataggcttcatgtatactttaaattcattagattttatttttccttttaaaattaaatgattagaaagtttaaaaccttgaacaaacgacagtaatatagtttatagggatattgtcataagaaggaaattaatgtgttcagtatgatagggtcaacttaatcttgaacgctttctgctgtctgtagtttcaatatttatgataaagtgaagatactgctattagagattttgaaattaaacacagagtcaaggaagggtatttataataaaggcaaaagggaaataacatttaaaaaaccaagaacagaggaaggaaagagattaaagaaaatgtcacaggttgaaaagcctatagtcctgcagagttcagaacacatggctttagttcagttaccttgagcgtttttggtccaaattccccgtaaagagttattagaatctgcttgaaagtagaggtattattcaccatgaaacctgtctatatccgatgttaatgttacagtttatttatttattcttaacattatatttgatgtgcgttcatgtccacctgtgcttctcactttctttccttatttgggtaatgaacaaacactcatgtgcattagggagtgttctgttgcttatagtcacaataggaccttcatcagacactattgaagaccttagagagttctcaaaattaagcctaaaagtatatggatccctatctttactttctatatttcaagtatatattttgaattactttataatataagctttccccttttttaaggtttgattggtttttaatttatttatttttaattggaggatagttgctttacaatattgtgttggtttctgccaaacatcaacatgaatcaaccataggtatatgtatgtcccctccctcttgaacctttctcccatgtcccaccccatcccatgcctctagattgtcacagagcactggatttgagcttcctgtgtcatatagcaaattaccaccggctatctattttacatatggtaatatatatgtttccatgttactctctcaattcatgccacactctccttcccccactgtatcaccaagtctgttcactgtctgcatctccattgcgcccttgcatataggattatcagtaccatctttctagattccatatataataggtatataccgtgaagaaaccataattgaaaaagacatgtaccccagcgttcattgcagcgctgtttacaataactaggacatggaagcaaccttgatgtccatcgacagatgaatggataaagaaattgtggtacatatatacaatggaatattactcagctgtaaaaagaaca

SEQ ID NO: 35812 - DNA, 2546 bp, Bovine  19866880867397
cacaaaagtggctatttgcaatagcatgaagtgcaaacaaatggacacggctgtgtttcaataaaattttatttacaagaaacacgcggcaggccagatttggccaatcagccatagtttgctgacctttggtctaggaaccagcaaggtcggcaactcctggagacttattgaaaatgcagtacctcagatcccaccccagatttgctgaattaagtcttcatgttaacaaggtgccctgatgattctatgcacattaaagtttgagaagactggtctctaaggcgagacaacctctatcccttttctgggcagcatgagccatgcctaactagtctccctgaacttctgccttcacttaactcttgttaagatgctcagttgtgtccgactctgcaaccccatggaccaggcttccttgtccttcgccatttcccggagcttgctcaaactcatgtccattgagtcagtgatgccgtccaaccatctcattctctgtcgtcctcttcttctgccttcagtctttcccagcatcagggtcttttcaaatgagtttgctctttgcatcaggtggccaaaatattagagcttcagcttcagcatcagtccttccaatgaacattcagaattgatttcctttaggattgactggtttgagttccttgcagtccatggcactctcaagagtcttttccaacaccacagttcaaaagcatcaacttaactgttgccacctctcaaaccagtctccaagaagcaaagggattttcttaaaatacaaattggatcccatcacttgcctactgaaaacctttcagcagcctgtcaattagggttgtcagacttagtttaaaaaaaaaaaaaaaaaacaagatgccaagttaaatttgaatttcaaataaacaatgactaaattttcagtataagtatgtcccatgcagtatttggaacacacttggactaaaatgttgttctttatctgaaattcaaatgtatctggatgtcctatattgtgcctggcaacccagtgctctgagattataatccaaactccttatcacagcctagaagaccccgatgatctggccctgtctccttcctgacatcatggcacaccgctcaccacctcctctctggccatcaccacaccggctaagctccttcctgccgagaccctggacaagctgtgacctctgcctggagttcactttcctcccatccttcagatttcagcctaaagacttttgtgtcagagagaggccttccctgagtctctaaaatgagcacaaactcctcccccctaagcccctgtccccctattctccattagcctctgtatcagcaccctctttccactgaagccctttccataatttctggtgtttatttggggcttatttttcatttgcctatttccccaccaggatgtggaaggagtggaggagtgaaaaaaaaattcacttaactttccttctccttaaaagaataaaggctttaatatagcttgccctccctaccccttctttagcttttcagaaataggctgtccatgaggagtttgagagaactataaaaacaaatttcaggaatttccctggcagcccagtggttaagactttgcgcttctgctgcagggggtgtgggttcgatcattggttggggattaggatcccccatgctgtgcagtgctgccagaaaaaaaaacttcagaggccctctagcatcttcccatcacgtagaatttataccagctggggaaaaacttgaatggcacatagcaatgggcaggtccttttttaaatggtggtagaagaaagtctgaaactgcaataaatatctgcctgggatggaagatgtgttggatgagtatctgcattggaaggtttggtacaggtcatcatttaacttttcccttctcatagagtaatcacacgatttctcaattaaaaaattcacactgaagttacatttatcattatattactactctaccatgaacttgttcttgtgttctcttttttaatgctcagcatccagggaagaacatttagggggtagggggcctttccacacgagactgttccttgagcttaaagaaatccaaagaaggaatgatttcttcggattataattgtcttagaagaaggtgaggttttatttgggaccagaaggtcagggaatagcgcagaagagggagagagaataaatagcatgtggaatcggggaggaagagaagaaaacagcagagccagagaacaggagtggcccagtgtgactgaaggaaattcatcaaaaaatagcaaaataataatttaaagaactgaaattggatttggtttatagactatatcggggacttccttggcagtccagtggttaagacacctcactttcactgcaagggatgcaggtttgatccctggttggggaactaagatcccacatgccacacggtgtagctaaaaaagcaaaaagccaaaaaaaagaatacgttgactaatgagtgtaacttgctcagaaaagcaaagaggagccacagaagttgt

SEQ ID NO: 35813 - DNA, 2639 bp, Bovine  19866880897076
aatacttatgtatttatttggctgtgtctggtcttagcctcagcacacaggatctttgttaagtcatgagggatcccgcgttacagcactcagctcagtagttgtggcacaggcttagttgctctgcagcctgtgggatcttagttccccaatcaggggtcaaatctgcaccccctgcactgcaaggcagattctcagtcgctggactaccaggcaagtccctcatctccaccttttggaagagactggaaatacttattttctctcctgagggtataaagatgatttcttttctccatagatggatcagaatcttccttttaatactagagtacaagagaaaatattccgtataaaaaaagactaattgttcatatccagcctacgaataactgctggaaagcaaatttttctgaagtcaagtactatgtaattcccaaacaaaaggaaaaaaataggctttgttttcaatcttcttgcataaatattaaaatgataattttaccagtatattcaccttttatcctatgtgaaaatgagtccctgatatgataaatcaatctttgtcttattcctcctgttgaggtgatatgaaggagtgttgagacaatgacaccatccccacatgttcttcaatagataccactcttccgattttcaacaactagctaagtgtagatttttcttgcctgtgccgccaaattccattcctaattaaaatccaaaacttaccatcttttcgtgaatatagagaaactctgtttaaagttcctgaatatccctttatgatcagaaggagttaatgtgactcagccttctaaatgtctcacttaacagcagacactctggggaaatgagcttattaatatgttttggtttagtttttaatgagactcaggaactgccccctaaacaattttattagtgcatagtatgtgtcagcccttggggtagataccatggagagtaggacataatcctggtgactagaaaacatggagtctacttgaacagagattcttgcatttgcattttttaaccttcactttgttcccatgagagcattttaaacaggactctaacatggaagcactagagatatccgtaacaggttagcagtgtttatctttgagtggtatgattataggtactgtactgtttctgtgttttttgtttgtttattttgcagagagtatatgtaattttttataagtagagcagtaaacactagtttttgaagtgatgaacatgatgttatataatattcccccttatccatggaaggcatggccaatatgttccaagaccccctgggaagataccaggctacttttctatacatacatacctgtgataaactttaatttataaattaagcaaagtgagagaatatctgaattgtcagcattgtcttgctctttggggaccatcattaagtaaaaggagagttagggtgaagggtgaagatcgctcagtcgtgtccgactctttgcgaccccatggactgtagcctaccaggctcctctgtccatgggattttccaggcactagtactggagtggattgccatttccttctccagggaacttcccgacccagggatcgaacccgggtctcccacattgtagacagacacttaactgtctgagccaccagggaagtccaaaatgagagttactagaacacaaacgctatgagactgctacccagaaggtctctaagtgaccacacttagagtgggatgtgctacacaaaggtatgatccacatcccagatgcagtgaagaaggatagcttgagatttcatcatgccgcttggaatggcacatgatttaaaatgtatacattatttatttctggaattttccatttattattttcaggcgatggttgcctgcaggtcactggaactgtgagaagcaaagtggtggataagagggggactgctgtagtgcttttttacaatagcgtgctcagtgaatattgttaagtgaatgtatgcctttttcaaattcttgaacttttctcccttaaaaatgttaaggattttatttcaggtccaaagaactccccagacttcctctaggagaggtattctgctaacttttatcttcaacatttgaaaaccaagtaactaaagacattgataaatgctgtggatgttatattatactcagaggataaagaaggtgaatttgttttctcactggaacattttatgaatcaacagtattgatgtgtaggaataggcatagttcgagatcattataacttggtcttacacaccactgccgaagtcttccaactcatcttgatggaatagattagagaatgcaaaaaatctctctctaagctgtaagatgtaaaaataagatattacaaaaactaaccttaaattactaggttagttggctggactgtgagggttaatgagtccagtgtttcaacttcagatagccttctttagccagtggctatattgctaaactagccagacttcctacataaatgtgcaatgatcttaagaaaaccagataataggaacatagtaacattgttaaaaaaacaactcaaaatactaactttaaaaacaggtgttatgtgtgtgtgaaagtgcttggcatcaatacggggctaaag

SEQ ID NO: 35814 - DNA, 1365 bp, Bovine  19866880924256
aaatgaaactagcttgttttctgataatagtttttctatacttttgctgaggttattgatattagttttactatgcagtcaagattttgtatgaaaggatagaggatatcctttgagttgagacttcaaaaaaaaaagtaataggtctgacacaggaggccaggaggggatggataatggtaccattagaattagttctgtgtgactccctgatgtttgtgataacagaattcaaccttggtcctatgtccctggcactggtttgtttagctgagattctgccttggtcctggttatcattctgctccaatacccccaagagaaataagaaccatgtccagcctgtgccaggcgcctttactgaggtttggtatcacctcttcccgtaaaaatggcaggtcaaaaaggaagcccattatttagggacaaaccatgcagatggtatttctggtttgtctcccaaggtcagctggctgctttacctagaatccacgttgaacagtttttacatcaaatcctctgtaccaagatggcggatcatcagtcactgagaagtcaggcctcttcctaacttctctgccttctgaataatctgttttatcccagtcctgagagggccaaattgttcagttaacaggacaggttttcagactacccattggttagctggagaaaataatatgatatgggatgaatggtcaatagcataatataagaaactaagagtaatcaatatctttaagatcccatcaagaaggaaaattatatgcaaaatagctcaatcactaattagtagttgttctcaattagaggcacctctgttttatgttgactttttcaaaatatcttaaaattagggagttagagttaccaagttatttgaattgtattgtaaatcactgggaaaattcagtctaattcatgtaaaactcctcaattatcttggtaatttagaaaaattagtgcttcctatcctgatttacccaaataagtatggttattgacctgaactattgtctttttattgtaagtagcattctggtttggattggcagttttttaagtgacattttaaggcttaacctctttattaggagaaagaaaacttaagaaagagaactttttaaattccttgctttgtaacagttgctaataaatgaaaaaaaaaaaaattccacaaccacaaagactgagtctaaagttgagtttattctgacatttcatagacaaaattctaattttctagtatcaaaagatataatcaaatgcaaacatagttgattttaaaagaattttaatgatttatttaagtgaaaaggccaaaattatttgtttataatcaaatttcccagcactgccaaatag

SEQ ID NO: 35815 - DNA, 1035 bp, Bovine  19866880930657
actgatttttcttccttggaaggagaaagcagagaagaagcccaagggctctgtcaattgaaggcaaaatttatcaaaaatactatatgatttagccgtcagggccttccttccttccccatcctttattttttatagaaaagtaggcaaagcatggaaagataaagtaagaaaaaggtggttaaataattttacataaagaaaatcttcccctggagcaaacaaacataatcttaaaatattttgaaaatacattatgcaagacagaaagatatactaatctgtgccaccaaattcctctttaaacatttaatccagcacaggcaggatatcacaaatgatgttactcatagctgttgtctaagtgattgattattgagaacccatatgcaggtatttaaatcttagtctggaaacagagaaactttagagtcagtcaccagtgaacaaatgcctaaaagaaacatacagaaaatccaaagttgcaaaaaataaaaccaggttttatttcagataaatggaagtctcctttgtaaattcatattcaaaataccataggggcctctttcttgtaagtcacagtacttcacaactcaaagaaatgctctctttattgagaggcaataagaatgagttataattaggagtgaaccagcgactgctggcctccgaccaagtgaaaacacggtaagaaccagcccactcccactccgacgattccagaatgcgaattctgcttgcactgaggaggctgacaagtccatgttttgaattacagtttttgctcttaaattgattaggagaaaagttaccatggcctgaaccttaacacagaagcagttccaaaccctaacgtgaacactgttaattggtggccagtcatttctactgaaataactccacttttcactcttcctggttttctccatctgaaagtcttccgcgtggtaaaggctgttaagcaggcatgaaaaagcacaggcctcattgtgtctcgctggaattgacaacagactgttatttcagcctggactg

SEQ ID NO: 35816 - DNA, 1936 bp, Bovine  19866880946607
tcactttcgtgcattggagaaggaaatggcaacccactccagtgttcttgcctggagaatcccagggacaggggagcctggtgggctgtgatctttggggtcgcacagagtcggacatgactgaagcgacttagcagcagcagcagcagcagagtaccaaacataaagaagagatagaaagggaccaaaaaaaaaaaaaagggcggcgtggtttctgtatctatgtaaacagaaaaacagaggagctaggtgggctacagtccatggcatcccaagaatcagacacaacttaacgactaaacaacaaaacaaaaagacactaggaattttgaaacaaagtggtgatatcaagacaggaaaaagcatttctggataggagtgatgctggctggattcgtacatagaggtgatgaactgttagccaactatacttattaggttgtaagttccttgatggcaaaaaaaatacttctagcttttctaataatctttacaatagggctttatgtacagtaagtattcagtgtttgtaaaattgcagcgtttcttaaaatgcacaatggttgataataaagactggatgcaacctaagtgtccacaaagaagggattggttaaatagatacattcaagttgttataatagtgaagtatgtctacatggggcttcccaggtgatgctagtcgtaaagaacccagctgccgatgcaggagacacgggagacactggtttgatccctgagtcagacagctcctctggaggagggcatgataaccctctccagtattcttgcctggagaattctatggacagaggaaccagcgggccccagtccacagggtcacaaagagtcggacatgactaacatgactcagcacacacacatttcttgaagtccaagaaagttaatcttattatgccgcttacattaagaagttcataggaaaaataccaaatggacatcctctggcatgcaatattttgtgccttatcctttttggaggaggctaaacaattctccctatattgtaagactctagcttctaatctcaaagagttaacccaatttttgtgaacaatgaaatctttctgtgttacattaaaattcatgaataaaatggtgttcatttacattaattatagtgatgattgcttacagttatgccagagaagatattccaggctcaagttctatttttagacaactgttctgaggatcattccacacctgtcctatttagcagctggaatagttaagcatcatagtgcttttaaaatagcagataagccaaccacaaagacatattttaaacaagggtgttttaatattgaagatcatgacttgaattctttcaatgctatcttaataaaagtattttaagatctaagatatgatccatgtcagatggattaaaagaaagtggatttgcctgaaatcaaaagaaataaaaatttcttccccacttctctgcttctataccttagttgtagtcattagaatcaagtaagaatgaacttcggctccataaaatccacattagaatggagaagagaaatatctaataactgtgttatgtcaaagtatgttttgagctgaaaagaatcttctgaggtttccctcgccccagtctaacttcagtacccttgttttacagaagaggaaaccgagactcagaatgttaatatgagagtcccagtgtggattctaaagactgtccaaggagccatggtaaaaatgaggctcaacataatgagttgtgctactatatataaaacaggtaaacatcaaggacctactctataaaatagggaatgatattcaatataataatctataaggaaaaggatctgaaaaagaatatatgtacatacatattacatatataaaaccaaattactttgctgtatacttgaatctaaaacaacgttgtaaatta

SEQ ID NO: 35817 - DNA, 2814 bp, Bovine  19866881023757
atttttctgtttttctgaagagatgctggaagctaatactgaaccttagcaaatctctctccttaaaacattctgagctacaaaccccctgggtgaatggctgtagggatccacctggcatgaggtgacatcctctgacaatagtcattatccagtaccctgaaaggcaggccaggggagaggcatcagggagagaatgctcggctatgagagatgtttctatctgaatcagtcacagtgtcatcagtgtaggcctgagtcacgttcagtcttggtcagttgagcacacaaggccagaaaagaatctaaatttagtctaaaactctgctaactgccactgcagattagcttctctctgctgctgctgctaagtcgcttcagtcatgtccgactctgtgcgaccccatagatggcagcccactaggctcctctgtccctgggattctccaggcaagaacactggagtgggttgccatttccttctccaatgcatgaaagtgaaaagtgaaagtgaagtcgcttagtcgtgcccgactcttagcgaccccatggactgcagcctaccaggctcctctatccatgggattttccaggcaagagtactctctaccccaggacaaaaactggggaaactattgtggtttttatccaaatcagatcactgcaaacctcaaagggctggtgatcagaatatactattctgcagtcttttctccaggacttctgggcttcagtctctcagattggtctgagtttgttgttgttcagactggccatggaaggtgactggccactcttcttaatcaataagtcattccatagtacgcgggatgtggatggaggagataactgagaggatggcgaatgactgaggaaacactcccggcattctcagatccttgagaaggggcagtgacaggaccacagccattggtttatgcacatggatccacaaggctgttgtggcaggagatgttcattaagctgttctctaagtgaagacagggtaaagtataaatgaaatttcccctggaacttcagagggtctttctctctcttggggaagacttgtagcagaaaattggcagttcattatctgatttgttcatatggtcattagcctaaaaaccagaagactggggcaaaataactatatataaaataatgctgctcaaaatatggtctaaagatgggcagcagcagcatctgaatccagcattccctagaggcacatattctcaggtcctatcctaggcatacagaaaactgttctgaaaagttttccagatacttctccatgtacaaaagttcaagaagaactgtcctaggcctataggagaggtgtctaaagtttccacttctgttcactcacaactaccccagcttgcttgtttttctacccttagtttccagttctcttatcctgatcatatgtgactaggtcatctggttatatataagaactcagtcttgcaatttttatcatcagtgtaaatcagaattctatttatggaaaacaagtctatagaggcagtaaaaacgctggttcttagccctgtgactggtttgcagtggagagactatagttacaacttctgaaacatttctgttcattcgcagaataacaatgatataaaataaaggatgaaaaaaggtgaaagacacttacataggctgcaagttgctcctgggaagcttttacttcagcttgtaatttctcaatgcactgaaaaggggtaaagtttagaaacaaagtgtgtaactcttccttttacatattcaaagtgttccagatgtaaatatgtactggttctcatattttacaaatgggagcattatctcagctagatgttttgaatatcatcattaaatagatcatcgctcccatctctttctctcttctactccatggaagaacacatcaacaaagtatatgaatatagtaaaaactaggtcatgattgggaaaaataatattcgcttgatgtactgaaaataaagttaacctatcttatatcacatcatgtatacatacatgtgggacccaatgaattggtatctgcctttggaatatatggatatattttaatgtgaagatatatatacctatatatagatacagattatctatctatccatccctctatcacaaaagcagatacaaaacaacatgggttgaacaagagataaatttacataatgacacatatataaatgtcctaagattcagaaattggttacttcttataaagtaatttattaaaagtctatgaaaaatgttttggtcaacttctttcactacccagaaagaagctattgcttgattaagttcaattgaaaactacaaagtatttgtatagtcagtatcacttataaaataaataggatattcacttaatatgattcaaaagaatacatatcaaacttaaaaatatcaccaagaaagtttatttttgtatgtgaatattctatcaggaaatacagttacattgagcaaatacaaaaactgtgatttaccatcttgaacttaaatatgaacttctagcccagccagaaataactacaggattgtcagctcatatgtttaggtaacttttaaaataaagattattcttcttctatgacatacctggtcttttgcaagaaccaattttttgtatggttctccactgtcttccctacagtccagagcttctagctttttctccagccaggaaacttgctcaagcagctttgattttgttccttccgagactgcaagcgaagaaatgtgcttgtaagggtaggaagtacaatacttttttaaagctatttt

SEQ ID NO: 35818 - DNA, 2739 bp, Bovine  19866881050601
tcaataatttacaaatttggaaagctcaacagcatgtttaagctaaaggaagcatcagtgtaagatgcagaaatagaaataaatgtaatcacttggccaccacagtacaagaatattcaaagacatccaaattttgtaagtgcctgagagtaaagtgttcctttttttggtagaaatgattcttagggaacggtcacaattgcttttacctaaacaatgaaatgttcctttcagatgaatagtggaatgtgggcaagtaaattattttgaaagattttgacgcaaccattatcagcattaataacaacaaaaggcagttattttaagaaggaccagagtcactcacagcagtattttaatcctgactggctttccctatcacatagcacacctgtcttccctttgcttggtccctttgtatgtgctcaggaaataaagtctaattttaacgtggaccaaggaaagcttaattgaaagctgccattttcaaaagtcatgtaatacatcccttttctcaaactaagctccttggactctaagttcacaaagtgcaaacaccctgaattagtcacaaagccccgtgtgaggagtccatctcagccacagtcattctcactgtcggccacgcactttagtccgttcgcagagaaaccctctctttcttaccccatacttcctctatactgagtcatgattcatctttctaagctgaaatttaccattcctcccctcagaccacccttgtactccaatatccaagaccctcaccaaccccttaaccctcttgtggacctaatacacctgttttctggaccacagattagatggcaatctgtcagtggaatttttctaaggtattactgtatttccaaagtaagttcagaaaggaacaaagatcaaatcacatttggttttgagcaaaatgaccagtggacaagaacaaacttacatgtaattgatctgcagtcacctagggagagggtcccaactctggccgttcagcagctccacctcacacctggtagcctttgaacacctccgggtttcccacctctgagctttgagtcatgatgctgtccgccagatgctctcctcctcaccctcttcccacctgcggctttctctccctccctccggtccacgccaaagtcctcctcctcagcaggtcctcggtcctcccttcacccgaggcaccgacgcttcctgcgcactgtccctgggaatatttcacctgcactctgcagcagcacctattacaggatatatctccactgtgctcctcaccatcccctttttaaacaacaggctccttgaggaattccttgctgctctgggatcattgcctctctaaatagaggttgagacaaacctctggccccttagggttcagggaactgaattcaagcttggaggtgctgggtggtacagagaaggggtgaaaaaaagaacatgtcatccaccctaactgggatgtcaggccattgtggttgaaatagatcttgtttcaaagaatcacaaataatctgagtcacaatgacattttaatagtcacagagctcatgatttaagaagcagttgtttggttttttaaaatttcctttggcctcactgctgatgggtagggtctgaaatatagaaatccgctggaattaggcactctcctttctgtttaaggggtcaatcctttcttacctagattgctttttgatggggaagggtagccatttaaaatatcctgaattgtattgtcttacatgggaactatcaatgccaacacatatccttctcaagcttggagcctttggaccgttcatctcattataaaatttcacagtaagaaaaaatattttgtctggagagaactatcttaaagtaatgatatatttcttattttccaagtgacagcagcagaattcattcattgcatgtggccccttgttctgggaaaccacacacaggcattcgatttcaccgtctcacttttgtggtcatccctctcgcgatgggttgcaataacagctgcagtagatgttgtgtgtgtatagtcctgcctggcacatggtgagctgttcaaaaactaggtgatgaggaacgagtgtgttctctttatctcattgttgtgcaaaatgagatttattgctcatttcccacgcaggaatggagattgttaaataaaccgccccaaatcaaaaaactcaagagtagcccccttcaaaggggaatgagtagaacgtcatcatccttcaactgctaatgccctgcagggtgctgtgaaacaacgcagtctgtattttaagtactctgaaaccatataactgctgtacctaatttttaaaccttgcaggccacaaacctagttatgtgacttgatgtattttcaaaagcagatgtaaagacagttcatccatcgagcaagaacactcacaggcttgtccagcttacactcgcgtgtgatggacgggacaccttgtcccacaaagacgtcctgtgtaccttgtttatatttatctagcagcctagtgagaccaatccgtagactgtgaaatagggagggagttggctaggtaggcaggactgaatttgcaacaactgacagggacaaactttgtcaaagtgctgcgttatcctgtagtagttctgacgcttggctgttgaaatgtgaacatgtcttgtaaaaaggaagaaatatatcctgaaactgaggcagaataaaatcactctctagttttttagctaaag

SEQ ID NO: 35819 - DNA, 1419 bp, Bovine  19866881078813
atcttgaggaaaaactacaaatttccctctagactaaaggaaaaggggtattttaaaaatttctagaaataaatatgaatcattggcacttcctccatgaacagcattttaaattaaaaaaatcataagctcatcagggctcttaaagaccactttgcataatctgaaaacttacttgtctgtcaggagtacatcttattttagaatcagaaatcatatatgtatatataacaaagaaaaatcctaaggagtatacataatttatgtgctctcttcctaatacttatcaagatttcttgttaaacttaggtcagagaagaaataagataagaaataagaccagaaaagaaggtagaagaagaaacatacagtgagcagagagcaagacggaacagatagtagattacaatgaattagaatggctgaggagagaagacaaagctgcagggaaagagccctttggcttttatctgtccactcactttcaattcactaattcaccaaacgttgaagacccattgtgcactaagcatggtgtgaggcataaataaaatcaatactggtccccatacccttgggactgatcattttatcaaggctgtcattctaatggccatgaatgttctattagaaaaagagtaaatgaagaaagtgttggatgttccaaagggtgtcctagcttaacaaatcccaagcaccaaaagaaagaataaatgaataaaaacaagcagaagtacctcatagatattcctcccatggaggcacaattctgtggagactaatgaccacttttcacagagttgacctagggagtttaactgtgttttcatcataatagacctaacgtgtcagtgcccgtggctgggagttgggggtgagtctgaccttgggggaggacaaggggcacaagaagtacccctcttcttgtcctcagtccatgaactgttaacaacccaaacatcttttaattgattgcagcagctttccttgtgtttctctcaagaattagccagctctcgtcattggttttttgtgaccccttccctgtgttgctgattgcttgacacagtgggtgtaattatctccaggcttccagcatgctttaatgaagagggttgtttatctgggtgagcagagaggcttgcctaccccttggtcctaaagtctttgctccgaaaacaggaataaaattaaaagctgttagctgatgagcaggaatgtcaacttttcatctctggcttttttaatggaagaaagttgatattctttttccttcctcacaattctatattacatgaacatttgtcatattaggaatcccaaatagtctcttaatgcccctataagaattgtctctgtcccttgtgttcagttttagagagacaataaattcatgtactcagcactcaccatataacc

SEQ ID NO: 35820 - DNA, 1516 bp, Bovine  19866881092137
ttttgttttaaaggaaaatgggctgctgttgaattattttctcccattttaaagagaacattaaactgtgaagaatgttgatgactattccagagcatataatatagaacaagtgggtcacaaagtctcagagctgagatctttacagggttttctaagctgggtcacagtgctttggttgagcccttgaattagccttaagagtctctttgtctcttctgcttttaaaggaggtgacctccagtcaccttcggtgaccaacttctgtgtttaatgctccctgtcagataataaattgaatcatgctgcaggctaaatgtgttctgtttctttgccttacttactgatcatattacatattatataaagcagtctaggaatcattgcaatttaatgtatagttcatatttatgtttatttatagacaataattttacagctgcagtttgttgttctatatctacttgtatgagcaaggacagaggattttgtgtttgctacctagggaaagtaatgaaggcagcagggttttggggtcatattcaatacttgtatcctaaatataggccaggtggcactgcccttgaatctgtacagtttgtacatctgaatagttataaaactctttaaaaaaatacagtgtgttaaaatgagagagagagtataatcagcacagccaagatatatttttgtgtatttgtgttggccctatttcaggtggtcaaaccacacgcattttcctatttgcgcttgtctagggaattgactgctccatcccatgccctctggggacctatgggataaactgttcctcgctctgcagctgtaaaaatgatgctgtctgctctcctgtggatggatcttgtacttgcaatgcaggtgagtgggtgaatgagtctgttgtctgatcccggtcctgttagctcctaaagacacaggaaagaaaccttaaccagaattccagctccagctttgccaaaatacagtgactaaactcagcaaagacccttacccaggaagggctctcctgctttccagagtcaaggggagaggcttctgtgagatgatctctgaagttgctgccagctccaaaatctatgagtctctgtgatttggggaggagtaagcaagcagaactgtgtcggtgcccctaaatccattggcctggagtcctgacaagagatgcagtcaagcacctgattgtacatgggggccagagcatctttatccatagtttctgcagcagccagcattgtggacactcactgttcatggttcatggggtcctgctttaaagatggggatgttctttcaaacgcactttccttttccttcccatataaatattttatttcctgacctgcacaaaactccgcaccccacagtgtgcatgaccgcatgttagacagtgaggtacccccaacttgatctctcttcccccagtagcccaatggtgcttctcgcttgacagctgtgttggtgctctgggttcagttctgagaaaggctttacgcgg

SEQ ID NO: 35821 - DNA, 1901 bp, Bovine  19866881095881
attagtggttctgagaaccatgaggattgggagatgtatggagtgactgctaacaggtgtgcagtttctttgggggtgattaaaaggttctaaaattgactgtggtgatggctgcacaacttggtaaatatagtaacaactattaaactgtacacgtaaaagtgaattgtatgggaattacacctcgataaagctgtttaaaaaaaaaaaaacaaaaaaacagataatacattccctatagccagccacctgtttcaaagtgtcaatgagagaatacctgtcactggaggtgcagaaaacgatggcatcaggggtgtctgtggagctcttcctgcatgtcccctcgtaatgtcgtaagttgagccaacagagaatcccgaagtgggaggacccgaagggggtgcagataagagagtgtttggggcagaggtggaaggcgggaagtgggatagaggaggatgactgaaggcagcagccgtaggtggagaagcaggaggtggcagagaggtaacgagcggaggaacggaaggaactggtgaagatggcacaaagggcaagggtgccgcaggctgcacaggaggcagggacggctgcggggtggagtacacctgaggcggcaggctctgcacagaggacgcgcttggagaagagaaggtgctggctgcggctaggaaagaggggagggaaaatcacacgtcagtgacatgctttcacttagttttcaaagtatcttattaccatcttgggaaatttttaaatttaacagaccctattcccaagagttatctttaaatacataattaacaatacatgagtatgactgagtgcaaatgacttttcaattcccatcagtaaaagcagcaggtatataaaattaagttatggtattgcacatctttgtgtttctgtttgttttgttgtgcttttaataaaacagacctgcttttcatttctgctaatacaagcataaaacctcacaatttagggctcaaaaactttggtcagaaggttaatctccacgaagtcacagaacattagacaaagctaatgcgctttttaggatatttctgtcataacaaagatgatttctagttaatatgaaaacaaaaaataaaaattaaagcaaaacaaagatgttttctgcctttgggcttaaataaaaaaggctatttaccttcatcctggcaaagattacacaagttttaatatataggcacacctcacgttattttgcttcattttacaaattgaaggtttgcagcaaaccttacgtcaaacaagtctatcggtgctgttttacccggcagcatttgttctttgtgtctctgtgtgacactctggtaccactcaaaatatttcacatttcacattattattgtatttgttatggtgatgcatgatcactgatctttgggaccgcaaaaagattacaacttgctgaatgcccagatgatagccagcattttaaagcaatgctttagcaaagtatttaattgaagtgggtacattttgaagtgggtacattgttttctttttagacataggcataatctactacacacttaatagactacagtatagtgcaatcgtaatttctatatgcactaggaaattaaaaaaatcatgtgacttgctttactgcagtgttctggaactgaactcacagtatctctgaggtatgtctctaggcttttgttaaatgactctgagaaaagacgacagtatcctgactctcctcaaaacccactgatgctagacaactgcacatacctaaaggagccggggaggaggagagcgcagcagaagccaggcccccagaattcggtggggggggtcccaaggtggtgttgtctctattccactttcttccatcatttttcaatttcagtacaactgtaaaa

SEQ ID NO: 35822 - DNA, 1682 bp, Bovine  19866881097338
gtgtccacacgagctaaatgcatacatccaagggagtcaaatgttagcccttttcttgatcacttgtaaccctcttcctcacaaaaaaaaaaaaaaaaaaaacaaaggagttacaagggttgagtgttttaattttggaataacatcaagattatctgcatctggcagaagtgtcaagatgctctaaaggtgttctgttggatcagaggagaaggaattactgggaaaagtaaagttttgcccaatggaggatgaagtttcctttttcagatgagctgagctgtcctctagaaaagggccaaatgaccatgttgagaagttgaagctcagaaaagatcaagatacatttctgcaccagaattcaaaggtgaaacaagattaagctgtaaagtaggaatgataaaccaaactcttgtttttctactggttatcacttcaaggttgtgaacatatataagtgtttccagtttttcctcagaccctgtggtgcctctgtttgggaagagatctaggcacatcatcattatcctgcccattgcctggcccagctgcttctgggcagagagaggccggaaccctcccttggtggctggtgggccaccggtatctcttaaccgtgtatgaggcactcctgctggagagacacgtttttcttactttactcctctaacacatttttttttttttttttttactgaatataaataacttcaattcatcttcactttatattgcctaagtttctgattccacatgcattttgcatcaactgaagagtttgttgagtgggtgaccttcacatccttttacaaggagaaaatacaaaatgagagctgggattaccgttttaaatggaagagctatagttggaagaaaaatatctcctcaaggtccttgaaacagagttgattagtcacaaagaggcagaggcaaaatacctctcctctctttgcactgtttttgcagcctttcttgactagtctttaggttctaggttttaaaaggaaacccctatatgccaagaaggatgaataagaaatgggaaataacattctctcagtctcaggggctttgcatctgtactcacttcaactggcccaataataccattttttcccttcatcaaattgtcatggagcacttcctatgtgccatgttcttacacacacacacacaaaatatatgttttatataggcatatatgtatcatctagtaagtgctagagaaagcaaacatatatcaaagtaagaggaaaaaggagtgtggaaagcaggcatgagctctcaattataatgacctcggagcagaatcctaaagtcagggagagaaaagagccatatatgcatgtgcaaagccctgaagtgggaactgcttgacaagtctaagggacagcatgagggtccacgtgtctctgttgagtgcgtagtgcaatagggggaggggcagtggctcgggaggtggtgcatgagacatacttacactaacaacgatttgctgcttatctaaaatgcaaaattaactgactgtcctgtgtattcttcttgatctatctggtaacttgttttcttcttccctccctccttccctcttcctttccttttgtgcagttgtggtattcaagtgccattcagttagattcattttttcagtttgcaatcagtttcaattttacttttccatc

SEQ ID NO: 35823 - DNA, 1093 bp, Bovine  19866881130590
tttggcaaaaatatttttggcatcaatggcagaaaatctcttaaatggataaaggtggtaaaatgtgattagtaagtattggatgtcatttgaggaaccaaggggcttccctggtggctcagacggtaaagaatcacgtgaaatccaggagactcaggttcagtccttgggtccagaagatcccctggagaagggaatggcaacccactccagtattcttgcctggataattctatggacagaggagcctggaaggctatagtctatgaagtcacacagagtcagacatgactgagtgactaacacattttgagtaaacaaatatggactgccattaacattggtatccctttccatagatgtttgtgtacaaatattaagtacatacaagttgctggttcaaggctaatcataatcagatgagcaggtcaagtttatgctttattaataccaagcttgaaactaaattaaatcctgactttgtgctatgaatcatctgcttcacagggttagattaaaagagcggaatttcagaatatagtcaactagaaattctcttggaaataccctgaaaaactcaaaattatgcattaggagacacagaaatgaaccaataattttataaaatgggatccagggccttttcaaaatatttaaacatctctaagcttatggccaccctggattagaaagaaacaaaaaatcatctccatgatataaatgctgttttcaaatctacactatccaagagtcatgtagaaacgtttaaacaacgagcggtgtttggctgtctttcccaagagcaccaatagacccagctctaaataattcaggaagtgctccagagaaagtttcaagccacattttcttactattgaggacactttttctacctgtccctagttactagattcattttctctaataatgtgccagactcatgttcatcattaaaaaagaaggaaaaataacattaacaaagacatttgctttataaactgccacaaagacagactttttcagatgtaattattttccaagataatttatcttattaaaatatggtaatttaccaggtttcaggtattgaaac

SEQ ID NO: 35824 - DNA, 775 bp, Bovine  19866881164143
tttttttttttcttagaagcagttgtgaactgtacctttaaaatctaacctttgaaatctggctgtgatcattgtgttgaccttagctggactgtattattattctcttgaagtcgaaaggcgtgaatagatctctttgtgtgctcagcccgcctccaagccaggccagcctaggttttgttttggcatagtcacgagtacgacacagaccagtaggttttgatttacagatatacataagtagatgtgatttcctttccaggaaaagggcacgatggctaacatgctttaatttatacacacgaggctcttttaaaaggctgacctgcagctggggcttggtgaaactgggtccttcagcaagaagcattgcttccgaatgctccctggtagactgtcagtctggaaagacatggaggcaaggaggtgggaggggaagactgactgaggaagaatttggggggcaggcacctaaacagctcactgtaagcatttcctaaatttcacatgcatccaaattttccttctccgaatctggtttccttttagttatttcctgtttgttaggcacgggtggtcctttcaccaggaaataccgacagctatgttttttctgatgtgtagttttttgttgttgaagatttctattaagatgaggttgacttggtcccgtcagcttggtgtcaattttctagttgtctacatggttccttcaggtgtcataagtgaaagctctgacttaaccatccccaaagctcaacaacatttccagggg

SEQ ID NO: 35825 - DNA, 1151 bp, Bovine  19866881175476
agggagagaaaaacaggagacttggggaggatgtctatctagaaaagaccttttggggtcttgcgtaagtagttacacttcgtgaacggaaagccatccctataaactattgatttttgtaattctattttttatgaccccataagactttttatttcttcagggtacaaaatcgttcttttgagataacattgatgcttttgagatttgattaataattaactttttttataacttggattacttgaagtctgcctttacaagtgtataatgactacattgatggaatttgtgaatgctgagttagtagtaccatgtagattgatgtgatcatagtgtcaaaaagttgaaatagaaatacagaaagtgtgtaatttcttttggatataattatttgatgtcatacagtcattttatacacacctgtcccagtgtttgaaaatgtgacatattcattgagataattactgaggtcccaacccttatagtgtatcgattgtttaaaagcctggcatcatttaactttgggtaatactattcctttcattccgttatggtattttgtcatttcagaagaaaacatttttaaaaaaaattttattcatatttctgttgtttctcttaaatctattcttttttttcaaaattccttatatagtccttataaagtagattatgtagctggtttatgtagctggtaattccccttttgttagagcatttttattattgaaaatactatattgatattttcagatttatttcatcaaagcccttagttgagtagtaaaacagtctatatttatgcataagtcttaaaggcttttttaatggaaggatattattatataccttgatcttgtatgcttcctgggaaagtttatgttattttaaattaaattctctaaataggaaatcacttctagttgtcccagaatttcagggttttgtttggtgtttctggtcggcttacaatgtgtgagcaagaacacctgcgttgtttagaggtgcagtagttgaagaagtcacctaggctatcaacctcagcttcctcatctttcagagttattttgaagattagagaaaaaaatgtacacaaaggcccttgttcagtaccagcaaaataatggctagtgtagtcactatttcag

SEQ ID NO: 35826 - DNA, 1736 bp, Bovine  19866881177721
gaaaacataggcagaagagtctttgacataaattgcagcagtatctttttggatccaccttctagagtatgaaaccaaaaatgaacataaatgggacctaatgaaatttaaaagcttttgcactgcaaaggaaatcataaataggatgaaaaaacaatcctcagaataggagaaaatatttacaaatgacaaactgactgacaagggattaatctctaaaataaacaaacagctcttgaagctcagtatcaaaacaacccaatcaaaaagggacagacaacctaaatagacatttctccaaagaagatgtacagatggtcaacaggcaccacaactattgagcctgtgctctagagcccgggaactgcaaatgtgccgcagctactgaagcctgcgcaccccagagcccgtgctccccaacaagagaagtcactgcagagagaagcctgcacatgcaaccacagaaaagcctctgcaccagtgaagacccagcacagtgcaaaagaaatatcttttaaaagtttaaaaaagatttagattgtatgttaaccacgagtttagtgtgtcagtgtggacattttaaatcaagtacatgcgtgcaacttttttttttttttttgccaccttataatttcatacatttggcagcatagctgtgtttctcatggtttgtcataatctctactaaaagtaacttgagggactttgaaatgtcacttatacctagttccagtgattttatttttaatgtattaaaaaatactctcaatttcttttttcctgaggctcaaagtctgactccccaggactacaatctgaggtggtctggccttttggtgacagtgggtgaagtcctggagaagagtttactcaatgtcagccggactgattggcatatggctttcactggcatgtctcgtcggcagatgatctacagtgcggccaaagcgatagcaggcatgtataaacagcgcctgccccccaggaccgtgtgagaagcctggccccaggctactgacacttgctcacttggagctactggtagagaagagacagacccttaagctggacaactttagtcagtccaactgttctgatcatttcctgtaggctgcagtttttcttttctagaaaggtgtggtatcattccagtagatgaaaagaaacaggtcctttttatgattatataattttacgtaccatagttctcaaaaaatgcataaatatttttataggacagtttgatataccagatttataaggtgcaaattcatgtgctgaggtatttaacttaatgatatgtacttgattattattttgttttttaagaaatagttgactaaagaacatgtttactgaatattgtttaaaggcattgtttcttttaattcatgattaatatcttccctgccagtctttgaagcttttcgtgtgtgcatgtgatcatatctgaggctaagctgtgggctcaccaacagactgtaagacacctacttgtagggagatggtgcacttttctatgcatatttttaacattggccagaatagcagaattgatcattttccttttggttatcatattatacacgtatggtctgaaaaatccttttttttttttccaagtaagtttcagcatttcacattcatactgtatgataaacattgggatgatatattttatttttcattgctctggacaactaagggcaaagattccagtctatttaaattagaag

SEQ ID NO: 35827 - DNA, 1850 bp, Bovine  19866881188991
gctctggtaggacttctcaagcaagatttggaactggcgaactgaacaaatcaaaatctcttgaaagcaaatatattccaaatcatgggtttttcaagaactaataatgtttatgtaccatgaggccattgtgcgtctcttatataacttaaacctccttttattttaaaaaaattctggtggaagacttggttactttgaaatagggcataattttacaactcttatgggtatttaatttttctctctcattctcagccagttatgcttgatcttcttattggaaatgtttcttgttaatctatttttcattactttttagggcttaaggcaattttccaatggcaaaatcattgcgagagttctcatttcttatctcaagtatttataagctttgtatattctaggatgattttacaactatcttttaacataatctttggcaattttatcggctttccaaagtacttttaaaattcattttcagtcagtaatgccaattgtatctaacatcttacagaaaaactcaaccaaattttttggccaactcaatacttagaatggtcccagcactttaaattctttatcacttttatatcttagcaaaaaactatcaggaatgaggaaatggccaatattttttggctcttcctgagtcattaagtttttaaattttaatattgatatctgaaataaagagttgagagatatatgcctctatcatttattattaacttagtttctctcttcattctaactacagcaacgaacagttcaataatattggtcttttagtttgaccttttgttgcaaagataaagtaggttttaaagccaagcttttcaacttttctttttttccaattaacctccaattcgtcctccatgttgtcaccaattctctcaaaacacaaatcagaacgtcagaatttcatacttaaagcttttgagaactcacctttgtggtaaagtccaaactggccttcattcactccacatgatctgagtgacccgtcacccagcaagttcacacagctatttatcacttctaaatatcacttgagcaatccttgctacttgaatttccccaaatattacatgtcctcactcctctctctttccccaggttattctcttcttggaatgcctgtaactatctggtcaacttaattctcaccagttcctcaagaatcaaaagttacttcctcttagaagagctcccaggccaatctaaacattcttcttctttgccctcataaccctggggcatcagggaatagatgatgtggactttgtcagagggaaaccacactattttcttggccattttcttactcatgtctccactagctggtgaattccctgacagggaattcatctctacatattcatctctacatcatctctacatgttcttaccatatatgcagggctcaataatgtttcttaaccactgattgaatgaattaatgacccataggaaaaaataaacctcagaatatgtacatcagttgtcctggatcttgaaatatttttccaaatattaaaaaaaaataaatgaaaggtctaagttttatcccatttaattgttaaactagactactgcaaaaggaaatcctggacttgaaataaaatgattgcaataccagtgaatataaacacggaaaaccaatgaaagctttactagaaaaatacttgctctaattagaggaaaaaaagtgttgcttctatagagagcttatagatatctttcaaggacttaattaaagttagttattctgtgaattcatttaaaagctcaaggctttcttttcattggcattccttattctcagtatgggcccgctcaaa

SEQ ID NO: 35828 - DNA, 1515 bp, Bovine  19866881229291
tcataaaagtgttaaacagtggccatccttctcagtaatttttttgttgtttcattttgaaaaaaagaagtcatttttcacaaaaatgcattttatattatcaggaaataagacttgttatcatcaataaattaataaatagccctcagattttatttctactatggcaaatatcaataaatataacccatgttagtagggcctcttggggatccttgattacttttttaaaaaattaacttattttaattggaagctaattacttaacaacattgtggtggtttttaccatacatcatgaatcagccacgggtactacatgaaagtgttctgattcccagatgtttgagaacctctgactcactatattcccaaagatatctccattttcccacctaaaagaggaaagggcctcaagtaagggtacctcagcttgtgcatgtgtgctaagttgcttcagttgtgtctgactctttgcaaccctatggactgtagcccagcaggctcctctgtccatggattttccagcaagaatactggagtgggctgccatgctctcctccaggggatcttcccaacccagggatcgaacctgtgtagcagagagccaagagaagcacacatgctggaaccaagctgacggggttcaaatcccagctctaccatgtcacaggctttgaggacttccacaactgacttaacttcgttatgacgcagtgtcacaacgggagcagggagatgatgatgctaataatggtacctacagcagtacttgtgagaattgagttgatacatggaaaggtggagtgtaagccacaaacaggcagtgatccttgcctctttattgattccttgttcacagtaagaactcaatacatgctgagtaaataaagcacttgggacggtaaaagccccacacagggattaggtgtaatgctatgtctttcttttcctgtgcatattttcaatagttgctttggcactgtcgtgaatctctgagtgtttgaagtgactaaaagataaagatgctggtggaggttgggggatggggaacttgccaagctcgttgaggtagccgccgtgtttccagtctgcaggcagcgtgcctgtataatctaccacagggcctctcttcccgggattcacatttttcagattcacaaacagttgattattttttgactgttaaaaatataaacaacaaatagatttaaaaaagaaaatacaatatggcgcagtgcagtgttacccatctaaggaaagcaggtccatggagcatatcaaggactggtccttacatgaggaggcaccaagggacagaggtgaagcttctgacctggtgggacttagaggcagcaggagtaggtgcccctcagccccaaccattccctccatcaccttactttttcattttaagttggtgctctgtgccaattaggcctcacttggatttacatacatggaactttgaactaaaaaaaaaaaaaacccaattcctagccttcccatcaaaca

SEQ ID NO: 35829 - DNA, 1345 bp, Bovine  19866881270020
tggggtactgaaagcataatcactgtgagcagagtaaatagccatgacttctgtccttttgtaacctctagaatacatttctctatcgcatgtatttcattagcatttagcaagggtagaaatgaagtaaaaccaaagcaatcaaaagaatggatgaatcagagctgcagtcctttgggaaaagtgtcctgggacaccatctccctgggaaaatgggttacactcgcttttcccttacaagcaacactaagaccaaagcaaaatatcaatgagctgtggacagcataaaaataattcaaaaatagagtataagcaaatgaaagctaccctgtatttaatggaataaaagatgtcatatatatttctctcccacacattcccttcagatgaaccatttcccatccagagagcagctgagtactaactttaagaccttggtgcttaattcttactcttttgatacagcatgactcaggcacacagctatagctcttccatgagtctgactgttgctacttcccaatttaactcaatcagttcaacaaatattcatcaaaactcttcaggtacaataacagatacgagcaatattgtagcaaacatgaaaatcacaacttcacaaatcattcaggagttcacacagttaagagtctccttaaaacaaagtttctaaacctgactttttctaaaggaagtattgggttttagactcaaaatagctttgcagcattgactctagagattcactacaaaataaaaccactggctctgccagtagcttctatggtcatatatagcaagaatcttcccatatttgttttataacctcagattttcagctgaaatgtcagcaatacacacagttgtagtccattatcagaaacgaaaccaacttaaagtttcatgatcataaatacacaactatcccagagggtgagtcgaaaagcactttcccacagctccaagagaagcttttccatgaagtttacctaagtccttcatccagaaatcgcttctctctggtacctccttcttacttcttcaaactttttgatcctcattgtcttttctgtttctctggtaccaaagagggttccctgttccagtcctgaagttctgttagttgcatctgacaccacagtaagactgaacattaccatgtttttcctatgtattaccgtgagaaagctttaaatttttcagttagttgaatggactacctccggcagaaactatcgtctctgcaacttttgatgtgttattatgataattaagtttccatttctttattttactagattgtcttaatctcatgggatcctgaggctaagatgacaaatgtggg

SEQ ID NO: 35830 - DNA, 1589 bp, Bovine  19866881281467
ttttgagtatctaatgctgcaaatgttgtgtgtggaactgaatgaagattatttacctcaaaaattttcatgtacatttatgacatttcatttatgttacatttttaaatatgccattctttcaaagtcattttgcttggtccttactctgtaactccaaaatgtaatcaacaaatacttggccaaaggtcaataaaacaaaagtatatgaattttaaaatttccctcttttttcccctaccttttcactacttatgtcaatagcacattaattgctatagcccataacatagaaaaacacatgtacacatgtacactgcttagagttgggatgattttgtttttacaaaaatatgatcttttatatgtatcactttccaattatatgtatcatctttctcctgttatcaataaatcataggcatctttataattttttaatgatacactcttaaactagtgaatttttcaacaagaattattttaatctaaatatatttaacattaaaatgtctcattatctttcatatcatacttctcatgccctctggtcaccatatggctgaaattttttcaaacatccttttatcctctcttccctataatacaggtatattacatatgtctatacacacacaaagtccaagcaggcaaagtgctcacacgaacattaagtgatgactaaaggctagtggtgtactggtgaatgtttacctaacagctcttgggagagggggagaaccccaatttatagtgtttgcctatttcagtgttttaaataagtactcccacctaccttggcccttttatgctgaaatttaacaacttgctctctcaagcctatgtgagctggctccagaatgccactgacaaggccacaatgctaacagtagaaggtgctggaacttctgtagggcaacctgaggctagtagagagactcctctaaggaccagcctcttaagagatccaaaaatcttcttagccccttttcttgatccaattctacaggaggttagagaactcatcctttctaaggcttccacacacctcttctaaactccataaggatctttaatgtgggattgggcaaccaggtttcatggactttatgggtttatctccattttaccaatgttggagctaaaattttatccatgtatcctgtaggaagtcataaagcctacttcagaacctaccgtacctggcatctgtaattcagagtgatagacaagaaggcaactagaaagattaggtatctcttatatagtccttaagccctctggtgtttaaagaagatttcctaatggctatttcctccatggcagcataagtataactgccataagagatttcacatgcaagatggtacccagaaaccacagagcaggtgggctagcacaaaattcagtcaattatgaatcatactatataaaacttaattttgaaacaactatacatatttccccagctctactggctatcttggtttcaaaaatgtaaatcaagggatggttaagggaagatttaaataaatttaaatctagagacaagtcaatccctcttggactctggcattttctaaaccaca

SEQ ID NO: 35831 - DNA, 908 bp, Bovine  19866881293852
acccagggatcaagggctgcatctcttgcatctcttgcattggcaggtgaattggagccacagtccaattgttagctctggtctctggccctcgtaccaggcctatggcccccccacattctggtaaaggattcataaatgacagcaacactgtgaaagtgcatgctgttttttcttttagatttccatgagcctctctgttgatgtcccatgcctctatgaacagtaaacaagcctgaaaagatacaagtatctttagaattaggaacaaagacagtgtttcctagcagattgcaatattgtattgccatgcacaaggctcaaattttcttttctgctctgcgaggcattttgcatccttacatagtgagagagagaagagtgaggggaagacttgtatgctctttcaattttagtttcttcagctataaagtgattactaaaataagtgccttttaaatgaatctgtgagaataagtgagatattgtaagcaataaatggtgaattccaacaaaaatattctctaatcatagaagttagtgaatataattaaaaatgtgaggagccaccccctgtaaatatctgataaatatttatgaaatgtagttatagcaatgatgcttctttttttagaaacatttctaaattcttcctgaaaactgagatctatatgaatatgtgtttatgttatgaccttttccaaaaaagaaattattacttgcatctggggaaaatctaaacacaaaacttagtatttgtttataggtctttcctcattgttaaccatatgtttatttaacaaaaaaaaagtattttgtcttcattaaaatttggggggctcatagtaattgaatagcagtgactcaagttcaattaatattttaatatttatatttggataaaggca

SEQ ID NO: 35832 - DNA, 722 bp, Bovine  19866881317855
cgaattcacaatttggctagacagagtctacaaagttaataacataaagtggaaaaaggacaagatagaatatcctaagaagatttatgaaacaccagatgcccctgaattaatattgtaagttcaaaactgtattcgtattatgattcaagagctgaatttatcataccttttagatagttttggttgtgaatgtcagggtgctgtagtggtttaccctgtgctttttagtctatagaacacctttccatttgttttaatatttgatcagaaacatggtgactcattcaatattgtttttcttacttaagtagaataggatgcagtcctaaaaacaggttcaaaggttgtgcaaaatcttacatgttataggggatgctgggcctagagagaaaaacatattatagatttttaattacatcttgccacttaagacacactattcagtgttttcttctttttctttttttaagtgctctttaattttgatatttcctcctgtttgagtcccagttaacttgttcaaattaaataagtacctgattcagactaaagatttgccatttggggcatgcctaataacttccatcttcatttcacatattaagtttatgagacaaagtcttcttataattatgattatgcttttaattttttcacttcccactcattttttgtaataatggaaatatgtaatactattttaacaaatgaacaaattg

SEQ ID NO: 35833 - DNA, 944 bp, Bovine  19866881331673
aatcaaaatcctcccctcatattgatttttcatggaaggctgtttccaattaaaactgaagagtagcacagctcaaagaataaagagattgtgctggactggcaagccagctttcccaaagctcaaagccatatttacagaagctgcagacacagcataccaggagccgccgctagctgcaaatgcgtcctttgggaagcctgaggacagactgtatggggtgtgctcaccaccacatatttctgccaaagtctgtgcaccctaccttcattgcagagggcgcctgtgaagccaggcaagcagtcacacaggcctgtgatgtggtggcagggcccactgctgtgcacacactgcgggcacgtctggctgcagcgatgcccataaaaaccaggggagcagactgaaaacagaaaggaaatagttatcttccctgagacatgtttctcctgtattccacataaggatctggttcaagtttgggataaaaaaaatttatttttagtgatactgagaattttccaagcataaatcaacgacaaaaggaataagggcagtttttaataatgaaaagaagctaggaaactctgaattgcttgagggcaagcaaatgtcttagttctctttattttcccatttatggccccaattagcttgaagcttggcatagagcaagggcctggagaattttcattgagcaaataaatgagagaaagaaaattctaaataccaacaaggaccaaataaatactcacatgttaatcctttattctttaagagtcattactggcaataaatagatctacagtcagaatcaaaagattgtccctcctcaaaatggttcaggttaatgattgtgattgaaaagtgaaaaagcaaaatgcttcataattaggttcttcacaagacattatttgtatttaagtatagaaagacagcatagaact

SEQ ID NO: 35834 - DNA, 1047 bp, Bovine  19866881349843
tcttcataaaaacaatgacttcatcatcagtcatagttcagcttttcacagggctcaaaaattagtccttgggccatgtgggagatagcaccaagtaacgcctcaccacctgtccctctccccagggccttagaacacaacatctctttaaaccaaaaaagaaaaaggaaaaaaaagaaaaagtgaggtcacccaaacagacacccaggcagactccagatcccagtttctgctcagccagagctccttacttcatttgtaaatatttaaagatcaccgcctcgtcaatgaacaacctgctattgctccatgaacatcctactggcatgcctacctgaaaattaagctagcagagaggaaagcaagtgaggagatgagaggcctcctcacctgagccctcaaccagcagtcacctttggtctccccggttgtatgtgccagtaaattctcatttttctttaagtcagttcgaatttggatttatatcacttgcaattgaaataaacttgactaatatactgataattatcaaattccattgggctatgtaaatatcattgccttgggaacttgaaacaacaaattcctgagatttccaacggtgaaaactacagcctgatgagtgatttaattaaacatgtacatatagatcactccccacgctatatacatagaaataaggagagacaaatctaaaggagataggggaaaaaaaaaaaaacttttgcgttttgaaacaacgtattaaggagaagacatgtgcccaatgtctaggactgggaagataaatgattccattttatgttgttattaaattgtattactcttcattaaatttaaatgcatttagaggaattaagcttatcaaaaacttggcagtgtgatataagcgatgattctttgtttatctgacaacatgctcctgtgagttgattcacaattttaattttggaagacagtatttctttgatgcggactgacagaatgatgtgaactgctgcatcattttgcatgaagtcatactgactggaaaggaaacaggggcca

SEQ ID NO: 35835 - DNA, 1201 bp, Bovine  19866881379826
tgcagggtagggccgtgtccccaggagtgcctccccccagccccgacttttggggagcctcggaaggggtgccgcttactctgagtgcagtagagccccgtccagcccggagtgcatttgcattccccgtcgtaggcgctgcagaaggccccgttgtggcagttgcatgtatggatgcagttcgggccccagtgcgcagggggacaagctgaaagcacagcacagcgtggagagttcagtgcgagtccctaggccagcaccccacagagaggatcccacccacctgatcccacctgtccacagctccttcagtggacaggtcagcagtgagcatcaggactgagaacgaccgtgctccacacagggctcaaacccagatggcgatgctggtgccaacggtggccatcactatgatatgatattcattcacatgctgcagaccgaggtgggcagagcaaacatcatcccaagcttacagagttagctatttaacaaacccacactgagcacctagatatgcccagcgctgtgctaggtccaggggagacggcagataacaaggcagggtccacagcatcctctgaaagcttacatttttgtaggggaggcaggcaaaccaatcagccagccacccagccagctagtcacccagccagtcagctaaaacataagggcagtaaggactataagaaaaaataaaatagggaaatggggacaaaatgatgggagctattcctttatggaaggtatctctgaggagaggacacttgagtagagattagatgggcaatatggtgtgacttgagataagtactcaaggtcacataattctttgtctgtggtctctaaacctgcacttgtcactccactctagacttgtcctgagaggcttgttttaaacatgaaggctcctattttcatgtgagaacagatttactataaacactcttaactggatgaagcagaacataatcaaactaaattatcaggggtcatcgcctatcaaagagcaatgagaacctcagataaagtaacataagattatgggggtaaaatgatttgctttatattcataccaatgcttcaagaacataactacttaaaagaaggaacacttacaatttctatacggttatccagtagggaacatggcccccaaaagataatacataaatgtgaattaatttaaaaaaagaaaaaa

SEQ ID NO: 35836 - DNA, 1422 bp, Bovine  19866881734480
ggaccaagctgactgggaagacagggtcccagcatcatgaaatgacagaaaagtgtctccggaccaagaatcctggcctgaagtcaggctaagggaagactcagaatgactggggccaagcttcctgcctccttggtgggacaggggttcagagtcaatattcagataatttatagaaaataaagaaatttgtgcagacttgcatttgtagcctgagattcattggagctgaactgttaaatccattaaaaatgagaatgacaaagactccacccctccacccagaacatcttgctggggccaaccttccactgagttctgctctccaggaaacttatgaaaatccccccttgctggtgactccacatgtggatctgtggttctcaccttgaactactgcagcttcagagaggggctgtcacatctagccacactgtgaccgcctacctgcccctgccacgtatacctccaccctgataccctgatggactcagtcacagtcagaagcatctcccttaacctcctgaagcatagccaaaccatgcagtagtgtttaacaaaacttcattaaatgcttgggaataatcaagatacactgcaaaaaatcacatacagggctaaacttaggatcacaaattcttgtttgtcctcagtaggcttccatgtggcagacacagtacccttggcatttcacccttgttcagaaaacatcccattttcttcccccagagaaaggagcaggccttaaccttccctcttccaaagctgttcattttgaaccccaggatgattaatgatgacaatattcttcttctggagaaaattctaccccacccacagggtgtggtctcacttcatggactgcaactacatgtccctaaaaccgggaatatttaagcttaaataacactttttgcggcattcctagagtcctatagatatctatacttaggagaaaatggtctcgagatatacttctgtacagaaggctaagtatcaacctgtatgtctacattcacatatatggtaacttcattatcaagaagtaggcatttgcttcacattcttataattaaatgaccatttttgcaatttttataatataaaggaaggcttctccaaaggtgaatgaaaatcacaactctaccaatccagctgctgataacttatatggaatttcctgcacaaaatcaaagtctttttctctgccatagcaccctctaccattccaaggactacacagggtggcagcactacaaatcaaaggagaaatctcatcacagtgccatttttgggcaagttaccatttgttttaatagattaatagccagatacatgctcccttgttcactcaacaaatatttactgagcacttactatgagtttgtacttatcttatgctctatcaatcatatcagatgt

SEQ ID NO: 35837 - DNA, 1583 bp, Bovine  19866881905522
gattttaagcactgaggatcaatggagatttgtcttctagtaagatcagctgcctacagcatgaagaaggggcaggaaggagctgacaagagacaggaaaccgggcaagaagcatggcagtcagcggcttagcgactcacgcagtgaccagagggataaagaaatgacccacatgcagtccactgtggagtgggctgatcctgctagctatgggcctgggccgagctcctgaaaaggaaattgatgtgctttcacgataaatcagtcaaaatatgtgtgattgggaggtaaccagaaaaggcagggaaaaaaaaaaaaaaaactgactaaaatgtttaagtcattgacttattttaaaaatataacaagccggaacttgaaagtggacagcaaataaacagataagagatagataaaaccaggaaagataaaggcaataaaaaagcatttaaaaaactttaaggtgcatttcccaaggaaaggaatactggctttgattcaagtcaacgagcaggaaaaagcagagaagaaaaagacttcagtcgcaaacattctaaaatttatcaagggtgacaataagcaaagtctactcttaacatgcattgcctagtcagtcatccatttattaattagatgctataaaaatcactggggaggaagtaccctgcctagagttcctaggataaattgcctttatgataaaacaaaatttcatttcataaaaattttgtaatgtcagatacagaataaactattgaaaaaaacaaaactaggcacacagaaaacaactttttagacttgcaggattcatctcccagtattagaacctacctttcatttcataatatcaagaaatttaaatgaataattctgtttctaataagtatggctttagtcttattagtactttaataaacataatttaacacaattaaataaaagcaatgagaaagaattattgaacctaaagcagatcaagaaagcaattacctaagaacaatcttctttcacaaaataagataaggtgatggttccaagatgagatttcagcctaactattattcatatgaatagtttttttttattgcctgtggatatggacaacactcctttttctttcagttttaattctttcaatctaagatccattctttaaaaaattacatggtgtgtttcttgaaatcctccaagctatctcagttggaaaggaatctatcttgttctgaaggtcccccaaagtaaacaagtcctttgtaactaggccctggttcatcagtcctaagagtaaggaaaatcttcattctatgtaagtcaaagccattattctataatttgatcctcccgtccccccacatctttttcacagtatagtcaatctagtatagcattgttctctatattataaatgattttactccttaaatgtaaatacatccttgatgccagtatagcccaaatatatactaaatactacaacttcaatactttgatgtattttttaaaggtttattcaatttcacacattttctctgctgaatcctctccaaaatgtccatattcctttcaacttcgggaacttcata

SEQ ID NO: 35838 - DNA, 761 bp, Bovine  19866882170039
tgtgtagactgtcacctggtgtggggtaaaatagataaacactacagtgtattctaaatctccagcctttctgatactggaaatgtttgactcttctttacaatttgttggtaaagcagtatgagaggaaaaaaaagaggaccaagaattagaaacttgggttcatttcctgatttacctgttgtaactgtaagcagatctgtatgtcttattttgatgtattccattttaatgtttacatttctttattaggctctatgtaaggacaacatctacccagctttccagatgtttgctaaaggttatgggaaaaataatgaacctcttcgtggctacatcttaacatttttaattgcacttggattcatcttaattggttagtctatacatgtgtgctgatgtagattttggtgcatttatagtattaactgtcaacattgagtcattaagtcataaaatgttactttgcctgctatactaagtttctttttgatcaaaggaaaagagtttagaaaatactgcagataatagcattcattaaatatttgctcaaactcataccctcactaactccctattaggctaaagggaggtcctaggttcttatccctaaaacaagtatgatagtagcatagggtaaaggattatggtgtcttccatgaaggtagaacctctgctgatctttttggttcctttgcctctgattgggtcttaaagaacgtttggactttggattataccatggaaactaactttctcat

SEQ ID NO: 35839 - DNA, 4370 bp, Bovine  19866880360556
tgttaatttctgctgtacagcaaagtgaatcagctatgaatacatgtatccctccttttttgggtttccttcccatttaggccaccacagagcactgagtagagttccctgtactataaataggttctcattagttacctattttatgcatagtagtgaatatatgtcaatcttagtggaattttgcaacaaaaaatcttgccccatgtgaaaggaatttggggagttcttaggcagtttggggaaatttcagggaggcgaagatgaagacaggcttcagtgatggggacattcactctacttagaaattagacactaatttctagtaagacactcaacttagaaattagacatttacttgacctaactataagtggttctaccatggtggggcagaagaccagaaattccagtatttcaattgctcagcctcatatgatgagccacgatgaataatatacactagctgatttgagtgtcttcttacagcccagtctgatagtaccctaaactgacattatcatctctcagtattcttctttccttggctctgcaaatgcaaagtgaaaaaagagaaatgaggcaaaaatgctattcagcacaaatacatgaagttgaagtggcttttggcccaaatggtccagagcattgtctccattctctgtctttttagcccagtggagaaaagctgttgccctaatggggaaatgaggaatcaatatggagctaatcctgatttggaaccttggaatgtgaaaatcacagatctttagggaggaaagctgtgttaaaatccaacttttattttacacatgtatagtatgtccttagtttcatgtatgtgatgttcatcttgcatgtaatcattctaaatgtgcacataatcattctaaataactagatctagatggcctgcaaatgtttgcgaggggagcccttctaactccataaatggtaccagtggatgtgtgacaaagcaaatgggttagacttaggaggccaaccgatttgcaatgatgcatgggttattgtcaacatggagataatcagcagtactgagtgtacctgaggcttaatctcgtctcaataatgatgctggtgggacagatacaaggatggtattgagagaagagtgacctgagacaaatattagtggtgctgtccacagctcattgtctgtaaaagcactgacttgactcaacttgacaatagttatcagtagaattctagtctctcagaattagcattaaggatattttcctcatggttggaagtcttcagctggaatttagctaaaagctggagacttttctgaggtagctacaatgacattttcaagtctgtggttgttggcggtcacatcgtattccaggtggctgaaccagcgtcgtaaatgatgtcagcattacctctgtattccgagccatgctactcatgttgtgccactgagtgttcagttttgaattcagtgttccctttgcctttctttgcttttagaagcaaagaaaggattgtcaaaatctttctcattttgtcattcattctgtttcattatcaagtctattggaaacaaatatatgccattgttattttgaccaaaacaattggttccacatcttgatagttacttcaatcttttatgcaggaggagatggaggctgagtgagagggtaaccccatgtaatgagaaatgtgtatgtaatcagatgtggatctcacaaccaacaaattttaaaaaaattacatctcaaagagaatgaaatgacacacattttggtcagtgctaagaatatagaacttcacctgtttctgcagactgcattgtttaaactctctgcaagaatgctttgctcccaggacctactcagtgctcagcatagaggacttgtaagggaaaaacccaccagtagatccttgttgagggggttgacatctagcagcaaaaaatgataatatggtagtcaatatttccaggtcatcctcatgtagtcattgcttcctttgttaggtaacaaagcaaatttctggatacatctctgaagttctagatcccttttcaggatgatgcaagattgaagataaaggcaggattagcaactaaggagaatggaaaaataagaatgaaatgaatgaatgaacttgactgaagcattgataggagatttaaattcatgccagcttctatgtcaagttcctttcattcatttcagctaatctctactacagccaggaatccgaggcaagaagagattaagcaccttgtctgaggtctcacagctgacaagtggatcatctcatctgctgacttcttcactcagatccaactgcctatccatagttaggtgatggcttttatttagttgatttcatgtactgctactgctaagtcacttcagttgtgtctgactctgtatgaccccatagatggcagcccaccaggctcccccgtccctgggattctccaggcaagaacactggagtgggttgccatttccttctccaatgcattaaagtgaaaagtgaaagtgaagttgctcagttgtgtccgactcttcgcgaccccatggactgcagcccaccaggctcctccattcatgggattttccaggcaagagtactggagtggggtgccatcgccttctccgattccgggtactacctgacagtaagacaccggatgtaacattctctgatcacaacaaaaccaatgaagtttttttctgattctgtctgttaagaagtcatcattggagtgtcagggtttacctctcaaagacattggtgagcaagtaataggaaaacttcaccctgttgtgtaaagcaacaagtgaaaatggtcaaactgggaagagtggtttatttgtgttgagttagaaagtcagaagtgtcggcatgtcctcaatgtgggctccacctgcttgaatgtctttcaataacattgacaggtcattgtgtttcaactattatttctttctaagcagtgcatggtatggtcattgaaatacccttatttaatcccaggcaagtttaccatgatctcacagagtctgatattaagaataccagtatgcagtttatatatggctttttatatttactccatagcataacttactatgaatagtatattttcagctagaccctcctccatgtctatcatataaaacaagcaacagaaaatcataagaagaaaaatatgcctggtgatgtgatgattttgttaatagtgagcctctgtgcctctgtgtgattgagatgcagtccgtttctgctgcacctctcacttactcccaggaaacagtcccagttgtctagagagtcaacacctcctgacaggcaccatctggtcggccattcattaactcccacgatgcggtctgtgaatctgcctctctccccgtgaccagtgacaccatcaagagctggtgtggcctaaagcaatattgcttccctgtttggatcacccagttaccaccaagcacgagtcctatgggcagtgtcctacttactaggtggatttgttgtatccctagatggactatttgatgacagtttggaaatttaaaggtgattgcaaatagcaaaagagtaagaagttttgatgggtgagcagatcatcaatgataaaaggattattgtttggtttggggagaaagaacaatgtagaaaattcttctttgagagtgcattttttgagaggtgactaacagagtcatgagttagattcattttcaacttgcattcaaaaaatcccttcttctgctttcttttagtaaggagtctagtgtctgctctgagatgctaagaaaggaaccaggagagtgacagtgaaggcaaagggaggggaaccatcagagacactgagtgtggaatagcaaggctcgtggtcattaccattaaattaaccacaagatccagtgtcagataaatgttccatcctgtctcagactcatgtttttcaaattcattcttccccttctagttctcctatagggaagtttgtcctattttattgtaagagttatttgatctgccgtgagtcttagaaggggtcttttgaaattttctgatgccaaaaatgttgggaagaacacaacctttctagagtgaatctcctagaatttgagctctacgaaggtaggaaccaggttgtcttctcctttgttgtatcctgagcatggtgtctgccatatcttagatgctctacaacatcttggtgaacgcaccaatgatcaattctgcagtgcagtgcaaacatgatgctctggtaaccgtaatagtagaaaacatttgctgaattcttgtaaataccttgcgctgggatccatgtatttcatgggcattatcgatttcattccttataagcaacc

SEQ ID NO: 35840 - DNA, 1881 bp, Bovine  19866880400764
agaaaaatattgtatagtaataaatgtatgtggaatctagaaaaatggtacagatgaacccagttccagggcaggaatagagatgcagatacagagcatggacctgtgaacacaggggtcggagaagggagggtgggagactaggtttgacataaaaacactgctggtgtaaaacagatagtgggaacagagagctcaactcaatgctctgtgttgacctggcaaggatgggatgggtgtgtgagattcaagaaggatggtatatatgtggagttggcttagttgctaagtcgtgtcctactcttgtgaccccatagactgtagcctgccaggcttctctgtccatgggattctccaggcaagaatactggagtgggttgccatttccttcgcctggggatctttctgacctagagatgtgaacctgggtctcctgcattgcaggcagactctttaccaactgagctacaagggaagcccacagtagtaccttgctggctatcaattgaaaatatagcagtgatttcatgggttcttaggagactctcatcactgaaggactttcacctggagttcccttgatgctgggggaataccagctcattgattaccattatctctgcctctgaaatcagggaactgaatagattctttgcttatgtctatctcttcagaaataatctgttctttgacagaatcatagaagatccccagctgatattctatccggcatttggcccaaattcagcccacaggaaacactcacacacatttatctctgcaacaccagagaaggcagctatgcaccactgaaatcacttcttgcttattcatccaacaggagtcggtcagtgtctttcacccctgttatgctccttaggtcggagttagaccatccaatgagtctccccagcaggaagaacatagatcaacttacaactgtctcatcaaaagtcttcttattcaaccgaagaatcggactccatagtcttttattgagttgagatatggaagaactcacagaacacaataaggtctctctaaaaactctctctctcctcattctcttatttccatacccttttatatcccttatttaggagagggagttaaaagttctctgaataatttctgccatctacttttaaaatcttgctttaatagcacctattctggaatttggtttctgaaacattgtgagtgtgtgtgcatttacatataaagatatattcattcatgctgatttctgtacagaactattacgtcaccaggggcatcaaccaggtctgttgtagtcatcacagcacacacagcatttattcaggcacgtggcacttaataggcatccattacaatatttgtataatgaatgaatgcatgaacacatcttttttacttattcataaaaatatattaagataattcagaaagatcccctgcccagttctaatcatgaagccatacagtccccaaagagatttccatttattccacaagaaactttttttcatttttgaacctttcctgtaaatgcatcagttaagagataaacattatctccagagttctacacagttctgccaaaatgtcaatcatgccatgacataaacagctatttttttctaagtaaagcaatttacaatacaatcgtacaccaagtgccatgaattctcagttagctatacaaaaatatcagacctctctgctaatgagatgaaggaaaacataattgacagttatcttaggagatttcattgtaatgcacatgacgttataataaatctggttactggaaattctgtggtgcactctttttaaggtatattttaaaaagctgccttgaagtcagcttatttgaaattcctaaacatgtactataca

SEQ ID NO: 35841 - DNA, 1241 bp, Bovine  19866880425133
tcatgtccattcaaatgaagagaagccccaggtgtcaagaaggtggaggccgtcccccgggcctcccagtgggtgggggatgcccaccaaatgtgggcagcagggggtcagtctccacctcctgggcttcctgccctacacggagctcctctttctgcctagactctccagtgccatagccaacagcagtcatgagtctcttggctggagaaccagcacttctgcacgttgagaatcgtgccctctggctgcaaggaggaaaagggccagaggcttggcagtcctttcagctctgagggatgacaacacggaggagatcaagaaggatgtggccccacagagatcacctctagagatggaaatgataataccgagaactgtggtccaagaacaaagctagtgaaagagaaaacactctaattctagaggccttaaagctgcgcactgttgcaattcttaaagcagatgcatcgtggaaaggaacctcagagaacactggcaatacaaccgctagtctggtctctgcagaaaggacactgtcaccaagagaaaatgacatctgtactttctagttggtacaacaggagcgtaaacaacaaaaagattttccatgtatcattattactactagaaccactaatactgccaagaaagtaggtaccataaaatatatatatatagggaaaaaagttctgacagagtgtttcagagactgctggagccaggattccctgaaaggggctttttctcggacactaacaaggacctcccgtgtataccacactcacagcacaccgtttgctttactcacaacggcagcgtcattcacaagcatgatacactcacctcaattttccagatgtttaggttagaaagcagatcccaagagaagtttccattcttatccactccgctgaacccaaagccagctgcattattcactgcatcagctatggtttttaaaacaacacattaggatgtgggacaaaagtcgcattgctgctttcaaagataactagatgtctgtctagctttaagagggagagagatggctgcagtttccttgagaaagaaaccaaaataaatttacaggatctcctgatactaccaagagtcagagctttggcgcttgggtgatgtcaacttttattcattcatttttattcattcactagcatttcatgagcacctgctaaggaagaaggaagatgctcacagaatgtgcagaatagaaaaagaga

SEQ ID NO: 35842 - DNA, 509 bp, Bovine  19866880506267
acccggggaccctctgggtagaccgtctcagactcgtccctcccaaggaagggagacgcaggcatccacccagcatctctgctccctcgtgtatcagaattcagggctgctggtgcagccagttgagtaggcttcctcaccttgggagaaaacttcaagcagaactgtaggcaggtgctgggtttgcacgtggggtgcagcagccttggggagctctccagcacagctcctctgcagtcacaggcaagcggtaaggtggaattgtcagagtgctgtggacaaaattgcgtcaaatgccatttacttgcacgagtgaagtctaagatgaatggtaggtgctttggaagggatattaatatttttaagacctttgagtatacttaataccttgaagtattctttcttcaccaaagaatcgatgcttttgaactgtggtgttgggagaagactcttaaagagtcccttggactgcaagggagatccaaccaatccatcctaaatgagatcag

SEQ ID NO: 35843 - DNA, 1753 bp, Bovine  19866880542881
tttcagaacagcaggttttagtgcaatatgatcgaaatttttaacaaatatgctgtttccacagtgtctgtcatgggttacatacgagccccatatgtttgttattttcttggaagaaccaattgacacaaaaatgtttcactgtttaaacagagtcccccttatcccagttaataactaagagcagactgtgtttgtctgtatatcagtacgctgaatggtctgggacaatgttggataaaagcgttataaatatatattcaatatatgtatgaacaaagttattattttttaaaatatatcttctcactccaaaaacaatgttctacctatctttgtgaatgattatatatttgatttcagttagcaaaacattaatgtatatatttaagctacagtgattagtgtaggattggtctctgtcttctatgaaggaattaaatgtagccttactcaatttccacattctctatacaacctattcctatgtcctgtcatgatgtatcatattgattacttccctgaataaagcacttcaaggagaaggactgtgtcttatcaaattccatatgaaagtcctggaggttttagccagctcaacagaataagaaaaagaaatagaaatacaaggattagagagaagggaataaactgcaactttgtaaagaagatgatatgattttctacttagaaaatttgaatctatatacaaataagtaaaattcataaatattttaaagggtgctacgtacgtataagatgatcagctcagttcagttgctcagtcgtgtccgattctttgcgaccccatgaatcacagcatgccaggcctccctgtccatcaccaacttcaaaagtaaattgcaacaaacagaatatgtaatgtataaaacaaaagagggaatgtttactagtgcaaaagaaaatataaagtacctggaataaatctaatcagaatgatcgaggcatttatatagatagtaataaaaacttaatcagaaacttcaaggtctgagtaagcagagagaaatactgtactcatggaacaaaaactttacatatcacaaagatttcggtcctctgcagacttaaaatttctctacaaattgagaaagtgactcaacacaattctaatcaaaacccaatggggtttttcatgaaactaacaaactggctctaaaatttacatggaagaaggtcccagattgtccagatgctcctgaagaacaatatgatggaacacctcattccaggttccaagactttaacacatcgattgtaattatgacattgtggtattggtccacagtagacatatagaacagtggaatgaaatagtgagcttaaaacagatcaacacaaaaatgataacttgatatatgacagagcttgatcagcaggaaaaaggggaacaggttgataaaaggttctgaaacatctaataatccatacagaaaaaaaaatgaaacctcacattctatctcacatcatatccaggaattaattctagatgagacagagttaagtataaagcaaaatttaaaaaaaaatcaaccaagatatccttcagtaattaaatggataaacaattgtgaaaggggtggcttccctggtggctcagtggtaaactctttgaaaaatatttctattctactccctccacaagtttttgtcctaacatgattgaaagtcttctattaattatcctatcatactttttcaaaacaaaatatgcatataaatgtaatcttca

SEQ ID NO: 35844 - DNA, 1203 bp, Bovine  19866880553585
tatcaattttgtagaatacctattggtattgactaagaattcatcaaatgttaaatattattattgtctcttcaatgaaacaattgcttatattttaagtggtgattcaaatgaatgttacataatgcataatatttggtgatggagtctgatttcatacaaggtatttttcattgcaaaatttttttacttttttcattttgtatttttgtcagtaaaagtagagtatttgggggagaaatgtgtagttttgtagctcagctcagtaactgtatcccctctggtattaactggtagttacttcacaaatccatacgtttttaaaagaacagatatcctttcaagtaattcaaaaatgttttctaggtacttgtttatattcaaagtccgttatcttgcatgaacattcccccaaacatacaccaggaattcttctcatattttgagttgtcaatatgaaatgtacttaaaatttcccccagcatcagttttctttgtaagctcttcaacacatttcctatgctttgataacagataatgtcttgttttgcaattactttcaagaaaatgacttctatagttttctacctttaactcatattaaaactacgccaataagctggttgtcacacatctttgtatcaaactgaatgtagcatttgaagaagctaatgagaaaggttcccttcctgagcagtactgatactccgtcgcagaattacctgtccgggtagtattcccagcccttgctgtcttgctgaaatgacttgcattttgtggaagctatttggaccattacttgcaaggtgaggaaagctttttgagaggctctttgataataagaaaaacaggaactaaacaggtagatgttatatagtggaacaaatgacctatcatgataaatttgctagcagtcccttttttggacaggtatttgtgtgtgttgtttgcttacctttctgtacacttagaggccatattatcaaagtactaaattgtcatacaaatttgcaaattattgaaaataactttaaaaatatcaccaaccccattctcggacaatccctgtcaacatttttgtgtattatatcttttgacttcctgtgtatattaaaaaatcattacagtatgtacgtatcattttttatcctttcatctggcttttctagaatttcatctaaagggagtatatagtcctttgtg

SEQ ID NO: 35845 - DNA, 1467 bp, Bovine  19866880554429
aaattgaaagcatgtaggttagaataattttcaaattgccacctcactcaggagcttctaatagtccattagcacagataggaatgcttcaaactgtgtgatagttgaagattcttcttcaacttctgtgaataactcctttcatcctatctcgtttttctgcgttgtccaggctaacacttggatgatatctctgccttcccctggagtcttgcatttgccactgtctttccttgaatctgtgtctcagaataaaggctcattttatccatgatcttttttttttttttgccctaacactgcgcatcctggtcactcactttggcttgcttcaagttttatggcttataagtaggtattgcctgatgtattgctttgggtgtgcaacttttaatgttatcactggttttcagttcttagtaaataagaaatgaactgcatcatcccagcagcttctttttatagagcccttacaacaaggtatctttcatacattattaaatcccaccaagaagttgtccttattcctaatttgtaaatgaaaaaccgaggcagagagggttgaggaagcttgaccggttgtacttggtaaatggcagagctgaggtgttagtctcactcttctttgttgaaacacagatcattcacatttgtactggtctgtgtaaggagaaggtttgcttttgttgtcaaggatttcttttatgtgtcttgaaagcctagtaaacatgcatttcttaggacctgccctttaaaattagaaatggaagatttggacactattaatgtgacgggcatttgcaagcactgcttaattcatctcacatcagtctctggtcacatgatagtaatataatttcacccgttgacagccacacaagaaactgacaacctgatgccctgggaactgagtccttcagttaaactcctcaaccctcattttgaagatttatgctgtcatatcatgaacatgaattccatagcagcaaaaacacaaaattgtggtagttattatacatttctgcttattgatcacatacggatggacagtcagacttgtcagcatcaagccaaggatacaccaggaaatcaaattaaaaggaataaaatataactttctaattgcatttgtggccaagggacctacattatacagcaaccagcgtgtaacaggtgtacttcatgttccgtgatttaccttgctgataattgctttgcactcctaataaattaacccacagaaaatctattcatctgcatcttctttttatgcagagctagaggaaaaaggaccaggtatagcaatttgaggtggcaatcatgcactgatttagcaaagaaaggtggcatggtgagagtcttaagcattctgaaagcatttctttgtaagaaaagaggaaggagaaaagaagagagggcttttgttaattaagttctgtgttttttatcgttttgttttattcgcta

SEQ ID NO: 35846 - DNA, 1203 bp, Bovine  19866880607379
aagatcagtcctgggtgttcattggaaggactgatgttgaagctgaaactcccaatactttggccacctcatgtaaagagttgactcattggaaaagaccctaatgctgggaaggattgggggcaggaggagaaggggacgacagaggatgagatggctggatggcatgaccaactcaatggacatgggtttgggtagactccgggagttggtgatggacagggaggcctggcatgctgtgattcatggggttgcaaagggttggacacgactgagtgactgaactgaactgaacttgcagttcaataggggtgggagttgggtaaggggtctacaaaagaaagtataaatggtaaggaaacttctagggttattactatttaagatgatggctctgttcctagtttaggtgaattataatgttttctataattttttaaatgtcttttattttacttctttttttctgtttgctcatcagttcattttggtccgccatttgtgttttaaatagttgctgtttcttttaatttaggatgccatcccatgaaaaacagtttttaaaaaattctgtgccctggacacagtattgctgatttttatttatttatccatctttatcctgcctgagggaaaacaaggatttaaaatgcattgttgtctgcatctgtgagtagataaatttagtatttatttgctgtagtgccagagtgtactttctcactcttaattttgccaccagcaattatttggccacaatcttaagcagattgtctattctccgaatgtctctgcagagtctcactagctacttagtcatggtaagatgggtaagagtagaacaaactatggaaatggacattggataatgaaggttaattcttaccagagagtaaatctggtttcaagttttagctttttagaaaatgactatattaaaaatttcctaagttcatctgtccatcaaaaatctagttagtacagatcagaataacagattaaagggaaacatgatttctgagtggcaggaaattttgttctagatggagctgatgtctcatccgtacgtgactgacaggttcataatggcacagtacatttactctcccactcctcttgtgtgtagattaaaaaaaaaatcatttacaacaaaggtagtcacatttccaataacgcactgttaactcatcgtgtaatgggaag

SEQ ID NO: 35847 - DNA, 1944 bp, Bovine  19866880619486
tgaaggcttaaaataaagactgaggtctcctgaggagggaggattcagtcttgaggctgactttggactctgtctgcagcatcggctgttccatctccaacctgataacctgctctgcagactttgaacttgtcagctctccaaatcatgtggaccaattccttaaaacaaatctctctctcaacaaactattgattttgtttctctggagaaacgactacatcagtatttttttccccccatggtttagctgccctgatataatactttataaaattcagttgatatactcagaagccactcagtcatatttttctgccttggtcccaatctctttgccatccctgccctcaactttccactgcttgatgaaagagagtatttatttcctctgtgctgtttcatctttttcactgctggagtctcagagaaagaaatttgtatttttttttgattgataatatgagttggaaatatcactttcataaaagatgctcaccccacttcagcaacacctaaaaagattccagctaatttagtgcatttaagcaccaaactgtagttgctactcagtgagttattaattcttcctctttcttctttttcttatttttttaaaaacaatatcttgacctattctcactccttccttctgcctcactgtagaacttactttttccagagatggaaatgtaaaatggatactctttccaaatgtttcatttgttttctttatttcatagaaagcttaatttcacagaaatatgagtaaagacacatttctagagtctgcttcagagtaatcttccatcttttgaaagtaatgaaaacagatagtaagcatgctaaaataagagctgttacactgtttatgccaaaatttgtaaatactgggcagctagttcttctctacttaggagaactattttgggctatgtcttcttgctctatttttgaccatataaactcactcattgaatgttgcttggagccatgcgcctgattacagatcaagaggtactgctggggagtgagatacactttggggttttgctttatgttttctaattaggttctatttttttcctcatattttgcacttttgaagttaacatatattcactgcaaaaaaaaaaaaccctgaaaaactaaacaatgtcagccataatttaatagcatataaataattcttaatagttatagtgtgtcttcttcttttcttcatgtgtgtatatatctatgtgtgtgcatgcctgtgtgtgtatatgagagagagagagaggtctaaattgctcttcacataaaagtatctcatgtttctttctttttttttggccacaccatatgtgggaatcttagttccctgaccagggatcaaacctgtgccctctttagtgaaggcattgagtcctaaccactggactgccagggaagtccttcacattgttaatactgctgctgctaagtcgattcagtcatgtctgactctgtgcgaccccatagacggcagcccaccaggctcccccgtccctgggattctccagggagaacactggagtgggttgccatttccttctccaatgcatgaaagtgaaaagtgaaagtgaagtcgcccagtcatatccgactcttagcaaccccatggaatgcaacctaccaggctcctctgtccatgggattttccaggcaagagcactggagtggggtgccattgccttctccattcttaatcctgggtacaatcaaatttcatttgactctgttcttgtccattacagcttgaagtccaatcttggttattttctgcatctgctcccatctttcttaggttggaacagaatggcaacatttctgtgatccaggaaatcaggaagaacttctgttctttagtttatttagagactgcctcccagagtcccttgccctgttccatgtggggacttg

SEQ ID NO: 35848 - DNA, 1189 bp, Bovine  19866880621870
tcggattgcccatgggccaagatgacaggctgcctcctgatgtacgtggtacccattttgcagaagagaacaggccagtaccttcataggacttaatgtggtccttgagagacccagttaaagcctgaagatggtgtagtacgattttaggagctccacatctttgccagcttacctcagattctaggacatgggcaggacagtaggtgacaataagtctatctttaaacagtgaagaaaggctggtgggaaagttacaaaacttaccttaaatatgtcaccgaggcccatcatggtataatgatggacttatacatttctattataaaaggaaacgttgaaaagaagcaggtgcttgtgaaaatatctgaaatcagagaatctaggtttgacacctgattttatttatcaactctgtgattttttggttcagtggcaaattttgtttatgagactcaccagtacatttaagctcaaatgtaggtaacttatagagaaagtactttgtaaaccgctacttgtagtagtactacagtagcgtgagtattagttgtggcacgatctctgccttggggtaaataaagtagcaagtatgattttctcatgaacccaccggccctccccaccaacaattcagacacagataatactagaggcaatttttaatagcactgagggcttaggaacagtgtgtccctttgagaacctggggaccatttgtctgacaggcttgtctgtttagcctcagtgggatacaatgggatagatgattgtaattgtatcttgttcttttcatttttctcctttcaacttgtagctggtaaagatctactgttttatatcagctcaaaattaaggagatgagaatatggatggttgactttttatttacaagagagaaagggaagcaaatgcccagcaacctttctgtattgtcaaaggcagagaagcaggtatgaattcgtgtaaacgtacagaggaatgaggttgactttttgctttctttcatcagaaagtgcttttttcagtagaattatatgctataatatcaattttgaatattaataagaaggcatttacatttttaagaatattttttataggactgattcactcgtattatttctccacgcctgcccaattcactaactttccttttctttcagtgcacaaaataaagcaggagata

SEQ ID NO: 35849 - DNA, 1662 bp, Bovine  19866880626040
ctgattgtagattcctatgaaactgtgctttgttcgtgccctcaaggactctcatgatctatttaaagaaaacaaaaaaagtgtaaggaaacagttataatccagtgtgacccatgttatactggaagtacctggtagggatcagagaaaggagggtgtatggctgattctgggcattggaattaatgtgatgggaagaaagaaaatgttaatcactcagtcgtgtctgactctttgcgaccccatggactgtaacccaccaggctcctctgtccatgggatttcccaggcaagaatactggagtggattgccatttccttctccaggggatcttcccaacccagggatcaaacccaggtctcctgcattgcaggcagattttttttccatctgagtcacctcccagggttaatgtgatggtgaagattacagtttagctgagatttaaatggctgtccatgtggacaagggaggtacagaggagaaaggactttccgagcaaaggggacagaatgtgtgacatgatgcacgtttcagtgccatgagggatgtgtggaagtgcacagagtgtgcggtaaggagagttgggagaagaaataaggagggtggttgcagcccagcccacagaggtggcattaacaggacgcactgatgtcgtgaccctgtggttcatgcggccacaggagtggcatgtgctggaagccatgtgcctgcaggcaaaaggcaagcagtggagaagacagagtcaggcatggtgactgagttgctcgaggtccccagaaattacttagagagctgcatcttgggagcagagtgcagtgcagctatgaaaaggatggggaggacctgggagggctcaaaacaattcatttggaatatgggacctcattttgtaccacaagttggtgaataactcgtgatctcttgatgactcaagagctacaggtgtaaatctttcccaagtttataccaacctcaaagttatggaatctgattttatcatgttttcctgtgcatcaaagtggttttgagtctcccttgttccttctctcccattaattgattataaacatgattacttggaggtgtcattcagtgtcaagtgatcactttcaaaaaagagcaagcacgtccacctgtgacaagtttgtgattaagcccagaaaacacaagccttttacaaagtgaagagttgtgggcgctacagttcaccggtgttggggactcaagagcttgaatacctgcatgtctttattttagaatgtatcaacctatggtcatgttgacgactcatttcaattcgtacatgtaagttaaacataaaatacatatttcataggtaagctgagacaataatggtgggttatgtcaagagaaggaaaggcgatgaagcgaaaaagacatttgggaagtagaagtgcaaggtgagactggatagaccctccatctgttcacacgaaggagcaggaacacacacaagcacggaattcccccgaaagcaagagggtgggttgggagaaatattgtttcaacagcactatttctttagagcgtgttacatgaaaacatttgtttttaattctcaaggtaactgaggtcatcttccaggatcacattcggttattcagaacagtattgatcattagcgccatgatcattag

SEQ ID NO: 35850 - DNA, 894 bp, Bovine  19866880634643
tgtgcatgctccttgttcttcctcgtaaagtacaaactcgctgccctctgttgcaggctctttatttcctcccattgtgctcatcagaaatgcttagctgctttcctgctcagatgctgaattaataaattacaaatgcctgttatcagagatttggaggttttgacaagtgatttagttgatcacaaatgcaaggttgtgttagggagaacctttgttttcggcctatagaatgtagatgagccttgaatctgaaaaataaacaggcaggtttgatgaactgaaattcatggcagggcttcttaatatttcctgaggttctaatcaaaggagcatcttaactggccccagagggaaatggaagatgaaaggcactgacattgatgcccactgcaccttgcctcatcacaactctttttttcccctccttccttttgcctgtttctaaaaatatctgggcaggtaagaattagcggtaggatgttatttagtcaaaaacaaaaaacccactgcataaggcaccatatctttaaaatttttaacatctatgaaattaaaatcaaggaaattgacatagataggatgaaagaagacacagcacctctagcttatgccaactaaaaataagaattattaatgaagctcggctttcttctgctgtgcacattaattatttatgataataatactccgcactgccatattaaagaattttcttcacccagcttcccagaaaactctatcttcttggggggaaaaaaaacggaaccttaacatgttaagcccacaaaagaatacattcctctcggtgtatttattatacaggaagatgaatatagtcttgggttattaaacggaataaaaacacatcttattagaacttacaggtatttt

SEQ ID NO: 35851 - DNA, 1161 bp, Bovine  19866880716736
ggtgccattgccttctcctgcttaatgatgaggagagtcctttcctgttttgctgcattgccacagactctgaaagccctgggtgctattatttagtttgtttctcttcagtcacctcatatcatagttacatggaatttaagcttcgtggaaacaattacttctggtaaactcacacgcttctagctcttataaggtgtaaaccaaggttaaagagattcttatgaaaagttacctcaagcaatgtttagaagtaaaacaccctgagattttttaaaagttacatggcattaaatgaataaacttccaacagatcagttactttttctttatattttaaactatggaagtatgataacatgtttacaggagacttggagaatacacaacaaagtcacatatagttccactatatattacagtttctttaagtagaaaagttaagatttttagttggattttcaatatcaaactctcaaaaatagaatgaatagacagcaaagtagaaggatatagtagacataaaaagcattataaaccaattcaacatagatttatacaattttcacgcaacagcagtatacaaattctattcaagttcccatagactataaaccatgagacataggaacatatccagggacataaaataaggtacaaaaatttcatcatctaaaggtattgaaatgctacagagtcccaacagatcaattattaagtagtaaacacgtactgtcaatgggctactaataagtctctcttgtgttaattatttgataattattctttggtttttactggtgtacttatgtgcatgcacacacacacatgaagttgtgcattaaagttccatttcttacaccatttacttttgggtgtgccagtaggaacttctgagggaccacatcacggggatccaaggaaatgggagaaaagctaatttttcaaccattttattgttgctctcatgcctgccaaaaaagcctatacagtagcacagggcttcagggcaaagctcactgcaatagctttctcttctaagtccatctcagagttaatcatttcctccaaggaggtggtgctataataaagataattaaattaaatttaatatagtggggcattgcacgaagctttatatcagatacgggttcagagaga

SEQ ID NO: 35852 - DNA, 2563 bp, Bovine  19866880745350
tatctgtgtcagcaaagtgacgtctctgctttttacattgccatgataagacctaggtggctgtagttggagcagtgacagctcagtcccacctatcattcaaaaactcctgaaatattaatctgtcattccagtaagaatattttccctaccttctgagcatgtggaggagattgcttcccaattacagttcatgccctcttccctcaccttcccactaaatgtccagatgctttcacctaatttgtgagttaatttcatttaatttggagaagggaatggcaacccactcaagtcttcttgcctggagaatgccatggacagaggagcctggccgactacagtccatagggtcgcaaagaatcggacacgaatgagtgaactaacagttcaattaattatttttattgcatgttctcaatatttactagcatccacttgattgacaattcagtcttccatctgctctattcattctttcaaagcatttctcacagatactccttcagcatctgcttgcaaacttctgctgaaactggatcactaccttcctgccatgtaaaggtattaaagggttctactagaagaacacaattctttattttagaaatctgacctagagcaagcttgtgagatacatgaatacactgtggcaacctggatcggtataacatagatataggtggtttaatcagcagaaatttattttctaactgggagcctgggagactgcgaagtccaagatcaaagccagcagaattcagtttctgatgaggggtctcttactgacttacagatggccgcctgctctttgcattctcacttggcagggagagagaattgttcagtgtctgttcttataaaggtactaattccatcatgagggtcccactttatgacctcataaacaactacctctcaaaggcccccatctcctaatactgtcacattgagggttaggattttaacatgaattttagaaggacacaactaagtcaagagcacaacttataaaatgactcagaactgctttttgtatttgagatcagagatttttattctttagggaatatttttattctgtatccctttagggagctcatctctgatgccttggtaattacttttgccaagaaatgatcatgaagtaaagattctttctcctgaactctggcattttctgcctcaactctggcactgtgtttggggtgatggtatgaaaagtgaaagtcactcagtcgtgtgcaaccccatggacccctgtcaggctcctctgtccatggaattctctaggcaagaatattggagtgagtagctgttcccttttccagggaatcttcccaacccagggattgaacccaggtctcgtgcactgcaggtggattctttaccatctgaaccaccagaggttgatggtatgtatactgtgggacagtcttcgcttccacgaaacagagaaagcaggaaaattctcattactggatgctgcccccgattcttcagcatatgagtaatgagttagtactatttacctagaaggtttataatgattatttcatgttttaaattcaatcttgatttttctgcaaatgcagcattcagaggaaaagaaagaactcagctgtctgtacaaacatatggaaatcaatgataaatgggcagagattgcacagtatatttattaaccaagcttgtataaatcataatttttcaaccatttattaaactaataggattgttttgggaacatcaaagaaatctttattaggtaaataatcatgtttatccactcagttatggggaaaagcaaatcattcacactgcatttactctgcctcatcagatttcatttctcttaaatgtcagccgttgataatttttaccaaacaacttaggaaaaaagccaaaatttccatcacctctttagtgcaggaaaaggattgctgtttgtttctcagattctcatttctttcttaatgattcttccatatggaactcaaatttaggtagttggctttgctggccagctctctcttccttctttcttgattcatcctatgccagtctttatattatctaactacccaggcacatctcagtggctgctttgttaattaagcatgagccagatcccctcagcacctgagacgattccctctgtttccactcttctccatcatgtaaccagatgatgtgcgctgagagaacactgactttttccagtgttaatagggagaaaacataattagaaagctaagtcagctgcctgacagggaagaaacattccttatttgttattttgatttgtaatatcaatgttgtcctgaaaaaaagatttttataaatcagaattttacaaataaaactgtactttagccatatcaacatgtattgtgggagttagacatttcattcatttagaaaatagttattgatccctcgaagaccagtcattagacatagtgggaaatgtgaagattcattgatttacctgataaacatttgctgagtaccagctgtgtgtcagacactgtttgagatactggggacaagaaacacaaga

SEQ ID NO: 35853 - DNA, 1830 bp, Bovine  19866880770160
ttgtgaaaaaaggttgatccctctttacattgcttttgcagtatttatcttaattttcctgggttagagtatatgcataaagtgaagtcactcagtcatgtccgactctttgcgaccccatggactgtagcccaccaggctccatccatggaattttccaggcaagagtactggagtggattgccatttccttctccaggggatcttcctgacccaaggatcaaacccgggtttcctgcattgcaggcagaacactttaccgtctgaaccaccagggaatcccagagtatatgcatacaaaccctaattgttctgagaccatggtctgccagacaagaggaactgtgtcttatttatctttgtgtccagcccagagctttgtacttattagtagcttagtaaatgttgtttgaatcgaatagctctgtgcagaggctgtgaaggcagataatagtaagcaagtttttgacttaattaggttcaatcaatatatcataaaatgcccagggaaattcaatgatagattcaggctatgaaggtaagagcagtatctaaaacagccaggattattatctgaatcttttggcattcagaagaagttgacctccatatccggctatctgcaggaggtacaaaaaggatctggctgggaatttaaggaagagcattttccagtagtgcctgaaatgcattttagagaatactccatacctttggtggctttttaggagcagaaatgtccaacaaagaaagtatactgcctgtagagcttcctgccctgactagatctttgatatggcataaaatataattaccagtctccggaagtcaggcacatcacataaagaatatctttttgcctctgactgcagcttattataagattgcatgacaacagggataagggtgactgaaccttgacctgcctggctagtgaaaaattacttttagtttcgtgaaagctctggatggatgataatgtctcagactcctgtcttcttccttatttgattattgtgatccctgacacctgaatattgggtcaaagtttacaaatctacttagctagagctacctcctgttgttatagaacccaactgatgacaagctgtcatctgtttcaactgtgctatttttcatggcttcactgtttaccgatgaaagtgggctataaactccaagactttggctgaagcctgaacatcttgtctggggatcatctcatttgttaattcattgaaaatttatttattgagcatctagtaggtgctggacagtgtgtttggtgctggagataaaagaagacacgattcttcccctaaggaattcacaggctgttaaggagacaattgttgttgagttgctaagttgtgtccaactcttttgtgaccccacagactgtagcctccaccaggctcctctgtccatggaatttcccaggcaagaatactggagtgggttgccatttccatcttcaaaggatcttcctgacccagggatcaaacttatgtctcctgcattgatgggcagattctttaccactgagccacctgagaagcccattatggagacagaaaagccagtaatcatgctttagggtcatcagggctacaattaaggcgtgaattgtaggcattaattaattaagaggattctgaaagcaccaaaggtgaggaggaaccctctcataggagatgacctttcaagtggccattcccacttacctaagactcaacatttcagataaaaaatgtataattttctctccccaactctcgttgcatcctgatatttccctttctgtaaatagtactactatttatcttccca

SEQ ID NO: 35854 - DNA, 1615 bp, Bovine  19866880777828
gggaattggaattaaggagacattcggggtagaagtgagggttccttgatccctgggtgtgttggacgtagatgctgggttcgtttgctaggactgtcctaacaaagcacactgatgggtggcttaaacaacggaaacgtgttctctcacagtcctggagaccagaagtctgagatcaagctgttggcagggttgagtctttctggagcctgagggaggagctgccctctgcctctctcctggctgctgcagtttgtccattaccatggagtttcctggcatctggatgcagcacacagatccacgccttcatctccaggtggcattctccccttggacctgtgtctgggtctaacattccctttttataaagatagcaggcagattggattagagtgcacccccaacgacctcattttaccttgataacctctgcaaagatgctctttccaaataaggtcacattctgagggtaaggactccagcatcttttctgggaggaatggcacagttcagaccctgatggacactgagtacgaggattcatgtaaatggtaccttgtgtctctgggcaaagggaacgtctcccgctcactcctaccctctttgtggaagctttcgggatgaagaaggtgggcctgatcctgaggacggcgttggcagtacagctggaagaaagaaagtgtagccaagtcaggctcgttgttgttgtttaatgtttagaaaactaaagaaagggaaatcaattatggggcctacctgaattttatttcctcaccaaaaaccaaattactcagcaaacttatcgcttgctattgcaggctttggtattaaagaaaacaatcaggcgggcaggattaatctctgacagctgccttatctttaacttgcacctttgttattttctgatgagcttctccttttttgctgccacgttgtaccataccctcactggttcctttcattttatcatcaggcaagagcggaggacctttcagtttattaaaaaacctttatttgtgaagaacaaagagtgggggaaaaggcaaacaatgaggtcagacaatctccttccagccaggagtcactcacctgttatttagagtgttatcagttagaggagacttgcctcgtggaaaatgaggctgtgacgggcgattcggttacacacacacacgcacacacacgcacacacacacatgcacccaaatctgactgacgcacatcaacctccacaaaaggcccttgactggcagagcagcaatactttcgtttctaagcttctaaaaaaaattaaaaagcctaacaagcctgtccctgtttctccccactttctctttcaatgcagttgaggcttcctggaaaggataaagccctgggcatttagtgaccatgtcctgtgtatgagctggagcaacttggctctcagaggagttggagtgtctcttttgcatcttatttgctgtttattaatttggggatcagttgttggcacacgccatggatttctgtctggaagggcagtggcacacgtgccattatttgttaggtggaagaacctgtgctttgtcacagcttcctgaacggaaagaatgttgcaatcccctattctctc

SEQ ID NO: 35855 - DNA, 1428 bp, Bovine  19866880818798
ttagaaataccatgagagtccgcagcaaaaagctcagaagtccaccaaataccaaagacaagaaaaggaaaaaaaaaaaaaaaaaaaatccctgcttctcctttctccttcttccccacctaatcctctcacctcccccaccctgcgagccctctgcagcaggaatgttctctgattagaggccagataaaatagcagagcagtaacgttttatttctgttctgttgccaatgagcttgtgctacgtccctcttatctcctctcttcacataaacatctcaagcccgaatagggcagtgggattagagtgtgtgaagtcagggtaaacacacacatatatatgtatatatacagatactgttcctctcattttcactcttttacaagtgcaagggagttctttttatgctctaatacttttaaaaataatcctgaataagataaactactaactaaacattagatgacattattacacattacacggagtctcctttaagctttttaggttttgtatttttttgtcccaaggaaataaatgttgtcattatggtcatggactcttttagctttagcgggcattatgaaggccaaccatgaaaagtaggataaatatctattgatttcaaaaaataaacaggacattgtgctcctctgatcaagacagaaaacgaaagcaattgcaatatgtcaaaagaaagaagtcatagctatttggcaaagggaatggctaagacaaagttgaatctctccaagaagagttatgtttgattaaactttttcctctgattcatcctaagaagctatttttccccaaggcctggagtggacttctgaaggacacatgtctgttattgatattgaattcagcttcagtgcactatttttaaagcagtcacagtcgtagctgtatgccagtatgtgtatagccttcagataagcaattgaccgtgaaataatagtacatggcttttaatatataccctctggttatgggtgtgcatactaaacatacagtatttttaaatatatgcctatacgtataaacacacaaaccctgtaagttaaagctctctatatctaaatggactggcagctgcttgaaatttccccctactctcccgaaggtctcaggtgtaggattcatgagccaatgtctcagctagaacaggtgtctatcgctgggtaaatagcaattaggcccaaatttcagactttttttttttcaaatccctttcggaggaaaagcccaggaataaatagttgctgtaacggccaggggtattgtgtagcattatagcctccagctggtctattacatactatagacaggcaaagaatacgagcacctgacagatgtgttctgttagcttcattaggaaagaaacaaagaaactcctcaattaatagcagcggagccaaatgggg

SEQ ID NO: 35856 - DNA, 793 bp, Bovine  19866880829501
atggccaaagatgatgggccagggtctttgtgatggaaatgtaattgtaaatctttatggccaactcaggctgtgatgtcttgatgctcttcaatttttaaaatatactcttggcttctatttgtattttccccctcaaataaaagctgcagaacaagaagggctaatatctgctcccaaatggacaggaataaaaaggaaaaacagcaagctttcctgaaagcaaaggcatttttcaccccctagtctctttgtacactgctgatatttcacatttgacacaaagagttgaaagcatgtaggaaaaagttcagaatgtgaaactgttctgtttagactttatgtcttgtggatcttaatctttagagactagtaatagttgtagtttcttttcagaggcaatttatagaaacctttgttaccaaaggttggcagagcttcattaaatgcactcattccattctaaaatcagatttcaaaaggattcaggaaatccacaacccctcatgaccaccaccaaaggatgaggtcaaaagtcaaaatcatgaagacaatcaacttaggacaagctgacaaattatcatcccacctgtgtatttgaatcataaaatacagtgtacatcagctcatttagaaaaatgtgctttggatttttattattttcctttctcacttcaacaccgagcgccattttcctctttctgagttttaaacaactcagaagcactggtgtccatttggtcccttgtactgtaagcaccggcagccaggtagatgtctgtgtaatttcctt

SEQ ID NO: 35857 - DNA, 1486 bp, Bovine  19866880899484
ctaacagatttgagtcctgtaaccttctgaaaatgctaatgcataagagaagggccccaggaagcatcaaaaaactgacggtgactagggatgtgtctgaacctgtgcagagggacgcggcatatttatcaggcaattttccaagcatgctgggtctccttgaagatgccacaggttcaggagctcctggatgtcacgaatcttgcgtttaatggcaagattattttcagtgtaagtctcttttgcttcactgtcttctgctacaggttgtccaaacaggcacaaatctgctttttctttggaggttgtttctggaggaaggagtaggaatggggcaagaaaggcaataactaacttctttagctcctccttgctttacatattttgctcgttttctacctttgctctttccttgatttaaccatttcctactatctcacaataactcacagaatgagaattgagaagaaccttggaaaccataagacctgaccccttcattttgcaaataagaaaacggaagtccaatgaggagaaacgagttgcctaaggtcacacctgtacaggatggagatccccgccagacagaatgctcttaccccacccaggttacctaggggccagcacacctccccacgctctccgctgttctcctttccctcagcacttggaggtccagatggcccagacatccctactgcacctgcgatgtgatgcagtccttctctggctgttccacaaatatgatcaaaaacaaactcgcaccttcgagattgttcagaaattctcccaccccgccccctcaggtttctagctcgtattgggtcccaagaattgcacgtggcccttgggaagggcagtgcttctgtacacgggtcttacttccccagttagaccacaagaaatgggagcactcttccttccctcctcttcaagcagaattcagtttgatggctgaattgaaatctgcaatgaaaagaatccaaacaagtgaactcagaccactgcacaaagggagggtgtgcaggagggggacgatgagaagggggggcggatctctgcagggacccagactacagaaacaggggggtttggctccagctttgttgccataggcagagattctccttacagtgctgctgtcctcacaaagatggtttttgcttcacctgatagacatttttgtcagccctccacctccgtcctggggctgaatccgacaaagcacatgaaaggcataccagcataccaggactcgaggattccctaccctggaaacaaatccaaggctgttgcatcctgtggccaaagcacagcctgaaaaaaatgctgcctgatcaccccatctcattctgttcaggccgctggacagagcacttgccagctccaaactcactttttgtgcaaagactcaatacacctattgagatcatgtccaggaatggcctttccttctgctgcctccaggcagaaagcccagcagact

SEQ ID NO: 35858 - DNA, 1072 bp, Bovine  19866880934829
cactgacttggcaaatatatatcatctccccaagccaagcatcggactggctccctccctgacctctttctggggaagtggctcaaaaccaataaaaacaaagaagagcctgttggccttggccccaaccagcccggccttggtcactcctctgtgatctgaccgcccagaatccatgcgggcctggctgccatcctgactgcatagcacctgccctcccaacaacactggccctttgtcaaaggagatggcttgtggggacagccctggggagaggaacagctgagcagaccaggctggtgccacgtgggacaggggggcttcagcaaacaaggcgtcctagagagtggcctgtggggctggagaaggatcagacagtaagtccaaccacagtgcctgatgagactgaaacaagaatcgaggacaggaggctgagcaacccccgagccttggccataggaccctccccagacacacacctgccgccacgcagactcctctctctccctcccccacctctttgctgagcccagccctcacggtgactctgccaggtctggctcaggggtgactggactggcctctctgatccctcaacaggcaaagagagcccaagggtggcccttctgttcattgtttgctcagagcttaggggtgacagataccccctgaagtcagccccttgtgggctctatggctgggatgattgagaggcagatccgggctgaaaagaaagtcatttccaccctttctttgtgccaggcatggtgtcaagggcttgacttgcagcatctcaacagacctcacaacaactttcagagggtcagactcaacttgtaatagggttacatccccataaacacatcttaagttgaaaatcctgagtcaaaaatgcatttaatacacataatctaccaagcatcatagcttaacctagcctactttaaacataagtagatcacttacattggactacagttgaggaaaatcatctaacactaagcctattttataataactgtgaattgctcatgtactttctttctttctttctttcttttttggccagcca

SEQ ID NO: 35859 - DNA, 2565 bp, Bovine  19866880940086
ggaaagatcccacatgccaaggggcatctaagccccagtgttgcaactgctgagccctcgaccccctagagcccatgctcttgcaataagagaagccacctcagtgagaagcccgcacatcacaactacagaggagcccccactcccagagtccacataaggcccacatgcagcagcaaagacccagcacagccgaataggtaaataatttgtttttaaaagtcactctttctcgtgtagtctaatgaatagcaacaaaataaaatgagatactaatatgtttcttaaatacatttgatatgaagattggcctggtagaattatttcttggagtatacagccctgcctcaagatgctgttctgtttgtactgaaacatttgtgtgcaatatataaagccatgaaagagagccctgttttatattgtgtgttgatgtgtatctgtaaaaaatgaattttttttcagtatggagcatttttcatttaacaagacattacaagtaaccttgactgtactgagaaggcacacaacctctgcaaattctgcatcttcctgatcctagtctcaattaggtgccaaacgtaactctaattcttatgttcttatgtagtgtttaattgtacggattccataaaaattcacttaatataaagaaaacaaatactcttttttattgccacactaaatacttttgccagcaaatgcttttgggggtgctttttatttatggatttttcacaatgccggagagcttttgtcttttttagtgctttatatttatagttgtgggatgatcattttctgcttggtttcacattgagctctttcagaactagttggagtagtaatagtttcatactgtttatactttctccccttgagtcctatgttaaatctttttcactctatcagtgacatcgcagtatattatggtatacattctaaggctattaactttcggcactgctaatgatttcttttatatatatatatacacacacacacacacacagcacataaaacatgtaaatgtttcttattcaaacaagaaaactcaaagcataatcaaccccaccagccaggaggaaaaaaaagaaaaggagatttccccgcccccccccccccccccccaatgagattgcaagagaaaaacaggtttgcaaaatactggtgttggaaaacaaagtaaattacaatagacccctaaagggagagatttccttttcttaaaaaacagcttgtttagtattctattcctacacttattttttttttttaagtaacacatttgaaaatcaacaatcacaatgtaacagctttcttgactagaaggaaaggtctgagtctttgtgacaaggcaggaaggaagaaaaggaaggaaactcagagtgaccttgacttctttcttcatcattgtgctcaggcatttgtaaaggagcctggactaatagctcaccttctgttctaggagttcagagactttgagggttgaacctggaggtaatgtatgcaaagtggctgggaaacaaacactcttaggggcaaagtttaacaacagaagatttaagggattagggtgattcagcaatggccccccaaaataggagaaatgaaatttaatagggcaataacaaccagtgtttgtgtctgcacaatgaggattgcctgatcctaaaaagaagtcttggaagccactggattcctggcttacttcacattttggcttcctttatgttccagctttttaaatttaaaagaaagaatatttgtttatttatttggctgtgccaagtcttcattgcagtgcgtgggatatttaattgcagcatgctaactctcaattttggcatgtgagatctagttccctgaccagggattgaacccaagccctctgcattgggagcatggaaccactggaccaccagagaaatccctacactttcatttgaaatgtttttctcattgagagatttattggaaacacaggaaaatatttaatgactattcattaaactgctgatctgaatatataaaagcgaatacactcttagacacgtgggaaatacaaaataatcataaattctgcaagcctacaaagactttacaatcccacactgggagatatagtaaattccttgtaaggtgactttgtaaatttgcttgggtcagagtgagaattgagaagtggtagtgaaaggagggccttcccaggtggtacagtggtgaagaatccacctgccaattcaggagacacaagagactcaagtacgatccctgggtggggaagatcccctggaggagggcatggcaacccattccagtatccttgcctagagaatcccatggacagaggagcctggcagctactgtccgtggagtcacagagagtcagacacgactaatcgagcacgctatgagatgagttagaggtaaaagcctgaaaataggtggggtttatttacagagatgatggattctgactagctgtttgtacaagagcctcagtctatgtgaggttttttgtctttccaacttgagcatagcaatgtgcgacctcataaggaa

SEQ ID NO: 35860 - DNA, 820 bp, Bovine  19866880946847
atgaccctgtgctgtgctatgagttatcacgagatgataatccactcctttggaaatgggtccgtgaatccacagacacttcccaccaataacagactgcaggcttttgagcagacacgtttataccccttttgaatgctgtttattaaatctgcagagaaactggctgattgaaagagaaaactataccagataggcctgtttccctggctgtggaaacagtttcttcttcctcagagggaatagtccatgagaaacctgagtaactttaatgagttttagacaatccagccgtccatgtatggttcattcccaagccttctttagtgttaaggatttcaagagcaacagtctaggatgttctaaaaacagaactgatgaacgatagacactttgtattacaacccagtgtccccataaggaaatcatttaccaaatatatacatatatatatatgtatgtatactggagaatcatttttcatgctctctttgtctcttgggatgtctacagtatctgcttgcatcagtcagggaggcccaaccactgtgcattaggaggtaagggatttattatgggaattagagcgtccacgatgtgggggaggtggaggtccaagtggggagttggagaagctgtgagccagaagtcaagtgcagccagtcacccaggtggatggggagcgggaaggtcgtggaggagtttggggggctgtgcctctgtgtagtgaccccttctgtggatttactgccaagtatctggtggtgaactcaggctcccgcggtcaatagaggcagctccatagactcatagatgcaga

SEQ ID NO: 35861 - DNA, 3404 bp, Bovine  19866880952044
atcatgtctgtgctgcttttctatttctgccctgaaaggctattattaggtgctctctctcttttctacatctccaagtattgccttcgtaaaacattccaaaaagtaaacattagctttaggccatttgattactggtttcccagaacgctatgttctgtcctgtttctctccatattcctttaatattaaaaataggaagtgactgaaggcagttgaatggctctgccttagaggctgttcccctagccagcctctcaagcattgttgggtccttaccctctaaaatccatttcgtccttattatatagacagtcctctgccaagcagaaaaaaaataaaatagaaactgaacatttctttcctctctaccaattactattttttctaagtgccttttgctttgtttaacaagcctccttagctgtggttcattttaagtaaggctcattttctttttcgtgctggattagcatctgaatggggaggagagctggctctggcagtgtctttgaacaggtgatataaacagagcctgggataagaagaaagcacggacacggcccccgcgggtggcacccaggaagtgatctgggctgatagaggtgttagctgtgtttaccgcagatggcactcttattcacacactacttccttccagctctgagctgacccaggggaaatggtgtgtgacatgccttgtgtaggaaccattcctgggagtctcacagggcagagaaacagctaggaagacagactgagtatttctttgacggtgaagatggatatgagatgaacataggaacctgtgttccacataggaattcctcctacactcctctaaagcaacacggagtaaagtttgtcccagttagtttatttttcctcatcacacacctctaaagcaaaatgcaaaaaaaaaaaaaaaaaaaaaaacccacagaaaacgatcatgcagttaagccaaggaagaacttaatcctgaaaccaaaatcattttaacatagatttaaataacattttaggggacttctctggtggcccagtggctaagactctgagttcccaatgtaggggcccaggttctattcctggtcagggaactagatcccatgtgtcccaactaagagttcatatgctacatgaaccaaccaagattgaagatcccacatgctgcagctaagatctggcagacccaaatacctgcattggcaggtgggttctttaccactagcaccacctgggaagcccaataaataaattttaaaaaatatttaaaaaaaaataacatttcagaaaaccttaaatcatacatgactttgcattcttttgggggcttcagtaacattaaaaaatacatttgtacacagttataattgttacctttttcttccaaaatttaacactagttcactcattttcatgaactatgtatcaacataacccatgaacttatttgtgatactgatatagaacacattctttcatttacttaatcactcgtcaaatatttatgagtgctcctagatactggagacctatctataaccacaaaggagattctgaaagataactcacgagggttgcttttcagtaggttctaaagccaatctctttatattttattttgcaaagtcagatttccacatcactaaatgcagacagttttttccctaaagaaaaagtaagcatagaatacaaaatctcatctcacttggctgggccttcacttctatgcaaaatgaagtaggggtaaatttaatatctaagctccctccctttttttcccctggaattgtatggtctgggtttaaggatatagcaagaagataacatgcatagtgtcatcaaacatcttataaatgcccttaggagtcataatgctttttctaattcatcagcgacaattaagcaagaacctagatttttatttcttagagccctgctaagtatttagtttaaaataggcatcttcggaaatggagaccaggaatttaggaactagagacagaggggctgacataaggaatacaatttacttctgtttgtttcactatgatgaggaaagaccaaacaagacttgagaagactagaacaatcccattacaggatccaaagagaagagtgaaacacatttcctccttaataagtgtgcttttgtgttcattccagccacctattaatccaaattaaaaaaaaatgttcttgacattcccgtctgagcccatggctgttctgatatcccactgagatctacaagtaatcaagagctcaataattccaaatagtgtttataggaccacttccttccataacttgtaagctgttctttagtgaagacagatggataaagtctgtaggaccctgtctttgaaaactgtctttaagaactttcgacaaccagtggggatgcatgtctgtctctatttaattgagttcattatagttaatatttttgtgactttcaatcattgctcaagtgttacatgttttaatcaaaagtgaaacgctttatggcacaaatactgttaaaaatcccaagtttgactatattatttttggaaaaaaatcttctggagcaagatactttttaaaaaagcagggaggggcacagttcttatgattttcttttgctgaaatcaatgtaaatggaataataaacaggcccaagttaccttaagaatgaagcattgccccttgttactttcacagatctctttctttagtaagccattttctggtctggattttattttattggctactagtttaaaagacatagtaaatatagtacatctgacattttattgaccaaaattatctagtaaatggcgcttctgagtttactagcaaaatgatagttgttacttacacggatgatagagaacagtgggccataagtcaaaaagtcagatggaaaccaaagtggtccttgggggcagggaacattagaaagtgtcactcatcgaagggaagaaaatcctctttattgtaggacttcagggtgtgattctggggtatttctaatactggaattaagaagccccttttgatgtgattaggaagtgaaaatttagtgtacacttgaaatgacaacctatttgagacactcgtgataaggaattgccatggcaaacagatctgagaggcatggccctaaacagaatctaggaacgtagagttgagggtgtaagaaattttcaactgcttgttttcagtgcaaagataaagctcgttggaatgctgaaagtacggtgatgtgggccaagcaggtaattggatgcaggtaatgcagcaattcaccaccacgccatggaaatgacctgggagatctctcaactcccgtgtgttccataaaccagccagagaatcttcttttttttacttaaaatttatttatttat

SEQ ID NO: 35862 - DNA, 623 bp, Bovine  19866881113113
aaccaatggatttcctctatttcttccttcttagcagcatggcaaatgccttcatctcatcagaaaagaaatctttattggatttttatccaaaagcttgtgtgtatggagggggagagagggaggaaaatttgaggtgaaaaatttaaacaacctccttaattattaaagtttgttgtaaaggtagacatcacttaattttgaggagtagaataaataccttgattgtttcatttcatatgcaattgtagaaagagcccaaatgtgtttgaggaatgtggatttactttgtcttcacttagtgatctgggaacaattaaaaggatgaatagatgcatcataagtagatcaactgtaaaaaattatacatgtagatacgcttttgagaactttatcccagaagtattcggagacattttacacaatctaccttcaaggatggctacctggtttacggtagacatctaataagtattcgtatgttgttgtttagtcactaagtcgtgtctcttttgtgaccccatgcactgtagcccaccaggctttctctgttcatggggttctcttaggcaagaatactggagtgggcagccaatcccttctccaaagtatttgtgtaaatg

SEQ ID NO: 35863 - DNA, 1413 bp, Bovine  19866881203126
tggactcattgtcacaggcctctgggtccattttacacacaaaatcaatatactactactaataaataggattacttttccacgactcctggtgggagctcagctggacttgtttgggaggcagtttcaaagttctccgaagaaaattactttcacccttaaaacccacagaaggcacctgagagaaactgaatccagaggcaaccagcagtgggacagggcgtcttagactggtgctcagttgctcagtcatgaccgactctttgcagccccgtggactgtagcccgccagctcctctgtccagggaattttccaggcaagaatactgaactgggttgtcatttcctactccaggggatcttcccaatccagggattgaacccgtgtctctgtgtctcctgcattggcaggtgaattctttaccactgcgccacgtgggaagccccatagattggtaggtagatggatttagacagagagagaaagcatccctatttaaacccttctcttaggatctctgcaggcctttgttcctccaacacgtgctgccctttctctgaaactgtagaagctcccagagtcctgtctgtggcctcttccatcaaaatgcctctcctttaacatccaggactgtgtatacctcacctctgtatgatccatgccctgacccaaagatgctctcagagccgaggatgagttaaaccagtatccagcctaagaagcatctgctaagtgatttctctcctctcactttctatattttacactgtggccccaccttgactcatcctaaattggaaaaactactcttggcaaagccaggtctttcaactcttgctgccccaatgtttgagtccttaggagggatcttgttaggtcttcttcacacaataaagactgcttaagtgccatcaactgccccgcagaacatggaaacacttgataacccacccccagacaaaggcctgtaggtatcccatgaagagactccacgtgtctaggggtgggcagggagcatcagagttaagagagaggtttgaagtcctttcgtctggaaatgtagctggggacaaacagcttaaccactgagcctcaccttcccccttgacagatgagggagggttgctttacaagatgaaataatgtatttaagatgctcattgccattccttgtgcacaaaactattcaatcaggttgttgtggtggtggttcagtcacaataaagtaggcaactgttatctttcttatggccccaaattgacagtggagaggggagagagaaccccagtctgtacaattgcaagaatgaataatgaaaaccaataatgactcaataataaaaagcaattttaatgaaaaaaccaagtataagatgaaaggggatgggatttttccaatttatagcaaaaca

SEQ ID NO: 35864 - DNA, 1350 bp, Bovine  19866881230810
atttcggtttagctcttattatagtgttcctaggcagcctgattgagtttagatatttatttttaatttggttctatagacccctgtgggatgaacatatttcccaaaaggcaacaaataatgttaattccaagggacttcacactcaatagcaaagcgttctctaaaatatgagatgataaaggatactgaaaacttgcgttcctttttcctgtctctctgtaaaagctcacaatgagatgtgcttcaggctcttttctggactcacaaagccctgggtggtctggtctctgtgggtcgttaccctgcgtttccctgtttatttactctgttgtgcctcttcgctctggccacaccagttttctcctcccctcgtgtatacagagtgtccctcctacctcagggcctttccatttgctcttcactttacctggaatgcccttccttctcccatttcaccctgttcaatcccctaagaactcaactcaaaagctggtctctaggaagatttctctgatatccctgatgtgaaagtgtacgtgtgtgtgtgtgtgtgtgtgtgtgcttctgtaggctttgtggatggaaagagtagggaaagaatagtttctcctaacacttgtatctctcattttctttgcacttttcacaatgtctacatttgtttcatagctgttctatttttacgtctctgccactaaactctaagaccaacaaagatggaaatcatgtctgtatttgttcactagtttctctaatactaggaatgctgcccagagcataggagaacctcagtaacatgagacacttcatttgttgaatgaatgagtgactatattaagtgtaattattctctgtattttaaaaatcataattgataaagggaaagggagaaagtcacactgagatatcctggtttaactaaaggcaaatagattaaaaagcaggaaaatgactcgggcattttccagctatgtgatcttgagcaaactatttaatctctctgagcctcagtttcttcaaccataaaattgtaataatgtcaacctcaaaatattgctataaagactaaataagttacctatgaaataaaaactgattgattcccattccttttattatcttcttatatttggctttgcaaagaccaagtgttaaactcagcaccatgatatgctcaaggggacccgttcaactggtcagtgtttagagaccccctattgtattctgcttctcttcacagctgagggggaagattttcaatagagcaggacacagaacagagtttccaaggccaaaccagccttaggagttagaggcccatggtggactactgtctccagttaaaga

SEQ ID NO: 35865 - DNA, 1084 bp, Bovine  19866881247584
caggcaagcccagacccaacagaatggaaagccttcctactatcagccaaagcaaatccctcaagggcaggatgtccagtgaattgccctggttcccagtggtgctgtgccaggcagcagtgctcccttggaccccctaagattctcagcctttcgggaagtccttgttttacctcctttgggttttgggtcacatttctttggatggtttgcctttggcaatgagctagaaatccagaagttgggacaagggtaggtatgggataccggtgcaccttgcccacgtttctggggtctgtgaggaaggacttgggatgaatgcaatgtgcgcggattctgtaggcagctcctgattctgcaggtcactccagctacaagaacctttgcttgtgctcaaccacctgcagcagtgtttcccaaatgttccagaaggccagggcacgtctctgagggtagagaaagtgcctggaaatctgcatctggaacacacgctgcaggcaattcttattctcgagtagctcagaaaaaaaacattggatctcttctttttgacaggtatctggggtccgtactatagaattattaccataacagagaccatagaggataaagaccaggaacaagcagaccttggagccaggctccttgggttcaatttcacctgcctcactcctcagtggagccctgagctagcctcttaacccctcactgtctgcttcttcctgtgaagaataagcatgataatgacacccacttcacaggttatacggataatgtgctaatgcacgtagagcacttagtttagtggcctccacgcgcgggcacttgataaacattagctattattatcccatagaccagagactgctgagaggcagagctaaagccagatctggcctagagacctattttgtttggcttgcacattttcctttttaattgagccaacatttaaaaactggtagattcctggccattttaagacacttgaagacctggcaacaaatgcggcctgctttcccctctggcaaccatcacctggggcggggtcccttggcactcttcagaaagggcatttctttct

SEQ ID NO: 35866 - DNA, 600 bp, Bovine  19866881284545
gtgggagggcagtgaaggaggtgatatttcacatctaaatatttgaaatgaaaaccttgtgtatatattcacatataggcatgcagcatccccaagcatgtacatatattctcccttgatgtacgatctcagtaaaatatcagagagaaaaaaatgtcagacatacatagcatagcaatcaagggctaatgaagatccaggtattaaatcaattaagaagtatcaaaagctacctaatcatcaaggaacaaaattggcaccacaatatgtagtgagtatgggaaagcctaatttactaaacataccctgcagtcacataattgcatgtaattttaccagcataattaactaatttaattaccacttctcaagtgcatcaattattgacattacagagttttcagacagcagaattactgtgtggtacatccagagaatgcaaaatgctttgtacactgattttcccagtcacagtcaactacagaagaagaacgtggagttgcagggagaaaattcctgtgggggagcctctgttgggcaggttgaaagagggagcacccccaaatgtgtctgatgtgaggcggagacgaggaggaagcc

SEQ ID NO: 35867 - DNA, 710 bp, Bovine  19866881290458
ccaattaccgcaccacaccgaaaacaaactggtttcagataaggtgggaagacagtcacggagtcacccacacatcatcagagcaaactgggggtctgacagagctgccctaacttaagcaagatgaaaagcctcagcactggtgaggacgcaccgtgctgtggggctgggggcggagtgagggtggaaggaacccagtggaacaaaagacaaacacactgcagctggcatgaagatgtaactcaagggaaaggaagatgtgaccttaccagcgtcgaggacaaggcagacccaggcagcaggacctttgagagaggagagaatggaggagaggagaaccagccagaatgtgtccacctgagacagtgctgaagacccggctggggagccttgagaccttattccttcatgaaattcaaggaagtgagccagctccagctttaggactaacattgaacccttcaagggcttcccaggtggcgcagtggtaaagaatatgcctgcaatcgcaggagacgcaggagactcaggttccatccctgggtcaggaagattgcctaggggaggaaatggcaggccactccagtattctggcctggaaaatcccatggacagaagagcctggtgggctacagtccgtgtggtcacaaagagtggacacaactgagcatgcacgcatgcacacacatacacacacacacagacactaa

SEQ ID NO: 35868 - DNA, 1202 bp, Bovine  19866881291651
aaaaagatcaaatatattcaatacaaaaatggtaagagaaggactttgctggtggtccagtggttaagattgtatgctctcaatgagggcatggaattctatccatggggcctgggttcagtccctggctagggaattagatcccacatggtgcagctaaaagagctcacatgccacaactaagacctcatgcagccagataaataaatattaaatatatatatgtatggtaagaagaaagagaaatgggacaagaagaaattaatagaaaaagttcataagaacaacagtcaagataaccaaatggactaaactcaaaggttcaagggaaaaagagtcacattggatttaataagtatgtgaatcctaaaggactcagcccaattgtaatcaattcacaagggcttcccaggcgacgcaaataaagaatctgcctgccgaacaggagatgcaggtttgatcctaggtctggaagatcccctagagaaggaaatgacaacccactccagtattcttgcgtggaaaatcccatggacagaagagcctggtgggctacaggccatgggggtcacaaaagagttggacatgacttggcaactaaacaacaatcgactcacaaacaatattacccgaatcactgctgttagcatcagcaaacaaaaacaagaaataacagatttagactcataaaaactgcagatgtttaactcagtggagatacttcacagcttcatgaaatgatttaacaagtaaaatatttgaaaatatttgatataaagttgagtattcagcaagaaattattggcaatagaaaaaatgctagaaaaaagtctcctagaaattaaaaaatatatttgttgcaataaaaaattctgtggatgacttaaacatcagttttatgcaataaggagagaactggttaactgagagatatacccaaaaattttgtctggaatataacaaaaagggaataaggagaagagaaaatacaaaaaagaattttaaagactttggaacataaaattataagccccgcatagacagcataaagggactttttcttggccacgactctggtcctgtaagatcttagttccctaaccagggatcatccttcaccccctgcattagaagcttagagtcttactgctctaagggacctccagggaaatccccaggcagcagacaggaaggaggaaagg

SEQ ID NO: 35869 - DNA, 1259 bp, Bovine  19866881426007
attagtgctgagtaatattccattgtttggatataccactaaaagtaaactttttaataaacatggtgtagaataaagaacacaaaatcattaatgcacagcttgatgaattttcataaaataaacacacctatgagctagtaccccagatccagaaataaaccatttcagcacagaagacccctggtatccagttcaagtcaatggccccctaaaggctaaccactatcttgatctctaacaccatgtattagttttgcctgttgagactagtttggatgtagactttggaaacatttctttcagtcagtaacccagaaggcaagtagtgatttcctcctacaatttggcataaagctagtttagtttttttgaaaggaagtgttagtcactcagtcatgtatgactctttgcaaccccatggtctgtagcctgctggggtcctctgtccatgggatttcccaggcaagaatactggagtgggtagcaagccattcccttttccaggggatctttccaggtttaattcctgggtctcctgcgttgcagcagattctttactatctgagccaccagggaatccatagttttaacaactatattatggttataaaaggtgataactttaggagaaattgaaactgggggatattgatagcttagtgaaaaattgtatggacaaaataaaagcataagaaaaaatgacatagatgagaaacatgactcatgatagggttggttcaaaatgaggatttgtttcaggcattttagatgtacccctgaggaatgaactgagaagcccttgtcacctgagactttcatgaagatttaagaatgcttaacaaattttaacactgttaaaattgttcatcaatttagggcaacctactgacctgttgaaatttttttttttttcagttaggcaaggagatgagcagtgtctgtaaaaaacatatgatctcatatcgatgctcagtgccaagaacatttctcattcactttactgagtcacagtaaaaacttcaagtgtttctggatgaaaccttcaatctggggatggcatgcatgactaaaaatggcttttcaagttagcatcttttgtccgtccttacaaaacaagctcacttcagtattccaagtataggtcaaagaaaacacagtaattctaatctggagctgagggatatacactctagggggtgagttgggcaacttccatggtctaaacctcctggttatatgcttatctgatatatttg

SEQ ID NO: 35870 - DNA, 892 bp, Bovine  19866881558763
actctagagtcagacagatatagttacagattccagctctgatacttaatagctatgtgacctttgatagaatgtttaccagcctggtaagaaaattgtgcacatagcaagtgtttaataaatacagccgctgccaccaccatcatcaaaaccatcattattatcaaaatcttcatcatcatcattatcataaaaaatttgggggaagaaggagtatgatccaagctgtgcctttggagatgaatttggcaggaatgcacagagtgagctggagagctaaagcaaaccagaaatactcatggttctatttagaatatctctatcttgtccatcatcctctttgcaacacccccacacacccacaagagttggagtagaaaacctaatactaccacacaaatgaggcaaggctggcatttcggcctgaagtgagtaatagccaaggatccagacagaagtcttaatattccctatccccgcttttctcaggagctcaggactaaagagcggacagacttatctccgggctcacacctagagatctcacccacagcattcacttgcgatgctcctccatggtctctgctgcctgcactgctggccatctgttacagtggcatcgtgccagcttacaggatagctcgccggcttcacagaagccccggggccaagaaatggtttcaacaggaagcccttatgtaactcacaagagtgcctggagagaactcctgattgcctcttcttttccccacacagcaatgctgatggtgatttctgcttcatgacattttatttcacctgttgattaaactagtagggtctccaatctaaatcttgaaatctggagaggaaaaacacgaaccatgtgtagatacctgggctgccaaacaga

SEQ ID NO: 35871 - DNA, 986 bp, Bovine  19866881706034
ctaggcaaccttatggacaggtaaccccacaggctccgttgtccatgggattctccaggcaagaatactggagtgggttgccatttccttctccaggggatcttcccaacccagggattgaacccaagtctcttgtcccatgagttggcaggcaagttctttaccactagcactgcatatagataagtcatttaattttcatgattctcagaggtagcccctcaaaatgaaggaatgagtgaaattctttagcagttacagtcaacagaataaatgtagattaagaaaatcaagagtaaaacttcaatcagaggcagatagattaataatctatatctatatatcaataagtagggggtttcccaagtgactctggtaaagaatttgcctgccaatgcaggagatacaagagatacagttcaatccctgccttgggaagattccctggagtgggatatggcaacccactccagtattcttgcttggaaaattccatggacaaaggagcttggtaggctatacagtccatggagttgcaaagagtcagatatgacagcgtgcatacacacaatctataagtgaatatacatactcactttcagaagcctaatcactaatcgttcatacgcatgctctatttttaagcttagaattaagccagggatgattaagggaagaaactgtcaaaaaataaatacaaaaagaatcagagcagggtaaactggttctccaaatatagactcttaggactgataggaggagtggcgtttgcccagccaagtttcactttggaggagaactcccaatacagtgtaaccaccagggcagctttggcagggctgtttatcatagccagcaaaggggagggtggagccctttttctgacaatgaaaactcttcacagagttcggtgagaacaacatgagctcactccctaaagatctcaaaattcaacagaattataagtcatgaaaaatatgttctag

SEQ ID NO: 35872 - DNA, 2914 bp, Bovine  19866880560006
aatgcctgttatgaaaagaggattttcttcactgttgaagaactcaccccctttactcttgacctccccattcctgctgcataccttcttccttcctgtctcttcctataccttcccttctaccctcttcagtttctcaacattatcactcaatctttctccttttgctttcttcgttcaatgcatacaaatcataactctattcaaaaatgtcttcttagatgcccttctctcacattttaaaaattaattattccttcttttcccctgtatcttcaatcttttcctaaccaagatgacctatttaaaaatatatatatatatatatatatatatatatatatattcctccttccctctaatatatatcttggagaaagaattttgcttctggttaccagttgaacttaacccatatgtgagataatatttaggcattagatcagaattagatgagaaatgaacaatatcactatactcttgaacttagaattgtatgaaataattatatgggtttagaattgtggagtctgccacccttttttaattggaatatagttgatttacagtattatatatttcacctgaataacagtgtttcaatatttttatagcttatactccacttaaaggtattacaaaatgatggctatatttctctgtagtacagtataatatatccttattgcttatgggtttgcttcctttggttcacatggttatatatgaatgaaatttgcattgaaaagggaattattgcattatatttcttggaggaaagtttttcatttggaagtttatgtacaggaagaatgttttatgtgtatgtcgagcagccaagttatggactattatagtcattcattttaggtctattactcagcatgtcaacagattacctattgtaacttggtctcctattatgttattttgaactattcttctgcttataccatggatgaataaagactcacttttttcagctcttagagagttataggctcatgacctacagtcacccatttaaatgctcctatttttaactttacatattgaaagaatagcttaaaaataaatggctaatcacagcaatggtatagagatgagagtagaggtgatgctggaagccagtgaaggaggagtattgagagcatccaaaagaatcagtttctgtgaaatgatacttataagtgctacattgcctaggcttcatttttcctgacaattttctaaacctttttatttagtcttttcaataattctctgagcctctagataaccttccaataagttcctttttattgcttaagttagttacaatatatttctcttgtttcccaaccagtgcccaaactgacatacactaaaaagcatgtaagtagctgagaacctaaataaatggcaatatgtgagtgttgaaaactgattttatctcacatcatgtagcgtactcaaaccaaaggtaacttcatgatgtaactgcaggccacgtatcaaggaaacaaaaatatgggaaaagcagtataattctaggaacaagaatttatgtgaaggacacaggcagaagatgtagactctagaatagactgaggaacagatttactaaataacagaagaatagagttactacactttccaggtatagaagttaaagaagaagcaggagagcttcaactttaaatttacttcaagaacaaatcaatattttacaaatctgcctgagtataaaaattacatgggagtcttataaaattatgggtacaagaccctccattgtaaactctggtgtattagtgttaggatggatctaagaatatctatacttttatttaagttgctagacaatctcacaatccaaaatgcctgggacaattttggactaaaaataattttgtatgaatgagagtgctaattatcaacagatgtttgaaatgtagataattatgatttaaaggctacatttgcttataataataacacagtcatgcttttgaaaaagtttagagtgagagtttttgaaaaagtcacccaattttgaagtgttgtcttcggctcaatacactggagagatgtaagttgttttattatgttgattgcaagtagcttcgccttaaaagtgcagaaagggagagttgattgtctgtggcatcctgaaatagtcatatattgctttcaaactcagttggcaagaattcagtcagaaacatctgcaagaatttagactgagccatgtactcagtgatctttctacctgttactctaattactacactataaaatttttatttttattctagctccctctgatgctgctggaagaccatagagtaaactcagcagggtaaaggagtctaagatgagaaagagaaagaggagaaataaggcaggaaaacagagaaaatgaacagagaaaatgtcatgctatacagaataacaaacaaatcctccacgtcttatggtttctgattcctgtatagcctcaaaagtaatgaagttgcttaacatatttggtagacagtatggtgtcaagtaaatatatatatatattaaaagaggggagataaatttgtaataatgctacatgaacttgtatacatttccttcacttcctgctcatttgttttttttaagctatattgcaaacagacaatagtatgagacctcttaatgttatattcaattatttctgaatttgaatatatttgagtccctggtggtcagaggttaaagcgtctgcctggaatgcaggagacccagatttgatccctgggtcgggaatagcccctggagaaggaaaatggcaacccactccagtactcttgcctggagaatcccatggaggcaggagcctggtaggctacagtccatggggtcacaaagagtcagatgactagcaacttcactttcactttca

SEQ ID NO: 35873 - DNA, 2408 bp, Bovine  19866880642779
tagcctcacataggcacaagtaagaagagttattataagatatccattgttgattggattttgaatttaaagcctgtaaggaaggacaaaggtcagaattcagcatgctgtgatttaaattctctgtttctagcaactgatttgttacaagacatcctgccatgtctacaaagacatccttctaattttcaacagcaaataccctaagaaggactgacatctgagaattatatacgaggctattgaaatataaccacaaaaatatgtggagatctttaagaaagcatataacttttcatacaccatacaaaacatcttccaaattaagctaattttaagtagtattttcatatttagttttttaaaatgtcattatcagggcactatctcttaatttaacatcagaaacagcatatcaagtctgaaaatttctgatctgtataagtagaaagttatattaccaaagtattcccaaagatatttgagtttttaaaaatagattatcaattttacagtttctccctatggtgaaatttgtaggttctctccctaaaacagacatttcagttgattgcttccagctttttggcagaaacaaaaaagtgaatagctaacacctggttactagctaccagccaaacttgcagtgtctgcctctgtggaaatgaagtttgaatcttagaaatcaaagtaaaatgaaagtttaaaagctttagtctgtttcctcaaatacaagggctatatccacagaaagagaattaaggggggaaaaaattcagagcatctattgtaaaattcagctttaatattttaaccctgaaagcagaaatacaaatatcaccaaatagttataattgaaattgaagttctcattatccattgttactttagtttattgacattttaagataaaatcaatgaggagtcagtgttttaactgatatataataaatttatttaacatggcattcttataaatatttcagaatggagggtgattgagacttcattccagatctttatggaagaaactgttctgggaaagggaattctaatattttaactttttaaaataaactttatttttaagagcaattttaggttcatagcaaaattgagcagaaggtatggagatttctcatagctccttgacctctctacacatgcatagcttcccctgttatcaacatccttcctccagagggtacatttgctgaaactgataaacctacaacggtacatcatcatcactcaaatttcacactttgcattagggttcattcttagtgtcgtgtgttctgtggtttgtggacaaatttttagtcacatgtctccatcatgcagagtaatttcacagctctaataatcctctgtgctctgtctattcaacctcttttctctctaactcctgaaaaccactggtgtttttattgtctccacagttttactatttccaacttgtcatatgattggaattgaacagtatgtaggcttttcaggtgggcttctttcacttagtaatatgcatgtaaggttcttctatgtctttcatggcttaatagcttatttctttctagtgctgaataatatcccattctctggattttctacagattatttatccattcacttactgaaggacatgttagttgcttccaagttttgcaaataataaataaagttgttgcttctgctgctgctgctaagtcatttcagtcgtgtccaactctgtgcgaccacatagatggcagcccaccagactcctccgtccctgggattctccaggcaagaatactggagtgggttgcccatttccttctccaatgcatgaaagtgaaagtgaagtcactcagtcatgtccaactcctagggaccttatggatcgcaggcctaccaggctcctccatccatgggatttccaggcaagagtattggagtgggttgccattgccttctccaaataaagttgttactagtattgatatgcaggtttctgtgtagacataaattctcagctgatttggataaatatcaaggaatataattactggattatatagtaaaactctgccaaaatgccttgcaaagaggctacaccattttgcattcattccagcaatgagtgagagttcttattgctccacatcttcactagcatttggtgtgattagtgttctggcttttggctattagatgtgtcattgtattttccagtgttttttcattgttattttaatttgcttttccctgaggatatatgatgtgaaaaacaactttcttttccatgcttatttgccatttgtttatcttctctgataaggtgtctaatgagatctttagtttagatttacaataacacgctgaactcacataaattcattcttgcatttggtgtaaaatggtatata

SEQ ID NO: 35874 - DNA, 710 bp, Bovine  19866880716821
atcctccctcctccctccccataccatccctctgggtcgtcccagtgcaccagccccaagcctaaacatttatttctttatgacaatatgttgacaacacattaaactgaagttttcaaaatttgaggatatatttttcccaatgtagtgttggaaatttaaatctaatatttttatttctgtgccctaacagcctattaaaaaggtcaaaacagaaactatctgttagagtttcactactttgaaaatttgccatgatttttcactgtatctattcttaatatgaagtgacagcatagcaaaggaagtaatttcaacacattttcttagtatcggttgcacatacttttccttgtgatctctccagtgatttaaaaaaatattttatgccaagaatttcttcaacatttgaccgaatttctctcttgacataattttataaaccttttttatttttcttggtatactcattgtacttttttctaacttctagtatctcaaagattctacgcactgttaaaataagatccaagtaaactgccagaagtcattccttttccttcaggaggttccccctaccacccggttatctgctgatttattaattgatccaaagcataatatgaagactctaagatatttgtggtaatgtagtcaatattgaaataaataagcaaagagctgtatcaaattctcttagaagtaatatt

SEQ ID NO: 35875 - DNA, 1183 bp, Bovine  19866880745748
ttaaaaagaaacacacacacacacacacacacacacctttcaagtcccagaaattgcttcctcacacaaacgaataattgtatggacataactctggaagggtacagcaaggtttacttctttaaaatatcttcatattgtttattcagatatgaagtgttacttgtctaactaatgatgtataaaacctgagaagccccagtgtatcctctgggctaatttgcagacaaacaaccctcaactgttaactcttttcccctgacttattctgtatatgattatctgactccctcaccctcattctttctataattaaaactaatgttactttttttctccacaaacatataatttattggatgatcttcaaaaaatttctatacttgaataatcaaatggacttagagtcaaagtttctgattcagaagtatatttttattcatctcagaagagttttgagttgatacagaaaatgcctatgttctgtgagtgtgtttaactgataaactggcataacaggaacgattatgtcagaacaccttagtcctgaagtgaagtgaaagtgcaagtattagtcacgctcagtcatgtctgactctctgggaacccaaggactgtgtagcccaccaggctcctttgtccatggaattctccaggcaagaatactggagtgggtagctattctgttctccagggatcttcccgatccagggatcgaattagggtctcctgcattgcaggctgattctttaccatctaagccaccagcgaagtcctgtctcaagctttatcctgatcaaataatatggcctctttatatctccgatactgtagatacacaagcaaccctatatagtattgtatttttcaattattgggaaaaaaaagtttggttgattttatttcagtaacttctgaatacatgtgttgatgtttaaaattcatttctatgctcatagttaataattgattagattctatgatagtaaatctttccatagaagaatgacaaaggatgaaggtagcaggtgtgagcttctttcaatttggatttgattgctactgaagctacttaagaatcaagaaactgaattttatatctgtgtgccttctctatataatgaagctaattattctaaaaataattgagctgacatttctgcagtaataccatcaaacctga

SEQ ID NO: 35876 - DNA, 1567 bp, Bovine  19866880918820
tgatattgttgactcctctttcttcctataagctacagagacactctgtttatcttaaaattgaccagtgatagattctgataaccactgtcaaagaagctggggaaaaaaaaaattgctgcctagatgttctcatcactctgtcattcagtttgcatttggcaagaaagggaaaatagaagaggtgttacctaggtaaataactaggacctattaaggaatagttgataaagaagaataatcagaataattcattctcaacttttgaaggtaattttctgccctggtctgaattttaagaaaaattcaattatttatagtaaatacttgactgtattattttattctaatgttaaatatgtaatttaacctactttgtactgtctagtttcacaatactcttttattcttttctaatgagtcaaattcctgttttgaataaagattgaaagacatatgcattttattttcaatacctaaggataatctgtcctagaagactgaaaattgattatgagaaaaccaggtctatatatggcacatatggtttattgaatgttaatgaattaaaatcccagctttcctgaatacattgtatgtgtaaggaaaaaaaattaatttattcacagttgtaatgattcagaatgactactggcactattaggttgttgtttttttttccccgtgataattatgttacattaaaataagccaagtggtacaatgatgttattagaagatatattcataaaatttgaaatagtatacaaatacaattataatatccagaggcattgaatggtaattcaaattatgttttttagtttttagatgtaaatgtttaacacaaagatgattaatttgccaagtcaagctaaattatctttcatttggaaaagcgctaatgtaaagcactaaaccattggttctaaaattttgcaggaagcttttaagtaacttctttatccatttaaaatttctataacagtaaatatgtattgtataaattttggaacagcatagtacattttttttaaaaggactgacaactatattcagactatcatattcttaatttcaaaaatgaacaaaatatcaaattcaaaagtgctgtttcatttaggaacagatatgctgaaactggaattgcatctgttcaatgtgttagaatgggactcttaagcacttgtggtagattattgtttgctggataaaatttaagaactccatctgttaagctttatgtacaaattttgtgactcaaattttggatgtaataatgtaattaaaatagatgcagcagcaaatcatattattgcaaatgaaacagattatatgatgtgtttagaatatgaaatatttctattccataacaatgtgttaaaaatatgatgatacagttttttcatgaaaggcactatgcctaattcatcttggtagactatataatagagtgcaaagtacatttaaagacccaaataaagggtttgatatataaaatatacttttaaattaataaaatattttatttgctcaacagcaatcactttttctagaaaaaactagt

SEQ ID NO: 35877 - DNA, 1703 bp, Bovine  19866880958129
tagatgtggtgggaaggatggtttaaaacacaggataattgaaactaataaatgcagaataactgaaagaactaaaaaagtcatagttttgcagttcctaatatgatgtttgataggcaatggtgtgatttatattacttattgttccaaataaagaagtagggcttctgtggtggctcagcagtaaagaatctgcctgcaatgcaagagccgccggagaccaggagacaggggttcaatccctgagttgggaagatgcttagaggaggtagtggcaacccactccaagattcatgcctggagaatcccatatacagaggaaacttgtggactacagtccatagggttaaagagtcggacacgactgaaacgacttagcacgcacccatacaaggtaaaacagtaaagatagaaaagaagaaagagttaattgcattctatcccataaggttttaatattttttaatctaaaattaaattcccttcacttgtgaaaagttctatgctcagctaggaggctgctatgaaacattaaacactgtcaattcttactgtgatgctgcattaatactgcataacatcaatattttatattaagaatgttaattatccctgagattctggaatgcctaacagtgctgaagtactagtgcactaattttatttttaattcattttcttttttctattggctgttctccctggccctgattcttctccctgcagtgagaaatgagttaaatcagctctcactgtcaaccagaacagccttggaactaagttaatccatcacctactgacaaaaggttaaaaatattgaatatcaatatccagaatgttttccaactcacagcaattgtttggcaggagctgtctaagctctgggactacagtgcaagtttttggcattttccgtgtccctggagttaccttctgaatgtactttatgtatgaatataaatgtaagcttttacttttaatgtagttcatactagatatataaaatttttgaattaagataatacaacaataaaatgtgaatatctactttcataataaaagcaaactttcacaactgattttcagaattatcagctggatctattgtgtacagactcatgcttattcatgattatctgatcacacattcagactcgtcacctacaaagactgaacaataggatcattatttttttgaatgaatttaactcagttcacatgtgcaaagaactctgttagacattgggaaaattaatgcaaacagttctgtccatgaacacatggaatcagtattctaggagttcaaggtaagatatatatatatatatatatagtatgtgtgtgtgtgtgtgactacagatgcattatagagaaaaatacattagagatatatgacatcttcagttcagttcagttcagttgctcagttgtgtccgactctttgagatcccatgaatcacagcacaccaggactccctgtccctcaccaactcccggagttcactgagactcacgtccatcgagtcagtgatgccatccagccatctcatcctctgtcatccccttctcctcctgcccccaatccctcccagcatcagagtcttttccaatgactcaactcttcacgtgaggtggccaaagtactggagtttcagctttagcatcattccctccaaagaaatcccagggccgatctccttcag

SEQ ID NO: 35878 - DNA, 1108 bp, Bovine  19866880959499
gcaatgcttgtgtaaaatatgtgtattgtactttatggtggtggccctggagaacgtttttccattttaaagaaatcagctacaaaacaagccctgtcaattatttgcatgcagttttcacagatttcacaggaaaatatggacatggagtatttgtataaaatattttgatatatacatttggacaactaaaatgtttcataaaacactgtgtgtaaaaagctcactgttcattagacagatttgtcccctgtgctgctgattcccatcttcaccctaaagatgaacaaatggactaattcagtgttccatcaattgatatatacaggtttaaatgatcatgaatgctgtctcccatccattatgttcttatatcaccatgaaatccctcagttgcatatataaacatgagtgtctcaccttactgacgtaacacgcacacatacacacctggaaatgcaggtataaatcctgtaaatatttttctgcaggcccttttacggttctatttcaaaactacctttaacacctattacttcaaaatacactaacattaacaattctttttgggtatagaatatggttcgatttttttttcttacagttattaatctcctgatagtttaactccaaatttcaaatgtttaaagaaatcttgctttatactgtcatcagtttttccttttgtatggaaatatataggttttatttctaagagcagcaataacatagtagttggaaacattgcataatgtatattattaagcctgcatttaaatcacttttcagaggcattgaactctcttctctctgatcatcacctccagtagctatgcaagggcaagtagagaaggttatctgaagagatctatgttgattataactgcatggagggaatgtactctttcaaattcctcccttactttattttccaaagtacactatagtgcagacagacctcacagcatggtatcagttttccctgggtcaaagaatagtcctgtggtatgcaaaatgtaattatgttcagcaggataacagataattgggataggcatagagatatatttttatcacatcctcctgctgtatacagtcttgttatttg

SEQ ID NO: 35879 - DNA, 775 bp, Bovine  19866881255105
atgtaagagcttatttaaaatttaatctggaggataatatttaaactgatacttaaaggattactaacttgcatgaatattgatttttgtattttcactatgtaagtgggcactttagtgaatcttatttgttggtgtaatagcttttcaattgatttctctaaggtttaaaggtagactattatgtcaactactgataatggaaattttcatctcttttgatacaaattattgaaatttccaggaaataattaaatcatatcagtaatagtgggcatcaaccttttacttttgcctataactagagaaagtcaagtcatatctcatttgtgtgatgtatcttccaatactacttttaatgaaaagaatatattctgactccacattatttataagttcattaaaggtagcatcttatccaagatacatatgaaagagaatttggattcaggattcttaaaatgcaggcaataaccatgtacttattatgtgaagaaaagctgttacttttcttgttttaatattcctaccaataagttaaacatgctattcaaaatatattaaacatctctgaaacaaacatttttttcccctattgtatataaactgtacaaatgttctcacaaccaaatgaatgtaagatgatcatgataaatttgtaccctgtcctatattcatacaagactcatctttaaatatttgaaatagtcatattttgtattatatttttaattttacaaaaaaattttatcgattggggttactatttaaaatt

SEQ ID NO: 35880 - DNA, 1348 bp, Bovine  19866880348408
taaatattaataattcccccaagcttgaatttcccttcattagaataattatcaggatgccaagtcggtttctttttacagcatttattaaaatttcacaatatagcctagcactggttcagtttaatgcatcaataaatatagaaacatctgttaaaacatttgaaatcctatggagtgcaaacaaaattgaaagaccctctagaattatgatattacatcacagctagaagattcctctatgaaagatcatctggtgtcaaccccccgcccatttttatgagtgatacaatttctttgctttttatgcttgtctctatttttccatcgtagactgacttggtcatttctttggagtctcttttggttgattcaaatcagtgtctgcatctccagagtattcatagcaacacattttcctcatcaagttattcttggagtaattggtggtaaatatggtcacttaccttttgttgtatcattgaaagctttagtgtcctttgttttatgttgtcagattctccctgctaactgattccccaaactcaggtaattctatcaagccactgatatttaatgctgccctaggagcttaagtggttcttcatatctctcaaattctccatacaggcaatggtacacattctcactcaaaagtataagtgcataacctcttggtgacacggttgggcttctctaaagtgtgactagtgctgagtccaactcccaaaacaccacgaaggacagtgtgcttgtgtcttggtttgggagacttaataatggccttccaacctgcacaccgtgtcactctctcagaaacacctgcagtgattattacctaactgtggacttcattcagcagctgctttgtatttctaccagcattcacaatgatggagtttccgcttttcaactccacatatctttcaaaggctctctacattaactggctgtggcaattgaaatattaattgcaagcacctagatcagttctccagagaaggcaatggcaacctactccagtgttcttgcctggagaatcccatggacaggggagcctggtgggctgctgtctatggggtcagacagagtcagacacgactgaagtgacttagcagcagcagcagcagatgttcagagacaactccagaaaccctccccatctccattctgcaatttcctatcaacgctaatgacttgaagacaggacaaaaagaagccaagggtgcctgagacagagggaagtagtcaagagtgagcagtggtccaggcagcagaatttgtcctgagactcttggtcaaaggaggcaggggctgtccatctgtggttcccaaatggtggtccctg

SEQ ID NO: 35881 - DNA, 889 bp, Bovine  19866880406792
gaacctcgaaaaggtgatggtggcagcccgtctttttaccaaaaggagtttgattcaaatgagtccagtttggattaggtaaagaatgagattgaggagatgtgttctagaaatcagccaatttcgcagcctggggcatggtatttgtcatcagctgagtcatactgccctgggattagccagctctactttctgtttcaacaataaaaagtcttgcaaaactgctggcatgtgagacagagggatccagaaagttttggcatcttttccagcagcataacgggttttagggaagagacttgtgagagcatggtccatgcactccaccaccagggacagatccacgttcacaaaggatgcagtgcctttcaattgttctaggcctgtaaaaaaagagacagaagcacatttaccccgtggaagaaggggaataggggaatgtgaagctaggttgcaaaggggagggtgcagtgagggaatttattttgattttgccattataactcggtccgcttgtggtgggtttttatctattcctcagaaaaggatgcagcagtgatttctttagattgttggctctcagacttgagtgagcagcagaatctcctagagagcttgttcaaagccagaacccaagaggttagtagttcgtatacccatggtggtagtaatataaacacagcacttcttaaaacaaacttgatataggaaatgtgtgtacacatgcttgtgcatatatgtgtgcactaatatagcatgtgcctctataattcagtgaataaagagagactcatccactaaagccctgactcacaaagctaaaggtgtcctggttctcagcaaatgaattgtgtgagtaatgagctaagatacctttaaagaggcaggg

SEQ ID NO: 35882 - DNA, 1836 bp, Bovine  19866880504060
actttatctttggttgtgacaggtctttgttgcttcgctctagctttctctagttgcagagagtggggctactctccatctgggcttctcattgcagtggtttctcctgtttcagagcacaggccccaggtgcatggcttcagtagttgctgcttgtggactctagagcactggctcggtagttgtgacgcatgggcttagttgctccaaggcatgtggaaacttcccagacagaggttgaacccctgtcccctgcactgacaggcagattcttatccagtgtatcaccaggcaagtccaaggaaggagaatcttgatggtgtttagtgattgtaagtaaatggagggtttaaagaactgggcttccctggtggctcagatggtaaagaatccatctgcaatgcaggagacccaggtttgatccctgggttgaaaagatcctctggaggaagaaatggcagcccactccagtattcttgccttgggaaattccagagatagaggagcctggtgggagagtgggacatgactgagcagctaacacacaaagaactgtgggtctcaactgagatgacaaataggtatggaaggaggaaggaggtgagaaaacaagatgcatgggtattcccaaagagccaatggagtagagcggttccaggtgaaaataagacctaaggtgtattcgtgggtagataacttaggtgaattagacctctttggcattagaaagttcaagaatgggttaagtacaattttctgagcaataaattgaataagaaatagtaagtaaatgtggttttaagggaagtatgggagtttttgaatgtttcatatcagcactatttgatgtagctgcaagtaagagctagaagcaataaattagataatacaaccaccaaaatttactcacaaggaaatgaaggtagatataaattgagggtcaacactgaggttccacagttatttgttactgcaactgggggtgcagagtactttttgctttctctcaaagagagaaaaaacctctctgaaaaaacctcagtgaatctctactgaacaagagacacagctatattgaaattgctagaagaggtaaatcgaaaagtaatagccagtttttaagatatcagttttggaaagaatttcacagccagtggggactttcattcttactaaagaatgactcatgaagtgacaatttagggagaatttctcattgttttggaaaggatggtctgtaaatccctgtttttctcctcaggttacaagatgagaagaaaggtggtagcagtcaagttggcttctttcgattggtaataaaactatgctgattaatggcataggttttgcaactgtgagttgttcagatcatggagaaaatgttaattttttagtcatattggcaggtgcttaactatagtgatcacttgtttcagtcataaactttgtctacgtgacaacatgtggattagtaattagaaactattgctgattaaacacacattctatctggtagatcagaaaagtgttctagaagataatctctaagtccctaatgatcattttagtgaggaaaattgtcacagtaatcatgttatgcatattttttcttatgatgcctttagaagttccatagtgtaggtattttcttcaaatttgcaaattggagacatttcggggcacaagcagatgctcttcatgatcaatatcagttctgggagccaatttctactattgctgaataagccatatggagcatctacacggcaatagcatcagtgtcaggatttttttccctctaagttggggataaaagctaagaactaaagtcagctc

SEQ ID NO: 35883 - DNA, 1734 bp, Bovine  19866880553928
caaaacaaatcccagcggctgtagcagaacaaattcctggagtatggctggtgtcacttttgtaagagttgtcagagggtcaaggctgttcatggagtttgcatgttgaccaacttcttcctgcataataatatagtcctctctctaaggtcactctagcacagtgtgtttctctgaataactatgagttgaatttatggcttcctagtaaaaaaaagtacactttgaaatttctacctcctccctttgtcaacagctttcctagttccactgtataggttccccttactataccaacaatggttctgacaaaggaggagcgtaattccaaatgttgttcataaaagcatagctaggcttggtcaaaaccaggaactctgttttttatctggcatttcctgactgtcccaacagtaagatgaagctggggtaatcatttgtttctctacactgtaagatccttaggtataataataataatataataataataataatgagtcatgggtacagttgatagattctttgaaaaaagattcttatttgcagaacacatcatttcagctgaaacaagaggtcttagtttgaaaggtggggtgaagtgtattttattggtgagtattatccttcaagagcaagagaagatgggtgagaatggagggaaaggaacagaagaactggggattcccagcaacagagagacttgtgagaaatagcgtgggggtttagtaagaaaaatgtgactctcacagagggtaggaagtggttactccttctggtgtgaccgacacacgtagagcattacactgtttttattccctggcttaagaatgatcctcttactaagtttactggtttcttcctatccaagacaacttccttttcccagaatcttaactgagatgataaagaatcaaatgaaatcaagagcagatgcttcataaatcctattgtgtaataggcaagtaccatccagtaggaaagaactcactaggaaccaggaaatggagaagagttaaagacaaccttcagcagttagagataactggactcgaaccctgttttaaggtcttctggaatgtttgttctgtgccagcctgtgttaggctcatgaggtgcaaggatgactgagtagggcctttcctattgaggaatcactcatcattcatttgttaattgtggtttaaggaagctcatagagcgtcttcttctccttgaatgccccttgctggctcccaacatgtgaccctcatctgtgactatttttcattccttgagactgttttagattgtcagagaaagggtgagttcatcccttgctggtggacatgtgcgccactacagccttttttgaaagctgtctggaaacatttattaaagtaaaaaatacgaattcctttttgagccagcagtcccactcctgggaatccattctacgaaaacaaagccagtatgaacttatgaacacgatgtggcaacaagatccaggaacaaagtggtggctactaagagtgggatggctaagtaaattgtggtagatatgtacatggaatgttattttgaagccatgaaatataacaaattatggctctgccatttggcatggaaggttttccatgacctcctttttgtaaggcagacaggaatctctatatgcatgtgcataaagatatttaagtgaacagggagaaaatatggagggatatgccctgagttgttaatattggtcacttg

SEQ ID NO: 35884 - DNA, 1096 bp, Bovine  19866880565229
catacctcttcttgttggtcagatgcaatgtgctctacccagataactattagcaaagaacaatgcttgacttctgtacccaacttcatttgtcacagagggaatctcaccttaagtccatcaattcaaaataggagtctctcatcttgtatataaactagaactaattttcatattttggtttttaacttctattgttgaaaatttcaaacatatacatgaggagaaatacaataaagaccccaatacctcaataaaccctcatcagcagcttcagtgataatcaactcacagtcaatgtgttttcatccctatcttcctctccctgcttaccttaaattatttggaaactaatcctcaacataatattatttaatctataaatatttcaagctcttggaaaaaagacctaaccacaatgctattgtcacacctaaaacaggaacaataattcacattcacccaatgagcccattttgatcctgctgcagaaatggatctcgttaaacatctccctgtatacagctcaaaagccctttataaactgtacacgtgatgactgactattacaatgctacttgaagggcgaagaaaaccagctcgttccctgaatgctgcttcatactgaactcagtttttggggaggggttgcatattttaccccttataaggtaaagaaaatggtcattggcacccacactacgggaacaaccctgacagccactttttgtacactgcccagggttacaaatgcatgtaattgcctgctggacttcagctgtacatgtgaacaactggttttccacacagcaaccattcattttacaatctcacatctcccctaatgaatttcctatgaatactggtattaaagaacctgaaagaggaaagacctctttttaaagttaaatgccatatttttcaaaaggttgctgcagaattttttccttacccatcagataaaaaggacatttatgcaaagaaatgtctttctgtgagcccaatattgaattttccattgttggtgctcagtgtctcttgggaggctcttaatgaatcagtcttaaaggttttcttttgtttcccctcagaccct

SEQ ID NO: 35885 - DNA, 2676 bp, Bovine  19866880594166
tgtatgggatgcctcactgctgtttccatcttatccaaataaaatgactcatatgcccagggctctgtaggacacagtgtcccttaaaccaatgatttggaataatctgtgttgtcccttgggccacacatgtggaggacaatgggaaagtgagaggacttgggtcttggctaagtgtccctagtcctggtctagagaccagtgtcctggccacagtgtattcatacagttgtgtctggttagactcggatttcagctgtagaatggtcaacagtgaggaccggctgttggcagtggctagacagcctactggcatcacccaggtccccggtgatgctctactggcattactatatctgtgcagaagtcagccacactttgggaaggcacagctcctgagcccaaggggtgcagtccatttcttgttgaacttttcactaaagcatcacatacatacaggtaagagcacactgctcaaataagacaacattaccatcaccaaaagtgactcttttagtcccttccggggactatcccccagtaggaacctctcttctgagtcttggcggtgagattagaacagtttggcctgtttttgtacagcatgcaaacacgatcgtgccctgtgcactgtggttgtctggcttctcttgtccgtggtgtgcacgtgaaattcacctgcgttgcggtggctgtggtttgctcgttctcaccgcgggctagtcacccactggcgagtacagcacaatttgctttaccatcttgctattaatggagtagtcagtttctgtcttttattgttgatggctgggtactgtccattttactctttgggtggtttccagtttggggatattataaaagtgctgctgtgcacattcttgcacatgtctttcaagtgaacatctgtactggatggatattctgcttggggatattcttaggggtgaccttgctgccgtagtgggtgtgtgtgtgtgcttagtcgctcagttgtgtccgactcatgcacccccatgaactgtaacctgccaggctcctctgtccatggaattctccaggcaagaatactggctgatggtgctgctaagtcgcttcagtcatgtccgactctgtgccacccccatagacggcagcccaccaggctcccctgtccctgtgattctccaggcaagaacactggagtgggttgccatttccttcttcagtgcatgaaagtgaaaagtgaagttgcttagttgtgtccaactctttgcaaccccatgaactgtagcccaccaggctcctctgtccatgtgattttccaggcaagagtactggagtgggttgccatttccttctccaggatatcttcccgacccagggattgaacccaggttcctccatggcaggagattctttaccatccgagccaccaggtttgctgctttaattgattttaaaaagtagtcttgagacattcctggtggtccagcagttaagactctgcactccccatgcagggggcccgggttccttccctggtcaggaaactaggccccgcacattactactaaagataccccggctgcaacaaaggtcccgcttgctgcagccaagtaaataaatattaaaaaaaaaaaaaaaaagcctactccctggctctcttacccctggttctcccctttccctaacctctttcccaaacccttatgtaaaagtcggtctcccttaaatttgaccgtaaagtagctcatgcgaccatttccatctgagatgtggccattgcacttggacagttatgagacacagctgagccttcaggcatgccttgcctgttggccagtgaggcaccaggacctccagacagcaaactctcgtcttgctgatgtgtttcttcaggcttcactagaagtcgtgaatagattttcctagtgacccactttaatgtgatatcagaatatcttcacaacaaatctcaagtctttttcgcttctagttttcctcctatcatcattcatttgggacagcttttctgtcacagaggagttgggatttaatcacaaaatgcttttctgcctcccattttcactgtggggggaagaaagagagattactgatagcctagataggcgaggtaagagggggactctttacagactgcacagactagcttgtctgactgtggtcttaactacttgaaagaggactaaagtagaacacacgattaggtcattgtggaaacttgtcatgtgtgtggaaaggggcagcagaggtgcagacacacgagtatctcctcttccaggccagtcagaggtgtgtgtgcgtgtgtgtatgtagggtccttgggcatgagagccaacctctcccaaatctctagttttctcatctgtaaagtgaggcgtcataatagcacttaccataatgttgagattatatctgataatgcattacagttcacagtcacataaaaagtgtttaataaacagtgtgtctactattttcaatggactgttattcattcactttctttctactttaactgattttgggttcatctggtacctttggaaacttccttggcaatttacagaagtacaggtggtcttacttcacttccagctgaaatggaagtgcaattgttattttaaccttctaggagcttcccagatggctccgtggtaaagactctgcctg

SEQ ID NO: 35886 - DNA, 3276 bp, Bovine  19866880633612
tatgtgattctagatctacaataactttgaaaggtgcacagcagcagataaatcagcatttccagtattttaatatagtttttaaaaaatgtgttctagttaattgtcttttgtttgtttctatatcagaccatgacctcctttcaaaaaaaaaaaaaaaatgccaagaataaaatcatttggggaatattcttttaacttatccttttacaaattttttaaaaatgaaattttcttactcataaaagttttacccttttcactagcaatttttgtttatgaacttttagcatcctcacccatgacattttctttaaaaccctctatgatattgtacagttattaggtgataatcatgtacaatggctatctgttggaatatctttagtaacctgaggctgctttaacagcttacctggacctgtttcgcatgtagtggggaactgttcaaggcatggacttgagtgatttgggtaaatctgagtttcttggacccaccagtaaggccgatgaccaaataatatcctgtatttaaagaaatataaatatgcatatatatttaaacacacagttgttacttaattggagactagctattctctcctataaaaatgactcaagcagactgttgatgaggaaagctcattattgagagactttgaaagaatttaagttctggtctgtctctcattatagaggatgagtcatatggagtttgggatcctagtttccaataaaaacagggacttttttccttgcaagggaagtctttcagtgctttggacacttagactgaaaatatcaaagtggtctttggaattattaatctgttcattatggtgcaattcgtttaactcacttcttggttaatcataccatatatgttataggcttttggaatttacttctaagtcagataaagtatagacttctatgcttttttgtaagttctgtttacgaataggtgtttcaagttaaccagtatgtttgaaagatcatccaagtaaaactatacacatctgaaatgtgatcattaagccaaagctacaaatttaagaagaagctttatgaagaatgaaacaaaacagaaggcttaccatttaaaaataagattgaaccaatccccaatgactgctacccatatcatcttagttccaactgtctgattaagttgaaaccaaagtggaaaataaatagaaaagatattccggggatctccaacattagacataaaatttagaaaattgtagtaagctcggtagtccttctgcaaatgctgaataacgagcactccattcctatgaaggaaatccatcttgaaagagaggcagttctaaacatagagtgagcggagcctgaagtgctctgagttctaccatttttatacgtttctctcttggcgtgtccagccattactgtgacatgtgatactgaccatctgtggagagggcatgtctgtcctctgctgaaaagttcaactactttatgattttaattgatgctaaagaggtgaagtaaatgtggatcggtggcaagtcgaggggaaatttgggtagagacacaatgcatttcttatacagtctgtcttttgtgtgaacagttggatcatgtttgcttgaaatttttgcacggttcatttccttcaagggcagagacattagcaatttctgtgcttcactagaagactatgtaaataattactgcatgtcaaatagcccttaaagcaatgcattttaatttaaaatagactgtggctctttgactattttattgggtctttcaggaaaacagatgagtaaatatctaggcatgaaaagtttatatgatatgacagtattttctgattgcagatgtttaaataaaaatattttactatttccttattagcaaagagaataatatgagagatatggaacagagaagaaaatacatggagtttatgaaatctggaaggaaatgtgttatttttcgactgtgaggccagaaagcagacatggagattactgagtagtaggtctactagatggtagaactcttaggaatgaggcatatttttattggctagcaaaaacaattgagagcatgggagagttgctcgtatgacagagcccaagaaaataaagtcagtcactgtttccattgttttcccatctatatgccatgaagtgatgggactgcatgccatgattttagtttttgaatgttgagttttaagccagctttttcactcccctcttttaccttcatgaagaggctctttagttcctcttcactttctgccataaggatggtgtcatctgcatatctgaaaagtgaaagtgaaagttgctcagtcatgtccgactctttacaaccccatggactatatagtccatggaattctccaggccagaatactggagtgggtagccttcccttctccaggggatcttcccaacccagggattgaacccaggtctcctgcattgcaggcagattctttaccaactgagctatcagggaagccctgcatatctgaggtaattgatatctctcctggtactcttgattccagtttgtgcttcatccagcctaccatttcacatgatgtactccatcccactccagaactcttgcctggaaaatcccacagatggaggagcctgagttggacaaaactgagcgtgtgacagtgacttcactttcacttttcacttttgtgcattggagaaggagatggcaacccactcaagtgttcttgcctggacaatcccagggacgggggagcctggtgggctgccgtctatggagtcgcacagagtcagacacaactgaagtgacttagcagcagcaactctgcataaaagttaaataagcattcaatatgccagcaaatttagaaaactcagccgtggccccaggacttgccccatcgtttaatggcaccttattatggggatccagtgtctacaggtacctccctagactctttgcttctcttggaggaaatgttttgactgaccagtcttttgggggtgttttttaaaaaattctatgcctttcccagataaattaaatttctggttatggaagttaggcattagcattttaaaaatactttccaaatgattgcaatgtgcagttagggttgaaatcattgatataaagcaattcatacatagcttgttctccttttggccttaaacccctccctctgccaaaagtctacctgaaagaagctgcactgacatttaatatgtcaactattgggcttaatggatttcccattacattaga

SEQ ID NO: 35887 - DNA, 852 bp, Bovine  19866880641010
gtgcaattgccaatgcaggaatagatgggatgctttatttctgggactcctgggaaaatgacacccacacttgtcctcccttgtttttccctccagctgtcttgtcagtgcctgggcctgggtctcagagggcatgaagtctgcaggggacctgcatcagtgagtactcacagcccagccttgctccaaccccaaagggagtcataaatatttaaagcgggcgtactacaaatactcccgtgcaaacttgcactgagtagatatgctgtaatacactattttatttcctcagaaaataatttggaaggtagatataaatcctaatactaggcttgtgtgtcttttatgttctatttccagaaaacttggcaaagcaattgagttggaagcaataaaaccagctcatcaagtcctgagtgcacatgaaaaaaagagaaaatcagtgagtcaaaatatttcttttctgccctgttaaagcaagatttctgtctttggctcaagagctaggtaatcgaaaagtgatactaagttttaggaattttatcataaaaataaacacaaatccaaagatttatgtatgaggatgtttgttaaagccttgtttatagtcgtgaaaaaatggaaacattttcatcttccaaaaataaattaggataaattcaagcaatggaatgtacccattaaaaatcttttggaagaatttaatggtatggggatatagtgctaaattaaaaaagaaagtgagcaaatctaacaatgtaacttcaattttgtaaaataaatgtgtgtatatatgcataggaaaaaaactagatgcaccttcccagaatgattatctctagatagtggaat

SEQ ID NO: 35888 - DNA, 2582 bp, Bovine  19866880679355
ctgatgcactccttttcctatttggaaccgtctgttgttccatgtccagttctaacagttgcttcttgacctgtatacagatttctcaggaggcaggtcaggtggtctggtattcccattgctatcagaattttccacagtttcttgtgatccacacagtcaaaggctttggcatagtcaataaagcagaaatagatgtttttctggaactctctagctttttccatgatccagcggatattggcaatttgatctctggttcctctgccttttctaaaaccagcttgaacatctggaagttcacagttcacctattgctgaagcctgtcttggagaattttgagcattactttactagtgtttaagatgagtagaattatgcggtagtttgagcattctttggccttgcctttctttggaattggaatgaaaactgaccttttccagtcctgcgttttccaaatttgctggcatattgagtgcaacactttcgcaagcatcatcttttaggatttgaaatagctcaactggaattccatcacctccactagctttgtttgtagtgatgcttgctactgctaagtcacttcagtcgtgtccgactctgtgcgatcccagaaacggcagcctaccaggctcctccatctctgggattctccaggcaagaacactggagtgggttgccatttccttctccaatgcatgagagtcaaaagtgaaagttaagtcgctcagtcgtgtctgagtctttatgaccccatggactgcaggcctaccaggctcctccgcccatgggattttccaggcaagagtactggaatggggtgccatcgccttctccagtagtgatgcttaactttccctaaagaacatcaagaaaccttttacctatattttcattttgtgttcaggctttgtcttgagagaatgacattcacattgagagctttctccaggccatgcggtggaaagatttcaggacttgtaggagttcatgaagctgtaatggatttttgtggaaggaggaggaggtgcttacgtgaattcccaagtatatgtggtgacttctgccttactgagtaatacttgctcttaggtaattatatatacaagggtttgtggagttggtgttttatcaaaccatgaatcttatcttttcagcttccttaataaaataccaactttgtagaaactttcaaaataaaagttgacttatagttcagagactactgaaataaccttgatttaaatatgatttcattattaaatagtgccctaaaggcatagacttaaacttctcaaaatgtttagagctcaacttgactgtgaaaaacattggtcctcatttatatgctgtaacaaggttagtgctacaggcttcctttggctgacagcagtgcctgagaactggcttgcattagtattcgtctcctgtttccgtggggaaaagaaaactagtcactctcagaagagttcaggtaatttgatatgaaatattgatccatgtttcaaaatctgtacctgcacgttcactttgcattagttgaagcatcatctgacacttaaaattctttactgaattcaaaaagggtttctttttcttaaggttttttttttttttttttaaagtaaaatctgagagctaatggctttcacatacaatggttatcataataaaacattgttctcatcaacaataatgaaacaaaccagattctttgctttaaaaaacagcagctttctgggcggagtaataagatgttctagttctgcagccaatgttttgtctcttcagggaagacttgatcttggccatgagaggtggggttgggggtacttattgcaaggattgggtgtgaagcagagctgaccagcccttgctctatctagagctccatgtgtggctctgagaaactggctcaaggagcatctggatactggttcagctacagtttgctgtaaggtgggacacatggcctagggttttgtttttgccctcttctccatcatgaatgcacgtgggaatagccctcctgctagagaccattgctgtcattattttaggattttttgcacaacagtctgtgataccagtcaccttggaatgatttttccaaagcacagggaagatggccattttgtcctcagggaatttaggcttctataaagcagtgaacagtggaaagaataaagtttttgttttcaggcaaaattaatctgtcgtgatagagatagttgtatgggagtgggcaggagagagcctgctggaatgctaaaagtattctagatcttgatctgggtggtggtgacatatatgtagacagttgatgtgggtgtatacatatggagacatagcgtatttctatgcacttagatttgtgcactgtaactgtttgtaacttatacttcagtgagaaaaattaatgatggtgtttggtcctcctgtagctccatataaagcagcttctgctggtgctgactgcagatgtgggcacaagacatttgaggatcaaaaactgttgtttaaagggctcttccaagagcttggcctattactgttgggagctactgatctctcttca

SEQ ID NO: 35889 - DNA, 2487 bp, Bovine  19866880746212
ttccctgggtgattcgatctgctgcaggattagaactactgcactgaggtaagctgctcaaacctacaaagcctacagcaaataatgtgccaagtgaggaattctgcaaaaaagcagtttgtctccagctgcttcatctgctctgcatgttcccacctttttgtgaagaatgatgttcaggttctaaatacctcacatgacttgacaagcaggggagtagaaagtcacacttggatggtgattttactgtttattttagtaaagatactttccagaatggcaaccatatagcacaggtatcttgaacatgaaagagacacccaataggaccagtgataataggcttattctgcccattacaaagacagttttatctatcctgagcacttgcttataccaatgttactctcccatttcttcctcagtggtagaaggccaattttaaattgagcacattgtctcttcaatataaacaaagagatacttctcagccttcttgcagctaagtatctagctgtgtgtctcagttctgatctatgaagtagaaatggtatgtgagatgttcataaaggctacataatgagagacaactcagctggcaaacaattttttacctattcacctctccttctttggggaaattgtttcactgaagtgatggctggagttccagcagccattttgtaacaggaagtaatcttcaagatagaagctgtgtattagcatcctggagcaaaaagatagaatatccctgtatcctaaacgatggggccatcatttcagatgccaactgcctccctcagacttattttacatgacaaataaactttttttcttatgtaagccactattatgattattattagctatatgctccaaagctaagcttaactaatatcataaaaaggaacaccatgggacatataaagttaaggagagattccaatggtgtatagaacccatcctgtgaattcttaatatactgattattgctgaagcaataaactaaaacactttacctaatattggtgtattgaagaataactagtataaattaacagtgctaaacttgataaaagagtagaattgaaagtggagagcaggagatgagctagagtgccaggtcacagaacgagccattggcatatgctatcttgctgaccatggagtaggagataaagaggaagtgaggatgacccccaagatctccagcttgattgaccgctgcagatagtaatgcccgtaaataagatggggaataccacaggaggagtaaagcggaaaggaagagcatgagcttggtgctgaccttgagaagcttttgaaatgcttatggatacaaatgcaaaatctagggagaaagttagaaaacaatctaggaattcaggttcacttgttattctgcttttgagaaacatttgatgactccacaccaattactcaatgaagcccaagctccctactttcaaggccatttatgacctggcttcaacctagcttttcacatctctatctctttgccccacaaggccccaccaaaaacaaatgcaagccttatgtttaagtcacatataacttcatggttttgctcaaacatgcttcatagaagttcatgcatattcctttcacaagaaacatacccaccttgctacaaatatctctttacctgtctgcctcccacatgggacagaactattaaaggacctcaccaactatctcggatagagcacattgagagataagtactccaatacctgcttcattaacagaagctcacgcagcaagcatccgtgtttttgcttactctgctttccttatctgggacacagaaaggaatcaatgatgacccagagtaatcagggctgggtgaataatacagtggtggcttttatctgctgagatcagatcagaaaaggatagaaaaaaaaagaaaatgcccaacagctagcaggagtaggggaattttatataaagaggaaacaaatacactcgagtctctgataacttttacttcatgtggcaaaagccatccagagcacgggatggatagttcatgtttagtatagggagattgaaggatgacaagggagaaagcaccagagtgttcaagaggaggagtgggttggatcctgaaaagcgtggtaggaaacctccacaggccaccagagtacaatagccacttcactcataaaaccagtcccgttagcagaagagggatacactctcccctcagtggtcttcagctgcgcttgtgaacctgacaaagctcattgttagaaaaggtctggaacattctcactgaaaggttttccacctgccactagggcatcttccaataataagaacctagggtttgacttctgagttgggaagattccctagaggaggcagtggcaacccacttcagtattcttgcctaggaaatcacaggacagagaagcctggtgggctacagtcccaggtgtcccaaagagacagacctagccg

SEQ ID NO: 35890 - DNA, 2604 bp, Bovine  19866880752794
attcattttttaggaagcttcttttcttgacataattgccaacggcttccagtgtcacatactttcaaatttaacctagaagatagtagaagtctccttcccagaaacctcagggagaaacaaaacaactcgaatcacttcttatatctgctctatactgtttatgtaactagtaaccctatctccagacttctctttataccgttctgtcaatcagcaatgccctttcctctagcctacagatacccacagcctaccttagccacctcctccatgaagcttttcatggtagcacctgacatatgttcttttatcctttaaatttccatactgtttatttaaacctgctttatggcaacccactccagtgttcttgcctggggaatcccagggacgggggagcctggtgggctgcagtctatggggtcacacagagtcggacacgactgaagtgatttagcagcagcttagcagctatagcacttatcacattcttccttatattaggttggttacatgcgttgttcttctataaaacttgaagtgccttaagggagaagtctgtaattgtccagtctttgtgtcccctcacagcacctaactttgatctgtacgttgtaggcgcacaatcatcttttgttgaatgaatcagtgaacacatcaagctaaattatatttcaataatatatttgttaattaaatccatccctaaaggcagtacatagtctggagacatttccactagggtccctgtttcctcctactagtctatttgtgtccaggtagaattatgctaaagcaaacatcagggagagagagaaagagagatatcaaaactcatcctgcagtcctgagggaggtaatagtgatgggccattgccattagagcaatagcagaaccatgtgggttggggatggagttgagtcttggacgctttttttcttggtggactagtgaaacgacttcgccccctctcctcctccctctgtgtgtgtactctgaatcagggtttagctcggcaccatggcaaccagactgaacgttgtgtcaaacccactcaggaagtgcctgcacctgacaggtgatgtagactcggaaccaattgagtcctgttccacaagccacagactaatccatctttctttttacttacagagcttccatccgacaacgctccaagtctcagctttcttacctgggtcatgaatcgtcactagcacttgtagatcataagtctactcatgaacaagacagaaaggtcagacgccagtggctcatgcggggatggaagaagtctctcctggagactatcgtatgccctttaagcttagaatctgagttttcaaggcctttatctagtaatgtttcattgctgctgccgctaagtcgcttcagtcgtgtccaactctgtgcgaccccatagacagcagcccaccagactcctccgtccatgggattttccaggcaagagtactggactggggtgccattgccttctcctatgtttcactaagtcaaactaaatgagaggctccattaagacgtgaacgaaactctaaattttatatcatgttttacataatattttaagagaagcataaataataaaatattttaagaatacatggtaactaagatgaagtattaaaagttcactgattattcttatgtgagccattctaataaacacaattacatgtacttagcagactatttgattatgtaggaatccctttcaagctcttaagactatctgaaaacctgtctttgtaaaactttaaatctctgtcttaaataattataattataaagtgtttaatacaagttactgcaaaatttaaattaatggggactgattaggttttacagacatttgtttacttaatacaattttataataattgttttagggtacatttgaaatgaacactattaattttaacactattcaaagcaacataaaaatgaaataggagaagaatcaacacatatagcaatactcaactttgttcatcaggatgcccactgctgcagtgggcacagtctaactttcacataaggtgaccatccctcctactcagagcctttcttaatcactgaactttattcttcagccctgatcctctcattttcaatcccccattactcttcatttcagtcttttcatggcaattttcttattgaggcttatttcagatcatgttgtcttatcctgttactaaattacaagcttcttaaagttagtaactgttatttgtgtttgtatcaacttgggcatcttgctttgcctggaaactcctttatctggttaccattagcctaccaggctcctcagtccatgggattttccaggcaagagtactggagtggggtgccatttccttctccaggggatcttcccgatccagggactgaacccagatctcccacattgtaggcagatgctttactgtctgagccaccagggaagttctggttaccatgagacctagcaaacatttctgtttatttgacacatgtaaacctagaaccaaccaaatcctgttccaatctgctcataatctacagactctttcatctttctgtttagttagagagctgca

SEQ ID NO: 35891 - DNA, 2566 bp, Bovine  19866880777933
ctctctatgaattaatatggtggtgatttcagtgcttcaggagtcaggctatttcatgtaaagatggtgttgatctggagaaggaaatggcgacccactccagtattcttgcctggagaattccatggacagaggagcctggcaggctagagtccatggggtcacaaagagtcagacacgactgagcgactaacacacaatcatacagtataagaccatttgagaggagccttttttcactcggcataatacctttgatctccatgttagttatttcatatatcaatcctttattctgttttctctgagtagaattccaggctaaggatgtaccatgatgtgtttaactgtctaccccttgtaagatatttgatattcccccataggttttgggctgctacaaaaaaaaaaaaactgctatgaacaaaaaaataaataaataaagatggtgttgatatttgtgggttgggccaaagacatgcaaaggaattaacaattgatgagccgtttttagtgctcagagcaggagggaaggctgtaggaaacaaggaataagcttcgttaatgatttggtggtgaacaggcaaacaggacaacagactggaggacatctctcctctggctctccaccaggactactggacaccacttggcacccgcggctactgcccctgcccccacgagacaccagctcagatgcctgcaggaaagaaaacggaacactgaggtatccttcccaaatggacagatgtttctttggcttttaccacctattcccctaatgtccgaattaaacctggaacaagtaagcaactacagctgaagtattaggacggagaacagcagcgcctttttcaaaagtttgcattcctttttctttttccccttctctatttttgaaatttgccttatttctcaacacaccttactgaatacgtcatagccatcagtttaatctcctcgacctcacagacagatagtagatctggttcaacagctatttactgagattctgttttcaggaactgacctttggtgtttatcataagactgagaaaggacataagtaaccatgtgacaagtagagcaaacaagctctgcctagtccactatgggggcagggtgctatggggcaggggaggcaagggcttaggacagacagcccagagggaagagaggaagggaatgggaaggaagaggggtgaagctcgagcgaagacttatgtaatcagtaggaagtagtcaggtcagtaaggggtgataccatttataccaaccgctggcaaacaaacagagttgctagcagggggcaaaaagcagatcattcccattaggaaatgaaatgttctactttctagtacagtaagttaaaagctttttctgttgaaaaaaatataaaaacaggatttctggaaactttatacttatatacattttagtagaactttaaacccttttcaaactaaaactattcttgcattttatcatttctctcccatctttcctgccataaaagatccacagtaaagacatagtattatatcagtgaatagtgaattgcttttaagaatttaactggaacattgaaatggagtatttttactgagagaggtcatttaacagtgatgaatgtgggcaaagactcactggacctggggctgaatgccagctctgctacttaatgttacttaacctctttgagactatttcttttttctcttttaaataggggtaataacacacacatcagaaggtcagggggacgatcaattaagtagcgcaatgcaggacgtagcacggaagaacacatggcaggagtctgagaaagcatgtggctgccagggctgaatacccttctttctttcaaagtcagctgttgtctctcccctagatatcacaggcctaaaagtatatttttaagttatttgtattatggactaagtataactttttaaaaaaataaagagcagtttttgtcctcttaccaaaaaaaaaaagtattcactaccttcattccaatgtggatagcccttgttttcttttttctcctgaactgtggtgttggagtggagaagggaatggcaacccactccagtgttcttgcctggagaatcccagggacgggggagcctggtgggctgccgtctatggggtcgcacagagtcggacacgactgaatcgacttagcagcagcagcagtggtgttggagaagactcttgagagtcccttggactgcaaggagatcaaaccagtccatcctaaaggaaatcaatcctgaatatttgttggaaagactgatgctgaagctgaagctccaatactttggccacctgatacaaagagccaactcattagaaaagaccctgatgctgggaaagattgaaggcaggaggagaaggggacaacagaggacgagatgattggatgccatcaccgactcgatggacatgggtttgagcaagctccaggaggtggtgatggacagaggatcctggtgtgctgcagtccatgggatcgtaaagagtcggacatgactgagcaactaacaacgataactaagttata

SEQ ID NO: 35892 - DNA, 744 bp, Bovine  19866880904688
atgacattacttacatgtggcactctgaaataaaaacgatacaaatgaacttatttgcaaaacagaaacagactcctaggcagagaaaacaactttatgattcaccagagggggagaggaagaggaataaattaggagtatgaaattaacagatacacactaccataaataaaatcaacaacaaggatttactatagagcacagggaactatatttaatatcttgtaataacctataatgaaaagaatatagatataaacttataaatacatgtaaccaaatcacttttctgtacacctgaaactaacacaatactgtaaataaactacacttcaatctaaaaaaaagtcagctatatgccatcacatgcactctttgaacaaatcatttgcccaagacttttgccctctgtctaaccatactttactcaaagcatattttcccatagataatattcttagatgtgtcttgtgacaaccgcttacactgtctaaagttccaaagcttatctaggttgggcaaatacagcaattgagaacattatttgcaatatgttgaaagattgtcaaagcattaccccaaagacattattattctatcatcaaaatgctcacaattagaggaggtttttccattcatccatcctaatgtttctcagttcttcccatctatgaagttctttgggacatttaaattcattctctgaacactcaatagcctatttcttttaagcttttctctttt

SEQ ID NO: 35893 - DNA, 935 bp, Bovine  19866880944601
aaaagcacacaggcattccatcaagggcaagttttcattgggtttaatttcaagactctcaagctctcaagagtcctggttccttggtttttgacacgtagaaaataataaacagaaagtgacctatgggttatatatgttgagttagaagcagtagtatgcagaaaacttataaaaatatttaagtccaagcaatgttcatcattttaataaaaaatattagcaataatgagttctaggaatccttgatggttctgaatgatttgtccctgataattggactaaattttggatattgaaaagttaaggaatagagagaaacaagaatttcaaagagaaaataagcagggggtatccatatggaagaagaatcaacaaggatgtggtaatatttaggtaaggtgtgggcactcagtacgttttgatggatcaatgaaatgatgcagttataagaatcaaagaagagttgagaattttttttttttgagaacaaacaaataattttccaggaactggaggagaaaatgagctacagagaaaaggaaaggcttatctagattcctactttgaaaaattgtctatggatagataaatgctaatttttaaagatgacaacatgttttttaccattgttgttttggattggataatgaataccttaaggcatacaggtcacagtctcattaggataaactttaaagatgcccaaattcctttggttatttgttttgtatattacccaatattactctgaaaagtggaatatgagatggaacttggaaattctttattataaagaactttaatgtaatggtgtatcttatagtagcttttatgcaattaactggagaatcttatctcagactgcctaataatttatgattaaagtgatgctcaaaattattttaatgatagttaaagtatatcagggaaag

SEQ ID NO: 35894 - DNA, 1633 bp, Bovine  19866881012172
tgggttgtgaagatcttttttgtacagttcttctgtgtattcttgcctctcttcttaatatctcctgcttctgttaggtccataccatttctgtcctttattgagtccatctttgcatgaaatgttcccttggtatctctaattttcttgaagagatctctagtcttttccattttgttattttcctctataaaatctggtccctttcaagtagaaaaaggaaaaaaacctaagtaacattttaatagtaagttgacagtgtctctttaacctgaaccctgagccctcaactcctgaagttacagttaaagcatcatgtggatggagtgtgctgcaacagtcaatgctactcttgacagtgttgagaaaaaaaaaaaaaaagaaaatccattcatggccatactgagcacctactatgaatgagacagagccaggtgctacccctgagtaagacccagccctcaccctcaaagactgctctttggtgagaaaaccagggagcttaaatacactcagtagtgttcctccaaggcttattattttcagagctctcaagaatagaccccttattaatatgttaatatatatatatttatattatgaattatacatcagaaatctaaagtatatgcttggaaaaggtgttaagttccctctatacactgaaatttagcaggctttaacagtggcatggaattcacagtttaggtggttcagaaaataatgccaaggaaaatggaattcatacaagaagcctgagaaaaatatatgtattttccgaagcaactaaatgtagattttgattcagcgtgcctaaagcaaatcaggctgtacagtacatagatagataaagacaacattttattaggcttataaagattagcaacagtattaggtagatcatggatatcaccacatcttacattacaatgataaaataatgctttggggctcagacctgatagatgttcttccaacaatattttgtacctaaacattctcactatgaaattatagctttacaggcaccccacctcctctccaacagtcatttttttaaggtgatagggagaaaagggagagggaagaggagggagagaaaaagaaggaagtgggatggttacacaagggaatggacattctgcgacagaaattcatcaattatctaaaatatatgaaccagggtcttcaatgaaagttttcagttataagtaaaactaaaggaacagactgattgttttaggagaaagtataaaatgaagatagagaaaagtgaagaattgaaccttatagtacatacaaaccatcagtaccctcccccacctcatgtgttttcacatatttttttgtgatttgattaaaaacatctgctctttctaagaagagtattatgtctatcttacaaatgaggcacagacagacaaaaagtacttaatagtacaggcactcatcacttttatgatacagttcattcctggaaaccacactgaaaaaatcattaagtggactgcgtggaatttattaaaatcatttactagaataggtttgaatttagcaaagaaagctagtgacaaataagtggataaatacaagagaggtattttaccggcccttatttttctatatcacaagg

SEQ ID NO: 35895 - DNA, 970 bp, Bovine  19866881020546
tatttctaaatctgcattctgattaatgaacacataaagtgtgttgttgtgataattcagtgagctataggttttaagtatacttttgtgcatgtttctgtatgtatgctatacacagaataaaaagtttacattagaaaaataaagcacttttctaacaatgccatataaacatttgttaagcaagtgatgattatgcatttcagtgtcagatttacagcaaatactcattaggctgggcttcccaggtggctcagtggtaaagaatctacctgccaatgcaggagacacagaagatgtgggttcgattcctgcgttgggaagatcccaggaggaggaaatggcaacccactccagtattcttgccgggggaaattccatggacagaggagcctagtgggctacagtctgtgggatcgcagagatcagacacgactgagtgactaagcatgcgcctacacacccattagggtattagctgaactggggttccaccaagatggaattttaagccaaagtcagggtgctacgcttctttttgttgtacacacctagcggagagtccctgtctccctccctccttttctccctctctctactctctctctctctccctctcactctcagtctttccacaaatgtaaacactcctcaggaccaaaaagatgtgtttagtttcacctgcaaagataagtataatctgtgtcaaattccaaaatgtatcaccatacattatttactttagcagttcccattcagagccgtttcctaactcttctagattggctttttaaatagagccataagaagtttctggcagctaagtgcatccaatttagaaacgctttagacaatttgaaaggactggatgtcctcagatttgacctgagtagagaattagatattggctgggaaaatggaaaggagagaaagttctccttttaacacaacactttaatctcatcttcaa

SEQ ID NO: 35896 - DNA, 1569 bp, Bovine  19866881035392
taaaaagtaggctagaagataaaaataagcagtgatcttagttgtgcatgcagttattttcagaaaaaggcaatcttttgtcatcctccccaaatctttgaaggatgggtagaaatcaagttaaaaagaaaaggagaacagtcactgagtcagtatgtctggtaaggtcacccaagccctctgccctctatgtttgaaagagggcgttgtcccaaacactagctgcagcgtggcatgtagggcgcacagatgatgcagggggattagttagggtatgtgggctcaggagatgaggggtttaaagtaagcattactctagcattcagaatatttctccttgattttgggagaaagaaaatgaaaagaatgatattctattatattaaaataagtaaacagactacctgcctgcagagaacacatttatgaaagtgaattctgaattaagactaagaataaatcaaagctttattgtcaagtaaatcagcaaacttaacagcataggagcagtgagcacagaactgggcatacaaatggggattgagacatggtcccagccctgcttggaactcactgctgagtggagaagggcgacaaggaaattaacgatcaccaaacaatagaatagaacagtgtttctggagaacacagagcaattgctactgagagtaggagactcaaacatctaattaaatttttgagtgaggtgaagaggacacaattgaaaacaaatgcaatcctacggctagtagagcaaagagggttgagctccatgaataattcgctactaagagatagtcaagctctgtttcttctgtactttgttgatgcacttgaacctattttgtgaagcacctgacttatttctggaagatattacagacttcatataagaaagggtcttcaccctttttaataaagtgctgactttgcaaactatgctcctaacatcagccagtgttctgaagagaagtaatttaagagacttgtacacagagaaaaactccttcactgcttcatgttagcccttgaattgactgactgggatgtgttcacagggtactttgaataacaactgaaagtattcattgctttatcgaggtgtttgccctttagtagcggacaaaagacagaaaacccttacatgtccatggaataagaaccagtaaaatgtggtgggctaaaatcctgattaatggaaatattctagttaacttaatgataaccagaaaattctccttattttgttttgttcatttattattagtcaaatggcataataaaaaagtcactgaaaatattttactaatttttgatggttcatagtgatgcattgcttcaatacactaactatgattgcagagtacaggtgagaagacaggagacttattttggaggctgtttgaatagccctggaggctatttggaaaaataatcctcaatatttccttattttagtatcagatactaccaggcaataggattatgctactagactatttcattttgcaaatacatttttattacacttacatttcaattcagaagataacctaaaaatgttaggta

SEQ ID NO: 35897 - DNA, 924 bp, Bovine  19866881082077
ttgttgagaaggaagtgccgttgcttcttcttgggaatccagtgtggtttccccctcctcctcctctccttctctttggtcttttgccccgccccccactttgcactcacctcctgcctggtgctgttgcagggccacttgccttctgcttccttgagctattctcccttctgtggttaactcatggtggccacattctttagccaggggcagacaggaggtgtaaaagaatcctctattatcactaatttagctgtaattgtcttaaaagttggccttcccaggtggctcagtggtaaagaatccacctgccaaagcagatgtgcagaaggtgtgcattcgatccctggattgggaagatcccctggaaaagaaaatggtaacccactccagtattcttgtctgggaaatagaagaatctggcgagttactgtccatagggtctcaaagagtcagaaaaactgagcaactgagtatgcacacacatcttgaaagttgaaacatagcctgtgactcctgacatttgattataccaccattgattatatgtaaggggtaagtgagtttctctgtaagatggtgatggtggggagggtaggtacttggaacagaacaacaggaggtccagccttgtctcttttggaaagatttgagcagattccaagtgactatcagggaatcaagtctttgaggtttatttgcaggcctccccaaatctaaattcataatgagctctccatgtgattagaaacttagctaaaagcaattaaagctaattattttcattctaaatacaacttgagttgctggctttgtctttagggctgtcaggatatgagcaaactattttagaaaaatcacttcaaatttggccaatttttcttagtttgcccctatacgactcagagcagagcagttgcccac

SEQ ID NO: 35898 - DNA, 688 bp, Bovine  19866881114150
gggatgaagaggatggaaagaatttttcctctcagctggggaggaggatatgggcacttgcatagagaggtagagaatagacattcagcttcagtgtcttgtcctctcctgccctccctgcttcactctctcttctaaactcagaaatagtggtggatgttttcatacagggagactgagtccctgtggaaagtggatgtggggaattggaggaaagcaagcttgactttcttttttctctagaattccaacccaaattctgtaaactgaacccatattctagatttcagttatgggcgggcttggtgttatttaactcttactaaggaagaaaaacattttatcttttgccttctcatgtagagaaataataaattccccctactctccattcacttatgaattccaggaagttagttttagttataaagagaaatgagttaatcctcatcccctacctccccctgtccccccaaccatcctggcactaaagctttaatgacaggcttcttttgcttgggagggaaactgtaggcaagattccctgcttatgtcataatttttgtcttacttttttctgaaaatcattgtccaagagcttgaaaactacaagcattcatgttaagtcatttcagttgtgtctgacttgttgtgaccctttggaccatagcctaccaggctcctctgt

SEQ ID NO: 35899 - DNA, 1388 bp, Bovine  19866881217769
gtagggctgcagtccatggggtcgctaagagtcagacacgactgagcgacttcccctttcacttttcactttcatgcactggagaaggaaatggcaacccactcccaggtcttgcctggagaatcccagggacggcagagcctggtggggtcacacagagtcggacatgactgaagcaacttacaccctatctaattatcctcttttcttttttctcttttgcttctttggttgtttaccttatttctcataaaaaatttcagtagcccatttcctccactatgagagatattatctttcataccatatgacttaataaaagaattcaaactcaaatagtgttgcagtgaaaagtaaagaaaaggaaggagttttttttctttttctttcctgaggacaagaagataaagagaacagtgagaagacctgaacaatcctagtcttttttttactttaactgctccgaactctgcatatctataactaagcttgcttttctgcccccttactctgcaagagttacatatcgcacctactatcctttgcttaccttcgcaacagcctcttccccttgtagttcttgtatcaggaggaaggccacagagccagggaactgccaaactcaattactgggttattgacgctagcttatgtttttgaacaagatcctaacacctttgtttctcatcactggctcctgactgcaagccctcatcttatataagcccctagactcctcatggagggggtcacagttcttgaggcatgagcctactgtgttactctctctgctggctgagaattaaaggcagctttctatttcctccaaactccgtctctgtattttcttattcagccccagtcggcagacaaagtgacgattttggccagcaacaacagtactggatctcttatgtccaaatctttttgttgaaaattcttttctcctgggggcaaaacttgccccatcgtactcatcccaagaagtcatcaactatgagactttcttaggcatcaatacattgtcaatgccagcttgaaataaactttaagcaactacacagatgtgattgttgttttctttccctacagctgctctgtgtttgaagtgattttattatcatcgattaaaaccactgcattgtggcctgttttaaacattttaacttaagctgctgttgctaaaatatactcaaatgttttctcttcacaggtatgagaaaaatcttgtgtttgcccagcgctggggaattagaaaagggatagtgatgggattctttactggattcatgtggtgtctcatcttcctgtgttacgcgctggccttctggtatggctccaaacttgtcctggatgacgaagaatatacaccaggagtcttgtccagg

SEQ ID NO: 35900 - DNA, 1374 bp, Bovine  19866881228498
aaggctgtgctctaaacaaaggctcaatttatgacttgctcattcaagatagctaattgtttattgaaaaatggttaaagaggcttaaaatataatattctagaaacaactccaagtagttcaaacacagatttatttacttttaatgttcaaagagtagttaactgggttttatgcgttaggggttttatttttctttttaaggacaggtctattcagaaaatttcaagaaatgctagtttcattgaaatttttcaggtaataaagcaatagttcaaatgtaaaagctataaaaattgccaaaattattgggtaatttttaaggacatctggcataaattatttcaccatgttttttctgattggaagaaaaaaattataaaggtcatcagaatcacagtttgaagatatatactaacttcttaaacccagaaaatgactaggcatctcttttgatcactaagttaaaggttgcaaagaggaatgtatctcatggtgaggtcaaaagaaaataaatattttcttaatttttcagatgaacagaatttttcccattctaaatagtttacttacagtttactattaggcccagataactgttttaatataaacatttcttatttggccattagttcttacaaattctacattttggtgactagggagagaagcccagaaatacaacctgtacacagaaagtagctattaacctcctacagagaaagatttataggtttgagtaagaaggtctgttaaaaatatcttattgtgtatgctgacagatttttttttaagaggactaattgaaatgttaatttgtatcttatttcctcggtctgatgcctaagtctccctttagtaatatattttagattcaagaacaatttccatggatgacaataatttcctaagtaataatgttgagagagagagaacatatattcccaaattagctgtttttgcttccgatgagaagtggtgcacagcttctgaggaagggcggggcagccgttgcaggtttctgaaaaggggagtgacagaattctaacgctcgtgtttatggcagaccagagcgggcaggtcgggcccctgccttgcacccatgctgttcatggtctccttggtgcagcttatgccagacaggtagaatgctggatgaatgggcaacagggaacgagagaaagagagattgaagaaacataagattaaagtagtagaggggataaggattgatgtcttccctgctcagaactgggaggtagtcaactattttgatgccctcttctccacatactcttaccttgtctgccaatgctctgagtttcttttttaggcccataaccttcagtctcagccctctcttgcactagctct

SEQ ID NO: 35901 - DNA, 1070 bp, Bovine  19866881303511
tcttggtaaaaagaatattaaaggtttttttttttttaaaaaaaaaaacaactatcccaaatagtaagaactatgaggacttggaaaatcccttcccctactttgggcatcattttttatttttaatgtaaagtgaatgagttcaaaaggtcacggaagcctttctggtgctaacatcctgtaattgtataaaataactgcttgtgaatgaaatgacaacaaaaagcaaacattcatgaagtattatctattttggctgtgttttccttcagagaaatagaaaattcaaggggaaaaaataaaccctggtggcaacgaaacccgctgactaatatgaaggattttagattgtctaatgtagcgtatagatcaagagggctgccctctaggatacaaaacttgtagagaatggaatgtttgtcacagtctaaggcaggagggaaaagaaagttccacaagtggtcagatgggggcaggcgtggggaggaaagcctgagctggagagactggcagcccttctaccgtctccaaggaagaaggggccagcacccacacgtgccctcatcactttcacatgtggggctctccagtgtcagctctgcttctgcataaaatcagcttcctccccataagtctttaatttcctccatccaagaagcctcagtgggcaatatacctcatgagtgcctttttatttatttattttcttattatcttttattttttaatttttttaatttaactttacaatattgtattggttttgccatatatcaaaatgaatctgccacaggtatacatgagtgcctttttaatgatgttccattttcctaaacacctgctcatcctttgaggcccacttggaggcttcacactcctcgaggccttcatgaatcgcaccatgcctgtcctttgatttccatgacacaactgtctcctcattctcttcctgcttctcacctgctcctttttacttctctgactccaatttttctcccaccttcgaacttcttagagcacctaatgtctcaaaagctcattcagaaatgtaccatatatgtctcagaaat

SEQ ID NO: 35902 - DNA, 1206 bp, Bovine  19866881330482
ttatttactttatatagaaacagaatttcagggttggaagtgactttatatgttaattaatgagtacaatatgctctctgtgtccatcctagctatgattaaaaatctctgttgacatggagctcactacttaatgtactgacccattctatttggcacatctatgactattagaaaataccttaagggaaaaattaccttgaggattccagtagaatctccttaggtttcacatttgtaaaattggggctagtattttaatgttggctaaatggatgtagccaatgattagactcctgtttcacagcattaccatggaaaagatggagcactggatatttgaataatctgtctaagagagacacggtaatacctctgagtgaaattccatgtcaccttggcattctttgcctctacaaacaacaacaataaaaaagtttaacttgcctatagaaccatcaaccacttgcctaatgatctacataaaatgcaggacttctttcaatttagacattaaaagaatgacaagattacccctgaaaaaaattgtaacaggtatacatatacatgggaatcccatacacatgggaatcatttgtcagctgtggcggtacaggaaaaagtgagaacgcttgaaatgtaaatactatgatcctcatgcattctacagaacatgaatgaccttacagcatatagtttcctgaatgaaatgtgaagacaagaagagaatagaaaggccatgttagatgtagaagctgggtagttagctatgtacactgataagctaggctatcttcataaaacagagttttttggggtaattcccattcatccctcagcagagttaggagttaccatgaacctattcctatagtaataggcctattgagtttctttgagaagaattacaactctatcaagtccaagatggatggcaagaatatgccatgctgtaaaaagtagggattgcaaactccagtgtatttagaggccaggcaggtaaataacaataataataataaatggaataggcctgatgaaagagaaaaaggaatggactggaaattatacaaccatgcaaattctcccttttctttgtgtcttctttttctgttgttttgttttacatttttatgaaaaacaatggatgagtaggcaagcacatatgttggctacatttacaatctttgattacttccttgtttt

SEQ ID NO: 35903 - DNA, 1771 bp, Bovine  19866881348662
cctgggttctatccctgggttgggaagatcccctggaggagggcatggcaactctccccagtattattgcctggagaatccccatggacagaggagcttggtgggctccagtccatagggtcacagagtcagatgactgagtgactaagcacagcacagcataaagacaaaaagataatgtttactttataattctttatggctgttgaaatgtacttcttgactacaacacaactctaacatcaaattatatgatgtcaagacttttgaggatgaccacgctaatttaaattagaggttcagttccacatagcttcaaaaatcttctcaagctcaaacagggctccttctgtcttttttttttttcctaacttccccacccacccccaacacctgacaaacacttattaaattcctttcggtggtagagatacaaagttgaattcaatataggcctttcctgggggcaattccagggggtccaggctcggaatagcctggactatgtccagcctgtgggcttggaagaattgggttgagactgtctccagctacaaattagctggtgacttgattccccatctattctagtccattctgtttcaaattcatcctcttcttgaattactttcttttcaagtctggctatatcccgcccatggaagccaggccattcccagtctggcaccaattttatattaataatgtgagaggatgagaaagcaagtcacaaagcaccaagtgtttaagtaaatgtctcctttgctttaagcgtaatgaagcagggtacgtgaaatgtttctagaaaacaactagaatgagctgcaaaggacatccaaccagtgacatttccttctcatagcagtgacatttgcaaaaagacatattaattctttctttcacttaatgtttgtggaatacctctggatttaaaggtcatattttgaggtcatctgtgaatacatcaatatttcaacattgctttatttatttaaatgtatttatttatttaaatgtatgttccaacattttttattaataaaaatcttactctatctactgagtgtgttactctataattgacaacaacaattacaactacaacaaaccatttcagtgcttaaacaagtgaaaggtgttttgtgtgtgtttaacaggatggctgggggtaggcagtctaggttgcaatagctactcaatggtgtccaagaatcaggctcagtctgtcttcctgctctgccatccacagtgtatggcttctgtccaggtggccacagcatggtcactgtgcatccaggaaagaagaaagggggaaagcaaatgtgttttcttcaacccaggctttattccagaagggaaagcctccacagagacttgtgcctgtatttcattgaccacagcagtcacatggtctcctctagctgcaagagtctgggaaggtaagtattttactttccaacctctgaaacaagcatgcaaggggagagggtgtaggatttgggtgtcaacttaactccctatgtatataacaacaaatgcaacttagagctgccttcctcctctgcaacctatgaaatggtttcacaataacgaaaattatgaaggcaacgtggcttctaaattatgaaatgctttgtgaatgttattacagggtatatttacataatccattgaattttgaacttctaaggaattttatgaaaatattgttcatctgttatgttgattccatacttgatctatcagaagtatatactctcatacctatgat

SEQ ID NO: 35904 - DNA, 1357 bp, Bovine  19866881384199
aaattgaacaaaagcttaatcatgatgctacagggctgtgacctcacagttgttcatagtagatgtcactgtaaagaaatctttaaaaaacagtacagaaaatggccacattttggagctctccaattacatttatatagaaagagccaaaaaagaaagatgaaatgcgtgctagggactgggataaactttagaaatagcttcatacatggatatccaaaacatgaaggtctatgcagtttggatgggtgggattaagagacaaaatctggcacactgtactagatgacttcaaagtagctcagttacagtaaagacgtgatatcaaagatgcagatggaggctctgaataagtcatttcctgaaagtgaatggaaaaagacattatttctacataaacatattaaataatgttattaatatacatctcatattattctacctctaaaagttgatatattcaggctggctttatcttattattgggaaccaggggacctgccttatatctgagggcaccctaccgtcatgcatgtataggtatctatggaaagaaacagaagctaatttctcaatagtgtgaaagtgaattagtgataagttagaatactgacttactagattcaagaaagagcaaagatgcagggaatagagtattatattttaaaggcaaaaggggacactatttatcacttttgctgtcaaaaaagaattttcccactctaatcttctacttcagcaaaagccaaataaaccaaaagttgcaccaacaccagaacatttgttgttaactaaaaattttgtgtactaacggagacacaaaagttcaatggatcaagaaaataaaataggcattaaactgaattgtgagtttttcctttaatctcacattttcccactccctttgtactctgctgaggtcactcttctgcattttcctgaacaaaaaaagtattctagagggagactgggaagtcaggtaaaaactggttctagaacccaaactccccccacccaccaaaacctattaagttctcactttgcacaatcctataatcaacagtgcaatgaatgccctcaatcagatcaaaagcaaaaccactcattttatgtcaaactgagtttcttccctttgtaactcatgaatagaatccaagttctattagccagatgtgtgaagacttatcaactaatattgagctttggcagctatcatcataataatttttaaagtcttgctactttgggcacccttccctcacatctggaagaaaatatgagacccatttaagtctacttgcattaaacaataaatgctgccaaaaataaaaaaatccataaaattccatttaatctc

SEQ ID NO: 35905 - DNA, 623 bp, Bovine  19866881403041
gggatccgacccctgcttcagttcccctaaccccaggtgcaggtccggtcctgctcatcctcctctttcccccttccttcctttgtcctgctgagttttggatctatatattcctttccagtgatcagggactcctgtctgctctcagctggtgttctgcgagatcttctgcatctgaaggtgtattcctgatgtatccacggagagagatgtactgcacatctggctactccttcgctatcttgtcttcctctgcagtcactcttttcttttattttctaggttgttttttttttcttgctgtgaactgcaattgttatgtctgactcagtaattcttcgcagtgtgaagaaatttggagaggacaatcatggttttgagtcagacagctcatgtaagtggccttttatcttattgtctcttgtacaaaaaacaaaacaaaagtggaacaaactagtgaagatattcaaggagcagagaaaattcagcaacaataagtagaactattacctcatattcttcttgcacaacctgggtatttctcccaagaatccatgtaatgtaactgctgagagtgctaggtaagaacgtataaatcccaggagagtgaaagcatctcacta

SEQ ID NO: 35906 - DNA, 3549 bp, Bovine  19866881409273
tccatatgggtccttggtgccagcaattgagtcagggcgttgactttggtagcttgggttgttggcttctctgtgtgttttccaatttatctcacagcatttattggacattgtatttccaatttatctccctgcttagtaggggtacaaatctctcagcaagaagtgcctaggtctgtcagggtccctctagcacccagggactgtgagcttattgattcatcaaggccaagaacggagtaagagaaagcagatcttcagcccctaaagctcaatgcatgaggtagggtgcaattctgagcgtatgtcctctgaacaggtcatggagtgttttcttcagccaaaatcaacactagccaatttgccagtaaaaatttagaaagcaaggaccaaagtcacacacacacacacacacacacacacacacacaagagacattaaatcagggtttaggagctgaggccttggaatcaggcagatcaagtttcaggttcagttcctctaccatcagagggcctttgggtcaattgtcatattatcttcatttccatttttctgtctgtaaaatagagataacttctaccttgaagagtgttgttatttagtcactaagtcgtatccaactccttgtgactgtatggactatagcccgccaggctcttctgtccatgggattctccaggcaagaatactgaagtgggttgccatttcctcctccaggggatcttccagacctaagaactgaactcctgtctcctgcatatcctgcactggcagagagattctttaccactgagccaccggggaagcccaccttgaagagtacctggtgaaataaaatgactagaggcctgacacacaggaagacccttgtcatgtggcaggactggccgctgtatgcattgctcatgtcttagcatggggttctcaggctcagtatttttgcagttttggtcagataattctttattgtggggggtctctgctgtgtattacaggatgtttagcaccaccctggcctctgccacttagatgccagtagtcttccccagttgtgacaaccaaaaatgtctccagacattgccagatattcccctaggaataaaattcttcccagtagagaactgctggtctagtgtttccttgtcttggaggtccagaatggtacagcattcaaaactgctgaaaactactgaaaacccagactggaaattcagtctttgtttccttagtagtgacatattgacgaaagtttatattttttatggtcttaccagaaaatttttattatttataaatactggatggcatcatcagctcaatggacatgaggctgagcaaactcctggagacagtgaaggacagtgaagcctggagtgctacagtccatctggtcgcgaagagatagacatgacttagcgactgaacaacaataaattcatagcctgctgcagtaagcattaacgtctatgattttataaagtttcctaggaactcgtgtatttgagtccacgtgatacaactggaaattttatgcatcgcaccacagggatctcacatgctgcaactaagagccgaggcagccaaataaataaaataaatgaatatacatattttgaaaattgcctttttgtcatcaggaggataggaaggcagtgagcaaagccaaatttatgtatgctaccatttgtgaatttagaaattaccaaatgagcactcacagcatttatgaggcctaaatgctagctgagcctttttgaggtttggaccactatgaactctcttggggtgcccttcagatgagtaccactgactacagaattcaaagaatgctctgagaaagccatggtccttgggattcccagttgatcaagtcaggtaggaatgatagtaactctatgatctattgagtggctcagctggtaacgaatctgcctgcagtgcgggagacctgggttcgatccctggattgggaagatccctggagaagggaaaggcaacctacttcctgtatttggcctggagaattcccatgactatatagtccatggggtcgcaaagagtcagatacgactgagtgactttcacttcacttcaccatagtctaggacctctgctaagatctagaaatatttatctctttcaaaccttacagtaaaattatctctattttatggatgaggaaacaaattcagaaatgcatgttaatgggcgcaagatagaactgtgttgtttcaggccactcaatcccagcatccatcctttaattgtctgctccactgttaaggggactcccactcaactctgggagtctggactgtgtgtacacttctctacaccaccatgcctaatgatacttgattttaagtaaatacatgtagaaggaaagaagaaagaaagagaagaaagtttccactcgaacaccaggcatctagcaataactggattggtttttgagccctttgattcatcagggcatcttcctctcctcctccttgtcatcagatagtcacacttccaatttagataactttgaacattattgaaaaatattcctataaaatttatctcatcaaattatcaaaatacttctgtgagctaagtagggttggtgtcagacataagatcatttgccagagagtggctagaactaaaaatttcatctctgagctcctaagctgtgttaaaaaaaaaaaaaaaaaagacagagagagaaagaaaagtagaactagaaagagatgaacacattatcaatcaataggaaaattaaaatatattatcaaaattctccatgacaccacaaagactcaaaaggaatcaaaaaaggagaactaggtttctctttgatctgtatttgaagggctgaagagtaactgcttgtctgcggctattggaaaatattacaactcaattgctgtccttgtctacttctgcttcttttaattttctcttcctggttaaaatatctaaaataagatcctttgatttcacttctcttattcatcttcctccgccctttaaaaataaacgagagattctttaaaaaaaataagataaaaaatagtgtctccatctttcagagtcactgtgaggtatactttttataagagaggtagagttctttgtagttacttcctcccaaacaatttggttttatttccacaaaacttcacaaagagaaagcaatactgaatctagtcgatcacactgactgttagggtattcgttgaatctttatttttatttttttcaatttgctgcaagtgtgacctgaggtgaattaacaactaagttttttaataaaatcaaaatacatcaaatagagaacatttatcaaaaagctttctaaaatattttctttctgagtttctcttgcacaagctttcttaaaagttgacagcagtctgactggacatgtatgtcccttgtccatttaaatcttgtaaacctgggacttctctggtagtccagtgcttaggagtctaccttgcagtgcaggagacgtgggttcaattcctggtcatggaactaagatcccacatactgcag

SEQ ID NO: 35907 - DNA, 1302 bp, Bovine  19866881879713
tcctgacatattttgacattacataactctttaattggggaaatcttccattctttagggctggaacactgagctttcactctctccccaggagtcacagatacaatttttcctcttcatttcatttggacaacagagggaattgggactcagactgagaggaaattaatgccgttaagaatcattgctatattttatcactgagaaaagaaccctaggtttggggttgggggagagtgaagagataatgggattaaaatatagaacagcacaaacaaaagtagagaatcttctataataatgccgaaagtcatactaattcagtactgatgggagaacagaagtgggtgcttctgagactctacacccatctgccaagggtcacgaaaaacgcccgtctgcaagtcctttacaacatacccactcttacctttcttttgatatcagtgaactgggaaaacattaaagaccaataaaacgacagctccaggatataatagtagtgaaggtcaggtgtgagtggctgaggatcaaagagaaaaaggcatgattaataattaataggaaaccaaatctgtttcaaacatctcaagctcagtactggaaagtgacatggtcttacacctccacaaattccagccccattctctctgtcgataagagagctttgaagcattcctctaatccacagcttgatggaattagttttgtttcatctccaaccagaaaagtgacaactggtatgaacatttggctgctgctgctgctaagtcacttcagtcgtgtccgaacatttggcagtggtacccaatttgcgattcatttcaacaatcacatttatggttctctgacatgcatctctacaagattcctttaggcaacttgcaaaaaaattctaacacatacacagaaagaataaatctggacaactcccatgagattctttgagattcctgtactcaattccttgagtacagggaccaggggaggcgaaagaagctggagtactctatgagtcatggaggcacagtttcagattctgtcttaattggagcttttttgtttttagaaaatgttctgtacattgtaaagatttttaaaaagataattcaaaaatatttattacaagatcaggggacaaggaaactgctaagagatacaggttaggcacctaccagggaatctgagatcaagccccagttccacagtttaagaagttataaaacttgggccttggtttacttattggaaaatggaggtaacatctgctttacctgcctcagaggtccaggaatgaggaga

SEQ ID NO: 35908 - DNA, 867 bp, Bovine  19866881915474
attgcccgagcactccttagaaataactgctggttgacaaccaccacctgtatatctatttttgctctcttccccagttcctttgcaaattctgcaagcagccacttaagtgtgggtgcttcacaggcactaggggtgaaagtgggaggaaagtaaaactgggtgcatggtttcagtaacacggaacaaatgagctcaggagcaattagcacactaaagaaggggtcccggctgtctgcagagtgagctctgctctcaggagctccaacccatgtttaatgagggccccttcaatcacatcttcttttttttaagccatgaaatgtggtaccttgacagtggggcaggcaacacatctcaaatcacccagatgcttcttcccacaaccagcctcattcacccgcagggagaggcagagtagccatttttgttgtatcaatagaaacacccctggccggtgaccagaccaacttaggtgtaacagagcaaacagtcaggtggtgtgaccaacctgattttcaggtccagtttttcctgggctgaggcgtttcctggaatagctccagaaaaagtgggcttgggggcatcatcctacaatggccttgtgagcatcccatagcagccacactgtcccaggacctagacctgggtgggtggtgcagggcaagttacttcatttattcctataggctttggtgtcctgatgcagaaaatgggaggtggcgattgctggctttcccagcatttctcaaattgtggttttcagaacatctgtgccctaaaacagcatctggaagtggtattctaagaagtagggggaggggggtaggaagagtgtgctcaggtaggggggaatttttcactcca

SEQ ID NO: 35909 - DNA, 1949 bp, Bovine  19866880459088
tcaaaccaaatggatttagcccattacctaagtatactaagcatgaaaatcacttctgcccctcacaagaaatgaacaaagaaaaatccttctagagggtacaaatgttaggtccatagtggttatggaatggtgtcagtatccatcaacagctgaaattaaggttaatgttataaaatgagatttcaccagctcaggctggctcagagagtttgcgctgaaagcatctgtatggggtcggtcattcattactgaatacctcgtgggatcagctgacgagcaaaatatgttctttcacatcttcagttctgcttcccgcaacttagttgtttatcaattaaagtgataaatacaagtgactttggtaacctgagaaacgcattaagtagtagagcaacctccaggaacactgccgtaagaactgcacgcaaagttcaacaactgtgaaggaactattagagaggacacacaaacaagtgaccttgactgacaaacgcactccatcccagcaataaacagtggaggtgctgataactgttcattggcgcagagagtaattacctatctgtcagcgttgctggtgtgtgcgaaatagtataaatgaaacatacataatgtacggcaataatatcgggcatgcagaacctaacacattatcatcattctcaggacccaggcttatgcggctgccaccactgagtaaatgccttctagccatgataatttcattctaatctctgttccatattataattttcatagcaaaaagatattgaggagcaatacgtttcaatcaaggactaaatagaacacaacctgtaactggtattttatacacctatatatattttttctttcaagaaatttagtcaatttatgaagagatgggaataagctggaaatttatgggtgacaaaccctgtcggtagcaatgtcaccatgttggagatgggctgaaaggagcttattgaagaggttggaggctttgtcttctatttctttcaataattctgtcttgttcaacaaaatgctatctcattcaatgtttctattctgttccaaaatacaaggtaaagatgtatttttgaacaaaataaaaggtagcccctattcaatgggagaaaaagaatcatctaggttttgaagacaaattatcttggtttgcatgatttgcttacataacagaaggatgggaaaatctcccccaccatgatgctctattatttgtataaaactgtctgactcttgcatgcttgtttattttgtgcctttaatgcaaatgaaatttgatgatacctctaaatcacatttaagaccatacaaaagaaaccaggaaaatcttaagtaacagcaatgccatcaggataaatcccttgactcaagtatgaagcattagaaaccctcacagttcacagagtgaacgagggatagcagtgcatcccaaactatcgatacataatagaaacagctgttggtcccaccagctccctcatttagaaaaggaagaaaatatatgaatttgggataatgcactggcacacctgattgttttaatttagcctttgaatctttacacagtaagagtacatattttggaaattttacagatgcttgaactaataattaatgtaatagtctgcctttttcaagaagcattttaactgatcatctaacgtcacattttaaagtacatgcatccttttaacttttaaaagatgccatcttcatttaatttttggtttgccagtttctcaaagtgattttctaaaactgatgctgtagttgataaatgaagtctttataggaaactgagcaaaacagagaaacagcacaaatttttcttcagtgcatccttttgtgtgctgcgtttttctaattcccagccaggagagtaaccaataaaaaaaaaaaaaaaaaaaaaacaactaactcatactaagttgttcggg

SEQ ID NO: 35910 - DNA, 2000 bp, Bovine  19866880466398
aggttctgtctcttcattttctaattgttttcttttgttaattgcatattctctcctgcctgacaagcagcacatcatccaaacccccaaacacacagtactcgtaagtagagaattagggttttttttttcacttccccccccccaacattttccctctaacaactgcatcttattatgctgatactgtagcttctaagctaggtattactgagacaaaagactgttaaataattatccataggtggctcagtcagtaaagaatccgcctgtaatgtgagagacctgggttcaatccctgggttgagaagatcccctggaggagggcatggcaacccaccccagtattcttgcctggagaatacccatgaacaggggagcctggtgggccacagtccatggggtcgcaaagagtcagacacgactgagagactaagcacaggccctgattacagtcacttttatcttagctattcaacaagaaagacaaacatgttcacttgcttaagtataggggattttctacagctatatctttatgatgtaaaacaactggaagaaaaggaaaaagaaatagcatctttactgaacaatatgttagtttccacttagcagagttaatagaattacagtttctataccaatttgaaagctgcaaacatattcagaaagtcataatattcatttctgctctattatttgaatcaataaacttcagaagttttgtattaatatttaaaatgaaactttgtgatatatcccaacaatgactctcatttaaaaactaagtattgtttcacttaatattgaatcatcaccctaagacagtaacaacagaaaagacacagattagaaagtcaactattactatgaacgcaagtgacaaacatctcctactttgatcctttgtggtattcaaattttatgtggaagaaacaacaaaagaaagtttggtttatttgactaaactgcaatgatctacaagacctgtttcagaaacacagcatcaacattattatcattgttgctattattattacacaggagtttgacctttatgattgtaaataccaaagatggtaaaatcaacatttgcttggttctaggaatttggtcttggaaatcaagagtttcagctgtcagtttaaataaacattagggagatgcatagacaccagtgatgaagctgttactccaagacttctttctgtgatgttcttaaatttacacaatctgggcaagttttcttcctagtcatgctatagtagacttcagtttatcttgaactcttcctaatgttggtcatttactgctggagattcagttgtatcccacacttggacagactttggataagtatttaaggatatcccaatgatgcgaggtctcctaattattcttttagcatcttagacttcttctctgtagtaagtatcacggttataatcacatacctatgttatttcttgttcattaactgtgttcctgtaacaccataaatcttatgaaagcagaggctatatctgactgtatatttattgcctagaagcatagtgtcagaataaatgtaaaatattcatttcttaaatgagtgaatgaaggaggcaattgcaaatggcaccctcccagttcttcataaattcatgtgacttttacagtagataagtgggaggtgtagagtaagtccatgtttcctcaatttgtctgtctttgaaaatacagattatcagacctttcctatggagatggctgattcagagggtatggggtggaacccgagcactgatattttaaaccagctgccctagggaaaaccaacagagcaaacttgggaaataccatattacaggttcataccaccttagatccataattctagaaagttcctctctgtttagtgatcaaaaggacttctggaattcacaattcttatgtttattaaaagaaatgttaatatgatgacacttctttgttctgcccacttggaatttcctgattta

SEQ ID NO: 35911 - DNA, 1277 bp, Bovine  19866880473139
tattcataactgtccttgtgtcttggcttttgtgtttgcgaggcaagatagtacccttagttctgatcaaatgctaaatgctatatttgatatggaaagtaatctccataagaaagtctcaaaaatataattgagttcccttggagcacaattatatttttgaaacttctctgaatatttctcccaagcaaatattaatgagtagcataagaatatctttcagccataggcatagattttctttgctttttttaaggatcagtatcgggttacaggaaattgagataagtgaaagagagaaacattcagggagtgagtacatacactcttcactgtagagccatcagacagtagcaaaataaacaccccaaccactgtcttttaatagtcatattcttcagtttatcaccgataatctagcgctcactcactcttactcacaggaagctcacagcctaacccatgactcagtagcctttgttcagagtgctaattctataaacagcaaataaaaaattacatatactggttctctatcatggagtcacatttagaggataataatgggcttgctgtgtgtgtgtgatttggtatatttttaaacacagactatagcacagagccctccttttcaagtgattccaaaatcactgactttagtttggattttttctctgtctactgaagttcttttcttccctcctgcctgcctacctatgagccatcatccacaccctgatcaaatttcattccttcagtgctgcgcttctcagactacatagttaactttattttcagaactacagattttaggtctagtacaatggattgtggtacttgtaatggtgtgtacctccagcacaccgttcttctttatacatcatgagcacttgctcaattctttcgaagactgacaatgagttaatgaatgtagacaattctcagagtctctttcacttgcagttaaattgaagtgaaaacaaatgtctattattattactgctactattattatttaaaaacaaatacttcagaatccaaggctttcattaaatactcttaccaacaactggaaacaatattacaaaacacctgtgtgtgtgtgtcttctgccatctccaaaatatcgatttactttctttcttcctctttttctttttttggccaccgttgtacgactttcaggatcttagttccctgaccaggaattgaacctgtgccctctgtagtgaaaccagaagtcctaaccaaactctctaagcctagaccaccaagaa

SEQ ID NO: 35912 - DNA, 1728 bp, Bovine  19866880514802
ttcactcagactcacatccatcgagtccatgatgccatccagccatctcatcctctgtcatccccttctcctcctgcccccaatccctcccagcatcagagtcttttccaatgagtcaactcttcgcatgaggtggccaaaggactggagtttcagctttagcatcattccttccaaagaaatcccagggctgatctccttcagaatggactggttggatctccttgcagtccaagggactctcaagagtcttctcccaacaccacagttcaaaagcatcaattctttggtgctcagctttagaaattaattagttaatttatttttggccataaagcatgtgggatcttagttccccaaccagggatcaagcccttgttcattgcattggaagtgctgagtcttaaccagtggatggtctgggaactcccctttgacgctctttggagtactttcttgtcatctcaccttttcttgttatgaaatataatacttgggatcttcactctaacatccctcttcaaagaagcttttacccaagcttccgacaggctaggtccccatacaatatgattccacactactaacctctccttcatttgcttgtcacagtttataatgattttttcctggcattatgttttaacacaatcacacgagaggagaaattgtgttgtgtgccttgactcgccatgtaccccagtgcctgacatggtatggttaccacgctgtagacacccagttattaaatgcttaatgactgaatggactccaaggtcactttccaatttcatttcccaccatcctcccatttccctctgctgtttattttcccgttatcttaatgtcagtatgatattccccaaacacataatgtgctttcacatttatctgcctgtgtttatcatctctcttcagtctgaaatgcattttatgctcactgaaattgggctcatagcttaaatgtcttgttctcacatagtcatttcctaggccccccaactaaaaatttgttatttatttctgagtacttctacaacatttaattatatctttggcacccaaccttttcttttcttttttttactttaatcatattgcatgttctttgtcttagtcaatttgggctgctataacaaggcaacgtagaccagggcttaaacaatatacatttatttttcacagcccaggtggcacaatggtaaagaacctacctcccaacaaaggagatgcaagagttgcaggtttgatccttgggaagggaagatcccctggagtaggaaatggcaacccacaccattgtttttgcctggaagatgtcatgaacagaggagcctggtgggctaagtccatggtgtcgcaacatagtcagacatgactgagcagggaaacatgtactccccaaccctcttctagggccaaaattatgcaagtgtcctttgttactcaactgattttttttttcctagcacttagccatcgactttgtgcacagattatatgtactttataaatgttttctaaaattgctgaatttatttttggctgtgctgggtctccattgctgtgtgcgagcattctctagttgtggcttttggggtctactttcaagttgcagtgcgcaggcttttcattgtggtggtttctcttgttgcagaacatggactctagggcatgaggggttcagtagttgcagcacgtgggctcagtagctgtggctccctagct

SEQ ID NO: 35913 - DNA, 1028 bp, Bovine  19866880552669
aactaggataacaagagtgataaaaccacataagcacctattctcttcccttaacttttcagagtctcttcgtgtaagctcctactagagtctagtatgtgtaggctttgaatatgagctattttatagtgactggtaatttaagaagcaaagagtggcaaaagcacttcccaaaaccctgaagaaggaaaagcatcactaagggaccactggtttaggatgggtgaatgatatgatgtgtatttcattcacaggcattaaactgaaatcattaattgcattttcaaaacttgactgtcttccatttttaacagacattgcatgaatttccatacaatgagacaagtgtttaaaaattgcacatttagcacaatcttttaatttttacaagaataagatgttcttgatactaaccccaaacaaacctttggggaaaaaaaaaaaacaatgaaaaagcataagaatcatcatcattcataactttcacacatcacaatttaaaatacactaattactacctggaactttgaatcctttattggcagaaaatttcaaattagtaggggagaaatataatctgggaaacacttttcaaagacaaaaacccaaattatctctgggcacgaggtaaccagctttgaatttttagttattcatcttctacagaaattttagagaaaaccataggaaaacgaaagagattatctcaaggtgcataaggccaaattgtaatctattttagttctcatttatatgtttatcaagattgtgtaatatcttctgtgaatgatgggtgggtgaaaaatttaataaggaaacagattttattgtgaaaagaggactaaaaatggcattacctagaaatgaaatttggcctttatgatttgagtggagagagaaaaacttgtcaaattatcctgagaaattaggtttttttttttttttttccatcatctaaaacttgagacagactgaatgcataaattcccactctgccccaaattcccatgacatccatggtacctata

SEQ ID NO: 35914 - DNA, 1493 bp, Bovine  19866880559106
gtgcctggtctttgagaaaataaaactttagctgtgtgggagtctagctgaccactcaacatccttggatgacaggatttgactgtttttgcattgcatgatcttttattttaggaaactgtgttttaatggtatgcacaatcacagagccttggagcagacatttgttgttttattcttcccagcctccccctcccctctcctagtaacagatcccaaattttggaggaaccatttcttatcacacggcacagcatggataaaattgacctcatcccccaaattttaaagtggagtctgattggcttaaacctatgagtgaattccctcctctggctaagtaactggttcggtgcagggcacagaacctaagtagaactgtgctgtgcttagtcgtgtctgactcttgagaccccatagactgtagtctgccaggatcctctgtctgtgggattctccaggcaagaatactggagtgggttgcatttccttttctaggggaccttcctgacccaggaattgaacccaggcctcctacattgcaagcagactctttactgactgagctacaagtgaaacccagtagaactagtgaagcaaaagaaatgtttgctgaaacttccaggaatgcaaaacatctctcttccctggaggctaccaaaagaaacctttctttttctagccaatgagtgtgaaaatgtgaggtcttgaactgtgtgggtcattctgagacaattgagggctatcagaggctctgggtagagtctgaggatgaaatcaatacaaaagtcagagaaactgagattaaatcagtcctagaagccacgtagcagcagcagcagcagcagcagactgacattgctgttgttgctgcttagtctctaagtcatgtctgattctttgccacctcatgaactatagccagtcaggctcctctgtccatgggatttcctgggcaagaatactggagcaggttataatttccttctccaggggatctttctgacccagggatcaaacccaagtctcctgagttacaggcaggttctttaactctgagccaccagggaagggccatgttacaagtttccaacactaaccctaagtctcagttccagctcctacttgccttttcgagtatgtgacccaataaatctcctcagcagtttaggtcattttgagctggggtgtctattactggaaacttgaagactcctaacagatgtaagatccgtggctgtatcaaatgtatccctcagtgatccctgaaggaagacagagaggaattaggaagtcatcagcagcaccagagggagagagatgctagcacaccttcctgaaataccacagtttgtgtgcaaaaagtaaaaaataaaaccctttcttaaggaatatcatggcttgcccacattttccaaaccagaaatccataaacataatctagcaaaaaaaatttttttctgatatgccaattcattacagaaaatctcaga

SEQ ID NO: 35915 - DNA, 1390 bp, Bovine  19866880590049
aaaagatacatgcacccccaatgttcatagaaacatttttataattgctgagatgtggaagcaatctaagtgtccatcagggatggatggataaagctgtggtatatacataatggaatattactcagtcataaccaaaaaaatgaaattttaccacttgcagcaacatggatggatttgaaaagtatgatgctaagcgaaataagtcagagaaagacaaatactgtatgatttcatttatgtgtgaaatctaaaaaaatacatcaagctagtgaatataacaaaaaaagaggcagactcacagatatagagaacaaattagtagttaccagtggagagagctgaaagggagaagggaaataagggtaggagattaaggagtacaaactattatgtataaaacaagatacaaagatgtattgtacaacacagggaatatagccaatattttataacttttaaaaagtgagtcatgatattgcacacctgtaacttatatgatgttgtacatcaactagtcttagaaaataaaaaattaaaaataaataaaattacctctttatttctgcactatcaatgactactcttatggatagaagaaaaacaatgaactagtatttgggttctttcctgctgttgctgttgtattaatacatgagagtatgatgacaaatttatgtacactagaccttgagccaccttctgaagaatccacagatccttctgggttcagataccacatattgtgttaactgcatcattggtgacaattctaaataaagtgccactgtttcaataagaaatcacggtgtcctagccctctatagcaaaagctgatagaaccttcttcagaagcaacaagtacattgtaaaagtttgctatatataggtattttattatgcactaaattagatagcattgatactgtaccttataattaggtgcaaatcaaatgctaaagaacaacacatacctttccaacatgatccaattaattctaaatctgctgattatagtctcatgtattaaggacttattcccattgcattaaataaaagcattgttaaagactgtctccccagatagatcaaacatcatttattaagtttcatgcacagctatctaaatggagggtaatgcacttggagtcggtgtcagatttcctactgtttctcagctttctgtgggtgatgtgtctgtctctttgttgtatagtctgaatgtgctttagttttttttgttcctgaccacagcctgcatgctgttcatgtagctcaaatactctctcctgaagtttgggcacagcagctgtctgttaccaattcctgtctcagggtgatcggtcagagagactggagacagagaaggccatgacactcatgtttgggg

SEQ ID NO: 35916 - DNA, 3827 bp, Bovine  19866880596138
ataaaagtaaagagaaagattttgaggtgagggtctcataataactaagtgcggttgacccttgaaaaatgcgggtttgaattgcatggtccacttatacatagatcttttcaacagtaagtattacggcactacatggtccttggttggttgaatccacagatgcagaagtgaagagccaactacaagttgtacaaggattaatccccaccttgttgaagggtcaactgtaatttgaaattgggcagaatttcctcaggggccaccatatgaatccccttgcagaagagaagtaggtggttccttggagcaccctggctcaagagagccaggccaggagctagggaagattaagtctctcttattttgtacatgggcccagagaacacaaataactcagtggtaaagaatccacatgtcaatgcagaggcacaggagatacaggtttgatccctgggttgggaagatcccctggagaaagaaatggcaaccgactccagtattcttgcctggaaaatcccatagaaagaggagcccggtgagctatagtgcatagggtcgcaaaagagtgggacacagcttagcaactaaacaacaataacaacagagaaccctaaaaagccaccacttttccaatgctcccaggtaacaacatcagtttttcaggacttgatgacaatagttatctgtaaaaatcttgagctctcgaagcagacaaggaagataattatcatctgatctttttgtactaaagcatactgaaatgattcattaatctactccccaagttacaggagatgagattcacctctaatgaggtaccaactggacaccttgccatgagacagtaacttaggtgaatatgtttcttattcatatttgcaaagtatctgtgatgggagaaagaactgtgttttggttccttgaaacttaatggctcagatggtaaagaatctgcctccaatgttggagacctgggttcagtccctgggttgggaagagcccctggagaacagaatggcaacccattccagtattcttccctggacaatttcatggacagaggagtctggcgaggctatcgtctttgtgtcacacagagtcgtacacgactgagtgactaacattttcctttaaacaggatgggggataaatgattatctagtcctttttttaacaacctaaagaagtattttatttggatctccatcaacagctataaatattagatataggataatatataataggtgctttggattgcttttgtaaacccacttaactttgctaaatagaaaaaaatattcatatcagatatgcaaattttgtgcaaatattcatatcaaaatctctatacaattcaaacaactcttcaaacaactgttccatcttttaaaaaatttttttcatataagaatagttccagagggtaattactcccctctccaaccccccaagaaagatgggccttcctgtccccagcagtgtttgcgatgtttggggctttaccttttgatgaatgcatgacatgccaagttctatgggtctacagattcatcactctccaaatttatagggatgtatgcagtgtgatttgataaattgttttgttttgcttttcatcactcacacgatattgaaaggacgctccctgtatatcttaggcatcatctatcaaaaataaggctttggggagaacaaataaaatgcagtaaaaacttgttgaactgataactatataatatgaatgtgtcatctctgaatatgaaggaccactatatgaggctcatattttattttttttagcaagtttacatatctggttcccagtggtttaaactgcacttcggttcagacgtttgcaaagcttcccaagtgtctttggggggcagagtgctataaattaaagtgattattaatcttactaaatctatttctttttactggcatttacttaggagatctgtacctccttatgatggattggcttggcaacttacttgacgtactggttggtatatgaaataagaagctggaacctgatatcctgtcttgctgtgtactgtttttaaaggaaaaagactctattaaattggcaactatgtacattgactaaaaaaaaatggtttaaaaagagatttctaggacttcataatttctggacatggcaatttaaatcaaggtggtaataatgattctatttacattttatcacaagagttaagtttcctctaattgataaaacagtctttatccaaggccactaatgactatgagtccaccaaaatacgtttgaattgcagaagaaaattgctttacaggctacaaagcctaaatttcttatcagagacatataaacgtaacagtcaaggactctgttaaacagattccatggttaaaatgtttactcttttttaagcaatcttcacccccttaggcaatcttcaatcttcaatgtaacaggtaatggaaaaggtacatggccaatatacagaactcaaatgaatgaaacagcagtgaaaataaatgaaaacaacaggaaggtttcaaatttgccattcagatagcaaacatttcatagattgaaaatttccagtgctgctgatagccggggtgcaaatgatgatattcatacctttttatcctttgaattcagtgtattttactgatacagaaagatttctaaggcatgctgttgagtgaaagaggttaagtcatagaatagtaactctaatatggtcctatttatataaatgaccccttctgtcatgcatatataaaataaatgcaaaaataaagatctgagaggcttcaaaccaaactcccaatagagcttggggtgatgatggggagagtggggaaggctgcaagatgaaggggctttgcccagagacccctgttatcagttaaactttgtataggaagttatgtcctcctattttttctgtaattactgttttaaagaaaacatgtctttataaaaacatgtggatgaatgacctcattcacaatttttcatagaatgttgaagggctattcccactacattctgaatttgttcccacaatgacaacaacccaacttgcccaaagccacacccaagtgcagaccctaaagaacagtaggaattccaccttccccaatgccctgtaacccaaggcctctccataagcgcagggagccccggtctcagacacacagtcccacacatggaatcaaaagcaaccagcagtagggacaaagcgataaaccaacctcaccctacaccagctttcctattcatgtctgcttaaacatttatatttatcttttaaaaccatacatagataaacaggcttcctagatggctcagtggcaaagaatccgcttgccagtacaagagatccaagagacttgggttcaatccctgggtcaggaagatcccctggagaagggaatggcaatccactccagtattcttgcccaggaaattctatggacagaagagcctggcaggctgtagtccatggggttgcaaagaggcagacacaactgagctactgagcgtgtgcgtgcatgtgcacacacacacacacacacacacacacacacacgtataattgtttcaagtcttctaggttccttaggagataactttagcagatgatctaaataagtacaaaaataagaaaaaggttggtttccactattctcccccagataaaaagactgccaaactaatgaataagatgacatttattacagtcaaaaaaatataacattaaagtcgctaagcgcaaagtaggttaaatgagtcacctcccccactcaattaagagccgaccgca

SEQ ID NO: 35917 - DNA, 1072 bp, Bovine  19866880640892
tagaaattcaaagcaggttttttagaaatgacgcccgactttctatcctcttctgaacaaggtctcctagatgcaggtgggtaaggacctgcatttagatctttcagttttacacaaacattttcacgggtgaaagtttatagtccacacctttctgaagattaagagacagaatctgaagctctgtttcagtatttctcaaaaatgggaatctgagtccctcttgcttcagaatcaccttgggtaaatattgcaagtgcgtatttccaggatctacttctgactcaaggaattaggtagaatctaagtgattctgatacacatgaaaaatttgcaatcattacatgtattgccctgtacacacatagctggtgtttggtacatttttgtggagtgaatcaaaataattcaagggaataaaacaaaatcattcaatcaagcaaagtacattcttttttaaattaaatgtccttcaggctttatgttgatttaaccacattaaaactgtgaccaaagacattctaaattgtggatctgtggttgataattgaaagagaaaaaccccttagctggtgccttgaagaatattttcttatcctcttggaggcatgtgtcaagcacatctaaaatagctattctggatcattctacttttttaaattaaaaaatttaattattgacaaaagctatttgctggaattgtgtaaaaaatgtttacagatgccttaggaaggaaatggcagaatgtggaactaattgtgttgattcaagataattatgaaacacaaatgaccattacttacaacaagtccctgatggtcaggggttgactccagggatcaggcttgaatgaaggaaaggaaaagaaaataaaaaagagtggtgatatatgtatgtagttataatacagctagaaactgtgccctatcttcaagttcatagaggtcttttgtgacatttcagtatttgaattatacatgctatatttttattaagtaaagcttttttttctaacttcaaaggagcatagtttttttttgtttgttttttttttaatctttacttcctgtca

SEQ ID NO: 35918 - DNA, 918 bp, Bovine  19866880687810
tttgaggtcagtttgccttggggcattatcaacactctacaaaaatatcgaaattgaaaaaaaaatctttttagcttttttttaatgacagtgaaccatcaaatctcatgagtaatgttgaaaaaagctggattctgcatagattgctctttacccaagatgcacttctgtctgcaagattctgaatagagacacacctgctagctagctgataacactctggggtcatttcattgaagaaactgtcagccaggaggtacttaaaataaagccacagacaaaatcatgacctgcactgttaaatccaaaaaggtgtaaaagcagaaaggaaatgtagataaatgcacattcctttgtaccataacaaaacttttacatgtaaattcaactgaataggaaagaatggggaagaatgtttctctctacagtagaaacaaattagattgttcagctgcacatttggctcccagccaaaggagtcgtgtgccatgcttgtttgcctaccagtgctgcttagattggcaaatgcccacgcagtttgaagagggcaggcggatgactgactggatgcctgccaggaagtgtgtgggaccaacgccactgctggactccacagcctggtaggaatgaggagtacaaaggcattcaataatctgaatgtccctttgcttcaagagagtggtgccaggcagcatttaatgagagattgctttgttacaaagtcctcaacatcaagtgggctggtgagctcattaacctgactgcagcaaataaaaaaggcacactcagaagactcccatgatagcctactcaatggtgtaagagcccttttgcttcctttatggtgatccattagcaagcagcagtgtaaacaccataaagcaagccaggtttcgatgttcaactaaagtcgtttcc

SEQ ID NO: 35919 - DNA, 936 bp, Bovine  19866880746399
tcacctcatccctccaggttgtcacagagcaccagctttggattccctgtgtcatacatcaaactcccactggttatctattttacatacagtaatgtaggaggtgggatgcatgcagaaatggtaaaaaggaataagagggagtcaacagtgtctgttaaacagatgatcctatgttacaaaaatgtataaaaatgaaatctggagttttcgatagcctggcctgcagtgcttcagaggacaactctcaggctgctggggctacctggctgcaggcgtaaaaagtgggaaggacctgaggggctgtgaccttcttatacaccctgagacagtcaagtgattatgtggtgacagagtatgaaccttcaacacgtaattcatattccagaggtcttctgtaggactaggctgaagcccaccctttgggagattcttcctgagatcagtctctttccatggttttctcccccactgactggtttttcccattcctttaatgtttcccctggaagttcctgcacaggagttctgcttccaaggactgcgatctaagaagatctacagtctcttataatttattttacttaatttcagagcctaagttctcatatctcttcttttaaacaacacatgtaatgatacactgttttttgctgttgttgctgacaagatttcctaaggacataatgctgaacattcattgttttccttaaattattttttcttcacaattagtttctgttcacttgagatctttcaatgtatatttagccgatgaaccagttttcatgatcactctcatgaatcaggtctttacacaatatgtgcattgatcataagagtaaatgacaccaaggacctgaattcttgaaaagaataattatcatgaggattccaacatcaaggtgattgcttcagtcctattagttcattctt

SEQ ID NO: 35920 - DNA, 1584 bp, Bovine  19866880841608
tcagcagtccacatcttatttggataagagagtcagtaaagcataatgccttgatattgaagaaaatcacaaataagaactgagaaaaaaaaatacagatcctggagtgtaaagagccttggaaagagtgagaattttatctacaaataaattgcattaaactgatcagtaattttttaaaaaacaacctatgtgacactgcctattaaaaaataagcagttattaaaaatcaatgaatacttggttgctaatcatacacagttttccacatttagcttttactgtttttatttgatactaacctcataattcttcccatttcctcaccttgaaggtgagagaaagaaagggagagagagggaatacatgtgtattcatgatgaattatagataaaaatctctaaagtacatgaagcttgtacttcaataagtcagtgactagtggcttctactgccatgactgaatacagttttgtctttccgcttagattttgatgaatacagacaattggtaacaaaaaattccaactattctctaaaattatgttttacaaactaagccttttatgcattctctgaattttagtgacaaatttaaaataactctgtaaagatatgtagcaaaatcctttcatttagtgaaaagagaaaagtatgaatcaccacctgtgaaaatacacagccttgcctaaaattatatcttttgcaacataagagaattgactctttttttcaattatttgtcaggcagatgctggtgattttatttaattaagctgctatggtaaagcaggtgtcataaaatatgcccaaatccagttgagtcagttttgctctcctggggggttgggaatccagtttatgttgtagatataactttgggatctgatcagaatgagtagtcactcaagttttaccctcattcctgaattggcccaccttattaactaaatcaaggggaaatagagtgaatacaatttaagtcatttatttttagggaaaaagttgtagcacatgtatatttatgtacactaaaaccttaaattatgccttaagactgaaaagcaaaaaaaaattatcctatttctaggattaggttaaaattattcaaaactttgtcataaaacttgtcccaaattgaatttaatttctgtgatgctgtttgagttaccagaaataataagtgagttgtttatctaagaaaggttctcacacatacacataaaaacacagaaatgatgacgtgaagagctgagcatagatgttctgacaaacttttcatgtctaatcatttatcattttctagaagacagtaacataagcattacaggtttgtgggatcaacctaaatttcatggtgtgttcttggaaaggaaggcttattaaagttaatatttgagtattgaatgcatatgacttctcattagcaaggagtctttgaagcaacctttgagtgagaaggaaacagaacagtaccaggaaaagcaccggtgtgtggacctgttttcttgtctaggctctgccactaaaaaatggcaacacaatcctggcctttagcttctcctgcctttctttcactggta

SEQ ID NO: 35921 - DNA, 754 bp, Bovine  19866880974594
tgtcccagcagttttaggctttgggtgtcagttctggagccctggactctgtgctgtttagttcagcattcaccatccgccgatggtggcagcatccgcccatacttgggggcatgtagtgggagtcacctgtggtgaagtttgggatctttcagttgtagtcttgtgtacaaataggtttttccaaattttcagactaacatcccttattggtcactttttttcccccactgattgctatgcctacattattaagattctgccacctcaaggggcatctcaatttaaaagaagaattatttcggctttcctcatttcttgggcaaaaagaatgccaagaaagagcaatttccctggagtccccatggagaaaaatttctctatggccaagtttataattatatacagaatttcggaacataatctcacgtggcttattgaagatgggagggtcaaggatgaccttgaaatgcttaactgtgggaactgtgtgttgacttcttgtgactactataatctaattgactatagctttataaacatgctacgctaaatattaaaaatagtaagaacaattaaccacatggcaaattgtctttgctggtcatcccaattagcaaggtcctgaaagtaattagtctaggctgaacagaaatcaggcaataagggagtaaaaaatttaatcaaacttggaattctgacctattaaactaaaacagggttaaaacctccagttgtgctactcatcgctttg

SEQ ID NO: 35922 - DNA, 2471 bp, Bovine  19866881065477
aaccctgggagagtctggcatcactgggagtgaaaactgaggatgcaagggagacagccctagtcgggactgtggggggcatagctgtgtgcccacgtagagtactgggcagcagtgggagagcacacatggacctgagacaacacatctgggtacccagcaagtggccgaggacccctgtggatgatggagctatctcggaaggtggagctccaagcgtgcatcatttcagcgcttatagaaatgtaacctcaactggatccaggggcagacgaaatccaccgcattctactttcttctagacagcgctgcactgtgtaaaattagcaagaaatatgctggtctgaccttcagttctagaagatgggaagcccaaagataatcaaatggcttcatcagcagtacagtaaaaacatctcaggattagcctatactatttgacctcactgaatgcagtgtgatgatcaaatgcatctcttcttaaaggtgttgttcagttgctcagtcatgtctgactcttagtggccccaaggactcagcgtgccaggcctccctgtccctccccacctcccaaagtgtgcccaagttcatgtccattgcattggtaatgccatccagccatctcatcctctgacaccctcttctccttcctccctcaatctttcccagcattagggagtttcccataagttggctgttcgcatcagatgaccaaaatactggagcttcagttttagcatcagcccttccaacgagtattcagggttgatttcccttaagattgagtggtttgatctccttgctgtccaagggactttcaggagtcttctccagcaccacagttcaaactcatgcattctttggagctctgccttctttacagtccagctctcataactgtatgtgaccactgggaagatcatagccctgactgaacagacgtttgtcagcagagtaatgtctctgcttttcaacacactgtctaggtttgtcacagctttcctgccaagaagcagttgccttctgatttcatggctgcagtcatcatcctctgattttagatcccaagaagagaaaatctgtcacaacttccaccttttcccctctatttgcctggaagtaatggggcccaatgccatgatcttagtttctttaatatttagttttaagccagctctttaactctcctcctccaccctcatcaaggggcttccctggtggctcaaatggtaaagagtctgcctttaatgcaagagacctgggttcgatccctgggtcaggaagatctcctggagaaggaaatggcaacccactccagtattctttcctggaaaatcccatggacagaggagcctggcaggctatagtccatggggtcgcagagtcagactcgactgagggactaacacttaacttcttcactctccttcttcaccctcctcaagaggttctttagttcctctttgctttctgcaattacagtgttatcatctgcatatctgaggttgttgatgtttctcttaaaggggtcactctcctgcagaatcattgtcctagttgttggactgcttttccttcaaaggagagcatttaatgtgctggttagtaaaccatttgttcatgacaagaactctgcattttgaagcatcaaaacctcctggagttagctgcatatacattttttcaaggcctatatattaaaatacaaagatttgttatcatgaaatttactacacacagagcagtgtcacaataagatcagtttctgtatgtctattatctaattggaaagatgacaagtgtaagataatgctgcctgtgctatgatgacagttatgctttcaagagtttatagttcttaaaatcaagggtgagtcagatcagtaaattaagtgtataaaaatataaagcaatatgaataaaacattttagaaatgaaaggcttttaaaccattcttccctcatttctccacttgctgagtttccttattaataagaattatgttttggctaacagtcaaaggaaccaaaaaagcaattattcatcagtatactgcattattactgcagtgcctaaattttcaagtgtataaacaagaagttcctctgcaatcaggaaaaatcaaaaccaggaattggattttgtaaaaggcaggagacctgggtttgatctttgggttgggaagatcccctgggagaagaccatgggcaaccttctccagtattcttgcctggagaatcccatggacagaggagcctggcaggctacagtccgtggggtcgcaaagagtcggacacgagtgaacgactaagcacagaacattttgttagtaagtttgggcaagcagtgagagtttcttcagtctttaccagtttgatatatttagtaaaggatgtgaaaaggaagttgcctattgtgatgatctttaattttggagatatgatggagtatgaagacctttaggaaacat

SEQ ID NO: 35923 - DNA, 4091 bp, Bovine  19866881100575
aactttatatcaacaggtttctgcttttccaggtcgaagtccttggaattgccaagcacttcagacctaaggctagggaccttggcgcgctgccagggctggtccaccgcccacggcccctgcttcttcgcggcgctcctccccatcagccccgccaatccccaacgcacaggcggacatatagcatctcttcgcactgagctttgggggacctagctaagagggtaagaaaagacatgaataaacaaacgggggccgaaaggcttgacttcaggagcttgatggacttgaagctctccgccaccaagtcgaccctgcgttcccgaagccggcgggggcgcaggatgactaacaactgtaccggcttcaaaccgacctaagagttaccaaacagcgccgagcaggcgaggggagccggtaggcagatgcaagttcaaggtcagcgtgcctcagattggggctggagagcagccaagaatgtgagggcctgaagcgctggggactcgccctgccagtgcgcgctttggacgaggcggaggagggctcagagccccaattccctggcggtttcccaggaggacgttccgctggggtcaccctggtcccggcctgttgcaatccccaaggctcggcttctccgcctcaagggcagcgcagccccaggcggtttccatggctctcaggaaatttgcttttccaagcagttcccaagcaaaagttcgtgacatttttgggcaaactttgctttttaccttcttgaatgtcctcaaatagataaatgaaaacacattcacacaagtacaattctccctttcagaaaacacactcaaatcccagtattctagagttctcctaacttaaatattgataaataataagctgtttatcagggctatagaagtaacaaagaggaactcctggctttgctcttaaatgatggattcgattgtgttccgttctgattttattcaggttcctatttcaaattacaagcaagtattaatgaagatgatcaagaaatttaagtacgacctaaaaaaagaaatcagtttggtctgaaatccaatagccctgtcatttcaatgcggggtggcttgttaagtgtttaagcgtcctttcaaagccgtaggtgtgttccttcctgctgaaacaaaactgtattcatctttgcacaacatgcgctggcgtctgtaaattatgcaacactcggccaagaatgctccctgtccggatatgtgtctgccaaaccgcaccgctgcgccaccagcccagcaccaagggcaccctgctaaggtgtccctggacggcgcccaccccgccgtctggaccgcggggtggcctgaactgccaccacctcgactgggcagagggaacagttccctgcgtttcctgtccccccattgcttcagtaactcacactgatcttctctgaaactgcagagtcaagaggatttcgcttctaccgtttcattcccaggggtcatttgtgggtcaggagtttccctcgagggctgattccacaccccaccccaccctaaaagccttcccagacccccagaaagtgcttcctttgttttttttctctgctctctttccaacttgctagttagatgtggaacccaggccctttcccctcttcgtagcagaataaagttcaagcgcagacatttttggagctcctgcggccagagaagggtaccaagttagcagctgacgtcagccctttgctggcccgaaaccaggcggcgggatttctacttaagtggtgaaaaagagcctaggccgtgactcagagctggcgacgattaaaccaggtaacgagacacagggcagatgtgttttcattgccctgtaagataaatgcagcgttaagtgcctgacaacttcccagaagcaatcagcaaaagtttacgagtgcataaacctcaaagaccattccccgacggttgttataaggcccacatttagagcttctataaattcttcagcagtttccccaagctaagtttccagggactattaagcagccacctcctccggggagacctgggggattttcttgaaccgccaaagaaaggtttggggctcctagtgagtgaaatgaaattgcgccaaagtttgcttcagaagtttgggtggccaaggagggaggagggaggaaggtggaccggaagtggggtccagggaaaagttcatgatatgccgggttagctgacagcagcggagggccggggtctgtcgagggtcggggatctagcggagctttgaccgctttgggtggtggccccagtttggccagtccggttctgcagggcacagctccctgtggcgctcctagctaagtccaagctcccccaactcggcccggacacggcagctccttcgtctgtctagtgcccactgagtgtccggcaggaatccagccggccagcgcaccagagaggcggcctggacggagaaccgagtccgaaaccggaaacgtgtctccactccgcccagagccaagacggtgccagcctcggtcctcccccaagtggccagagttcttgggtcatttagtatcagacacaccgactcacctatatttatagagaacctttgtttacgatcccggtgaaaacaaagctgctaattgaaaaatagtaacaggagcgtgtctttcagcaccttaaagcccgaggttaacagctgcgcgcgccgggggagggaggggccagggaagcgaggagcctggggccgccctgcacgtctaacgtgccttgggggtcccgggcgagacacgtgggccggatcgagccttcaagagctcagggccggggtcccaggctggaaagcttccggcagcccgccagctctttctccccctttgggttccagttaaccccaaggggcgaaggtaaccgacgactgcgtagcatttctgatcccgtgagattcaatttcgagcagttattttggaaagatagagctgggcccctttccctgctttccaggtgaaaacgcagacgtttctctgccgtcctcatccctcctttctgaaataaggcgtccaactgttccgatattaccattcaaaaacaggttctgtggcgaacctcatttgtgaatctattacagagattaatagattatttctcctttttcaactaattctcagtggggaaatttaaccatatggtaaggagagaattagaatttcatcacattagagcaaaatgtaatgaaaagagtccaacacctggggccaactctgaaagccacaattaaaaggtttttaatgaaaccagagaaaccaaaaatttcataggcttcagtaattctgccacataaggaagacttattggagatgttgggaaatattgtttttacttatgctgtaaggatgaaaaccagccgctaaataccatgtgcgcccgggcacggaacccagagtcccatttctcatcaggggagcagcacttgtttccacacttcggcttcctctctctccaagaacaatcgaggcagacccagttgtccctgaatggcttcctagccttggaggcgacgtttccgggtaaataaatatgcactgatgccccacttagtgtgtgagagggtttgactcccgttgaagttgactattctgaagccactggattttaatctggagggaagtttgagcaatcagtttctttctggttaggaaatcgtgggcttcatcatcaccatcactgtagccgtggtttggaggcggctgcgaaagtaaccccctccaccaccacctttacaaaaagtctaatgggctgcactccccccgccccccacgcccgatcggggtaggaaatgggcagggagcatagtggagggggcggaataaggcggtgtgttgagaggggcgggggggggggggagggagcgattgctttgctcttttactagctaagaatcttgggtgaatttagggcaagccagcggagacaccatctccccccccactaaagtcccatatccaaatccagatcagagccatcctatgaacaggagtggagtatcagtctcccccggaagggtcatgtagcaatgagacagcagggcgagagaagggcggg

SEQ ID NO: 35924 - DNA, 1099 bp, Bovine  19866881143401
ccccggcccccgccccccgccccaagacaagcagctttttcggcgcaaggatgcgccccaggcggacaggcaggtccccaggctcgcagcgaagggctcacctggcttccaggtgacttttaaggggaggggcgtggtatagcactgctgggactccagcggtagggcaggatacgcagataaaagcaaacagtgaaaagagtttctgaaaaattcactgccttcttggttacctggacatattcagtggcgctccttagaggttgataatactcatttttgttacatgagtttatcttttcgaatcttggaaaacgttctatttgggggggggggggaattgttggcctaaaaaaagtgaacacttttagggcttgtcttggtgtccacgaattaagaagaaactaactgaaaagggctcaattctgcctttggggttttagctttgagatttaaaacccacagcgccatctcctggccgtgaggagaacgtaacgatggatgacaacaacatacttaaatactgagaatgaagtattcaaatatgagagacactttattttacgcctcaaaaattatttcggtgataaattgattgcgatgataaaagatgagctggaaatttatgatcattaaagattgtcagacacaatcccggaagctaattatttgtgaatagaagtctgtatgctatatttacacacatcatttttatagattcggatatagttattattctagggacttgtgataaaatatgattctttaatttatcatcaatacataatttgatggaagaaattaaatcccagattaatttctaaattaggatttgaaccagttattttatgcaaaagatactgtaactttataaatatctcagtgctctcaggtgttaattgactagtgaaaagcaattgctgaattactatcgggatattttaatcaccaaagcatttcttattaagtatgggtttatttattaaaagcagttgtcttttttttttttactttttctgggttatgcttaacatgtaatatgatagaaaggagactactgtgagatgatgctgtgttaaacaaattctcctcctaggcc

SEQ ID NO: 35925 - DNA, 1163 bp, Bovine  19866881147760
atatatatctttgtcttttaaatatatatattataaatatataatatatattatatataatgtatatgttataaatgtatatatatatatatctttgtctatgaggtagacattagtactaatttaagttcataaattataaaggaagaaataaggttgagaaagtttaagaaacttgtccaagtttgcagagttaacacatgacagagtcaaaatccacatctgaacctctgatcaaacttgcaactacttcattgcccaagtgagtattgtcatagaagctgggagctggcagaattgtcatgtacctggaagccattttaatagtaaaagaaagctaagacaaaaaggcttcccagatggcacaggggtaaagaatcctcctgacaatgcaggagacgtgcgttcaatccctgggttgggaagatcctctggagaaagaaatggcagcccactccactattcgtgcctgggaaatctcatggacagaggaacctggagggctatagtctatggggtggcaaagagttggacacgactgagcatgaaaacacacacacatacacaccaccatattgagtatttggaaggagtgctggaaggctagagtccattcttacttggagagaacttgagactgcatcttggaaattaccacatgactacagatgtaataagtgttattatagattttgaactctatcataatcatcatttaaaataattccatgttcttagttttcacggtagaaaaccaaataaaaataagcaacaaagaagacttctgacaaatatgcccataagaataggaacctgtatatggctttaactaatattaataagatgtgaggatttttttccaggaatgctttgaaaatctgaaaaattttaatgctatttgcaaagaacagttctgtgctgcatttatctccctgtgttctctaagcacctatggatttttgtagttctcttcttaagcacgctcatgatgctggagaatcacatggccaagagaattgagctcagtaattccatgagaagaaagtccaactgaggtaatgtatctgaatttagtacctaaattaaaagtttgagactcagctttccccgaagtaatttcttctctcatcagggaatgtatatgctataaataagacttccag

SEQ ID NO: 35926 - DNA, 718 bp, Bovine  19866881151846
ttggggctatttgagaaaattatgaaaaggtggtctccctccgccccaacttgttttgaattatgctgattatactcttcagtggttctcaatatttttaccaccttaacacaccatagtgacaagacacaccccaccagacacacttggcccctaggcagtgcttctcagctggagaaagaaagtcacttgtccctttgctgaagctggagatgagggagtcccttggctcactgccctgtttctaggttcaaaatcaccagtaaatgaaatcttgcttaaatcttgcttatgcagcaggccacagaggtaaatacctcagtacatccagtgtaaggtccgtatgttccttatacagtcagtagaactacataacattagtggatttttttttccctaacaaatcaactagctatttaattcaatcaattatatttttgtatgttttggtcttgcctgtggttcagatggtaaccaatctgcctaccaatgtaagagacctgggtttgaaccctgggtcgggaagatcctctgtaggaagaaatggcagcccactccagtattcttgcctaggaaatcccaggacacaggagcctggtgggctatagtctgtggggtcgcaaagaatcggacccgactgagtgactaacactttatgtgtttcacaagacttaacgtatataacattggctgggcacttgtaaagatggtattgtag

SEQ ID NO: 35927 - DNA, 1551 bp, Bovine  19866881273606
ccttgcttttgaaagactccccctctcctcctgccttcgtcttatttttattggaataccaaaaatctgatcatgacgatcctccagactgactgggatctgtagtttgtctactagacacttctggtggcctttagttttcctcattcaggctcactccttcccctgggttgctgtctttctctctagggtacctttctagttggagatgtcctcattagtcatgtgatggtcatgaatggtcaataagaagaagaatggtcagtaagaagaagaagagaccagatcaggttattgcatctaatgctgtagaaatactccagaaacttagaggagtcttctgaaaaatctccacggtgcaactctgttctgttcccgttaactttccacctgtgatcattcacctgtgtttagacaccatggcacctgatgcttgaaaattcccccgaagttacagcagtaagagagaaggcagtcatttttttcattgacaatcataaaaagagccaaggttaatgaaatcattttgttcttagcattactaaatttaggactaaaacagccaatttcctaacaatttagcacatttattcttccaggtcaaagagcacatctgaactgtctttaatgcagagttcttaccgcaaggccgagcacgctggcactccacggctccactgactgactgaccacctacaactgtttgactgaggttgccaagcaggcttggcacacacgtcctcaattaacagattggatagttgctaattatctggatgaaggatttggctccctcagctcgccttttcctgcaaacaggaaggaaaagattccaccagagtgttctgaattattggaatttgtcccctgtggcccaccgtgatgtcacactgacattttcttgcaagtagtttttgaggtgaatgtggagtctagaaagttaatttggtgaattaaatacatgacatagtgttgaaaatactataaatctgaatgcttttgttgtgatgaagactttataaatgccgggttggggaaaacgttttcgggatatttattaattctttccctggtgaactactgacaatctgttggtgggctgcccagtttcatgcattgtctgtgacaagttgtttgtctagactggcttcctctgtccccgaacctcatgcctttctgtgtcactgcccaccctcacaccttgtgtgtcagcaacacaaactcatttgacacgagcaccacaaaactgcactgcacaaggggaatttttagtcaaaatacagaatatattgtatatatatagacattatactaaagttatttagaaatcccctttgctttttaaaaaattacttgtttttaattaaggataactgctgctgctgctgctgctgctaagtcgcttcagtcatgttcaactctgtgcgaccccatagatggcagcccaccaggctcctctgtccctgggattctccaggcaagaacactggagtgggttgccatttccttctccggaaggataactgctttacaatattgtgttggtttctg

SEQ ID NO: 35928 - DNA, 888 bp, Bovine  19866881410782
caaagactgagggcaggaggagaagggggcaacagaggatgagatggtttgatgacatcaccaaaaatatcagaagttggtatctcattgactgaacctaatgtggtgagccattctggttgcccttgaccctgagtcacaagggtgctgtgactctggagtagtctttgaattgtttgtagctgtttctccacttgtaaaaagaaagaactggtctcactgagctgaaacatctcttcctgctctaaaacgatctactctgaacttcatcaaaaaagcttgtatcacatttcctagagtatacacacacacacgcacacacacacacacacacacacacacagctcctgacaaaatataggctatgattactctttataattgccctatttttctaacagattgatttgtttttagaaaactgtcaacttttcaaaacccaaagaatgatatactcctacaataggtgaaggttatcagaaagaaacttgccaaaaattagacaaaacccctcctgttggaaaaggctatgttccaagcgtgaatcagggtcaattcctcaataataattgacaattatatctgccctttagtttgattcatttcacaggattattattgctaacacatttcataatttgactctaacatctcccatggctctgctaatctcaaacatatacttcttcaaaggattgcacctttataagcccccaaacgcttccttagtggcccttcttaactgagtgaaagaatgtttactttttaaaaacacctaaacttcatcatctccatacttggttgattttcttcaaacacaggaagacatcattatttaaactcctgcttaaacattagtttcagagataagctccactgggcaatatt

SEQ ID NO: 35929 - DNA, 2627 bp, Bovine  19866880285167
gaaacagtgtcagactttatttttttggggttccaaaatcctgcagatggtgattgcaaccatgaaattaaaagacgcttactccttggaaggaaagttatgaccaccctaaatggcatattcaaaagcagagacattactttgccaacaaaagtctgtctagtcaaggctatggtttttccagtagtcatgtatggatgtgagagttggactgtgaagaaagctgagtgctgaagaattgatgcttttgaactgtgatgttggagaagactcttgagaatcccttggactgcaaggacatccaaccagtccattctgaaggagattagttctgggtgttctttggaaggactgatgctaaagctgaaactccagtactttggccacctcatgcgaagagttgactcattggaaaagactctaatgctgggagggattgggggcaggaggagaaggggacaacagaggatgagatggctggatggcatcattgactcgatggacatgagtctgagtgaactccgggagttggtgatggacagggaggcctggcgtgctgcgattcatggagtcgcaaagagtcggacacaactgagcgactgaactgaactgaactccaggggatattccggatctagggatacaacctgtgtctcctgcattgcaggcagatgctttatcactgcaccacctgggaagctattggattgcatatgagcttttaaatctttgctgttgattcttaacctagagctgttgtatgttataatgacaggcaaataaagcatcagtttggatgttcaaaaatcactaatacactgtaagtttaaggcaatatctattgaattaggcttggctgtacccctgtacaaaaaagactcagctgtctggccaaggaaaattccatctacattgtggcaaatatcggggacaagaatctgtgtaatgccagtgaccctcagtgtccccctgatggtcattaccaatacaacactgatgtggtgtttaattctgagggcaggcttatggctcactatcataaggggtgagaattacttgtgccttagctgatcttgacttatttttgtttgtgatatctatgtagacttgtttgttgaatgttggtaaggggaccgttataaacacattccttaattattacatttagttgaaaaggggacttaacttactttgacttttatataagggttctgaatttgaattagtcataaaatagaatctggcagaatattaaagcagatgtgctaatagcctcacaggattttaatattctctgagaaaggagaaattctgtttcatcacatgatttaatactagagtaagtttttggacccagtttgttagtttttggacccaatttgttagtgtttggtattaagctttagtcattcattccattaagatctttttttgtttgaagtgatagaaaaacccccaactgaaattgatttgaaacagtaacaacaaaagcaatggaatgcccttgctcaggtacctgagaaaatataaatcatagaaaggataggtctagtttctgacatggtctgtatcttaaggcctggaagatgtcagccatccccacagctctctctctctctctttcttttttacagtgtgtttttttatcctctcaggccatgccaaagtgcatgcaggatcttagttctctgactagggatcgaacctatgtcccttgcattgggagtgtggaccacgggatcaccaggagaagtcaccctctagttcttagatccttgtaaaaagttccaactttttctcagctgactatcctttcagacgccacatggctgctggttacaaagcgcatatcctaatgggacaaaatccagaggaagactgaatttctctttcctagaaaccccacaaaaaccttattattccttcagtccacctagcaaccacatgcctcgcttgagtcgatctcctgggaatgaaggatgggctgccacctgagcagaggacagaagagtttgggaacctcagtggtgggggtgggatggggtgtggcctgagcatatatgcacacatcaggccaaataaaaacctgagcagaacataaggctgcactcttgagtccagggtagatggagtttgggagcgaaaatcaagctggagaaaattttctaatgacttactaattaacaaggtttacttccctttcacttttcactttcatgcataggagaaggaaatggcaacccactccagtgttcttgcctggagaatcccagggacgggggagcctgatgggctgccgtctatggggtcgcacagagctggacacgactgaagcgacttagcagcagcagcagcagcagctattacattgtctaagttccagtttactttacctcacttatataaacctagccataccatgggaagacatgacaaagtttagtttattaacacatgttaaacttcacaagctcaacattcagaaaatgaagatcatgtcatctggtcccatcacttgatggaaaatagatagggaaacagtagaaacagtgtcagactttatttttttgggctccaaaatcactgcagatggtgattgcagccttaaattaaaagacgctactcct

SEQ ID NO: 35930 - DNA, 1936 bp, Bovine  19866880361724
attatgtatagatatatgaatgaatcaaattaaaaataaatttggtttaataaaattatgtgcattcatcatatattgaacatctgggatgctatttatattgatggtagagtatttcagattccaatccagtgataatccaatgataaatttcaaagtttgttaaagtattttaggaaacattggtttcaatgggggcattactttatgggaagtaatctacatttgtagtaaacgcatcaaggaactagtatatgtgagaaggtcttggcatggattatctgtgattatcagcttctcaacaatgttcccctggctataaatatggctcactttccatagtcaatgatttaatgagagactgtagtcaaatggagtctgagattttaagaagcctaggctatacttcatctgttgtgtgaccttgggaaaattatttaacctcattgggtctaaaaaaatggtaacaacagtgggttaattgtgatgattaaatgaagcctaaaatttttttgagagcagggactttctcttcagtaagtatcacatatgaacagtgtgttaactacagtatattcaataaaacaaatacttgttgaatgaatgaataatgtgtgtaaaatacctagaccagtacaggcaaccaataaatggtatctaaataacaattattagcaaattagctatatatctttatatatgtgttatatagaacacatagaaatttgagagcatatagtagatcctagttgactttaactgtttattttttcattggacaggattgaagatgtttgattgagtttactgatcagaatttttttttccctttttatcatttgttttttctttttgtttttggccatgcctcttggcatgtgggatcttagttccctgaccagagatggaaccatcacctccagcattggaagtgcatagtcctaatcactggactgacatggaagtctgagatcagaattttaaatgctagagttagaaagtgtttttatttgcttttcttttgatgacaaaaatcatttaatactgaaactgtaggtggggttaaaatagaagcctaatacattttggttaacagtatatcaaagtaaaatttccttgtttttttctatgaatttgatggtagacctataagttaatggtcctgatgcttttaactgagttgatcacccatggtctccccatacggtgctactacagcagaacctagatgtagcacttattcagttataccaccttgtaggcagatttctgctgatgtgttcattggctgccagcacagcattggccatctttacttcgaaacacagaagagttaatagcagaggaactgggattgaaatattagggttacagtaagtaatcacatactgttaaattatttgactcagttcctaatctgttagtgaagtcactcagtcatgcccgactctgcaaccccatggagcctactaggctcctccgtccatgggattttccaggcaagaacactggagtgggttgccatttccttctccaggagatcttcctgacccagggattgaatccgggtctccagcattgtaggcagacactttatcgtctgagccaccagggaagtcaatctgttaaaggtggataaaaagcacatgccttattcatttttaacgtaatttagaagggacaagtacttatttacccagggatgctttgactgcaagcaacaaaataacatctgaagtttgtttaaatacagggagacttttaataagatatccagtcatatctcatgaaaccaaagatgcgatgtgtcactagacatgagtgaggttttggaacagagaactggaaagccctcagaagccactgctccttaatcaactgtctctcctgtgtaacacttatgttcattatgtgtttctgattcattttgtaggtt

SEQ ID NO: 35931 - DNA, 2303 bp, Bovine  19866880367586
caaccaatgcataaagcaagtttttgatgcatattaagcatatttgtcatcatcttgtgtttatctttaaaaaaccactagaaagcaaagtgtcaattaggtaatagctatactatcataacttttttccttaccatgtatcttgttgttgttcagtctctaagttatgtctgactctctgtgaccccacggactctagtccaccaggttcctttgtccatgggatttcccaggcaagaatacagtttcccaggttgccatttccttctctaggggatattcgcagaccagggatcaaacctatgtctcctgcattggcaggatttttcaccagttagctaccagggaagcccaccatgcctcgtactttagtgctaaatttaaagtgagtggagacagctttttattgtggtgctattatcacattgccaaaatagttagaagagaaacaaatagaaaaccacctggcaaaggaatgcatttcagtaactttattgaaaggtatatcccttagtaccaaaacataatgggagttggttaggttacctctggcaactcaaaattaacactgatgtattcaaaatattgaaatgtatcagtattttgggaaaactgtaaagttatccataaaacatggtttaccaagtatgagatacactgtgggtctttggttcattttctgatgcctctatagccataaaatgatgtcaaaactggtgcagccatcctggatggattcaggctacacactgcactgagaaactctctgcaacactttaaccctgtagatctccaaacactacacctcagcaaccttatacttatgaagatgcctacttatctttcctaatacttgcttttggcacacagtaggggcaattaatataagtatattctcttccttttaagcaaaattctaagttagaaccaagttttataaaaacagtcctcagtaaaaactgatggagtgttaaaaagttttcagagtgacgctaatttgttttgagctactagtacagtaaaaactaattttcttgatgggactagactgaggcagtaaattttgtataaaacttttaaaatcatggatacaaacatcacctgttttctagaaaaatattaaagataacatgccaaaattaacaagttggtagttttgctttacataaatgccctcaaatttaaatgtgatttctatgtagcagtaaggtccacatctctgggttaataattacttgcatcataggtgccgagaaactaactattctcactgtctagaatagtgacccttattgtgccttaaaaagtgcatttgtgaaatggtggttttgatgtaaacttcatagtttaaatttaagtaggttaccctttttaaacaccacctaaatacaatatattgacccaatacagaaacttggatcaatgttagaaatgaagattcacagtttacctttccaggcttgtcatttgcatttcacatttatactgttactttgatttgtatgtttcataggtgaactcaaatttgagtaattccactatagggtaattttaattaggcagttttcccaaatctgagaacaccgatgctaatctagttgtaatgttttgaggcttcacagcttaaatccgttataatattatggaatccacagctcaggattgtggagaaaggcttcagaagttttttgttgctgtaatcatccaattaagggaccgtttcgggaattgttggaaggtgggttatcctgtagtaactatgcctcagttgccgtgcagtacgcccagaaacaatccatttcaacttctgaacatttggtttggcacacttgttcgatgaatattcagctaaacacttggatacaagctcctgccagaaagtcaaatctctgccactgatcttggaatgtttctgaagacgttctactccttctgttaactctatatacttctgtgcttggatctccaatgcgatgacagacaatgccaacacagatggctttgctttagaaaatatgatcctgcagtagcatgccttaagttgggcttctagtctttcaaaattaaggctactcttcctttcatgtggcacgttctcttgaaggagtgagtaatagagctgtagaaactgaaaggcagtagtagctttgactttccaacacaccttctccaatacgatcttctccattttcatcaagtctgaaaccgtgaacctgtactggcttattcggatcaagtcagttgccaatgggacattcctttcctcttctggtgattttacagccagatagaagcagcttagt

SEQ ID NO: 35932 - DNA, 1898 bp, Bovine  19866880411712
tgagtacagatgagtatgttcttcacatagcacgcaggctaaggtaagaaagggtgaaacaagttagaggaaattgacatggctgggtgttaaatgtggtagcaaggaaggtaaacaaactattgcccaaagtcctgaatgtgcctgcctctcagtaacccagctgggtcatcagaatgttctcggctggctgggctctcaggagctcgtctcgaattcttttgtttctactccagttttgtgatagtgccaaacagttactgccacccagttttgcccacgaatgttgatagaaacaagggattcagaagtagggtagaaaggtggacacattttgtgaataagactgaagactaggtaaggggtagttggcgcactacttggtttataacagacaatgaaaaacttagatttcccccccaaagtctgaagacagtcattcagctaaaaacgttctcagggttagagtcaaaagtaagtaatggtttgaaataaaaatttttcttctgagcctttttaaagctcattttttaacctgtgtttcatgccaatcatatcttctgggagcctttttccacttaactgattttcatctgtctttaaggaattattttaattgatacatttgctttgttacctgtctctgatggagctgtcatgttggacacctctggattcagttgtccgtgagacatttattaagtatatcctgtgaattgtgcttggccctggagatcctggctattgagattttaaatgaaaaatatatttcatgagagaagtatgaaaatgctatgggaatgcagtgaagagaaataaactttgccttgggcagttggggaaagcttcatggagcaggtgatatttgagctgaatcttgatggatgggtgggagcctgctagttggagagagaggaaataacatgttcaaatgtccagagttgtgaaaaattcatgatatgtcatgtgatagagaggtttgaagagctgactcagggggagtaatgtgattggtgaggtgctctggtcattttttttttttttaatctagaatgaggagaaaaaattccagagaactaaagcactctgcatcacagactagcaaaacatcagctccagtaagtaacccccatgcccatcttgggtactgtaaagaaccacataggctgcactagggaatttgacttttcacttataggcaaaggagagccaatgggtgacttaaaacaggtgaaagaaatgatcatgtgtgttagacaaggtggtggttaagaaggtatatcgatgtgagaggaatggaagaggcagagtcaacaggatttactgttttattggccaaagacatgaatgaaaatgataaagggaggcattgagtttgggtacctcgtactatggtgatgtcatttatggacaaagaggagctttttggaggaggggacagtgaaagaaatgagttcaccgcttggctagtgatatctgaggagcctaaagtacatccggatgtcgttaaatgtcagatgcccaggagaggtcacaatgatgtttgtgtgcagtagggaagtagctgtggaagtcgtggaaatagatatcctttaacattattttccttccaaaacagtttggacttaactccttcattctatagaatgtaattcttatgtacttcatatatatttctggacttaaaattgagctttaaaaggattctgtacagtttgattaatttggcactacaccagtattttttagaaccttacttcctaacaactctattaatatttaaggtggtttggggaagtcacatccttttaaaggttatattctctcatcttaatccccaggttcaatggttcttcactgattcttacctcattcccttgacaaactattttcctcca

SEQ ID NO: 35933 - DNA, 1842 bp, Bovine  19866880421856
tggagtgtgttgccgttgccttctccttgtgtgaaagtgaaaagtgaaagtgaagtcgctcagtctcatccaactcgtagcgaccccatggactgcagcctaccaggctcctccatccatgggattttccaggcaagagtactggagtggggtgccattgccttctccgaaatataacactacacactatcaaatgaacataacaataggtggtttcccctctttatttattttcttttgatgtttaactaaatacttacagctgttgcctcaattcaggtgaatcttgaggtgttccaagttgattcagggtcctctgtatttccgcagctattatgatagaaagtaaatgtatagtaattattacaaatgttaggccattagaaattaacacaaacaatgggacagttagaaaaagacaggaaaaacaaagggataaatatagaaaatattagttgagaaaaaaaatcaatgacttattcaaacataattagtgacaatgtattgtgtgggtaccttaacgtgtgaaactgtaactatgatccaaaaatgttatcttcttccctattccatcagcacatttggtacaatggcacatggactgtcatgtaaattctactggcacaaaaattgtgaggaaaatatgattcactgggatataaagtgaatgaattatggttaataaacgacggaggaataacaaaattagaataaccatttttcaactgtctacgtaataagtaattcaagcaagaatcaaaggatgctaaaaccatgagaatactcacatgacctcaaattatcatcacatacgtgtcattaacttgggctaactttatagaggattaatctgttgcttgaaacaaatgaccaaatttaggatcaccagtcgtacaaactagcattatgagcctcctgacacgatgcaaccagaaagtcacaaaatgacctatgtatttttcttgccaaaatatttaactggaatctatgtgcaactgagcacacatcacacacaatcatgagaaagaaatcagaccaatctagattatgtgataatcttcacaacaactgatctgtacttcttaaaatatcaatgtcacaaaagaaaaaaaaaatatgtaaaagcaggaaagctttctaaattaaaaacacaaaatactttctaaattaaaaacataaaatactaaaacacccagtatacaatttttgactgtcttctgattcaggaaaaaagaaaaaaacctacaaaaactatttttaaaaagttatagagacaactagagaaacttgaatctggagagagaaagactaaacaaaaattgaaaaatgtcagcaactggtgaacccaggtaaagtgtatataaaaagatcactgtactatatacttctactcttctgtaggttttaaatatttcatgctaagttcaccattcagaagtctaccactgtaataatagtaattttttaaaaaaggctctttacaaaggggaaggttctcgttttatgtatttatgtacacaaataaaatggcaagcagagataagttgaaaatccatctcaaagtaaagcactttcacatttccaagaactagagaaaaatgatccaacccatccattctttttcatttaaaagaagtcgtttatttatatagcttaaatgcttttaaaaaagtcatttgtttatttatgggatcaagggaatgattgtattccaaaacacaggattacttttgttcactcaggatgatgtaatgaatattgctttcaagtcaaagatggaaaatataaatactggagaggaaatatatagcaactgttaaccactcagctagttacaaagga

SEQ ID NO: 35934 - DNA, 1715 bp, Bovine  19866880428729
tgaaaaagagggagagagaacttgtttttatataattcacgtgtattggcaggaattcaagaagcaccaaaaaagatggggaaagacctctttttctttattgccagaggaaaaatatcatccatgttacctttaagcctgtatgaacatgacaatgttaaactccccctgccctttttctaacatgcattccattaggccatcttaaaatttattctaactacagcactatactttgaggcattattgtgtatttgtaattaaagggtttactgctttggcaattatagggagaatctgagcaaaaaactatattctacagaagacacaaattatagtagtgaccacttgtacattgatttaatctagacctcaagaagagcaacagactttaaaatatcaaactttttttgcatagtaaggaagatcaaatatgcactgtatacaataaaatctgagaagatgttagtataatgttggcaaactatagctatgatagtgacaggatatagctactatttgtaagaataggttctatattcttttaattcgtttatttttattgggttctatgcagcttgtcatcagcagaatatcagtaaatggtaagaaaatgacatcttgccatataattaagtgtcattctaaattctactcattgctagatggaattctttcacactggaaagcatttaatagcatctccttgatctgtgtgtaagaaaatatggcattgagtagcttatccaagaaaacatacataacaagtatctgagccagacctaaaccaggacttctgatttcaaatcctgagtgctttcccactgcagctgctgctgctaagtcacttcagtcgtgtcagactctgtgcgaccccattgatggaagcccaccaggcttccccgtcccctggggattctccaggtaagaacactggagtgggttgccatttccttctccaatgcatgaaagtgaaaagtgaaagtgaagttgttcagttgtgtccaactcttagcaaccccatggactgcagcccaccaggctcctccgtccatgggattttccaggcaagagcaggctcatgtaaaacttcaagatacacatttcaaacaggatatgcaatttggaaaatttactttaaattataaccttatgctctgattactttccatcagtatttatctttgtatgtttctctgtcctgagcgttgcctcttttggatcactgttatctgatttttctaagcattcctgtgtctttcactctatctctataaagcctttccacttttagaccttatctctacttttattttattctaagattttttttttcttttttgcttttcggaaaattttaagtaacctggctttattatcaagaacttggatgcttcttacatattccagatacttagaattatctttgaacttgatttcctctttataatttttatcaagttacctaagccctttaatccttgtgaatatctgttctgaaattttctttgtaggctgtgagaatcctgtaggcaaaaaaaaaggtgggggtggggatgagtgtggttaggataaagaacaagactctggcatgtaatcaataggattcagtggataagcagaatttccgattgttatatcagttttaaaccaagttatgtgttgcccagttcggaagtttcattcttccaacatgtttaactcttctctagcac

SEQ ID NO: 35935 - DNA, 936 bp, Bovine  19866880491484
attttctttttgttttttaattttattttatttaactttacaatattgtattggttttgccatatatcaaaatgaatctgccacaggtatacatgtgttccccatcacaggtatagtagagcaaaaccttcctaagaaatcatcatgattacacaaccctataaacaaatattttctcaattccttaggggattaatccctttattttttatttgaaatttgtgaaattttcatttaaactgcatcccaggatgctgttttattcattatacttttgagaacctattatgtgcctgtacttctaaatgttggagatactgctgaacaaaacttatttaaaaatttctatcccttcatggagcttgcattttagtgattagatcaggaagcattagaagaagaatcaaattataggtagtcaaaaaccagacaagtttttgaggtggataaaggacacatttttctttagtataaaaccatttgtgaaatattgtcactttcttattttgagttccatcaaaaggaagaacaaaataaggacctccactctcctgaataaattgtgctgaaatgttttgctccatgtggtaagaattatcagaacatgaagagcaactaaaacaaagcaaaaattttggggaagagtatttacataagagagaactgcatcaagagactcttagtggagccaagacacaaagtaaaccaccataaagaaacaatgcatctaaagaaacaaacgggagatgtgccattctgagcaagattagaggagagtgagaatgaaatgccagtgcatgtctttatgtgattaccccaaagtagagctgtctaaacttatcaaataaaccttactaggaagcaaattcaatcaaccgaatgaatgtttaggtatgacatttttaatcattaactgggtaaatatttttatctcct

SEQ ID NO: 35936 - DNA, 2146 bp, Bovine  19866880551959
ttctagcagttgctgagagaagatgataatctctcctattgtaaccgtggaattgtctatttcattctgtaattctgttcacttttgcttcctatatttggaggtctatttattaggtagacacacaattgtggttttgtctttctgttgaattggccctattgtcattatgaaatgtgtttgtcttttgtgacaacctttgatttgaattctcttttggctgtttaaaaaaatagccatattatatgtcagttatatcacagtatacgtaggtaaaggcaatggaatgaagtataagatcgcagcactggccttctcaagcttatcgtctacgtggcatttgttttttttttcattcatttcatttcagttcagttcagttcagttgctcagtcctgtgtgactctttgcgaccccatgaacagcagcacaccaggcctccctgtccatcagcaactgctggagtctacccaaacccatatccattgagtcggtgatgccatccaaccatctcatcctctgtcatccccttctcctcctgccctcaatctttcccagcatcagggtcttttcaaatgagtcagctctttgcctcaggtggccaaagtattggagtttcagcttcaacatcagtccttccaatgtacacccaggacttatcacctttaggatgggctggttgaacctccttgcagtccaagggactctcaagagtcttctccaacaccacagttcaaaagcatcaattcttcagcactcagccttcttcacagtccaactctcacatccatacatgaccaccggaaaaaccatagccttgactagatggacctttgttggcaaagtaattttattcctccaattccagttttggataaatttagattcttatgtggtcttgatctaaactatcagcccagagggagtgagaagagatgaaaaggaaagtagattcctggaattctaagacttcttgctatttcctagcattttcccaatataataacagcttattcactgataaccagaatttactttgttcttctgaactctctctcctcctctttttatctttgtaatatgcaagtatataacataatgttatatattacacataatatacattaaacatatactgcaaaatatattgcaagttccccacaatttagctgagtattacagaatcatatatgtcaaactaatgattcagctttacatttccaacacagtgactaacatgaagtagatgttaaaaaaacttataggaactgaacttactgaactgaacttggaaataaaacctcttttcaaaataatcatttttcagcaagaagtaacaggtaaatgcattaaaagtgagaagaatcaaactgttgataatttccttttttccccccacaggtttctgggatatatatatatggaagtaagagaaggaactctaacctgatcatggatttcgaagagagactcctcaaaccactaaggaaaagataacaaccagtgcattgtcctaagaaatgatgtccctttgccacaataaaattaatatttcctgtgtgaaaagcagctggtcaaatgacatccgggcttccctgtacagtttaatggtgctcataattctgaccacagtggttggcaatctgctagttattatttccatatcacacttcaagcaactgcataccctaaataattggctcattcagtccatggctactgtggactttcttctggggtgcctggtcatgccttatagcatggtgagatccattgagcaccactggtcttttggagaagtcttctgtaaaattcacaccagcactgacattatgctgagttcagcatccatttttcacttgtccttcatttccattgaccgctactatgctgtgtgtgacccactgagatacaaaaccaagatcaacatcttggttatttctctgatgatcttcattagttggagtattcctgctctttttgcatttgggatgatctttctggagctaaacttcaaaggagctgaagagatgtattataaacacagtcactgcatagggagttgctctgtcttcttcagcaaaacatctggggttctggcctttatgacttctttctatatacctggctctattatgctgtgcat

SEQ ID NO: 35937 - DNA, 1676 bp, Bovine  19866880567240
attgaaatttgaattagcatgattttgttatgtgataattgagaaactcaagaattgatttgtataaacgttgaacccaggggaagagacgtatggatttagaaactgttgcgtgtatatgttgaagtatagtttgtatctatatgttttccaatcagacggttcattctgaaccacagtcaactcaccacttgtcactcactcattaattactactcacggtagtagttttattttaaaaatacaaaaatggaataaagcatatgcttggtagttttccaagaagaaactttttctgacaaaattaatatatatatatatatttccccccaccctttggcctacaagattcactgaccattatggcatcaaagtataatcatcattgcctaaggctccagcactgaataagtagagagtaagctggttttgaaccagactgaacagttagcaagatttgtttacttctacttcttagaacaagatcaaatgaacaaattccaagcaaatggtataatagaaggagacaagggaaaatgagtaacaatataccctcgctgaccttttcccctatattaagatgtgatgttcaagatttcacagtttgtctcatgctcctgattcatacataggatacataagattttcccaaagaaagcagcagagtgtcacaatgttacaaatttatttttaagcccttaagtcttctataatgtgcttgattatcttcataataaagacagcaccacactaaagaacttctccaggctttaaataataataaaagatgttgagtgggttttgttcatgccctttctatgtgctacacaaatttaaatacgcagtttgtttaaaacaatgctaaaaggataaattaaataatctccaataagatggaaacaccttaaaggcagaaatttggaaagaaccaaagtctcaatctatgcacatttcccaatctccctctgccttgtttttcaaaatccagctctattttaggatttaagagtattatatctaaaatgttcctttttcccatgtttctttccatttttttttcaagcttcacactgttgagagtttggtctaaagtctggggtggtttatgggcaccatttgttttagtctgctaatctttcccaggctctccctacttttaagacacattctaatttggggtcacatggatcatttataaggaaatgcctttttgtaattcacttgcccctacatatatttttatctgtaatatttacacagctaatttgaccagaggataaactgctcttggaacatgagtaatttctgtacagagaacaaatatagttgcaatcaagatctgcatgattaggaacgggtgtgcagagtaatttggaattcagggcagttaccagtgcagcacacgagtagatttttagatgtggtggtgaactgttgaaaagaaattggctgagatttgagcgtcatttgaagtggaaaaagaaaaacagcttgttttggagcttcatgcccttttcttcctttggtatctgaaaaaaaaaatttttttttctggtttggagaaaactgaggcaccaaagactctaatcattaataaaaaatggttcttctctgtgcaaagattatctgtccaatatacctcagaaaaaccagatctacgaaattatagatggatt

SEQ ID NO: 35938 - DNA, 1977 bp, Bovine  19866880640615
caccctgtgcgaggactggacgtgacgtcgggaaggctgtggtcaggtgcgcactccagcagtctcactgtaggcatgcatggaaagtgttatcccatctcaggttggtagggccacagcacgttccagtagagactcagcgggccaagcccctcacctaccccaattcatgcacggtgtgggtcctgatgtggaggctgcagtcccagggggttgtctgtctgtctttggttgaggcggcaggcccaggagaagggtagatgcctggctcagcttcctcaccccaaacagagcctggactattgtttcagtggttggtggaagggggagcctggcagtgggggggccactgagttgcagaacagggtctccaggcacctataaggacctgcacttgacctgctaatatctccacgtccaagagagcgaggcattccacagcaaaaatcaaataatcttggcaagtcgagagaaactgcagagaaggggaaaaaacttgtgaatgtgagggcactatttttcatatttttgaacaaagatctccagattgttgttttgtcccagatcctgcaaattgtgtagccagtcttataaatagggaataggtaacattattgccaaatacaaaatgaggctattttggaacagttgaattaaaatcgatttctttggatgttaaaatcgtgttctgataaagtaaaagggcacagagaaatatgttttgcagaaaaactttttaattataatcaacaaaagtaagtttcttttcatcagtcacaccttacactacagggattgcttgtgaggaatttataatgggcaaagtttattggctggctttctaaagcaccctagatgttaacgtttcagacaacatgaaggctgaggtccattgagaggtgactttttaaatgtgcaattgttgcatgtgattatcctttgcaaggaagaagttcacaggtgtaaagggccaggtatttaaattaaatttcttcaattaatcagataatgtgatttctgaataaccatagtagatttgcttaaagttcactacctatgagatttagatacagagaaataattatataaacacagaaggactaaatttcagaattttaaaaattcttttaatttctttacctaacaaaatggaaaatagatataatatgaggaagttttaaaagcattattcaagtatgcagttttatttatttaattttcagaattgaaccattttttccgaagggcagaaaaaaagcaagcatccaactgcagaaccatgaccagcaatctttcccaacctgataccgtgcagttctgctatgagaatgtgaacagatcttgtattaaatcttcctactcacctgcatctcgggtgattctgtacacagtgtttggctttgggtctttattggctatctttggaaacttcttggtgatgatgtcagttcttcacttcaagcagctgcattcgccagccaatttcttgatcgcctctctggcctgtgcagactttctggtgggagtgaccgtgatgcccttcagcatggtcaggtccgtggagagctgctggtactttggagccagattttgtgcccttcacagttcctgtgatgtggcattttgttactcttctctcttccacttgtgcttcatctccatcgacaggtacgttgctgttactgaccccctggtctatcccaccaagttcacggtgtctgtgtcaggagtatgcatctgcatctcctggatcctgcccattgtgtacagcggagctgtgttctacacaggtgtcagtgacgatgggatggaggaattagtaagtgctctcaactgtgtaggcggttgtcaaattgttataaatcaaggatgggttttgataagcgttctcatattttttataccttccctcattatggtaattctttatggtaagatttttattgtagctaaacaacaagctctaaaaattgaaaa

SEQ ID NO: 35939 - DNA, 1097 bp, Bovine  19866880659246
actcatgtatctaaactagatgtttgacacctccatttagatgtttaaaagacacctcaaaatttacttggccaaaacaaaattctcccacatctcctgaaccgttgttcttcccatcttagtacatattcaccaccatccacttggctgctcaatgcaaaaaccatggcatcacccagatctccttctctccctctcgcccccaccccaccccaagcattacaagtcctgctggctgtgcctccacagtacatccaagcacttctcgccacctccccagataccactctggggcaaggcaacacctctctcttcaaaacccttccatagccagggtgtcctctttctatttcctcaaagtctatttactaagcagcagccaaagtaatctttccaacgtgcagatctgattgtgtctcttccctgcctcttggactgaaatctaagctccacaaggcctcacatggcctccacagctctaggtgacctgactggcctcctctcccagttctgtctcttgccactcttgcctcaagtgctgtgcatcagccacactggatttttctttttttcctgttttctgaacaccctaagctctggactgctttttaaaactaccagctgttagtagttttccagctgttagcaggcttccaactaattgctcttccccagtatcttctcactatcagcccctcctcttctgcattcagaggattctctaagctaaggcagcttctccctaatcacctgctctcacatcactctcattattttttttccttcatgggaaattaagttgctcattaattaaaaaaaaaaaaaaaaaaaaaaccactggtttctcctcacactggaaactacagaacaggaccgtttggatcttgtttactgctggatacccagggtcttaaacagtgatgagcaagcagttggagctcaataaattatttgctgaatgaataaagacttaatatcaaaactttaaagtcactcagtctgaaccattattcaggtatctaaaactctgagtaacagacctgagaaatgtcttaccacaatagtgctgctcagaactgcactgcttctgaggtaga

SEQ ID NO: 35940 - DNA, 1008 bp, Bovine  19866880715682
tgaaagggtgtgatccacatttccttatgtgcaattgcttggagcctttaaaataatgaagcaggcagttcataggttatggttcattctgtcttttgaagaacggttctaaaaactaacaaagccacacaggaaaaaaaaaaaaaaaaacacttatgaaaccaaaatacgacctgtacacacttaaattgtctatttacttttctcataatctttaaaagatttaaaagaatgtttacatcctagcttctgggcatacatattttttcaggagtcttcaagcagaaggaaatattttgaagaactgtgcatataatttgatatgggatgcatttaacagctggaaggatttcacacttagaacccaatttataaaagtttgtagttggcattatttcagctctagtcctggaagtcataatttcccaaagatattttttctcaatttgaaaattatttacataaggaacatatatcatttcaaaaatgaagttatcatagctgactttggccaggcataaatgaataacttcaagaagagacatctgagaatattattcacttccactgaaatcctacagtcaatttcagttcttaatgttcaaaattctttctttgcaagtaaacaatctattctttcacatcccctagcagaatgaagccaaccattttgttaaaaaatcaaatacagaatttcaatatgataaatagcagtaataaagaatagaaatgagcccaattttgttccaagtgtgtgtgtgttctgggggtggtgtgggggatggttagaataataatgagattaagatgaagagattcagaggacctggaagtgggtttgttttcacttgtaagaataaggaaggaaaagaatggtagggaaactatagtcaatatcttgtaataacctgtaaggaaaagaatttttaaaagaatatatgcattctgaatcactttcctttcaaaggaaatgtgttaatgtaaattaacacatgtaaataactatgc

SEQ ID NO: 35941 - DNA, 2691 bp, Bovine  19866880737397
ctcttagtccctatagagaacagaacaatctgatgtcacatggttcaagtccatggtgagcatcacaaaagtagcaacatgagtaaggatacattttggagaagtttatagactgatgttgctttttcttcactaccaaactccagccagtcaaatattcatggagaggtgatgataataaatcattttttcattttcttggcatctacaccctccaaccttaataccgccttcactgttaaatttatttagcatgtcctgtgatacttacatgatacttatgtgcaaaataggattaacaaacagactatcacaagttcacctgtgtcacaagagctctaaaggagaagccatctatggagggtaaataagaggcacttacatggtcagaggaacttaaacagaagggaaaaaaaaccagatgctgcagaacctgggggcaggtttttatatcagttctacaagggtagagagaaattcaggagaaaatctcatattcacctgtgatggggaaagcaggaggctgggcactcaggggatcataggattagtttttcaaccgtgtgtgtattggccttgtgtttgtatttgcaagtatgcacagagctcatagactgaacataaagaacaaattgttctttattatgggactttcctggggtccagcggttaggattctgtgcttccattgcagggggcatgggttcagttcctggtcagggaactaagatcctgcatgccacaaataaaacaatttttagaaattataaaagaacaaagtgttttttattataattttaacttagtgcagcacctaacaaagggctttgcatgttaaaaatacaagcactggttgaatgagtaaataaaaatctgaaaaatgagcactaactatagtatattaatgttgggttggccaaaatattcatatgggttttcctgttacttcaaatggaaaatcctgaaagaactttcagaccaacccagtaagttaacacttggtctcagtgtaatgttttgcttatttaatgctgtcttgattagaatttgttaattgaaaacagccagttattaaatctacccaatagatacattgagatacatatctgtttactttgctaaaagttaattgctgtgattttatacaccttttgaatctaccgctaaaggagttacagaaaaatctatattaatctgtcaatcattaatatacagccattgtgacttacgtgtataaatttataaactagatgctcatgttgtcaagttactgcttatttataatttgcatcctgtatttccttggccacttctaacctgatcaaaagtacagaccagtgaaaatcctgtgcctctactgggtgaacaaataaaagatgtgtctgcaaatggaggatcagtagcatcattttatgcatttatgaatcataaatgaaagagttcagctttaaatcaaattactagaattttatcaatgcctctatagttacttcaaaagctgattttgtgccattgaatgtcactaggtaagaggaaaatgaaaaaatgcagttcatatgttagattcatatatacattgaggtgcagtgttaggcttcagatgaaacacggggctcctatagaattttttacacactgtaaaataagcgtctgcaatccgatacttcacacatttctattaacctttgacattgaatttgttctattctgattgttttttcattgatacaagtgtttggtgaggaattaaggagctttccttcacaaatgttttgtttgatttatagcatttttcgctgtgatattcctggttagaatactttactgttgaaatctttaaaaaaattagttaaattcccaaaggataatgtgcatcagttctatgttaagctctttgttcagacttattatttctgcctccaaaatgtgttttcactaacattatagcatgataaatgaaaaaagtgtgtgcacagcttaaaacatttggaaaagcttctataagttgcttttatactgggaagtttactttttccgtagagatatttcttttttaaaaacgtatttattcattatttttggcagtgttgagtcttcattgctgtacagtcttttatctagttgtggtgagcagggactactcgccagttttggtgtgcaagcttctcatcatggaggcttctcttgttgccgagtaccgactctagggaacacaggcttcagtagttgcagcgtgtgggctcggcagttttggttcccgggttccagagcacaggctcagtagttgtgactcacaactactagttgctcccagcctgtggggttttcctgggtgggggattgaattcatgtctcctgcattggcaggtggattcttattcactgagctaccagggaaactcccataaagatatttctattccatactctactgtcccacatgtttctgaaacatgagcatgaactctgtaggaattttatttttggactcaaaaactagagttgtatggtagacagtttttgtttaatagaattctccaaccttccccttcttccttacatagacattagttttatttcatttttctgaatatttatgttctcttccttaacttacagtacaaaaaccttccagttaacaaagagctaagtatcatattcatccttcattttccatactatttcattctc

SEQ ID NO: 35942 - DNA, 1546 bp, Bovine  19866880744550
cctgtgccctagggccctaagtcccttccctttaactgtgatgtttcattcagtcttgaagaaattcctgtatcaatatataaaaggaagtcataagtacacccaagtaaagaacattaattttaattatttgattctctgtaaacaagagcaaacaccatgtgataaaatgtttattatttgagggggtaaagttaggcacactgataaactatatggtagctatttcttaaggcatagttatcatcaattctgaattaagaattggcaaatcttaattcagaattaagattaaattctgaattaaactgactcttaattcttaattaatctagaaaagtaagtgattccttttatatgaaataattacctgaaaagtatttgtctaaggtagtgtgaattctgtatgtttctttgatggctgaaaatgcaagaagaaagattagaaaaagcaacagattgaatcccactgaatgagtcagaagagtgagcaatgtgtaaaaataaaaaggacaagagtgtgacttccctgaaggttcagtggttaagactccatgcttccaatgcagggggcgtaggttcaatccctggtcagagaactaagatcctacatgtcacatggtgcagccaaaaaaaaaaaaaaaaagggacaaggctgacgaggggaataccaaagtcctgccaacatcattccatggcctcagtccacatgatcaccacctctggttagtcaccaattttaaggtaactctccatccatgatagccattgctctgacttggctagttggtggtatgtcacaatagagcttctaaaccaggacagcagaagcttgggatgtcccaacaggtgatccaagatagctctgcccaattaacataaatcttaatgagagagaagatgagttggtgcagacatgactgtagcagtagatcttatctaaacatccagtctgaaaaggaaagttaagattaaaataaaattcaagatatatataagatgtgatgtccaatttgtgaggagtcctctatgaagttttggttagaagaaagatttccattgatagaaaaaaatgttaggttgaggagcaccagaactctaaagtcagaaagcttaacaaaattgtgatttttatagaaggaacattttattataaaatcaagaaattccatttgagtcagttctagtgaggtagatgaaccttgagcctgatatacagagtgaaataagtcagaaagagaaaaacaaacgtcatatttcaatgcataggtatggaatctagaaaaatggtactgaggaacctatttgcagggcaggaatagaggtgcagacagagaacagatttggacacagttggcgaaggagaagataggacaaatcaggagagtagcaatgagacatatacattactatatgtaaattactgatagatagctaacgggaaggtgctgtgtagaatagggagctcaacgtggtactctgtgacaatctagaggggtggggttgggtggaggtggggagaggttcaagagggagggtgcatatg

SEQ ID NO: 35943 - DNA, 1260 bp, Bovine  19866880746951
acttgcttatggtggatgaaatacttgcaaacatggtccaagcagagacttgaaaataacttgcctattgtgtctttctctattcatgctcttggactttttcatttaacatgtggacaagcccaggctttctggaagataagggaccacagaatgtgcctccagtcatttcaagacatggccatcacaaaccaaccaactccagccaactcacttgctagcagcagatgcatgaatgagcccagccaagatcaactgagccccttctagtccagtagaacagcttagttacacccagttcacagcaccaaccacactatcagggctaaagaaatggttattgcgtaaagccatgaaattttgaggaagtttgttacacagcaaaggttaacagaaactgttttcttagcctgttttgtttgacttcaaaaaacagataaaatgaagaaactcttaaaattctcctacctcaaatttttcaggtgccagcttgattttagtaagtagcacttcaggaaaaacatactctgttccaaatgtgccacttagagagaacatttcaaatctcgtcaaagcagtttctactggctgtccacaagttgtcacatcagtagatctgcatttcagcattgtgcatacctgtgtagaagagatgcagataaaatccaacaccttgaatctaagttacttgtactagaactgttgactcagtttacagcaaagaaaatattttctccatttgctaaagggatttggatcatacaattacttgatttattggaaatggcaaatgattaagagccaacccacacatcctgggcaaccagtggattgaaagaaagaagccagttttcataataggaaagaacaaatccgactccatattggatctggttcttttactttaacctttgtattctattgtttttgctataagtccatcactaaatggagattggtgcactcagttattcagtcatgtccaactctttgcaactccttggactgtagcctgccaggcttctctgtccatggaatttccaggcaatattactggagtgggttgtcaattcctcctccaggggatcttcctaagtctcagatatctcctgcattgccaggtggatactttaccactgtgtcacctggaagcttaaatgggagggtgtctataagcttaaattatacataatgaactgtctctgagaatagtgcctttcatgtaataagctaaaataccctttgtttagctcataggga

SEQ ID NO: 35944 - DNA, 929 bp, Bovine  19866880773240
atgcctttttccttattattactcatctcttgaagcatccagcccctacttcctttctttatgacagtcagcctacagtactttttgttccaacaggtgtataatgatgtatctgattacttatcacaaggcattttgtgttccaagacacaaacagaatgccagtgtaaggagtctagtcctacttcaacatggactgtttttaaattccttaactgagaaatttttttggtagatgtgttttagtttattggtgatcttgtgcaccaggcatattctgtctatggtgactgcaaaatcagcttacagtactgactgacactccttgtttaagcttgaataagaactatcagctttccacctacttgactaagcaataaaattatacttacatttcattgtgtgtaagtgaaaaccaattacttcatgacattattcttataattcagaaaaagaagccctctccatcagaatttcagtgtaatagcagtagaaacattttcttacgacaatgcagtttccgtatcctatgtacaaaatttcagtaaaagaaatatctatagaaatatgaaatcaaaacttagaatagcacatgaatgggacgatccaaacacctgtcttcagagatgagatacaatgcctgattagagactttatgttaatgattcgacaatatccactgtgtgtttcgttaaaacgctgcactgatctcttcccaattcccatcatgtatacaaaatgacatttgtgatttttttaagcagtagagcaatatattctattcactaatactgtaacaaaaatgaagaatatattacttttaaaattataaacatccataaataacattgactcaattttacagtgccaaataggctactttggagagcactcacttagccatctacattaacactaaaatcaccatt

SEQ ID NO: 35945 - DNA, 1664 bp, Bovine  19866880777483
ctccactcccccaccaacttcctgatcctctccatggccaccactgacttcttgctgagctgtgtggtcatgcccttcagtatgatccggtccattgagtcctgctggtactttggcgatctcttttgcaaagtccacagctgctgtgacatcatgctctgtaccacttccattttccacctctgcttcatctcagtggaccgctactatgctgtttgtgaccctttgcattatgtcaccaaaattaccatctctctcataggagtctttctactcatcagttggtctattcccatcttttttgcttttggcctggtattctcagaattaaacataattggcgcagaagactttgttgcagccactgactgtacaggtttatgtgtgctgatatttaacaagctctggggggtgctggcctcctttatagccttctttctccctgggacggtaatggtgggaatttacatacatattttcacagtagccaggaagcatgctaggcaaattggcacaggttctatgatgaaacacattgggtcggaaagcaaaatgaaggcatcaaccaaaacagaaagcaaggccaccaagactttgagcattgtcatgggagtatttgtgttgtgttggctgcccttttttgtcttgacaatcacagaccctttcattaattttacaacgcctgaagatttgtacaacgtctttctctggttgggctattttaattccgctttcaatcccattatatatggtatgttttatccttggtttcgcaaggcgttgaggacaattgtctcaggaatgatcttccaccctgactcttccaacctaagcatatttcctgcatgtgcttaggtaatgctctccattttctacaattctttcctactaaggaaactggatgttctttctccctagaggtaagggagtggattgactagacaaggatattcttccatttggtgtaatagacacccatgtattagtcactcagttgtgtcagactctttgtgacaccatagattatagcctgccaggctcctctgtccatggaattctccaggcaaggttactggagtgggttgccattcccttctctaggagatcttcctgacccaggaatcaaacactgcattgcaagtggattctttaccatctgagccaccagctgatgtaatagacacttaggtagaagcaaagatctagccttctggttataccagagttcccaaagtggtcaatttctggggttctgggagacacctccagtaaaaagacactctctcccaagacttgttgactcccgaatttacaaaattagagatttagattttcactcctttggcatgtcagatggggatcttctttttatcctgtaaacatcaaaagaggagacagttggacttcacacttttaatagccatgtagagtttatctaagtctttcttgagattattacattttgggagagtggggagagcttgagaacactgtgaggctgaagtacagagcatgtgaggacatggaaaaggagaaggaagcagctgcagttgcttccagttttactgattctgatttaatctcttaaaaaagatttcaagtggcttttgcaatagtttgataaaactggactgtctcattaaatgagcagaatggataaagaa

SEQ ID NO: 35946 - DNA, 1467 bp, Bovine  19866880859638
cattggagaaccattgctttaggagacagttaaaataagttaatgaagacattgagaccctgagctagataaacaacaggcaactttctagagcaacacttaaactacgatggcctcccttctagaaaaatgcttagatttgggccacccaggttatgatgttttcccagactttgaaatctttttcacacagtctaacgagaaacttggaggcatgacttgccaatatttgatcaaaaataaatgtgctgttttcagataggtccttcagggttggctgatattagtccactatgtaacagttatgggagagagcaagaaatcttgacttacgcacagcgctgccgccaacgtaagcagtgccgaaaaccaaggaaatttaaagcacacggcttattgtcaggtttaacttgttttacaaacccaaacagtcatccaacttcaaaaaacccatttctgttttgataactaatgtttaaccataaaaacaaaagaaatgcatttttgcatataaatatatggtaattaaaatttttgccaaagaatttccaatgcctgatatgggaaatctttagaggaagtgatgaaagtgacagagaatcatcacagagaaatgttaacaaagcagtatcagtaaggaactaagacaccatctaatttctagactagagatatacatatatggacatgaaatacaaggtgatattgtcagcatactgtctctttctacagaccttctatactgctctccttacttaaactgtataaatctttggttgaatacagacttggagcatgaagaagatggattcagatcttaaacctgccacttgctaaatggcatgctccctcacaggaatgttttgaagacggtgtctggcattcttggaactcctgccactccatcatttggctctgactttatcctatcagggtgctatcaagttaaatattagaattgtttatctctggccattaggctgcaagctctgtgtgagcaagaagcctgtccatcatgtgccacatcatatcctcaaccctgcatgatccctggctcttaatagccacttatttgttgaatgaattaataagatgaatgagtgacatattagcattgcttctcagccttttcgttcctttcaaagcccacttgaaaccatctttacatgaattttttctatactgacatgaccactgtattttttattattgttcaaaactacttggggttcattattgaggtattggtttggacacttggacctatccatgtgagccattctacttgagtaggaaaatcaagttgttgactttgaaaatcaggagcagagcatttaaaataacatgcaaaaaaaaaaaaatcatttcactaccaggttaggaaaagaaattgaaaaaagatagcattttgctctgggacattttcaaagttttttctttttgagcttaatgtcaatctccagtatt

SEQ ID NO: 35947 - DNA, 866 bp, Bovine  19866880970633
aaatgtatttttagacatggcatcagtcatttagagcttgcaacagagattgaaaacatgaaattggacaccttatttcccgtggctatgtaaaatttatttacaccccaaatcataatataaataaaaaggaaactttcagaaatggaggtcttattcttctttttgtttaactcaaagaggtttttgaaagaaaaaacaaattatagcaaaatgatgaactactgatcctccagtcttccctcacaaaagaaactttgacaaaagataatatttttcaactgacttctacaaatcctccagaacgcagtatctgtatttcttaataggaataatgattgcttttatacaaaattctttttatacgaatctcagggtttttttttttaatttttaagcttgaacataatacttattctctaaatatgtgcatatataaatttttattgtgttaaagagaaattaaatctctaatatcctgtataatacttattcataaaaaagaataatcaagtaaatcttttaatttcagttataattgtgaaacaattgctaattatggtgatcttaggttgacatgtactattttcagataactggcaaaggaaaactatctcttgaaaacctattattttagacctttacctattattaaaggcaaggatacatccctaataatcaggggggaaaaggaacagttttcagataatctaattacattactttcaaagctgtaactgtcaaaggttttaaccctcacctacagccatttctggaaaaaaaaaaaaaagttatttgactctgaatggctcacaacttttaatgaggcggaacaaactatttttatggtttataataacaataaa

SEQ ID NO: 35948 - DNA, 1348 bp, Bovine  19866880990088
gtggaattccatgggtttgtttccatctgattagaaagcaaatcacccccacaatcattagcacagaaaactgaataaattcaaattgtctttaatgtcaaatggaattcagtcataaatctctcagttcccctcattcccatcagtacttctctcttccaaggccatcattacatttaaaatgtctctgaatctcttctgctcctgctaacagacacacaagtagacacatattatatggcaaacaaggctggagccagaatttgatccacatccatctggcccaaacatcaatcataccattataccatactgtgacatttcagcatagccaaataaaaaaggcaaaattactgtagcccttaaaaataatccttgatgaagaaaaaatatttggaaatcattggtctatactagtgagctagtcattcaatatttcttagtaaatctgagatgaatcaatgaatatgataaagcaatgttctacagcatcacagcatcccgcaaggttatgatcattaataatgtgggaatcatcaggtacgctgttgctgagttgctggtcccgcctgagatggaatgtgcgtccttggcgtaccatctcccaaagagcgacactgttaggacaggctcagataatccattcttgtttaccaaacgcccatcttctagtacctaaagaaaaagtgggaagagtatagccaacttaattaaaatatacattacaagcagactcatgattctgaaaccatcctagatatcacagttgatcaagtaggttactaggaaaagggcctggggccagggcttggggagcaggtgggaagggtaggggacagctattttatatgtaaggaagactagagcctttctataaggttcaataattgagtttacacaatcaaatgtaacacaacctttaacagagtcagaaatcatcagtagcaaaaatttatcaagtccaattatattcaggataaccaggagccagaagagtacagatagcactcttccctcaagaagcttaaaagttaatggtaaaactgagcagattccaaatataaagagagaaatcagtataatagtatcttggcaagagaagcaggtatgtgcttaggaagtctgagagggaatagctgaactggtcagcttcccaaattgggaaacaacttgctacaaggagggagcagttgggagtttctccctggggttatattatggaagactgtgccaagtggaaatcaagcagcaaaggctcattctaaaacaaatatgtttttccttctggcttacttcactctgtataataggccaatacagtatactaacgcatatatatagaatttag

SEQ ID NO: 35949 - DNA, 3194 bp, Bovine  19866881199483
gtaccatatgaatgtgagagttggactataaagaaagctgagcaccgaagaattgatgcttttgaactgtggtgatggagaagactcttgcgagtcccttggactacaaggaggtccaaccagtccatcctaaaggagatcagtcctgggtgttcattggaaggactgatgttgaagctgcaactccaatactttggccacctgatgagaagatctgactgatttgaaaagaccctgatgctgggaaagattgaggggaggaggaaaaggggacgacagagtgcgagatggttggatggcatcactgactcaatggacatgggtttgggtggactccgagcattggtgatggacagggaggcctggcgtgctgcggttcatggaatcacaaagagttggatacgactgagtgactgaactgaatcgaataaatgcagagctctgtcttcggtctactgggaacagaaaaggtattttcttttctgtttaaaaggtatttaaaaggtatttaaagtgtatttcctaagacaaagcattcaatctgaaaatataataaaaactgtcagttatggaagacaacttttactaacttttaaaaagtgcacatgaaatattcagcaaatatttgttgggtcctacaactacacaaaggcttccctggtggcttagtgccaaagattctgcctgcagtgtgggagccggagaagacatgggtttgatccctgggttgggaagatcccctggaggagggcatggtaacccactccagtattcttgcctggagaacctcaaggacagaggagttggcagactatagtccatagggtcgcacagagctgaacacgactgaagtgacttaagatgcacgcagaggcatgcaccactacagggaacaccatgctagatatgtgggcgtctggggaagagacattctatgcagagctgtccacgcacagggtgggagatacagggtaaagcagggctggtgcccttcaaaaccctcttcaaacttctaccatcttcatccaaacagcagcatttctttgcctagcttaccttcatagcttttaaattatctcctgcatttttactgatctttctgaaggcttgtctccacgaggacacaggaatgatccttataaaactgaagtcagagcatgtcacttctctgctcaaaactcaccaatggctactttctcacctaagtaccaaggtcattagcatggcccatgaacccttatgctatcagggccctccaatctgtctgcctttctgcctccatctcctacttttctcctacttcttcacatcatttcaaccacactaactttgttgctgtttctaatatgctagatatgcactctgaccatggaaccttggtatttagaattcccttggcctggaaggttcttttctcagaaacccatatgatttcctccctcacttcctttaagttttgcttagataccaccaagaagccctctggtgacataaaaatttaaacctcattctttccaccatattcatctttcctgttttattttttcctataatatttatttctaccccatattgtagataggttgacaagtgatagataattaaacaaatatctttttttttttatttcaattggctgtttccacacttgaatataagctccaaaggacaaagatttttaattctttttgttcactccactgtccagaactgtgcttggacataataggtattcaaaaactgtgttaaataaaagcaagaacagagatgtcattggttgatgggaaaaaagaaagactaccaaacttcttgaaatggaacaaatgcaacatcctggtgggaattctcagaaggccctaggaaatttggttctagggaaaagtcattcagaaagaaagaaaggcaattcctaatggaagtgagaacagaaggcttgtcatttagaactgaaccttgagcatgggacatggttaaataagaaataattatgatgcgatgcaatgcaattaaaatagtttgttaatattaaggtaaataatattgaactttgtcaaaaatcaaggtgtccctatatgcagacatagttgttagtttgtgtggttttgagagcttttccaaaaaaggaattcctacaattttagcaatagtgcatttggaaatgtgagtcaactgacatgattctcttaaatgtatagttcatatgttttcctttatattataagtaatagcgtacttttatcagacttcatatttcttattctagatttgatttaaaccacttatatgggacttccctggtggtccagtggttaagactccaggttcccaatgcaaggggcccaggttcaatccctggttagggaacttgatcctgcatgtagcaactaagctccagaacagccatataaatttaaaaaataaaataaccaccgacacaattctgctctatccacctcctaggtcctcatcttaagctttaagaatttcatatacattcatgttatccaactatcttattgatgagaaagggaaaattttaatattaagctgacatgtgactctgtttcactattttctcacactgttttaaaagtacagacctacacaggaaagcaattttctgctcactggtaaggagtcagaagagtagagtttggatatggttcttcctctagccaaacaccctgtgaccttaagtagattatactatcatctctccagattcattccctcagtggaaattcacattggaattagattctgatgtcatcttatagcactaacttcatattcactttcttaatacacatatttgtaggagatgaaaaattataaaactatcctgaaacttacagatgatagtgaagcttatacaatgatctacaaagttttctcagattaagttcatgttcatggttaaattctccataatacatttccttacctgtcaggattattacaagggatccagttcacttgagggtctgggatatcctccaagtatgggtagatagattccctggtgaagttaaaaccataaatgccatcttctggggtcacaatgatatgtgcaccctgttacaaatgaagcagaatcaatatattattcaaataagcaaacaataaaagaggaggcctgcaagaggacctgagggcgagaaaattgcttttttttttcatctattcttcgtttt

SEQ ID NO: 35950 - DNA, 3804 bp, Bovine  19866881222071
aaaattttcttgtttgggaaatactgttcagaataaaagttccaaatgcccacaaccaatgctcttaactcaacacgcatgttatctatggaggtacaaagccagttgagagctgaagccaagaatagaagtctgaacagacataaactcccactgggcagaacagttttctataatctttttaaataatcttcagaccagcttctatgaatcccttaggaacaggaccctaataaagtccatggcctatgaaagctatttataaaacttttctgagaaggttacacaaatatattgtctcaagcactgtgtaacgaaaagttataacctattccttagaggatatccaagtttttaacagatcttaaagctatctttacgtaggttagggatttgcaaagaaaaagtagtctgattatactttttatatgtattcaaatctgctgtgataattctttatcatcataataaccaccatcatttatcttctagacacttacatatattttctcagttaatcttcatacacacacatacacacaaaactatgaaacagtaatagtatttctattttagagaaaaagaatggggatttaaataaactaaatgacttctctagcatcttattatgataactaaccaggaaaaccaggattcacacctaagcctccaccccaattactgaccataaagccagtgtgggctgagcaatcattatatgtgtgtgtgtgtgtgtgtgtggcgcacgcgcgcgtgcacactgaaatacccttatcaagtagattggtatggacactataacaacctatactgaccaatctgatgcccagacatcagccttacaaaaaccaaaaacctgtcaaatcccatttttaaattcttcatctgtaaaaagggatgaaaattagtaccagtgtctttgtttacaattatttaatggggagacccagcatattgaaaaagaaatgtggaatgggttttaaaatcagatattccctccctactaagtataggctcagtggtaaagaatccgtctgccaatgcaggagacgaaggttcaatccctgtcagaaagatcccctgaaggaagaaatggcaacccgttccagtattctggactgagaaatctcaaggacagaggagtctggtgggttacagtccatggggttgcaaagagtcagacacaattgagtgcacacacactaagtatggaagccaggataaacctctgaccacattatgattaaatgtctatggttttcatgtattcaaattcacacttaagtcattatttctgataaagtaatcctgccaatgatattagctgccaagtggtaagctagatttcaagttcacctgctgaatccataaatgctatatttatgcatttgttaacccaagattttaatggaaaaaaatgaacatattaataaaatgttctatttagaatacacaagtcaaatttatgccattaaggaagggttgctttctcaaaatggggccggggtcggggaaaggcaagcactacccaaagcagattatatgcagacatgaggaaattaaaaatgaaaatgagcaacagaaatccatatttcagaggtaaggtttttgggaaatatctcctaaatgaaactttaaataatatagaatttttaaatgaaagttgaggctggaatgcaactcaccaatgtaaaataatcctttgaatcttttcttttctaaccagagtaaagacctaacataggtagcaagaaaatttctcaatttcggccctcattttctcctctttttcttaaaaccaatacatggtaattcgccatggttaaatttcctgaaagaagctaagaaagcatacaagttctttacacacatgcaaatttatgtatatagatagatagatatagagatatagatattgatatatgtgtatttcaccaaaatatatcccagttgcacactgaaggcttgtattccctggaagctgccccctcaaggaaagcaaactggatactaaatagaagttgaggtcttaagatcttgaggtccatagatttaccaatctaatcttttctctcctgtactaatattgcaacaaaacagatggtaatagttcagatgcatatatgtaattttttctgcctgagatctgggttccttattccttatcattaagatcactttagaaatttgagaagaaataaggaagatgagtctactgttcttagaaaatcacgactccataggaaaaataaaaatagagattagaaatcccccagctggggagtcaaggtcttagttaggcatgtacagctttctaaatcccataaaaatctcaacatctgacccatttcatttttacaagggaaggggcgattgctctggaaaatatgcgtaaaaatccgcagcattcagaggcattaaacagttttatttcacatttgtttcctgtgtatcctgcttgatagacacactgcagcacctgctgctgtaagtctgctcttcgtcagcttccagccttctcagttcagaaagcactggtttgagcagcttttcccacagctgaggtcatgctgccctcttctggtcactgcacagaatgtcctgaaatgaccctcgaaaggaatgcaaagtggagaactagagattgttgtctcgtttataaagtgtttttcagccagtaaattaaaaccaattttattcaagatggcaatgctataataattttaaatttggtatgttttagatagaagctattcctgagaagttttgaagtctttatctacacattaaattgatagctctgatgtttttgaatatggttttcatattacctaaattttaatgatctattttgtacaatgtgaacataaataaaacatttaaaaatattaaaaataacaatcatgtatggtaaactgtaatattggctaaggcattctatttctctccaatgaatccaaatttagaaacactcaaagggaagcaaggaagtggaagacaaaagctaacaacaacagaaattacactggaatttcaccaaagcacaaatacaagaaaatacaggcacttttcaaaaggttctttttgtctctaattttcagaatctgaaaacatatccactagcattccatatctcaaaaaaatagtttttcttctgctcttgttattactacaaatcaataactggcatgttaatgcaattgtctttccagatttttgtggacaggaactgcatgttagtctagcatgagaatctatgtcttaggctcattcatcttaaagagatctttaaaaagcaggttcttctctgcaaatattagcaacgttctgtcaacactatggaatggatacctaattctggattattttttaaaagtccaattcccctaacaaccaattatagatagcaatattcctttatttataactgcttccaaaaattacattaattttttactttatttgatggcaaggcaaagaactagctgtaatcttttgtaaaatactctttcatgatttcaccttcaggcaggttttcttcacatcactcatttctggacaaatggctcccctcgtctttccttctctttaaaggcacatccttgaatctgctagttcacctgtgtattaagggcccagcaaggattctgttgttaagtccctaattcaggagactccattgtcctacatcactgctggtggcctaaattaaagggaacaagtgcagatcaggaaaatactgcacaaactcaaagtgtatagtgcaaatgatggcctgagggagatgatgcttatacatattgg

SEQ ID NO: 35951 - DNA, 970 bp, Bovine  19866881278437
atcatagcacttcatctttagatacctacttactaaccatgtaaggacgctttgatgtttaacattgccacaataccactatccctctgaaaattttaacctcatttccttaatgtcatcaagtacacagccagtgcttacagtctctggttgtctcataagttttttatagataacatgtttgaattgggagtcaaagtccatgaatcatatttggttaatatgtctcctcagttttttaaaatttatagtttttcccctccttattgtccccttttgtaaatattgctcaaaaaactgagatatttgtcctgtagtttcccacattctggatttttctgattttgttcttgtttaataattcttctgttccccttgtaaattgacaatatagtttaaaggcttgagtaacaccacattttcaaagaagatggcccaaaactatcctcttaacccttcactcacaaagagggtagaaagagtaagagctagaaatggagatgatagttgaagagagggattgttatgctgtcggtattttcacctcaaatcaagagaaaaggacctgttagctacaaacaatgaaaaaaggtacaaaacaaatgatcccattaatattaacaccaaaaaattgtttataagaatatgtttaatgaaagatatgtaatatctctacactgaaaattataaaacacgttagtcagtgttaaacagatggttatcaaattaacaccaaatacttgtatctagaaaatatgctccagtaatttttggaggtgttatatatacttaaatcaaagtagaagcacaaaaggtggtgtcaatttacttgcacatacaaacgtgctttgctcatcctcagtaaaatagactcatactcttatggggatttcacatcattttaaaatatcttagtaacagtccacacattaaattttcttttcttttgtctccataaagagtaaacgcg

SEQ ID NO: 35952 - DNA, 1337 bp, Bovine  19866881292343
gctgttgtggtttgaaaataacagaacaatgtgctgctgcttcaccagccggttaatgacttgccccgtggttaaaggccccaaaccacacggggcaagctgagctgagccactcaggccagggctgcccggcggaacagcacaacaataggaaaacattttgtgttcattatccaattcgtgctgagctgatttttttgaagctttattaataatttctccatagtttatgctctcctgtttgttttacaaaaagaaaagacactgtaaagctgcggagtcagcaaagagcaatgcacagaaaaaagttaaaaggccagacctaaccccaaaaaaccttaagctctggactgaagatcagctgcgggtggtgcggggacttaaaaaaaaaaattgtgccactctgttagaagaagaaaaataagagaagaagaaggagggagggaggaatcaagagacaatctcaactccacagtgtctgtttctcaattcataaatacatgacctggtaaagcatgaatgcagggtttacactgaagaacacaatagtcagtgaacacatgcctccaagcctcagagaactggataaagatagaggctgacaaaagtgcattttagtattttacaatttttatttcatattggcattttaatctttttaaacattgtttctactgtacaatccccaaggaaatacacatgcatctgcaacagttatttgctgtgatctaatattacacctcttcatgggaaatagatgtggaaacagtggcagactttgtgtttttgggctccaaaatcactgcagatggtgattgcagccatgaaattaaaagacgcttactccttggaaggaaagttatgaccaatctagatagcatattcaaaagcagagacattactttaccaacaaagatccatctagtcaaggctatggtttttccagtagtcagagttggatcgtgaagaaagctgagtgccgaagaattgatgcttgtgaactgtggtgttggagaagtctcttgagagtcccttggacttcaatgacatccaaccagtccatcctaaaggagatcagtcctgggtgttctttggaaggaatgatgctaaagctgaagctccaatactttggccacctcatgcaaagagttgactcattgcaaaagactctgatgctgggagggattgggggcaggaggagaaggagacaacagaggatgagatggctggatggcatcacggactcaatggacgtgattttgagtgaactccgggagttggtaatggacagggaggcctggcgttctgcgagtcaggagtgcaaagagtcggacacg

SEQ ID NO: 35953 - DNA, 1696 bp, Bovine  19866881360922
aaaatcccatggacagaggaggctggtgggctacagtccacaggtctcaaaagagtccagtaagacttagcgactaaacaacaacaatcatgaactagatttaacactgttttctctactactttgccaataacagaacaaataaagataaaacatgattgcccagaagtctaaagttctgtgcttctggttttctaaaatctataaataaacacattttctgagtaattttgtgcaaacagatcaagcttaaaaaggttttctactggtttgtgaaagtgaggaaattggatctgcaggggacctgtcgggtcattctcttgtgctgggctctctgctaaacttcctcattcttggctgagtctctaaagaaaaggaaacgcacactctctgggagacagcttcattatatttacttttcaattctctcttgaaattttttctcaagtcaatccttttagtaccatattatgcaatcttactctatctttcatgtttacacccaaccttcagctgtttataaacagataccatgcccacttttagtcatctgttagccacgttaaacaaatgtaaggccttttaatctggtttcagttcagtctctccaagcccttaatcatccttattgcttgtctctgaactatttccagtttcctggatgttcattttcattagacgaatcccacactgaatgagttattacaggtgtggtctcattaacatagcacaatgaatcctacatttattttttctcttgtggcattatgttctgacttccgggcaaattcccaggagctctgcgacttccatattctgacgaacttagtgtaatgtttttttcctcattttcacctcacacagtgtttcttttagcaaactgtaacaacctgatttcttctccagtacttcaaacacccagttttaaatgatagtagaagtcaaaatatgagtaagattacttcattgtgcttttgatttcattggcttatcaatacctacatctcaaaataggaaatgtccagtcaatttctttttgcatacaactcttcatcatatcggagaaggcaatggcaccccactccagtcctcttgcctggaaaatcccatggacagaggagcctggtaggctgcagtccatggggtcgctaagagtcggacatggctgagcaacttcactttcacttttcactttcatgcattggagaaggaaatggcaacccactccagtgttcttgcccagagagtcccagggaagcgggagcctggtgggctgccgtctatggggttgcacagaattggaaacgactgaagcgacttagcagcagcagcagcttcatcaatatagtcttatgatacacatctgcctgtgaaaaatgtccactgattataatctgaaagtctccaaatgcacaattcaatgattggtggaaggaggaagattacagatggcaaataaactgatttgacaattttaaagtaatgtatttggcatagtcaattccagtatccattcattttataaaatcacaaagttaggaagattgctaaattgcagaaatccatttaaactgaatatttttgagtgaaactattataacaccactgaaaactataccaaaagctttataatgtccattccttccactatattttatagcacatttagaaactatttatacaatgtttttcaatt

SEQ ID NO: 35954 - DNA, 2407 bp, Bovine  19866881406298
aacctgcaagctccagcaagctgtaaattttatctccgtgtgaactagtttcaggtttgaaatgacaacttgattttttaaaaaaaaatcagtaatcctaactgtaaatgcaatatttatcagagtggtatgctggtaaatgttttaacaacaggttctctgggggaaacagccctgatatgtaatatgtcccagtttccaccgtgtcagtatccccaccatgatcaatttcaagctttccgtgtgacattactgaatgcagagaagggaagaggtgaggagtgtcacatcattatagaataattccacagtcaacataaaaatgtcaagagcatcagtaattgagaaatggtgaaaaatgattatcaaaacgtgagttatgcatatttattgcctttgtttacagctatgtttgattgctgggagaaatgtcaataacctcagatacgcagatgataccagccttatggcagaaagtgaagagcctcttgatgaagatgaaagaggagagtgacaaagctggcttaaaactcaacattcaaaaaaataagatcatggcatgcggtcccattacttcatggcaaaaagatggagaaacaatggaaatggtaacagactttattttcttgggctccaaaatcactgcagatgatgacttcagccatgaaattaaaagatgcttactccttggaagaaaatctatgaccaacctagacagcatattaaaaagcagagacattactttatgataaatgtccatatagttaaagctatggtttttccagtagtcatttatgaatgtgagagttggaccataaagaaagctgagcaccaaagaacggatgcttttgaactgtggtgttggagaagactcttgagagtcacttggactacaagaagatcaaaccaataaatcctaaatgaaatgaatcctgaatattcattggaaggactgatgctgaagctgaaactccagtactttggccacctggtgtgaagagtcaactgattagaaaagaccctgatactgggaaagattgaaggcaggaggagaaggggacaacaaaggacgagatggcatcaccaactcaagggacttgagtttgagcaagctctgggagatggtgaaggacaaggggtcacaaaagttggacatgactgagcgactgaactgaacgatgacagttatgttaactggacatttatataatttgttgataacgactgtgcttaacaaccagcttccaatatttctgaaaatttaacaattggctcttacaagctggtagatactggctccagcacatacggtccaccagcacattatgaatgaccacttaatacttttctactctgtctgtggtcctccgtccagtagcaacagcatcacactggtagccccctaccccacccctcttccagaatcagcttctgcatttaataaaacccccaggtgactcttgcacacattaaagtttgagaaccactgagctgatgaacaacttgagaggatgcaaagttacatagtagagaaggaaaatatatacacaccttcactttttaaaaggctaaaaacaaaagccttttagacaaaaccgccaatcatcatgatgtttcaaagcgactgcaaagaactgttgcaaaacccataatgttccaagattcttgttcaggtaatttcgaatacaatgcgtgttgtcattgctgtagatttgggaggcagggattctgctgttaaaacctttgagttcaaatcctagctttctgcaaaattttccaggagaggaacagtgggaaaatgatttaaccactttgtaccttaaatatcttatctgtaaagtggggtgatagtaatagcacctacttcattgagtgattgtaatgaactgtgagattaaagtacttacacaacctcctggtacataatgaatgctcattaaactttagtaattattactttttccttaaggggaaaaagttccaaaccattctctatgcatcaaccctcaaacatgtttaaaataagaattatgaactgtttttctcactacatcatctaaaacttgattttgatccgtaacttttatattattcttgttccctaagactcataagaaaatataacaattacaattatttctaaaatatgtccaaatttcagagtgattcattccaaccttagaagtcacctgggattcttctgggaaagtgtcttgcattctttaaaaagagaccaaagaagagaagctgtcttctgcttcgttttgtctcacgtgcagatgctgttgtgaactctgtgaccacagggaagtcctgaatgacagagagaaggggggaaggagcctgactgggaggcagggagcaggagatgacatgagctttcttcctgcagactggagaagctcca

SEQ ID NO: 35955 - DNA, 1632 bp, Bovine  19866881514365
gagaaaattttaagaaaaaagtccctgaagaaggtggaccaagaacaatctggagtaaaaaaattgtcttagaagtaaaaatgaggagttaactcagtttaataggagggaagacaaagactacaggtgtaagtaagtaggttggtaaatttggtggctataaattacagttttcttctaactggttctattttctcagtggaataagagactaactaactaagatttattagcaactccttataagattggggttttcttaagcttggattcctcagctgtgatacagactcactttgcgtgcagcagccacctacatcattcccatgggacttgggcacaaggtgatccaaaataaacacaaagtccatgctacctgctatgctgtgagtcatgaagtcttttgtctctgattcaggcatctcatgtcttctggtagcattttgaaactggggccagctaacacatcaacttacaagtaaatatctcagacatttcatagtttctagttcaaaaggtaacatcagcttaaccatttaagatcacttaagagtacaaagcacatttcctttattttttggaattctacttttgcccccaatcttttccctttctctcttttcttttattgtttttaattttcaagattgggtttaagcacttaattatctcattcaacatttaagacgcatatgttttaaagtctttcagtaatttttaaatgcttgacttttaaaaatgacaatttttcctattttttttttttttattaaaggacggttatttcagaagttttcttttgggtgggaatagtaattgcttctgagtcatagtaagcaattgaattttagaccttgaagaccaccttccagccaagatatttcccaaagaatagaagcttgtgtacctccctaaatattaagtaaataacagcaataattagtaggggactgctttgaactgatgatgcagggcacctcactggggtttaccaaatttcagcttggtaaaatgaaacctagtaggtgcaggcacagcggacaccagggtctgtcaacgtggcaggtcagggagggcccagctggcttctttcaaaggacgcaaccaaacagagggtcttggaagctgtcaaaaagtgagagacatgagcagaataaaatgctctggagctggcaagggataattacatcctgtgcttttaggactgtgggatgtgggttgacagaatcaagcatggaactttcctactcaaaatgagtcaggggataagagtggtgatcaaaggcaggaagtaagtaggtcccaatgcaacttggacctgtgatgcacagtgaaaccccaatgaactatttcccaacttgtaaagacacatgatgaaacaagtgagcatttgtttaattttggaaaacttggtgggtcttatttgggacccttgaattgcccaagttaaaactttattaagtgtaattaactaattatttgaatattcaaatatctatctattttaaggaatttaatataaatttatggagttatagaccattaaagcattcttattgtaagaggtgtgaattcagtattcagtgtgttacatttcttcctaaactcatttaagtaaaaaaaaacatagaa

SEQ ID NO: 35956 - DNA, 686 bp, Bovine  19866881515274
ctttttaatttgatctttcttgcgtttgaagtactcttcaatgacatccttggcctgagactctgcaatagtcctaaaaaaattatatacgattttactaatatgtagaaactctaagttgttagcattagttatactgaagctttaaatacttccatcattaaagtttcttgtggctatctttagggaccttaatgacttcagtatcttttaagcaataacatgacaggaaattctttttttgttgttgtggtaaaaactcgttttaaccttttttaaacatagagttcactgatgttaagtacatatgccttgtaatatagccatcactaacatctgtctccagaagcttttcttctttccaaactgaaactccactcactaaacaataattcactatcccccaccccccaccctccagcacctggcaaccaccattctatcttctgtctgtgaattggactactctaggtacctcagatttggccttatacaatatttgtccttttgtgaccagcttacttcacttagcatagttaagtctttgaggtttatccatgttgtagcatgtgccagaattttccttttaagggtgaatggtactcattatgtctgttctacatttcgtttgtttattcatccatccatggacatgggatgtttccacacttttactggtaatagtt

SEQ ID NO: 35957 - DNA, 1798 bp, Bovine  19866881525396
cttgtgacctgaacagggagcttatcttctttcatgagtgaaagaactgatgtgcatggtggggaggaaaatgaaggatcttttaaagaatgagtcttgagctgagaagctgcaggtgaagccggtgcagccggggccaagcactctggtttactgtgctcgccctcctggcactccaacacccgcaggcaagtcctgcttccatgaagcagtctctcatctagaacacatttaattttaaattcctcattggttttcttcccagataaatcaagaatatcttgaaacagtgtcacagagttgcaatttcgggcattttacagcttctgcagactaacaaaaagttaaatctgaagtcatggttcttaaaaatgaacaaagtacaaaagcgagtcatttgcaaactgtatctaaacagtactttggaattcgaaggtggccagaatactgcaagctctgacttagcaaagacattcagacttacctcttgtcacgtgggcctgcccagccgacctagttggagggagtctagaatcaggagttaacagaggccgagagtaggacgcggccccttgagagggtggtctgtgtacacagctaagacaggggggcttgccagcggggaaaccttactccttccggttttccagcctcctcggcccacctcacgtcttggacgagcttccttcctgtcatccgctgatggcctccccttgctccaaaagcagctgcagtattaggcatgtgaggaatccccctccagcttgtatgacagtgcttcctcaactgttaacctcagtctgaattcctgatcagttttagttgcaacaccctgctactcacatgttattgcctcttcttccctccccaagccataaagaacagagtgggggtgggggaaggaaacctacacaagttatattttcagagaaaccaagacaacaaaaaaatcctcaaaaatatgtacatgtggccaaaaggaacagataagagcagatcctgggtgagaagccacgtgtatggacagggagtgagagggtgttgcagatgagaacaggggaggcagagctccaaatgtcaccagcaagtatccaccagcagaagacggtgactgcaccccgaggtggggtccaggagcagcgctgagagggaacgggggcggctctgctgggggagctggaaaccggaggctgggaccaccctcgggcccccaggctacccatctcttaaagtgtcacctttccctaagaggaaagggacaccttagaaagaagcagctgaacactggggagtcaatggagtgatggggggacaccatggctggaggggaaagccctcctacaccaggctaggttctgagaggcagagggggaaagaaacagtgcctcagggcagcacagagaggaaggggccctagagtagagtctggctcctccctctcccttcacagccaggaaaagcacactcactccactgaataacaacagaaagaacagatatagcaaccatgcagaagactataaaaaactgtggaaaagaacagcaaaactccctatgaggaaaacgcagcaggaaaaaaaaatgtaaccacagaagtggataaggtgaaaattataacccaaaatagcactgaatttttttttttaactcagtgaagcaactgcaattttaaaggaagatcacgcaagagggccagataagatgcaccaatgaagcagaaactagaggaacttagggaagaaaaagaatttagaattcttttctgcaatgaataaaaaatgacaggtcaggatagatg

SEQ ID NO: 35958 - DNA, 864 bp, Bovine  19866881709557
caactgcggtttctgctgatagcttcttatagtgcaaacacttcagggccactggtcataaacattgagttcagtcattagcatgtatacaaatgttctctcctgttattttgggagctctattaaaactgaggcttgccttagattctgttttgtctgtcacagctaactatgcaagttttcatgaattgttgctatgatagttcctactacaatgattccacattggtcctattaatggaaatattgagccatttaataaaatattttggttgaaagcattgaaatagtttaataaaatattttattaaaagaaaagagttcaaccccaagtgtgttttggaatggggtggactcatctgcttggctcactgcttccaattctatatttgtgtggacctcttaatagtgccaacagtagcatcacgcactagagtcaatccaattatgtacttcttgcacaatatcctttctcaacactgtgttgtataatctattcctgagatagtataagtagcggtagcagataggcagatctttaacataaaagctcttccagtgatacaaagtacaagaatctgagtttaataaagcgcactaaattttatctatgattatatcatattttccaaaatatgtggccattctggtgctctttgtcctgagagttggtgcactggacacttttcttgcttcagtgtttgagcatgctcttatattaccaaacagaacagaaacacctgtgctaaaagaagaagctttgctcctgatgaacaagaatatagatgttttagagaaagcacttaaactggcagccaggcacactggctgggacattggaaagaaaatctgaaacttcataag

SEQ ID NO: 35959 - DNA, 749 bp, Bovine  19866881815989
tcctaatagactgagacttgattatccattaaactggaaaagcatttgttttctctgtagtaacaatcttacttgattttttaaaattcattcatttgtaaaatgtgaagataccttcaacttcctcaacccaatggcttacatttgttcagagaataaattcatgcttgcagaaccattcttgaaaaccccaccactcacaatgactttgatggctttcctaaaccaagggtaaaataaagcatagatcaaggggttcatggctgagttataataagtacaccaacagcaaatctcataaatataggccggggttatgaagcccataaaggcatcaattaatgagtcaatactgtatggtaaccacgaaatcataaatgctatgactgtgatacccagggttttagctgctttcctctctctcttggctactctggatttataactgtctgatgatgactctcttttactactgatattttcaatctttttagcctgttgtctggccactaggaaaatattacaatagagaattagcataacaaaggtaggtataaagaaggatagaaaatgtaccaacacccagttttgatttataactatctgacaacctcctacacagttgagggcactagacaattcctctagcccattctcattggcaccctgtgtagaacacggcaccactgtaagtaatggggtaggatccaggagatgctgatgcatatacatgacacagacactgtgaa

SEQ ID NO: 35960 - DNA, 1300 bp, Bovine  19866881873458
gttactgtagctcttattttgaaagaaatgaggcaatagaactaaagcaaacagatctatgtgaattttattccaattgttgaaagcactgtataaattatataaaagaagtgttgtaaaagaaatattaataatagtcctgtagtattactacctaaaaaaagtagtataaaaataatctaaaagatacatttcttaaggaaaactgaatatgggaccactgaaaccctgtttgattgcagagtagggtttttattgttttcttgttggttttatgcctgaagactggttccatgtatgaattatgttgaatatcatggaaagtataattattctatatcccgaatctgcccttttgccacaggcacaaaactgaaggcctagcagatttcaaaatattctcttatctgccactcactttaaacaagatctctggccacaggcctatttagatacatggaaatctgctgtgtccctagtggtgttctagctaactcctggcctgctaccacaggctgtaccgtgaaaacaagtttacacaagattacaaaatctgcttatccctgttttgttttaacacctgtgaaaaaaaatacaagactgtcatgtggcacgcaaaaggctcaggtgtctccctgtttagaagctggcagtcctgaacagcaagaggaaatcaggttgtaatattaataaacacctgccagaactattatattcattggctccatcccagcgaactaatcaactaaacctaacaaaacaattgtctaaaccctaaggcagggtgttaccaacatggctccgagtccaccctgtgataaatatgagaagccagtgtactgtactgttctgtaaagtaggagagcagagtgtctctctgagaaggcagttaaaaataacaatagtaataatagcacagtttctatgcaccaagcaccattgtggatggatcccagggacactgaactgatgggaaaataaacccttcttcttcatggagtgcacgttctggtgggagagacaggtgagaaataataagctcagtgatcccccttcttattactctcatcatcatctctgctcattccctcatagtatttatcagtgaggtggagaatcatggggatgggtagggaacacacgggacagagcaaggactactttaaaatagatggaagacagagcctgctgaagaagagaaatgtggacatctgaaaaaggagaaggaaccaggactgatagaacaggagaagatggacttctccaagataaatgcaggtgctcagagaggggacatgag

SEQ ID NO: 35961 - DNA, 1466 bp, Bovine  19866880454315
aatctatgacagcttttgaatcagtaatcccactacttaggatttatcctaaggatataattatacaagtggagaaagatctgtttatacacccttaactcaatactgtttataacactaaaaaaccagtagcaatctaaatgttcaacctaaggaggatggatacacgttatatacatatccgtatgttatatacattgggatctgtgcatccattaagaatcgcaatatatatttaaatttatgctgatatgaaatgttttcatgcaatatcaagtaaaaaagtagtttacaacagtatatggaaaacatcctaatagaatctagacattcaaaaaatgtaataagcacacacatacccacatatgtagctgtccacagatcccttactaccttccatatgtggatgtgtatttaatataaaatacaggtaaacaaagagtgtatcattttaacaggaatataaaacaaattagatttactgaggaaggaaaacaattctccttgactcctaccaaaagaaagacatcctacataaaaactcatggttagttgttgacagaataagcttttaaatatagtatattctgtgaagtaaaattatcattaaaaagaaatagcaaaaaaagttttcagcagtatatttatgactgagtactttttgctgtccacctgaaattatcacaatattgttaattggttataaactccaatataaaataaaaagttaaaataaatgttttaggcagaataggctataaaaatacctgaaaataaaagggtagtgggattaaaagcagttaacatggattggggcaagagtatacaacattttcaaataattttcctgatcacccaatacctcacacacatagttatacttttagtaaattaattcagtgtttaaaaaagaaccaagggttaatccactaaagcttgtaactaaatttgtatttagtaattataacagcctgtcagtacatctcaagagcaatgcacatgtacaggagatgcttgttcagaagatattgtccacataacgctttggtatgtatggattcaatttagtagttattagtgttaatgacaataaatacaaaaggaataaattagacgttcaaagtaagtgatccaagaactaatgttttcacatttaagaaactccccatgacttttctttgttaaaaaatcaaaacaagcacacaaaacagagaacacacttactaagtgtagaaagcacaacacgtacctgtctgacactccttgtgttgtgtatgtggtttgcaagaggtagccttggtctgtgtgacaggtttgcacaataacgctttgttctttaaaagttttgaagactgggaagacagaagtttcatggcatctgtctgcacacttccctagttaaaaacaaattcagaaaccaaagacagatttttttttttttagtatcttctcactgactataattg

SEQ ID NO: 35962 - DNA, 1369 bp, Bovine  19866880485707
aggcagttaaaatgtcataagtgaatggatcttgttctttgtaggtttgcatccactttcccaacacatgccatctgccaagcattgttctaggaatgggggagataatgcagtgaataagatggatggaattcctgcactttcacggagcttaccttctaatgggagagacagacagtttctgaatcacacaaattgaaaatggtaatgatagaagagctatagaggtacacagtgccttgagagcaaacagcagggggatctgacctagtcagggaggccagagaaagcttccctgaggaagcaacaactgggctgagatctgaagggtgtgtaggagttagcaaggcagaggtggatgggaaaagctttccagatgggagggaaataggccccttgatgggagggattgtgggactgcaaaagaccagcctggctggagcagaggaagcaagtggggagcgtgttgtgagaggattttggaagcccaggaagggccagagcctgcaggccttgttggatgggttaaggcattttatcctaagaacatcaataagccagtgaagagttttaagcagggaagtgacatgatcagatttgtgtttccaaatgaccatttggaggggaactgggtaagaatggaggcagggagaccatttaggaggcttatgcagacatccaggcaggagatgatgttctgaggtagttagattaggtagcagcactttctgctgcaaatacagaaactctggccaacagcggtttaaataaagaggactttattccttcctgcgtttaggcctggaggaaggcgactgcttctgttggttccctggctcgatgactccagggccggcatttctgtgattctctatgccttgctctcatggtggcaagacagctgccctgggtccaggcattgtgattgtattcaagctgaaaagaaaggaaggatggtactggcgagtcctgccccttttattataaaggcaaaatctttcccagagactctcgtcagatttttttatgtatatattattatcgaaatgtgaatcatatgacttctaggtacaagggagtctgggaaaggggaaaggaagttgagaatgagttttggccagtcggcccacagtgatttggtagatatggaaataagtgggcagatctatttttaggaaacaaaatccataggacatggtgatggattgaattattagtcccctccttgcttgtttttccttcttattgattatgtttagtaatggggaggcagcagaaggaatgtgatggtaatcgtgagatataggaggaagtttatataattaaatctatatcaattaatcatctctttaagaaatccagaaatcgg

SEQ ID NO: 35963 - DNA, 1110 bp, Bovine  19866880783586
ctaaagttggcttcagtgctctgcttacttctctggttctgtcttcacttagattttggctggagggatttttattttttttttaccagctcattgatgcatttaagaagatttaaaaatatatttcatctatcattaaaaaaaatcatttatcatgttttcagtgggaggatcaaccaggcacctagtctgccatactgcttgactgacattttgatgagtttctctgtctctgcacctgtgtggctctctaattctctcttctagtcttggagactctattcaaatgcttctgttatgcttcttgacttctttgactacctttcttcacccagacagagctctagattctaaaagtatttagtgctcatctctattaaggcatggaattcttaacacagcagtcatgatttgtggagtgcaaggtcccttgttaaagaaattattgagaatttcaaaacagtgacagcagagcataaagcttgtaagtgtggggctctgtgtgactgcacactcacactcctgtgaagctggccctgagagtaatgactgatttacctctccgtctccctcatacactactggatgggtgtgagagaacactgtctaaagtctgtctgactaatctttatgccccagcaggctagcaaggtgccaggtacaatcagtaaatattcgtggagggaacagatgaaaacgacaccatttcctaattctaatatatgtcaatgcttttatacaaactgtaagagaaaagtagagaaccacacaaaatgtccctatcctttgtgagatgcatttccagtttcagaatagtgaacagaatgtacattttagaactgagaaggacctccctggtggtccagtgattaagaatccgcctgacaatgcaggagacatgggttcgatccctgttccgggaagattccacatgctgtgcgacaacgatgaccatgtgccccaactattggacctgcacgccctagagcctgtgctccgaaataagaaaagccgctgcaatgggacacctgtgcaccatgctcactgcaaccagagaaagcctgcaggcagcaatgaagaccctgcacagtcaaaaataaataaataaaa

SEQ ID NO: 35964 - DNA, 1687 bp, Bovine  19866880825699
gtctcagggtggtctgagggtttgtggtgtcagggtttgtgctttttctccactagcaagtactaccccataggacatgggaaagggagttgggagtgctttgtctggagagaaataaatacagggcacatctcctctgagactagagctgggggaacacggtgcatgcgtgtgtgctaagtcgcttcagttgtgttcgattctttgcaaccctatggactagagcctgccaggctcctctgtccatgggattctccagcaaaaatactggagtaggttgccatgccctcctccgggtgtgggggagaacatggattgatgctaaagagactgagtttgatgagatcttgatgaaggctcagtggctggtagcagcacctgtgtagtgatggggggcgtgggaaaccattggtgtggacattcccaggcttgatgtggccacagacaaagcaaacggggtggtctgggtttctgccaaactagccttttgtgctgtgagtctcagacatgggtcctgcttggggaaggaagaggaggactgtgccatggatgaaagaccaagctatcaaagcatctttccaaggtggagagatgcttctcggtgcttttccaataactacttgagaggccattttggtctgaagtcccctctgcttccccagagaggggtaaaggtggagaagaattgccatctggaggtaggcggttgatatctgtaaggttaccccagttccccctcctggcagggtaagcaacagcctctccagctcaggccatagggtgggccagaggctggacaggccctcccctcccctctatggaagattcccaggagacttcacaatcttcctcattgtctcacatccctcagggtcaggaagttcttcttgttgtctgactgtgtctcttccactactattaatcatgtccgcaaagctagctcttcttcctgacatccctgtgtctaataatggcatcattagtcttccagtcacggctgctgcgaacttcagagtcgtcttcctttctgactctctcccatctcttcccagggttttccaaacctcaaatgtctgctggaactctctcatcccacccctcaaaattgcttatttcccacctcctctgcctttgtgcatgctcttgccttcactgggaattccatctcccttacacacagccatcttgttctccatctcaagcaaactcttctctgggaagtcttcctcggtttccctctactggatctgctcttgccctcatcttaactggcctaacattttggaacctctttccagcacggtcatttattcatctacttagtgaacatttgttaggtaccctctctgggcaaagccccgagctgagtgctggagatccagtgagaaacagaatttggttcctactctgcagaagaccagattctacttcgggagacagatactgaaagagacaatttcagtgcaatgtgatagttgctttcatgggggaacccagggtattctaaaaacgcaatagagaggcataacccagaaaagtcttcaagggaaggcggagcttaatctgaataagtgttagccaggggaatgtgttgaggggtggatgaaagaagattctaggaggagggagcagcttatgcaaaaatacagggacctaaaataaccctctcatggaaaggttggtcccc

SEQ ID NO: 35965 - DNA, 888 bp, Bovine  19866881201560
tgaaaataactgattcaaatatttcattcagatttatctatgcctaatgagaaaaatgatgtggaacttgattctccacctgcaaaagaaaaaaagaataggttttttccagacttacgatgcggaatatttaaaagttggttttattatctgtccgggatcaaaagaaagttcaccgagggccacagtgtgtcatctgtggagaaattttatccagtgaaaacatgaagccagcaaatctttctcatcatttgaagacaaagcattcagaattagaaaacaaaccagtagatttttttgaagaaaaatctcttgaaatggaatgtcaaaacagtgctttaaaaaagtgtttactagttgaaaagtcacttgttaaagcttcttatttaattgctttccaaattgctgccagcaaaaagccattttccattgctgaagaattaattaaaccatatttagtagaaatgtgttcagaagttttgggttccagtgctggagacaagatgaaaaccattcctctttctaataatacaattggacacaggattgatgaactatctgcagacattgaagatcagctgatacaaaaagtcagagagtcaaagtggtttgcccttcagatagatgaatcatcagaaatctcaaatactacccttcttttgtgctatattcgtttcattgattatggttgtagtgatataaaagaagaattattatgttgcattgaaataccttgccaaatgacgggttttgaaatatttgaactaataaataaatatattgacagtaaatctctgaattggaagcattgtgttggtctctgtacagatggggcggcaagtatgactggtaggtgttctggtttaagggcaaaaattcaagaagttg

SEQ ID NO: 35966 - DNA, 1215 bp, Bovine  19866881996035
cttatatgcctccctggacaggatactcccagctcttcaggaaacccacatcatactggaccagccctgtctgctacagagttctggtccagctgcagggagtcatttccctcatgccttctcccatttctcaccctatttctatgccccagcagatgggtactacaatggctcaattactaacctgaacttattgagcatctagcctatgccagattttgtttatacagagataaagcagatggatcctggtttttaaggagctcacaccctgcaaacacatttttatcctactgtgttgaagtatgggaccttagagaaggtagcgactgctatgccctggggttgataaggtgggcaagcttaggtgaggtttcttggaagagagggtgcctgaactgcatcggaggcaaaggtagggggacaggctttccatatggaagaatcctacagtctgtgctgactcctctccccattctctctcctgttgtggtcctggctcctgctaagcccaggaatctagagaagagagcagaggttaagataccctggatgctgggggaggaccaggcagagctgaggagtgagaggtgccacctcatgaacctggctgttaaccaaccagccagccctcatgggacccagctctgtgcttgaatcctttgtgggagaggcctggaggagacagcaggcagcccctgtcccaactcacacagagagcctgcagggcagtgtgccagcccaggaggcaggcttcgtgagggaacaagacctgtgggccagggagtaggacaggccacaggcctgacctggctgagaaactgctgcccagtggacccttgccatagactggggattctgcctgttgttttctgatagcaggctcaaggctggcagcattctggagcccagggcagcaacagcccaagtcccaccaaacacatacaaataaaagaagacactaaggtgcctgaagtcagaagtagccaacatgtggaaacacatgtgctagttgccttggacggatcaactttgagtactcattgctgcaacttaggaggtagggttttgttagccctgctttacagatgacagaattgagacctgtggtcatgcaggtaggctgagagaaaatggttggaagcagatgattgtcttcgcaatacccagcaaaacgtcactctggacttgccctcccagatccttggagctgga

SEQ ID NO: 35967 - DNA, 2566 bp, Bovine  19866880271050
aaatagatgggtaaacagtggaaacagtgtcagactttatttttttggggctccaaaatcactgcagatggtgctgcagccatgaaattaaaagacgcttactccttggaagaaaagttatgaccaacctagagagcatattcaaaagcagagacattacttggccaacaaaggtccatctagtcaaggctatggtttttccagtggtcatgtatggatgtgagagttggactgtgaagaaagccaaagaattgatgcttttgaactgtggtgttagagaagactcttgagagtcccttggactgcaaggagatccaaccagtccattctgaaggagattagccctgggatttctttggaaggaatgatgctaaagctgaaactccagtactttggccacctcatgtgaagagttgactcattggaaaagactctgatgctgagagggattgggggcaggaggagaaggggacaacagaggatgagatggctggatggcatcactgactcaatggacgtgagtctgagtgaactccgggagttggtgactgacagggaggcctggcgtgctgcaagtcatggggttgcaaagagtcagacatgactgagcaactgaactgaactgaactgaatctttttcaaattcttctcccatttgggttattatagaatattgagcagagttccctgtgcttgctccttgttgcttatctaatttaaaaatatttattctatttatttatttggctgcattgagtcagttgtgacacataggatcttcgatcttcatggcaggatgtggggtccttagttgctgtatgcaaactcttggttgcagcatgcatgtaggatctagttctctgaacagggattgaccctgggccccctgcactgggagtgcagaatcttagacattggacaccagggaagtccttgtttgctcttatgaagctgtgtgtcattttgggaagggcactgtgggctaggaggcaagggacttgggatctaatctggtcacagcctggtcactggtcttctctggcttcatttcccatctataagctcaggaggagggagcaggaggaagcagctgcttgtcccttgagtcagcagactgctgacatctcttcacctccctttggccgtcctgattccactttggacagacacacctggagcagggcaggaagaaacacacacacaggttcccttggaacaccatctctgtcaatctgttctgaatggactgtaatgctgggagctcaagtctatgctctttttttaaaaaagtattcatttatttatctggctgcttcgggtcttcgttgccacactgcaggatcttcgtcatggtgtttgggtttctgttattgtggtgcagggttagttgccctgttgaatgtgggatcttagttccccaaccaaggatcaagcccatgacccctgcattggaggtggattcttaaccactggactaccagggaagtccaaaatatatgctcttaatagcaattttctttgtagttgttgccctgctgctgagcccaacagttttctttcctacaaatggatgtcttatgaaaaaaaaacacttaatatagctccaaaatcatgactatggcatttacctaactctgcaggatcagagaaacagaggaaacaaagctggaccttgtccatggaggcagtgaagtgcagtgggtgtgtgggtcctttaacttgacctccttgagcctctgtttcctcatttgcacaaaggggacaatacctttacactgtattaaataagatgacatgtgccaagtgcctggcacatagtaggagctcaataaatgtcagtgctccttcccagggagcagggaaatggctcttctccccagacagccaacgagtccctctttgcctacaactctctgggtttgtttatcttgtgtagtaattaggcaccagcagctgagagtatccaaacctacagccttatcttttccccaggctgcttcagttgatagagggttgggtggtagatgacagcttgtttatccagagagcctgtaaaatattctgttgagcaaacacacagaaaagctcgtttgtcttgtcttttgtctctacaactgcacagttcagaagggatgttctccgatcttaccaactgcttgctcctctgaacgttgttcacagaccctgtctgcccacccctgggaatgctggggctgttccaccccctccctctcaccttgctaacccttggcaagagggcaggctccatttaccacatctggttttggccgcttctctgagcttcacactggacaccacacctgggtgtccatggacctcacccactcagcccattcaagatggaagccacctcccttcccacacttgctccttctctgggtctctgggtcttggccactgggagcactaaccacccactccttgggcctgaaacctgggagaccgtcctggacatcctgctttttctctgctccacatcctaacacctatcaggcccatgttctctctcaaatctctctcctgattgttctcaattcagccccag

SEQ ID NO: 35968 - DNA, 2744 bp, Bovine  19866880407093
aatcaggaagcagaactgttcccaaaaccacagaacatttccccctgagttactccttactaagggacactctttccccctacctctcacctgtggcaattacttctgtgttcttcatctacacttttgtcatctcaagaatgttatataaaaggaatcagatagtatataacctttttcccccctcagtgtgatgccctggagatccatcaaagttgttgtgtgaatcaacagttcattttgtcatcacttttgagataaaaggaatcaggtacaggacacttgagaaagaaattcctttgtgaaaagtctttgttttcaaggcttaccgttactagttctttgcccccctcagagacctgaacagttaatttatttcagtatgattggcaaattggcgagttggtagatgattgattttattatttgatttataagtgttttcctcagtcttacagcaattagtttttccatgggccctaagttttgcacggatctttatgtgtttgagacactcctttcaactatgaaatattcattgtatttttgaggttaatgctaggtgctgtaatgaataaacccctgcaaagtttagtagcttcacacagtaaaattttatatctcattctagcaacagaccatgtatatatactctgtctttaaaatccttttctctatgaaatgatttggagacgcaggtcacttctgctatgaacctctgctatcttttaagaccttgaggtcccctggaaccagccatcagatagagggagagcatggggggtcaccaggctgcaggttagcatgggtcatacttggaagtggtatcctccatttcttccattcctgtgtcattggctagaatgcagtttgatggctggggtcagctgcaaggtagtaaacaggagtagatggaaggatgggaagatgacgttcctaatggcaaccacatctttaaggcagcactacactccggaagagggaaagcacgattattgatggatggctgattgtctctgcctccatctcctgtcaaagaccccatttcagatgaataatctcaacagcaacctaacgggaggggatctaagagttgaagttctagatttgactcttcttgagcaaccaaggcaagtcatgttcactctctgaatctcagccttatattatctacaaacagtgggttaagttaaataattctgaagcctcctctcttacatttaatggttttgtgttgtgacccttctttattcgcagacgtatttgaaaaatctctgcgatcttggctgaaggggaggttcggtcaacctgggttagtctgttcctccaatcctatgtttgccaccatggactcatctttaacctagagtcccagggaaacagaagaaaccctgggaccacacagcacaactgctattgcaatcgggaggattctgacagtttaatcatgagagcggtaaattcagctcctgatacatttgtcactctgaggatcaagaagctggtttcactgtgcttgcctagatcaccgcttgagagataacagacaattctggtcatgccaggaaggaaggaaaaagaaaactgatctttagttctgaccgcctatcctctgtgctgctaccgccattttagagggagccagagaggaccgctggtgagagccgcgaacatctcatgctttcagcccatgatcacccagacctctgttccttagagtaacaagtgagacttcatattagtggcaattgtgctgatcaacactgtgtttacatctggatgaaagcggaggaagaactaaagccagaatgccttctgggcaattcccctcttccttaatggacaggatctggaggaggcgtggctacactgtttccaagtcaggtttccttcggggctgtacatttcgtttctttcatgtctctgaagttgcttttctgcatgcctggggaacagagcaggatggcatttggtgctcttgtcgtctgggttttcaggggtggatgaagcttggatgctcattaagattactgcgcctcatcatttttaatgtgaggcccaaggtaatatttaatgaggctgaaaagtatattaataaaattgcttgtagtaattagcaggaaattataatagtagggtgatggggagattttagaaatcagttaggagtgatcaagaccaatctcgaatgtcactgcttattattttttgctctcaatcatcatgaactacacctttgcatgtttacctttgaaaagaaatctttgatggggctcatgcatattgctattgtttcatgttgttttgttccttgctgagtaacgtagagctagaggagtctttcgaattacttgtcaactgccttattgccccctagaggcaaatgggagctctattatttctacctttatggcctcttacctgaaaagagaggctgtcagagaccagagtccccaaggcttctgtgaaggtgagatgagaccaggagtcctttgtggggcttattaacccagaaagtgtaagtaaaggcaaaaaacccaaaaagctcacagatttgggaggtaggttatgatcgagggtcctaaaagctgtgcaacatcttcaggtttgactgttgattaacccttctctaccagtctctattctgttttacaagtagatttggagctaaaacttctgaaatgaacaagattccaagaaggcaggacttctcaagattaccctggttgaggcttgagctgggg

SEQ ID NO: 35969 - DNA, 2599 bp, Bovine  19866880595691
actgtgtgaggcaacagacctcagggcctttgcccgcactgttctcgcttcctgaactgctcctccccagtcacaaccctcacactttggcctaattagtggccactccaccttctagcttagctgaagcatacactaaatgctcaacaaatctttgttgaacaaatgaatgaataaattagaattgcagtcctcctaacaaacttctatttgtcattatgaattaacaaattcatcaatctggttttagaaccagagtctcatggactcggtcaggcaatcaaactccctgacactgagtcatgagtctggggatctgtgagaatgaggaattggacctagatcttggtgacccactggccccagcttgggctcttaggtagcctctgtctctaacatggaatccatctcttctctggcacccagaaaactgtgtccgttggtaaacaacacagcacctgcagataatgccacacacatcaagtctgatgcgacagctcctgttccaggcatgtttactctctgaaatcaaataacagatgcaaggtggcagggaaggccggtgaacaggaaggaagatctaacttgcccagtccttttccacttaggaatgataaacgcaacacaccatggcgacataaactgtaagcaggctcccctttaaaaatacaaccatcaatctgttgctaagcccacaaccagttgcagtattaatcatattcttttggcaagagaatccatttcccaataaagtttgagtggcagaggaaaggcagagccaaccatcgggaaataaacgatgcttccaagtgatcaaaggaaagctgctcttctccctggcagctcgctagccatcctgctgctcgcagcagacatacataactacacgtgccactcggcttcccccacatcacatttccatcattgcggagtgctccgcggttctgtgctgggcccatttttcactctgcgccagttttgtatgctttgaacacagacctcccctagaaatgaagagtcccttcttaaggacgcccgtcacctctactttcttactcacagctcccttctctccctcgccttctccccgtcctcagccaataatctctcagcaatcacgccaaggagcactgtgttctgctttgcctcctgaaccgtgaacacctggaaggcagagtccaaatctttctcctctttatttccccagaggctggcaccacgtaaacatctgatgagtgcttagacagtggggctttattcacgataagagagaagattctaataaaggaaacaaactcgggaatcagtgaactgctattcacgaagaaagtcgaagcaaccaactctcagatgctacactcgtattagggacagcaggacaaatccccacatgttccgctcttttcctctaattggctattactgagtatttctccttccatacaaatgttaagatctgtttggccaatagcctttggaaatgctatgatgttacttcatctacactaaacttatagattaatttgaaatgaatgacatcctgacaacacttcagttcagttgctcagtcgtgtccaactctttgtgaccccatggactgcagcacgccaggcttccctgtccatcaccaactcccggagcttactcaaactcacgtccatcgtgtcagtgatgccacccaaccctctcatcctctgtcatccccttctcctcccaccttcaatctttcccagcatcagggtcttttccagtgagtcagttcttcgcatcagatggccagcttcagcatcagtctttccaatgcatattcggaactgatttcttttaggaaatttcctgacaacactgtcttccttcacacccataaacacagtctctctcttcactttcttagccttcttttatgccctttagattttctcagggcaaatcgtatgcactctttgagtagatgaattcctagatacattatagttgttgctattataaatgacatcttccatcataatttcttaatttattattgtggtacaaaaaaactactgatatttgtatgtttctatcatctgacaaacttactgaactctctaatactgatgattggtttgttaattattttttctccaagtaaatgatattatatgcaagtaatgatgatttgtctcttcccttcctaatcctttggcctttgttttaatgcattacccaaaatcttatttagtatgtggcagcagcaatcatgggtacttcttgctaaccctgaaaaagaatgtttctaaaatgtgtcgatgaaatatgatgtttgcaataggcttttggaggaaagcctttatcaagttaaaggcaccctctccgtgatagagtgtattgttcccagttgtctgctgccctttctaccaggtccatcttcacagcgcaaagtatagatcccaccacactgataccaagcttggtcatatgacctccttcagccaacgaattgtgaaaggaagcgacacatgacacatccaacctgacatctgcagccatcacttggtgcttctactgctcattccctctgctaaggaatcaccacatcccagagagggcgcctccccca

SEQ ID NO: 35970 - DNA, 1366 bp, Bovine  19866880598250
aacctgtttcttctgatttttcctgagcagagtggcttcactgcagacgcagtgtagcatatacttagcaagtggctgcgtttgtttcaaggagtccttaaacgagaggggattagcttgtgttggagatttgatgcattctgagcctcactcatttgtaaaaatgtgaatcttccgtggtatttcgtctttctggtttaatgctaactagaccatttaagttagttattttcccctggtttctaacagctgcacttgtagattcaggaatgctgcaaatgttgacttttaaaaatggacttatcttcatactttatttctaaatggagacattttgatatccaaatctagtataaatatgactcagtttgatttcttcgaaagaatctgatttaaaacttttggcaagtttgggtaaataatatgtttaaaaactcagtggtgtgctctccatagtctttttatctggaaattcccagtctcaaaaaacaatttcagtttgtaagcttacatccaagtacacagttggggtgatatgctttgctggaacatgttggtcatggtgtccgaaagtcagtggtgaaagcttgtcatcaaaaggcaatttcctttttctttcttgtgagatgtgttttatgagccaggatgatggttaaaaaaaaaaaaaaaaaaagaaaagcatttaaaatcagcctctgaaaagtgtggaaaaaacatggtttgggacgaggaaaggaggagacagttaaacatggatgagggaatcattcatttatgtactagtgggttttggcatctgtacattgagagcaaaaatggatctgagagggactgacttgcgatggcagttgttagcaatgtagtcatttaactcgataatcattacctctggggagctgttagcagtacagtcaaatttgactttctctcctggattgcttgatttgtttcctaataaaagaacaattaatgtgcaaacctggcttggattctgtttcagcaactatcgcaagcatgttcgtagcgaaagcagaccaccgtcttgggttgcagcccgctgcctttctcctctccttttcttcttgcctagccccagcacggctcctgcagactgcagattgccgactgagacggcgtcctctgtagtagtgtgactgtcgcctttcagagccacggccacaggacattacagcatcattcttttgaacacgggatactcccatgacactctggcagcgtgttgctgtggaaacaagagcagtgccatataggtgggtgggtccctgatacatatttatttatggtgatgaagagatggtagaatctcaggcaactatggtgtggggggggaagttaactcaggagg

SEQ ID NO: 35971 - DNA, 1249 bp, Bovine  19866880628045
cctaaaggaaatcgcccctgaatattcattggaaggactgatgctgaagctgaagctccaatactttggccacctgatgccaaggactgactcattggaaaagaccctgatgctgggaaaaattgaaggcaggaggaaaagggaatgacagaggatgagatggttgcatggcatcaccgattcgatggacatgagtttgagcaagctccaggagttggtgatggacagggaagcttggcatattgcagtccatggggttgcaaagagttggacaccactgagagactgaacaacgatgagaagggtgacagggaatcattactctgcctaccacacctttatagaatgatgttggctttctgacccaatagattgcagagctaagtttttctaaaaaccttagtttctcaacagagttcagaggttcttttatagtttttagataaactatccttctgctgctatatgtatgcatttatgaagatctgtttatttgcagtggtagctactctaaatatatggtaacttggacatttttgatggctattatgaattccatgccagaattatgtgtcattagctattctctttacagttcatctagtctgcaagacagaggctggtaagtgttaacagaagactaaaggaccacaagggcaggctttgagataaattatttagtccaaccatcttacttgatccatcacaaaatttgagaattgcaggaaaacttctcctccaagcaccctgatgatctccaagcttgattgaaaggctctgagtgaagggaactcactacctgtcacagcaaattaccccaaggttgaatatttcaatgcctggaatgcttttattttcctgcagtggaaacatgccttcctttagtttacacccacaggctctggttctgtcctcttgggcacaccagttatccttctggagggaggtaaaggcagagatcggatcccttcttctttttattaatttatttattggctgtgctgggtctttgttgctgtgctgggctttctctacttgtggcaagtgggtctattctctagttgctgtgtgtgggcttctcattgcagtggcttcttgttgtgaacacagcctctgggtatgcaagctcagtagctgtggcacatggacttagctgccccatggcatgtgaaatcttcccaaaccagggatggaactcatgttctctgctttagcaggcagattcttaaccacggaccaccagggaagt

SEQ ID NO: 35972 - DNA, 3431 bp, Bovine  19866880665996
ctgctgggtttcccaaattggtgacatattgagtacagcactttaacagcataattttttaggatttttaaatagctctgctggaattccatcacctccactaacttcattggcatcagtgcttcctaaagcccacttgacttcacactccagaatgtctggctctgggtgagtgaccacaccatcgtgataatccatgtcatagctactttaaaaatgctctggctaattcttatatagtaatggtaattaacctagatttaacccataacccacaagcaaaaacatattcacaaaaagtcttatgcaaaactgttcagggaattctctggcactccagtggctaagactctgtgcttttttattgcagtgatccaggtttaattcagtctctggttaggaactaagactgtgcaagccatgcagcatggccaagaaaaaaatgtttatagcatctttattcataacaaaaaactggatacatttcagttggactgtgccaaaatcatacaatggaatttactcaacagtgaatggctaatatacaacgtactgttgttcagtcactaaggcatgtccgactctttgtaaccccatggactgcagcacaccaggctttcctttccttcactatctcctagagtttgctcaaactcatgtccattgagtcggtgatgccatccaacaatctcatcctctgttgtcctgttctcctcctgccctcaatcattcccagcatcagagtcttttccaatgagtcagttcttcacatcaggtggccaaagtattggagcttccgcttcagcatcagtccttgcaataaatattcaaggtagatttcctttaggattgattgattggatctccttgcagtccaagggactctcaagagtcttctccagcaccaccgtttgaaaagtatctattctttgacactcagccttctttatgatctaactcttacatccatacatgactactggaaaaagccgtactactagaaataggtttgactgtgtggacctttgtcagcaaagtgacgtttttgctttttaatacactgtctaggtttgtccttgcttttcttccaaggagtaagcatcttttaatttcgtggctgcagtcactgttcgcagtgattctgaagccctagaaaataaaatctgtcactgtttcaactttttctccatctatttgccatgaagtgatgggactggatgccatggtcttagtttttttaatattgagttttaagctggcttttttgctctcctctttcaccctcatcaagaggctctttagttcttcactttctgctgtaagggtggtgtcatctgcatgtctgaggttattgatgtttctcctggaaatcttgattccagtttgtgcttcatccagcccagcgtttcgcgttatgtactctacatagaagttaaataaacagggtgacagtatacagccttgtcatactccttttccaattttgaaccagtctgttgttccatggccaactctaactgttgcttttcgcagcagccaggtagcatgatctggtattcccatgtttttaagaattttctacaggtgtttgttgtgatccacacagtcactggtggctcagagggtaaagaattcacctgcaatgcaggagacccagtttctatccctgggtcaggaagatcccctggagaagggaatggcaactcactccagtatccttgcctggagaatcctcatggacagaggagcctggtgggctagggtcacaaagagtcagacctgactgaatgaccagcactttcactttcatgcagtcaaaggctttagcatagtcagtgaagcagagtagatgtatttttgaaattcctttcttttttctgtgatccagtggatgttggtaatttgatttctgattcctctgccttttctaaatccagtttctacctctggaagttctcagttcacatactgttgaagtctagcttctctagggttaggcaaaaagggtctttgttttacaatgaagagggaacagggcttcccaggtagcactaatggtgaagaatgcacctgccagtgcaggagacataagagacgtggatttgatccctgggttgggaagatcccttggaggagggcgtggcaacccacttcagtattcttgcctggagagcccccagggacagaagagcctggcaggccacaatccttagagtctcaaaaagtggcacatgattgaagcaacttagcacacttgcaagagacaaggctggaaagaagcggtgtggggaagcagagtggaaaggtgacttggttggatagcacatcaaagaatgtttgcctttgggccagtggatacttaagacagttgtatgctgcctgaggctgacgatgggtcaaagttgaggtgcataaaggaagaaaagaagctgaaacaggtttaacaatcattttgttcccattcatcagtggggacaagcagttcagctaatcatttctgaggcaaagaataggaatttggagcatctatatttggctttgatgtgggtaaacactggagtacatccatgaatcttatcagaatcatctgaggaagtatggttctctgcactaagcagtttcctagacgaaggagtcagggatttctttaaccgatgctgttttccagtatcacaggatccagtaaagcgcagcactgtcacagtttgtaattatacatccaattgtatgactgtctgacttgtgtgtgtctcactcatgaaatgatgttacaggaaaacacaggctgagtctgttttttgctggacaccatggaaaactcagagctgggcatcgtgaatactaacttgtagtcattagtagacaaaggaaagaataagcaaatggattcacaatagtcaatagaaagtttatttctctttttcacatccattaaatgaaggatttatacagctacttcctattctgaaatatttcagttatgagaaaacagttgttttcacaaacacatagttcagggatagaactgatttaacaaagcttttagttgttgagggcaaggtgccttttcatttggtattttgtcttgtgcttgtgaagttctgttgaagtataattcatacaaaaaataattgcagaagagaaatttgaatttgtgaaaagtgtaacattttagtttaattgcctttcttctccatcttcctgagaaagggaattacctctctcatcaattttgagattacacctgcacagtgtctaatgactctcgtgagtttttcttcccttagaatttcacctcacttccatccattctcctgttaagaaattagccaatccacactctgcttctcatatcctgccctaagaacttcagtgttcaatgcaataagcgatacaaacttgctctcattctcctaatgagctgccatttt

SEQ ID NO: 35973 - DNA, 2436 bp, Bovine  19866880738517
tggacttctgaggaatggtgaacaagaatctccactctgtcccgtctccctcttctgtcctcttcctgctcctgaccagcaggggaggccctctcagctcacaccacaccaccacactcctcccaaaacagtaaaacagatttcccaaggcaagggacatcagcacctctgacttctcaggcactcgagaatgacgctagagacgaagtagacacgtgcaagctgatgcatccatctcttgtgtatcaaatgaaacacttctggagaaatgttctcctttgtaagccactggggtacccatcatctctccagccccttcagtgctagggtccccccaaaaaagacatcagggcacaccctctgatttggcctagcagctgagaaaacaaacagcacgtctttagaaacacaactgctgggggcattgggctgcaggaaagctctataaccaagggtggctgagccccaccatctgagatccctttgaggactgaacgttgatctacagacatacaacgtgggtttatgggaacagtgctcaaaggcaggagggttatagctggtctatgggctgcagcagagaccagcagctacagcggaccaagatcagagggccaagttctgaactgttttgaaaagcaggtgctggggacttccctgtggtccagtctggttaagacttaaccttccaatgcagggggtgagggttcaatccctggtcagagagctaagatcctatatacctcacggccaaaacataaacaatactgtaacaaattcaatgaagactttaaaaatggtccacattaaaaagaaaaaatgggggattgacatgtacatactgccatatttaaaatgagtaaccaacaaggagctactgtatagtacaaggaactgttcaatgtcatgtgggagcacagatgggaggggagtttgggggaaaaaggatacatgtacacgcatgggtgagtcccttcactattcagctgaagctatcacagcactgttaattggctataccccaattaaaaaaaaaaaaaaaaacagggtttatatgtgattctaatcgtgtaagaaatagactcagatccatgaaacattttgcagtccatactacgtgccaatccctgggctaattgtttttacccatatgatctcattaaatcctcctcccatcaaaaagatgaataaataaaagcatttgatttaaaatcacagagactgactgctgaaatagaccagatagatcttggatttccaccatgaaatgcagaatgccttcctcatccactcatctgcatagttactttcttttggttctgtccttgagtctagttcaagggaccctaaactccagcgtgcataagaattactcaaccaaacacactttatcacgggggcctgaagggatttttccaagggtaatcttgacagtatgcaagtcccaatttatctgctgacttcaagacccaatcctcactgaggattcccgtccactgagttacaatttatgatcatcacagaaggggaagtgcagcatgcacaggtactggcagagcagtcagcattcagaaatgtcccaggtgatcaaaaacatgaacagaagctctcgggctgtctctgtcactagcaatttaaggatgaataaagtgagtgagttgagtcagagacagggaacaaaatgtaagtgaatggattaacaaattgtggtagatccttgccacggaagactactcagcatgaaatattaatacactcaatgagatggatgacactcacaaacaggagacttaagtgaaagtcaagcgcgaataactataccatatcactccttttagataaaactgtagaaacagaaaagctataggatcaaaacacagaaaagtggtttcctggggcaaggaattggggcacatgtcaggaggcaaagagggggacggcaggggaggagggcttcttgaggtgagggaatgactctgtatctcaatgggatggtggctatataattgtatacagtgaccaaaattcacagcagttcagttgctcagtcatgggcaactctttgcgaccccatggactgcagcacgccaggcttccctgtccatcaccaactcccagagcttactcaaactcatgtccatcaggtcagtgatgccatccaaccatctctgtcaccctcttctcctcctgccttcaatatttcccagcatcaggttcttttccctgatgtactatgatgtaaattcactatgatgtacactaaaaattttatagcctggaaactgtttcttaacgcatttttttttaaagaggagggggaaaaactcataatcctcccacatgaaaagattagagaacctgatcccaaacaaaatgatttaccagtatgggtcagaagctcatacaaagcagaatcagattcttcccttcggattt

SEQ ID NO: 35974 - DNA, 2204 bp, Bovine  19866880747137
tctttgtttggaaaccgcttggttacctgcagtggcagaaggccccctggttgggactcctgaagtgtatccatgccgaccactcccttctatgacaatggccacacatggctgttacgcttccttcccaccgtctctgctctctcccaattcatcagaaggcactatccttgggttcctccaacagatccagagctagcttaatactgctctgacatccacccatccatccacccatcattttgaacccctattttgggtctgaccctatactaagagataggattcttggatttgacaagtgcctactctggagggatccccagtctctgcatgtccacccatgactctccattcagcctccctagtcaggcactttctcccagtatttttcagctagtgctgagtttgggatctctgacatccagccttcgaggaatagttaatgctctgtttgatgctggaccatcacattaagctcccatcccctgttaataggcaggtgaagatggagatgtcccatgagggagaggggctgtctaaggacaaagggcctggacagtgctcagcaaggagcccaccactccctggcctgagaatatgaatgttctccaggtcattacagcagtcaaacgcgtgtcttattctaagacgtatgtaatttctatctgggttgtccctgcccccacccttccaatcactgcagtggaaagaggggcagcttgcacaaagtacagatggttaatttattggcactgagcaagtcacctccccttctggatggcaggcacttcatctgtaaaatgggaggattgtaccagttgattttccaaggccattctttccacgtctgagcgcttattattctgtttaaatctgtttaccatcttatcataaattgaagagcaaatgtgtgtatgtacacaagcattcatatgggtcaatgtggcctgtgaaaaatctgactcttgattcctgctgaatatccattagatcactttaaaaagtaattccaggacttccgtgatggtccagtggttgagagtccacctgccaattcaagggacgtgggttcgattcctgatctggaaactaagatcccacatgccttggggcaactaagcccatgcaccacaaccactgagcccatgagctctagagcctgtgcgcagagaagccactgcagtgagagcctgtgcactgcaatgaagaggagcccctgatctctgcaaccagagaaaggccacgtgcagcaacaaagacacagtgcagccgaaaatcaatattttttaaaaaaaagtaattccagactctcattgttgagaaaaaatggcctctgcagtgagtgtggaggggaagtataccttcactgaccgacaacccatgtgctacacaggcatggaccaaagcctgggggaaagggcacatgaggatgcacgaatgggctggatacaggaatccggggcgatcatcaacagaaccctgtggtctactctgtggaaacgaacaaagtctcgagcatctgctcaaaggcaggctggattatcccagaacatctctggaaatgagagacagccccagtccctgggaaatgaggacggggaagccctgggcagaagaaaaatcaaatctccagctgggccagagctcagggggctcccgaggaaaacataaaatccctgccctcagtcatgagacagccacgcaagctgggtccagggtgtgtctagagaaagacagacttctttggggtgtacaggggagctgagaagcctgcggcacccaaggatggaacctgacctcgaaggaggtaacaccttctcatcacccccagatgtgccaagcctccatgtatcaccgggaactgtggacacccgcttgtttctcccacttctgataaggtcagctgccgcgctttataatgcaagaatataatattcctgctgccaaggcacactgatgtctaaaccaactacctttccctgccttatggagaaagcagctcagcaggggagaggcgagccaggctgcagttacaaggcttattaagacacctaatgaaacaccttgcggcggctgccccctctgaggacagctcagcaaaatgcatcaccaaagcagatgtcaggcttggggcaattgcttccaaagcactaaagtcaggcagggaggcactggggctcgcatcatcctcaccaggtatt

SEQ ID NO: 35975 - DNA, 2244 bp, Bovine  19866880842853
caaagtgaactcttgtataagcttgggtttccccatggtttacatatgaaaaaaaaaaaaaatgtatgtgaccaaactcaaacctgactgggtggtctattcctgtataaagatggttaggaagagctttgaaatcctgatatcacccaaagggccttttcagagctactaacagttaatggaagctatgggatgacaaatgtcaggtcaatataatagggaactttcttaaagcactgcccaaagatgggttgggttgtactaaggggtggtgagcaacctatcactggaatgcaagcagagaccagagagagggatgattgtagaaaggcatcaagcagtgggctatgcagttacagtaatgtatcagactggtgagcttctggtaggaaacacgctaagtttaagtgtttaagtgaaagtcttcagtcgttgtctgactctttgcgaccccatggactataccgtccatggaattctccaggccagaatactggagtgggttgccattcccttctccaggggatcttcccaacccagggattgaacccaggtttcctgcattgcaggcggattctttatcagctgatccaagtgaaccaaatgagatattccaggaaaaagttgcagctcattttaggaaagcagcattttaaacaacttgttgtcaaacccagttaagccaaattaattctttgtttttcttaaaccacctttcagtgttcagtcattgaaacagaggggcagttcagatcatccaaaagaactttagagtgagatctagttttgaatccaggccatttactatgtttgggaccttgtgcaagttacctgacttctttatgctttggtctctttatccatcaaatcatgatatagaaacctatcaatgtggttgtgaggaaaaaagtcatgttgggcatagtacttggtacataataggtgcacaataagttctcagtatgactataattaccacagcatctcaggagtagccacaaccagtaagagacactggagagaaaatcagtcgtgatgtgtataacaatagtggaaatctcatttaaggatgtctgtagactgacaacggagaaggcaatgacaacccactccagtgttcttgcctggaaagtcccaccgacggaggagcctggtaggctgcagtccatggggttgctaagagtcggacacaactgagcaacttcactttcacttttcactttcacgcattggagaaggaaatggcaacccactccagtattcttgcctggagaatcccagggacgggggaacctgttgggctgctgtctatggggtcgcacggagtcagacacaactgaagcgacttagcagcagcagcagcagcagcagtagaagctgcacagtgtcgttacacgtggcaaacccacgcactgtttaaggtgtgtgctctccatgcattgctgtgatgtttgttttccacaggaaatgagatgagagacaggagtttaattcttattgtagtggatgttacttcctaaaagaagttgaaaataaatcccgaatgggcttttcatcattatatcactgtttcttaagctttttccccctcattatcactctcctaaggagcctttttagattttcttttttcctattaatcccacttctccatgaaattaaatggaatcagaatttgagcttcagaggagccccaaactcttgtaatagctaagattattttgcccctcccaagaacaattttcgccctttgggaggcgataggttcctccgtggagggtgcaggatttgtataaagctttgtaaagaatgaagtgtccaggttgggatttcagagcgggggtggaaatcattcttccccatggctttatttagtatttgttttcattggaaaaaggctctcagtaagacttctgaaatttgccttttgctgtgccttacagcagcgtatgttttggggaaagagatttgtcccaaccatggtgcctttatcaagagtgctggtacctgctatacctacactccttgaacctcacagggacagttgtcacccatccagtgattttggaggaaggtggagcctggttggcagtggggggtggtgtctggatggtgagagccgtggggtcagatcctgtcccctgtattggctgctggacccagttccagggacaagaggacagtgctgaccagcaccggtgggaatgaggtatgtgcaagcctttggggatgcgggatttgtgg

SEQ ID NO: 35976 - DNA, 1841 bp, Bovine  19866880856231
ctttataaagatgccccaccccttggcgacctcaggggaccccctgcacgtaaggagagatgttcctagggaaggcgtggtgggcaggtgtacagtccatttcccaacatgggtccacaggacacatctattccagaaccactcagggtgttggttaattttgttgttcagttgctaagtcatatccaactctttgtgaccccaaggactgcaggcacaccaggcctccctgcccctcactgtctcctgaagtttgcccaagttcatgtctattgaattgcagtcggtaatgctatccaactgtctcatctctgccgccctcttcaccttttgccttcagtctttcccagcatcaggggcttgtcaattaattcgttaattttgcatggaactaaatccgaatccctagagactgaggctcaggtatttgactttttaacttggacactagtgactctcaggcatatgtaagtcggtgaatagttgatgtggcatcagaaacaagggaagctaagagcctccagggacaactctcagtgcgctgaggccaggtcagcaacatgcggacatcagcattgcgtctctgtacctacaggatgaacactgagcctggaacatgtatacacgatgtgctttgggcaggattctttttcttacaaatgacagacatctagctcaaacaagcttaagtgaaaagaggaatccagtggcctatttagctgagcaattcatgggcaccttcaggcaaagctggatccaggtactcaaatgccattctctctctcctccttccccatccatatctcagtttggggatagtcagagaaactggacaatgacagcttcatgtatagttctcatgacttaccagtcttcataaaataaaaaatgagaccttctccaccacccctgccaaactctagcaaagacactgattggctggattggggcacattccatttcctgaaataattcattcggcctgggaagtggtagggagggcagcactagaactgaccagcctgtcagtggacaaatgaccacccctccatactggggccagtcaccataactgacagccccctgaggatcagatggagtgggaaaagaaggttttctccaaaggatcttgggcagtcaagtaacatctattcacctcacctatgaaatgaaatattcatgaatgcttttaataagtggtttacaaacctgaccacttacccagggtctgctgctgctgctgcttagtcaccaagtcgtgtccgattctttgcaaccacatgggctgtagcccaccagtctcttctgtttaagggatttcccaggcaagaatactggagtgggttgctatttccttctccaggggatcttcccaatccagggatcaaacccatgtctcctacattggcaggcgggttcttttcctctgagccacctgggaagcccccctctccatcagatgttctatccaatcccccaccacagaccctgtgatttttacacaaccgttgccccttctctgtaccaaagctttttcaaccagtcagatactccacaggcaacccagtggaataaagacgagttccttcagtttcggaaacagtctgtttgagaaatattattttactgtactgtactacagagaaaaacatttcacccaaagtgttagccacacacttcagtccccagaatctccttcctcatgcctggaacctagcaggatgggggcagagccctcccaagtgcatcgagattgtcccatgggtgcccaggccagactgtgcacgcttatttaagccattatcatgtcagataaaatgttgataaatcattattttcta

SEQ ID NO: 35977 - DNA, 1368 bp, Bovine  19866880863784
gaacagcagaaaactctttagacattactcttttgatcataatttaaaatatttgtggcatagggaatgctatgtatttatcaagtctttttacatttaaaaagatctcttcctgtgcatcccagaccacttcattcctgtcttctcttacggtccatcaggaccatgtgactggattgcagtcaactagatgggttctaaaccactttagaccatagaaaaccctagggatgtttcacactcattgtctcttctctttccaagctaacctcagaggccacaaggcaaaaggaccacttggaggagccacagaacccataataaaatgtcatttcaatgagaaatcacttttgtgtgtgtatattaagccactgagatttttttttctttcctgcccccaaaggtaagagtcaaattaaaacatccaaaactggggtggtattggaatttggagcaacaaaacttcttgttactcaggttatctcatacattgaaaaaaactagtagatgggaattccttggaagtccattggttagcacttggtacttccacagcaaggggcacgggttccatccctggtcgggaaactaagatcgtgcatgtcacatgacttggccaaaaagagtctaacaactagtagatgccaggcacattccccaatcaaggaagtcactgagatttcaggagtttgttattgtagtatacccgagacaagccagactcacataatattctgttaaaatcaacatgaatatattaatgagcagaattaaaaattcacatgaatttttaaagttaaaatgcaaaactttaaagaaacatcgtgcttgaggcaggctacactggctatgctccagacccccaagacccacacatgcattcacttgtgctattaggaagacttcagtggaattatcagagacgtaccctaaagtatttggcagagacagtctgtggaatgaaacaaaacccagttctattacttcctcactgactcactgagcaagtcactccccttctataagcctcagattacgtgatgggggaaccattgttattgggtaagttttaggtctcctggcctggaagaacagcaaaatttgtcatggagaagccaccagcccttttgcttagggaagcacctgaatggatttataaatgatgaggctgaccagacacagccgggttgagagaaatttaaatgcttttaaaaaagaagtaaaattgttcattaggacacataacaggaattttggagtccccagcaatctcttgagaagagtccttagaaaggacaaatgggtacttccctggagatccagtggttaaaaatccaccttgtaatgcaggggacacgggttcaaccc

SEQ ID NO: 35978 - DNA, 2060 bp, Bovine  19866880908844
ctttgctgggagaatgggggctctcctgtagattggagggtctttgacagcaactctgacctctactctctagatgctagtaggaactcttcccttcccagttgtgacaaccaagaaagtctccagatattataagagccctggaggggacaaaaccacccctgggtgagaaccatgctctctgaccttgttgatggaataaccagtggacaccaggatctctgattcagggacatggacagggtggacagtagtctgtgatggggctgtggattgaaagtgcctgtttatggtccaggattgaccatctggacacacaggcccatgggaagaccttggcccccaatttaagggctaaccctggcatcctgccatctgtgtggtaccctctctctcctgggtaccttctcggttcctccatgaccttcaggaggtcacatgtatacatatgaatgcatatatatgggagatgttggaaatgagcatctccttccaacaagtgtccaactctctgctcagggtagtactgcagggtttgagtaattggggaaaggagatgtaagagagcgggataatccagcgaggagaggaacaccagtgtgctcgcctttgcactcgtcacatgcagtgaaatggtacatgtaacccactgagcatagtgcctggcatgtggaaaatgcttaataaatgcaggtgattattaccgttattattaatactatttacaactgtgactcttttttgtaaaataaataaataactagtttcctgaaaacactcctccaggcttcctgctccattaatattcaacttatttaaatttaattttttcaaggttctctatttaattttttaaaaacctagtgaattattagcattttaatgaataatgacatttaataaataataacactagtgagggctcaaaatacagggaatttgaattaacaccttacctgtgttttctccgaaaagaaagaaaaaaatgcctacaagaaactctacactgtgaccaaatggtctctgtaatttgagcttctgaattttttttaaagtagtgttgtgtgtggaatgatggccttgcaacattctcagttcttcctattttacaggggagaagtgcctaactagagttaattttatttagaaataacagagcatggtggcttaggtggtaaagaatctgcctgcaacgcagaagacccgggttcgatccctgagttggaaagatcctctggagaaagggagtggctacccactccagtattcttgcctgggaaattccatggacagaggagcctggtgggctatagtccatggagtctgaaaagagttagaaatgacttcgtgactaaacaagagaagaggtggaataagaggaatttatactgattctccctgtaatcccagtattacatcattatggatgcctaagaacagtatagaagaaatatgcaaagaaatataccaagtccttcaaagtagtggatatttgatataaataagataattaaataaacattttttatatcttgaagttagatccctttagaaaatagttttaaaataaacaatattgttttcttctctcagaaattcttttgagttcaatagaacttattaaaatttggagtaaacttttcacatattgtacaaaaggatggtaaaattggaaaaatattctgtttatattttctagacatgataaagggactgaaaaattttgtctttttcccccaacctttcaaagagcactaaatatctaaatatatgtggttattattttatatgagtatttctgttaatttgtaaatgagaaggtgacatttttagagataatatttgtcaacacaagttgatgaaattcaaaccctggaaatactatagataaatgccttcattttaaaattagattattgagttttgtattggtttacagaagcagtgacagattttattttcttgggctccaaatcactatggatggtgactgcagccatacaattaaaagatgcttgcctcttggaagaaagctatgacaaacatagacagcatattaa

SEQ ID NO: 35979 - DNA, 1254 bp, Bovine  19866880921003
tttttatatttagttcttataaattcctaaaaacaaagttaaattttcttatctcttatcttcaccatacaccctcaaaagtgaatgagaaatttagaaagagctattcctctcacccaaattgaacatgggttagattgtgtttagattatgtgctagattctgttctttttccccccttccttttggcagggtggggtaccatgtaaaaaccaagtaatacatgatccaccttgcccagctcattcaattttgtaatataggtcatgacagaaatataatgtcctctttcatttgctgtctctgatggaagcattctaggggaagctttttctcccagccccatttgcctttgtccttggggtcaggccccttactggatgttgggacagacctgctgcagttcataggaaagggagttactggcctgtcatcgttggtccaggcgtagcatcattgtacagttgagggttctgagcagaccttttccaccctcagcttccagaggtgaccatgaagattactcctctcagttatggtgatgccgtgtaaattttcaataaatatgctttatctggaatttctctcaactgggcagcctgctgtgagtatggaaaagagagatttgatacaggagggcaattaaccttgttcagtggacttcaaattcagttttcttaaacggttagaagcttctttgcactcaatcattggctttctgcatccagcccccacctcaggatacatcaggccttagcagctatatttatttactactcaagacagagttctgtccattgaaagaatatcatgtattctaagaataattaagtattagtgttacttttaccttttaatcagtttaagtagttatctttaattatctggttcttgaccacaagcttccccccatcattccatatcatggagcacctgcaatgtttagaggcaaatacaaggatgaatcggaacctttgtccttgagaacaggagacagagaattacagcctaagggccatatcccacagccctagagccatatcgacttacccacctaaagttttattggaaaacaccccttcatctgtgtattttctatcttccttatcacagtggcagagacaagcagttgccacagagaccatcaggtccaccaactttaaaatacctgctgtctggtcctttacagacacagttttctgacacctgatgtagaagtcaaggtctaggcagagagagaacccagtccccaga

SEQ ID NO: 35980 - DNA, 1015 bp, Bovine  19866880932832
tgctgtctgaaatcatgaaaatacagaagccaccctaaaataccataaagacgagattataggatttattttatatctacatgggatatcatatatatgtttttaaaaagagcacaagtgatcaaatatatttaaataaaacagagagctacaatgtattaagtggaaaaggtaggctaaagatcacatctgtctatacctatatttatatttattcctaagtgtgtacatgaacgtaacattctgaaagaacatgcacacaggtgttaataaaaggtatctccaggtatgtgagtagtaggtgatctttgtgttacatatgatcttcatctcataaaactgtctgaaatagctatgcattctttgtataacaaaaaacaatagagctgttttttcaatgctgtggtatctgttagtaaaaagagctgtgtacaaaacagtgtatacccaagggcatttcaagttctgtaaaatataaatgtgaaggagaaaacttgttaggaaagacacaatattttaatagaagctagatagagactgagatgagggacatcttcaggttctatttcagctctgcttttttgcattttcaatataacacaaacgttattttcatagtctttttatttttttctaaatcaattcctggtatgtcttttaatgtaggaaaagaattgcaagcagggaaaagaatgaaccaaaaggccctctcgcgtctcctctggtccccagccctgcagcacagaacacagaattcctccagtggtttgaccctgtctcctccacaaggcggagagtgcagtgatggctctgtcccatctcattcacctctgtatctctagtgcccatcacagcacctgccacacagagggtactccattgttgccacagaaatgaatgaagaaaatcctggcaggccatgggagccatccaagcctatagagtgtagctatgtgttacagagatcattttactagcagtggtgggaggatggactctcaggaggaaagcaggg

SEQ ID NO: 35981 - DNA, 1683 bp, Bovine  19866880963613
tttggtttggcttctgccctcctgaaatgcttaaacttgcatttactgtgagccggaccacagctaaaaaccttatgtgcgtccaccctacaattttcttattatttcccattaacaggtgaggaaacagaagcacaaggaattcagtgattcaggatgcctactggcttcaggtttcttctcagcatttcctttcaaaatcactgttatcatatctcccaaccatggacaaaaaataatgaaatgagcagagaactccaagcctaatcatctcaaaacccttttcattttacagacatttcagtagggctttgctggtaaacaaaaataaataagttcagcttacccagaagtcagatgccctgtaataagttctgggcaaggctctccccagagcaggagaatgtggcattatagtttaggttgagtttatttctttaagccttatgctccccaaatttctcaggcactacctacctcaggaaaactgagatatgataacaaagactgtatagcccccccaaaagcccccagattaacaaagctccccagggcttggctgggggtcagggcttctgctttcagagaacaaactaattcttgtttcccaagggaagaacattaaagacccatggatgttttaaaatataaatgtatggaattgtgcaatctctcaataatcaggtttctcttctctgacaggtttccaaaacatcaagaatagacaaatgttaaatatttccttactgctaactacatttccccccctcctcctttttctcctcctgtaacttctaacatgaatttattttctatttgaaagccaatctcactggttattagatattctccctgctgtcaccatcagtaaattattaaacagctgaccaagctttgttttaaaatgattctcttatgaagctcagtgacatatttgccatgaatactgaatggtgccgcggtctctaaggacacgtgagtgattcctatttactacctttagcaaaatgtgtgtgcaattagcagcaagaacttgacttgaatcagttaccagagatgcctgtggctggttcacgtggccctctcttgacacctcaccttcctgaccggagaagcaggttccgcttctagaccgcatcgcgaaacagcgcatagaaactgccttttgtcatttctcacctccttgcttgtcttgccacccctgagccttgacgtacctgcagggaatctcttccttattgaaaggagcagctggctctgagtgaatttccctgagaagaaaataaacctgatggagatgacattgcttaaactgatcatatctccacttcctcatcttcaaaacagacatcatggtccctacttcttagattctataatgaaaccaaagcactgaacacagtgccttgtagagacagagtaagcgcttggcagctgctagctactttttttccattgatgcccacgtaagtccagactctctaggttgtaagtgacccatctcaaacgcatgtaagcccaagagggcacatgttgacttactgtttgtcttagtggttgatcagttgagatccaatcagggaaacagaaactgcttaaagtactcacaacagaagaaatttaattctggaaattgtctataaaggtgatgaggtaactgagatcccagaaagggacgggaag

SEQ ID NO: 35982 - DNA, 552 bp, Bovine  19866880977217
tgggagtacaagaaagttctcttttggttcaatctatccgcttcaaaaaggacaacttcataaagtgaactgaagctcaagagttaaacagggagattcctacacaacttttattaaccccagatggtccaaggaggctttcaaaataaatacggttggcgttccctccacccctgaatgttggggttttggagacaactcatttatgacacacatgtttctcctgctttaattaaactccttttctcgtcaagggaagggaagataatcccaatctaacgtctcatccatgttgaactctgctgtctctcttctgtttccaaatgaatttggcttattaaaaaagtaatgagctattaattaactctacactcacataaagctgtttaattctcaatctaattagcagcaatctgttgaagggttctaacgattattttaaatttgctaacagagacatcttttcacttttcataagttatttatagaggaactcacattggatcctgcttgctttttaattttggtaacatatttattaaatgcaccact

SEQ ID NO: 35983 - DNA, 1299 bp, Bovine  19866880996944
taattatctagcccagggatcagaggccaaagagggatgaactgtatggaaacggttaccatgacggaggtagggagggattcagctgccttcatacaaaaagctgctctctgtgaccttggagttacatgtttgtgccctgcagtactcacagaggtcagaccactggactgggcattaggtgaccgggtttccaggcctgtctccaccactggcccactgcatccttggtcaatttcctttactttatcaggaccctgtaaaattagtcaagggaaagatagagggaaccccatagctaggctgtgaaactgccaagaattgatatcctagaggactcctttttagactttggaatttttcctgggacaatgaagatccagggaaaatttatgagcatggaagggctttcatcatatttgggtttgtgaaaacagttagacacctgtgtgtgaagtgtggggagagacgggttgtgggcagtgggtggatgggtgtgtccctaaattcatgtctgctttaggatggaaaaaagtagcccccattcactgagcatttattgaacacctcatgtatacctggcccttgtggggtactgtagagacacaggagtttgccagggcaaggacaccttacgcagatgatagctcacagatgaatggatttggatgatgacataagcaaagaccttgttcacgtttgctcacgtggtgagtcatgtcctaagcctctggataagccgtctctacagacccaggatgagaccatctccccaggcctgtgccctgggcacgtcacagagtaattgcctcacctacatcatagctcccaacactcactgccagcttttgtccaggcttaagtcttggagatcccatcatgtttcccacttgagaaattcccagtcaatgtagaatcatcaatggagagcttttaacagtctcttggtatttcctccaacaacccacagtgtattcctcttggctgcctcctagagcacagtggttaagagcatgagcccaggaactggaccatcaatgagtcggaagccctgctccactgctctcttggctgtgtgaccttggacaagtcacataacctctctgggcctcagtttccctatatgtaaaagaaacttcttattataaaagttaaagtgaaatatctacacatagtagatgtaagctacatgatagataaatggctatgttagtttatgtggtttaattctgttctataggattcagctaccctgtgtctaaaatgagatataatcgttatgcctttatgcaaaaaaca

SEQ ID NO: 35984 - DNA, 1184 bp, Bovine  19866881019817
agttctgactattgattcttttttttaatttgaaggttaagcagaaaatccatttaaagttaacccagactatttatacttaggatggtatatgaactaaacacaatgaaattgagcccaaaggaatatccccaagaagaaagaagtcagtaatgtgacccataattgccttttatgattggtagtgtatgtgcctggatctctgcacccaccccaatgcatttaataaaagccattggcagcttaggcagctaaaggcctctagcaaacagttaagagccatcccactgttttgagctgtcttagactctgaactccctgaggacagagtcttttgcatttcactttagtgtctggctggtacacccagaagtttgaagcaggggtgagcatgcatccttcattagatgtggctaagaatgtaatgatattctatgttatgggaattttactgtgattgcaccatctcattgtggcttctcctttgtctttggacgtggggtatctttatttggtgggttccagcatccacctgtcgatggttgttcagaggcttgttggaggagaagatgagtacacgtccttctaccccgctgttttggaagtcatggggaatttaggattcagaatgggcagtgggataccgtataatgtgacaagagcattaaacttaattctggccacatattttcaagataccagatgaaagatattacctaggagactgctggccctctggggataagccatgaaccttgtcatatgaatgggatgctgaccaagatgtttgcttgcacgttagagagactctggtccctgagattgttcaaacacttctgtacgtggtgggaaattagggtggctcttcacattttcatggcattttgtagtaatgataaaagaaatgtgtttcattatttttattttgggagatacctaaaaacactgaaataaagtacaaatcacccataaccccaccacttggagataactactctaaattttggtgtaactcttccagtggcttgtttttgttttctaatgcagatatacacatctctttgcataaaattaagccaacatgtacgtgttctctaactgatttctttatttagccatgtataatgaacattcctttgggctccaaaatcactgcagatggtgattgcagccatgaaattaaa

SEQ ID NO: 35985 - DNA, 841 bp, Bovine  19866881107394
caccctttgttccaagtttccaggtgccacccgccagcctgtgctgtccatggggtgagcctccccactcggtcaaagcaccctttgttccaagtttccaggtgggacccgccagcctgtgctgtccatggggtgagcctccccactcggtcaaagcaccctttgctccaagtttccaggtgggacccgccagcctgtgctgtccatggggtgagcctccccactcggtcaaagcaccctttgctccaagtttccaggtgggacccgccagcctgtgctgtccatggggtgagcctccccactcggtcaaagcaccctttgttctgttggtttacttgaaaatgccactcagtggcttcaagcgagaaggaggaggcagccacgtcttcagcctgttctcagacatcgatcacctgccggctaaggagacgtgactgtcgcctccccaaccggacaagatgatttttctccaccacaatacgagccccgtgagccatacaatcatggtgaattccctatcagctcaacatcctatgcaatttttcagagaatatgattctatctgaaaataagtgcaacagtctggaactcatttctcccctgtgcctaactttcagtttcctataaataccacacagctttccaggcaaagacacacctcagcattatccaacaagcatcagtcatgcctctgccttgagcagtgtctgaaggcattgagaattcaccgtcttattaaggcatcactaatgctgtttgctgggcctgaaattgtgtcaaatatcaccgtcaagaatgtttcaagctaaagtgtgtatgtgttgtgtgtgtgtgtgggggg

SEQ ID NO: 35986 - DNA, 1316 bp, Bovine  19866881149458
tgccaagcacagggcctcacacaggaagtttgaatagaaaccattgtttcttctatctcgttaccagccacatttaggttaaaggcaactgacaaaggaacgagcctgtgaaacaattcgggtcatggctaaaaatataaaattgatatgatcctcaggaacagccctaaatagatgaggtgtcaagtcgccctcctcccaatccccgctccccactcgggcgcgtcctaatccttctcccggacaaaccgcagcaagaccagcatcgcagactctgctccatgagcctggccgctgggtgacaggatctgggaaggcacttacttaagtcacaagaaatttcttgacacggtgctccaccctctctaaactgctgtttggggtttcccagagaatgaggcccgaccaaacaaaacacaaatttcctgtcaatgggaccaccagcccgagaagccctcggaagtcaccttgcccttcgggcccatgctccacaggccgcaactcctggggcccctccaaagcatgcagccccctccctgtccctcccacccagactcagcatcccccacagagaagccccctggcaggggctttgtggtataaaaggatctgacacagcttaggcaacaggcagacaccggcgcctcatcgacacagcggatattttctcagttaaaaaaatgtgttctcacttaagaatgctaatggcccatgcacagaaataaaatccctgacctactttgaagctgaacttattaaacaagccgaccttattactcagaagagactgtaaaacagtagaataaagcccaagtggaattccttgcatccttccttgacaggcactgccaagaaaagtacagaggagagtgggagccctgggcttggaggcaggagccagggttcacgtccagctctcgctgggtctcactgtgtgacctgagagctatcactgtcctctctggtccttagcacctgcatccaggggcctggaaggaggtgctctcagtggtcattttcagctgtgatagctggtgcttctatttttttttttttaagaatttcatgttaaaattaaaaaattaaaaataagttaccaagagcatatcatgatagacaccataagacagggcgaagacacacactgtgcctctaaggagcctggagcctagcagagcaagtgtgggaggtccatactgattaatggatttatctcctagcagcaatctgaaagcctccacgaggctacagcagacaaaacacaacttgtgtctgcaacgagaatccccgctggcaatccacctgacaactttggt

SEQ ID NO: 35987 - DNA, 2138 bp, Bovine  19866881177336
ctctcattttcctattacattattccagtggcttcaactctctgtttgcaaatgctaaccctaccagcaacaaaagcatcttctacaaattgctttgtaagtcatcaagcatgcgttatgattatctagatactcataaaatcctagtgcaattcacatggcagacaccagcttccccattttacagatgaggaaacgaagcctgggcaagtacaccagttcagatgagaagtggtggtttagactagaatgtaagacttgcagttctcaggcctaggccctcggtgttatcttcctcatgtagtctgtgataagagttcactgtgggtgctcccctcagaactacagaacttctcgactttctccagcacgtagcacggggccttggaaactcaataaatcattgcttgagttaatgaataaataaacgccctttccatcatggctttagctttctcatctgaaaatgagcatgtttaggtgcaatgattcccaaggacccctcaggacccctctttcctgtagctacagattcccagcctccagacaagctgctggggtaaggcctgtgccaggtagatcacaaggacagacagagagcatcagctgcactggttgtgaataaaaagaacaacaatgaaaaatgaatggagaccatttagggaaagaataataaaaccccacttttcgtgaggctagaaataatacagggctccatgacttgctaccgactctacttcttgatgtctttgccaccccgatgtcgttcattcccactttgcaggcagttcttttcttgtgcagaaatgtaatttagtgggtggcttttcccatgactctgtgtcgctaacacatccatttccttctctgcttttaaagtttatgttcctttgccgaacaataggctgcgcattaccactgcctccaaaaccctacgcagcagagaaactcctctaaaagctcctgtaggtcttgagacagagagacagacagacagacatggggggagcagtttccagagccctacatgatattcgatgtccttaaagatcccaaggggaattcagccaagtgcacgtgagctacaagatgagagcggtaactagagtagtaaacacttactatgcagcaccaagctgtgccggatgcttgttcaaagggctttccaacattctctttcatttaaatttcatgacaactctgtaagaaatgtacgattatgtccattgtacagatggaagaaccaaggcacaggagggttaagacatttggcaggtcacacagaaaagtgtagagccaggcttggccccccatgctgtgtggtcccacatatatttcccactttgctattcatcttttctgctaaaatgacttatgacccactggacagccagcattcctggctaccccctaagcaacaccaaatagtagatggacaaagagcaaggagatttatagtcagttccaacctgtcaccattccaggctattccaagattactgatgcaattgtgggcagattgaataacctcgttaagacttaacttctttatgtgaaaaattaaaatggtacacagttccaggtaccttggcaaatgtttaagacttaagagataacaaatgtcctgtatgttccaaatctggaaagtcccaaggcagagctggggacagagcatcccttcattcagttattcatttacccaccaactgtttattgagaagtgaccacctgccatgaacagcacggggtgctggagaaattctcactgtcatggagcttactgtttagcgatgagagacagtaacagtaggaagcggggagggagaggatcctttagactggcctgagaaatatctgagctgagaccaaaatgaggagcattggtctgccaagagagtggagagaacattgcagaaagggaaaagaacaaatgcaaaccagcagaaaaaccttgaagagtgccagggaaagaagtggagccagtgcagctggagcactatgcctggcagggaggagacgggggtgagtttttgagagggaagcaggggttcgatcaggccggcctttcaggccacagtcagagtttgaatgccatcctatgtgcaacaggcactcttacaggattttaagcaggggtg

SEQ ID NO: 35988 - DNA, 1244 bp, Bovine  19866881199586
attgacgttttcaattgaggtgctggagaagactcttgggagtcccttggactgcaaggagatcaaaccagccaatcctaaagaatatcaactctgaatattcactggaaggactggtgctgcagctaatgctccagtactctggtcacatgatatgaagagctgactcactggaaaagaccccgatgctgggaaagattgagggcaagaggagaaggggagacagaggataagacggttggatggcatcactggctcaacggacatgagtttgagcaaactcagggagatagtgaaggacagggaagcctggtgtgctgcagttcatagggtcacagagtctgacatgacttgccaattgaacaactagcagtgaagaaacagaagcactgacttcagtccatgggacaggaagatacccaaacaagcaattccaatcccatgtggcaagtgccaagatggtagccaagaggactttgaggccctgaagagcctgcaaaagacacagaaaggaagtgacatctgaatagatttgctttttcacgtcctttgaatctttcatcaaactgctttccaaaaagcctgtacccatttgagtatgtaagactattttctaacatgaatgccaatgctgagcattatgtcatttttattatatcttgcctagtttgacaagtggaaatggtactttatcttaatcagtatgcctgatggctaataaggctggtaatatttcacacactcactgggtgtttccagttctacttttgtggaaattcatctctcctccaagcttgctcggacccccatgccatcttattactcccagtacacggtgccgaggccatatgtatattgaagactgcaaatcaggagtagggctgggtctattttatccctgtatgtgcagcagaaagcactgcccagcttataggagatgctctgacagcatgtgccaaatgaacaacacagcaggctcttgagcccttgtttcttcttcactggggtgtcagcagcagccatatcagaaccacaaaaaaatggtgctgctttcccaaagacagtcctgccaacattattaacagcaactgggcacaaacaaggagaaaaacagaaatagagcaaggccatagttcaccccattgtacgtgatcatctggcaggggagcgtttgtaaaattcaaagagaattgtcttcagaaaatacattttgcttaagcgattattccagggtacctgcaaaa

SEQ ID NO: 35989 - DNA, 907 bp, Bovine  19866881231785
acatgggctttggcagttgcaccacgtgggctctagagcacaggggctcagtagttgtggtgcatgggcttagctgctccacagcatgtggaatcttcctggaccagggatcgaacttatgtcccctgcattggcaggcaggttcttaaccactgggccaccagagaagtccccccaaactgcttttaacccagagcatcattatggaaaacaagcctatgaatcacttgtgcgctcttcgtaagactgcggtggaaaatgttgttccctacatcacacgctgctttctttatgaggactcctgggaacaattcctgtctggcttctgtgtgaacaacagctagaatttctggagcaattggtttgtgtttatctcagggacaatgtgaacagtgtagctgccaagctttccttcttctgtcggtggccgtggtcctgtgggctctgcctgtgactcaccagaagcagcagacgtacagaaatgcagggcttttttgcatctgatcagctcccaagtgttattttcctcctgccttgtgttgcctcacttttaatttatgctatcttgttatgctttatgttctactgtaagccacctgaaaagcgttctgtgaaataaggtttggtttacaatgaaaagtagataaaaaagatgtagaagagttctaaaccttgtgtttctgtctattttcttcaaaagttgattacattctgcttgaacatccttccactgttagactcaaggtttggagcacacaacactcagaactgtagcaataacattcataaaataattggaaagcccaaatacagatgctgaatgtactatgactgtctcttcttattctcatgacccaactgaggcaacgccattgaaatgacagagcttcctgggagcctaatgcat

SEQ ID NO: 35990 - DNA, 1517 bp, Bovine  19866881238208
atttcatgggccccatccacgtgtgtgagtgctaagtctgaccctatagacagcagcctgccaggctcctctgcccgtgggattctccaggcaagaacacaggagtgggttgccatctcctccttcaggggatcttcctgacccagggatcgagcttgcgtctcttaattctcctgcattggcaagcaggttctttaccactagcatcaccaaaatattaagtgatgttcttctgtaatgaccgtactactgcctcagcaatcaaatctaaaagttcaggcaggacatggtttgatccatataataatttgtatatttacattaagccttgcaatcactgccaatttaattctcaattttagcctgtgaaaattaaaaggaaaaaaactgtctaaaaataggtccaaaaggcctaaaatattaagtactaaattttttactgagtatccatatgcaataaaactaacaaatttcagctaaattttattaagtaccctaacctactgtttcctattaactgggtcttgtggagctattgtttcctattaactgggtcttcctattaactagtatcttgtggatactagtgtgatcattttatagtcttacaaaaacacagtacttcaacttttagggtaaggtttgaaaaattttctgatgaatcttcctattaattcatttttcaccttctgactttcttaattttttaaacatttaagtcaagtgtgagacaataaatctctttactcaaagtcctttagagagtaaaatcctgacactgaactgacactgcccaaaataataaaaagaatgaaaagatgtgaacacactttaaaagtgatgtttgtatttttctccaagacccgaaatttcctataccacgggtcatttatttgaggttcctgtggctgagctcctaacatggttctgaaagatcttctattgctgggagtcaagaccttaggcgttccctccccttgagggtgagctgaacccagtgacttgacttgaacatggcaagaatgatggatgtcacttccgaaatgaggttgcaaagactgacttccagcttgctcttactctcccctaccccctcaacatctcactctggtgaaggcaggtaccatgctgtgatggagaagtccatgtagcaaggaacccagatggtctccctccagctcatgaggaactgaggccctcaagtccaacagccatgagtaactgaatcctcccaacaagcctgtgagtgatctcaggagcagacccttccccatttgagcccaggtgatgacagcctcagccactatcctgactgcagcctgggagagacccagagcacccagctgtgccactcagagtcctgattcagagaaacggtgagacaataaagtcactatgtctcgaggaataacccattacacagcgacagacaactcaccaagctgccttagggtgagactagatttccgtttttcttttagaaagttggtgcccaaaaaacacagacagtagcatca

SEQ ID NO: 35991 - DNA, 1468 bp, Bovine  19866881266024
attatccttagaagcctgtagcctcctatggctgcaaggttcgtggatggagtgactgcagaagcatggtattgattgcaggaagtaactgaagtgagagttcacaacaccttctggaaggcaggcagcgcttggctctggtgcagtgctaatgagctccccagccagctccagttcgacctgcatcttcccagcaaaagaccgagggctggcgaggaagaagacaccagcgggtgtgggcgaggaggtgattcatgcagagcagttttgtgggctcataccagctcctctccccgagtcttttgcttcttttgccttttatctccacgaggcagagcaaagagccaggcttgcactgggaattcctccctgagtgtataaatgagccagtctcttggaagagagggaatcctctccttctagagggatgttaagcccaaggatttgcctctttccctccctctgtgatcctcaccaccttcctgtctttccagggctgcataatccacgtggaggtcagggtgtccatgtcacctggagctaaggtgtgtgtcgttgtttgaaagcagacgtgggtcagcatgttgagtgggcacctctacctctacttcaggttgcatcattgtgtgtttatgctgagaagccttcccaagaggttggctttttttttcccctttcttcaaaatgtatggcaaaaaaaatcacagtgttaaaaattcattatcctccaaataaataagtaaaaatgtaaaacttattattaacttttgtacaattttaaatgctgtgttagtcactcagtcatgtctgactctttgcaaccacgtggactctggcctgccaggctcctctgtccatggaattctacagcaggaatactggagtgggttgccatgccctcctccaggagatcttcccaacccagggatcgaacccgggtctcccgcactgcaggcagattctttactgactgagtaatgagggaagcccaatatatctacaaatagaaatatgcataatatagacaaatataaacatgtgtaaatgcacagacacagatgcaccagtggatacacatatacacatctgtgtgcctgcacgtgcacacacgtgaaggcacgcaaaattggatacacccatgcatgcacacacacatgtgcccacagacagatgcacccacgggcacactgttaaattaacgaaacaacgaggctctaaacaagacttcaggtcagttcagttcagttcagtagctcagtcgtgtccgactctttgcgaccccatgaatcgcagcacgccaggcctccctgtccatcacaaactcccggagttcacccagactcacgtccatcgagtcagtgacgccatccagccatctcatcctctgtcgtccccttctcctcctgcccccaatccctcccagcatcagtcttttccaagagtcagctcttcgcagatgggccaaagt

SEQ ID NO: 35992 - DNA, 1049 bp, Bovine  19866881364032
aatagagaaaggcaggaatacttcagcaaaccaaagaacacagcacctatctaaaggaatctggaagcaatttttaaagaacacgatgtactcagaagaattcatgcccgtgcaatgagcagagcttatggtccatgaatttgccatctctaaaccaaatgacatccaaagtccctaaatgtgcgagaccatggagattaatactgaatgaaggcctccctacagacagaaagtgtctgcacgtaacttttcaggtgacagatgggcagacaaggtccgcacatcaccgtctaggtgacatcacgcttttcacaaatctcttctcagtctatcttctaacagtcccaggaggcaagttcttattatccccattttgcttttgagaaaactgaagcctggagaaggcagatgatttaacaaggtcacacaaggaggtcctgaaagagccagaaaccctggcaccattccctggtccagtgtgcactgctgggctggaggacacttctcaggctgagggacacccaaggctgccttgggtcggcagagcccagagctgcaacacccatccatctcaagctggatggtgcatccagattcaggctttgaatccacaaaagaattctccttaacaccactttaaatcttccttttaacccttcaatttatttttttcaatgaaaacctatgctgcaaagccctgggagacccctgggggttgaaacagcacacaactagcaaaggaaggccatggtatttgcatgtaaaacagccttctatgctggtaaaagcaacagccgtggtctgatacacagggtatgcagtgttcgctagcatatgaagccacattttgagggaaaaaaaaatttttttgatgcccaaaagcatacctacaggagcaaacctagcaagaagaaccaaacttgtcctaaaccccatacaaacatctcaacgtctttgccagaatggcttaagcataaatgaaatagctttgaattacatccccaagatgaagaaaattgagctcacagaaaatagctaatgcgggcaaa

SEQ ID NO: 35993 - DNA, 3422 bp, Bovine  19866881444255
aagagaccttaaggtgattagttaaattacctagaacaagaagcagaacaaggaaaagtagccagtgtattgatatttgatcaatatctccttgaatacagtaaaatatgattatcgataattacagatataactattgttgttcagtcgccaagtcgtgtccaactctttgcgaccccacggactgcagtacaccgggtttccctgtccttcactgtctcctggagtttgctcaaattcatgtccatagagtccatgatgctatttaaccatctcatcctctgccaccctcttctccttttgccttcaatctttcccagcatcagggtccaaagaaggcgggaatggcaaaccactcccatattcttactgtgagaaccccaggaacatgaacagtacgaaaaagcggagatatgacttggtgggtgtctattttgtactattgctattgctaagtcacttcagtcgtgtccgactctgtgcaaccccatagatggcagcccaccaggcttccccgtccctgggattctccaggcaagaacactggagtgggttgccatttccttctccaatgcatgaaagtgaaaagtgaaagaagtcactcggtcgtgtccaaccctcagtgaccccatggactgcagccttccaggctccttcatccatgcgattttccaggcaagagtactggaggtggggtgccattgtcttctccgattttgtactaagagctatacatatattttttccctctaataaggatccaactagctatatctgtgcccactgaacagatgaggaacctgaggctcgaagcgaacatgtaatttccctgaagacacagagacctggggccaggtctgagattgaaacttgggatgctgacatccatacacaaaatctatactcttgaccctgcccaactaccttgatagaaagtcacaagggacttaaatccgaacatctgactctcagcatcagtactggatttctttgaagaactaatctgtacattgataataagttctgaaaccatggtaggttgttaaatggagttagaagacaaattttaaaaaaccatcaccaacaaaatttttatgagttagaaaattgtcatcaagaccacatctgcatatttgaggaaacctaagcccttgggataagctaaaataccttgaaatcaaagactttaggaaacccagaaacagacagcaaattagtgcatttatgagcagtggtctggaacaggtaggttgaggggccagattgtcaattgagtgaaacctcaattacagagtaatctaatgtatacccagatacattatcacaactcaataaacagctctttggaatgaagtaattccaatttgcttgcattttaatctgtgtgttgccctgaaaattttgtattgcctacactcaaatgaggtggtgttttctgaagcactgatgctcacagtcccaggacagtaaacgagccacaaaccagccataaacacacctgcctagggagagacagagacagaagtggagacagaggtccccgccctccacagcttggcccagcacaagcacctgccacagacagcatcagagggacctccggctcctggcaccctcgggagctgaggggtcctatgacctcccaacccctgcatggcctgagttccaaatgagtgatgccaggcggagtgggcccatgaggtccggaggccgagcacaagcaggaccagaaacttttcctttggtccagatccctggctcactggtggtggatagaggaggaatctggggagactgatgtggtgggaactccaggacccaaatgttcccaagcctacatgttgggccccatttaaaaaaaaaatgtaaaaaatgctggctgtgctgtgcagcaggtgggatcttatttccccgaccagggactgcatctgtgcccctgcagggtaagcacagagccctaaccactggaccaccagggaaatcctgtgacccccactttaatattccctcctgtatgttctgcacatgagggaagcacccatccccactctgcataggaagcctcaaaggatctctgcagggccacagatacgggaacaagattgtgacctggacaagtgtcctgccccatctacctcagttcggttcagttcagtcactcactggtgtcctattcttcatgaccccatgcactgtagcacgtcaggcttccctgtccatcaccaactcctggagcttgctcaaactcacgtccatcaagtcggtgatgccatccgaacatctcatcctctgtcacccccttctcttcctgccttcaatctttcccagcatcagggtctttaccaatgagtcagttcttcccatcaggtggccaaagtattggagcttcagcatcagtccttccaatgaatattcagggctgatttcctttaggatggactggttggatctccatccagtcccttggactctcaagagtcttctccagcaccacagttcaaaagcatcaattctttggtgctcagccttcttgatggtccaactctcacatccacacatgactactgggaaaactatagctttgactatacagatctctgtcagcaaagtgatgtctctgctttttaatacgctgtctaggtttgtcattgcttttcttccaaggagcaagtgtctttaatttcatggctgcagtcaccattcacagtgatttggggcttaccatccacagtgagcctaagaaaataaaatcagggatcgaacccaggtcccctgcattggaagtacagtcttagccactggaccatgagggaagtcctgtgtgtgtgtctgtgtgtgtgtatgcgtgtgtgtgtagggaagggttaaacccatttctggaatctggcagttggtatcccactccagacaggaagggaactcaggagcgtgatgcatgagttaaaaacaaaagttagcaataggtcaagggacccctgctatgagcccagcctgctgtctggatgtttttgacactgttcaggacacgatgctgccagatgctgacaaggccacaagcctcgggccctccaggtgaggcctaaatagcatgatccagcccctgggccaacccctgctctgcccctaaggacctgtctctgtgtctcaacctggctgtggatgttcctacagctgtaaaatgaattaaaataaaaccaaggtgcagagccacagtcaggactaaataagatcatgaatgtaaagggacttctacattcaaggggtctagtttctagctgacccccaagtgaatgtaaagagagaagaagtgcaacagggaagaaaaacaggcactaagaaaatgcgatattccattaaggattccaataaggtgcaacaaaacaggatccatcaccaggagcacaaacctaacttcacccacg

SEQ ID NO: 35994 - DNA, 1601 bp, Bovine  19866881606127
cagagcatacggttcccccaaaggagtctctccaagtgtcctaatttcataacgaatgtttcctgggccatttttgtcattagaatagaatacaaatataatatatggcaggcatttttcctcattctctaattaaacattaatagcacttggagaggtattatcatgccgtttttaaaaatgaggaagaaactcagaggaggaagtcacttgtccactaataagctagtgagggcagacccaagctctgaacactggatgaagcctctggtctgtcccggctctacagtatcacctcacttgaatatcgtcagtagccttcgagaaaggaggctgctctccaacgcagagaatcctcactggatttgcagtcacaacgagtgggtttcagacctgcccttgcctctgttccttaataagtgttgctaatctctttgagcttctgctttctcatctgtaaaatgggaataaagtgtgactgcctcacagacttggaacaaggactaactggacaccatttatgaacatacctggcacagttgttggcacagagaaggtaaatgacttctaattggttctgatgttagaagtcaattctatagcatgcctatgttttcctgtatgtggctttggtgagcagtgaggtttgagcgtgttcattcatccctgcacggtccagtttaatatttttctcttgtctcatgcagtgtcatcccggttggactttgtctttttaaaggcatttattctattctttcacaatgatatatgtaaaacccactttccttatgaagtgtttattttttgcatatagaatcctttgtaatctaacaccatccagatataagagccatttagttgcatatgtaaaaggacctatttgaaaagtaaaggaataaagtggcctttatgtgcttgggggcctttctggggaggttcaccagagaaatggaagtacacacacttcctcaagaaattcagtgtccctggggtctctaaatcgtgttattttctcactgtacatgaggcctcattgcatttgctttatatcctagtcattctctgtcacagtggcagagatgaatattttcttcactgtagttgttttcctaagaagctaaaaatattggaaggaaattggttttttctcttctgccttatctttgcataactattctcggggatctcagagcagcgtaggagatgacctctttttttattgtcgctgtagcgccaagacagagacacaagcagcaggcaataaaagcaaccctggcctctgcgactgtctttggaactgacaagatgatggttgcactgaatccactggtcagttccaatttagtccaatccctgatttgacatggcctccacccctgcagcccagtgactgattgtttttcatgattgatggaggtgacagatttattttaaaactgaggctgatttttcaggaccctgatgagcttggggagatggacgggggtggggggtgtataggagggagaaagaatactcctttgttaatggtctctgtcagtgacttctgtgagagcctcaacagctcaggaagccctctgttaggaaagcaatggcaggga

SEQ ID NO: 35995 - DNA, 742 bp, Bovine  19866881953035
aatgaaaaatattgagaaatattgagaaaattgggtaggggacaggtcccctggggcccagaaagctgtggtaaggaaattatattgtattccaagtagagtaggaagtcattggaggatttttaagcaggggagaggcatcgaatttacaatttatttattcttacgatttaatttctttgcctctatggataaatatgtttcaacgtttttctcagatacacggtttggagaaactttgagttttgagactagttttcccacggggtggggacatgcttttccgaagactgaaaaatcctccgatgcttttaggtgctgcaattagtttccagacacacgttgactcttctttgaaatacttcctggcatgtactgctggtaaatttgaaggttaaatcttcggcttcctccaaaaggtgacagaggcacagagtaaaactaattaggaaaattcctgagtagttgattgcagccatttgttaagagttttgaaatgcaaataaaaatttgctcagctctttctctggaagggagacttgttcagcctggtgtttggttttagaattcatctgcctgtgaagggaaaagtgtgacctctctgcagagaggcagtgagcacagcttgaatctatatcctgctcttgtctcaagtctttctcttgagaacaaaagaaaaatgcattcagttctcccaatagtattatttatcatattctctcaattctaggatgtggtaaag

SEQ ID NO: 35996 - DNA, 2280 bp, Bovine  19866880420522
ttgtttccatagcttgactattgtaaataatgcggcagagaacatgggggtgcttatatcttttgaagttagtgttttgctttggataaatatgcagaagtagacttgctggatcacatggtagttctatttttaatttttttgaggcactgctttactgtttgccctagtggctgcacccatttacattcccaccaataagacatcagttcacttcagtcgctcagtcatattcgactcgttgtgaccccacggactgcagcacgccaggcttccctgtcgatcaccaactcctagagcttactcaaactcatgtccattgagtcggtgatgccatccaaccacctcatcctctgtcgttcttttctcctgccttcaggctttcccagcatcaggatcttttccaatgagtcatttcttcatatcaggtggctaaagtattggagtttcagcttcagcatcagtccttccaaagaacacccaggactgatctcctttagaatggactggttggatctccttgcagtccaagggactctcaagagtcttcttcaacaccacaattcaaaagcatcaattctttagtgctcagctttctttatagtcaaactctcacatccatacgtgactactggaaaaaccatagctttgattagatggacctttgttggcaaagtgcttaatatgttgtctgggttggtcataacttttcttcaaaggagcaagtgtcttaatttcatgcctaccgtcaccatctgcaatgattttggagcccccaaaataaagtctggcactgtttccactgtttccccatctatttcccatgaagtgatgggaccagatgccatgatcttcgttttctgaatgttgagttttaagccaactttttcactctcctctttcactttcatcaagaggctctttagtccttcactttcggcataagggtggtgtcatctgcatatctgaggttattgatatttctcccagcaatcttgattccagcttgtgcttcatctagtccagcgtttctcatgatgtactctgcatataagttaaataagcagggtgacaatacacagccttaacgtactccttttcctatttggaaccagtctgttgttccatgtccagttctaactgttgcttcctgacctgcatacagatttctcaagaggcaggtcaggtggtctggtattcccatctctttaaggcaagatcaaggtaaaaagcaagaatgtgtcctgtactgtcttggaactgggaaagtgtacacattgttagaacatcattccaatatcatttcctttgcctctctggcttcatcttgtaggatttagctcaggtgacattttcttctaagaaggtatttactaccattttctcctcaaatctgctctgtgttcacacaatacattgtttttccttttcttagaagaaaatgcaccatacaatgattatctgcttattggtcagtcttgctgattatatggggaaagtctttgaatgaacggagctgtctttgagtctatagaatccagtataatgtctggcatacagtagaaaccaattgctgacattgttgaaagtcattcaatcatgtccaactctttgtgaccccatgaactatatagtccatggaattcgccaggtcagaatactggagtgggtagcctttcctttctccaggggatcttcccaacccagggatagaacctaggtttctcacattgcaggcagattctttaccagctgagccacaagggaagcccaagaaactcaataaatgtcagctaaatgaaaagctgaatatatattactaatttctaatgtgggtataaatagcttttgtcaactgaactttttagttcagtttgttagttcagagaataatactgaggtctactatgcacaggccaagtggacttccctttgtggaacagagccatatataataacatccatcattcagtttccagtagtaatactgggtgcagatgaatatatattgcatttgtccaagaaaaatgatacagattcatttttaaagtttcctacaaagtactgctgttcaaaataattagtttttctgaaaaagtgtgatgctgactacatggcaggggtaagttcctgccatgagcatttgaaaaaagtgatttaattaaacttacatgtgttaaaacatttaatagctcatataatgtgagattttatgaaaaggggaaatatctgcccatataaatgccaattaaactgtgactgaacatccctaattcaatg

SEQ ID NO: 35997 - DNA, 1361 bp, Bovine  19866880569516
tcatcatccctttgatggtatgattacatttcactcatacggctagatattattctatgttattatagtaattataatatttaagaatataataacatacccattaaaatatttaagaatcgaattagatacctcagaaactacatactattctccctacctctcttactgactcctttcatcgctaaagagcagccatctggttcaagattacgctggcaagggttggtcaaagagctctaaatttattctttttttcccccaactttaaacttttaattttgtattggggtatagccaactgacaatgttgtggcagcctcaggtaaacagtgaaagaacactctggttaaattactgtagaaagtctgttttctaatgcttcactttattagatcttgttgggaaataaaaatgaccacatctttggtgcaagtgcttaacctggacatcaacatcaactttttaatgtgttctccatcactgtttctttaatttcaactcaaatgcatatgacgtttgaaaaactcatgaaaataaaattcaaaaaaatatttgcacagaaaacaattcatgaaataaaggcaccgattgaacttactttgctttgcaaatattcttggtattctacgttatatttctttaaaaggtcctttttcaattcatctgtccttgggaatgcaatctccttcagtttcttttaaaaatatatatatacacacattgattagtagaattttcagtatagtctttcagatcatcagctgagaaagaaaaacaactggtatgtgtattagaaatcaagacacaagtaaccaaacaggaaggtggaaaaatcagtattttctagggctccaaaatacaacttttcagcagagaagagaagaaattatcccctttgtaagacctttattgactccactggttaggtaagcattttgtataggtaggtacctcattttcaggtagtggacttgcaactgcacatcccatggtatgtaaattatatggcatcatagttaaaagggacattggagaacatggtaagtagagatccctaggcttaacagactgtaaaaagcagttgaggcaccttttataaaaatacagattcccaggcctaaccccagattttctgaatcaacatattcagagaaaggattgggatctgtatctcaaacaactttctcagtgattcttgatggcatgaaaataccattcaagtacccaccccagccttagtacagatgaggaaacaaaggctcagagacatcaaaaggctttgtcagtgtcatacaactgacttgtggcctccttatgactaaaaccccaaactcctaactctagctaagctcttccat

SEQ ID NO: 35998 - DNA, 2030 bp, Bovine  19866880691537
tgagcagtcaagcaatgtcagcactgaagatgcgcattatgcatgcagcactgtgagaagagcagtagaaataaagatagagcatcgctaagatgatgcggtcatttcgggagaaaagcagtaatagcagcaaaagcaatgccacctgctgctttacagttagtagtagtgttatccaaccaagggctgctgcattcagttgtgcatatcacttcagttcagttcagttgctcagtcacgtccaactctttgcaaccccatggactgcatcatggcaggcttccctgtccatcaccaactcctgaagcttgctcaaactcatgtccatcaagtcagtgatgctatccaaccatctcatcttctgatcaactattatgcttcaatttttaaaaagaaaagctcttatactcatggttatgatttataacagcaaaagaaaaatttcatagagcagaatcaggagaaatcaagtgcaagcttccaggtgtcctctcccaggaaagatagcacttattctcccagcaacatgtgtgacaacatactgccaaccagggagactcacctgagccttggtgaccaaagtgtttattacaaatcaatcatatggacatggagcagagacatgactaacttcagctagtcagtctccagagcccccagaggtctacctaatacagtgtggcccagaacctcagctgaaccaaaacaggtattcaccatagatcatatggtcaacataaactatctggcatggcctatgatcactacgcttcccagaaggctcagtggtaaataatttgcctgcaaattcaggagacatgagttcaagccctgggttaggaagattccctggagtcggaaatggcaacctgccccagtattcttgcctgggaaatcccatggacagagtaacctgtcaggctatagtccaggggattgaaaagagtcagacacgattgacaactgagcttgcatgcatggtcattgtacaaagacactcttatcaggcagatattccaagggcttagaggcctcctgagttaacccttgactacacatgtacataaaaatataagccatgtactagattatctgtgcaaaacagaactgtataacattctgtctttagaaactagaatcacaattccacttagaagacagtgtccaagtaaataacaggtatgaataaagctcagcattctaggacgacagtaaaagagcaaaaattcaaaaacaaactcagtgtctaagactaggaaaatggttaaataaatcatggtgtactcatagcctggactactatatactcctagtgtagtagtagctcagttgtgtctgactcttttgctaccccatggggtgtagcctaccatgctcctctgtccatgggatttttcaggcaagaatacgggagtaggtaaccattcccttctccaggggatcttcctgacccagggatcaaacctgggtctcttgcattgcagacagactctttaccgtcaccagggaagccctatatcttaaaatccatatattgtaaggtgaaaaacaagatatataattaacgctcatcactcatgaattttgcattgtgaattcacctcatttctaaaatttacttgtaatctcaaaatcaatcattgaggtgctgtttgtggtcatttgtggacttgcgcaaagtggcaaaaagtttgagttgcccagtgggcacattcccagctgaggtcaaacaaggagacaaccgccttcttgtttatccttctcatgatctacctcctgccatgcatttcacgtttctgtgcttttgtcggtgacttctctgtctaaagtggccccgagcacagtactgaagtgctgtctagcgctcccaaggccaagaagcctgtggtgtgccttacagagaaaacatatgtgctaaataaggttcattcaggcatgagttttagtgccattggacatgagttcaatgttaatgaattaacaatgttttaaactgtcttcaaactgaagcacatactaaacaaggcaat

SEQ ID NO: 35999 - DNA, 1649 bp, Bovine  19866880715519
gtataaatgaattggttttctgtacatctgaaactaagatgatattgtaaatcaactatacttcaatacagagataaaataaattgtgatactcaaaaggcatttcatatgctcataaatgtactaattcatgattctgttgtatttttaaatgagatgattcaattaatattttcataaaacaataaaaacttcataaaacatttggaaaatgaatttgaagtgctgggaagaaatgcagctaatttgtcaccataaattcacaagagcctaattgtgttatcttgctgttaaaatactaaaatttcctagaaattatgcattctaaagataagctgcccataaaccaccaaactctaatatccacttgaacatacttcccttttattgtaatttgcttttaagaaaataccatccagaagttatctaattcaataaagcataatgaatcagaaataaaatttctaaatatcattttctttgcctgccagatgcctgaagcccagagatgaggtcagtccttgggcattattaatcaattttatttaattttcatgtattttctaagggcagtacatgaacgagatgaatttaatccagcactattttcaaaagcaaaacctctcctagaatacctctcatccaccgcttctccagggttcctcaaccacaggaaatattctaaccgttcaacatatttcagtagacagctgcagtcacatttctggttttgaactagacaatctcttcaatgcagtggacaaaatctaaacaggctgtgtccctccaaaagtttccctggcagattacttttaaatgctcaaaaaattccctatactgccaattgtgtccttagtcgttcagccgtgtccgaccctttgtgaccctatggactacagcccatcaaggtcctctgtccatgggacgtttcaggcaagaacagtggagtgagatgccatttcctcctccagggaatcatctcctatgtctcctgcattgcaggtggatcctttaccggctgaaccaccaaggaagcccctgctgctgctgctgctaagtcgcttcagtcgtgtccgactctgtgcgaccccagagacggcagcccaccaggctccgccgtccctgggattctccaggcaagaacacgggagtgggctgccatttccttctccaatgcatgaaagtggaaagtgaagtcgcttcagtcatgtccgactctgtgcgaccccatggactgcagcccaccaggctcctccgtccatgggatttcccaggcaagagtactggagtggggtgccattgccttctccaatgcatgaaagtggaaactgaaagtgaagtcgctcagtcgtggccgactcttagcaactccatggactgcagcctaccaggctcctccgtccatgacgtgctattgttcctatatctgggtttcagaggaagagactggaaggttagcagcttccatgaggtcagtaaattagtaaggattttagctggatgaaaacccagtcactggacactaaagagaatggttttaactgctgatgccatttggcggactggagacgttttttaaaaaaatgttccagttttaatggaacaggtgatgccatccctaaccaagatctggagaaaatctgtcatta

SEQ ID NO: 36000 - DNA, 693 bp, Bovine  19866880716420
agatgttttccttaaacaggaaatttgacacactgacatactcaatggcattatgaaaaaggaaaaattgatcacaggacatgtagttctgttgtggttctgtttcatctcatgttgtggccatatttttgtgttaaaaactacatgccagctttgacaaactgttcatttcccttcatattttgggtaagtcaatatatctacaacagtacataaatcattaagtgaaatcaaataatgtctgattttcatctcaaaatatgattaaaatgcatgaaattatattctgtctatatcatgatagctatgatcaggagactacatggttaatttccctgacagactataaaatcacccagccaggaatggtgaaagctgttaatcaggaagataacctttgaaagccttgctcctttcataatggttgctagttaaatatgaacatctgggaaatcattatgaattcatggtgcataaatctattgccctatgtacagtacccctttttatcacagcctttccataataagaaaagaattcgtgtgtcaaaaatttttttaaccatacacatatttgatgtaccatttatcaacaaaattgacactgctcttggatgtccataatgctggctataaaatggggataataatatttagctgagaaatatctaaaaggcttaatgttgtagcaatg

SEQ ID NO: 36001 - DNA, 775 bp, Bovine  19866880877094
ctttttaactctccttgggtactgtcataagttagataatctaatttatctattgactagagacgtctgtgagaacacaaagttaaggaaataaaatagccacaagacagttttataaagaaggtgattgtatattctaagtgcagtgaagtagactaaatagataggttacagagtgaaaaaatagaatagggtagtcagtaaagcttactgcttaaaaatgagaaataagcgcaaaatcaaataagtactctttaactttccaggtaaaatttatataaattttaatagtctattgagagccctgagttgagaaaaaaagacttatgtttcatttcatttcattcaaaaagaagaaaacagtccaatacacttatacaacaaaatattacttggttttttctgtacctgaaagcccagaattctttggaatttgtttttaggtacaagtgttttcgggaccaggtagtccctctgctgttccccatccacacatcataaccagcatctgccagaaggaagcctaggctgttattaggaagattggaaatccagctgctggcagatgtgagcaaaccatgttgcaagtatacaacaagtctctgaactggaaaaaatgtagaaaatttcttttaaaatattgtagtgtctacatgagtatctgacctcaaatttaatcttataggataaaatttttttaattgtataaataggggtaagttttacatgttttaattccattttatgtcagagttgttcactaatgaatttctct

SEQ ID NO: 36002 - DNA, 1314 bp, Bovine  19866881007152
tggctctttagttcctcttcactttctgccattagagtggtatcatctgcatatctgaggttgttgatatttctcccagcaatcttgatttcagcttgtgattcatccaatctggcatttcgcatgaggtactctgcatataagttaaataagcagggtgacaatatacagcctcatcatactccttttccaatttggaactagtctgttgttccatgtccgattctaactgttgcctcgattctaactgttgcctcttgacctgcgtacaggtttctcaggaggcagttaaggtggtctggtatcaccatctcttgacaggtttctcaggaggcagttaaggatggtctggtatcccatctcttgaagaattttccacagtttgctgtgattcacacagtcacacagtgcacagtcactttagtgcagtcaatgaagtagaagtagatgtttttctggaactcccttcctttttctatgatccaggggatgctagcaatttgatctctggttcttctgccttttctaaatccagcttgtacatctggaagttcttggttcatgtactaatgaagcctagcttgaagaattttgagcattaccttgctaggatgtgaaatgagcgcaggttcaaaagcctggactgtagttaatccaacgtgcaagtgtggtcagtcatgtccgactctttgcaacgccatgcgctgtggcctgccaggctcctctctccatgggattctctgggcaagaatactgcagtgggttgccattcccttctccaagggatcttcccaacccagggatcgaacctgcatctcccacattgccaggtggattctttaccactgagtagcgctacaacaaacctactccccctttctttttaaaaacagtattttattaaaaagtgtatttttaaaggcaactcacatgattctgatgcaggcagtgactgccagatgtttggaaactgctatccaagacaccccctgcatcttggtttggtatttaaatggtgagttatttcatatttaaaaagaatctgggggagaaaattgtacagttgtacaagggggaaaaaacacgccccaaggtagaaataagtccttaacatattgtcaggtgggaaaaaaaaattaagctataagagtaagaagaaaataaatcaatctatttctataattatgatctctatctatatctttaactactactttttgaaatgacatgcagccagaaacagtacaatgcagagacatttcatattcctgggtacacattttctccgtgggggattacagaatgatataagag

SEQ ID NO: 36003 - DNA, 1985 bp, Bovine  19866881110442
tgaactcagaatctggggcaattcctggaatacagtgagtgctcattagatatatgtgtatgataattaattggaaaacaattggcaatgggggcaataagatatcacattctgtcaacgcaaagtctttgtgatgacagtaaatataaaagattgtgtagtgagaacattcatgcagaaagacaatagtcacaaactaaaaatatctttacatatctactgtctgataatactaatgtctgttcatagagctttcacttcattatgttattatataaagagttcaatcactatgagtagtattatcttaaaatgtgaaggacaatgaggaggatacacacattcacagatacacacatctgtattttggggatgacctaaaatttactccattgtatatgagggaaaaatataaatgaaagaaaactctctttgaaagcttaaaaaaatgaaacaaaagcttaattctttcattcaaataatatctataatttaaagtcatgacaagataaattcacagttacgttagaatcgtgcaattacatgtgcacaagtgaaagctcagtgatgggatagctcgctctttgggagggagggagtagaatgggagtattatgaaaacaaagagtaccttggtccatcagaattttcaaagaaaataaccctttggccagaccataattccccatagaaacaacctacatagagtcacatacagtgactaaattatgtttatgcttttattaagcaacagagctcattctgacaatttatctactaagactcatgccagaaaactgcttattcattttctatattctgtttggaaaacaaaacatgacacataacaatataaaagaaaactataatcccgagacgcatgtgcagtcactgtacaaaagtgttctaaattgtcttaggcctgtggcattggctttccaaacagcatttaaacactgccacatgctgttcatctgtgtgtcttgcagcctgtggcaccggcctgacctcgacagaatgaatcgtgcaccaaattaatgaagctattaactcttcaaaggaaacttccctggtggctcagatagtaaagaatctgcctgcaatgcaggtaacccaggttggatccctgggttgggaagatgccctggagaagggaatggctacccactccagtattcttgcctgaagaattccatggacagaggagccaggtggactacagtccatggggctgcaaactgtcggacacaagtgagcgacttaacactttcacttcacacttaactcctcaaaaggaccaaccagtcttgaagaagggaagtataaaaatcttgagaattaaataattccttaagaattagtaatttctaataatgccattttcagcaacatggatggacctggaggagtgtcatactgagtgcagtcaagtcagagcaggagaaaaatggtatgccgtcccatatatgtggagtctaaaaggaaatgatgcaaataaacgtactgacaaaacagaaagactcacaggctagaaaatgaacttatggttgccaggatgaagggatagttaggggggttttcggacagttatgtacacagtgctatatttaaaatggataagcaacaaggacctactgtatagcacatggaactctgctcagtgttatgtggcagcctgggtgggagaagctttgggggagaatggatatgtatggctgagtgcctttgctgttcacctgaaactatcataatactgttgattcactataccctgctgctgctgctgctgctgctgctaagtcgcttcagtcgtgtccgactctgtgcgaccccatagacggcagcccaccagggtcccccgtccctgggattctccaggcaagaacactggagtgggttgccatttccttctccaatgcaggaaagtgaaaagtagaagtgaagtcgctcagtagtcatggcctgcagcctaccaggctcctccg

SEQ ID NO: 36004 - DNA, 1635 bp, Bovine  19866881129375
agtactaatttatctgataactagagatattaaatgtgctttgattcatatgtttgtcctttggtttttctgtgaattatatatacatttccttcttttgttcaattatctattgtagatttaattgatattggttttatttttttcttctttccttcctttcttctttctttcttttcttactaaaaagtcaccagttcagatttttcatgggatgaatcttgaataattaagtatattatttgttaggacaccacctagaaggatctttccactccctccaacagtattcttatagaaagtttacacagaatttcacttttagaattctctttgatgacaaatatattaatatttccttttacaggtagattccaaatgtggcagcttttagcagcaacatgctggatgcttcttcttggacctgtattcggttatcacaagaaaggatgcaccacaaatcctgaagctactatgaatattgtaagtcgttcattaaggaaaaatatttaagataagacaattattaagctattgtcattttaggggctttcctgctgtcatttttagatatgactggtatgcctgtctagtttttaaaaattctaagttgactaaatctgtgtttccaacctttgttccttggcgtcgttgactaaacaaagaactgcaaaacctgactcaatttgggggcagtgaagctccctctgctggtggcttgagctaccatttcatttgtggtttcttgaagagaaagttcacaaattcctgttgatgatctttttagagaatccttgggctcttctgaggttttttatagagcagtttctctgatttatgaactacatttatgtacattttaagtttagtaagccagatttggtttgggctgcttataaacaaaaatatctcaacaggcagaaattcatatcagaaggggactagaacaaagtggaatgaaatagatctatgcaaacaacaaaaacaaacaaacaaaaagaccagtcacaaatgcttacgatatgcttcattccaatggaaaacatatttcttgtatacactgtgtaccatcatgtccccacccatacccatttgtattagaactttaagaatggaactatcaatgacataatttttcaaaaaaaaaaacatttacagagtgaaccctgagtgccttaataataccatgccaagaaaactaccatgtatgattaccaccttaccttaccaacaccttggcatacatcttccttttaaaacccacctcaaatcatcctgattttcctgctgtattctgttccaaaacatagataacagtagattgtgacttaaagtattatattgcaatgtgggtaaaaatctaggcattatatcatgaaggtatacatgttcctttcccctttttagagccagattatttcctactggggctatccttatgaaatatatgacgttgtcacagaagatggttatatcctcggaacttacaggattcctcatggaagaggatgtccaaaaacaggtaggatttatttcattatgaaaggaattatgcctaaggggagattcctggatgtgctgatagcagcaggacagctggattctaaactagagcctattctcttctattcctcc

SEQ ID NO: 36005 - DNA, 805 bp, Bovine  19866881136345
ttttagcatgaaagtcatgcactctggtacactatcagaaaggtgatgtgcacatgggtaaaaccctgcttttctttcctaatcaaggcaatgtttgaccttaaaggagaaactgttctacttcttttgccagttaatgagaaatataggtaatccctgattggactgatgtcaggggagctttcataatggataaattagctaatctggggctgaagatcattgctaccatctccttgtaaattatgtttgatgatattccctaggtaaagattgatttataaatagttacttttccaaaataacttggtctccttgagcaaaacaggaaaaaaataaatgaatataaatagattcctaagaattctcattccggggtgaagggaatgtcaagaagtctgaaaatgattcttgaaagaataattattttttattttttacagaagttgtttggtaccaaaggtttctttttagaagaaagtatagggaagtcaccttctgtcaaaatctgcaacaataaaatattatgggtgatatgtagagaatttatgtctttatgggcaggatccaacaagaaaaacatgaatatggtatgtataatgattcgagggccgtttgatgcttttagaaattccagctttcctttggttcttctttttgttttttattcatttatttttggctgtgctgggtctttgttgctgtgccggctttctctggttgcagggagtgggggttactctctagttgaggtgcgtgggctttgcactgcagtggcttctcttgttctggagaacgggttcca

SEQ ID NO: 36006 - DNA, 1756 bp, Bovine  19866881236123
tgataggatactgaaaggggaactccccaggttggtaggtgtccaatatgctactggagatcagtgaagaaataactccagaaagaatgaagggatggagccaaagcaaatacaatatccagttgtggatgtgactggtaatagaagcaaggtccgatgctgccaagagcaatattgcacaggaacctggaatgtaaggtccatgaatcaaggcaaattggaagtggtcaaacaggagatggcaagagtgaacgtcgacattctaggaatcggtgaactgaaatggactggaatgggtgaatttaactcagatgaccattatatctacaacttcagttcccatgaattaatataatacatgtacaatcagagttgactcattcactgtaattcatcttttttgcccaggctccagctttaaacactgtactgttttagagagcaagtttgtgtgtcaacaaattctgaaacagcctgaccaatcatggttgagactttttcctcaaaatctctgaaaaggctttggaagtgaaggcagattccgccccacacacacacacaccaaaactacaaacattcaaatgctgtggactaaatatacatttttaagaactttttgagagtataaacagattatatgtttgtcagtgaattatagttttccctctctctcataaatccaagcatcagaatcaatgttgccatatttaattatagttcttcaaaatttataacatttaattactcaaggagataatcacattgcctagtggcagagtttgttctggagcttatgttgacaagaataactaacacccatagtctattagccagaagggaagggagttggtcacttaactgaaataaattgcatatatgttgagtcatctctcaaacgtggagcttgccaaaagaagaaccagatgggaaaaactgaatgagtcagtgcaaacctgtcactctatttggggaaaaaaaactcaagcttaattttctattcataatatgactatattcatataccaactgcatctttctttatgcaagcagattactgcactccaaagattcctgcaagcatgaataaatctaccaaggggaaaggtgggcttcaaattctccataaagatctcttatgtttttcagcttctggtgcatatctcctgggatctgttttttaattcacaccagggtgggtcctaaaagtcagaaactcagaaagacatgtacagacttacactctccttataaaaaaaaaagagagagagagagagagaaaataaacagtacggaggggatttttttaatatttagaatttttgcttttccttcagaagattcgtaatcaaaattaatttatttttccaaataaacattgcacagattattttatcattgattgattgacctgggttcctttcttcttgctttacttcaatcatagtattgcatatatgttggtaatgcgatttatagaatacaaaccaagagcttatttttgttaccatttatttacatctcaccagtgtagcaaaaatgactcatgctgacgatctcttactcacttatctcatgagtattgtactcaccatgaggaaatacccaataagcaggacaggcattaagaggataatgagtagataatcaaagaaggtaaatcttttcttcacggcataatgcaagcaggttctctgtttctaaaaaatccataaaaggactctttattaatgaaacactttttcaaaagtcagatttt

SEQ ID NO: 36007 - DNA, 1658 bp, Bovine  19866881247179
acgaggagtacaaagctaactcctaagacaaatcacacacctccagctatatgattaaaagcgtacaattacttcccctccttgattactcatttcctggccaattttctttatttaaaaaaaaagtatattttagtgctttggttaacagctcgaagtcattactgttttggaaaagttgattcgtctggttagccagttcgcaacagttttacagaaggtttgtataatgacatccttcgtgagcgtgattctgcaagtagttggtaagctggggcccgcctcctccataagctctgcacctgcactcggttgtccatcttccctgttggctgtatcccattaggaacactctcctttccctccctttgcctggctcattcctcatccatctggatccctctctgaagacattttcaagacattttcgtctgggagatcttcctgtctcccaattcaaggttaggagctttgctttgcttctaatgctttgcttctaaatgctttcactctccctgttttctgctctgcactcgtggccctgtcttacaggtgtggatttacctgccccctgcttcactgcccagcagattgttagtgctgtgaagaagatcctgctcctgcagttcccaacccaaaacagacacaaaaagaagtgaatggtgggaggttggggagaggggtgtaaaggggctggcatatggagactctgtattatctttgcaacttttctgtaagtcgaaaactattctgaaattagaagtttattgaaataaaaaaaaatcataagaaaggcgagaggaagggagggaggagagcgagacagctgacaaaatcagcatctcttgagaatgaatcataagtcaacaactttcacaaatggttcttccttacctaatatttgccattttagcccagtgaggtgtctaagtattatatttactttataaagaattgtagccaaaaaaatttaagcaacactgacagtttgattagttagtaaatagtagattcaggaattaaacttagatattcttgctctttctaactcccctgaaacctcccccactccacacacacacctaacccttaagtttaatgaaatagtaataggtactttgtgggaagaaatgtgttacatgatcaaatgattttagaaaattctgggttaatttaaacaggtctcctaatctaagagttctctgagccctcaatatgctaatatgcattctgactaagataaactgtgatctatactgtttcctagtcttctttgtctttatggagttctttgaagaacacctactgaataacaccttaagaatgctggtgttctggaagaaacagttcagacatctttaacagttaattttaacaacacatttttacaggccttcaagggcaaagaaatacaattttaataatagagtttcaggcactccaccagatgtgggagacacttcggacaaccatcctgattttactcaaaccacaccatgtaagttaaagcctgctgcttctactctaaagaaatccttgccattgaacatttcattctaaataacatttaaacatatttctacttattttaaaaagctgggaggaagaaaacccccaatacccttttaccatcaagactttttatttcttatccccta

SEQ ID NO: 36008 - DNA, 1323 bp, Bovine  19866881264170
aaatctaaagtttactggggacagacttcagcagttgtatctgtgtgagatttccccagggaaatatttcttccatcctgagaggtatctccggagttagaaaaatttgggtttgaaatctggctctgacccagaatctgtgtgaccttggtcaaattgctcaatccccctaagcatctgctttcctataaaatgagaatgagaacagtgctgcccttaaaggattgttaagaaaattaaatgagataatatcaagtgcttagcataatgcctaacatataagtgtaccgcaaaaacccagcactgcagttcttaaatttatatacctttcgagatgtctatatataaagtataacatactttagaaaaagttttttgaagcctttagaggcaatatcctaagtgtcaagcacatcaagataatactaaatcaaagatatctctttggtaggtaaagtatacatactgggtacacttcacttttcagagcagatggtaagaaaacaaaacattgctttgaaaagtaagatgtattaaagattctaaaaccatttcagataatagtttttgaaaaattaaaataaaccatggacttctttagctatctaatctagaatgctgtttgaagatttatcttttgaaagtaatgaaaacccatattttgtatcatcattatcctagtacactggcattacattttcctaatcctattcctagcccaggactatataaaaacggaaggtgccgaataaataggcttccctgtattatcaaaaagaaaagtatctttattaaaaatttaagattaagctggtttcacactcatgtttagggagaatgctaatcattatctgaatacaaactttaacaggtacattccacctagttgctacacatagctgttttctgggggggatggagggagtaattcagttcagttcaatcactcagtcaagtccgactctttgcaaccccaatgactgcagcacgccaggcctccctgtccatcaccaactcctggagtttactcaaattcatgttcattgagtcagtgatgccatccaaccatctgatcctctgtcatccccttctcctcccaccttcaatcactctcagcatcagggtcttttcaagtgaatcagctcttcatatcaggtggccaaagtattggagtttcagcttcagcatcagtccttccaaagaatattcaggactgatttcctttaggatggactggttggatctccttgctgtccaagggactctcaagagtcttctccaacaccacagttcaaaagtatcaatttgtcgggcttagctttc

SEQ ID NO: 36009 - DNA, 728 bp, Bovine  19866881294940
ctgtgtcttatttcagtgttggaaggtcaggtagtaattgatagttccatttttttttttctctcttacacagtttctgtcatatctgcctccctgccttctctttggtagggtgaaactgaaaagcagtgactgattgattgtatgaatataccaagactataaattcaaacgagtgtccctttcaacatagtcagtcaccctaataagccatacccttattgcagccagattgggcatctccttaaaatcctgacacttattcttcagcatgtactcagttcaatcaggtctttgaaaggtgagcttgaatttaatgtttcagaaacaactcaagtcatttggacatatatctttttagtaaagtagatgggcaatcttgacaattttctttaatgtttttatataactaaagagatataactgcttgcatttatttgtgttaatgtgtccagtaagctgattctaaaagctcctaccctaaaagatgttggccagtgtatcactacagatttaatcatatggccttctaggataagtgctttgaaagacaaaagtcagttgtatttatcagttaaagtacattaggtgtgttgttggataatttatttaatgtggggtgattatgactttgggctttggaggcagacttcagttcaaacttcagctgtccctgtggctttgagtaagctaaactataactccaagcccatctgtaaatggtacaa

SEQ ID NO: 36010 - DNA, 2159 bp, Bovine  19866881350027
aggatgagatggctggatggcatcactgacttgatggacgtgagtctgagtgaactccgggagttggtgatggactgggaggcctggcgtgctgtgattcatggggtcgcaaacagttggacacgactgagcgactgaactgaactgaactgaactgaactgattggtaatgtattcagttataacactatctgaggacctttacctattattaacaatgcatctaagcttctcaacagcctatatgatggacactgctattattttctatatttgacatataaagaaactgagctacttgctcgtgtcaccacagctagtgattcaaacccagtcattccaatttgaaccacttaggtaccatgctatgtggatgagatgatgaggcctccttgtagcccttacctatgagtgtgttatggttaagtctgtcttcacatcaggttccagtctccagcatttggtttggcagccaccatactcccatgtgaagttcttttctcctgatcttggtttccttgcagtgtgcacatgtttttctttcatttcctcatggttagtgttttatgacttggggatcttgaagaggcagccgtattgtggatgtaagccattaccacacaggtttctgctctttttcagaacctcataatttgttaaaagttctggtttgggttttcctcacatcttatcgctgacagttttagcagtgtatgccaacattatcgactgtctccagggtactgatgagatataaaggtttctgtaattgtctaagatcatttgccactttatgtagtacaacttgctcacttaggtacactctgcttccaagtggtttttctggcccccgtgggctataaaatcatttgatacggctataactttaaagacactagcaaaacaaaacactagctttgaatcatttgcttttgttaactcctattttaaggttacctttttaactgaggagggaggcatgataagcagggtttcttctttgtaaatggagaaaatagagggatattttttcctctcacttcttttccttgctgatgatatcaattggcagtgattttcttatgagctttctgttagttttttctcgttttgaagcatatccatttccaatagaaatttttgaaaactgtagatcatgaccagtatcaagagctgctctgatcaagtcttttttttatctgatagctatttgaaaattaagcaccagtccaaggccacaccgtttgttagggtcaaaacaaaggctagattcttggtttccagacagacagttcagtgctctttctatgttccaaatcctcagagtttgtttgaaataaaggtcaatattgcaccttcaggagaaaagttaaaggaagatttacttcgtaaaagctgattattttgaaagctcaaagccctcacagatttaagtttccaaagaataatacacaatcacaagtgtagctttccaagaacctagcaggaagagatagaaaaactgtatttaattttctagccaaatgctagactgacataaaattaaaattttttaaaaagtgtatgttatatatatttgaatgctcttagggagttattaaatagtaaaactggaaaagaatagtattttcttaactcctttaattttttgtctcaattgagttaatattccaatatagtaaggaattcagttttaaatttctgtggcccttcatcaagtccctaaaaagaatttatagtctgtattagtttgttaccataacaaattgccacaaactgagtggcttaaacaagagcaatttatgactcacagttctggaggctagaagtccaagatcaaggtatcagcaacattggttccttctgagggttgtgaggaagagtctattccatgtctcttccttagtgttttagttttatggactgctaaatgaaatgccatagaccgggtagcttaagaacaacagaaatcttgtctcatgtacttctggaggttggaaagtccaagatcagaacactggaagcttcagtgtctggtgagagtcaacttattgattcatagatgatgactgtcttctttcatagtaaaaaggtcaagggatctctttgagatcccagaggcctcacttcctgatactttgggtgttagcatttccaca

SEQ ID NO: 36011 - DNA, 856 bp, Bovine  19866881367647
ccccaacacacacacttgttctcttacagaatcattttggattagattttagactgagaagtgatcttggagttctagagttcaatggtctcattttacagaggggaaaaatgaaacccagatagatgggcattttcccaaagtaaccatttagaagctaatattcagaattcgacatagaattctcattattctaattcaatttaagagtttgttcaatttctccatggaaaatacacacccataagttcctctttctcaaatcaggaactcttgctacactgaacccagaaggcaatggctcaacaactgagccccaggggtcagctgtacctctccctaattgcatcatctcttcatgcctgatgtcctcaggttacaagggaccacaaagtactaaagatagagaactactctacctaagtaatcacagactgttgttggtcaatgtttaccacttatgattaaataaaagtcaaaatatcaaaacaaatcttttaataaaaatcaaagtgataaatttttatcaaaattttaaaaatctttctgaaagcctaaagaaggaaagtattcccctcagtatattctccccattcctctcttttaaagaaatctttcagaagatacagaaaaatcaactgatgcagatggtaggatctgagaactaccaggggaactctggtctgtccacagactatcagtcatacttacttataaaaattcagattttatatcttattttgttaatgacagcattgggcatccagattttgagagtttggagactgggttcaaatgaaaacttctactgcttatgatcataaggcacatccattttttaaaaaaataaagtatt

SEQ ID NO: 36012 - DNA, 1518 bp, Bovine  19866881402825
ttttgtagcatgtaggaaaatgtgaaattgctcctaagatgcatgtgctgaaaggcattcattcttttttagagctagaaaagtagaggttcccactcctcaacagttaagaaaactgccattttcttgacaatttgtggaactcatacattggtcatgataaagcctgtgtctattttttccaaagtggtgcctatgaaatcttagcaaaatgaatcattctatagagggtttaaaatcacagtggaatcaatgttttggtcaaggtactgctgctttaattacatttgtttcaacattttggttttggagattttcttatctgacctattatgggtccctgtgaaaatgaagtttaccatggtgccctctggtggaatcccatctggacatttttaaaactaaagccttatgtagtgagaatgcatccctctgcattaaagaaaaggagtaactctaaataatactgtcggcatactgtaagaaggttctattgccattgagggactgtaagaaatacatgcctcagaatatttgcctgcaaattcagggatacagcctgaaggagctgcaaaggaaaggccatgatataaatgtatgaaatttcaatcctgttagaatgaaggctaggagccacagcatttcacatcacctgacaacttggaagctgactaattaggtattatattcagaagggcaaaagaaggttatggatgtttcagcacttgaaacaatatttataaatagtcatgaacacaaaaggaaagtagaatttggttgtggtttattgaaaaccagtgcagattcatttcctcatcagagttgataaaaccataatgtgtccatcaaaacagcaagcgtcacagcattggttccttgaaacttgttgtgaccgtgaaatttagtgactcttcaaaaagtgtctctcgcttatctctgtaaggggataaagtgatgatctcttggagatattctgggttacatatcacagggatcctactcaaggaatttgagtaccagccaatcataaaaagatatcaatggaattacaaagtacttagctgaggacttagggtcttcagatggagaaaaacagtgttattccataaaaatcagttgtatgtttgttcatttgaatgtactaaataaaacagttatttaaaataaaagccaaaaaagaaaaaggacaaagtgagcatctaatcctttagagtgtctgcaaacgatttagtggtttatttccgtattcagcattcctgaaaggtggaatgtagggcagagtaaacagtgagctgtgaacacaacacacttgcatttgatccttgatgcttttcttactcgggacctttctttgaaacctgatgtatattagattaaaacaaaagcaaaaataactactaaaccctctaacgcactggttttcaaagtagtggtactgccccctagggggtgtttggggataatcttgtcaggaaggtgtctcaaagtatctaaatgattatgtggctattactgaca

SEQ ID NO: 36013 - DNA, 1460 bp, Bovine  19866881423547
attttttgtgacccccaggactgtagcccaccaggttactctgtccatgggatttcccaagaaaaaaaaacgggagtgggctgctgtttccttctcgagggggtcttcccgaccccaaggttgaacctgggtctcctgtgttacaggcagattctttaccactgagccacctgagaagcccaagcagactttatttgaaacaaagtattcctcttatcttacctctcagctatgttccttcttctagtcagtctcctcccccagcacacatgtgcgtgcactcacacacacacacacacacacacattggctgtggtacatttacacatcttactccttccctttggaaagccttatacctgcttccttccctggcaaattttgatgtttccattagacctcaagtgaaatgaccagtcacaccctattgaaacgttctctgtccagtatgctggcctcctcccatgcgtttttatagcgccttgcccttctctctgtcttagtccttggacacttacatgccagcagttgtgctgaactggaaactccttaaggacgtgaccctttaaatctcttttgtattcaccttgtctggcatgtagcaggttctcaatacttggtgaatgatttcatgaatttcatttccccctaatgaaaaacttcactgtacttccaaccgatttagcagatcgtgacctattaagtttgaagttcaatacacttctgattatcttatcaaatgactgaaaatgtgaacgtttaagaatttcggtgtaaacacttgggcaaggggaaaagttcaggggtcttaacctagttttccttgctctttataaaacatcttgatttcttcaggtggacattgacatgatagcacaacagagcactgaatgtcaattgaatttttttttcttttttaatattttcaggttacaaatgctgctgccaactctcttggtcaaatgactcttcacctccagcctcttcttgtgtgtgggggggatggatttactcagtccaactttgacggctgcatcacttctgccttatgtgttctggaagctttaaagaatcatatttagtactgcctgtattcttatttttcacatgtactttggggttcttgttttcacagttttctgtcattgattattttgttttctcttttgttgagagaaattactgaaaaattgttctttactgattattatttttcacatggagtataaaatcaatttgataatttcagtacttacaactcctacaagaaggaaaaatcccttgtactttatacttttttccacttttctgagttgccatgtctacccactccttgttggaggcaaagtcgtgcttaagaaaaaacaaatagctctccccccaaattctgtcaaatccaagtaacagttcatgtccacagacctttgttgtcctttgaaaatttcagtcccaaataaaga

SEQ ID NO: 36014 - DNA, 1339 bp, Bovine  19866881466934
aagaaaaataagacagagaaaaataatgaaataagaaacaggatttctcgagcatttaactgaagaaaaaaataatgataatggtaataataataattcattattaataataacagtagtagtttgccactgctgatagcaaatgaccataaatttagtgatttaaaacagtatttattatctcactttctgtgggtcagtagttcaggtatgggatagttaagtcctctgctccaggtctcactggttctcaagctgcaatccaggtgttagacagaccgttttctcaacaagaggccgaactaggaaacagtggcctcccaagctcattcaggttttggcagaattcattttctcacatatgactgagagtcccaattctttgcaagttatcagctggaggccacctgcagatcctagaagccacacacggttccttcccacatttgtttgccttattaagccaacaaggagaatctcttgctccagtttgctaaaatggattcttatatagtagactgcaattaggggatgacatcccatcacctttgccaattctcctgtctagaagcaagtctcaggtccctcccgcactcgacgggaaaggattacataaatttgtggttcctgggtggaccacagattattggaggggttaccttagagtcggtgtaccacattcttatgactaaaatccacttccttagagaaaggaaagtgtatttaattttacagccattcctccatcattctaattaggtcttggtaaatttcaaggggtgcatcctgtccaaggtaaaaatccacatgattgtagtgtggaattgacttgtaataaatgagcttgggaattttagggagtaaattctcaacatctttgagatcagccacgtagtcctgtccaccactccacactgctgttggaacttccatattagaaacgttgtatagaggaggtgtaagctaaataaaattgaagagagagaaaaatagttttcacagaaaatcatattatagaaagaacatcaatcatcagttgttaagcaagttctgtatgttctaaatgttactgtatattatgtacatacattcaccattgtactactatcttagaaatagtctgaaaatgcaagcagcatatgcaagcagaattgagagagagtgacagggagaaagagagagcctgatgattgtgtatattcctggctattgtgagtttatcattatacttcttatttcagtaaaaccaaaccatatttttataaaatgtaaaatagagtgatttttactacttgcattgtaaagacttacatattctataactaaattatgttccccg

SEQ ID NO: 36015 - DNA, 633 bp, Bovine  19866881575973
aagcccttgaaattggacctaaatgtgggcaagttttatagcttactgtttgattctactatacagttagggttgagaaacactgctttagagcccgcatagggacaagaaaagctttatgtccagagggttcttgatgttcttcttaacaaaactgggagtacttctgctttattttaatctgaaccctcaagatagactggaatatccatgaaaattcaggtcctcaacagtaattatcaggacaagccagatcctcagagaaacggggagcagtccacccacctcttgggtttctgtgtccttgtatctgcaggcttctgagctctttctggctaagaacaaaagccattttacaagcataaatcaaggcaggaaagaaagtccctgcaattctggttagagctgatgggtcctgttcaccatgcttacatttagtcattctcttacatctggaagaattgcctagagttgacccataaatgtccagaccactcattcactgggtacctgatcctgcttcatccccatcagccccaccctctccctcctgtatgttgacatagccctagcataggtcccagtttctgactgtattatacatggtgctacatgcagtaccatgatttgtcc

SEQ ID NO: 36016 - DNA, 1240 bp, Bovine  19866881624590
tcaatgataaattcccccttcctccctcactattgagccaggacaatatataaggggaatgggtgagtggcaggctcatatctcattcaacctgcatttgcttgttagatggatgtcacttggaggctatggtcactcagctgtactttggaaaaatgctctatcctggttgaatagcagcttcctgagatgtgctaatcttgcaataatttctattgggctttggccctggtttctgtttcagcttttaaaattctatcttctggtaattttttaccatatattatttcttcaaactgattaattataacattaacaaggtctcttggcttctgtcctctttctttggtttcaggaagtgtctctgagggttttctggccctgttcaatctgttctgtaacagaatagaacctcaactagtccatttcatatatatgttgtaatctttaaaaatttttatgtatttgaggcccaatttagcaacagaaaaacttgtttactttaattcctagatcatatagtttaagtattgtacagtatataatataatatacaaccatcaaattgatgccttcaagctgtggtgctagagaagactcctgagagtcccttggacaggaagaagatcaaaccagtcaatcttcagggaaattaaccctgagtgctcattggaaggactgatgctgaagctgcaactccagtattttggtcatctgatgagcacagctgactcactggaaaagcccctgatgctggaaaaggttgagggcagaaggagaagagggcatcagaggatgagatggctgaagggcatcaccaatgaatggacatgaacttgggtaaactccgggagatggtgagacagagaggcctggcgtgctgcagtccatggggtcacaaggagtcggacacgattgggcaacagaccaacaacagtatagagtaactaataatatttgtggaatagatgtgtgaacaaacgacctatgtcctagtcaagctgctggcgattttctgttttatagagtagacctgctgggcaaaataattttactctgttacctatattcttaggcaattgttaaagaacaccctattatctagcagctattgaaattaaactaaatttaaaattcagttccttagtcacactatgtcacgtgctcaagagctaaacatggctggtttcaaccacattggatggggaaatatagaacatttctatcaccacagaaagta

SEQ ID NO: 36017 - DNA, 778 bp, Bovine  19866881673046
aacaaggtggtgcgtggtttgtgactgcagtggtgaacggaagtgagttcaatgaaagagaattaaaaagcaaggataattcctgatttgaggctaaagaggctaagacattgattggtggctccatttgcggaaacagagaagattaaaggatgaacaagttctgaatttcgaaggcagacaatcaagagccagtgcttcacatgctaagtttgattataacatacatagattttttttttttttaaggagtaaagtaactcttgtcaatcatattctgaattctacttgctttccagggctggaataatctttcctctgtgatccttgcatcagatcctttaaaaattccatagattctgcccatttagcaaatggggcctcactgagtggactgcatatatttcagaatctgtttgcgagaagttttttctctggttaagacctcccgagttttatgaaaacatctatttatccttagtcacaaggagattttcagcctgttgcaacttttattggcactgccaaaaggaaaaaaatatggaagcatttcaatagtcctttaactggacccaccaaggtccccagagcaggcgatttgtcctaactcgcacttggtgttccagaccttgccggagttcttctgcagcatgtacgaaagccctgattttctatgatgacagtcgatgaaaatgtcccactttcccaatactccccagcaataagcagtcatcctttattatacattgttattcggcctactcagcatcatgcccta

SEQ ID NO: 36018 - DNA, 757 bp, Bovine  19866881686388
atgtaaaggtaagatgagaaatagggggaaatgattgaaacttggcagcaaaaacttaagtttaaaatgggaacaaaccaaagataacaaaaacgaacaatgttttaccagtaaattaattttaaaaagaaacttttaaataattgtgcttttcgtcaaattaaggtttttgttagttgtgggagtatgatgacttaaaataagtaaaatgctgcaggcttccattaaattaagtctggtgccacttacagttttttccccaagtccagtttatttgctttggctttagctaagcattgtggggagttgttattatgcaaacagaaaagaagctagcgggtttgcaaagtacaagatgaacatatttctgagtgtcctaaagcttacaccaccagactctgacattttgccttaatactgcagattccaggtcctcgtaaacattgctttctgatttctaaaactatgaaagtttgagttaaaatattaattctttgagtcattgcctcagcctaaattaactctagtcctaaatataaatatatatatatatatctgtataaaaatatgaggtgacatgtaataaagtttttactattatgaattttagaatgactatattgctcacgaatggcatggccataaagtaattaaatggataggctgggaagagtggctgtaaaatatgtatgatattctgtgacattttatatgagtacacacaatgcattattattatattctttctcatttgaag

SEQ ID NO: 36019 - DNA, 1000 bp, Bovine  19866881747070
ttaacatgtttattatttgtattttttttataggctggtaattctggtcggttccaagcttttgattggggaaaccctgatcagaacatgaagcacttccaccaggtacaataacaataatcaccaattgcatactgcaaatgaaatttgtaaaaatagtatctactcatcaagcacctactcactatgctccattcactatgccagatactttgtatagatcagatgctatttggggggatcttaccacttgccatatcattgtttttgattcttagcatgacctccccagataaatattaggttaggtaaattgtctctatttttccagaagctcagagaggttaggtgaattgtcagaaattatttagctaataaagaaccagaataccacccagggttcctggatcaaaagtcctttcttctgttacacttactccttctcaaaaaaatagaaactctcagcacttaagaccatatttttaaagaaagaattaaagatgcgcaattttatttctaaagcgtattctctggcttcttatccatccttcataaatgaacctgataaaatgaactaacattatcctaataagtttttggatgtcatttactgctcattcaaaaacaattatgaattattaaaggtattccagacaggattatcacctttagaaaaaagcaatgctatttgccagatgatatgtccatgtatatcttgacattatatatgaaaactttcctttgtgaaaaaatttcatattaaagtgaataggcattgttgttaatttttccagtatttaaggaaatccaatgatggctttagcttctggctaatagactgagctcaaattaaacaagtaggcaacaaagatacatggatttttttcaaatccggcatgtggaaatgctggagtttttttaaagcacactccagtactcttcttgcctggaaaaccccaggacggaggagcctggtaggctgcagtccatggggtctcga

SEQ ID NO: 36020 - DNA, 1193 bp, Bovine  19866882107621
aatacatgatagtaaaaaactctttcttttccttgccaaatgtatatatttaggacctagggcagctccctccagcattttgcattacaaaaattttcaaacaaaataaaaccactctgttagatcctgcaacaatcaaaaactttccaggcccagaagatacaattatttgtaagtgaatctctatagaaattgagattgtttcagtcaaaagtcttgcctccctgttctcagaatgaattgtagagcccctggagcagacaagggtgtctaaggttaatctctgtttctatatagatatcaattaccttttcaaaaggctgcccagtgggatttgctacttggcagcttgtctaaaaactagctaaatgtactaatgtgtgtggcaggggaggaaaaggtccagtttggttgtcaacctagttgacccttccatttttgtacaaagaaaaaaatatgtttcttttttaaaaagggagagttttaagccctttcagttgctaaaatagctgatttcacagttttgttggtttatttttttaattgaaaaaaaaaaatgggaagccatgataaaccctcacgtgcatagcatatgctcacctgctagtatgagtctccttcatctcctcctctctcttcctagtgagaatattttatgatttctgaagatctgtgttttcattaagaaaagcagtaagcataatatcaggccccatagctccaaaagtaggttaaataataaaatgaagcccaggatacgagtgtaacaaggccagtgtcagaagatcattcatttatcaattaattaaatctttcattaagacagaaaatgatggttaaagggaacgatggcttttacttctgagtgcaaagtaaccggtaatgtcagaggagaaagcaatgctaaagttcatcttgaagctcagacttacagatctagaagggaagtgtggacgtgatgaagatatgcatgactccagtgcgggaattcttgcttcatcttggccacacaaacttggaagctgtgtaacctagggcaagttacttaacctctctgaatctcagcttcatagagatataaaattaggatggcaaaatcatctatcttgcagggattttgtgaagattaaatgaagtcttggttctaaaagtgttttgtggccaagaatatgctgtgataatgtttaggatta

SEQ ID NO: 36021 - DNA, 1569 bp, Bovine  19866880609750
aattttgaaaatggaaagaaagagaaagaataaagcattgatccggcctttcatagaaaaactgtacctcagagtaaccaaatagttgataaagggaggtttctctgtgtagaaatatttcagctaataagtaagaaaagaatggtaattttaaaatatcatgactttgctacccttaatacattaatgagcctgggtggtgacggttaacgccagttagtgagggagagagagagaaagcggtgaccagaccctagatacgtcttggtcatggggcacagtgtcaccaggggaacagcctcaccaaaaacgtggatcaacaccatgaagttggtgaagcatcttgatctaaggatcaatttacagaaaatactgggagctgatgaaaatactttcaaagttacacgtcagggatgcagtcgtcagcaccagctggtggggcttctggaagaccaacgtctcagtgtctccaacacatagattataagagagaaaagaagtcaacaatatatttcaagtttcaaaatgtatttgtaatttcttcaaagactgtttctagggttcagccgcagacgtgaactaactgggagctgatggcttatccataaggtgaagagaacgtttcagtgtcacatgtctatatgtgtggataaagaggtgtgctcagaaatgtaccttaggaaccgcagcacgaccacagaaagaaacacagagctttcagggcagcgttactgcttacagagaagctggaaacagctgaagtctccaagcggtgagaatggcccaccgcctggcgatggagacaagcccggccctgggcccagctggggcacagcctggacgtctgacctcttcccatgagcgccctctgggctggctttcggtgtaccatcttacgagtctttcccaatttatcccctttgggtccctattttttcttttgctatattctattttggcttgaacgggtgaattttcatgatccaatctgttcctccgttgacttttgtgtctattatttatctttcagaggtttccctcaaaatcaccatttttatctttatctttttatggtttactctgacccagtctcatccgtctctgtcatatgaagaccttcatgacataaagccaccctcagcctctcctgtcttgtctgctactcccttccacttacatttcgtgtggtaatctcaccgtgttttgtgttttgttgtcttaaagagtcaacttgtgaagaacgtggcagaagaaagggaaacactgcttttatccatcttcatctttactcttcccagtgtttgttattacttctggacaccacgtttctttctgataaaatccctcttcagcctgaagaacttccttcatcattcctcagggtgcagatcagctgggaacacgttcattcagctttaattccccttaaagtgtctttatttatccttaacgtttgaaagatgattttgctagatgcattcctatttgacagactttattcagcttcattttcttgctgccaatcattatttttgtgacaaaatatcctctgtgagttttatccttgct

SEQ ID NO: 36022 - DNA, 1781 bp, Bovine  19866880748183
ccatgcacacacggtcatgcggctgcttttacctgcgaggtctctgaatatcttcgatatgaccacagggacgccgtgttccacgccgccctggaagacaggcacaggggtgcagtgaagtcggattggggaccttcacagggaagtgtcgggggaaaagcaacgcattcatacctttatgctcaggcccaggccgcccacaggctgtctgcgaagcgtaacagttctgtgctttaaaaaatgtagaaaacaagcccagtttaggttaaaatggacaatcagaaagtgaatgcaaaatgtatacattaacttctttattaaaacttcagacatatgggggacatatgtatacctatggatgattcatgctgatgcttggcagaaaccaacataattctgtaaagcaattatccttgaatttaaaaattttaaaaaacttcagtagccatttatatttccaaaggggagctgcctaatcactgcagcaacagcaccatttcaaacctgcactcggcagtgctacagggaaacagacgggcctggtaagaaacagccggcaccgtgctggtttaagatccaccccgagctcctgtaaagtcggtcatctcaccccgttctggctctgagggatggaggccccgttcccaggcagcagatggggaggctacagagcgcatgctcagccctccgtttctaaagtctgtcatctcccctgacccccaaagaggctgcctgcgcaccgtgctgctctgcacagctcaccattttcagatcagtcgtcaagtaatcgatgctaacttgtgaacgatccaccatttcacgtcctgacccaatttaaagctgccagtgctgacgagaagccaagactaaccctgccgtggctgacgagtcggtcacgccacctctcaagtgttccaacatgtaaggtgtgtgtttggtctaaactgactatttgtcagtgaacagggttggccaaggattgatgaagtggtgtaggaagcgtgttcacctccaaaagtagcaatgggaataataaaaaggatgcacattgctttggtaatttctgtaaaaattggagagattcacagcaaatacgctggtatatggccaatatggagggtaattacttagggttctgcttactacttttcaaatgttgaaaaattacataatcaaaggaaaaaattataaaatgtttagtagactatgcaaaacactttgctattatgattttacttacctaaagtttcactgaaagacaaatttttgtgtcttatttgcacacttatatgcacactcacacaaacacatataaaccattatttattctatccttaagctaaatcacagtgtaaacttttataatgaatttggcccatctattcattctttgtgggcttcccagatggctcagtggcaaagaatctgcccacaatgcaggagatgcaggttcaatccctgagtcgggaagatcacctggaggaagaaatggcaacccactccaggattcttgcctggagaatctgtggacagaggaggctgcctggctatagtccatggggttgcaagagtcggacatgactaagcacacacacacacattcagtatctcaaggttttcatgttctcaaagccaatctgtccttgttgaagagaagaagactatggattgagtccacacacatttactgggcgaatgcacggtgctgagggccaggaccagggcaaattccacaagagtcagagtcgccgatgtcccggcagctgggaaattcctaagaa

SEQ ID NO: 36023 - DNA, 1008 bp, Bovine  19866880158322
ttgcagccatgaaattaaaagacgcttactccttggaaggaaagttatgtccaacctagatagcatattcaaaagcagagacattactttgccaacaaaggtccatctagtcaaggctatggtttttcctgtggtcatgtatggatgtgagagttggactgtgaagaaggctgagtgcggaagaattgatgcttttgaactgtggtgttggagaagactcttgagagtcccttggactgcaaggagatccaaccagtcccttctgaaggagatcagccctgggatttctttggaaggaatgatgctgaagctgaaaccaatactttggctacctcatgcaaagagttgactcattggaaaagactctgatgctgggagggattgggggcaggaggagaaggggacaacagaggatgaaatggctggatggcatcactgactcgatggacgtgagtctgagtgaactccgggagttggtgatggacagggaggcctggcgtgctgcgattcatggagtcgcaaagagtcggacacgagtgagcaactaaacggaactgaagccctcccctcattcttcacgaggggcagagaggtcagggggctctgaaaggctcagccctgcactgacacagttcggaggcagctggacttgggcggaagggagggaggcaggtacaaaaaccaatggcggagggggacgggagggccccattctggccctgaccctggagaccccatgcaggccccaccccgtttctgccccacccccggcacacggggccctccacggcaggcccgcctggccagtacatccggggcagtgggcaggggctccccgccctgctgcggccggtttaccctgagaacccgggcccccatccctgcattctggatttaagaagggagaaaatgttaaatccacactcgggctttgcgaggttgtaattactcgggtctatcaagaataaccttccctctttatcaagcgccatgacaggcccgccacaa

SEQ ID NO: 36024 - DNA, 1222 bp, Bovine  19866880410820
ctaattatagctaccccgtgccagtgcccacttcgaatctaactctcatgagaggtaggcgctaatcttatctgtacttcggctctgaggcgactgaagctcagcgaggttaaggaacttgtcccaagttcacattttgttcgtatttcatggacgttctggtttcgcaaatgcagatcccatctgcgagcacaggtttccaaaggcagaaggcccctgtagaatagaatgtaaactgcagcggggacgaagttgcaggaaacgcaccctgtactcactttctcaagtctcttgtccgtttcttttggcgcacctggggcccgggtggaggtacttgttttgatgacagtttaaggtattattagttatctcactataactttattgtaggaaaagaaagacattgccagctgtttagtttgagtgtctgtcactgagccacccagtgctgtagccacggtctacaggaggctatttacatctgaatatcaaggaatcaaaatgaaataagattagaagtgcagttccacagcctcaccggccgcctctcaggggctctggagccacatgtggttgtggctgctgttctggacgcaggaggagtggagtgtttccagccctgctgaaagtttggtgtgatggcgctgctctatagcgagcggttctcttttgtccttctggataagaattggcaacactcttggctaaagcttaggctatttttcactgacaaagagataaatttagccagacgtttcttttatgtttaccttttaaaggtctgtgtgtgtgtgtgtgtgtgtgtgtgtgtgagagagatctttcctcccattcacattcagtttttgacataaatttgagtttcccttttctcctgggcccccagaggggcttacgttatcattattgtgtgttttaccaagaggctttctctgaaaagatcagtacggcgggcaagtgatggccacggcttgaagccctgttaattccttgctctccaaagaagaattcagttcagcttttaaatatgcatttgtgttacttactccctacctgggctgaattcacgaagaaaaagcgttctcagcagggccaggaccaaagagctagaaaattaggtcacattctacgtgtggtggctgcctgccaggcctgaggtggaggagacagcctctggggtacccgagggtgctgtgtgggggttttcctgggtcgggcctgc

SEQ ID NO: 36025 - DNA, 3999 bp, Bovine  19866880438843
actctttttttcggtttatgtattctgttctttccaagactgctaagttgtttggacataataatcaatttgtttggacctgactacttaataaatcaaacctcgcagcctggggtttctatgagaaaacatccataaacactgggggtcatacgtgccatgacctgaaaagtgtcagagcctttgccctgtattgttctgggcattatatgtagcatgttcaggcgcgaggagcagggacagaaagactggggacaaaggggccggcatgaagactgcacccaaaagtgtttctgcaaaaataacagctgagagcaaataacacgtaagcgtttgttaaatcacaatagtgggtgcagagatgtctcattttttcatccttatccatgtgttttcagtggttaatagtaaaggcagtttgaaaagaggacagaaggcggctccggtataaatttagggtgcacttgtgtgggaggaaagcagagagctggagaggtgggacatgagatcctaagaggttcaggagaaacgggctgaaaccaaggaggtccgaaagaccaccctcctctagactggggttcccagcccctggttacgcgcttcagactcagggctgcggaggcccgggtgttgggaggttggagaggtcaggagcgggaagagatggggtttgctctgagggcgtcgattcttaaccctggatgtcagttcctgtctcttcagaagtcttaaaaagggatgcttggcgcatctgaaaggcctgggcgtatggacatccagctgtcaggcacctggcgggcagctgggacggagagtcacctctgtggtccaggctctcgggagctttcctgtggtttagacgttgctgaatcacgtggaggtgtggattcggacgggcaggcctgggtgggccgttcccacgggtggtggtactgctggtctgagcaccgcactttgagcggcggcctcttgggagggggcctttttcagctaagggtggttgtgatggacgctcgttggagagcagaaaggtagtctggatctgtctccgcccggcgttcgcttttgataaatacccctcttatctttttttttaatcttttttcccccttatcttttgcggtgtaacattttacccccaaacttgggaactgaacacagtgaacgcttatcatctctcggggctcctgtgagtcaggaatccagaggcagctgagctgggcggttctgcccgggggcctctcctgaggctgtggtcaggatgccggctggcccgaaggctgctgagcgatgctgtcacttcggtgtggagtttgccgtggttgttgggtagtggtctcagtcccccgccccgggggcttctccgtgctgttaagagagtgtcttcccaataaggcggtgcttccccggtggctcagtggtaaagaagtcacccaccaatgcaggagatgtgggttcgatccctgggttgggaagatcccctggaggaggaaatggcaccccactccaggactcttgcctgggaaatcccatggacaaagaagcccggtgggccacagtccgtggggtcgcagagtctgacatgactcagcagctgagcgcaagtgcacggaattgacagcgggcttccccaggcccgcccgcccttctgctgcatccggctggccgcagcggccaaccccgatgagtgcagggggtgccccctcgtgagcaggaggattactgagccccatctgggaggctggccgtgatacgccttgatgtcttcaactaggaaaggaatgcccgtccaacacgagaacttgaaaactatgaaaagctataaagtgaatgtctcccatcacgtcatgacccagaggaaagttctgtgaaagttgtggtccctgtcctgccagttaagaaaaaagaaacgcatggattttcatatgcagacgcacacatagacacttaaaaacagcagcataacaccggccctttcacacagattgttcttttccttggcatcaaatctggcacgctgtcagtgggtccgtttcagttacgcttgggtttctctcatagacggtttgtaggatatcaagatttgacaccatccaaatagctggttgggttttcaaagtttcatacatttctgagtgaagaaaaatgttctcatcatgtaaaaacttcttaatttggatcatcagttcttgcttcgggtgcctgaatgatgtaataaacacgctcgagccttcaaatataggatttgagtgaagaaataaagaatgagtttgccagctgatccggcatcattgcatgtaattgcaccatctctggttgcttgtcatgagctgttggcagttgttaaaattagctttacagtctgcctcagagtagcagcaaatgtagtaaatgagcactcactcttaatgaaactaatttgtatttgaaaatataactacatttattgcccccattatttaaatacatgcctgctagttggtagtaaaaatgaactttaaactgaggttttggggttttttttaaatcccagctgaaaaataatcttttcagaaggtgatccttttcaaagtggttttccagtgttgtgtgggcatctgggcttccctggtggctcagctggtaaaggatccgcctgcaatgcaggagaccctggttcatttcctgggttgggaagatcccctggagaagggaaaggctacccactccagtcttctggcctggagaattccatggactgtatagtccttggggtctcccaagagttggacacaactgagcaactttcatgggcatctggggaaatatttaaaacacaaattagaaatgctttaaaagtaaacacttcaaacatttgaaatgacacggtggaacttctgtggtggcccaggggttgagactccgcctggcagtgagcgcggcgctggaaggcaagttcagtccctcgtcgggaagctgggatcctatatgccttgtgaccaagaagccaggcatgacaatggagtcagtgttgtagcaaattcgatgagggctttggaaatggttcacataaaaaaatcttaacaaatacgtaaaatgacacaggatattgtgtcctgttgctgatctcttttttctggaaccaggtctctggggatgtgccatctgtttgatttcacagtggttccctctgaatgccctgcaccccacccagacttctagaaccaccagcctccctgtaccacctgcatccctttgtctcctttacctgtggtctccttgagggcatgacccaatctttccatttttatgtttcctaattcagggcaggactcaaagcagcttataatacgtttgcattgagtgaaagaatgagtgaacttggaacataaattctctccctcatggagctgacgattcctgcacgaagctggtccccatatacaccaaagacacacttccttctgagcttgattcagagagaattgcttttccagaatgtcaccagttggagggtctttgcttctgggtcatttgcagtgtctaatgtcctgtccttgcagttgggtctcagaaccccccggtgattttctgagtctcctcgccagtcagcatccagttcctaatgacgtttctagtagagaactagaaggatattttgtctctctcgtcactgtctcaccataggagtggggaaaggctttctctctttttctgcctttgaagacgtcttggatgggttttcttggtgccattagaatggtatcatctgcatatctgaggttcttggtatttctcccggcagtcttgattccagcttgtgatccatccagcccagcgtttctcatgatgtacgctgcatggaagttaaataagcagggtgatagtatacagccttgacaaactcctttcccagttgtgaaccagtccattgttccatgtccaattctaacttttgcttcttgacccacatacaggtaaggtggtttggtactcccatctctttagtaattttccata

SEQ ID NO: 36026 - DNA, 2370 bp, Bovine  19866880587035
ccgttcttggagacccggaagaggaatggtgacagggtaatactgccggcacttctgatggctcttcggtttgttgaaaagggcaaagatctcccatttctgcggggatgcatagagagaacgggagacgggaggttaaacagtgacaaactgccttatcgggctggatgcgactaacaggaacctgcaggcagggcatcacaggccagccttctgctaggctgcatgtcgcctaacaggaagacccaagcagcacgttaggcagccttgaaagtgacatggaccttgaaggccgagtcccatggggactgccaacagaaggccggcccttgtcatctgcgcccatgatgatgaagtcctcggccactgcagccacggaccttcaataccccgagaggcattccgaacggagaccaggaaaggggtactctgtgctctgagaaaaactggcaggttaagcctttagataggtattttcaagagagcattttatgagcctaattcttgtatctcctcaaatcgagaaaaggactaaaatcgttcctggtgacatctgctccttgtcactggcagcaagcctctacccaaaaggtgtaactgaccacacatatctccttcacaaaaatcgtatgttacactgacctctcctcctacctccctggagccgtttttcagggctatcggaaatgttgtctcccaggctaagtcctcattctgtccccaataaaacttaactcgcaactctgacgctgtgcgttttttagtcagcaggactcagttctgaatatgacatatgatgaacagctgttagctgggatcaatttgtatggttaggtgtttgaaagaaggatatagtagacatttctagaaattcatacaaaggggtattttagaagaaaaagcagacatgttttggggcaagagctgatctgttttttctttttcttttaaaggaaatgcacagaggcacataaaatcaaaaatactgccgtaattccaggagctctgcacctccctgaattcactatttataaactgcagtggtgtttcctggggccgaacgcataatacttaatcaaggacatcaaaaatacatcactgaaatgtaaaaataaattcgctccagtaaatgagggttcctgcgtggagtgataaggttgctccaacagccaatgggccctgagagtaaggcgcagcttccccggccttcctttatggctgggctctgtaaaaatcgatgctcactgccacccggcagctgacccttgcctcccgccctacgtgcggccggccacgagtgagcagtctcagcctccggaagcaaatacctggaatttcaatctaaggctgaaggtctatttttgtgttactcaatttagtcgagcaaccaagaattcaccccgcttaaaaagctttgcttacacaggccactcaggaacatgctttggttgccaaaaatatcgattcagataagaaaatccccaccctccttccaaagaaatattctaaaggtcataaacaatggctgacattagcaaaaaggataaaggacacccacacactccctgtaggagacaccttgcctggaccccacattctgggacactgcatcccatgtttatttcccagttttccagtctccaaatacatgacctttgaaaatggatccactttcctttatctagataagtgtgcttaaacaggaaatggagcttcatgaccataaagggacaccgttaccatttgccacaaacaggagcaaacggtgaggcattttcacaccaaaaacgtttctccacatagcatctcaagttatctcacaggacgactgtattctgggacaaagagagtctttccactcaggtggcacttacccacctgagtaagtgccagcagagacctcagggagcaattctgggccaaagactttgctgtcagccgtttcgagcaatccaggggctagaatcaatgaggaaggaggggacgcgtcttcacaaacagccacccggctctccaacaaccagcactggcctgtgcctcgtccccaccccatagtactttctcggtccacttccctgactcaggaagccatcggaaaaggcagccggcaagtgctttcaggggagaaattagctcttggtatatggagctagcgatcccctattttgtgactttcaaatacaagcgttagctgtggcgtcatgccgagaaaggtttatagagaatcaagcaaggggattagggctggggggtgggacagaaagtgcccttttccagtccaaggagttggggttcaagtaagagctgcagctgttgaaagggaagagtgggagccaggccttacttcatctcttcaaaagcagaccctat

SEQ ID NO: 36027 - DNA, 1298 bp, Bovine  19866880597032
tggtataagctgtttaggaattttggacaacatgaagttgtagagatccagtctatttggaaagaatattaatatggatcatatggaagatcaatctccaaaggtcttaattcagtgccagaaacaggttaacgtacttgcttgtgtttttatgtggtgggaacgcgactgtctaagatgatgaaagttacctgcacttctaagagtatttgtcttcatatacataaatcatgaagttgaggttaaaactaatcctgccttaattttggtctatacaacataatagctcataatgggagctttatatcgccctgtcctgatgtaacttctatgggccatatcagcagtgcccattgttttataatccctaataatcttcattctgaatctaaggggaagaatcttttaacttaagcattcccaagagggctttcttgtgcctcagaatttgaaagcaccctgaaatttgttcttttaaaaattctctgtactttgttatgtgtgcatgctataacattcttacatgtatttattctgtgattaaatcttcagattactgtaaatgatacctaaactctaaagagtcaaatataattatcttaatatgaccttaagaaaagtaagggaaaataaaaagtaaacttttatttgtctgcaattttgttggactgaagtatttaaaagagtaaggtagaaagaagagacaaaatcctaaacctttcaaaatggaaaattaattttaaacttaaaagtgtgttccttcctatgttgatattgcctttgcataagtgaataagtagaaataaacttttttcaaagaaaagtttattttcccttttactatttttttttcagaatacttgtttaaaaacattaatgctacaatttacattgtagaaaaattggaaaatactcaaattaattttattatatgaaagtaagaactggattctagtatcaagcgtgccacggctagttccttttcttgacatcagttcccacaatttcaaatgagaagattatgctaaataaatccctaaaaacccttccaggtctgtaatggttcttttatacaaaaagttgcatttgcataatgctttatattactagagttcattcacgttggtcctacattctcagaactgccttgtggggtgggcaggacaaaccttgttatatctcctctacatgggtgaggaagttgagctgtaaggaattaaaatgatttctttgaggtcacataaaccacttggaaccagccatgtactggttctacaatttcatgttataatttatga

SEQ ID NO: 36028 - DNA, 766 bp, Bovine  19866880606781
tgttgagatgtctcacttgtatttatttggaagatactttctttttaccgtctgtataaaaaaaggtttccactcatataaaatctaattatggtttttatactacctaattttggtcatatggaattgatttttttttaattaggcctactcttttttccaaagaggaatcttgtaccttgcatatgatttgacttcatgaaacttagtttatgtcaaaagccaagtgatttttgttgtgatagggaagaaaaattttagtttaaaagttatgtggaaatagcttaagaatcatccatgtggtgtgattaatgtttttattactctcttgtattttagccctcactggtgcaagctatatttaatggagatcctgatgaagttcgagcactaatatttaagaaagaagatgttaactttcaggtaaaacagtttcactgataccagccttgaaaagcgtactttgctagagttgatgatttttgttaaaagacctaacacaattctgtaagtttgtctaagcaaaggtaaaaaggtcttgaggcaaaaaggaaaggactggatatgtatattcagggtaattactaaaacctaggacaactaggagtcagtgaaggatttttgttcccccaaccttttactttgaaatttttcacagaaaagttgaagaactttttgaatacccatataacctccatcattgataacatttgccgtatttgctttctctccaatatttacacaagttatttttatactacacata

SEQ ID NO: 36029 - DNA, 1447 bp, Bovine  19866880632523
gatctaatttaaaaatagaggagggataatgttttttggattgaaatgtttaaaataaaaaatttaagtaactaaatttaaaacaaaaggttctagaacagaccttgtctgatagaaatataagatgagccgtgaatctattttaaaattttctagtagcgacattaaaaataattaaaacaggtaaatcaattgtaatatcatcggcttaacatgtgatcagtaaaacactctgaaatattttacattcttcttttttccacaaagtctttgaaatcatgtgtatttctcacactcccagcgtatctcagttcacaccagctgcatgtcaagtgaaaaagggaagcgccaaggaagggaaggaacgttagaaaaaaccttcagatgcgttatgagcacttagatgcctgtcagggcctcactggcagtctcaaaggccacgcttcctggtggtccatttcagtaaatatcgttggctgaatcagaggagtccttttcctgcctggttaatatccatctttctcttctcgtgcagaccgtcattgatagatggcatctttctgggtgaaaacacgggtttttttttttttaccatgtttcttctttgttctatgacttgttctatctctgttacccatttttctacttaatctcattctcaggctcttccgctcttccactgaaatgcgtgagaaggcagctgggaaggattttatatgcgtgtgtagacccaggcagcatcagggaccccctttttcagtagtgggaaccaaaatgcctcctaaaatcagtctcctgaggcatcattgaccgcccccagcccatgtcttacatggcaaaaaatgaaccagagattgctgaggacaattttgcatgcaaattggtgagtggagcccatgtgtacgattttctatttccatgcaccaatttgggagtttgcacatgaacgcggtaattgttcatgcaaagctgaaaatgcaggtgtgaagccttttttagagcttgagagctgtctggtcctatcctcatttgagtgctgttgaatcttttgtgatgtcatacacataattttatttattaaatgcattcacaatatgtggaactttcggtaagtcttgcaaatggctcattgactgtgtcactgaatacgtgtctccactacagcagggagagggggcccactggtctgcatcgctggtgtgtctgggaaccatgcctttgaaaccacgagtgggcttcctttgagggtagacgtggtactaagcctgcagagaatgggatttattctgttataaactcttctttttttcatgattgaagtactgacatcctatttttttcaaattttggtaatgtgaatgtgaacttgctcgttcgtgtctgactctttgcgaccccatggactgtagcccgcctggcttcctcagtccatggggttctccaggca

SEQ ID NO: 36030 - DNA, 2735 bp, Bovine  19866880734053
tgcgaagagttgactcattggaaaagaccctgatgccgggagggattgggggcaggaggagaaggggacaacagaggatgagatggccggatggcatcaccgactcgatggacataagtttgagtgaactctgggagttggtgatggacagggaggcctggcgtgctgcaattcatggggtcgcaaagtcggacacaattgagcgactgaaccgaactgaactattttaaatatataggagatttttacatgaaggatggtatatgagttttcatttttgacataagaaattagcagcaagggcacattccattaggaataactaaaacccaggaactgcaacactggctacgaggtgcttttaaaatgctccttccctacaagtctcgaaaacagaaatctgcagaggcttgacctaatgacaacagtggagttcatccctgtctaaccccctccccttcttgcttgcctatatatttctctctttatcggtaaaaatcgaagagtaaaagaggctaagaaatgggagagaagacattttatccaatggtcaccttcagcgtgtttagtgatgacaacaagcaaagcctttaggttattgtttttagaaaccagagtattttcaactctaaagttggcaagaaaatgtgccccagggaaagataatactcaagaagcctgttgtctctttagtgacaagatgatcttcaggagatctatctcctaatttgctagcatctgcaaagaatcaaaagccatctttgtcttttgttgatcaataaaaaccgccagggtagcaggaacacgaggcttaaaagtactgtcgagtataaaacacaagcacgtaaagggacattacctccaattacacagcaatgtatctaatttgggtatagattttctacttgtgaaataaacaactttttcacagcaactggagcccagcacacaatagctgtctagaaccctttaccctgccaggagcttgagccaaattagatacaataaaggaagacgtttatggcactttattccacgtcccagcagagcagcctgctgccacccagacactcacgtgccactattgtccactctgatagcttaataaagacaaatcctcaggaggaaaacagccacgtgagaacagttccaagaaaaacctgacttcataaaggctgcctgcaactcccactgggcagagtggagcaggcaccacgattaggatgtgcattcaagcaacgccactcggagattttctacagcctcttagaataaattccttcattgaaacatcaatgagccatgaaaccaaacagggagctatggaccaggaccgggtccaggtcacgtgggtggccgacggccggaggcagcgcgtggcactgcgggccggggtggctgagctcctttaatcagagctcggggcacagggcgcccctgccactcccgcccccagggcgtgtgttatcagttcaggatacattctggagatagaaggtaggggaaaatccacagagaatctaaaaaggaacgaggcagccgagaccacaccaaatgaaggacacagaaggtcgcagggaacacatgtgacaagaggcacttcctatggaaacgctgaggcaagcagctggagacgtgcctaaactgacagtgtgcgtgtaagcctaagagtatgtttttatgctgctgtaggtttagagatcttttagtttttaaaattatcttccagtaacagttttgtttttctttttgttacagtttgatgaattttaacacaaacatagagaagtgcaactaccaccaaaaccaagatactgaacagtcccgctagcacccccaaactccactttgccatctatccctttctgctcccacccttgccccgctctaccccatcaagcactggtctgtttttattgctgtgtttctgtcttccagactgtagcacaaatgagactggcttctttcacgcaacacagcacccctgagagtcacctacgttggattgtgcgtcagcagccgatctgtttttactgctgaataacaaatacaggcagacctgggaaacactgcagatccggctccagaccactgccatgaagcaccgaaatcaagagtgcctgcctgtgcacgttcagtcatgtcgcactccttgcgaccccatgcactgtagcccgccaggctcccctgtccatggaattttcccagcgagaatactggagtgggttaccattcccgtctccacgggatcttcctgactcagggatcaaagctgcatcccctgcactggcagcaggttctgtatcactgggccacgtgctggagcacagctactgctcgctttcccagtgagtataagttatgcttacactatacttcagtctttgaagtgtgcaatagcattatgtcttaaaaaaatgcacataccttaattgaaaaatactttatactattaacactaagctacagcaatcaaaacagttttgtactggcatagacagacagatcaaaggaaaaggtcagtaagccccgaaataaatccacacttatagccaattaatcgatgacagaggaggcaaaaatgcacagtggagaaaggacagtctcttgactaaagtggtgctggcaaaactggacagctgtatgtaaaataatgaaataagaatgttctctaacaccgtccagaaaaataaaacctcaaaatggattaaatacctaaatgttaagaccagata

SEQ ID NO: 36031 - DNA, 2546 bp, Bovine  19866880743932
tgggaagccgctgtgcagcacagggagctcagcttggtgctctgtgatgacctgggagcgggatgggggttgggagggaggcccagcagggagggagatatgtgtgaatacggctgattcacgctgctgtacagacgaaactaacacaacagtgtaaagcaactccattcgaattaaaaaaaagtcaatgctttaaagcagaatcagagcattgattgtgcagcccccgtgccagccagccaggtatccagctaagccacctccacctctaccccccaccccctcaccggccagtcaggccctgggtccacccgctgacttctctcaacccacccaccctcttgtcccgacagccaccttcactccctgctcatgattgcaacggcttcaagatggtctcctctcccccagttttaccccttccttccatcccttctctttctaaacccagagctagctttccagaacacaaatctgattgtgtcacctaccctagccccatctcaagagcctttagagctcttgagagagactagactcctcggtccaagacctaagaccttcagtcatctggcccccaaaaggacacacaccaatcaacttgaactgcccgtggcttctcaagtctgtatgttctggctcctcccacaggttgtcccctttacctgaaaaggatcatctattcccagcctcattcgccaccttgttgttcagtcactcagtcgtgtctgactgttcgtgaccccatggaccacagcacacccagcttccctgtccttcaccaactcctggagcttacccaaactcatgtccattgagtcagtgatgccatccaactatctcatcctctgtcatccccttctcctcccgccttcaatctttcccagcatcagagtcttttccaatgagtcaactcttcacatgaggtggccaaagtattggagtttcaacttcaacatcagtccttccaatgaacacccaagactgactttctttaggatggactggttggatctccttgcagtccaagggactctcaagagccttctccaacaccttctccatctggctgactccaaatccagctgcaggtctcaaaccttccttgacacacacacatcttccaacaagggaacctttcaccacatccccttcatcaccagcactctagtgacttggctcttcatctgtaagatgccgagcaatgtagaccagtaggctaggccagtggtatggactgaatggtgtccctttgaaatccagatgctgaagccccagctcccagggtgagagtattgagggtgaggaagtaactaaggtgccatgttttggggctttcccaggtggcccagcagtgaagaatccacctgttaatgcaggggccatgggagacatgggttcaatctctgggtcaggaagttcccctggagggaaaaaaaaatggcaatccactccagtattcttgcctggaaaactccatggacagaggcgcctgatgagctacactccttgaggttgcaaagaatcagacacgactgagcaggccatgacacaagtaactaaggaaatgaggtcataagggtgggactctattcccataagaccaacgacctcacaagaagagacaggaaaggggcgctctgtctcactcaggggtgaagacgcagcaggaaggtggctgtccacgggtcaggaagagagctcccaccagaacccggccctgcaggccccccgatcgtggaccttcagcctccagagccgcaattaaaaataaatatcatctggagaactttgctacagctccagacacaacagctgggtccagtccgcagtcagtaaatatgtgtgacgtcgatgaacagtcatcctacggcccctagtgaggccaggagcaagctttcataacacaaacggtacgttaatcggattagggatgcagagtcagacctggaaccgactcttcctacctcaaaaaccgaccgggagagcaccgccccacaggactgtctgctctgggggtgagtcctctgcgatggccggtacagtagccatgagccacacgcatctgctgagcacatgacatgtgcccgggatggcagagcaacggatttttactttgattcctgttttttcatatatttcattcatttgtattcatatatttgtttcatgcgtttatttcactcagtgttaactgttatactaaactgccacgtggctggtggctcctgtcctggacagtgcggagccacacagtcaggcaaaggtcatgcccgaggcattactgtcgccctacgggtcacagactgtgcccactgctcctgttacaaacaccatggactctcacaggtagctttccagtggtgtcagtggcctggcaccgagaagctggcaagccgcacacataaaagggctaacgaggcacccttctgcaggaatcgcgatgctttatgggcctccacctgcgaggaaacccgtcgaagggcacgttcacccctcggtatcagagttaattaaaattgaaggcccaatcaaatcacccagaa

SEQ ID NO: 36032 - DNA, 1516 bp, Bovine  19866880748343
gagaggcgaggatacacactgtaaagcagttctcggagtccgaggcctgggagacggtggacagcacgtctgtgagggcgtcatgggttctctgtagtggaaattctgagacaacgcagggagagagccctcgagtcgggagcagagccagtggctagagccttcccctcacgccctgcctctcctctctgcaggtgcctgcagcagccgccgcccgcggacagcctgcccaccgccagcgtcgtcctctgcttccacgacgaggcctgggccaccctcctgaggaccgtgcacagcatcctggacacggcgcccagggccttcctgaaggagatcgtccttgtggacgacctcagccagcaaggtggccgcgggcttcctgcaggctctcttgggagggcctggaccctgagggcctccgtgcacagactggagtttggagcctatgtaggcgggagtccccgaagccgtcccgcagacggggattcgggtgcaggagactcatccgggaagagccccagaggctccgccccctgtgacacccccagagtgtgatgctggctgcaggcgaggaatcagcagctggagggtgactgtgctgctctctcgttattggctcttttgatcgcagtgcagggcatgtgggatcttagtcccatgcccctgtattggaagtggagggtcctaaccactggaccgccagggaggtcccttgtgctcaccttttttgtaagggacttgagcactgaagcgtctgcagattttggtgtctgcagtgggtgggcggactcctggaaccaacgccagcaccccgactctgaaggatgaccgtacgttggtctttccatctctgctagtgctcatctgggcgctctcacacctgtccatttgcacagtttttctgattttgaatgtgctgtgctgtgcttagttgctcagtcatgtccaagtctttgcaaccccatggactgtagcccaccaggctcctccatccatggggattctccaggcaagaatactagagtggattgccatgccctcctccaggggatcttcctgacccagggactaaagccagttctcccacactgtaagcagattctttaccatctgagccaccagggaagcccaagaaaactggagtgggtagcctatcccttctccaggggatcttcctgacccaggaattgaaccagggtgtcctgcattgcaggcaggttctttaccagatgagctaccatgctaatatcctctttcaaataaatgctaggtagagctggagtctagggtaggtaatgagcacgtgacaggtgtccagagttgagttacttttagaccccagctcacgctacatatcagcattagtcctcccacaccccctcgtttaatcttttcatcctctcttcagttttctccctccatctccactctcacctattgcaatcggtatgctactgtgtttcaaacttcatcttgtatccacagatcctgtggggtgggtttagaagctatgcca

SEQ ID NO: 36033 - DNA, 1936 bp, Bovine  19866880808825
ccttgacgtgccccttttcctatttggaaccagtctattgttccatgtccagttctaactgttgcttcctgacctgcatacatgtttctcaaagaggcaggtcaggtggtcttttatctttttaatatcctttaatattagaggagcaaaaactacaagtatatttttggcgatttggtgttatatggggctatttcatttgaatatgtttttcgttgccaccaaaaaaggatcaaatatttaatttaggagaactgcaaatcttagtgttgatgcagattaaatcatgaaacttttcctgcagttaacgaaaagttttttttgttgttgttcgttttttaagaaatagcttttgattgcatttcctcttcttttccatttgaggaaactctcggattaaaaaggatgaaagtcagaaaggacctacttagctatctttagtattatgtttttattagtgtaaattaattagggtaaaatcagataattcaaacagcttttaaagattttatatatgtgtttggtatgtatgtatgtagatggtaaacaagagcttctctattggatagttctctgagtggggggcagtttcccctactttcggaagcttgtgtgctaggcagtgtgtagttctagagtgtcagactgggtcatgccaggagtgagaactttgaacagcgagggaagggacagtcacgttctggagaaatggagttagctggacttcagagttagcaacagctggcttttgagggacataagagcaaactgctgcatgaagggtgggcagtggagttgaagccagcagaacaaattggaattgcaagtgtagaattactcgtgtagagccagtaagtagcctaatccaaggtatgggcaggtaagttaaaaaccagcatgtctgttggttaaatgattcgaacagagatgcctggaatccagagacctcagtcgaggagactgggggactgcagcctgcagacattctcagctgatactgtagtgggtcagagagggaacctaatagaagtatttcccaactcagaaactggttaagagttctaaatgaaacactatatagatgtactatagaaatgctctggaaatttgtgtatagggttaaagcacttatttaacagttagtgaccttggtaatttaaagaaacttattttaaatagtcccttaatgaaacaaattatctttcactttatcttttatcataaagctggatttctgtatatcatcctcacttaaatttagatgtactgactggatcgcttaactgttagagatgatcagtaatatctggattcttttgtatgtcctggtgcattactggtttagaacctcctgtgttttggcttttaaattattgcttttgagatgctgcttaattaacttcgggtctattttctttgcttactagcagtgttccaccgactgagagtccaggttctatttataaagtcagaagaactccctacccttcacctagtttcctcagcacctagaagccacacttttgagcttgggattccttttctctgaccttaatgtctttcatcatgggttatcctctttcttcacccacacctgtgctttgctgtgttagaaccgacttcaccttgttggctaggttcactttggccacaaacagacctcttgagaaacttgacctgctgactcgagcagtactggctagggtagtgttttctgaatcacgggacagcttttcctatggcctctttaggggtctcccagctcttccgttgcacccttttgtattagtcatacctactcagctttcatctctgtttttccacctcagtctccttttttgagtccattggcacctctggggcctcagctcttaacttatatctcagtctcatccctttcatctggtctgctacctcctgcaatctgtctgtcagg

SEQ ID NO: 36034 - DNA, 1005 bp, Bovine  19866880907410
tactgtgctaagcgtagggagctaagagttgtaacctgggggaaactttgtaagacctgttctttcagattccttccagagttcctctgtcttggagataaagatcttcctttctcccaggtatagggaggacacctctcacatgagggtcttatgaccttcttcaggggaaggtcaaagagttctcatattccttcagcagaaaatattcaacccaccaaggtgccatgtttgggggtggcatatcctgaacatccccagcgccccttccctcaccaaaaccctgtaagaagagctgtgctggggagagaagggcaacgcatctgctttgaaagaacaggggacgggtagctgcctgggacaagggcggtgggggtgggagcaggggatcttagaagagcctcgggggtctcgaggaacaaggcaagggtcctctagcaagcaggcgaaaagggagcggaggatgatctcggtctcggtccgagaggacgtcgaggggcggcatgggtgtgagaaagcgctcggcgtgctcgggacggccgcaggtgtgaggcgtggtgtgcaggcgagaccagcggggagacacacggcagaggcagctgcgggttaggagcccgcgacggcccgagaaggagcgcgaatccggagggccccgcccgcagcaccccggaagtcccctccgcgaaggcgggctggacgcagcgccgggtgagaccggtgagaccgtctgagattgtgcagcgagaaggaggacgtgtcggctcccggcaaaggctcagcccagcgcccgcccgctcaacgggactgctggcagacagcgccagaaataaatacccagctgtaacagaaccaaggcacgggtgttttttcaagtaaacagcctcacttcacctcacctgaactcacatgaattctcattttgtcctgctggctggaaactgccgcaggaatgcaggaatttactgataaggtgtctcagttggaaggaaaactgagcggcatcct

SEQ ID NO: 36035 - DNA, 3506 bp, Bovine  19866880938300
attctccaggcaagaacactcggggtgggttgccatttccttctccagtgcatgaaagtgaaaagtgaaagtgaagttgctcagtcgtgtccgactcttcaggatcccatggactgtagcctaccaggctcctctgcccatgggattttccaggcaagagtactggactgggttgccattgccttctccgagagccattcataagcaattgcaaattaaaattttgtattatattgttactgaaaattttaaaagctcaatttattaactttttttggagaaggcaataaactgttctttatctaatgaatcttactgggattacttatttaacaggaaaatgatcataaagattaattgaaagtctttattcctccattatttaataagtaattagaatcgttcagagttcctagacttattttgaaaggaacagttttatagtatctcttacctgacttatatacagaactctgtattatcttgtttgagctgtgccatagttggaattttacaattttcattttagtctttaacgtcctgttgttttcatccaaagatgttgacaatagaaaacaaatgttgtgagtgccccctcacccccagcttttggtcagtactttgaatggagtcttaagagacttaacattgtattttctgagtttgttgtgtttgttgttgttgttgagatatagttgtcccataacagtgcttaacattcttaaggataaattctaaagtgcttataggcaaggtgggaacaagacagactcctgacagaaacaggctgtaacttagactgtactttagccgttcactggtttattcttgatttaaatgtgttctgaagaaacagaaccagacaagggtgagcacgagtgctgctgtgaggagagactgcggccttaaggcgggtgatcgtgcgctgaggctgctgagtggcatccctggcctctccccacttggtgccagtggcagccctcagtatgtcaacccaaaacatctctacacattgccagatgtccccaaagatacaagtaacacctccttcccaccacccattgagacccctgtgttagagcaagaaggctgttttcagaggttgagaacatggagcctcatgttgacggtggaccgtaagttccaaagagcatggtgggagggttccaggtgctgggcaggagtcagagattgccagggacagaataaggctggtccttaacaggggtcagactacaggagatgaggggtaacctgggaggcagaggtttctgggggtggctggcataagccaggagaaatcatcagaggttgaacttcatttacaaagtagctagtttacagattatctgtgttgggaaacataaagagctacccactttagttggaacaagtaatttgaagagaacaggtatttgagtgaccaaatattggagaagtagtagtgcaagtagtgattaatacagaaccttaaaacatgtgttttgtaaatgtgatttccaagaagtgggagctctgtagtgaagatggacatgtttgtttataaggtaaggtgcgtgcgtgctaagtcatttcagtcgtgtcttcctatgtgatcgtatggactgtagcctgccagtctcctctgtccgtgggattctccaggcaagaatactggagtgaattgccatgccctcctccagagggtcttccagacccagggataaaatccacgtctcttacctctcctgcattggcaggtgggttctttactactagagctacctaagataataatatggtgcattaaatatgaatttgggtctaaaaactgggcaagattattcaagattatatttctggtgctgactttgaccaaggatgaagtcatagagcaaaggaaaaacttaacagagcaagattgactgtgtaacaaaatgaaatcttactattgatgcatctgtgacacagacactcagtgagtaatgtaatttcttgttctgtcttaggatcagttcacgtgtggagagacagtcccagccccttccaccaacaaagaactagttaaatgctgaagaagatttttaggttctaaaacctgaacttggggaatgaggcaagctggaaaagtctaatgcggagtcactggcttctttacggggacagtccttttgtggtttgctgttcatgagagtctggattctttccatcaggtgccaagttcatctccaattgaagaagcaagtccaccacatgacatgcctggattttgtgctcaaaaccttgaattggaagtgtttccatccaaacataaaagaagataatttcaaatcagtgcttttttccctcagttttatttttatatctttacactattacttcattatctgacaacagcatcatctacctcaaagcattaggtttctttaacttaaaaagatttttattttaatcacttacgaagattttttaaatcagccctttctatgcaatttgacgtcagctctttgctgttgtaaactgaaggaagtcagttgcctctagtctgttgggactgcgccttctactccctcaccacgctgaccttcgtcagggatctgtgttctgttaaacgtgccacttcattatgcttcatatactgggtcctggtggtggtgcaaagaaaaaatatactgagctcacaaagttagtgagttaagaagaaaagtcaaaaaacaaaacagtcaaaggatagtggacttcccttatcaatattctgcgttttccttgaaaatcaggacaagataaaaaacagccaaaggaagtgaaactggtaacagaacgagaagagaaaactatgcctacttagttatttaattaaatgcttgagtgctttttcgagatcagtgcaactaatatttctgtatctggcctcttgtgtgtgtatttgtttttcgataaggctaatgagattttactctagacgggttaacgtcaagtcttcgtggctggtggctgtgctttcagcactactaccaaatcagtcactagtcctaaaaggtaaagctttgataacagcccttgtatttactaaggatgaacttgaaaatgagatgcctgttctaattaaatatgccctgagggcagatatgtgctgcgcttagtcgctcagtcttgtctggctctttctgaccccgtggactgcagcccgccagactcctctgtccatgggattctccaggcaagaatactggagtgggttaccattcccttctccaggggatcttccccacctagggatcgaacccaggtctcccgtattgcaggcagattctttactgactgagccaccaggaaagcccaagggcatataggtaagcctttataagctgtagccacacatacattcactcttgcagagaattgttaccctggagaaaaagaaaaatacaaagataggccattggtcttctttgccacagccatgagagtagcaagaaatagaatcacttgcatgggaaattccaaatttccctttaggtacatac

SEQ ID NO: 36036 - DNA, 728 bp, Bovine  19866880964695
ctctgaaattgtggtggaggaggaggattaaaaaccaaaggacgtggctgcacatgataagcacctttttaaagaataaaaagaaaacaaagcctattttcagttctctgaaaagccacacatgtgtcaacaagaacaattcctttctttactcacacaaattttgtttcctgattgcagggcccagtttcagctttttaccatggaaatttatctgtgactgaaaataaaacagtatcaaaactagaattaatgtccaagtctttacttccaagactttgattaatacccaagttctctaaaattactagtatcaggtaagatcagtgttaagaatataccaaatcaaaacttacagcatgaaaccaccttacttaccttcactctaataaaattttgagaagttatggaatttgatttaaaaaaaaaaaaaaacctttactctgtctctaatctttcctgtctctagttcatgaagctggatgttcaatcaaaaatacagaggttctgattaagttatgtaaattattccaagcctgagtttcaaacaggaaatatatttatttctatatcttataaaagaatgagtatatattcaggacacaaataatactaaacaccacatccataacatgagagattttttccaaaagaagattacttacttctactatcttctgcacatccacgtcattataaaatgaaacaaatccatagctagaaagtca

SEQ ID NO: 36037 - DNA, 2089 bp, Bovine  19866881052871
cccccggtgccctcctcccgcccgtcagctctccagcaccatctctgcccaggctgctggaggaaccaggaatgctgtttctctcacagggttcatctcactctagaccaacataccgtgtctcaccaagagagccacagtgggcaggaagcctgcagcacgcggccagggcatgatgggtgcttcttttaagcctcccaaagctcagtctgtgggcacaaacagccctgatgagtccccagccccaggaagttggtatgactgagccactaatccaggggtttttccaagcggcaggggggtgagacaagggatcacacctggtctaagatctccagggctttcctgctcccaccaaagaacagacaagtctccagccatgcagggcccaccaaatcaaagacaaatcatgggaaatcaaggacgatgctttcccgggataccacacagactctgttaaggctgtggccccagtggatgggtttccggatgtgggaaaacgggcactgggctgggacattataaggctgaactgcacggggaggattcagacactggttcctatgataggaggcctcgccatcttgttcatctgtgcaggcacagcctggagccagagaaagggcaggtaatcaataaatatccaatgaattcatgttgttgaataaccctgtcagacaggactgccttctccattaaagaaagtccacccaccaagtatgccagctcctttaggaacagatcaccatcaaaggcaacatgcattccgtacagctccatactgtcttcacgcttaacaaccaactcagaatctacacctgagatgcccaactgaaataacccccatcctcttttaggagggccccataaggctgtcaaaagaaggtatcctcctccgtatgaatcatatatgcaccagaaaagcatgtttatgcaacagaacagaaataaacctcggctgctgatgactccagcaagtacccactgcacacctcattcttatttatcaggagatctgacctgtaaacaaaggacagcttaaggcacgtctgaaacacagaactgggaagatgactctccagaattaatgacagtgacaagtgacctgaaggcagaaccacctgcattttcacactatttgaaaatacttcatagataaaattcaacaggccacctttcttccgaagcacgcatgaactctggtccaagcactgtctaaagcattcctataaaaattctttgacgcaacagagctaatacccataatcaattaacaggatccatagcacattaacttgttttctgttctgttttaaccaaatgagataaaaattattatcatgaccacagtgccactttcgtgaatccctacagaaaaagaatttggttttgctctgacacatcacagtcatcaccaagtttcattctactgaaggaaggcttaagttgctaagatttactgcttgcacagacacacacacacacacacacacacacacacacagccctctgagcccattttcacacaagactgagtgctgtttcctcatatggatgtagagacactggggaagcagcaagaagagtttttacattaagaaaggaatgcaaagaacaccctcgtccctcttaaatcgtatcacctccattagtgaatatctaacaataacattaatactaatagcaggtttggttgcattcgcaaaagcaacaaccatacagaagataaatgtagtcgctgtgctcagaaaagcttaaagccacgtcacacatattatctcatttatctttaaaaatccccgaagactccatatgagtgtattcatctgcagtgagacatgttttatgggagccgatttccttaccaattcttcatatcttctgtttaaaaacaggatctgtctttagcatgcctccccaccagaacctcagctcctaactcatgcaactgacttcctttcatgagtctcaaaaacaaaacaacaaaaaatgcaaccaactcttagcaattacagaaagtaaaaacaaaaatgaaacacacgcaggaaatcaaagaaattcacaggcccaaacaattgccattgcccaa

SEQ ID NO: 36038 - DNA, 1141 bp, Bovine  19866881216991
tggctacacctgtttgtcccagagctttcagctgtgtccttcttgataaaaggtgtacatcccttttcatcagagaatgatcaccctaaagttcgtcaagtttctctttttgctccgtctcgctggaggctcagagtcatatgtaaatctcgtttctaataactgtattacccccagtttccaacaccaacttttcctttctgaagtcttcttctattttagccagttacataagtgattcatcataagcctctttgaatacattttgggtaaagatgaagattaaaatgtcaatgaatgaaatgaaagatgtttccttgttttgttttttattctcatgggccagagcagctgcttggtcagggctgaattaggaagaaattggagttgagagacttgaaaaggagtgattaaaaaaaaaaaagtcttatatttagctttgtgtttggaacctacagatgtatctagagttcttggaattcactaagggcaaaatagcaaagcttccctgtctgacttggaaggagctaggaaaggactcactccatcatcctgtcacttgtgaactgagttttaactcacaggcagacttgaggtcaatcctctcctaagcctttctaagccctaggtggtcaagcatttgagtttcaatggagccgtcaacaaacaccagctaactgaaatacgtgaggtcaaccaaggcaccactgtccagagagccaaaagctaactgcagctgcaaactcatccaccaaacttttaccccaaggaggaaggaccctagtttatcttaccactctttgtttttcccctgggcctgaacgttcctcttgctctgtgatgtagaaagtcattctggaagcccatgcaaattcttggcatttgtgggaagtgtcttatactaagaagcaagaagctctacagtctctcttcccagagttttgctgctcaggtgcgaccccaagattgatgctggccctcccaggactctgtctgccgaaggggacagagcaggacaggggctgagagctttcctgggccacagaccagaggaaggtggctcactctgcagggctggaggcatctaaatcccctgctgctcctcaacacacgcacacacacatgcacacacatacacaca

SEQ ID NO: 36039 - DNA, 820 bp, Bovine  19866881256645
taagtcatccacaatttgatcaggtcagaaacatcaaaatagagaatgaaatgggaggaaaagatgaaggagaaagatgacttgataaggaggacttgagggtcagcaagtatgattttctttcttataaggcaaattttagagccatagcgccttattcaaataaccatttgtcaaatataggtaacgttggtgtcaggaatgaagatatattcttcaatgaaaacacattacttgaaaactcactactatcaacagtttttacataatgtcagggttggacggtacccagaaatcgtcaacaacctggagagtgtgtttcaatgagcttggtgctagggtaactggacagctgcacatcagcaggaagtcacacatccttagtcaagatcaaagcaacttttatggaatccagttttaaatcaatgtcatggcctgttgtcttcaaatctacttcaccaccacatcttaacgactttgctaaaatattcccttgtcatgtgtaaaatccaccactgaattttctaaatcattaaggaagtaatgtcaaataggaccactgatatgagcaagtaaccctcttgtagaaatgattctcatctctacattccacaagaaaacacagacttaaaaataactacaggtactggtcagctacgtaggcaatgacacatgaaccaagtaattaaattattttcaaactatagtaacctgtctgtctaaacagcactgtataaaataaacagcttaatttttactgagccatcgatacactaaaaaatgcattaacagttaatgataccagggtaagtctctctta

SEQ ID NO: 36040 - DNA, 722 bp, Bovine  19866881733297
atgactgcacgacttacttacttacttacctcataaggcctagtagcacctgcatttttagagacgggggggtggcatacaggatgcgcctctgctgcaaataggcaaccatttagtcaaagtggggggttaagctatggcagatgtgggtcaatagaacatgttctcaatctccccttgataggaaggcaaattcttactataagatgctgttccttaaaactgtctagtcatatctaatttgtgtgcattctcagatattccagtcagagccttggtaatataaccagtgtttccaattgtgtcctgttacaaggagaacagattattattgtatttatacaaacaaatatatgaccataaaaatcagaatactcacagaacactccaaaacctggagggatcagatagggagaaaaaagtaaatgtttcatctttattcacaaatgtatatgttagcaaattgctcgtagcttaagagaaaagagaaaaagttttcttaactctggaaaaccaaaacacaaaagaactaacaatgtttcaaacagaaagtcaaaattataatcatcctcattatttcactcagtcccatgaaatttatggagaaagacaaacattaaaaaaaaagaaaacaagcaaacaaacaaactgccctttttaagatgaaggaaaattaagttttagatttcataagtacactatagatataaagtctttttttt

SEQ ID NO: 36041 - DNA, 705 bp, Bovine  19866881785630
atatctgaaaccagaggtttcatggcccacaggttaggtccagcacgtggccaggtctgcacattgtcattgctctcttacatattgtggggggctgcttttgcattttgcagccctacaagggcagagctgaagagctgtgagagagactccccaaaccctcactacttagtgtcttccccttcacagaaaaagtttgtcagcctattttatacaggtccggggacctttggagaaggaaatggcaacccacttcagtattcttgcctgggaaattccaccgacagaggagcctggctgactacagtctaaagggtcgcagagtcgggcacgactgagcacagcacggagcacccagggagcgggcgtcggtttcgtgacttacaagcagcttccgagaagaccacacccaaggcccctggtttctagtccagctgcctccccactagtcacgaggtgcttcctactgcagtgatgtattataaacatttttaaagataaacaaaacaaccagagagcgatggttttcaacccgacagtcccaagatggaaaaagaaggagtcccagcaaacacagggaaggacttgtctatctttggaatatttgggggaatttcagcagtcaccttggaaatctgctgaaacaaataacgggcggcaagtagtcaaggatgccactctggaggtaggaaaggcttcttttta

SEQ ID NO: 36042 - DNA, 1443 bp, Bovine  19866880066358
ttcgcatgaggtggccaagtactggagtttcagcttcagcatccgtcctttcaatgaacacccaggactgatctcctttaggatggactggttggatctccttgcagtccaagggactctcaagactcttctccaacaccacagttcaaaagcatcaattcttcggcactcagctttcttcacagtccaactctcacatccatacatgaccactggaaaaaccatagccttgactagacagacctttgttggcaaagtaatgtctctgcttttcaatatgctatctaagctggtcataacttcccttccaaggagtaagcgtcttttaatttcatggctacaatcaccatctgcagtgattttgaagctcaaaaaaatagcctgacactgtttgcccacctatctgccatgaagtgatgggaccagatgccatgatcttagttttctgaatgttgagctttaacccaactttttcactctcttctttcactttcatcaagaggttttttagttcctcttcactttctgccgtaagggtggtgtcatctgcatatctaaggttactgatatttctcccggcataaacacatgtacatatagctctatatgtataagacacatatattgcacacataggtctatgtatatataaacaggcacccccaggctatgttcaccggatttgtaaataaggaacggtaggtaagcgtctggctgacatttgcgctcccgtgtattttgcattgtgctggttctgtctctcctgtaagctgataagacgtgcaaaggccaggagtgcgtgatgtccttcttcgatgatttttcacgattcctggcatgacgctctgcagagtgaatgtttaatcagggccgacagacaggaggccacggaggtcaggtctctttgtcctccaggcttgtcaagggtgagaaagctcctcagagaggggaactgcgatgctattttcagctctttgaaggatgagcctggaagcccagaaaggaagctggcagtgagacagggcacgagtcaggagagtggagtcaaggggcacctaccacgccatccaacccgtttcagactgagagattcatccaggccaactgagactggggagctggacagaccaagctccttccccagaaggagaaggaaaattctgggtgtttttttgctggtgatcatcgtgtatgtgtgtgttaaatcacttcagtcgtgtccaattctttgtgaccctatggactgtaagccaccagctcctctgtccgtgggattctctaggcaagaatactggagtgggttgccatttccttttctggaaatcactagccatctgatttattaagcacctcaaagtgctcagacagtaaataacctgcctgccatccaggagacccaggtccaatctctgggttaggaagatcccctggaggaggaaatgg

SEQ ID NO: 36043 - DNA, 3200 bp, Bovine  19866880376944
cttacctgcctcctgagaaacctgtatgcaggtcaagaagcaatagttagaattggacatggaacaatggactggttccaaactgggaaaggaatacgccaaggctgtatattggcaccctgcttatttaatgcatatgcatagtacatcacgtgaaatgccaggctggatgaggcacaagctgggatcaagattgccaagagaaatatcactaacctcagatatgcagatgacatcacccttatggcagaaagcaaagaactaaagagccctcttgatgaaagtgaaggaggagagtgaaaaagctgggttacaactcaacattcaaaaaactaagatcatggcatccagtcccatcacttcatggcaaacagatggggaaacaatggaaacagtgacagactttattttggggggctccaaaatccctgcagatgatgactgcagccataaaattaaaagacatttgctccttggaagaaaaactattaaccatcctagatagcatatttaaaagcagagatattacattgccaacaaaggtctgtctgatcgaagctgtttttcttcagtaatcatgtatggatgtgagagttggaccataaagaagactgagagctgaagaatcaatgcttttgaactgtactgctggagaagactcttgagagtcccttggaccgcaagggagatcaaacaagtcaaccctaaaggagatcagtcctgaatattcattagcaggactgatgctgaagctgaagccccagtactttggccacctgatacaaagggccaattcatcagaaaagattctgatgctgggaaagactgaagggaaaaggagattgtggcagcatatgatgacatagtttgataaaaattactgattcaatggacatgaatttgaacaaaccatggcagatagtgcaggacagaggagtctgacatgctgcagcccaaggggtaggaaagagttggacacaactttgggactcaagcacaaaaacaaagcttaaaagacaaaaactgtaaaatcaactataactacaatgaacaattaagggataggcatgaagacgtaaaataggacagaaaaaatagaaaatcctgtaggggagtaacaaaatatagagctttcaaaatgtatctgaacttaacctacaatcaacttaaaagaagtagatgcagttttatgttgatactgtaaccgcacatcaaaaagctgcaataaataaagtttaatgagaaaggaaaccaaacaagtgtttggtggagcgagcattcacactcaggacgctgagactcccagtccatggtctcatccatcctgaacctcattctagctccattttcatctcactgtgatgatgaatttttattcgttcagattttactttgaactctgtttgatatcagctcatatataaccactgtaatcacaagccagaaagtgatacagaatataccagataatttttattccttggccattaagtaacattaagttcattaagtcactctattatctctaatcagaaatgtggtggaacttccctgttggtctggtggctaaaactccacactcacaatgcagggagccaaggtttgatccttggccagggaattattaaaagatgtcacataccacaactaagagttcacatacaacaaataagacctaggagagctaaataaataaatataaatattaaaagaaaaggaaatgtggcaaagtgaagtttcaggactggggctggattcatttacataaaaaggttctagaatatgaacttggccactatgtttcaggagttgggccctaaataatatctcttaaaatttcctggtaatgtttcttgtgccctagttgtacaactgaatgcatatcaacataaggccactgcccttctttacagtatcttcatactcattattgttcccttcatttgtggtgtcacaaatattaatggagtctagttgggcaatgatactaaaaaggcacaaattcccaacatgtttatagcaaagaagtaacaattccaggtttgtattttcctgatctgataaagatgtgtcctgctgttgggactaattacaaccagaagaaaagaaaaagatttgttcatgttttccgttaaaacaaaacaaaacaaaacaaaacagaattaacccaaggttatgccaaagtcatttttcttctgtgctgttattacatcttctggagtgggaagggaggactacattggagctcccacacaaccgctgttctgcgtcatctctgctgcagtccatagggagtgcactgctaatagttatgaaaattacaattcattggcatgctgacgagttgcgactctatagttagttctgctttctttttaattttccacacgggtaattttttaataagcaagaggcaaggacagatgaagaaagctagagtgtgcacccacatcttcatttatatctgagacgcaaggatggtgtgaaaatgtgtcagtgacgacacaagcatgatgctcatcaagccaatggcagacaaaggtaatgataaaaacttggcatttgcttggactggggaggaagatatgtttctgttgaattaatccaattgtcctctaaaagatcttcagcattaactaactgtattaagtaactcatttttatggacaaatactgtttgactccaataatacaagattcctagaatagtcagattcatagagtcagaaatacactggtagatgccagggcaaggggattgaggggaaaaggagttagtgagtgtttaatgggaacaatttcagttttagttcagttcagtcgctcagttgtgtctgactctttgcgaccccatgaaccacagcacgccaggcctccctgtccatcaccaactctcggagttcacccaaaccaacatccattgagtcggtgatgccatctaaccatctcatcctctgtcgtccccttctcctcctgcccccaatccctcccagcatcagggtcttttccaatgggtcagctcttcacatcaggtggccaaagtactggagtttcagcttcaacatcagtccttccagtgaacacccaggactggtctcctttaggatggactggttggatcgccttgcaggccaagggactctcaagtgtcttctccaaaaccaaagttcaaaagcatctattcttctgtgctcagcttt

SEQ ID NO: 36044 - DNA, 2496 bp, Bovine  19866880592009
ctccaggcaagaatactggagtggattgccattcccttctccagaggatcttctggacccagggatcaaatctgggtctcctgcactgcaggcaggttctttaccatctgagccaccagggaagcccctgtgacattgttgggatgggctaaattaggtgttatctgttccttgcaaggttcatttgctagtgttttcctggcctctctttgctgaagtcaagaggattgaagctagcttcctgctgtatctcctcccagctgttaaaatttcctgctctgtttcgcaggcacaacccatgtcaggatccaggcgtgtttccttgctgctgctttactcacttattttcgtcagcacagagcttagtctcagaaatgacagcttaaaataattcatttgatgttgtcttcgtggacatgtgaactctgaatgacttcacaatacctggtatgcagagaagcctattgtgacactcgtggtatctttagcagaagctaatattagcattcaggttttttttctttgcatgtaggcattcattcattcctttgttttcagtttatccaggaagcatatattaaaaccctaggagggagctagagctaggaaggtcacacgaagatcactgtacagctgtctctctggaaatacagtgaggagggaatgcttttcctccctggcacagctaggtcataaattagccgaagcattcacaactttccagtagagtgagccaagacttcattcgttttttacaaccacacataagaagccaggcagggcagtttaatgtcatgggttcgcagcactgggctttggtgacatatggctggggttcaaaatctgacagaccacttacctttactttttttgtttgtttgtttggattttggatcctgctaccctgctgagtctgtttatcagttcttagtctgtgcgtggagtctttaaggttttctctgtgtagtatcaagtcatctgacagttttacctcttccattctaacttagatacattttctttctttcttgtctaattgctgtgtgtcaactttcaatactattttgagcagaaatgatgtgaatgggcatccttgttctagatttagaaagaaggcaaagtgcttttcactgttaagtgccatattggctgtgggtttgtcataaatagcttttagtatgctgagatatgttctctctgtagtcacttttgtaacagtttttatcaggaatggatgttgaattttattacacggtttttctgcgtctactgagctggtcatgtcactcttgtcttgtttgttgttgatgtggtgtatcacattgattgatttgcatgcactgaaacatctttatgagcctgagataaactcagcatggtcatggtgtatgacctcttctatgtgttgttgtatttggtttgccaacaactggttaagaatttttgcatctatattcatcaaaggtattggcctgtaattttctctactggtgacacctttttttggtggtggtatctttatctgattttggttatcagagtgatggtggctacatagcatgtcttggggaggtgtttcccttttcttcagtcttttggagaagcatcagaaagaatatgtgggtccacctgagaatcccctgattttggttctgtggtctgtgaaatgagggagcttaatgaagccactggtgggtgtgaattcacccgatgctgacctgagcagtagatagttttctttcccttcgttgctgccctgtaacctgttttctgatatctctctcaactgtctctcgatgagaaattttctcactgcttattgccttttacaataagaatagtattaatttcaggcattgaaatttacataaacaaaagagtgagatgagttatttcaaatatatataattatatattaatttatatgtaatagtattagtttatatatataattatataatatattagcatattgtatatgcaaatatgtattatatattgtgttgaccaagatgttcatttgggcttttccataagatgttatgtaatataaattatattacatattttccatatttcataaatataaatttattacaaataaatatatatttgtatattatatacattattgatatgtaactataatatatgaatctattatatattaaccataattgtgtttgttaaaataaatacatttaatatcaatatattaatttaatacacttatacattatatgtttatattaatatatttatatataacaaatctgtatttatgaaatatcttaaaattactataatttatatcatataatatagtgacatatattgctgtaatgtaaattatctattatatacatttataaataaaaatgtattatatataaacactttaatataaatatataatatatgaatatatgtttataatatatatgctatattaatggggattgtcactccaaagggtctgactccttgcacccatag

SEQ ID NO: 36045 - DNA, 2647 bp, Bovine  19866880634859
tactggaatggcttaccatttccttctccggggatcttcctgcctcagggatcaaacccacatcttctgtgttgcaggcagattctttactgctgagccactgaggaagcccacaatggactattactcagccataaaaaagaatgaaataatcccatttgcagcaacatggataaacctagagattgtcatattgagtgaagtaaatcagacagagaaggagaaatagaatgtgacatcccttatgtgtggaatccataaagattatacaaatgaacttatttacaaaatagaaacagactcatagacttagaaaataaacttatggttaccaaagggaaaggttagaaggaaggataaattaggaggttaggatcgacacatatcactatacataaaatagataatcaggacctactgtatagcacaggggaaataaaagatatgtcctattacattaattgttgagtttttttttattagaaaatataatcacgttaactcaatgtccagctccctactaggcctcaggagacaaaaggaaaatgcataagaagcctcagccttcagggagtttatgctctagttgcttaagtcaagactgtataaaatgttcaaatagtattttggcttctttgaggcactggccatcagcatcataaaaacactccacataattaataaaaacactccctgcccgttcctgatacccagagactgttgaggacaggtgcagtttaggagtgaaggcaaagaattgctctataactagggtagggagatgttaaactgccttcagattagatatgaggcagaattagaactgacttcaaataagcctcttattcatgctcagtctctcagtcgtgtctgactctgcaaccccatggactgtagcctgtcacgctcctccatccatgggattttccaggcaagaatactggagtgggttgccatttcctccagggatcttcctggcccagggatcaaatctacgtctcctgcattgcaggtggattctttacaactgcaccatctgggaagcccatacccagctactttcaacattaccaggactaccaagggcttctgtttaaatggtaacttccctacagtttaaatggccagtgaaaagttcagtgcaaacttgagcacagtttgggatggtatggcatatttttcacatgactcttaaggaagtgcccaagtttttcttccttgtgggtaaagttgttggcaacatgtgataccatcctcaggctgcgatggccaccaagcatgcatgcagagaacccagagagtaaataagccctgttggaaatgtgtttcctttttcccttttgccacggttgtctttcagcagatttgtagctctcaaggtaattaaaccttgcatgggcattgtgtttctcaggtgtgaaaagttagcagttttgtcccataaagagtgtgcagaatccttgtaaattgaccagctcatctacaccttccctgagacgcaattgctccgactgctgtgcgtgtctttggtgcatctcatgtgcctgatggtttgtttgctacatgaattggtctggctgtcagagggagcctctgtctgcagaaggggcagcaggtagaggaagccggctgggtgccttcacatttgctgtgtagaggtctctgcttttcacgtgcgtccctcctcaccctttataattctgctttcttcccagccattgtgacagctatttattgttcattccaggatggattacccttgaattacctctctgcttgtcactgttgtggtttcttcaagctcccagtgatgggggaaacagtaaaccagtctgggccctttaaaggacccgactttctgttcaaagagaattatttttagaaagctgctatagaatttaactttcttcaatcagcaggatttatgtgaagccatatgttggtgtgatttccccagataaagccttaggaatcttctttcaggctcctggagcgggtgcacaatacatcctgtgggcaggctgcccgctgcctacaggggtgcagaacccctttgatgggctgagggtaaggctttccagcggccttgggtcttgaggctccagcctcagccaggaagggccgaaaggatgtgacaagtgacctctgctagcagccaagctgggaatgcgagtgatatgtttaatcaatactttattctcaattgttggatgtaaaaggcttagaaaataattcaacagagtactcagttctgaaataacaccaagtgtcatttcacctctctttgattcagaaggtcctttagaatcctttcatccttggagagctagttaaagattctgggtctagaatggctgataaaccagcctttgttttagttaggaagggaaatagtagagccaggagaggggtgagagccccaagcaagggcggtgtttgtagtcggggtgttagtgctcggctctgtctacctctgaccattgtcccccagtcttccctggttctgtggtcaaaggtgggtccaggtagggcctcctctccccgttttggcctctcacctgttagcacccagttctgtaatacactttgaagaagtgaagtgaaagcctgtcagctgtatcagactctttgtgacactatagactgt

SEQ ID NO: 36046 - DNA, 5149 bp, Bovine  19866880656185
cctttgacatgctgttccttctctttggagtgtttccctttctgtcccaccctcacatctaagtcttattcctttttgaaatcagtttcatagaaggccttccctgatgtcactgcctccggtctttattttaatattttaacaaaaatttattttaatatatgggattttaaaaaccaccaaaatgtcaaataaccagtgtgtggagtttctttcattctagatctagaattttttctttgagaaataaaatgaaagctgcatgtatcaaataatttgagagatgaaggaaaatcggatgtgaaggaatatttacttttgtggtgaacagtttctttcatatggttgtctttaactttgttagcatagggataggataggccagttaattacacctagatagtaagagattctccactagcctgagaaggctctgcaaacagcgccaaattgaatttgggaatgagtaggactgaggtgtttcagactttgctagtaacctcaggcccttcaggaattctaaatggcatgttgtgatgtttgaggatgacggggagggagaataagatgtatcagatgctaaggctgcttcaagccttaaacttgtgtgtgtttaaatacttgcaggtgttctcaaggggttctagactcagcacagaaagctcatgtttcattgactggattagtatggttatttatctctaggcatgttattgatgctcaagctgaagttccaatactttggccacctgatgggaagaactgactcactggaaaagaccctgatgctgggaaagactgaaggcaggaggagaacggggcgacagagaatgtgatggttggatggcatcaccaactcgatgcacatgtgtttgagtaagctctgggagttggtgatggacagggaggcctggcgtgctgcagtccatcgggtcgcaaagagttggacacgactgagcgactgaactgaattgaggggtgttattaccttatttgtagaaatctcctagacttgatataagtgggccacacaaaatgtgcccaaatgaaaacattgattcccaaattaaccttctccccacatcagccagctccttttacatttttaggtaaagagattgagggaaaacatttttaagaacaatcctgtgttgtgtttttgctggagaactcttactgattttccatattttaattaactgtgtgttcatcactcagttgtgtccgactctttgtgaccccatggactgtagcccaccaggctcctctgttcttgggattctccaggcaagaataattctccaggcaaaagggtagccatttccttctccagggtatcttgccaacttagggattgaactgggtcacctgcgttgcaggcttttttaccatctgagccagcagggaagccctaagcatgactaatttaaagatgattttaaatgtttatattgcagaatagggcacatcaatgtatcaacaagccctagcctgataattggtagatagtgggcacctaataaatgtttcttaacagaatgaatatcaaatgaataaatatatttttaactatttgtataatgattatcaaatatggaaattttacacatatttgtcatttattacatggttgattgaatttttaccatgttctaggagtaggagggaattatggaggttaacgagacgtggtctcagacctcattacagttatatttcatgcagtggttcttaatctagaatctaatataattatttgggaagcttttaaaaataccagttcctggatgttacccagcgtctctgatttgactggtctggagtggggccgagacatcaggtgtggttgttagttgcagccagaatcgacagcttctgttaccaaatcctatctgcatcctcttgcgttgccataataacgttctatagactgggtggcttaaacagtgcacgtttattttctcgcagtttggaaggctggcagcctgagatcaaggtgctggccgattcagctgctgttttttcctgttcttagcagggccacccatctgattagggctctacccatgtgaactctcctggtgactcggatgataaagaatctgccagtaatacaggagacccgggtttagtccctgggtcaggaagatccctgtggaggaggaaatggcaacccagtccagtattcttgcctggagaatctcatggacagaggagcctggcgggctacagtccattgcatcgcaaagagttggacacgactgagcgactaacacactttcatacacatagcgtacatacgtgtcaactcatttaaccttaatcacctctccaacgagagtcatttcgagtttagggcttccgtgaattccgcggtagtgggaacacagtttggtccttggcaaccattgatcaagagaaggaagtttttgtaggaagtgtgctactctgagttctaagtccacgtgtgattagagccgtagtgtttgtgcgtgaaacacgttggggttagtggaaggagaaatcactttcaggtgctggggttagggagcattttggatggtgttaagtgagtgagccttgataaagaaaatgaagggtgggagatggagaatgaaggcagcagactgaggtggagtctgacccgacgggctgctcgctgcctggcgctgcaggatccatctgtgctctctgagcctcgggttctgaacccccgcccctgcctgtgacggtgctcgtaaaacgaccccttcacctccactttgtccttctttctgtaagtaagatctaagctgattgcctggtgggttgattgatttttagccaaggaggataatacaaccactgggatggcagaataaggatttaaacaatagaaattttaagctgaacttctgatcctggtgggactttggaattactaatagattcttgaaaacgtgggtcaagtagatttggtgatagagcagcactgagaacacagcataaaaagcgccaatttaaagacagagcctgtaggattgcctgggcaggaacgggagcagagcttgctttgggtgtttatacggcttttagtgttaccattgttcagagtattttcaagactcttttagaatttgccttcagcttctacagtacatttatcttaatatcttattatcttaatattctcattttggtaaatttttgttttgaagatgaacttgaatttcagccacagttagccagaggcagtctgatgaagggagtagatgaccctccttgggcaacactgctccccaagaaggttgcattgtagttttaactcagcctggctctaaaggccatcctgagaaagatgtcgtgagtctctacaaatgaaccaatttcattgctttttatggctgagtaatactcctttgtatgtatgtaccacatcttctttatcctattgtctttcagtagacatctaggttgcttccatgtcctggctgttgtaaatagtgtttcagtgaaggacctagaggctgtcatacagagtgaagtaagtcagaaagagaaaaacaaatactgtttattaacatgtgtatgtggaatctagaagagtggtacagatgaccctatttgcagggccggaattgagacgcagacatacggaatggatgtgtggccccgtttgtgtgtctcagttgctcagtcgtatctgactctttgcaacctcatggactgtagccttccaggcttctctgtccgtggggttctccaggcaagaatactggagtgggttgccatttcctcctccaggggatcttcccaacccaggggtggaacccacgtctctggcattggcaggcacattctttaccactacaccacctgggaagaggtgaagggtggggacagattgagagattagcgttggcatgtgtatagtcagtgggaagctgctgtacggctcagcctgatgctctgtgatgaccgggaggggtgggatgaggcgttgggaggaaggtttaggaaggaggggatgtttgtatgcatatgcctgattcacgctcctgtacagcagaaacaacacagcacggtaaagcacttacacccccattttaaaaactgaatgatttgagcaagcattgaatctttgaaataagtgaataagctctcaatataaaaataatttccctactctattatcaaaatggtccatgtgttttgttaaattttacggactgttgagagatggaggagaaggaccaggagagctcagacagccagaagccattgaggagcacccgtcagtgtgggggtagccccccgtgtcccagacgggcatcggagggaaggcacgtgagtgagggatgcgttgctgggaggcccaggcgtgctgtcgtatattcctttctcaaatgtctacttacgtagacatgtctcctatagtgacatgactgatttcctattagctgtcaatgggaaattgtgcccgtagcaaaagacagccttgaagttttaccaaataaagtaaatgtgaaacctcttccactgaaggcattatggccacagcggagatcgctgcgcttttctaaaattggcaggtcttcttgcataagccgatttcctgcttcggtatgctttgagactagttgtccctttctggcctcatcttggttaaaacaacgtgggtggaagaggaagttttcacacctcgcaatctgcagaatctgaggtccaagaaataggtgcttttgggaaccgggcacatgtggtgtgaacgcagtggttactaccagtgggagctgatagcacggaggagctcagatgtggcacagcgatggcgggacgctggcgtgtgtgacccagaagctgagcagaaataggcacttctacctcattgatgtgctttccgggtcttgtgagttcgagattgtaaaaagttctatggtcaccgactgacctaatatttgatgtttactctccgcgaaggtactttctcagccagctgacaaatcaggccttttgccttttctaaaatagttttcttcatggttggaatcattgagctcctttctgatcaagaaatatgaactgtgacgttttgaattttgcttgttcaaaacgatgcttctgaaaccagcattcttcttgtccaagagttcctgcaggctttcacaag

SEQ ID NO: 36047 - DNA, 1172 bp, Bovine  19866880696204
tgggatttctttggaaggaatgatgctaaagctgaaactccagtacttgggccacctcatctgaagagttaactcaatggaaaagactctgatgctgggagggattgggggcaggaggagaaggggacgacagaggatgagatggctggatggcatcactgactcgatggacgtgagtctgagtgaactccgggagttggtgatggacagggaggcctggcgtgctgcgattcatggggtcgcaaagagtcggacatgaccgagcaattgaactgaactgaactgaactgaaaaagtaaacagtataggctaaagctgtcaaaacaacacaaatactaaatagactctgatccaaatcataagatgtctacactggcaagatgggaagtggcttctgtctgacagaggtaggtggataattcctgcacctagaggaaataggcgcccctctggttcatgctctttccaagacaacttcagagctgagtttcctctccccacattgcaaagacaaatgtctagccgaacatccgagttaaagggatttttgattggtgttgaagcactgcatggattaaatgaaagagtgaaatagaatctgcttctgtcacaaatccaccttaggaaatgtgtgggaaaatatgttttcagcaactttctgattcatttaaacttcaaaatactctagattatacctgctctccatacttctgcctgtttctggtttccaaattttaatatggtttccctttaagtgaaaactcagcttgctctcctcatcagccaatttactgggtatggatgccacatcactacttggttccctgaaggtaattttggagattttagctttctcctttttaacatgtaaatttgctaattctgaggaaattgaatctgttatcaaggcaatatacaccagaaaatccctttcaaatgctgcttttatattaggaaaagcgaagtcacaaaaagccctgttggaaattcattcatggtgctaagaagtggtaaaacggagttgtttatctataggatgacatgttattaaacctacattttcccaattaacatatctttcctatctatggatgatgagaaactgaaagttcaaacattcaaacgtgaatgatcaggaaagtcacaggcagccctcaggattctgcatgtgg

SEQ ID NO: 36048 - DNA, 1480 bp, Bovine  19866880710729
aactgaaccatttagaaaacgaaagatcatggcatccggcccatcacttcatggcaaatagatgaggaaacaaaggaaacagtgacagactttattttttttttgggggggggcctccaaaatcactgtagatggtgactgcagccacaaaattaaaagacgcttgctccttggaagaaaagctatgaccaacagacagcatattaaaaagtagagacattactttgctgacaaaggtccatctagtcaaagctacagtttttcctacagtcatgtatggtggtgagaattggactattaagaaagctgagcgccaaagaattgatgcttttgaattgtggtgttggagaagactcgtgagagtcccttggactgcaaggagaccaaaccagtccatcctaaaggaaatcagtcctgaatattcattggaaggactgatgctgaagttgaaactccaatactttggctacctgatgtgaagaactgactcactggaaaagcccctgatgctgggaaagactgaaggcggaagaaggggacgacagaggatgagatggttgcatggcatcaccgactcaatggacatgagtttgagtaaactccaggagttggtgatggacagggaagcctggcatgctgcagtccatggggttgcaaagagtcagacaggactgagccactgaactgaatatgtactttatcggaaatttatatgtgatttatcagaaagaaattttgtgtcctttgctcattttttaaactggctattcatcatttagattagtgggacttgttccagaacaccatacaaatgctgcctgttctagaacacaatatttttaaagagtgccattcagaatgacagtctgagattcgtctgtgctactgcgcataacactagtatgttccattttactgttgaacagtatctactgcataagtcctccagagtgtaccctttctccttttgagagacccctgggttgtttgcagtttggggctatctgatgagctactgtatgtactaactgcacagggatgaaaggtgtttcatttcttctgggtagcattgctgggtcagtgggcaggtctatgtttagtgaatgctgtcagtgttttcattgtagtcattctgataagtaggcaattcctattactataaaggttatcaaccttatgctcctacaggtccctgagagtctgttcatttttaatcttcttttctctgttcttaagactgaacattcctactgatctatcactatattcatcactccttctgtcatttttattctacggttttctataccagatatttcagttctagaattttgatttgggtctttctcctttcagattctgttaagattttccttttattcattgcaaccatattttccattacattcttaaacaattacaacagctgagataaaatccttgtctgctaattccatcatttacaatcctaaagttcgac

SEQ ID NO: 36049 - DNA, 2030 bp, Bovine  19866880748859
tgtggagtgcctacagcatggtagcatctgggtgctaaagaatggtggctcagatggtaaagcgtctgcctgcaatgcgggagacccaggttcgatccctgggtcaagaagatcccctggagaaggaaatggcaacccaccccagtattcttgcctggaaaatcccatggatggagcctggtaggctacagtcgatagggtctcaaggagtcggacacgactgagcaacttcactttactttaccgtggtccctgtcctcaacaagcttataatcttctggtttagggtatcaggctcacataaaggtaaagagatggactcagattaataattttcaatttgcccaactgcttcaactatatataaacacgcactggataaggaagtgatgtacacaattgtggtaggaacctgcctttgagaagctcagaagtacaaacttggattacaacagaacagagaaacaacaggaaaagacagtccaggtgctgagaacacagttttagttcagccaaggtggtccctaagctggtcagggaaggcttcagagaaagggtaggacttgtgggtgtactggatttgggaggacagaagcatttcaggaggtcagaatcagtggggaaaaaatcacagcaaagacagctgcaaattttctagagattgaagtgcggcaggaaaagcgaggagacagatgctatggctcagttaatgggacaaaggacttgaatgttaaggccaaaaatatgtatggtggccttacagtaactcagcatcagggggcagggaaggagtcaagaatcagcattgcatagcctttcaacaaatctctgatgcacacgccaggccattcacagttgagacaggtgacctcatccccactgagaaacaatgctgaacggcacgtagttactctgagaaatgcacccagaaacaaaataccctgcacaccaggaggaaagccttcagtacctaggggatccaatcatgcattcactattctgcacaggaaaataaaatcccggcttgtcttgaaaacagagtttgcgtgtgcaactaactcactataaactgacttgtcaccccaaggagattagttctttccatcaattttaagtacattagagctttcaagcagcaaaacacatcctgtgtcatcaaggacatcattagtcaagtgtgtcaagccctgaaatgtcaaaaatgattctaacatcctcttagactgttcaaagtcctgcatcactttgtttactgataatggtaaagaacagtggggaaaaaacaagctaaagaggtgaacatataaattacaacgatatgtgtttatttcatttagggcttgaagttattaccccaagtgataacatgagtacatacatactaagcttttgatataattctgacaaacgacaccagaataagactcgggggtctccgaatgtctagttgaatgggttaaaaaaggcacacaattcaggaaaattatctggcttcaaaatatatggttcttataattgttcccgtacagataatgatatacaaaataacatgttcaagttacatttcgaagagcaattttcattctcagcttcttagttgaaaatctaattgtgtttaaaagcctgagaaagtgttctctggccccaattgttcagtcttttaaaatatccttctataaataaggctaatagcttcattttctccacaataatgggattaactatttctgggcataacgacaggtcaaaaaccaatctccattatttgccagatgaaaacaattcagtaactgcttccggctttttcttttaatgtgctggatataacacaacattatttgagatacttattgacctttgtcagaatactattaggaccaacctgtcctgaagctaacaggaggatgagatgcagctcctgcaaattcaaggggctggaggactcgggcagcaagcggagccctgatcacgggtgctgctgctggtggcagctgcttaccagaagatgctttatgacgtcagcatatcct

SEQ ID NO: 36050 - DNA, 1391 bp, Bovine  19866880838121
tttgacattatcgacctttgttggcaagtgatggctctgatttttagaatgttgtcttaaaaaatagatacatgtacacgtataattaaaatcactttgttgtatacctgaaataaacacagcattgcaaatcaactataatataaaaaaattttaataaaattttaaaatatattggttggctaacttcaactcagttggtacccatccctggttctcaacttgggggtgaagaacacccaagggaaatttgggaaaatctggagatattgtgggtgccaaaactgggtcagtgagggcgtgtcactggcatctggtaagtcgggtccctgatgcgctttcacggggcatttcacaggatgccattcacagggcagtactgcagcaaaggaggtgggtcgacatcagtagaactgaagtcagggaactctgcaccactccactgcatggcaacaaagttcacaaagacgctgagagtgagaacaagctcttcaatccaatgtaaaaacataaaaaacatgtttcaatggtttcagtggacacaaatcaaggtactgtgtggtttatgtcataagcaccagtccaaattagccactacaacacagctaaaatattctgggtttccaatatccttaaatgatgacaaaatgttcatgcttggcagaatctgagtcaatgagcactacttgaagccagccattttcctatagtaacatgctttgcgtgcgtgaatttcaatctctcataattttatttttaactttttccaggaaaagatgcaatatcctctttaattatcactaaatgtgataaatgaaacagttttgtatttcccagcctcattcagttaaaatactagaatggagaaacttgccaaaatgaacgtgccttctcttttggatggtaaccaaaagcaccttcttatatccagtgctcagactgccaaagcagaagccagcacaaaaacatacttttgcagctctgctaaatttaatttttttatgttaactctctttagaagattggaaagattcccacagaacagccttaaagtcagtacctgctttccaactggaccaaaggaatggcaatggaatattactcagccataaaaaggaatgaaattgggtcatttgcagaggtgtggatgaacctagagattgtcatacagagtgaaataagtcagaaagagaaagacaaatattttatattaacacatacatatatgtggaagctagaaaatattttttgttgtttttagttgctaaaatggtgtccaactcttggcaactccatgggctgtagcccaccaggctcctctgttcacgggatttcccaggcaaggatacctgaaagtagggtttccatttccttctttcaggggtatcttc

SEQ ID NO: 36051 - DNA, 1355 bp, Bovine  19866880844864
ctttaaaaacaattcccagtggttttaatgtatgtttaggcttaagacccactgctctagaaaacacagagctggagctgcctgtgaatttcttcttagtcctcggggagtatccctaggaaaggtattggaaacgcagcacctcaagcatgttctatattgtcacttagcaactctctattcatacaaaaagggcccctgcaaatataaaatcccaacacagaaaattaatacagtgaatccgccaatatgtgcacaccctgcactcacaccttatccgacgagccatgtcagaatctcgggatcattgtgtgtgtggttttggtttcatgctgaacatttcgagacattgtgctggctgcctcatagccatggtttcatggacaatatcaactcagcacgagggtcatcacacaccccatgcatcttttttgcccctctgaacaaagtgaatgttgacctggatacggagaaggatcctagctagggtctttctcattgcttgaatcctaataaaaaaagatttttgcagcccaagcagagggctatttttttcacaagcaaaagcaatctgttcttcctgagataaatcagtttgtgttctcatgtacagaataagggatgcccagcgtggtgggaagtgggggacaaatcaggtcattacatcaaactactgctttctgttttacaaagaacattctcaggtgtttctatagggtactgactgtcatagaaccaaagagttttcaccataacaacctttgcaattggctgttgttccctttttatgttgagtcaactgaggctcaaatgctcaagtcattgccttaaggtgacaaaaaaggggcggaatgcatggttgctgagtccagtgtttatgtgttttgttttaggccatgcttgcttaaagaaagacagcaccggtgagagacagctttatgcagaggaaagtaaaaattaagcacacccagagagccatcatctttcaattatactgtggtaacacttaaaaattacttacacagtatactaacttactgcccatcaaaagcaaatgcacttcctgaaccacaaatatgtattcatacaaagcaaaccttattcatttggaaagattccgcatggagtgttactataaataacttcattatctgtaatagaaactcagctatcaccattctaattagaacatgactaaagaaatccatgttgaacaaagcatctgtaacatttggtgagggtaataatggctttgaagttccaggaaaaagtcagttttccaaatttctcatttacatctctctcactgttcccgaatcaatggtttaaaaaaaaaatatatatatatatatata

SEQ ID NO: 36052 - DNA, 776 bp, Bovine  19866880848939
tgactgtctttttctgacttagcatgatctctctaggcccattcatgttgctccaagtggcattacctcactcttttttatgggtgggatatatctttatccattcatctgccaaaggacacttaggttgtttccataggtcctttctagcgaccactaacactacttaaataccttgagtagaaagcagattaaaatagctacctaaacaaaatacagacctgtagggaagtgtggtttagagggagccccgcccaccgaggcagggagcctctgagaaacggggagtgtcctaaaccctgagcagcaggcagggcctcctgtcagcagaagggcctccctactggaacacagcggcactgtggctcacgcttattcagtcatccctttactcatctaacaaataagaaaataagtgaaattggttccaggaatactgcataatggaggtaataaaataaggaaatggaaatattgggttagtcattagaatatctcttcctgtatcaacattcctttttggttgttgttagcaacagaaatcgaaatggaaaaaaaataagagtaaatggcttttcccaggtcttttgcatattattgttagcaaatgtggttctgtgtaaccatcttaaatggtaatagtctgtcccacagtggttttcttcatagaagtcattttttctctttctcctgcctggggatttatgacttaacaggcagtaataggcaagataaagccattcatcatgcaggcttaatgcaggaaagtaaattaa

SEQ ID NO: 36053 - DNA, 1606 bp, Bovine  19866880881712
attagatcctatttgtttatttttgtttttatttttattactctagtaggtggatcagaaaaagatcttgctatgatttatatcaaggagagttttgcctatgttttcctccaagagtttgatagtgtccagccttacgtttcagtctttaatccattttgcatttatttttgtctatggtattagagagtattctaattccattcttttacatgtggctgtccaattttcctagcacccagtataatatcacttatatgtggaatctagaaaaatggtacagatgaacttattagcacataagaaatagagtcacaggcgtagggaacaaatttttatgtggttactgagaagggaagggtggtgatgggccaaattgggagattggggttgacatatatacatcaccatgtataaaacagatgattaatgagaacctactgtttagcacagggaactctattcaataatttgtggtgacctaaatggaaagtaaatctaaaaaaaagtggctatgtatatacgtattcactttactgtaaaacagaaagtgacattataaaataactatactccagtacaaatttcctaaaaatatagtgctaatgaagtttcaggccccacgggcaccagaggacagggctatttgcagatgagcctggaggacgtgaaggaaaggtagtgtgatgggaggaagatggatcgatcagaacaggtagaagcagaagctacggtcagagtctgacagacctactggggaccattttatgcttcgagtctatttgacccccttttgcggtgtcttacattctctcagaagcacagacaagaaagctcatgtgaaacagaacttaagtaagaagccaggttcatctttgaggtccctgtgtctgctttccattggcttcctgcgtgctctccactcggcccacttgattccctttatattctgggcacgtacagatgtgtatttttgtaatgggcctgttctatctatatttgagttttcaggagggcatgccatttggaaaaagttttccttagtaatagcaaagggaaaaatgactttgtgtttcaagtaggagacttgtttcaatgacatttaaaagatggatgttcaccattgggcatctttccaggttgagaatctggcgtatctcgagaagatgaatggattgaagaggctggttcatacattatctttgttttgcttctggccagcaagggagaaatgttacgatggccagtaggctgtcctgtgcttgtttttaggtttgtgtaaagtagccagtatgcagaacactaaacgttgcctgtggtcttttagctcctggaggaaactaaaaatagaagacagggaatgaacaaaacatagcacaacccggcattttctagcctttccccctcattctacatccgagatcttttttctgatacctcaagacataaagattcctagtgtcctgtttcttgctggtggatggggttctctggggactagacagcatgcttccactcagaggctctctgaagtgggagcttagagactggaagatagactgatttgcaagaggcaattctctcatgaggacaggactctgaatta

SEQ ID NO: 36054 - DNA, 796 bp, Bovine  19866880898234
agaaagaaaataagagacacattgacccctgttcccaaatcaaagtgtgtatggaacatattttcttctgcttagctccacagtgcttctgctgctacagttggacacttcttttatgaggtacaataggaggttaatggatcaaatgagcagatggtaatattctggaaaataatgatgacacttatgccactgccagggacttgaccctgctgagtgatatggtaactcagcagtgggaaattgttcctgggggcacacaatctgagtgctgcttccattacgtggctgagtgatcagctgctaaacacacacacacacaacttacattagaacacactgggtaaaacacactattaaaaacaattattccaaagaatgctcagggaccattaattcttcaaatcaacacatgtcttaggaatgtcaactccatgctgggcaatactgcacagcttttctcaaagtctgttatgcttaaaattagaaattcacaaaataatcttgagctttatgtgcacaattaaaaatattttgtgtgtgattgcatttatcactgcatgcatgtgtattttataatttatgctatatttatgtctccttagataatgtaggagttattttgcattatttaaaaacataaatggtgtcatattgtatatattttaaaattatggttttgtgcttatttctatgcataaggaaaacatagttacacagaaaaatattattccacaaatattgcttaaaataaaatgaaagtgaattgggtaagtttttagaaaatggcttgggg

SEQ ID NO: 36055 - DNA, 1417 bp, Bovine  19866880975375
aataatagcctttgattcacagttatgcaaaatcctcccttcatttttacaaagtctagtctaagagagtaacagtactccaagaaaagaaaatactataaaaactacagagagcagggtttacagatccctcagaatgtgaatttcatttgttgaataaatcactccagaatacaaattcgtatttcagaagaggaaaaagtgcgtatagatgatcattggagtaaaggagtaacagatggcaagtggaacctttaaaaatccagtatcggtgaatcagacacatgagattggaaaacagacttttgtttctaccttcaacaattctcttcccagataaaaattctcctgtcagctatagagtttatatcaaatctaccacaagtgttcaaagcaaagagaaaccatggtgatgttaaatgacagaattggaaatggccttagagactatgtgtaaccctcatacagaggttgaaacctcagcacagagagtttaaagttggtaacaactgtagatggaaatcctatggctaaaacgcattcattgttaatgggggaatcctaagagtgtatgtccaaagtattctttcttctctatgtattctggaggtgaggtctgacatgtttattaattcaaactgtaactctgttaagagcacccagtgctcatatattttctaaagctgacttaccaccagcaaggtatttcattttcacaagaaccttctcacacatgggccacaggccaatgcagcattttcccctcataatcctgaacagtgaggcagatttgaccccactcttcttccagagcatgtgggcagagtatcagccacagtgacagtgaggagggtgacttcactgagctctggtccatgatacacagcagagagaggacaatcattttagaacacgcttcacacccccagcctctcctctccttgcatggtggcactggcagtcttcgttccgcatgacaggacctcagtacggaaacatcccaggctcctgggtcatcacttgaaagaaagccacccaggagagctgcccgacctccatgtactacagtatgggtgacaagtaatcattctctcacagcacagagaattcaagatgcgcttgtcaccgcagcatcacctaacctctcctgactatcatagggacgaactctctgtaatgaccactcctacaattgggcgtattcagaactgagagcatcctgaacacatgcacacagctttccatatcacgacggtgttgagagcaaatcaaaaatctaaaagaaagtagtatagctggctcctttttctctttctctgggtctctcacttctgtttctcattggccacctactcttgggggatcagtctatatccctgacatgccaacactaggcttgccagctctacactccctg

SEQ ID NO: 36056 - DNA, 1640 bp, Bovine  19866881056283
tctgcagccccatggactggggaatgccaggcttccctatccttcactgtctcttggagtttgctcagactcacgtccattgatttggtaaggccatccaaccatcttctgtcatccccttctcctcctgccttcagtctttcccagcatcagggccttttccagtgagttggctcttcccatcaggcggccaaagtaatggagcttccacttcagcatcagtccttccagtgaatattcagggttgatttcctttaggattgattggttagatctccttactatcccaagattcttttccagcaccacagttggaaggcattagttcttcagtgctcagccttttttattgtccagctctcacatatgtacgtgactactggaaaaaccatagctttgactgtatggacctttgtaggcaaagtcatgtctctgctttttaatacgctgtctaggtttgtcatagcttttcttcccaggagcaagtgtcttttaatttcatggctgcagtcaccatcctcagtgatttttggagtccaagaaaataaaatctgtcggctagatgcagtgcaaagcagacaagaacttgaaaacaaggtcactggcaggagtctctatcagttattttggtttcaagccaacagaaagtaaccctggctaatttaagcaaaatagaatttattggcagaatagggatagatcataaattttaaaaaggaaaaattgagtctatagggcttagaaaaggtaacaaggagggaagctccagggatccaggacagttatagaaactaataaaaggtctgtccagggcttctccatccaaggaagtgcctctcagttgcccttgagctgtttcactcaagaaccaaattctgggtaaagaaacttcctggaagacttgggtcacctggaggctgagacccctggaggcctgctgtgggagtggaggagttatcaaaggaatggactgttgttatgtataaaaaaatgggtatccctggtggctcagttggtagaatccacctgccaatgcagaagccacagatttgatccctgggtcgggaagaccccctgggagaaggaaatgacaacccactccggtattcttgctgggtaaatcccgtagacagaggagtctggtggactatccatggagttgcaaaagagagaggactcagcgattgaacaacaacaatgtataaaagatattgtgggagagggatcagggccagcacgtcaacagatgcccttttcagagatgagagattcccagccccacccttcctgcataggcggggaccctgcagcgtgcagtgatgaagagtctggagctaggaggctgggggcgagggcagtccctccaccaccatcgcatctgcaaggcgcttctttaggtccagacctgagcagtttgccgtacgatcccggatgtcccttccagagccgctgtggctcccagacctggagctgcgaggtttctgtggagagagggcagcttgtcctaggccatgctgggagagggggagcggagcatgggacggtgacagcctgggcagcttttccttccaaccccagttttaggagtgattgtttatgaagcccgatcagatctgctgtgtaccaagtgcactccatac

SEQ ID NO: 36057 - DNA, 1374 bp, Bovine  19866881081494
atgtatcagaagctttattctcaatagcaggataggagttaatcttgcttttctgacccctgttactggtgagcttgaaaagatgcccaccaaaacccatcctttactatactttcactttgggtctactcttacatattctcctttcactcctggagatgctttctaagttgtacaaatttcccagaatcatagcccttctacctcgcccaatctcacgtatagagggtggcatggagtctggattcaagcctcttagggccctggaatttggtcctctggctttggctacacccagtctctttcttccctttcccttatgcccttcagttaagtccagcagtggtttggggaaaaatctgaaccagttacaacagtgtaatataacgggtcaccttctgcaaacaaaaattttatgactactaaatgttaggggccaataaacatagcatacagcagtcctgcatctgtaaaatacactaacaggtaattagggagaaatgagtagaggtttgttttacgtttagaaattccaaatatctcttagcaaaatccatttttaaaataatatgtgtttcaaaagctgcacaaataattttaatatggtcttatctttaaagcactttctcagcgctcatttccccagtgtgctttgaagtgtgtatcattaccagaggtgtgtgtcagactgggttatttttaaaacaaattagtatagtgaataagcattctgtttttaccttaatagttaaattgaatttggggagtaacaagtaaaactacagaatcaaggcaattggagttttattttgggggttgggatagagtaggtctgtatagacatttcataatggtatgggcaatgcccatttcttttctgttgtatattcctacagagtgaccccctagagcagagatgctcaatcagcagcagaaattttggtcttcatgggaggctggcaatgtctggggacatatttttaaagtttatttatttgcttatctgtttacttagaagtaaaatagctgtgtaatgttatttaagttacaggtatacagtatagtgattcacaattttaaaggttatactccatttgtggttattataaaatattggttatatttcccatgttatacaatacatacttgtcacttattttaaacctaacagtttatacctcttaatcacccgtccctgttttgcctcccactggcaggtagccactagtttgtcctctatatgtgtgagtctgcttcttttttgctatattcactgctgctgctaagtctcttcagtcatgtccaactctgtgcaaccccatagacggcagcccaccaggctctgccgtccctgggattctccaggcaagaaca

SEQ ID NO: 36058 - DNA, 2180 bp, Bovine  19866881130798
ttccaaggcaccagactgagatgagcctcttcagaatgtctgtgtgaacgacactcagcaccgccactggacaagcctctgagaacatccttctttcaggaagctccctcctctgcttcctcaagcttctcacttgcttaaagacttaatgaatactctcagggttaaacattgacactaactgttcgggaccattcatccaataaatggtcatcttgggtggcctctgtcatctctaagtagacttttatctttaaaagtgcagaaatagcaacagtcatgactttaagtactcaaggcttacctcaaatcatcttctctgtctacataaacctgattctatcaaacacagctactctctccttggtagtacagtcttttgtcccagtttattttcactggtattaaatatgtattattacctcctaaactacattttaagctctttgagagatcaagcactgttggcatttggacacgttttccccagtaaagacctcctagaatgtcctgtacgtagtaagtgtcgttgtaataacttgtctgatgaaatcaggtctgttcatgtctggtcatcacttgaaaacacttcaccctttgaagactcttctcggtgctctcaaggacaaagggggaatgaattcattactagactgggcaacatgaaagccaagtaggatcttcttgctgttccaagtttgttacacaactggaatgcgaagctgatgagctatcacatccatccaggtgggtagatccatcgggaccccgtgaggatgttaacacatgagccgggcagatgggacttgacatttccatctgaggtaacacgtgagaagggacctgtcacatcacagggcccatttgtctgcttataaacagggttcaattaaaacaattatttatacatgttctgtagaccttgaagagcttcccatgtggctcaggggtaaagaatctacctgccatgccagagacatgggttcaatctctggattgggaagatcctctggagaaggaaactgcaacgccagtattcttgcctgggaaatcccatggacagagaagcctggtgggctgcaatccatggggtcacaaagagtcagacacaactgtgcaactgagcacacacagagagcttgaaggacaccattctttacatccccttggagttctggaaaagagtgtgcccattttcgcaggtgaagcagagtaactcagtgataatcccagatcccttagagatgtacgctctgtctcttgaactcagacaatgaaatgtttaggccacagatttaaagataaatatactttggcaggtttatctgtccctaatcacagtgtaagagctaatgacaatgatgcttaccgtcattttctagacacagcttcacagaatgaggctatttatgtcttcctaaatacagattatgatttagatattccgtagtggcataacaatgatttcttaggctaaaacagatataaatagcacaataatcccatttaggtaaggtttgcttttttttccccctaaagtggacctgcttatttaaacaattatctctggggttgttgtttgttttttaatatattcacttgttggcttatctatttattcattgcatctggtcttagttgcagcactcagcatcttgtactgtggcgctcagctcttccagccgtggtgcgcaggcttcagcagttgcagcgtgcaggcttagttgctctgtggcatctgggatcttagtttcccagccaaggatggaaactgagtcccccgcattgcaaggtggattcttaaccactggaccaccagggaaatccctatccttctttgcatttagtctaacaatatacacagcaatagcaaaagacattcaaacacttagtcccattaggtgccctatttacaaatctaacactgttaggagtcattgctcatgctaagtgtgatcacaagcaaacctgagtaggcctcctgctgcccgaagtttcttgtttctgtgtgtatgcgtgttggtgtatgtctgcatgcgtctgcgttttgagtggccctctttgctcgagatcatctgtccagcatcatgagagtctcactctgtgtggccattcttcatatttaagtcttcactttctctaacactgaaactaacagaagcatataacgctcctgactg

SEQ ID NO: 36059 - DNA, 1531 bp, Bovine  19866881246052
ttttgctgggagataaggtgcagaattgaatctctacaattctattaaataccctgaaatgaaccgagagtagtcccagagttgatggcaggactgaagcagaaagatggtatttcatggtccttatttcaaaggtgaatacagggacaaaaatctaacagatcatttataagtcattaacataaatctcatatgtaaatatataaatacatgtgtatatttaaataactgaatttattcttctgttttatggcttcttaactttgcatttttcttagaaagacttcaactacactatggtaacctgaattttttattctaaaatgttacagttcaatttatatataatatggtgatcttaaaatgatttttgcatacagttttaagtagatgttcagttttattccttctctagatgtctggtagatcttaaaagtttatttaaaaatttgtttcccattgagctaaatgcaactttaagatacactaaattttcataaatatgtggatatattcctagaaaatgctttatttcttctgtttacattgcattatctatccacgcctgggaaaaagttactgttaatattgtagttttaaaatatgtttgaatatctgttagggttcttcactcactatgctacttttcataattttttcttaaatttcttgactatttttatatgcttccattttacttgaagttctgacatgtgatgcatgcttaatttttatacaactaaatttaaaggtacatatttctattttttaatcattaattcagaaaatatacttgctttcaaaacctattacccatttctgacttttctttcaggctttcaaaaaatcatctgtctaaatttcttagaaaatctttacgatacatgtcactataatgcaagcttatttataaggtgcctacccgtcaaatccatctgctatgatgaagagaggcccttcctctgtgttgtgaaaagcttaaaatgaaggtgtcattcttgccccacaaagccaggttaataaccgtctcctactattacagaacacaaccagctgtggagtcagctgtctccttgagagtttcattacttttggctgttttccttcacaaaaattattaaactaaaaagcaaacctttccataaatcaaaaagaagtgttatgttttacaaataaaaaggactgcatgtatttattttttataagagatctaagagctaaattgccattaaaaaatgattactgttaataagatactgtgtgtttttgcctgatcttacaagattaatattttagtttatctaattaacaattatttttatctatattcttaacctaaaaaggatttgatacaaatgtattttgcttaaggttactttaaaaggtaaattaatgaaaatcaaaagttttacagtatttactgtcaagctttcttcttatttttgttcaaatctgggcaatggatgaaaacaaaatttcctagctctcttgaatcacagcagaatcaaaaagcagtataaatgtatgtata

SEQ ID NO: 36060 - DNA, 1071 bp, Bovine  19866881274026
tagaggagtaaaagaaaaacaaaaactataacaaacaagtgccaaaaaccaaacagaacaagtctttatatagaaagatgataaaatctatagaaaaaatagtaacacccaacttttaaatgtgaaagaatatggataatccatagtaaaaagcctatcaagcatacatgtatttattattgttaatgagagtcaataagttgtaacaatatacctgtttgtatcaatttagcaaatatatttaaaatgattatacctattgttcataatttatccatagcaattggcacaacaattcccctactttctagaaattatccttcagaaataagcagagctagagatgaaagctttatttttagagtgtttacctccatgttaattttaaaagaaaaatgagcaacaacctaaaactttgacactagataagcagtgaaataaaggacggtatgcacattcaagtcatgtagtggtaaaaaattcacatgccaactcaggagatgcaagagacactgggttccatccctgagttgggaagatccccaagagtaggaaatggcaaactagtattcttgcctggagaatcccgcggacagaggagcctggtgggctatactccatgaggtcacaaagagttggacacaactgagcgcgtgcatacacacacacacacgcacatgtacacacgtgcacacacacacgtgcgtgcacacacacacataaattcaggtcacaacaggaaagagcaggcaaagagcgggctaatgacagtagtctgttttttctgcttggatttttatgtatttctggtgtcattttgcagtgagggagaatttgatggtttgggagagggtgacagacgttcacacagcagcagagaagttaagaatgtaaactcagggcctttcctggtggtccaatggttaagaatctgccttgcgatgcagaggatgtgggtttgatccctggtcggggaactaagatcccatatgcctggagacgactaagcctgcctgagacgactagagagtccctgagccgcatggaacagccccacgtgacacgatgaag

SEQ ID NO: 36061 - DNA, 819 bp, Bovine  19866881305356
aatacagtgactttgttttcataaacatatagcaccttatgccaaatgaaaaataatttgagaatcagcagaatccaaagtgttttcactgttcctacttgaaacaataggagagtaagaagaaaattccacatggaggtaacaaccatggtagcatggctgggccccaaaacaaagaagagaggtatatttataaaatttcaacagccctataccctgactcatctccaggttcataaccatgaagcccactttgtccaggaccatgaattcactccagtattttatctaagatctgaaatttccagttctcatggggagtcagcatctgattttaccacaaagactcaaactaaataggacaagtgactttaagtatacaatttacaaagagttctgagatttggcattgggaattttgctttttagcatgggaaacacagttcctaaaagagaaacaaagttgttaatcaacaggcctgagacttgattatcaattaaacagactctaaaaacatccaaatcaatgctaaacatatctacacagatggtctcattcagtccaaaactctcaagagagaaaactcaagcccattcaggaaattttgtctcctacaaagtgatggggacatggcactgaatgcagccggtcttttaaaaggaacagcaccgatatttgtgtgaagtgactaaagaaagctgtgttagaagctagtctgaatgagggtgcggcaataagattttgaaatatacaaaattctacaatcttttattggcaaaatcatagtattctgacttgtggagtacgaaatatccatc

SEQ ID NO: 36062 - DNA, 974 bp, Bovine  19866881376396
tcgtgtccgaccctggactgcagcactccaggcttccctgtttcaccatctctcagagcttgctcaaactcacgttcattgagtcgctgatgccatccaaccatctcaccctctgtcatccccttctcctcctgccttcaatcttccccagcatcagagtcttttccaatgagttggttcttctcatcaggtggccaaactactggaccttcagcttcagcatcagtccttccaatgaatatttagggttgatttcttaaaggattttcctaaagaattgactggtttgatcttcttgatttcctaaaggattttcctaaaggattggctggtttgatctccttaatgtccaagggactctcaagagtcttttccagcacattttgaaggcatcagtttttaggcacttggctcacacatgactacaggaaaaactatagctttgactatatttcaatccaaaaaaaatttttttttcacattcttgactttgaaattttgtctctcttgccatgggttcattttagtaacatattcctgattcagttcatgagtagtgcatcactggaatttagttttatctcttagatccatgttagcaaaacacaagccaaaggccaaatctgacccacttttgtttttataaataaagttttattgaaacgccaccatgattatttactttcatattatctatggcttcttccttactacaacagctgagttgagtagttgtgacagttgtgacagagactacatggctcacagtctatggccctttacagaaaaagtttgccaacccctgacagattaagtataggtccttcactctcccattgccaccatggttattcttcagtctctcaaactcgtaaggacaatttaaagagcctggtagatgcagccaacaataacagctcatggaatgtacacagaattacctgactgactttttttgatgatagtttttgatt

SEQ ID NO: 36063 - DNA, 822 bp, Bovine  19866881408946
cttatctcacatggcaaccacctctacctgactacagccttttccaggccaggcacagacacagtcttaaattctttttatctcagaactctaagtagacttcatactgacaaatgatcagaagcagtctttaaatttaaaaaggaaagataccatctctactttaagtctttgttcattggacaataagaaacaaataatcagttgccctgttctctctcccccaacccaaggaagaaagaaaagaaagtgaagtcgctcagtcgtgtccagctctttgcgaccccatgcactgtagcctaccaggctcctccatccatgggattctccaggcaggaatactggaatgggttgtcgtttccttctccaggagatcttcccaacccagggattgaaccggggtctcccgcattgtaggcagacactttaccgtctgagccaccagggaagtccacccaagaaagggttgaccaataataaatggtaactatacagagtccttagacatcaactcagaaggcacatcacagggattcttggtccccagaggaaaaagggactgctactcagagtgaaacccggtgctgttgagagagtcatttcctaggcaggttgataagaactctaggggtccccaaggagagaggggtctggaattctcaaggaggaagaaaggacaaacttttttaccctctacattccttaggattatataacaataacgtatcctgcctgaggacagtctttggattaaaccttctggctaaacctgttatcttaaaatgtaaattatgggagtaggtctagtaggtctttacaagg

SEQ ID NO: 36064 - DNA, 841 bp, Bovine  19866881572436
ctgcagtgattttggagcccccaaaaataaagtctgacactgttcttgcttagaataaggctaaagtagggagtgtccatttaaggtatttttaaaaattcactttatttaaataaaaaattaataatggttcaagtgatagttatggcaaaaactatggaagtgggacacgaatgactgaaagagtgttagatggtatatttatttctcacaacaaccttgcaaattagaaacaaaagtccggagaaacgttgggacttagccaacctagaaagcgaataggtcatgaaacaggattcaggtgaaggtacttacgtctctgactaatgctctccaaggttccccctttaccaggatgcttttttttgtataaggaatttttcgttcaactactgacgtgtgtgactgactcatattgttttttaccccacctcatctcctcaaaaatatttacttcctaaattaaatccttcccctcccgaatgaatttggtgtgtttttaaacacacttataaaacatacagggaacagggcccgatttcctgcctggctgagtaaaacagtaattctccagcttggcacctcaccctgcagctgtgataagggccgttatgcccaaataggcccttaaacggaagacctgctgagcagagacccactttcccagccctgctccacctcgtcagcttctctgccaactgaccaggcggaagaagcagcaggggaggagggcctgcaggtaggtggggaggggatcgttttttttgaaagccttaaatccctcacagggaagcagcagctgctcctcgtttttccaacatctgtcccatctgtccccctg

SEQ ID NO: 36065 - DNA, 1240 bp, Bovine  19866880390336
aagggtcagcttatttgtttgaccacagtacttattctaaccctcatctctctcattatggctgggaaaatgaaagaatggctagaaatgaaagcataaaagaatgtgcataaaaggctagagttaaatggaatatatcagaacttcttttgatgtttaagtccccaggtttgaattctgtcactaagcaaagcacttcagaaggtgaaccttgctattattaaaaatagctaaagaatataaaatacccttatgcaaccagagtataaaatatttcgaggtattagaaacatcactgtggaaagagaaaggattaccattcctctaattcttcttaccttaacaatggtattaaatccatgtatcctctaattctttttaacctaacaatggtgttaaatccatgtagtcacctagaacataccacaaggtctattattcaatcagcatcccaggtcacatttggtcttcccatggaacataaggtaaggattaaggatatggtcaattctttttttcttcaaaaaagagacactttctcattctaaatattttggacatgattttcactctcaggaagcaaaacaaatgacaattatcagaaacaaataagcaagtgacaacccattttgtatggggaggtcatacacgatcggaggccaggaagccatattggctgtgctcaggagccttcagtcgtgtccaactctttgcgaccccagggactgtagcccgctaggctcctctgtccatggaattctccaggcaagaataatggagtggggtggccatttccttctccaagttgatgacttcagaacaaacatattcagtctttagactgccttagatagtcaccatgcaggtttatttcgtttgtaccttctgatgcattagtctgtgcttagaacattctcttcccttagtctgtgcagtcctgagtgcttatggaattcgaagtatttcacagtaaccttcacttggtcagctatttggagtaagctgtgtttcttttaagtgtgtggacattgtttttgcgtggagggtagaagagggctggttaaaaaagtatccacttgtttttactccagtgcatgatttgaccgtaatgtttgcaatttgcattacatgtacctttatcactctttccagttaaggagatttaagccctaaaacaaaactgttaggagcactgttcccactgaggaggtggtagttttcctccttttgattgtgtttg

SEQ ID NO: 36066 - DNA, 1318 bp, Bovine  19866880431281
ctcccccatccctgggattctccaggcaagaacactggagtgggttgccatttccttctccaatgcatgaaagtgaaaagtgaaagtgaagtcactcagtcgtgtccaactcttagcgaccccatggactgcagcccaccaggctcctccatccatgggattttccaggcaagagtactggagtggggtgccattgccttccctgccaagaagttgcaagtatgcctaaatatacatgtttattgaatattttcccactaaaaccattgggttcacataaaccatagattggctcataagtatggaggcattcagtttttcaagtcagcatcttctctctgctgtcctgttagaatatatgtcaccaagcaaggggggcaattaaggagacatgatgtttatgctgtttaacttttgttattttgtgcttttggaaaaaatgagagtacaaaaggaggtggagatgggactgaaaagttcaatacagtgtaaatttgttctgtttactgattatagcagaaaacataagtcctctttcctgttatttaaaaatagatctctgaacatgtctcccacattcctatgaaaagtaacagctactctagtgttccaaagaaaatcctagttattggatttctatagtgaagaattatttcaaacaaccttaccttgcttttaaagactacttggaatcttgatacatttttccattactggcagtaaattatttttagttcaacttgtcacagttgacaataaacttagattctgttttgaatgtacattctgtgctgctgctgctaagttgcttcagtcgtatccgactctgtgcgaccccatagacggcagcccaccagccttccccatccctgggattctccaggcaagaacactggagtgggttgccatttccttctccaatgcagaaaagtgaaaagtgaaagtgaagtcgctcagttgtgtccgactctagtgccccatggactggagcctaccaggctcctctgtccatgggattttccaggcaagagtactggagtggggtgccattgccttctccgtacattctctataaacatctaattatatagccagtccaaagatatggtctatggttttttacatagactgtagtaagaagaaaatttaaatattatgaaacctctattttataagcttcctgttaccagagagatatgtccactcatataaaaattatatttcatttaaaacttgaagtcactgagtacatactgttacagtatgtaaataattcagataaaatgtatacacttacaaatattcttacctcccaaat

SEQ ID NO: 36067 - DNA, 2592 bp, Bovine  19866880448810
accataatgaaggctgagtgtcaaaaaattgatgcttttcaattgtggtggtagaaaaaagaacccccccccctttgtgaatcccttggactgcaaggaggatcaaaccagtcaatcctaaaggaagtcaatcatgaacattcattggaaggagtggtactgaatgtgaagttccaatacattggccacttgatccatagagttgactcactggaaaagaccctgatgctgggaaagatttaaggcaaaataagaagggagcaacagagggtgagatgattagacagcatcaaagactcaatggacatgaatgtgagcaaactccaggaaatagtggaggacagaggggcctggcgtgctacagcctatggagtcacaaagagtcagacgtgacttagtgactgaacaatgagcaacacatcctctagtcctctcactgtaggtaaggcactattctagtcaatttacttgtcttagtttgtctaatctccccaacagtcctataaggttggcactatttttcactctatattacagatgatacctcataggctcagtgtggttaataaactttgatcaaacttatcccatcttatcaagaggcaaaaccagaattgcatcacatgtgtgttcttactcttatgtttttaatcattctttttttattaactttgatttctgtcatatgacaaaattaaatgaagtgtagagatcagaacttattttttgtttgcttgtttgttcattagttctttccagtatcctgaatagaaggcataaagcttaaacaagaatggtgactgtctgtaaaaacaaaggaaagaggaacagtgtaattttaaatgtgttttcaagaagataagtcataatacagactctgtgaacccttaaacagtggatatccatctcagctgcagctttcagaggagttcatgtgagaaaagatgtgccagataagtaaatgttctaatgttagtcttcatatctgttatgggctaaatgattgttcaccacttctgcccaccaatttgtgtgttgaagttttcaccctgaatgtgatagtattaggaaatgtggctcttgggaagctattttgtcatgagttagagccctcatgaatgagattaggggctttataaaggagatgccagacttctggcctccagactgtgaaaaaaaaaaagtttctatcgtgaacaaaccacccaccctttagtgcttcatatcatctcaaatcagagaaggcaatggcaccctactccagcactcttgcctggaaaattccatggacagaggagcctggtaggctgcagtccatggggtcgctaggagtcgtacacgactcagcgacttccttttcacttttcactttcatgcattggagaaggaaatggcaacccactccagtattcttgcctggaggatcccagagatggcggagcctggtgggctgctgtctgtggggtcgcacagagtcggacacgactgaagcaacttagcatacctgttgttattatgtgtgagaaaagagtctttaatttgttctccttttgactggttttgctccagctgcctgctgcaagaactgtcgctgtgtgaactaaaatgaccggatcgcgtaaatcctcaaatgctaaaccgatgccctgcattgcatttctcacgtcagatctttgattgtcccagagctactctcccttgcacaccttgaattaaaatatccatggtcttacattgcccccaaacctatctcaaagagtctatttcctgacttttaccctagtcaccatgatccccctccagttttgcctaaggaatgtgttgctatggcaacactcaccacccacagtcaacagtcaaatttcatttctcagacatagctattaaaaaataaatggtccatgtaacattctttgtgtttgtttccctgttcatttgtgaaatctcctacctgttcgaggcattcacaaatgtaataaaataccctttctaaacatttgggcaataatttgttaattcaacaaaggcgctattcagattctcaatgttttataaatagctttccatcaacatgaagtttaaaaaaaaagtcacagtcataagctacttcagtcctagattttgcttagtcaaactgtgtcttattttgtaataggaacatgaaatgaattgttacatattatctgctaaaaagaattctgtctctttaatttttagaacccaaagtaaaaatgacttatttaactgagtcagaaacaagaagaggggtgtaggatttctccctctcttcagtggcctccccaccaaatccacttttatttccccaatggagacaaactaataacccatggtatgtgtacaagccatggcgaacatcacacatttctaggatacttttcctggtgcatggcccggtaaaacccagtccagcccccaactgtgggatgtcatgtgtcaatagcaaccatatttaactcatttccatgcctgactctccagccttctcttggtgagtccttaaaaagtgatgcctgcagttgagtctcttgctgtggagccctgggaaggaggtaaggaggaagcttaccctat

SEQ ID NO: 36068 - DNA, 2897 bp, Bovine  19866880482083
ctgatgaaacaatggagcataagcatgaatgaaagagtttgttctcctttctacaccactctatttgcatgtggcacacatgatgccccatgagcacagaattctgggggacccatgatgtgtgggagttcagtgagattcaaagcaagcacatgagaagtgtgttctagctctgattgagtggaacccaaacttgtttcacgttcagaaagaaggtaatggcattctgaaaaatacaaatgacccagaaaccctattatatcttttcttactccccaatcacttctgctgaaaatgatgacatagaatgaaaggaaaagatggcaagccataattccttttgctttcagttctttcttgcttatcagtaagctgtagatagaaagtattagtgaaatgtacacatatcaagaagtgaaaaaaaaagttaatcttgtgcagggtttccactcttccagtaagaacaaaaatacataaacatgtacaaactatgaaatacaatttgagtaatctaggtgattctgcaaacatggtaaaggcacttatatttgcatttaaagtgggcattgaacaatataatcattaacagatttgtgctaataattttaatttttttattttctcagaatgacattaaataccaaataaaaagcatatggactttcctggtggtccagtggttaagaatccacctgccaaagcagaggtcacgggtctgatccctggtctgggaagattccacatgccaccaggaaaccaagccaatgtgccacaactagagtcagtactctagaggctgtgagccacaattactggagcccaaaggcgctagaattggtactccaaaacaagagaagacaacacaaggagaagctcacacaccacaactagagcatatcccccactcaccacaactagagaaagatcatgcatggcagcaaagacccagcatggccaaaaatttaaaaaaaaaatttttttttaagcattatgacatactgaaaaagactgcacaagagaaaaaaaaactttatattttaaatttctaacagcatttttcctgctgttttaacagtggcctcttgttttaattttgccctagtcccagagtttatgtatccagccctgactatatacatctgagagtagaaatagttgtcattacttttcattgactcactgttccatgcgtttgacaatattcagcactcattatgtatgaggaatgtgctagtggctgggaatatggtaatgaacaaaataggcatggtctctactctactggacttcattgttcttccttgaaatatagctatgctttatgttttagtgtcctctaattcaatgggattttccctgttaggtctaaattaacaaagttgagtttcctgtcaatgacaagggaagaagtcttattagtatgtctgaactccttctgcaagagtgattttgtcactcatggtcaatcagcaaccatacagagtatgggatctgggatgagaatccagtgagaaaggacagcttgggagtccagctgcctgggtttcatcataattcttacctctggctaaagctatgccttatttgcacctattctgatggtcccaccagaaaaatgagaaggtgctggtctcgccactctccagttcaccgtgatgttacagaagttaaagggccgcacttcttcagaagccttcctacccggtgtgtacactttccagacgtcagcatttttgtgtctcacagagataccaagagctggcctctgaagaaagtgggccacagactgaaagatgttgggggaggggagtgaaggaaggcagaggagcctggaaatcatagctatccagaaccactgaggagggcggctcttttcttcctcttttcccctgagagtgtgtgctgatctggtcagtaggaccctcgagtctaaactgcactgtatggttacaaagttcagtcctatataataactccctcaatatggtccaccaggcatgtctgatcactggttgcagcccatggaaatcactgtcaagtttgctccccttgatgaaggtagagttcttggggagtaacaaatatgccatcatgagggagattgtaagggtggagcactcatccttaccacaggaaggatgggactgcaggaaatagtgcgctagcatcaaagtgagagaagcatgagattgggagcctggagtccgatttcccactaattagcatatatcctctcagcaagtagctttctagaccttggtttcctcatctattaaatgagagttgaataagaatatttcagatatcaactaaagctcgaacatttttcctttgtcctttgtctatagccttctccaatcaatcctttccaaaaacatgccgctgtgtagaggtcacggaccacatcttttttgtccttgattccccactatcacatggtactgggaacacagtaggtgctcaagaaatgtttactgaatgaatgtgtctttggacaatctctgtgaatggatgttgcttcttcttatctcttcccagagaaacagggcagaaatctatgataacataagaaaaggaaagcattctaatagttgataacacagaatacattaaagcaatgctcagtcaccatacattaagtctttttaatgtagcttttaaacagcttttcttattagccaaatgaaatacagtaatcctttaactctcctgtgtcagattatcagctatttcaagtaagtgttaacatttctgtcactggcaaaagtgaattatgttttcctttccaagcttgcatcaacatgcccaacaagcaggctgaacacgcctctctaatgggacagtgtgaggtgccactgcttggtgattataaagcagctcgacatcggggggagggg

SEQ ID NO: 36069 - DNA, 1355 bp, Bovine  19866880629149
tttatttctctagtgttatgcagcttatgggaaacaaatgaaatactacatttatttgaatttttattcagtgttgagttatactcttatacctcagctaaatattgttttgatatattaaatgtagacctctacaccctccttttatagtcttatctgtcatttgatttttttccaagtcattagtccttcatttcattgtttctatcatggctttaaatatccagtgagaccctatgatttttatctgaacactaataaaccacttctttgaagcagcttctactatagccaggaagtcataataaggataatggagtaatagtcactatcttcaccaccacatgattcctaacagtcacaagcacagcttccccaagccccatcaccgtctccatgttaataatggttaatgagctaaagtattgaagacacatagtctccatttgctcagggattttgtattgtatatgctaatcatgtgagagaactagaggaagatgcagtagaaaaggttatgattaagaatgttatgtattcttctttttttttttcctgatttaaataactgctgaggcacaaaccaagacccaagggagctacagaaatttacacatttacaaaactgggttcccacgaagagaagtgtcttgcaggaagaatgtcaggatgaatatttcccatcacatttgaaaaggataccagtaaaagaggggttggcaacaatgctcttgtacttaggagagctacagaaggcttctaaagagccaccggagtgccaggcaattctgatgatggtgtggtacaatttgaaggactagagaaggtcccatattacaaaatatacctccaccacttagaggctgatctgctgctgctgctgctaagtcgcttcagccgtgtccgactctgtgcgaccccatagacggcagcccacccggctgtcccttccctgggattctccaggcaagaacactggagtgggttgccatttccttctccaatgcatgaaagtgaaaagtgaaagtgaagtctctcagtcgtgtccaactcctagcgatcctgtggactgcagcctaccaggctcctccatccatgggaccttcctggctagagtactggagtggggtaccattgccttctctgagaggctgatcactgcaccttaaatttattcactggaaatacaacactttgctttatgaagtcttttaaatctgtagttgagattcaataccagttagtgaaaccacctgtatcagaaaccttgtttccaaatgatgcttgggctttattttcaagtttcctaaactgggcattaggaatgtaggttttcaaagtcttaagtgtgctcg

SEQ ID NO: 36070 - DNA, 2045 bp, Bovine  19866880642796
aatgctttgtagggttaggggcttgggaaagggctgtaaagagaagtttgagtaactctgatatgatctttgggtcttcactttctggaatcaccaatgtttctcctcttggtctccctaaacccattaaacacctgcattctaaaagaggggagcttcccaggtggcactagtggtaaagactcctcctgctaatgcaggagacataagagatgtggtttgatccctgggttggagagatcccttggagaagggcatggcaactcactccagtattcttgcctggagaatcccatggacagaagagcctggtgggttacaatccatggggtcccaaagaatcgaacaaggctgaagcaacttagcatgcacgcatgcattctaagagtgtctctattaatgtccaatggtctgtaaaccccaggttaggccagtgcagggagctctctggtgtcttgacctcaccaattctgatttctggctttacaggctttcacagcctctcttctgtccacaatctaggattgtggatagaacaaaaccttgactatagtgaatgatataaaggtggcttagtgatctgtaagttaatatggctatctacagtctactcaagagtacctctcaaccatctttcttgatcatttggggccaactcaatgggctgaagctctgagttcaataggatgtttagaaagagaagctcctcatggttctgactgctatgttaccactgccacccagagtcaggaactccatcagatctctagcctccagcccaagttccctgaaaatgagaatccccccaaaatattaattttctatgttcagagccttctgaaactgcacttttagtatcacaacaaccccagccattggtactttttatcctctactcttggagaaggcaatggcaccccactccagtactcttgcttggaaaatcccatggaaggaggagcctggtaggctgcagtccatggggtcgcgaagagtccgacataactgagtgacttcactttcacttttcactttcatgcattggagaacgaaatggtaacccactccagtgttcttgcctggagaatcccagggacgggggagcctggtgggctgctgtctatggggtcgtacagagtcggacatgactgaagcaacttagcagcagcagcagcatcctctattctgggcttccctggtggctcagatggtaaagaatctgcctgcaatgcaggagacccaggttcgatccctgggttgggaagatcccctggagacccactccagcattcttgcctggaaaattccatggacagaggagcctggcaggctacagtccatggggtcgcaaagaatcagacacgactgagcaactaacattagctctgttatttcatctgcagcttggaggcttgtgtgttgtaaacccacagaggaaaactcagaagttatatagaatcagtctttttttttttcctccacctaggagaaattgttttgttttcttttatttttctggaaagtcagttatatgttgccatagggataaaagataagaaaaaaaaataatctaaccaaacaggaatatgacttttcatttatgtatataggcacttttacctgccttgtgtaaaatcaattcaactcaacaaatatttatcgaatccctactatgtggcagccataattctaagttgtacgtactatcagtgaccaaaagagatggactgcttaccctcatccagcttatagttacttcacagggtattgtagtaattgacgcatgtaatatacttggcatagtgcctggcatttaaaaactacataagatacagactatgtgtaagagaaaataggacaaatggcagtgttccaggttgaacttaatttaatcatcatttgtcactgctctgatgaatattgcgaaaatgaaggctttagattgacactttttaagtcaaaacatgagaaaatatattcttagagtcggttgtaaaatgacattaatctaaccgtgatattctattttcacagcagtagcctag

SEQ ID NO: 36071 - DNA, 1685 bp, Bovine  19866880675545
ttataagttcacgccctgcacctgcaggaccgggcggaaagaaagaccgaaattgccttgggcggggggagcatagagggatgcaaagatgcaagcgcaggggaggaagaagcggaagaggggcccgctagtcttccagcttataaacaaagctccgggtccacgttgtctcgcgcctttcccgagtctccacccgaagcgcacagtgggcccgaaggccccacttttattctcgcaccccgacgccgggggtcctttcgcctctcgcatctggcctcccattctcctcatcctccccttctctgggctcaaggccccccggctcggacccggggctcagagggtcgtgatcctggacgtgcaggtgccattacggaagacgccgccggactccaggttctcgggctggaagtcctccacgctgtaagcgcggctcttgagggccgtggcatagtagtcgaccggctcctcggcggcgttgtccatccagctgaggcaaaggatgcgctggaaagagcgcttgaagttgtctgaaaggaagccgtagaggatggggttggcgcagctgttggcgtaaccgaggatgaccgacagctggctcaccgtggcgtcgtcctgctccgcgaacacgttgactagctgcaccacatagaaaggcatccagcagatgacaaacaccatcaccaccatcatcaccatcagggtgatcttgcgctccgagcgcttgcgctgctgccagccggccttgagggccaccatgcgcattttggcgatgatgagcacgtagcacaagcagatggccccgacgggcagcaggaagcccatgaggaaagtgtacaacacgaagcccaccagccagcgctgggcgggctcgggcatgagcatgttgcaggccaccgtgccgtcgctgttggccgccgtgcgcgagaagaccacgatgggcagaatgacgagcagcgacagcacccacacgcccagattcaccaccttggccacggtgggccggcggtagcgtgcggccttgatggggtgcaccacggccacgtagcggtccacgctaagcacagtcagacagtagatgctggtgaacatgttgactgcgtccacgctgagcacgaggcggcagagtagcgcgccgaagggccagtggcgaagcaatgtggaggtgaccaggaagggcacgctgagcatgagcagctcatcggcgatggccaggttgaggatgtagatgttggtggccgtcttcatcttggcgtagcgcaggatcacgtagatgaccatggagttcccacagagccccaccaggcacaccacggagtagatgaaagagatgaggatagcgctgccctggccctcgctcaaggtcccgttctgggacgcgtttcgccccggttcttccatcccgtctgcagcgccggccccggggcccctgctgccgccgccttcgccgcagctgcctgggctggggctaggagaggagggagaggaggcggtgccattggggaacatctcagctgatgggggccggtggggctgccggggctaaggacgttctccgggcgacccccgccgctggcgccctcactcggcacccccggcggtccgcccgcagctcgcagtcacccggcgcctgggggaagcgctcagcgactgcaggaagcgcagctccaccgcggccggcggag

SEQ ID NO: 36072 - DNA, 3177 bp, Bovine  19866880749688
ctccatcagctcctaaatcctatgacaatgtaaaagttttgctaggccaggataaagtattaagcagaacattatccttccaactctaatcccaatgctatatttagattaatttctctctaaaactaattaaaatcactggctcttttagggcaatttgatctgcacatctgattcattttcctatactggtagaaagggaaagaaacacaaaggaacatagttctaactccacatggccccatctgtatgcacatcaccaaagagaatgcaaaacattcacaacatcaataatgtcagagttattaaagcaagtaatttccttttcctgatgccattttcatgaaccttgttgaaacagtctcttgcacatttcttaaggtcttttttccaagtgagttttccaaggaaatagcctcccatgtttatatagatatcttccagttttgagcagagaagagctcaggggacaatctttgggtaaaagggtaactgtacaagcgatccttaactacttccaaaacttcactttgcagaactttctcattgtgttttccatgaccattattttgccaggaccctaaggatataccattctcctttttaaattctggcccagatttcaattcaaacaacatatcttttccttatcttttttttttttttcccagacatcttaagctgatatttgtaaagttctttacacaaaaattagaagaaacaataaaaaaaaataaaaaagaatagactactttataaagggtacatttcctctcccaagctagttaattcacaaaatcaccttttgaacactcaagtttaacccttctttctattcccctctttgcacttttcttcccaagtcacagtatggcgtaaagagtgtcagtcactcagaccttctaaggaaatgaacagctaggggctttgatgtgcagtgtaactttcgtgttctattgagagcattcttaacagtgaagacacaggagctggtctccatccttcactcctcaacagttggagctacttcctcataacttcattatcagtcttcttgactttgcaccaaaaacaaacaagcaaggaaactcacaggaaataactctacaattatacaaagtaacttttaaaagtgtcatgaatttaaaaggttggagaaccctccctgctccttcccccacttcatcacaaggtaagcagtgagcctccctcccctccttgaggccctaggggctttcccagtcgtcaccttctcactgcacagatggagccaaaggcgttaagtttctcttatatttgaaactaaaacattcatcatagttacaaatccttcctccaatctgatgcttggaatgacatggaacattaatctcctctttcctctagggcttgccaaggatcaaaaaaacttctgcctgtaaatggctctcagcattgatacatcctgaaaccatctatgtgcatcaggaaagaaacagagctcacttgcttctatgaaaaaaatccatgttttttcatcctcggggctttactcctgagaatcaaattggaaaacaccatttttaaaggcacattcaaagacaatctgtgaaggaaaaaaaagtagctgctagaagcaagtaaacaatctatacttggatctctgaaaacaagataaaagtactttgcaaagaaacaaaatctaaggaactcagaaaaactgaagtcaattgtgaaccgatttgctgatactcttctcctaagaggagggcctgtgctgttttttaaaaataaatatataaataaagttgccttgcctatatataagaagcagaattttagttttttccttcataatataccaacagaaaccaccgcaagcaagtttctactgcctggagaataaaggccaaatttcttgttatagtttacatacctcttcatgacgcagcccagcctggctttcggaccatatttcccttgtaatctcatacgcagccttgttacagcagtattagttattagcagtttctcacaattgtcacattttctcaggtctgtgcacacacacacatgccatccctatttttgacatactcatggtctccctccacactgtctacctaacttctatttctccttcaaaagtcagagtaagtgttgtctactggaagtcttttctgattgccataggataaagcggatccctctctattgtattgtccgctgcactatgctaagaagaaggcaatggcaccccactccagtactcttgcctggaaaatcccatggacggaggagcctagaaggctgcagtccatggggtcgctgagggtcagacacgactgagcgacttcactttcactttccactttcatgctttggagaaggaaatggcaacccactccagtgttcttgcctggagaatcccagggacggggaagcctggtgggctgccgtctatggggtcgcacagagtcagacacgactgaagtgatgcagcagtagcagcagcagtatgttaatgcccatactgggcgaatttaggtgagaaacttctctaatgacacaatgatcttaatacattatttctcaaggactgacgcagagaaatttttttaaaagactatacccacggtaactgttttataactatgaataccgaaaaatagttttataaagaatatataatgccaaagcattaaataacaaattttgtacattttaaatttaatgtgaaagctaatattcttccatgtctttaaagtaatttattttatttatttgtaagtactgatttataagtatgtagtgatttcactcttggaaacaagagttctctgtttcaatttttatagcgtccagaaaatataagctaatatttaaatgaatccagtggcacatcatttttataaaagcagtcctaattttatatatattatcaagcttgtacattgtattttcctaaggcatctgtacaatcaactacaactagataaatatcattataaaaaactgttagaatgattagagtagcattaaaacaagcatacttcctgtcccaagtgtgttttgggcaggggttggaagatggagaggatatgtacttttatggacaagactaagtaacaaatactgcaaggtagtatgactgtgtggtctcctgtatgttcagttcagttcagtcgctcagtcatg

SEQ ID NO: 36073 - DNA, 1341 bp, Bovine  19866881073579
ttttgattctaatttggcagttccaatggaacctcattgcactttctttttcctcccaaaggcaagagctgtggattctcagggtggaaatgcaaggactcacaggtggcctggaaaagaatgtggtcatttcttgctttcatgaatgagcaaaccaaggtgcagggaccatggctggtggggcttcagagctggttgaattcctcaaggcttgttctggctgtcttagaatctgggcagccggcttgcaaaacatcaagaggaaatttcctcttgagccataccgggtgacccactctgccacaatttggaatgggagaattctagagcagtctgggaacttttagctttacctgcccagctcgcccaggtgggaatgaagtaaggctaataaagtgatgactttctctgaagtgttccacagactcagaaaggggaagccaagaatagagtccacttgtcccaggtatggtgttcattacagaccaggctgccttcttactgtgtcacattgggtgaaattaattttgaaatcattttgatcaatgtttcattttaccaatatgtcataatttagtaataacatttaattccatccatagatacttaatttgatcaatagttaagtcctaattttaaatatattaatttttgaattttggtgggggcagaatattttaatgttaccctctccctttctgtgtactcttgcttataacaaagatttgtcattagcttttaagccagaaagaagtcagatcctcctatgaggaagacctctgtgctgtaaaaactgtctgttcactggggaaaacatgccctttggtaaattttcacaagagtcattcccccagctctcaagcttttaggtacagctctgcttgtcccatagaggctggattaactggattagactaacaatccatattgtgtctcagagcacttcttcagctgtatccttgaaaccagaggactcagcaaggcaattctggttgtttcttgaagctttaaaaatatttcataatgtatgcctgtgagcatatgtatgtgtatttatttaacatttattgagtactttgggggctttccaggtggtgctagtgaaaaagaacctgcctgccaacacaggagacgtgatttcaatccctgggttgggaaaatcccctggaggagggcatggcaacccactccagtattcttgcctggagaatcccatggacagaggagcctgaagagctactgtctatagggtcgcaaagagtgagacacaactgaagcaatttaccgttcatgcactcactgagtaccttatactgtaccagacactgaactaagtacatt

SEQ ID NO: 36074 - DNA, 1571 bp, Bovine  19866881314618
ccctacaaagcatccacgtcttttctttaacacagggcaccacatatttctgaacccatattcaagaaactgagctgctaaattctgacagaatgaatatcagcaaacttaaggaagacaactgagttagtgaaatgctttaatattaaaagctgcttccctgaaaatgcaatcccacatcctagtgttagcttttgatttaaagtttccattgataatccccagttctgaatgtgttccttaatctattcttagtagatctctagccaggaatttgaacacacggaaaaaaaaaaaatgaaagaaatttccagggagtataaatgcaaagcctgttggtttgaaaacttgtccctaaaagaagtattaatatttaatatgaattttaaaatcttgtatcattttactttgggtcactaaaagagaaaggaagcaatcctcaaatgttaataatgactttttaaaagtaattcaaaaaggtcttagattaaaaattaagtagttctctaactttattgttggagccgcttaatataatttaatataaactctctagcttctttagcttcctgatttgttaaatgtatacgtgtgacacccttcccccaacacacatacacacacgattatatcattagcattcttgcaggtcactttccacatgccaactctctaacctcttaatccccttctaaggctagtgacaaatagcaattgccactggcacaaagctaaagggaaattgtaaaaaaatattacatgaccttgggatcaatcaataatatggaaaacttgctggaaaataaatcattacctctttagagctttattggctctgatttagatgcctctgtcttgaccttccaatttaaacctgagtgaaggataagtaaccaccacttcctcatttttaaatgggtttttctggtatcatcccttactttccttatagaaatttcctaaggttactaagactgcaattagaacaaaaataaagttgtagaagtttcgggggaagttccatgtaatcattacaaacacccttcagaattatattgtgcttgttgcatgaaatatgagaagcaaaacaggtgttcttttttaaaaaatagtagagttttctctgacttttgaaagtgaaaaaacatttctacatccaatagatgatataagtagtgaacatctaaaggtgatgaaaaaaatgttttgagactaacagccaaggaagagttactattaaatagagctttctaatgaaaacaaatctttatagacaagatattcaaactgaattgtagtttcagagcctaaaagtgcttctagcatatcataagggctcagtaaatatttgcataattaaatgcattttattgatgggtaagagctatatatgtgaaaagtgacattttgtattggagtatagccaattaacaatgttgtgagaattcaggtggatagcaacgggtatcagtcatttatatacgtatcctttctccttcaaactctcataaaagtagccttcttgttatctttcatcttccccgacagaagaggggcgtttcagaaaaaaa

SEQ ID NO: 36075 - DNA, 1215 bp, Bovine  19866881589750
acaacttaatttttcctatggttattgatattcttgacttctgtttccacttagggtcaatttttattatgttatatattccagattattctatttaggttacttatatttttgaaaaataatgtaaaatttcctattactttttactttctaagtttctttttgtgtttgtgggtgaaagtacttcaggttcaaaatattgagttaatcataacctaatttcatggtgtattacagttattggcccagtcctttaatttactgatttatttaatccattgcattcactcacttccttctcatttctctctctctcgtagaaaaatgtttgatgtgtatccttcctatgtgtgtattattgtgagtcttcttttgttatatgcatgtattttaatttaaataatagcatcattccatagataacattctgagaattacttttgaactcagtccaacacttttaaggggcttatcaggtggtgctagtggtaaagtaaccgcctgccaatgcctgagacataagagacatgggtcaatccctgggtcaggaagattcccctggaggaaggcttggcaacccactccagtatttgtccctggaggatcccatggatagagaagcctggcaggctacagtccatagggtcgcaaacaggtggacataattgaagtgacttagcacgcacccatgcactaaatttttaaagatattcatatttctggacatctatccattgcttctgaatgctgcataatagcctataatgtgcctcctcattatgctgctaccgatccattcccctagtgatggacaactacctgacctctagctccttatcacaaatacaactgtgatcaagattctactacatgccctattatgggcctgtgtgagaatgtccctgtgatgcgtaaccaggaaatacgctgctggggcctacagtaacatctactcatctgactaagtatccccaaatgcttttctagatcaggtgtagcagtgtaagataactaaaggacgaaaataattactttttgtggaaaaaaaggtttttattataaaaataataagcataaagttaagcttaaaaatgcattccaatacacattaggtgcagacgaacactgtttgattctacttatatgaggccaattcagagtcaaaaagtacactggtagatgccagaggtcagcagggggtggactgggggagtg

SEQ ID NO: 36076 - DNA, 1163 bp, Bovine  19866880368584
acagccctcagctatcctcttcctaatgggattgccccaaccgaagacaaatggcttgcttaaacccaaacacttttttccagggtagtttacttacaataggactattaggcaggctctctcctcagggaagaccggagcccctcatcccttgggcatgcttatgcaaggacttctccacccaccctatcctacatccttcccctccgtccacagatccgaaaggctcttcctactaaacaccctgcctgttaacacgtaagccacagaacccatctggtgatggatgataagaaacaggaactgttctgttgaaagaagagttaagatggcgaataaacagtaatggtcaggaagatcccctggagaaggaaatggcaacccactccagtactcttgcctggaaaattccacagatggaggagcctggtaggctacagtccatgtggtcacaaagcgtcggacacgactaagtgacttcactttcacttttcgctttcactttcactaatggctttctcacaatttctattaacctggccaatacacgtgccacctgaatactacgcgttgtgggttgtctctttgtctttccagcagcggctcatttcttccaagacgcacaaccgagcaatgacagaaggaacgagaacagctgcaagcactgagactctgtcaagaaagcctctttcttctttaggttatccaagacccacgcactgcaaccagatgcatgccgtcctgagcccaaaccctcgacttctctcccatctcggactttcaaattcttaaatttgccctttacttaaaaaagtcaatgatttcaccaagaaagtttgattagtttcttttactttctgtaatgaagtgccatcctttttacacttgaaaggatctttgtaataatgcaacattgatcttttgaatacagatgagctaacctagataataggatttagaatgtgagagactggacttgggatgatatttaaggctccagtgccatcaagaggaattgcagcataagacatctgcttccagagacattgtctgccgccacattaatagatggaggatcatgttccctaccgcacaaagtttttattttgttcagcagcttcagagatgtcaatatgctctatcttcagatgtcaatcacccag

SEQ ID NO: 36077 - DNA, 1567 bp, Bovine  19866880386561
tagagctgggatttgacagctaataggttgagtgccagaaaacatgatactttcctcctgatggcctcccaggaaaagctgtgatgaagaatgtaaggttgtagaagtcaaagatcataggacaccttccaataaaaagtctctctcccaaggtggaatacttttatcagttaccttcttggtaatattttaaaccttaataatggcagcagataccccaatattctttcattctcagaaagataattttatgggctaatgttagaaactcattaatctacatttccactcaaagaatttataactgtctgcattttcttactccagtcatcagcatgttgaccactgtgggaaaaagctgtgtccacaatggaagcatcaggagagattctggtgatggttcacagggaaacttgaagccctgaaaatttgactttcttctatttggcactcaacatcctcaacttcccctccattcccctttcttcttctctattcttgtcccaccacatccgtgtcatggaaatggctactgaaataaattagtttaatttgtgaaatcacattacggttctctctgctcatgccagcttgcccagattagcccaagcagatggcaatggagtttcatcgctggtgagaaaaggggccctttccagaactgcagaacaagtgtgggagaaacgttatggatgccagaaagctgtgtacttgagtttttgggccagcgatagcagtgctctgcatcaggacgactctctgccttctgaacagagggcttcctgagagctagaagcagctggttctggagaaaagatggcttgcaaagaatcagaggcattatgagtcttaaattatttaagttcctcctgtggcagcggactgtaattgcttcctatttctgtaaatattagcagctgtgagcctttcaagtaaggagctaaaacagcgctccgtgtatcatacttaaactctggaatattgttaaatatctgaccttgggctgtcaaagcacactcgttacctacactagcccttatgcaggggagttgttgacattctgaactggtatattattttcagcctggtctgtaatagcctcgagagatggagaattggcaaagggaattgcaagtcaccaagtagcaatgtcatgatccatttcctcgagggaggtcacctctgtgcctgctgctttttagttgtttttacatctgtaactccaccgacagctgtcatgatgaatcctttatcaaactggcaacaacttgtaataggactagtttgcataccagctcttacctctttagtctcagttgatctctctgccttatgttcaatgatttaatcctactgattttttttgagccttcagactcgttgtattctcattgtcttttgcatttgacttaccctgagttttctgtcttaaactctgcatgtccttgtagtacacctatgctagcttctacttactctgaggatgatgcctgctcttggaagctcttgtgggctaattgggcttcccaggaggctcagtgtgtaaagaaccagcctgcaatgcagg

SEQ ID NO: 36078 - DNA, 2242 bp, Bovine  19866880400386
ttttatcatgaagttagagattccctttttattattgaagctataggaggcatttttcaatggtctggagctaaaatataacttcccctgccactaagcttgccagtggttcagaacgttagtttaaaaggacaaaatggcctatggttgttgctgttgcttgtaaattccattgtgaattgattataggctgagagatcgttgatctggacatcaaggttcaagctatctgaattcataatagaggactttttgaactacaaataattctgcgtttttcagtacaaaaacagcttggaggtgtgagggttgggttgagctggtgggagtggtacaagcctgttgttattctggggaacagatccagtgcattgaggtatacctaattctcactgcagtcattgtacatcagggcaatttagatttcgtgatcaacctagcatttcgtatgtagcatttatcttattagagctaccaatttaattatatatgaaaacattcaaattagcaagtgcatgaaggaaaactgcttgtgcatggaagaagataagcctatattatggttaatgtatttatccattaatataatcattatgtcatttaagacatttaggttctaccaaagtatcttgttaatgtgagttataatgcctgtggttttcagaacactttctgaacttaatcctggtctctttccatggtttacagtattcaatttttctcattcgcagttgtttcaacattttcaacttcctctagattatttattttgaaattctgttgccagaatatgttgaatatgttgctgattatcattaaactatttatttatttttctagaataaaggtatttctaacatatataatagtattaaagagtgctggatgtggggatttagagagtggccaccttatactttaggtaacatttcatattgtggtgcccccccatcattgtttagacagtttttttttttttttcctcatccttgaagagtctatccattcattttgtttatcagttcatcactctagcttttactcgatgtgtcattaaaggagcactttgacaatgaacttcaccaagactaaaaccttaaagttctgccagaaatatttgtgtatatatacatatatcctgtttatctgtctctattaatttgttaactctagtgtcctgggtgtttacaggggtattctatgctttatagcttcacactgtaagtgtctagaataagaactgaattcccttgactccatcttggagaactcccctgtgtaattgaagctatctgcagcatttggtaagtggggctactccttttcttgttcctctttggacaacactgttcatttggctctcttcctgtctctgtgctttgggtattccttctgctcccattcagatagtgttcccagaatcctctcctgtgtctctttttccattttgcacacattcttcactcgtggggataagtggtgtttctccactgtatctctctttttcaacttgtgatcagacaatcatttttcttcacttagtatactacttgtaaatgtcaatagttcctcaaactcaacaatctcttaactaaatgtctctctacctgattattttttctcctcatccctcatctctaagtcttgtcatctagaatcccaaaatgtgtcctagtctataaatctttcccgtgctaataattccattactatggcactagtccagatcttatcatccttttcttggacaagtatatgagtttgctaacctgattttataaactttattcttaatattttactgacttttattcataagtatctataattatctgtctaaagtgatttttttagtccttattttaactgtctgtaactcacaataacattgacttctttatcttcctgttacccttttcttggttaatgtaatgatactctcacctggttttcttcccaccttctgcctgttcttgccaggtctttttgtacattcttctacattttctaattccatatttgtaggtttttcataggttctagcttatcccaatttcctttcattttatttcctctactttacaatctcaaatattccaaggcttctgtgattccctctttgctgctgaatcccaaatttgtatctctagtccatattgaatgccaactcactactagttatcgatctctgtttgaatattccataggaatattctttccagtttaaaagcaaactcataat

SEQ ID NO: 36079 - DNA, 1379 bp, Bovine  19866880433687
tgaatattcaggattcatttctttaggattgactggtttgacctccttgctttccaagggactcccaagagtcttctccagcaccagagtttgaaagcatcaattttttggtgctcagccttctttgttgtccagctctcacatctgtcgtattatgtatatgtgtgtgtgtgtgtatgcctgcacagtttatattatacacacatgtatatacatatatatgtagacatattgaatataaacctatgtataatctaaatatacataaaaactaaaagtgacttttaggagactattcatttaatgcatggagatgatgtagttatttgattaaaacaagtaatgctgaggttagaccttgatttgaactaagatctgtttcttagttcttcttcctaggtatggccttcagcaggctggtcagcttttcttatattcatttttttagtcgcttaagtagagatataatggctcctattatataggactgttgtataagataaataggatcatatttatatatctcttaacatagtggctgatgcataatggtactcagtaattgtctcagtaaatataaatataaatatttactcagtaaatataaaacaaaattttaaattattattattattactctagctttgagcatggttccagtttacaatttaaatcttttctcccaagagttcacttaagaagatttcaaatctaagtgccacccaagcaggaacattatctaaatagtttctggagcctgtgggaaaatcagagctatggataattagaggtcagctgtcaggacccaagaaaagatcttttaacatatcttcgggcaaaagagagaaaaaggcataggaactagaaaatgttcaaggcagagtgaatatgtatttttccttgaactttatccagttgtggaattcaatatgaaaccttagaagtatgagtgtcaatgatatttcccaccaattaaatttcatcctggcatgaatcagctggcataaatcaaagactttaggtgaaagaaggtcattttgttcatgaaaatgtcatcctctctgtacaaacagcaccttccagggttgtaactgtattccataacaatggggcacattgttgtgaggtgtgtagcttagccttttttttataaaagagctgttgctgatgattcagtattgttctttttcactcactacttagacttaacatgtcatttcctgcaaaaatgaaggtaaatccagatggtttgggaaactctgataggtttactggtatcctgttggattgggtagactcctgaccatgttgtatgtgacagcttgctcttacctgtcacttgctgaaagcagaaaattcttagactatgttcagccaga

SEQ ID NO: 36080 - DNA, 905 bp, Bovine  19866880523491
atataaaacgtgtaagaaagctttatatacgtagtattacctggattgaactcatgtgctataattatgattttaaatttattactatcttttacatgaagttcagctagtctgagtaatttatattctctgaacatttcttgttttactctttcatcaggtttcactcttaaaattcactgcatggtctccacggacaagaagtaaaggttcttcattgctgcagcctctcagttaaaagatagggaatccgcatttccccatattttactgttaggctgccagtatgtttcatagtctcccacatgcttttcttctctcaaagacattttcaagttttcttaagtcagataatttttgggtaacaataaaattttggaatcctgcagtctttaaaagaaatacaaaaaaatttaaaaaactcacatattgagccatttaccacgtctatataaaaattacattaagttgcattattatggaattgctaatactacctaattttaaaagcactaaaataaacttttttggaagtgattttatttactaagagaaaaaaacaacgcagaataaggcatatatatctatatgggtttaaaattgaagcctattttatggaaaatgggacatttaaaataataatccgaacagggaaatttttttcctacataaatatcttataactttgtgctgtgtagtatgggagtttttcctggtaatttttggttttgagacatataactcttagttaaaacatactgacttgaaggtttcttagctttcatcatgagggtaccgtgaccaaagcaaatcacatgtctcacagtattctttgtatttcatatagttcggtcaaatggagtcacctacttcaaaagttattgtgaaagaaacctgagaaaaga

SEQ ID NO: 36081 - DNA, 1740 bp, Bovine  19866880549369
ccccatagtgaaatttaatcaaactgaaaagaccagttgatctctcttcaagagaaaaggagggggtcatgtgtacatctttaatatatggatggctgggtagagtaaatgactgtcgcacagaaggtttatctgtaaacactgcagtgagtctggggtttttagccacaataaatggctggtttcaatcaactgctgctagcaggaaatccatggcccataggggcaattacccatctcttgactgaagcacaggacaattacaagctaccgaagtatactcatgataatggagcacttgactgttcagtgctaatggaatcgggacaagaaacagtggtttgtagctacgtttctcagctttgacccagccccaaacccttgcttgttttgcttatttcacaagacggtggcacagactgaggaaccgtggtctacaaaagcagtatcatcttcatccaaaacacagacatcaaggtgttcactcctctgcatccccaacagccccttaaaatgatttacactcatcctgatttttcaaaatacatcacaccttcatctgtagttttgcagatttcttacctaagtgttatattcagcatttggtgctcattactggctaaactgattagccaaattaggacttctgatctcaaggaagtgaagagaaacttgtcagggaaataaatggggaaataaatactcttttatgtcactgtgggaaaaaaatgtcagctaggcatccatagagaggtaaagcttctaagagtagagaaggaaaataaaagtaagtggtctatcagttaaccttctattctcattacatttctttctaatggaagacctaatgtgttaagcgctgtactatgtgcttaagtgcattgtctcattaagcctcacaataaccccagagcagttaatacgataatcctcacttaaagaatgagataatggagactcagtttgagtaatttactcaaagcatcacagttaagcacattgtggaatcaggacttgaatccgatctatatcattccgaaacctagctcataaataccctatcatcctgccccttctcttactgaatgactccagtaagaggcaatgaataattggcaaagccactctattgtgctcccatgatagacattaacaatgaatcctggcctcctttcccactgagtgtagacaggatcatagaatctcttctataacagtaatttcatgaatccaacaatcttcaacctttatgccaacttcagtatagaatttctcaggcctggaacaacatttgacctaccagtcaaataacaattcaataaatgttagatttaagagatcattgtatagaaggggcatagacatctttgttagacctaaagagatcagggcttatgttgtggctctcccatgtactacctccatactctgaacagcttatctaactctggatcttaattcctcagctgtaaaagaaggatggtatgacccaccttctttgccaacaaaggtccatttacctaaagctataatttttccactaggtatgtacggatgcaagagttggaccgtaaagaagactgagcaccaaagaactgatgctttcaaattgtggtactggagaagactcttgagagttccttggaaagctaggagatcaaaccagtgaatcctaaaggaaatcaaccctgaatattcattagaaggactgatgctgaagctgaagctccagtactttgg

SEQ ID NO: 36082 - DNA, 1688 bp, Bovine  19866880594954
ctgcaatctatggggtcgcaaagtagttggacacgattttgcgattgaacaacaacaatcctctgaacctgttatactctctctaaagtggggaatacttacctacctcctagtgctgttgtgagtataaaataatcacataaaacaatagctcaatgcaaagaatgcagctggtaacacattaactatttgtataatgttaataacaataattatttctgattgttaaacttgtgaaatagttgactaaatttcccagaaaggtttgcaatttcataggtttttataaaaagcaagactagaaagcactttttctcagagaatgctgtaactttcagaagcaaaggggatcatttttgcctgaggtctgtctctaacaaataagaagaagttattgatccacaactggttatgcaaccctgcccacactcttcatagcaggagattaaaaagactaagatgtatccttcatcctcaggagctttgcagtgtagttaatgttgacaagactaacttatttaaaacacagagcaaaataagagatgttatcaagtccaaatttcatggaatgagttataaatgctataaaaccccagaagaaaagcagattagtatgggatagagtggtcaggcaagagagaaggtataaactagaacttgaagggtgagttatatttggagagccaggaagagggcattgtgaggcatgaaaaatggaaagaacagagaagcaaaggctagaggccaaagagagagcaatcgctgtaacctggtgccaagcctatgaatgttaaagaggcaagagcggtgaaaaagaaaaaaaatcatggggtaatggtcaagagtagggactcaggagtcagaatatttgggtttggatcatgtcttccccacttgctagctttgtgaccttcgacaattcctttaacttctctgatgctcaactttcacgcctacaaaatcagtgatagtatcacctcgtagcattgcttcaagattacagaacaggaatgtgaaatgcttaacacaacggctggtacacacgaataattcagtatatgacatttccagtaatagttgtaatagtcgtggtagaataatcatgcttgactctagaatcatagatatttaaacacagaacagacgccaggggttattttatctgagcctctcatttaagagggaagataactgaagtgtagagatgagatgacactcagcttctcatcggcaaactaagaatcactattcgcccctccacacctgtcagattcagcattcctattccaaaataactcgtggttggtgctcgtgaacatgctaaattagtgctgatttaggattcctttttaaaggactgctgagtgttagctgcctccagtcagagggagaatatgagaaagccaaattctacaaatagaagttttcaaccctctaataactactccaccaaaagtagaagccgagcaaggacactttggacttaaactcgtttgcctggtcttcctccagtcaactttttacccgatctttgctagaaaacttccactttggtctcctagagtttaaatgaagtctattaaacatctcttgtatatgttgcagggttcttttttaatgccctggaatttttcagccctggaaatatatgtaaaagtaagttcacaaagcacttggtgtgatttcta

SEQ ID NO: 36083 - DNA, 1705 bp, Bovine  19866880646148
atctacgtttcttaaattctctgtgcttagtttttgcacctataaaaacagatgatattagcgctattggtagaaaatatgagctaagcagcagttccaaacctttttggcaccagagaccacttttatggaagacaatttttccaccaaccagggctgtggggggatggttttaggatgagtttggtgcattacttttattgtgtgcattatttctattattaatacaccagttccacctcagatcatcaggcattagatgctggagtttggagacccctgagctatgacatgtgatgcatttagtgctatgctggcattctctaagtactcaataaacatcagttattatcatttaactgtctggcactgtgacatctatagctatttttctttctcttttaaaatgtcttgttttgatccttgttttctccagatcctcttacataacatcacaatgtcataacagaaattcagagtgagaagcatctttgttcctttaccaccttgtttctctcctacctgaaaaaaatagtcaagacaccgtttagatctcaaactaatgttctgtggcaactgctcaacatgggcagcattcaaaatacacctccagtgatttttttttctgaaaggtatacaagtaaggttaatagaggtgccatttccaaaatatatctgccctgagcaacataaaatgattatttaagagggcacagggcatacgacacactctgatattaaaaggcctagcaactaaaattaattttacaagctcccccacatacaaattttcattgactctgaattttctatctgaattacttttttcctctagttcagggagatctaaaaaaaatgagtaggaagaagaaaaatcttttcatttgcaaaccattgcacagacacctgcaccttttgagcatttaaaggtaaatgactctgtccttttcttgttccttttttctctgtagagttgagtgacagcagcattggtacagaaataaaatacctatttcccctcatcaagtctcactgctttttaaattatcttgggtagtcttcatttgtaaatatcttatctatgagaacagatgccttgaaatttgctgaagaaaataatagctttctttgctcttttatcaaaaaacatatcttcaacaaaagtaaaactgagaaagatttctggtttttgaaaaaatttatggccctaaaatacttatttttttagcttgttcaaactttaaaatagaggataaagttaaaaattagatagttttttgtttttgtctcaataacactcctgggattgacatttgaaataaatttcaagcgtaacaaattattggtcaaaatgttctcagaagcttttcaaagtccaagattatgtctttattctcttataattatttaaaagtttatctgcattaaatcattataattattattcaaaagcagctacatttttttgtttcctaactgattctgttggcttagtattttaatgaataatttttcttttaatgttctttaaatggacatggactggttcaaaacagagaaaggagtacatcaaggctgtatattgtcatcctgcttatgtactaagatggcagagtacatcatgaaaaatgccagactggatgaatcacaagttggaatcaagattgccaggagaaatatcaataacctcagatatgcaaatgat

SEQ ID NO: 36084 - DNA, 1092 bp, Bovine  19866880750776
acattataaaaccatatttatgaacttcgacctcacagaccctctgaatcatgaccctagaagtttttgcgatggcaataaagcaggatatgattaatgtgaaactaaactgtcatattcatgccctttcatttgacaatccatcatgtaaatgcaacagaactaagatacagaaatttgtcaatgttcatggtgtttggcttggaacttctttacagacccaatacttgtaagatctgtttgatgtttcgaatcactaccaaactcccaaatctttaagaaaggcaatcaagagtagggtagtcatacctgatctattgattttcacattcacctacaaagaaaggttctttgagctagtcatggtctatctttacctaggctctagtacttgcataagagagattaaattacttttcagtaagtgacttaaacaggatgaaaaatacatatacacacattatgcacatatgcatgtatatatgcaaacatatctacttgcatgtacatatatatatatataaacatacatatgtatatggccattaaaaaatgacaagtctttgcctaataacaattttaagtgtttatatgagcaacaagccaaatggtacaggtgtcatcagcagtaaacaatctgatcctcatcttacttctccagcatggagacatactgaccatctacagatgaagagaccaccctgtgagcagagcctgcaaaacgacttgctttggaaggctgtaaaaggacatcaccgaaaaaaattttaaatagcatgtacaaggaaatagattcatttaaacttcaaaatgctacagcagaaacaattctaaaatataaatgggttatgtgtgtgtgctcagttgtgtttgactttttgtgacctcatggagtgtagccccaccaggctcttccgtccaagggattttccaggtcagaatactggagtgtgtttccatttcccttctccataaataggttaagtacatgagaaataaaagcattacttcaaatagaatgcaacaagtttttttttttaaactttacataattgtattagttttgccaaatatcaaaatgaatccgccaca

SEQ ID NO: 36085 - DNA, 1310 bp, Bovine  19866880770742
ggggcaggaggagaaggggaagacagaggatgagatggctggatggcatcactgactcgatggacttgagggtgagtgaactctgggagttggtgatggacagggaggcctggcgtgctgtgattcatggggtcgcaaagagtcggacatgactgagcgactgatctgatctgaaggagttattagattaccataaattaaaatcaactcaattcttgcaatcaaagaagagggacaaatggtcaatggcacacatccacatgttagaaatgaccatctgtgtcatgtaactaaatgccagttgacagattctgttctcccaaactgatttccaggtgcgtgaaatattcttatgtccaaatgataaacttttaaacatccaaatgaatggggagaatagtattcctcccttcaaccccacaccctcactttcaaaaaaaaagacaaaaaaacactgatattgccatagaaagaagctgctgcctctaaatagtgtgctgtttttcaaaacacaatttattgtctctatacttctgaaaattcccaaatttccaaagagaaataaatcgtaggtctcagattcagtcaggagataagcttaaaacagaagtaaaacaaggcacagcttgtctagagatttttctttagaaaacataaactactctatgcaattatattgagaattgaaaactgctacagatggcttactaagactattaataccataaaaaccattatatgcaattttgtcattaattgctaaaatcccattgattttaatctacaaaagtaataaatccaacataccataattgcttgtatttttaaaccctaagagattagacattttaaatcttcctgtctctgcccataacaagggaatttaaatttgagaaaataaatttgaagcttatgctttagggaagaaaaacataaaaaaaagatgaattctgtgtgtactatttacctcactacagactttctataaaaactgcaagataaaactaaatgttagaaaaatgtaatattcttgactcagactatgacctaacattggtctcaggtaaaaattaattttgtaactttgatagatgttagaacatatttccttgtgattatagatacacatattttagtggtattatccttatatcctaatatttacataaagacattttccaatgcagatcacaacaatgtaaatactttaaaaattactaggttttaattttaaaatttaatagtagtcaaacacagaaatctttgggaacagtctgtatacttaatgtcaaagtatacacaaagaaagg

SEQ ID NO: 36086 - DNA, 1828 bp, Bovine  19866880775461
aaatgtaaaaaatattaaaaaaaaaaaaaaatctgagtagcttccaggtgagtggaagcaaaagtgtgcattataggtttccaaagggtcctgcaaaagagcctcagaggggtggagggagtctctttttttcccctctttcatccctgtatttcctgttttctcaagcaattaggaaagcagagaaaatgctccactaaattattttcaatttatccagaagatcaaatctgggtggaagcaggctgcacagagttgcttaatcccatgagcccctcggtgtgtatagcatggccctcttctggactcctgtgatgacagaggagtaggtgcaaagaaggcaaaaaactgagtcacaaaagagttaaggaattacacttactctcacagaactggtttggaggagaaatgatgaacatgaggaaaaaaatatttgctaccttgcaagaagcccaaacgattaggtttacctctgactctatttcacacctcttttccctttactttttttcccctagtctgttgttcatgactcaaggcttgagtttagggattgtgactcaccatgccactttgccagtatggattctcactgatgcctaaatcccacaccctcttccattagagctccccttcttgctgaggtcacctatttctaattcttattgggtttattctatagaacagaaatattctgtgctaaaaagtccaaatatgtggattttatagaattctgatgacgctcttatttcaatgttcataaagtgcttctttggagaaaatacaagtaagatttgggatcttgaagacacaaactgctaaagtttttaactgtgatacgacttcatttgagttatgggaaacaaagtaattgaaagatgctttgatggatttaaaaaggtcaaatatccttgatgacactagacattcaacactgtgacagccaacttcatttttataacaaaatatttcagtttttcatttcctggttcacagatgctctctttatcctcattataccttcataaggtatagttgttgtgttacgacattcgttctggcctccatagcttactggctccctaccccttcccactaccttcaaaaaaaagtagccatgaaattaagagaaaatatccagcttaaagggcaaggatttatagtagcgcaaaaagagtgggaaatgaattatttcagaccaaaagcaattatattttgaaggcagaagcagacatcttctggcacgactgtcaagatgttacaaaaagattaaaggaggtttttttgtcatttaaaatctgtttctagttctcaaaaaaaaaaaaaggtctgctgttcagtttgtgatttttaataagatttctcaatagactcactgctttagaaaaaaaaaagtgtaagggaaaaaagaagcaaaaactcgaaggccatgtagcaaatatagccatgactttgatatagtatcgttcattttcaccattctggtggatttagacaagatttttgtaggaggttataccctatacaataacctgtcaacaaaatatactttttgcagagatttttcaggatttaggcttctattggggttaaagtagaaataccagattaattcctttgaaaactctgagaacttttgctcaaggaggtaaaagatggtatttttcactgttaacagtgtgcaaagctctccttaagctccaaatgtctagatactatttcatccccattctttgggggtattggttcccacaattcttcattatgtattgctcatcaagcacctgcttaagagacacagagggtatcttgaagaactgagtttatt

SEQ ID NO: 36087 - DNA, 717 bp, Bovine  19866880780130
acagtcagaagacagtattggttataatatgttgtggtaatacagattagcccagctagcaggtcttttcattgtttctttctttctgtttcattgatctttgaaatgaaaaataactttttatggagagccctaagagtaagtcaatataatatatttttgttttttgccttttttgttgtggtggttgttgagtttcttgtttaaatatttatttacttatttggctgcaccgggtcttaattgcagcatgtgggatctagttccccaaccagggatcaaacctggctcccctgcactgggagcctgcagtcttctgcagtcttagccactggaccaccagggaagtcctgtcttgcctttttactttctttcattttattttccttgtagttaatacgagttaagtaggatttaatagttttaagtcttaacttcacaaaaaaatctttttcagctacaactggatgcatttgaagcagagaaacaggctttgttgaatgaacatggtgcggctcaggaacaactaaataatctaagagattcatatgccaaattattgggtcatcagaatctaaagcagaaaatcaagcatgttgtgaaattgaaagatgaaaatagcaatctcaaatcggtttgtaaagtcacgtttacttttgttgatactggggtgggtggtttttatttgatcagggtaatactgacttcataaaatga

SEQ ID NO: 36088 - DNA, 1165 bp, Bovine  19866880815395
caccacattaacttaattcgcacaggctttgctgaaaccttgggaagtcatcttattggggaaaagctaaaattataggtggtgtatttcctctacaatgaacttgagttattaaaggcactaattttatcagccacctattgttagccaaattgtgaaatccattatattttccccacataaaattttcaagcaattcaaccaaatgaatttatttcaattcactgcatttattatctatttttactgttgctgaggcattatgggcaatgtagagatgaataagatatgccctcccctcttctctttttctcatctaaaaggagttttagtctaaaagaaggacttttgatagggatacaaaacaccttcattggaagtcacactatgaaaaggaccaatatctgagaaattatgggatggttttttctagaacaaagctttggtttcaggcaccaacatattctcttctccaagcctaaggctcaatgaaggatgtaaaaactggaaaaaagaaatatgggccaaagttggctataaaatgcaaaacagaggcaagccctccaagtgtgcctaagggagactcatacaaagcttttgacaggttttgaagaaagaggaagattttgattggggagttattaaaggaaagggtattttaagtaacagttcagcatgagcaaatccataaatatggggaaagaacaaaactcaattaaatgaagaagaaggaagcatctttgactccagaagtttaagattagctggcaaggtacctctgggtggtatcacaaggagattagacatgacagagagccaggcagtaagcatattcatttttctttttctttttttgtctgactagcatttgtttaccttcgtctgataacagtgttttgtatgcctaggactaccattacttgtctatatttgtttaacattatgttttgttttattcttcaagttctattgagatataattgacatacagtgctgtataagtttaaagtactgtatgtatgacctacatacatcatgaagtgattaccacaagtaactcaatgaacatccatcatctcaaatagatataaaagaaaaaaaaatatgtttttccttgtgatgagaactcttagaatttactctcttaaccttcctatacaaccta

SEQ ID NO: 36089 - DNA, 2061 bp, Bovine  19866880827616
catgcatgatttgctggtcgatgttggcactagaaatatacgtttaaggaggcatttgggtcagtcaaggaagatataatgaactgaaacagactaagttgaaaccatcatgcttctacattatcaaagatgaataggcctgagtctcctgaatttcagtgacctctgtcctttcacctcaccatggcctctaccatcatttggaggagcccatccagtgaagcaaactctttccactgacgctgagcttgtcactttctcctacattttagagtgacagagggaatgttattttactttctgggggaaaaaaaaaaaaaaggctttgaagctggaggaaaaaaagggacagacaaaaatacagattttaaagcaagaagatatccctacattttgaaaatctgcaagcttcaaaacgtagcccacaaatgcactcagtgttgttctctatcttacctccacaatgtgagacatacactttctaaaaggattttagtcgccaagtgttttcccctagctctcccaagtttgaatgatcaattcacatgataggtctaaaatcaagtttggaaacagatttattgctatggagatacggctctatgcataaaatatcagcctttttggccaaatggcaactctctttgtttgcacactcttgcaattacttccaggtcattaggcccatcttgagtagatgttttactgtcatgaataaaagtgcatacagacattcagtgatttcatgataatagtcataaaagagcaggggaagcaataccaacaaggaagaattacaggccctgaacttgagctcaattttataagaaaaaagtattaagaagaaaatcggcactatcataaattatcaatagatttgttctacccaaaagatatactgaggacctacagttagccggatgccattctaggtgctaaaagacggaaaaaacagacactgtgccagaatgtattagcagtaagtatagcgaagaaaataaaactagatgatataatagaaaatgaccagggaccgaaaaatataagttgtccttgaagcatcacacaaacttagatccaaatgacaaaaagtcatttgaaaatcaggtaaaagctgggatagctggtacaaagcctatgagacaggaataaactttgcatgttttaggaacaataacaacaacaacaaaaaaaagtgagtctggctagagaatattgacctagaggaaaggactggagaaatagactagatcatgtaaagcctggttgttgagctgctcaatcatgtccaactctcttgtgatgccatggactatagaccaccaggttcttttgtccatgggattttccaggcaagaatactggagtgggttgtcatttccttctccaggggatcttcctgattcagggatcaaacccatgcctcctgcattgaaagtcagttctttaagtgagacactgagaaaaccccgtaaggcctgataagcatatataattggcccaaatatttactgaaaacctagtatgcactaggcactattctaaactccagagttatatgaacaaaagggcaaattcctgaccttggggagctcactttctatttattagagatagcaaacaaattttttaaaatataatgctacagagaactataaaatgggctaaggaaattaactggtatgtgtttaatagagacatgctgtattatacagagtattacagtaaatgaaggatgatgacaaatcctttgccagtccttatgttgagatgtcgagtctgattctcttatccttgaacctgggctagccctgatgactttcttcaataataggatccagtgaaagttattttctgagacttcctgtgcagctaaaacataataatccttgctgctactaccaggtctcttagaaccctttcttggagctctgagagcatcacgctgtagaagtcacatgtagacaccctggttaagataggcagcatcttaactgctacccaatgatcccaacttcctaacattcatatccttgtgtactcccctcccttgagtatgtg

SEQ ID NO: 36090 - DNA, 2093 bp, Bovine  19866880838363
caagtaaaggactaaggtgaaagcatgctaaccatattccaggaacatgaaggaagtgctcctgtggctggagcggagtaagtaaagaacagaggggtaggagatgcactcagagaggaagcaggacagcagatcacaaaggcgatttcaaggactggcacttgctgggagtgcaccttagggtttcgaacagtgacccaaactttgagtagaatattgtcataaaattctgtcttagttcaactccctacccttttaaattctacacccaaatggtgagcagcacaagcttacaacagacacccttcacagcatcaagcgcccatcatcaaccagtcattttctaacttaccctgaggaatggctcacggaccctgtagtcggcatgtggcctgtgcctttatttcctcccctccttctttttggtcaggccatatttgcaattcagcacccggcgctttcattttcagagtgtttacattaacttgaagctgttaacctagttgtggtgcagaatgtttcagacagtgccagaggctataaataaataaccgttatttcaggtctgcctggcaaacaagcgcccggattctgttgaggccccagagaccatgactgctgcagctctaaatacctcaaacagggctaaaagcaggtattctcaaggaatactaagcagatgcactctaggtgacacagttatgtcttcccatcgacatacatctccggatcaccatggagaccaataaatagacctctctgtcatacccatttggaataaactacagctaacctgagcccaattattacatattaccaaccagatttcttatctcacttcaaactttagtaactgacgaatgaccaaaaccaagtcttccaagaattttaatatatgttgtgatctagagcagatccgcagtttttcaattagcaagagctatttttataacatctcattaatgaccaacatataactatatatacgcacttagaccaaataagtcatctctctatgccttggtttctgtcattgttaaatggaaattaaagtacctatatcacagtgaatgtggacttaaatgagataatacatgaaacctgtttagaaaagtatccgacctgcacttaacagtcaataaatatcagttcatcattatgtaaaaatactactgattattctctccacgtaatagttatacttcaagccagtttttctaagaaaaactctaatgaccatgttacaaagaatttggtagcacttatagatgaattaaaattcatttttcattagagaattgcatatacttaaaccataggatgtagtgggaaaggaatatgtggtcattatagatttggggaacagtacatttatccccattgactttttcatttatatcttgagcaaataccatgaaaattgttcagaattaggacacgttgtaccagcaagaatctcacttaccaaagaatgcaataaaaattgtgtcagtgtattttaagagaaagatgcaggaaatatgactttggaactctttagcaacaaaactcggggaaggcaatggcaccccactccagtactcttgcctggaaaatcgcatggacagaggagcctggtaggcggcagtccatggggtcgtgaagagtcggacacaactgagcgacttcactttcacttttcactttcatgctttggagaaggaaatggcaacccactccagtgttcttgcctggagaatcccagggacgggggagccttggtgggctgccatctatggggtcgacagagtcggacacgactgaagagacttaggagccgcagcaacaaaactgataccaaaaaaaaaaaaaagtcctgattcatttttcattaagcagaaaattcaactaatcagaattcctctttctttggcaatctagctggttaagattttgtactgatatcattttgttgaagtacctcaggatgcaaactggtagtcaactgcttggtctacatacgtttttattttatgtgactcaatcttttgacaaaatatcacaatgtttagactaaggaccttgggaaatgactaagggcggttagttttctc

SEQ ID NO: 36091 - DNA, 1509 bp, Bovine  19866880893833
tgaagtagacttccgggttcataaacacctgggttgatctgcttttgtgaatatgaatatatttgttttgaaagaaaacagtaattatattcccatcaaagttaacattaattaatgtcaagtcattggaaagacagctacattgaactgacaaaaattctttgaggctggaattgttttctgcagtcttgaagaagccttacatctaatgcttggcttctaactctactgatacatcagtgcagcttttaaacaaaattattttaaataaaatgttatgtctcattgttatcttttcccaataaaatctcagaatcacataagtattctagattttagctacttttttgataattcatacaatgtacagtctgggctttaatgagtgcttaaaacactctgaatgtgaatttattttctcatatttcatgcgtcagcttttcttatttcttaatcagattcatttgtcttctggaccaggtacagcttctgttgtcttagaggtaaacccaaagttgtgttaagaaaatactgtcattattaaacctacataagcagaagatagaaagccctcaccatagaataatatctacctactgtaaatgattgactgctatgagcctagtgctgtagtaagtgcttcacatactttatatcatgaaggttttataacagccctttggtataagaactattataccatttcaccaatgggataaacaagtaaattaggtaactcacctatattaataaccaaatgatatgtcctactcggtgtgactgagaatcaaccaatattgatcatctctgatggccattctagttatgaaatctgatcactgattttctgagggaaaaaaaatctgaggattaagaaaatcctcatctctcattctagaggagccacaaaccagaggtgctctgactcaagtggtgaccttgtattgaactagatatgacatctaggaagttgagaaggaatgccatccactcctgctagtactcccagaattagacctttagtttttggctctgtgggaaaggatgaccaactatccaggtgtacccaggaccatcctggtgctagcccctgaaagtcctgcatctgggaaaccctacctatagatgtgttccctctccattctctaccaaatctccgtgatgctagctgcctctctacatctctaaatcctcactttttgaagaaacattaagactttactgtggcaagacttgactacattaagactatgccagatacaaaggatatcaaggcaaaacttccaaatctctaaacaggtaccacctggctgctgtattatctttcatactgatagccatcctttcaaatactaactgggactaagacctaccatctaccattatactctataaatagcatgtccagcctgcccggctcttcttcctctacctagttactctagcagctatcttgtgtccaccctgctgttcccatatggtctggtctatccacccagtgtgctatgt

SEQ ID NO: 36092 - DNA, 969 bp, Bovine  19866880927139
agtaagagctgaaaaataaggggtagggagtggaggcagatcacagtagagcctggcaccgaacaagtgttcaaaatgtggctattattgatatatgccatccctgtgttgttgatacaagttgggattacatagttttctttaacactttcaacaagtcccctttcccaaaaaaaggcttgcggaacagattatggtcccatcacttccccccagtgccatcaatggagtatttgggttctcattgaccctgggctttcagtaagtgacaattgcttttcctctttccaaggtcctgttcatcctaatgaagatgcatcgttggcacttgcctcccgcatggctgggaaagagcagtgcaaccaaaaggccccatccagatggaggagctcagtagaacatctgccttgcatgtctgtcacctccctacctcctgctgctgtgttagctgccagccattatagcagctcctgagtcaagggccctcctcttgtagtgctttcttggagctttgacagattatctgcactgtcattcccaacagcattgtgccatctttcttaaaactgcaggaagatcctgatggaaatctcagtcctttaaaaaaaaaaaaaaaccctccaaaatagattccattaaactatagttatgcctgcaaattttatatcaactggcattaggcagttagttcactgtatcaactacatggatggcctatagcgtccatgtgacactgaagaaacgagagagctgtggaaaatgcattcaccccctccatgtcctctaccaccaatctaagtccaaaccagcctcatctcctgcccagattattacagtagctgcctaattgatctggtccaaccatcttagttagtccaaatcatcacttgcctgagcattactaagtagcctcctaactagcatgtttccactctagctctccttaacccagttgattttccacatttg

SEQ ID NO: 36093 - DNA, 1455 bp, Bovine  19866880935579
tgaaattttccaggcaggaatactagagtgagtttccattcttttctctaggggatctttccaacccagggattgaactcaggtctcctacattgcaggcagatgattctttactgtttgaaccaccagggaagcaaaaagcccaagaataaggataaaggttcttgcttcatcctcacattaggggggcaggaagttattgaaagacaggattaatgaaaaagtagatttaattagggacactgggattggataaacaaaatatgagtctggccagtaactcccatgccaggtattctttgctgctgctgctgctgctaagtcgcttcagtcgtgtccaactccgtgcgaccccataaacagcagcccaccaggctcccccgtccctgggattctccaggcaagaacactggaatgggttgccatttccttctccaatgcatgaaagtgaaaagcgaagtgaagtcgctcagtcgagtccaactcttcgcaaccccatggactgcagcccaccaggcccctccatccatgggattttccaggcaagagtactggagtgggttgccattgccttctccaggtaccctctagtgactcctaatgtcacataaaataaaacccactctgttagaatgaagatttttatgctttcattttaccctgttcgctctttgcaacctccaaccacttgctcttctgtatgctctttgaagaactcacacctttttcctgcctttgggcctagaatatcctttacctgattttttgtacagcatcttccttatcattcaggttttaactcacatgttacctcctctgaaaaagacttgacagccatatctaaatagcttattcctactttctaccacttactgtttcatcccattgcttggcaccatcaccccttttcacagcattaacactattttaaattatgctgtttgattattttttcctatctttcccctccccacccatctatgcttgtcttgaatagaagctatatgagaacaagagtcttgtctgtcttgctcacagtatccccccccaagacccagaaagtacctgacacagaatggacacttcatgcacattcactgaataaagacaattttagaattgcttttaaggtctattactactgaataaaatatatattcagatatatttttggatgtctccctcctctttgaatgtgaccccaggcctccttgggacaatgagggtagaggaccccctgaaaaataaagtgttggaaatatatttgtattcctttatctcaaaccgcttattgaaacccaggagagaagcttaaaacacaaatcctattctttttcaaagaaacacagtctctaatacctttgtgaatgtgtcatctgagattccagacttaaatgaataatttttagctgtttcctattctattttccagatagaaaaattttaagagagaaa

SEQ ID NO: 36094 - DNA, 1049 bp, Bovine  19866880999580
cttgcattggcaggcagattctttaccactgtgctacttggcaagccatttctaattctaattcatttcctggaaaataattagcatttagtaaattcatattttaatgtgcgtcttcctactatgggtaaaagctcatggatatagtttaaagactaccttatactgaattcctctggagataggggaaaatgttgttgttcctgagttgctaagtcatgtctgactctttacaacctcatggactacagcatgccagttcataactgttttctattttaaagatctccttcaaggaagcctgttgaagagcggctcacggttggaggaggaggtgacagttctcaagaagtgtatttttggtttggtagagaattattgtcttgtacaggacttaaatctcaagtctgtagtaggtggtatgtgacttaagagccttaagggaggtgatttgtcactaaatgtcaagtgtaactctttcaaagggactaacaagtgaagtggaaatatcatattatgtgccatcttttttcagaaggattctaaatgagcagttattctgaagtggagttgtaggtttaagactggttttaccacttatctggaatcttgaaacatgccacagtgttcatggtttcattccttggcaagagaataatgaggaagctttgagtttttacctcttttgcagagacgattttccaggaaacttgattttgccagtcctgttatttttgcgtctgtctttatagaagttaccatggtggcagatgtctggagaaagtccagtaatttgacttttattacacattatatttatctctaaggtagtttatcacttttttatatcttacgggaaatttgagattaaagaagcaatggattccgttttcttttattagttcacattagtagttgcacacgtatgctgatgttatcaatgatcatgtaactaaattattttactggtctcattaatggtgtacaagagcctgtaattgtatagagtgcataaaatgtattggtacattttgatcattttattcagc

SEQ ID NO: 36095 - DNA, 1725 bp, Bovine  19866881048802
tttcttcatctatgaaatgaggttgattatgatttctcacatacataaaagtgttaccaaagaatctagtataaaggggctagtcaagaccttttcggttataaatagcagaaatacaattcaaacttattaagcaaaaggaatatgttttacataactaaaaatcaaggccagacctggattttggtattgcttgattctgcaattcaaagaatgtgattacaaagagggacccatttgtgaggtagattctttccttgcagagggcaacgattgcttagcaacccccaggaaggaaagaaacatctttctctaagagcactggctgaatggtcctagggagctcctgccttggcttctctgtgtgcacttgaaccctgatatctgtaaactgagggatggatgtgctctgattggccaggtatgggtctcatgatctttcaaatgttttttgtttgcaggagacagaaaattcaatttaaactacctcaaacaataaaagggaatcaaatggctcacacagatttgatttcaggtgggattcagcctacaaacagagtcatcagggtgatccctgatttctccccagctctccatgctgtgtcccatattgttaatttcattctcaggctccgtacatgaccctggcaactagagtttctctctttgccgaatcaaaatgattttatttctcacactgcttcaggctgagagcactctttcagtgctcccacacaatttctaacttttgtccatcctattaatggctggcattgggtcacatgcctcctcctgtggtctgaaggatggaatatatcaattgcattaagcaagcatagcttgcttattcagctaggatacgactaagaatgggaagatgcgtgttccataaagaatttcagggaatatttggtgaaggaagggagttaaatgatggatagaagtgtattatggtgacacaaactcagtgcaggctactaggaatgcctttctcactcataagccagatctcagtactagacagaagggtgaagggatgtatataaggtagacaaagcaacaggtatccgtgacaggtatcctaatatatgttagtttgttaggatattctcatcccattcatgttgtataaacgggggtcctaaaagatgaagtgatgcctttaaggaagcagagataataaatggctgagctgataccaatatattcatatatatatattccttatgaaaaccagttatgggaagtagctataagggccaactgttcagttcaagaagttgaggggaaaaaatgaacatagaactaaggaggcagagaaatgaaagtactgaggatgagaaaacagtatttccagatttcccaattatatttgaaaatggaaatcctctgataaccttttttctggtgttttgcttgaggatctatggtccggaacttgaaaaagcacttacgtcattgactcaacagctctcctgcggcatgaggtttttagccacttctagctgccctcttagctaggtaggccagttagacaagtggcttctttttagaatctaattctctttgttttctcttttcaatcattcctactttctttcataagaagtgtctatatcaatgtgtgggaaaccacttaacaattcaattcttctcagaataattgagggtcaaggattatcaacactaaagaaaatgattgcatttcctagatcatacaaaaca

SEQ ID NO: 36096 - DNA, 924 bp, Bovine  19866881223111
ctgaagcatcttaaagcacagttttgattcttttaaaaccagggaaatattcctctgaaaataatttcggctcattactctataaattactttacttctgccaaacacaggaatgtccaacacctcgaggaactctaaatgaggaacaaaaagctgcgtagttaacaagcataattaagacctgaatatattctgtcttcctgaaaagtctatttttcagtttttattcttattagtcaagtatattaaacatgactttaatttgcatctgcctcttctcccaccaactcacagatttacagaattcagtaacaccaggtgaccagatttatacatacacacacacacaaaacaaaatgtttgaaaaagtaagtacatataaataaatgaagagtcatagctcttattatgccatcaaatcaaataatagcaaattctaaggtacaggacaataaaaggctcttccaaaatgatccaaaacagtactctgggacagtggtttctactttagcacacttggattaacttctactaaaaatgtcctagagaaagtcaagagtgaaatatcacaaatatctaaagtaggatcttcttaagttttagtgataattatactttgctattttcagaacctcttcaatttggcaaagtttcacattgatttatttgattctcacaacattcccctagagatagatctttgagtagacactcctggactttgagaagctttttaaaatacctaggtgacactggtctaaactcccactgtcactctattgtaccccacagccagtaatatgaacaggaaccaccacagtttattcctgtgacataaactatagaacagtcccactactacaggttctgagagaagcaaatacgtgtcaagcctttggttgtgtaattgaatgaaggaaaacg

SEQ ID NO: 36097 - DNA, 869 bp, Bovine  19866881260507
attgatggatagaagtttataataactgcattcatacctcttacatcatgaaccccaaatgtaatatacagcccgatgcatttgtatttggattctaacttagaaagtaaaccttagataaggcacaaaagacacacatgctgaactgtgacatggaaaacttcatggtgggtttacaaaattaccaggacacctaaagatgactgcggctaaaacagacacaactgaaagaccatagttaagcccattttgttccaacttcacacacagtacgagtcagtcagtccctccaattcccaaactactgatggaatgtagaatattacactgtgaataaaagcctcatttgatcactaacttgaacttggaaagagcaatcagacgctttcaaccagtatcaaagccacagtagcatcaaaacttgctttctacaggaaagatatgaaacatagtcccaagggtttaggaaacagaataaaaaaacagtgaaggtatattcttaagcagatatattgaagttcacttcagcaaaaggagtgacaagaccggtagtgatgtcatttccactgggtgtacctttcgcagtgttcggtacctgaggttcttaacctttgcccccaccccactctccatcacacactgccaaaggcagactactctcaggcacgttttatatcataacacaaaggccaaggaaaagcttcagtgttaagaagcctaggttcaaatattggctacttatattctgagtgaccatggggaaaccattaaaacttaattaggttcatttgtcactgggatttttttttaaagacctaatcttttttttcaattaattactatggagtacagtgctttctaatgttatt

SEQ ID NO: 36098 - DNA, 1628 bp, Bovine  19866881263880
tctccttatctccagatttacccctcaaatgcttccctatgtatagccagagtgatttttctaaggtacacatgtatttgctattttaaaaaatatataaattttatttattttaaactttattgatgtatagttgacttgtaatgttgatgtcatgttgtatgttgtatgtaatgttgatgtatgttgtgttgaggtatagttgatgtcatgtttcaggtgtaagcaaagtgtatcagttatacacaaacatatatccattcttattttaggttattttcctatataattacagagtactgaggagagttccttgtgctacacagtgggctcttatatacagaccactgtgtataaaatagacagctaatgatttgtcatttttaggcacagaccttttgaagacacctgttgccctcagaataatgtcaaaactgtctaccacggcttagagagctctttcaagaatgactccatctctttttgcagcgcagtttcttcccatctccaaccttccagtgtaagccctgctcagaaggaattactcctggtttcctgagttccacatctctctcttccttggcacagtagatttgtgtgtgcaacttcctcgttctcccacctcctctgtgttaaccttctactctgctaatcttcgaaggcttagtgtagagaaggcttctcctggaactctttccttgaccttgccaacacttggtcaggtgcctttttactgttctcacaaaatgccttctttctttttctttttaattggagtatagttcctttacaatgttgttttagttcctgctgtacggcaaagtgaatcagctgtatgtatgcacatatctcctctttttttgaatttccttcccatttagggcacgacagagcattgagtcgagttccctgtgctctacaacagtagattcccattagttatctattttatatgtagtatcagtagtgtatataagtcaatctcaatctctcaattcatcccccactcctttccccacttggtgtccgtacatttgttctgtatgtctgtgtctacttctgctttgccaataagttaatctataccattttcctagattccacatgtatgtcttaatatatgatattttttttctctaagttacttctcactgtatgacaatctctaagtccatccacatctcttcaaatggcaaagtttcatttctttttatggctgagtaacattccattgtatatatgtaccacaccttctgtgtccatccctctgctgatgggtgtttaggttgcttccatgtcctggctattgtgaacagtgctgcagtgaccattgtgtgtgtgttttaagtcactttatttgtggctgactctttgcaaccctatagactgtagcccaccaggctcctctgatcgtgggaatctccaggcaagaattctggagtggattgtcaagccctcctccaggagatcttcccaactcagggatagaacccgtatctcttatgtcttcagcattggcacatgggttctttacaactagtgccacctgggaaacccacagtgaacactgggatgcaggtatctttttgaattatgattttctctgggtatatgccagagtgatattg

SEQ ID NO: 36099 - DNA, 1345 bp, Bovine  19866881287295
tctaacctgtgcgtggttctggaattctatttgttttgttttggttttttttggacttcctccattaattatgacactgaaagttctttgttctcagagaagcaaagaatcaaagttttaattaaacccatgggggcgctgctttagtaactaccatgtaccacacacttaacatgagttatttgatttacttctgattatatccccatgaattaagttttattacctctcatcttacattggagaaaactcagggtcatgaagtttagtgatgagcccaagactatgcagccaaaaggtagaactgagtttggaacccaggttagtttaacttgccagtaaaacactcccgcttaattcttgagaaaaagttgactgcagttaatacgtttttaaaacctcagtaaattaaagcattccctgatagctcagttggtgaagaagctgcctgcaatgcagaagaccctggttcaactcctgggtcgggaagatcctctggagaagggataggctacccactgcagtattcatgggcttcccttgtggctcagctggttaagaatctgcctgcaatgcgggagtcctgggtttgatccctgggttgggaagatcacctggagaatggaaaggctacccactccagtattctggcctggagaattaacatagactgtatagtccatggggtcacaaagagttggacatgactgaacgactttcactttcacttcaaattacagctagactcaaccccaagttttctaagatgggaatcatacataaggctttaaatgaaccttttgggatggcatttagccttttctagatattatagaaaagaataaggtttaattggaatttaggtataaaacatctccaattccagctggacattagaactaactcttttgcttcaaaacaaatggaaatataggcatgattttcttaggatatgtaataataattttctactttgtaatataaagtagtacacagataaaattatctatttccctgtgagtccaggaagataggatccatacctgagtcatttcattatattctggccttatattgacttattgagttgggtatagtcagaatgtatgtaatcagataagaaacaaaataaatgcaaaataatccttataaagaaaatatcaaactttatgtctagataggaccagcatcagtgcatgctgtcctatcttggagcctgaggcaaaaggctccaaaaggttttttcatgcccccttaaatattgtactcacatgggtgcctcgcttgctttaccctagtcccagccctggaaatactcctaagtgcttattcagatgggttttct

SEQ ID NO: 36100 - DNA, 1137 bp, Bovine  19866881311701
caagtccatgaggctgtgaaagttttcaccctatcctttttgtctggtgttataagaatatctctatctatgaatttgcatgatatctatttatccatctgtctatcatttatctattggaaggattccctatgtgtgctgcctaaaaatttgctttttattatttaaataaaaggtatagaaagggtaaggggtggaggaaagcatttgactactaaaatgaggttggtgtcagaatagatttatcgatctattttatccttgtgagatgagtgattttttgtagagtcagagcatttttgcaatagaagtctgaagaccatctcgtccaactccttgttttacacatgatggaaattttgaggtccagagataagtgacttgcctaaggccacacaaataaattgctctgttactttacttttttgaaaagtacttttcattgaaaaataaaaaatttcccaaagcggctagatttgtgtaaccagcttatagactgaacatgaacatcaccaagcacttcaaaattctcctttgtatcccctccccagtaactatcctttctcccattcccaaaggggactgctattctatttaaaacatagcttaattttgcctgcttttgaactttatgtaaattcagtcacacagaatctgttcttttttggtctggctttttcacccaacgtgatgtttatgaaattaatccatttttcatcttgcagtagtctgtccatttgcattgcaatgttttattccagtgtgtgaagagaatgcaatttatttgttttcctattgctttgtttttaatgactagagattcctaatgttgattttcaggtccatcttaattgttttgcttctggacaggggtattttctcaaaaccaacctacaaggcagttgtctgaagtcatatctttaaatacagcaaccaggaagcaaatatatatactaccactgattatttgctgtagtaatttccatttttctttcgcctgactttctgtgactattgagacactagttgagcaagagtcagatgatattccctctcttcttttatattctgcattatggccttttgctattaagaactgacttacaatttgggttttgaacaattcatgttaaaata

SEQ ID NO: 36101 - DNA, 1258 bp, Bovine  19866881331089
cacagcaggttttatttccaacatctcttccttctcaaaactgcagtgcagattttgcaaacatgatgggttacataaataggattatgtactcttcatgcaaactctgaagccagctgtccatccggttctatttcccagataggaaaaaggattactacacagctccaacacagtactgaatagatatcgataaattctgattctctcatttcaacttaagagggaatgcgtgtatttgaaaagtttattcaaccagactcttaatgaaggcaatggcatgttgattatataattatagttttacaattatatattcagtgtgtatatcagggatccacacaatatatccaagtattatgggtttaattgtgttctccaaaaattcatatgttgatgtcatagtacaccccatacttcagaatgtggccatatttggaaatagagtctttatgaaaatatcaatttaaaatgaggtcattagcatatgactgctatctttataaaaaggggaaatttgaagactgtcatagggagaatgctatatgaggataaaggcagcaagcaaggtaatgcttctacaaggcaaggaacaccaaaaattgctggaaaaccaacagacgcagggcaagactcatggaacagattctcccttttagcttcagaagcaactaacccttgttgactcagaactatgaaacaatatattcctattgttgaagccacagtttggggtactttgttacagcagctataggaaactaatacataaagcaagaaatgtcgcatcacaagagtggaaatgaaagggggattatatgacctctgagaattttaaattttcattttttgcatacactctaataaagaaagggtttagtctattctcagaccaaatgaaagtcagaaattgagataaataccttgataacccaggccaaaacttctactattctttattcagtaaaatcagattaattgaagcaaaattaggttccttcctactgactaaataatccagataatggtctcagtcctcaactttggttgatcactatgtagtaaacttgatttcaggtaaaggagtttagattatctttaaccaaaaagacttaacaccttcatccctctctattcactgatacagggaagagaccactgaaaggcagggttttccctttctaacctgctaagcaatttagtcctagtttcagtgtctaatctactccccctttcagttccatgtgggttcatgtac

SEQ ID NO: 36102 - DNA, 1265 bp, Bovine  19866881408320
aacaaggtaaacagaattacccagggcccagtgctaaaaacttgagaagtcaattatcaagctatctagtaaaagcctcccaaaaatccaataatcctccagtcttacttttacgatgacattagaaataacatttaatttttatatatataacgaatgaactcaaggaaaagcaaccagtctatgctaatcttttaaacctattaccaacattttatgcatcataatcctagctaagccagagtatatatatatctatttaggttcttccaaaacaacagcactttctaaaagggtccctgccaggcagtaatactattcatttactaaatattgcttggggactcagccatgcatgactcacattagtgcagatgggagtttcacagtcatatccaaggtctgtggaacaaatggagtaacccattattggttcttcttctctcatatatatttaacatggatcataaaaagaatttggtctgctatgccttacacaattgccaaatatcattaggttcacatttttagactttgttttccctttgaacccaggtatcatttatcctcatgagttcacaggtaggatgaaacctatactttaagccattatcttaagactatttcttgatcagcctcctgtcatatcatgattttattggtataattacaagtaaaggaaatttgatatgtaaaagttgctacataggatataaatctgtattttcctaacaccgaatactgctaatattcacatcacaggtaactgtcctacaacagagtagtctgtcaatttgacttcctaatattaatattatccaaataatgatgctcaattaaagctatgcaaacaggtaagaggcaagaggcacttgtttctaagccttcagcaatatgatgaaataaattacagcctatctgtccaagaaagtgtgctcaagcaattgaatatgatacataggtctctacttattgtccaggacataccaccaattaaaatttaacaaacaataggtcaatatggtagttgatccaattttgagcctatagatgtgtgttaaaatggagcatggaagagtatacaccaaaatcttattaacagttatctctgggtgacaagattatagataaggtgcttgcttcttcttacctatcaatatcccatataatgataaatttaaatctaggcttcctgggggctcaaaggtaaagaatccacctgccaatgcaggagatagggttcaatctcgggtcaggaagatccc

SEQ ID NO: 36103 - DNA, 2959 bp, Bovine  19866881429844
aaactgcaaggtcccttaagacgtaggcttggaagtcccagaatactgtcttttcgccactctatacactaacactatttataggcacagccaagatgcaaagggtgggaaagtagatgcttttttctctctctctttttgatagtatcaatggcatgctggtagaggagcaggagaaattcttggcaacttttctataaaggaacagatagtaaatattttaggcttttgtagccctgtacagcctatttttgttgcatatgctctcctcttctgacaacaagcttttaaaaatgtggaaaccaattttgatctgtgatatgtagtttgtgaatccatgcttagacaggtgatatacccacttcatcattcattcttagtatacttttgtattacaagttcctatattactttgaaattattttaaattgttttcttaaaattacagttgatacttgaataacaggtttgaactcggcatgtgcactcatgtgcacctatgtgtgaagtttttactctaaatacttatgtactgtagtactacatgattcaagttggttgaatccctgaaagtggtactgtgggatcagttcagttcagttactgagtcatatccaactctctgtgacccatggactgcagcacaccaggcttccctgtccatcaccaactcttagaatttgctcaaactcatgtccattaagttgatgattccatccaaccatctcatcctctgtcgtccccttcttctcctgccttcgatccctcccagcatcagggtccttttcagtgagtcaattctttgtatcaggtggccaaaatattggagcttcagctttagcattagtcctaacaatggatattgaggactgatttcctttaagattgactggttggatctccttgcagtgcaagggactctcaagagtcttctccaacaccacacttcaaaagcatgtggatagggaagctcaaatgtaaaattctgtgcaaattttcaactgtgtggagggtgagcactcctatcccctgtgttgttcaagggtcaactgtgattttatcctgactacaaagtaagcatcatgagagaaagagcatttgttattttatttgttaccttctctataactgtcttggtccctagtaattgttcaataaatatttgttgaataagtaattattaaataaattaatgtcccagaatttatttttactttatcttgtggagctatattctgtattgatggagtcattctcaggctctgtttaatgttgaggatggctgcaaatagctccaggccaaatactttcaggttaaaatttagtgactctttgagtagctgcagaaaaatttctgggtaagatcttggatggatcttagctgtgtcagatattctgttttgaagcagctactgtcacccagaaaaataaggtctggccaaccagacctaagtgccttgtctcagtgaagtcatgaatgtccccaaatgtgtgaactgaaaggtaggtatatggctctcacaggaaaatcgccttactaggtgaatgagaaatggattcctctgttaaaatacgttcaaattatggactttttgatccagcattcttcaactttagtgggataaaatgttgaaataggccaaatgaaaagttgttacatgactgaacttctgtctcttgttgtttattccctgactcatgtccgactctgtgaccctgtgggctgtagcccaccagggctcctctgtccatgggatttctcaggcaagaatactggaatgagttgctgtttccttctctaggggattttcccaagccagttttcaaactcgagtctcctgcattggcaggcagattctttaccactgagccaccagggaagcatccctactttctaattatttatatcatgaaagtagttttatttttctaactcattaactttagtgatttatacttaaaaaatatatatatactataaaatagtaccattatctgtcttattactatgagttctctctttggtttaatttagggggaaagtgatggcagtgctattaaaataaaatggaaagacagtgatttaaaattaatcaatgaatcatatatactatatttatttagattgcctgcatcttattagttactctaagttagtaagggatgctgccttagtggaaaagaattgtcttttctgcagtaagagtttttggtcacaaatctctgagaaaatctgctctgttacatactgtttaaaatctatgtattttatctgactggtgtcttgaaaagaacttatgaatacttgtttttaaaatttggcctactgaaaatcagtttttttaaaaaaaagtgctacatgattgagcatgcattttctgctctttccctaatatttgatgcaaaatatggcatggaaagtatcagcatcttgtcccttcctatactgtcaatagctatctctattcctattggttccattgtgagccattttcagcctaaaattttcaggccaaatatgtatggaacagattcctgtattccagtgtttaatctcggcaaacatggaatacatgcaaaaacttggcagcatttgcctgtgttccttgctagattgtcacttggtctgttttgagttaggagctttctcactcattgttaaatattagttatgcactttcttgaagatagcatagctaatgatagaagaacaaagatgtagttctcaggatcatttgttttcaggttttcaccaacgcttttgtaggtttttgtaacagtcactttggaaatataggtgagattgactagatgatattattagcaaacaaccaaggctgatgaaatgaccatttcatgatgcctctttcaaccagtttagaatcaaaactgtatttctgagaaattgcataagtgccagttattccagttgttttcaagtcagtcagcaatatcgtta

SEQ ID NO: 36104 - DNA, 1120 bp, Bovine  19866881440381
aatactttagtatttgctagctatatttagttatctttgcacattcctcttcttttactttctttattcttccctttttaaaaaccaacccttgaaaagtgtaaagaccattccatagcaggcccttagctggatttgatctgggactatagtttgctatagtttctctactccaaaatcttggaattactgctgccttaaaacaaaacttgtgctgaaatttctgacagatcataggagaatcaaactctctatttcctgacttcttgaactatttctgcaattatcaaaccaagatttttctctggcatcattgagctgagacagtctattttgattctgagtctttgaaactgtatttactataaatgaatacatatgtcactatggagaaaagatttaatttctagaattttcctttaaagatatctttgagatttttttttctttcattttaacacgttttgaaggcttcacaataaagcaaaacattagtgtttgtggattattttgtccttatccaaatgcttgaggctattaatttttctttgtaaaaaatgtttttacatccttccaaacaggacttaagctgacttctagtggtaggtaaagctggaaactccatgacttaactgctttatattattttaaggactgtagaaattgatggattatcatccagaaaatgaaaacagttttcagaactacttcgcttagagaattgagcttttcaaagcataccccctcctcaaacaccaagtattatgtgatttaagctcctgttatttctgcaaagagcttaaaagaatgactgaccagcatgaaaaagcaatagagcattaattgaacagatttgaaataattgagttctacatttgttaacaacataataaaggatgttatcaaaatttcacacgtgaatataccattcccaaaactgcttatgaaaataatagactttgatgctgagaacgaaaaaaaaaatatgctttaaaaatttattaggaaacttcccttaaaaatgaattttagaaacttctgccttattatggaaatactccctgacaggctacagttatctgtttccagatttggggttctattgaaacaaaattgatga

SEQ ID NO: 36105 - DNA, 1503 bp, Bovine  19866881599094
ttcagcaaatgaacattttaagatcatttttatctctagtagcagtttctggtgcccagtgaataaagccaaaaacctaacactctgatgagacctctagacgtatttccttggttcaggggaatgcagtatcagtattccatgtgtaaataagttcaattaacaacgagttatcattgcaaagggagatgaaaattagtttaaacaagtcaattaaatcataaacatttcaggaataagaagatgtgtttgtaatccaattagtgtgttaatatactaataaatttactgatttgaatggtatcttaattgtatagtaagacaccagaagaaaaaaattgtatatcttaattgtcataaagggagctttggctgcagtatgactacataagtttggagaaaattatccatgttaatgagatcaaaatgcttctatctagaataataaataaggttacttgatactttggctaataaaaatgcatccaagggacaggggaaatgactgaacacagtgttgtctgccagacgctaattacactaagttcctgatgagagagaatgggacattttatactatgaccaaaaaaaaccgcttccatagtttaaaccctcgtaagatcatgggaataaaatattccaggggtaattctttattgctacctcaattaccacaaattaagccgatattaatatactttactgctgctcagccctaagtgaaatcagttgcacttcacatataactcaagggaatgagctgatctcctatttctgcgtaattacctgtaatttatggagcacagagagacctgtgagcagtctagccaaggtcacctaagaaggctgaattgcatcgttttcaatcaccatctgtgatctgggttggggctgccatcgccccaactggcactagagaaaaggacccttacccagcacaggggtcatggaaccagaccctcaggccaaggggcagagttgatcatgagttgatgcctcttaatgagtagatggtattccaatttaaaaaaaggtagaaatagataaataatgggttttattgctaattgcaacattttaaatcaactggaatgcctgcaaggaagtttgacaactcattctgggcaaattccaacttactcctacaaatgtggtctcctcaagccttctactcaactgtagtacaagggcagtgtcccctccatgtctccccaactcagataaacctccagccatttccaacattacctaaagccattgttactccacagacatttctcaatgttttacctcattctaataaaattcaatatgagtattttctatttatttatatgcctgttttaccaaaaaaaaaaaattgagtcaagtggataagcaattgggaaatgatatgcagggtaaatcactaaaaccagtgatgaactaggagtagctgagggggaaagacagtctgggctttcttgatgaacactgtgtgtagagctttaataaaacatacca

SEQ ID NO: 36106 - DNA, 712 bp, Bovine  19866881654905
ggatgaatgatggaaagaggtcactaaaggttaaggaatgagatacctcatctgtaataggtgggaagaagatagggtgaaagatgcaggtacatttataggttccatgaagaggaaataaaagcatttggattcttcgtgaggaaaataatgacatcaggagagtcagacagatgtgtatgaaatctgaagtgggtaccgggagagggaaattactatatattctaagactacaggtaacatgaaatgcccatttatgattgggcattgtggaatttaaagtaataacaattgttttattcatatagttttgctgacagatgtccctaggtgaacaccccttgcttgctcacgtatgtttgagagcaggctcctcataaaaatacctttcaaattgagcagtaacatcttccaggttctgcactgtactgttatgtttttcttgcaaaagcagggtggcctgagtataagcagcattactttcctccagttcagcttctttcctaagaaaaaggaatggttaaaagataagatgctaactgcatcttaatttaatataccatttaatataccgttagcttaagaaagagactaggatataccttcgacactgtgaatcatataccccacattggacagcttagatctacattcatgatctatatctgctagcatgtttatttacatgcagcttcatcttatctttcccatt

SEQ ID NO: 36107 - DNA, 926 bp, Bovine  19866881707817
acgtagcagacttgacccatggtgggcagacccattaggaggcaacacacatctgagtaccaggggatgaataaagagcagctttccacagcgctgtgcacagatctcacaaggtgtcatttggtcgattctttttccccttcctctagactcactttacatacacctgtagcatagtctctcaaagagcactctacggaaaagggatttctcagatgcaaaccctttgaggcaacagtttttgattcttaactgtctaaatccaaatcctcagccaactgataactgcacatcatattcctttgtgtggttaaggaagtaagtcatataaaagtcatctctttcataggctgtaatgctcctttaattagattataattaaaagcaaataaaaaatgcagattaataacttcataaattgtgcttttctgtccttgaaaaatagctatgttttttcctctcataatcagcctaaaatagagtcaggaaatggttttgggcattttgatcataaactactgtcgtgtgtatatatctctgtgtgtgtgtgtttgtgtgtgtcttcccctgaaaggcactcacacagagaacattttaattttccatggtattgctattttgacctctgagaccttgcaaagtaaagtatttatgatcctgggctttttttatggtattgtttcaatatttttgtaacatttgtatttcttgctgatgtttttggcattaaaaatcactcaagctgtgctgaaatataatggtattcactgaaccataccctagaaggataattcagttcagtggggttattctagctcatcatgtacataaaggattgaaagaaactgtagaagatcctcagttctctacatgggcagcactgagtctttttttccctctaataacttgacatagaaaaaccttcg

SEQ ID NO: 36108 - DNA, 958 bp, Bovine  19866881717840
tttttgaatatttccatgagaataatccacataaccatgaaataagctaattttattattcttatagaggagaatcagttatggtaggttcttattatttaagttgagcagaactagagggcaattatttttaggagcatgtaaatgctaaaagtggaaatgattcatatgtattcataaacattaacagtgtttataatattggctagtaagggctgtatcaaagtcttgattatgttcataaagatatcagaagaaaaagaaaatagccttgtatttgcatttttatacttaggctgatcagtattctcaatcatcatgtagattatggagtaattttacattttctcttttgtatgaactcttatttatatttataagtatagacttccttttcctgttttcatgtcaaagtaacttacagtctcattgtaatatagcaaacagaactaactcggaggcaaaacaattttcctaataaggtattaagcaacacaacaaaacacattttacaaattcttccaactgtcgagattcttgtaatgcatcaaaatgagaaaccacaattgtgttattaattaagaagaataaagttacatttgctgaaacataacatactttaacatcttcaggaagaatgtttcaggaaggaatgacagtaaatttcaattagaaaataaatactacactatacatttaaccgttataaaatgaaatatatgtagcttgactgctactttattgaatgcaaccatatgtttgtatgtttgcctcatcatcaagaggataactgatttcaggaggatgctgctgtgatttagtcaaggggggttgtataaatgtagattttctattctagagcaaagtttggaaaacaatttcttgatcttctatgaaattgaaggtaatagttttgataagcattgagttgggaagtcactgtgattttgatgtgtgt

SEQ ID NO: 36109 - DNA, 1154 bp, Bovine  19866881741432
aaaataaaataagcatttctcaaagtaacagaggaccttgggcaaaaccttctgcagacatgtcacaatatcctctgcttgcggcaatcttcaaggggttgggttctccaaaatttaacatgtttcactataaatcaagggtcttttgcctaaaatcagcagcagcactgaagaatgacctcccttgatatcattcataagtcttgggatattaatctagtccaaagtaagtccttcttttacccagggttcaaccaaaagcatcatattaatccttaagtttctatacaaaagagttctgagatgaaggtcagtggtaaaattgtatctagaaatttgagtgtgagttaattacctaccagtccactttggtgaaaatcagtgaccaacacaaatggagacaaggtgaactactaaacaggccttcactagctgtggtcagcagagccctccttctgaagggtttggaatctgtgagaagattctcccactactttccaggccaagtgtgagagctgaagaaagaagcacaaacaacctattcaagtaaacaggcagacagattacagcccatcctgagtatgtaatcttttaaagttactaaaattcataggcaacttgcctttttggtttcatgaatttcatttcccacaacacagtaaacaagatatcttaaaagttcattccatctaaaggatgattcccttccctttttcacctcctccttcccaaccacaatccaggaggtatactgataattagcttttagctgtgcacactgacaaaaaaagaagaaaaaaaaaaaggcccataatgtcctttaagcctttgacagatgctatgcttttcattttactcaatttttttatttaactattgtattaaactatttggtgatttaactttttcataatcagtaaatgttaagtcagataagagaaaggcaatatgagagacagaggccctggttaacctttgctggaatcactctgatggaaatcaaagaacaaacaactcgatagagctgtaatgggccctttggagagagaataaaaaatatagtgtattcctcaaagcaatcacggaagcctcaccattacttcaagcttaatgggtctgaaaatagtagttaaaaaggaatcaactacttttcc

SEQ ID NO: 36110 - DNA, 1186 bp, Bovine  19866881825362
ttatatgaaatatacaaattccctaaaagataccaaagctctctcaggaaaaaacagattaagttcttatctgttaaaaaaattaaatttatgacaatttttcacaaagtatatgctacaaccagctggctttactatacatttaataaattatacttattttacataagtttttccaaagcatctgtacacatcatcttttaatcctattcttttggaaaagaatttatataggaaagagtttgtctttaggttgaatttgaaaattaaggtactttaagtttgatacaaagtctctgaacttggtgggacaatactttatggttcctttcagaatgagaatactgcaaaataaagagaaatacacaatatcaatactaattaagaaaagatgcatgaacttcaggatgcaaactactaatatgatataatataaaaagggtgcaaaaggaatatctcatattgaattaatataataaatttactttcacatgatatgacagtataggaaaattatacatggactgattttccaagtatcataaattgtgagacctaagttaatacatgagcaaatgtatatggataaagattatttttaaatgtagaaactaacatatcttaaagttaattcaattaaaaacatttattaaaatctgataggcactgtgagaatttatgctgggaaaacaaaatgaaatccagtggatttttaaaagctaggttgttttctctgtccacattgtctgaataccacagttcatcacatctgtattcattaaacaatactgttttttggttgtatacatcatactcttggaggaggttaccattagccccactatagagtcacaaggtgggaaagccacaacctggagaccaattaccccaaagaagttcttgcactgttgtgacaattccagggcccacaacagacttcctatcctggggatccagcaaagggactgacaatctccagagaacctgactttgaaggtcagcagggtttgactacagaacttccaaaggacaggggaaacagagactcagggagggcacaaacaaaacctcgtgcacactgggacccaggagaaaggagcaatgacccctcaagagattaagccagacctgcctgtaagcattttagaagtctctggtggaggcatgggttgacagaggcctgcca

SEQ ID NO: 36111 - DNA, 1685 bp, Bovine  19866880195738
ttcgatgcatgagacagggtgctcagggctgttgccctgggatgaccctgagggatgggatggggagggagttgggaggggggttcaggatggggaacacatgtacacccatgactgattcctgtcaatgtatggcaaaaaccactacaacattgtacagtaattagcctccaattaaaataaattaattaaaaaataaaaataaaaaatgttaaaaaaaaaaaaaaaaaggtcagacctgatgatttcctagtaatagaattcagtgaggttcttaccatatggaggccccagaacaaggtgcttaaatgggtacagggatctgtttcacggtatctgctgaggatgggactctgtgtgtgcccatgggtgtacacacgtggacgtggcttcctttggatcccgaaatgaccagttccacaatgggaagagaggatgaaggcaggccagatttgaactggccattccttgaaacaatgtgagttaaaagccaagtcatgaaaactgaaatggctggctgccggctttccactggagtttggccaagatggcttgaggaatggtctatgaggtccctgggctacagggcttggcctgggggcttggctgtggctacctcagtggatggctgagaccccgaaggggctcatggccccctcagggccctggccatggtctttgctccagggagccctgcagcagctcaagccaggaagtgccccgggtcaagccagtgttgctcttggctgcagggagagaaattagaaaagacagggtggccggaaagagaaggagccaggtcacctacttggtcacatttaatgaacattgagatttgtaaatattaagcaagtatctgtaaccaaggaacggccttggcaagggattgagcggagggccccctcctgtttgatctcacaggtttggggtttctctgtgcacagagcatttggcatctttttcttttgtatggttctgtgggttgaataaaggggtggttgtttttcaactgtttatgtgcaggctgacagtaaaaatttggtactggaaagtgagcagcagtctgtgataagatcaatttggtgtttgcataaataacttgagaaccttaaaaacaaaactgtacatcatagactaagggcatcaaaggtaattaaatctcacctacctcattttgcaaatgaggaaacagaagagcctgcttgcaacattgcttacaactgtatacaagcttgtaaggagtgtggctttttgcaaaatgatttttttagaggttcctgctgaagcatctccaggaattctaagttggaacatggggccgctggaggagggataatggaaaaccatttgtgtttcctggtaattacagggggaatgacagggtggtggggcaggggtgcagggggaatgctgggatcgtttactccactcccgcctcctgctggggtctctcgttggactcccagagtgtccctctctgttgagcaggacaaaagcacatgtggatgtggaaaaagcccctacaaacagctcctctgagttcctgtgacagcttgccccgagggaggcactgtgtggagtcaaccctgtttatggagaggcttccagaccccactctcccctcgtctttcttgctcagacaagcccgccactgagctgtcaggggaagagtttcgtttttagca

SEQ ID NO: 36112 - DNA, 3010 bp, Bovine  19866880434885
tatgatttccttataggcacaataggttcccatagtaatgatttaaaaatacataatgtaaacggtaatgtccacattttgccgcctaacccccaccccagctatgtcatcagtcactgtcaacagtcaggtgtgtgctcttccagggccctcaccctgcacacacactgctgattctgtgtgtgtgtgtgtgtgtgtgtgtaaaccttgatgggtttacatgttgtcttgtgtcttatttcacatattttaaggtttctgctagtgaggatttagatttacctcactattcttaatggatgcttgagattttgttatatagctttgccgtgatttattcctgtttattactatttttaattctacaatttttcacccatatagcaaaatatcagctattatagtatccacctctgtatccccatatagattgaataagcagcaacattttgccctgttggcttcagaatttttatgtgaataacggaaacattccatgcagaaaggaagccttgtgtgtgctccacccagtcgctctcccctcttcatgcccagagggaaggaagctgccttctgcagttgatacagcctgtttagtcttacatttctactacatgtggccatcaacagggtgttactttgtgcattcctcaatagtatcattaccatatgggtatctcctgtgacttgaattttcattcttttttttttttttaagatttttcattattatataattctatgttgtcttccatttgataagaatgaatacagctaatggatatagcttcatttaatccatttccttattcacagaatttgagttgtcatacttttaattccagttgttcaaatgtgttgtctctgcttcttaattctggactcttttttatcttctgtggaacagcctgtctaagattggaatgatctgttttgaaagttttgtagaattcatcgatataactgtctggtctggtgctttctttcattttttttttattagttattgaggtttttaggttttgtatttctccttgagatatttttgataggttctatattttgaaggaatgtatgttttaagttttcagatttagcagtgtcaaggcgttgttagcagtcttttgtcattaacttgatgtgtgtctatagtgctgtgcctccatccataagagtatttgcagtgttctccctgcccccttttaacgtgatcagttttgccagttttgtctgtttgattaatcttttcaaagatcagttttttacctcctgcactttgaacatgcatttcctggggcctggcctgcagttcccttgtctcatcacctggccgagtctttcttctagctctgtggcactgtgtgggggtatagtaggtgctcaggaaggaaagggaaagaaattaatgagagtctattatacataaagagctacagattcattctcaaggagagaaggccctctttcagggtgtattcccaaaaggactgttgtaaagacgatgtaactggtgttgagtgattgaaccagctgagcaatctgaggttctgtaattcttttttccataatttatcaggaagtaaaaagctggacttgcagccatggcgtgactggagtgagactgagtgtgagtcagtgagctacagaaacaggtaccaagtagtgcctttctacttatatttaagagaaagacaagccaaagtgatgagatgtccattttgcaaactctttccagtgggcttctccaggaagacttgggtctttactggggtaagtacctgccagtccatccttgattatatactcaaaacagaaactaaaaagacatttaagtgaaagaaatcaccacatcttcagtggtccaaccagaataagaaatacctggctttagtttttcttataaagtgtagctgttttcctagtaattctacagcttctcatggagagagaggtaaaacaaaggagaagaaattcaaggaaagttttgttagcaagaggctctggactgatagttaagatattaaaatatttgcaacacataaaacatgctggcaaaggtggtaatctttgaaaaggaagaggagagtgggaaaccaggaaatatcagtagaaaggcagggctcttttcacagttacattatgttcatatttatgaccatgttattgtcacctaacaaaatattcatagcatgttaaagcctttgttttattttacttacattacacaatttgtaagactgagttgtaaatttcattgtctctctggcaggagccttgccaatgaaaatggcaagtgatatcttccttactggttatgttgactcaataataataacagcaagttgaacagctaattaatatcagactctctgctaacatttgtataatacattgttattttaaatcaactatttttattcccttatatagcacattaatttttcatttttatacaaagagattattatccccattttccagatgagaagatagaggctcagggggagtagaaagtaggtggcctggctgaagtcctccagcaagaaagggagggaggcactcttggagccccaggtctgagcaccagactttggcccccatggagccggcggcagcagcagccagactcccaggcacttgggagatgctgtgggtgcagtcatcattctctgctggtgggagagagtcacgtttgtttaacgtggtgggaaaatgcgttctgtttctagccctgaggcccgtcactcctgaccttattctgattccagccacgcacactcctgaatctgagatctttccctaggtgcaccttgactcctgactgttcactcttaccttgggcatttctgtatctactgtgagctctccctagtgtggagagtttataacttttctttccagtctttcctaagattgtaacctccttccagtcaagaatctgcgcctcccgtctctgcagtctctatcctgccgctcgcccagccctggctcacatcaccccctccctctg

SEQ ID NO: 36113 - DNA, 816 bp, Bovine  19866880467018
gtttgtctagtcaagactatggtttttcctgtggttgtgtatggatgtgagagttggactgtgaagaaggctgagcgacaaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgtgaagagttgacttattggaaaagactctgatgctgggagggattgggggcaggaggagaaggggacgccagaggatgagatggctggatggcatcactgactcgatggacgtgagtctgaatgaactccgggagttggtgatggacagggaggcctggtgtgctgcgattcatgggatcgcaaagagttggacacgactgagtgactgatctgatctgatctgataattttgtttttatataaaagtaatgaactgagaagtcaactctaaagacaaaattgtttctagcatctaactcctaaagctttctgatgcagctcctgtacactgttaaagctttaatgcaaaagctgactcacgtcatttattgcttacaatttgatctaactacagtgactggaacagataaaggttaatttttatgaagttcagaggcacattgttgcagacattagttttgtgccttatggatgtgagtctcttaatattttctttatggttccaaatggctgctgcagtttggggcttcatgttcaggttggcagggaaggaagcagaggagtacaaaagagca

SEQ ID NO: 36114 - DNA, 1258 bp, Bovine  19866880532122
tcaggctccattagggctggaaccatgttttgttttttttctgaataataggcatgctcatacactcacataaagttggcacctgatagataccagtagtgtgaacagtcagtgtctagtaaaacgcatgtagttagtgaatgacagagtcagagtttcacccaaacttctcttaaatccagtgtgttttctgtattttagccactcggtaattacatatcgccattgtcctgaaacaagcttaccatttattgaaacagataatgatctcagtggggtaaactctgtgtatagaggttttatagttactgtgtagggcctttaatttctgtcctttgtttcacatgtgtttcttgctccacagctgtatttctccattaaagtacttcagtgatttccgaccttatttcactattcatgatagtgaattcaaagaatatactacccgtactcaagccccgtgagtaaacaaaataacttttattgactaaatattaacctttataaccaaagcatttagaattatttttggtaataatttaaaagtttaaaatttgaacttattgcgagattgattttgtaaaggtacttttgaggagcagctggtaataacttcacatttcaagagtcagtatcttattttctgtaaatgatctgctttacctgtggaagccataattgttattaatagctagctacccaactgtagttttagttctctttgttctttgcttcatgacctcttacagtatcagttatcttttcttgctctgtaacttccttttccttccccttcctcattgaatcaccatacaaacatataaaaattcttctcagtctataaaaggggaaaaaaaaatatcttgcctttccctcttagctcttgctctattgctcacctttttttcatagcctagtttctagaataacaataaaaatttccatttactgtctccacttcttggtttcctagctgcttctcaattcattgcaagttgatttcttcgtctctgctgaagttgtttttgctgaggttaagaagacccttctcactgccttgaacctgtggacacattattgccctgttttttcctgccttcccttttctcatgacattgaatccactgaccttgaaaacactttaatctttgatgccatctcacctgactgtctggtggtgcactcagtcttctctgcagacttctcttcctctgccaaccccttaaatgttggtgttctccagtattgtgttctgggt

SEQ ID NO: 36115 - DNA, 1505 bp, Bovine  19866880565425
tttctttttctaatttgaagcccccacaaattatacacgttttcagattcttcaaaactggatctgcccctacgtaatgcccagacatttccccacctagttctatgttcaagaccacatcacattcagcggcaagaagggtattgtcccaccaacccctaagcaactctagccatgacgagcagtttgatttccaatccccagatggcaactctggtggaccgaggagctgcccttccagagacacccaggatccaccaggaagctcatggagccgaccagtcctgagaggagcctgagggcacccgcgtccacagaaaggaaagaggaacgcctgctcacacacgctgtccttcagtcattccttaggtccactgaaatctcaccatccaatgatatttacgtattttcatgacacacgtaatctgtactctccaattacagagcctctgtaatcagagcacttccaaataagtggcaggtggatgatctaaaactgctttctaaaaaagcaacgtggcttggaagaataagaaaggggggatcaaatcacacagtgtgcgtgcaaacagtggacaactgtctatttaaaagaactctccaacgcacagcacagccgttacggtggggcatttacatcagtcaggagcctccggagtccagttgtccaatcaaatgcctccccccaccaaaggtcagagtggagagtgtccctccctggtctattcttatccccctctccctggtgtgggggggagggggcatctctgtggagtgcagcttggcggtcttgataagcaggtgtcagggagttgaacatgaccttgctcatcagctggtgggaaccaggcagacaagggagtctctgtatcgctgtccacagggtcccagccccagaaacaagacacagtgaggcctaggcgggagggagggaggaagggagggaagcttttacacaccccgcccccgacctgctccccccaccactacttcatacaccggggggaagtcaccagacaaaaggaaatccacatcatttcactcgggagaggaaaaatttccaccgagaggaaaagaaaaatctgaccataaagatgtgttgaagtgtttcccaaacagcagagtaggcaaagataaactgaggagatgggttttgaggaaaatcaagaggaaagtcaacattgtctgtggagctggcaaaatcaatcaggaaaactgttggcagaggtgggaggagatgaatgtacgttcacctagctgattccatcgtacagacagccagggctgtgtcaatggctgttactgtaccagcccctggaaggggtccaacatgcaggacccgctctgaatgtccactaacccagtttctaattaaatgtgggttaactggcactgctccttacagctcaagggaccaattcagagccgaaaggagcatttttcaaactaaaaaggccaagccagcaccttttattttctcacatcctttcagtgctcaacggacc

SEQ ID NO: 36116 - DNA, 1363 bp, Bovine  19866880681040
gtgatagttcttttgtatatgcatgggagtcgcagaactttctgattggatgagataggaaagttcatatattttatagatagtaaaactgagatccagagaggttatttcgtttgcttaaaggcacagaagctaataatgatgatgatgatgataataaattaatgttttcccctaagcagataggggaaaacatttctatctatgttcagatagaaagcagatgacttatgctcagatataattaggtcttattccctcagtacatggttagaaaatgttctgatctatcaagtttgtggtttatgttgcaaaattgagttttcttcaccttcctagctaaagacacaggtgacagaaacatatatgccatgtctcaaccatagaatcattgtggtggcagccctttagggcagcccttgtcacccacctctttctctgggtttcctctttctactccgtccctctgtctgtgtgtacagacttgggactgcagggagggcggggctgggacaggccatttgtcaagccaggggtggaaggtgggttagggcggtgcaggggaggaacttgttcctgcagagtcctggaaatcttatttggagccactcttctattcttagtttcgaaggcactttgttctctggtgcattgttttaacaggcaccaggaaatcaggctctgctggggtcagcgatgacactggttcctgcctgcagccacccaggtgggaagtctactggtttgtttcaatttgttcgtcatcaagatctttgctgccctttctcattttgctgcccaacctatctgcatgaagcagggaagggcgaggaggagaaaagagattccagtgagtctctttttctttataagcaatagtaactgcacttatttctgtgtaaaaggaaaaatgctaaaacccacatcttaagaaggcagtgtgcccattgaagcagcattgttcactagaaatagagtgtgagacacatataaatttaaatgtcctagttagccacgtgacagaaataaaaagaaacagatgaaattaattttaatgatttgtttaatccagtatatccaaatattagcttttcaacatgcaatccacataaaaattattaaggagacgttttacattctgtttttacaattctgagtcttggaattccagcatgtattatccactcagagcatatctcacttcacacgagccacatattgaatgctcagtacccacatgtgggttcctggtggccattggacagcgcaggtctagagcagtactatccaatagaactttacatcatgatgctcatgttttgggtctcctctgtctcacacagaaaccaatagccacggatgg

SEQ ID NO: 36117 - DNA, 1598 bp, Bovine  19866880707126
tttcaaataaaataattgaaaaataaacactttatcttccttaccagcgcctggagttgttaacaatcactccattgtctacggagaaagtatctgtaggcaatccagcaatattccaggctctgattgttactggatcacccagggtcttactcagtgagaactcctctgaacacgggatttttttctcctgttagaaatacacagatttatttttgacattttctcttatcttattgattaaaatatttttagttaatatattatttgttgttagacagtatttaataattcttaacaactgaaaaaactgaatgaaaagttagactatggaaatattttactgatcaaataagaagaaaaaaaacttcatattttcagtcatttctttccttctctatttttattatcaacctttcccccccaaataccccaacatatattttaaatgttctaaaaataaactcttaagaaaatataaaaccattaccttgcacaacatgctccaatcttctgtacatgtttgtcgaaagccagaagtgaaagcaccaaggtaggctattactcctgctgatattaagacatcaccagtcaaattttcatatactatctgaaggtcatctgcagcttgagaccatctaggagaccaatcaaaggcaaaacagcctcaccaaagagaatgatttaaggcagtaatgaaacagccagaggtttctagtccaaattctataacaaaatgccatgaaaagttgggtacttgcgtatctataaaatgaggaggttagggtcccttctagctctaatgtgctataatatacatttatgttttataaacaataattcactattcattattagaatattacgcatttcttataggacttgttctttcaggataggaaaacagaaacaaaaaaaaatcaccagaattttgtctaataattttattcaggatgatttggcccagtggccctgctatttgtttctgaaaaacacaggaacatttgtaattcattaccaaaaattacatttaagttgtatagcagttggcatactatagctaaggttggtatctttttccatttaatgaaacttttaccataaaaagtgcatttcaaaaccatctaatctgcactacgaagtactgtcaaaagtatgttactttatcatgctattcattcaacaaatacaattaatagctatgatagttggctgactagtataaatagattagaataaagctaactggctttgttacatcaagtcagttatttaaaataaatttaacaaaataaaccatatattcactactcccttccaaacactttattacaaaacatttgaacacaaaattggaaagaactgcacagtgatcatccacatactcaccactaagattaaaacttgtcttaagccttatttgcctctttctctttctctctctcttttcacatttgaaagcaagttgcaaacaccatccttgacactgaaattctgttaggagaagcctagccaggtgctttatagaaagtcccatattctcaaccagccatttaaaaatcagtaatcaaaataaacaactcactccagtattcttg

SEQ ID NO: 36118 - DNA, 1272 bp, Bovine  19866880715564
tagctttgtatccatcagcgcaagaaagggtgctccagaggtcttctgtcgttcaggtaaagtgacttcgccagtctctgtacatactcgttctggaaggggtgccaggggtgggggtgcttatagtaaagatgaagaccagactctactgaaaaagtgtttgctcttgaatcttaagcacgtcatttagccttcattcattcatggagcaaatactgagtacctgaaatgcgccctgcacgcttcaggttaccttgaaaaaagacgtgcttacgatttcgtttatttagctaaataagaaaatttagtagttaatattttattattacttaccaaacactggtgacacattttgaagaacttcaaatttaagcctccagcatctttgtgctccataaatattagcttttaattttggctcatagtaatcctgcagttcccgttttatagatgttactctaaaactctgtccattttttaggtaactgattttgttcatattaaaaaaattagcttccatttttttgagcacctactgtgtatcatgcacctctgagtaagctcatttaattcacataattaaattttctctttgaagtggatgatattgcttctttttcactcatgatgaagctggtttaggaaaaagaaatgtcactttccaggtcacactgctataaatggttcagtgggtattcaaagctacttctgcctgactcctatgcctacacttaccacttaaaaacaccatctccaaccttagtgttaccatctgaactgtattaatcttcctctatatgttaggttgttattaaaatattatgctgaatcccattcatgtatactccaaaatttaaaagttaagttgcataatttctatcatacttcatcagcagggaaggttttggaataaaatgtcagttcatcatatagtcttagatttaaaaaaaattttttttcagaacgggaaatagaaactgaagtcagcattttctgtttatcttaggtttctgttcttcagtctacaaaggactcttctaaaaagatatgtgttgctaatacccatctctactggcaccccaaaggtaggttttgttgattttcacaagtggcttaaacatggtaacttaaagttggtaaaagctgttttacacaaatacattttttctttgttttgtcaaaatatagtttataacacagtgctgtacaatttaaggtatatggcataatgacttatgtatattgcaaagtattatcacaataagttaacat

SEQ ID NO: 36119 - DNA, 1088 bp, Bovine  19866880749564
cttttcttaggattattttgctgggcgacatggcacaaagaaagcagtccaccacttgcagtctgaaggttgacagtgctgctcttgtttgaatgtgtggctcctctatgaggccaaggcttggctgtccctgctctacaccctccagggatctccgtggcaatgtgcatcattcatttaaagactcatgcaggacaaggctgctgtgggcagctgaccaaggctgaccagcaaattacatctcctgcctttcctttggccctgccattattattattattattattattttaggtcagtgaaaatgttatcaccactcctccactggaaaatgtttgtggttgcagctaaggacctgttacaactgctgacaaaggattcaaaaatcctaggcacaggagaaataaacgaacccccttagcaaaaactcctctagctttttccacttcatttaggctgtgtacactgggctgcttcattagaacctctgctttcactcctactcacatgaaggttttgttttgtttttctgggaatcacagctggtgtgttttaaaaagccatctgctatggactgaatgtgtgtgtcccctcaaactcatattttgaagtcctaaaccccaacatgatgatgtctgggggtgaagctatgggaaggtataggtttagatgaggtcctgggggtgggaggtcccacaagcagattagtgtcctcataagaaaaggaagggagaccagagctctctctttccaccctgtgatgacacagaggagagaaagcagtcctctgtgagccaggaaaaggaccctcactaagtaacagatctgctggaaacctgatcttggatttctcagcttcccaaactgtaagaaataaatatctgacccagaaccaccttggggagccatgtgagaaagaaaggaatgtttttgtttaagctactatggtattttgttatactagcctgagttaagattaattaaagagctgtcctaattaaagaagagtctagtgtttgccatggtaagaaataggaaactatgcattagtgcctctaactgcttatgtattcttccatcatacaagg

SEQ ID NO: 36120 - DNA, 1743 bp, Bovine  19866880751387
ttaagacttgggtatgagcgttgcgcccatatttctggaacctttcccaacaagcagactgccagacagtgcctccaacgcagaatccatcacgaccacacccctaatagctttttcaaggtcccgtagagtgttgcgtatagttttaattaagctgcaaggaaagcaattgtgtcatcatcatatatatgataataaatatcaatatacagtccatccagaagaaagagtaggatatcattcacggttttatgggagtatttcccaaaatttggtcacctcccacttcataatgtaaggtaattttaggtgatacttggatgaacatttttcattttaattattacatatgcattttaaatatagaaaataatataacttgcacatcaaaattgctttctgggtaatattgcttaagaccaggctaatttaaacagagaattatttaaggaaaagtatcaggtaaataatgttacaggtgacatgcaaatatgggaagagttataaaggcacaatgcaatggttgaaactttggaaacactgcataaaaatctaaagtgtatattcattcatacccttataagtactttgcttctcacttagatcccaaattctaagaacatcataaatatacctcaagtgagggttttgggctataagcctaaacaactgagagacaatatgttattatgtacaaacacatatggtctttgtattgttgttgctgtttagttgctcagtcgtgtctgattttttgtgatctcacggactggagcctgccaggctcttctgtccatggcatctgccggggaagaatactagagtgggttgccattttcttctccagggggtcttcctgacccaggggtcaaacccatgtctcctacattggcaggcagattctttacaactgagccaccaggcaagtctagatgtataagatgtataagtctttgtataagagatactaaattcattaaggcatcatagggttttaatatgtcttattttaaaaagtctggaaagttaaacttggaaacactagaaaattcataaccaaaacaattctccattccttaagccagtattgagctttagaaaattcaatttaaaaatttaaagcaaataatctgcttgctattttagggtacctaccaatctagattagacttaggaagaaagtgggcagaaaaatgactaaatatgtatctacacataggcttagataaaggtcattccagctttatttcctgaggagaagagcaatggatagatgaaaaattacgattaatgaatatttttaaccagatctcttttttcatcatcatttttacattagaaaaggtatactcccttctggggcagtatgcaactctaaaaaaggagacaaattctaacaaaatggcaagttttgataattttttcttaaaattttgattcaatactggtgtatctttttatcaactttggctggtagctttctgaatcactgggtgtagagctccttacttgttaaatctttccatttcttgcactaacacagtattcatgctctcttcatatctcacaggatacttgagcagtgctgattcaatgtcaaagtcacttggtagctaagagaataaaatttgaagatcacgtattactctcaaaatgaacagtgtcattcggctataatatcaataatagttaacattaggcatttactatgtgccaagaattatgttaaggctttccaaatat

SEQ ID NO: 36121 - DNA, 1361 bp, Bovine  19866880835398
ggttgcagtgatctcaacctccgaaagcctagttcaatgagattatcactaaactaccttaaatacattttttcccccttttaccattggctatgaggctggctctggtctctgagcagaggtaggtaacacacattgagtaagttaagcgctagtctttggccataggacagtcttgttttctagtctcacccctgtgtcccacctttttttttttcacttccacagctaagttatgaagtctggcaaaaataagggattcaaaagctgcttaagtttctttcttttttttttttttttttacataaacatgaagaaagagagagagagaagcgaaatttaataaatactagagtaggaacccaacaattaacgcaacacctacaatgtggcagatactggttctggatgatttccttgtaacaacctttgtgaaatagacattagctcccattttagtgattaaaaaactaccgttaagttgcttgcacaaggctaggtagctaacaaatagcagtcaagactcaaatccagctagattccccaatttcaaagcctacaatcttcctgttttcaaaccttcctcacagcttctctgacagtgaagacaaaaagtagatggctaggggggaaaagaagaaaaaaatacaaaaaccgaaggatcaaatgcagatatatgtaatattaaagactttgttctgcattctttgctcacctccatagtcccactgacaatctggttcccaactaaaaagtattcaggaggaaagtcatgagtcctaaggtagaatgctacaattgatgagaagattcggaccatagtttcatcactgaaagtattaatggtgcagatgttgaaatgccgaataaaacggggagtaactggatttcttccaccacctggagggcccatggcagcaatcagctgtatgtcaaccaatgtgattttacttgtgtccttcaggtcataccttgaaagcacataaaaatcccaaaacagtcagtaataaagccaacaagatggactgaaaagtagagttcctttgaaactttatctgattttagcttttctaaaaggaagaagattagatattacttggagtaaaagagaagtttgtttttaaggattcatataatttttacttcttttttttattgaggtataattgacataacattagtttccgtgtactacataatgatctgatacttgcatatattgcaagatgttcaccacaataagttcagttaacatctgtcaccagatacagctacaaatttttttttttcttgtgataactttcaggattcatcctctgagccattttcaaatatgtgatacagttttattaaactacagt

SEQ ID NO: 36122 - DNA, 2245 bp, Bovine  19866880891060
tactttttttctttcttttcaaaggctgcaattttattgtaacttgagtcttgatccccccaccatcgccaagtaaacagggtaaggagagttccattcagaggcagctctgggtggtgatgatgtatccagggtgagaggtacctttggtccctgctgcccagcgcctttgaacgtgttatgtaaatcattgcttcccctgagccttggaggtagacggattatttctgatgtggttcctttttttccagatgaggattccaaggcacaaagagccaggaagggattaggatgggaggccacgtgactcagagaggcctctctccgccagaaaccagttcttaccctgccccctgcccccagcaggccaatttgccctgccttcccagcacccagcctgagatggacatcagccatgtgctgcagaacagctcatgggggtgggaagagagcaagactagataccagcgagtgctttgcagagaattaaaccacgattcggcatttaccctggaggttcccaaacctggctgaaccccagaagcaccggacggaggaacattcttgggggtaggcgggggtgggagattccgggactcaccccagatctgcttaagtgggatttcccggggaaggctgggaatctgagtttttttttaaaagctgccagatcagtgattgccaggatttttggggggttggggtaggggtggatagagggtttgactacaaaggggcagaacaaggggatttttgggagatgatggaattgttctgtgtgctgactctggtggtggatacactgatgtatgcatttatacacctatttatatatttatacacgtgtaaatgcatgaaacatcttcccgggcagcactagcggtaaagaacctgcctgccagtgcaagagacaaaagagatggaagtttgattcctaggtcaggaagatcccctggaggagggcacgcaacccactccagtattcttgcctgaagaattccatggacagaggagcctggcatagcgtcgtaaagagtaggacacaactgaagcaacttagcattcactcatgcatacatttatatgtgtgtaaactcctggaactgtacaccaaaaacgtccatatttacatgtaaaaaaaatgctgcttcagtgaaactgagctatcactgaggtgtcaggtgacgagttttctagctgtgggagaatgctacctggaattgcagaggcaggtaggcagatcctatcgagtggaactttgtgtaacaatggacatgttcttctctgcactgtccatttcagcagctgttcaccatggtggctgaagtgtggccagcacagttgtgggcctgaattttaaattgtactcaagtttcaatacctgcacatagctaggggctgccccttgggcagcttgcttcggaggcagacattgccataatggggggctttggctttgtgccagctgcacacagggccctgtggtccttcgtgcttgaggaacaacagtaagtcatcccaggtagagggaagaacaggcacacaggccagctgtctgggttggtaggggcagaggaaaaaggaactttggaaagaacagtgatgtgaggtgggcccaggcagggaacagtctcgccaactggaggaatcagcttttcttcccttatgtgcagaagtctgggccaactgtgggccatttcctgccccaacttcccaacctcgttcatcttaaaaagacacaatagttagcatgttccttaattgagcttttctgttccctgagatgctgggaggtacaggaagccattggagagttcaggggaatgatgtgcggatagggttagggggtgcttctagcttcacaggggatttgctgggtccccgtgtcaacttggacagggtgtgatgaagaacctgcatgggcatatcctgctgctctttggggacgagatcctctgaagaggcgcctgggcgcaaacctcccaccttaggcacccagtgcacggcttccgtctcagtgtgtgttcagacactcttaagcctatctccccaccctcatgtatttatgctgtcttaaatagcgttacttttccaaatgcattataagagtgagattctgagagtgtgaccttttattaatgcaaaccaaatggggacagaaataatgttccaatttgtcaacatatttgttcttaaattggctaaatggctaacaaaaaaattcatgagccacaggtttttataa

SEQ ID NO: 36123 - DNA, 1646 bp, Bovine  19866880914277
actatttgctctattaaaatgccttggtatttcctctgtttaaccacaggccacttcctttctgccactctaaacccggcagggccaccggctgattgaaaagacacaagcccaggagtgatcacatcctattgaaacagatagtcttactgcagattaaagctggggcaagaagagaccaaatctaagagggattccttgagatgctccttatcttgctcaaatttagcctgttgatatcattcacacttaaagtcatgaatgcattctttttttgttttttttttttcagaaggcactcctcctaagttgtaaccaaatgagttagtgtgtgtttcatttacataaagcaggttaaagtgacgatccactgaatttctcattgtgtgagttgggaacgcttcagtgtctgggaagggcatgatgtctgttcataggaaaccatacttggcttattctctgcttgtagatcctgcctgtttgttctcatgtgctcagaaacccaagtaagacgtttatagcttaactaataccaagaatatatctggggagactgtctctcctgctttcccgagcagtatcttgagaaggtttaattaataacaccaggcatgaaactaaaaattgaacaattgaaaaattacctacagtaaacaaagactgaaatttaaactccatccgtaccctgtttcttttgaaggggcctaaaaagggaatgactagtgagtctctaatgaagactattattttaacatttgcaactccattgttcaaagcatccatgataaaaacagctttccttttctttggttccttgtttggaaatgttggggaaaggtggatgtagctaattaaggctacaacatttaaaggggggagcttaataagtaccagctgtcctcaacaaatcaaccgggtggatgacaaaataaagatgtgatgtgaatacacatgtaattctcttctaaaacggaagttggcctataaattgtctgatttaatagggtaaatgaaaactacctctactatgcacttttaagaagcatttgttttatagtaaacctcatgtcttatttgcataaagcctgtgcattaaaagttgtaagggcagtagatggcaggtactgtggaaagtttaatacactgtaattcttctgtccgtttcttcactctaaagctgatcttaatagacattaatcatgaggcttttcattaaaattactacatcatagggaagcttgcttgaacttatcagaaatgcctataaaattgtagccatgactttgaaaagagaatttggaaattgatagcattaatgaaaatgttcaggtggaaatttaccttttacacattaaatgaatatttcaaatgaatccttttaaatcataagggatcaggctttaaatatagctgtttttcaaatttgaaagtcctttactccctaaaaaaccaggagtttttccaagtgttctgttttgtcagttttgtagattttttccccccattgaatggtaaccctttaaaaaaatgctggctgtggccccagacttctgttctgagctgggctgtttgacttgctagtgggaggttgatggggatagagggagggtttcctggaaagaagaggtacgtttccctgagacggg

SEQ ID NO: 36124 - DNA, 1137 bp, Bovine  19866880950582
gaaactaaactgaaaggtgaaatcgttgccgcccagcgcccatgcagaccagcagtcactcgtgcctggggcttccctttactgtactctctcccacatattttggattgtgaaaatttcaaacctgtagaaaagttgaaagatcagtggggtgaacacgaatttccccttagctgagagtcaccagtgctttgtccccgtgtacctcagttgtctcccagtgtccttcatgatttctttctgaatcacattccaggattcagacaagagccattcacggcttgtagacataccctgtctctttagtctccttgcatctgatggagtccctacatctcttttttgatcttttgtaacatatacattctgaagagtcggggtcacttgtggtatagacggtcacacaatttgagtttctgattgtttcctcatgattagggtcaagttaaaatttcgcaagatctctctaaaagttcaagtgcgatgttgttggattttaggtatcagtaggtaacaaagattgctctagcaaagagcaaaatgtgttttttctacttgaaattattgcacgtagagacctttctaatgatttaactcagtttggtcttgtattattcattctttttttttgtttgtttgtttaattcagtgctatacagaaagacttctcttttactttactgggagtccaaagaaatggcaaggtgtcttttgcactatcttgtaatttaacttttttccatgaagacgatctggaatcagctgtgctctcaaaattgggagtgtcacgtcccaagagtgcttaaggtttttgccattcactggagcttgtttcaaagagttgtagatgtcaccctcagcgactgaccaggaatgagttcctattatagcttcagctttggcctgggtgagtgcatggccgagtgctccctcacaccaaactcagccgcttctttcctttgtgctgagaaaacattgagctttatttccagaaaaggccttttccttctccactcagaacatgtccttaaagtcagtttccagccttctccttctgtgagtacatgttgcctgaattattttattagagacccttaagagagtttatttgtttaacgtaattactatcttctacct

SEQ ID NO: 36125 - DNA, 1004 bp, Bovine  19866880991750
ttggttattaaatagaaaagccctgtgattaaatcacaggactgttccaacactaatcaattaaatctcggtcatttaaaattaagtcaggccttgcacttgccctgcctctgtgacagaagtgggaaccacacactgcaaacgtgactgaaggtatccagagagcatccgtttatagtcctatgtgatgtgggtacttagaggagggtcaggctgcatcccaggtaggattgcctcctccaccatctctaatacccacatcttctttgcctgcctctcaacatccagtaacaacaaatcagcagtgacaatagtagtaatagtgattatgatagtaaccacagaagcaataataattaccattttttaatctcttgccatatggctggccctgttgtaaatattttatctgctttaatccttcaaataagcccatgatgaagaaatcaacgtttatggaaatatatcatagacacttccatatctcacacacctggaacctgcctggcccatagttcatcctctataaatatttgtcgtgtgactgaagtgatagagagcatcagtatctgtgatacacatcagttgctatggtaagatcagagcaaggagaagtgatggatcctgaactcaatctgtctcatttattctctttgtttccttgaggtatgtaggtaaatgtcttatgagcctttttatattgttctaaggcacatattgttttaaacgtaaatttactttatgtgcttctctgatggctcaggtggtaaacaatctgcctgcaatgcaggagacccggattcaatccctggattggaaagatcctgtggagaagggaatggcaacccactccggtattcttgcctgagaaatcccatggacagaggagcctgccaggctatggtcctggggtcgcagagttggacatgactgagtgactaagactttcacacttcccttcacattttttatattaatttaaataaatcacacttgtttttaaa

SEQ ID NO: 36126 - DNA, 1329 bp, Bovine  19866881028118
ccagtacctctttctttgctgaggccctcaatctttgacctgcatgcctgctgccagctagatcaagctgcctcctttctccccgtcacatccattccccacatgaagccagaaggatcttcctgaaacacaagttgggttgtcactctgctactctacacgttttgctgccacttcctgttccctttagagaaagctggacgataaagcctgcttcttaatgtggctttcaagacccactccctgcctgcctcttcatctttccccagttcccttcttcctctgaacgtctttaatcatagtcctgtccacttgctggtccttctgcctgtactcttctttccttcatcctatctttgcctgattgtcattcagatctcagctttcactgtaacttccactcacaagtcctccctgaccctcaaggagtgtggtgtgccccttctggaggcttccataggagcctgtgctttcatttactatgtaagtccctgcagtgcccagcagaactcttggtgcacaggatgtgcttcacagatactcaacaaagaaaagcaaaaatgaggattcatagcatgtgaaagaggctctgaaaattctaagacattaatttcagttcataacagaactataataaaaatttggcaagaaaaccttgtataatgaggtaactcagttatatttttgaggatggaagatgtgagctttcttctacacaatcaccagacccttttgttggtagatttctgattctcgtattccctggaatttcctctgatgatattctgtcatccattcttttctctctgcaccccttgctcaggtgctaagagaaaagtgctgcattgaaagaaataagaagcaaggttcataatatgtacagatttccatctttggatcaaactcagtattaaaaatctgtactgtttcaaagaggtcttattttcttaaacacaaaatcccttaaacttcagacagagactctcagctgaagccgtctttggctattcttagcccttgctcttactgctttttcaaggctgcgcgtgatctatacatccattgagtcgtctggcttcctctttgggaagtaataattctggtgagtcaaggggatggttggtaggataaagtggacatttcagatcagggtttgatgaatcagtcagccgagcctgaagctggaaagattacccactgcatacttcacattttcttctccaagtttaccattaagaatggcatattgtacaaatgggtttttttgcagcatgtgaatcagcttgtgacaattctttagggttttttcctttaatctcataaataaaa

SEQ ID NO: 36127 - DNA, 1409 bp, Bovine  19866881114615
tgactctctaatataggacctaccacagtctccaaggtaattagaagctccataaatgctgtttttggcactgactggggccacacattaaaacatgtttattcccaaactgtcagcgaaatatggcggggggtgggaccacatcagacttgctgcagcgtatgtgcagaaaagagaaaggtgatgctaagggcaccgttcaaactgaggtaatttcatcatatgacacacagcaacccacccccaaaattctgagtaagagtaagagaattactcagaggaagggaattctgagtaaaagtgggaactattattaccaatttaataagaagaagaatagtaataccgctgctgtgccttttctgtggcttaattcatttcatcttcatgggggctctaacagaaataagggccataacagaagagaaggctgaggcactgagaacttagccttggaaatgccccagagttagaggtcagggccagacagcctgattccaggatgcctgctctcagccagagtcccaccaaactgcctaagaattttctgggaaaaaaaaaaaaaaagaattttctggccacctaatccacaaaagccataaactgggagagaaaaattaaccatgttgatcagttatgtgctatttatcaattatttctatcaaagatggtccagcccattctcttgggcacctcatcttccagctcaccagctggtctccagtgagaacagggccagcacttgcatcagcgctaccgtagctgctgccatgacaaccgcatcctgccacccaggcacaggtgctctccccatctttgctccagagccctgattcagggatgcagctcctgagttcatctttctacctgcttccaacttgctcaagactttaccaaaatgataacctcctgggggttcctcaggtccctggatacatctggaccagactaatatgtatgaaggtggacagggaggtgggattcatgaggctatccagagctgcagagcaagtggctaacctcccgaggggcttcagtgctaggcagggccaggtctgagttctggctctctggcccttgctttctggggatcctcagcaaatgatgtggtctctaggaacctgtcttatgtgtgaaaaccagggataatattagattttacgctgcacagagttgctgtgaggtctaagcagactggagcatgtaaaggccatgcaggggagatgctggctgttaccgatgactactgtcaactactgtcaccatgcactggcccggtgctgatgctgagagaggtcaggagccctcatcctcttgctgccgccttgacagatcagcagcctgacattcaaaacagaaagtgctcctctgggcagctcatgggcactgatcccagggctggacaggcc

SEQ ID NO: 36128 - DNA, 954 bp, Bovine  19866881207030
agtaggtattaaaacctgcttttggtctctgaggaatacagatatatgtctgctctttgcagggttttttaccaaacacagtaaatattaggttagttttgtgaggctcctctggcaccagaatccttaagagtgaagcagaggatgtggggcagcgagtgttttctgtgttatttataaacctgaaagggaagtatgtaaaatacattcacaaggaatatatttagctcttaactttttttacattggtattaatcatgatatctgagttcagactgttttatttgctcaggattagaggaggatgtgagaatcccggggacaggggagcctgattggctgccgtctatgggggtcgcacagagtcagacacgactgaagcgacttagcagtagcagcagcagtagaggaggatgtgatattacaaagataaatacagactattaaattataatttaatatgacggctatatttttaattaaataaatgtgggatttaaaaataacaaatctcttcagtgttctgttataccttcaagtattatacatatatatgcttttgtatataggaaggtatcttataagaaaggctatatgttacttctactaaaacttctatgttagttaaatattgaatactctcttttagaagggaagcactgtagaaaaaaatgctaatcatatttttctattttttcctcttgcagtggatctgtacaataaataacatttctaaacaaatatatttaagtgaaaacccagaggtaatatttttattttatggtatccagatctggcaaaatttagtaatttggtggtttatatggcttttattacattttctcaagttctgtaatcttttaacttgctcctgaatgttttataatgatcttatgaatttaagaaaatcagtgctaactgtacaggagtcttttgctttcactaacttaattt

SEQ ID NO: 36129 - DNA, 1488 bp, Bovine  19866881257712
tgaaagtgaaagtgaagtcgtgtccaactcctagcgaccccatggaactgcggctcaccaggctcctctgtccatgggattttcgaggcaagagtattggagtgggttgcaaaaactcaaatgtaatagaaaaattcaatcacagagatggcttttaaacacttaaaactttctgaaataacactttattctaactcacatacaaggacattttggtatgctatttacacagttttcgtgaaagtgaaagtgaagttgctcagtcgtgtctgactctttgtgaccccatggactgtagcctacaacgctcctctgtccatgggattttccgggcaagagtacgggagtggggtgccattgccttctccaggggatcttccccacccagggattgaaaccgggtctcccgcattgtaggcagacgctttactgtctcagccagttttcttagtgtttcctaactttgggcttcccaggtggcacagtggtaaagaacccacctgccaatgaaggagatgcaggtttgatccctgggccaggaagataccctggaaaggaaatggcagtccaatccagtatttgtgcctggaaaattccatggacagaggagcctggtggggtacagtccatgggggtcagagtgggacacgacagtgacagcacaactttggacaaactgtgtgaacgtagccgtgtactagagatctgaccagagtatatggcacttcaaaataatactctatattctaatattctgaaatgcctgtgtgatcattgtctagtcagcaaacaccaaatttgaagagtcaggatgtggatgtttaacaagtatgtagaatttttgtgaccagagttcaatatagctagctgtagtgttgttaataatacaggacttgtatgtttttctcatgggcacgaggaagtcatattacactttgtttctcagctttttgttttctcagcttactgtcaaagtgtcaatatgtatgaaacgaaatcaaaaccagattttaaatggaaaaaaaaattgcaaaagaatcagattctggcttcaatatattttgtatctgtaaactgatgttaaaatgcttttaaaatgctatttaggaaggcacaatttggtagcttcaatttttcatttatagcttttagatcccaaaacactgccaccttttttttgcttcaagtacttttaagcacttcaaagttcaatctgaagtgcaggtaaaaccctctcattttcaaaattactaagagtaaacaatacactggatagtgagcagaatatgaaaataaatgcaggctacttcatcaaaagagaaaagttcttaccaggcttagagattaaagaagatggaacaaagggcttcatgactggaaaatcagagctctggttgaagtgagctctagctatctaagctagaagttaaatgcagaaatacaagatgacattatggttatcctgaacatgaggctgcagctaaagca

SEQ ID NO: 36130 - DNA, 2817 bp, Bovine  19866881273688
taaggttgctattgaaagtggagaggaaggaatacttttcagagtatacttcgtaagtagaattgacaagacttacggtaggaggaggaacgaaaaatgagtcctaaaattcttggatgatgggatggatccaggaaaaattaagagagctaagtagaggagcaagttttatagggagcatactgtcttcagttgtatacgtttttagcacacacacacataaagaacccccctggagatctgcttcgtctgaaaactgagagaatgaggggcaggagataaaagctggggagtcattggtgtattggaatattcttggtacttgatttggtattctaaggaaagcaggaaaagaggagacagaatgtattatgaaacaggtgctaaatgagtatttgtcatctgagtacaacaagggacatggtttaagtgtgggtgaaggaaaacaaatataagaaaagaggcacagtagggagagaaccagagaactaggaggagaatggtatgctgtgaactcaaaaaggtcaaagattaatggctaagctaaacccagactgttgtttgcttttcctccaggctgtagttcagtcactataccattctcagttatttgcagaattctgcttttaatgtgctttttaaaaagaaaatggttgatagtaaaacaggaaaactatcttatccaatattctgccggatttttatctcagaaaataagaaagctatgtacaattgctggcaatgcacttttttccttggatagtctcttccccttggccaccactaaaggtaacttaaaatcaaataaataattgtatttttaatcttttcactcaaaggtgaagtatgaagtaacagaagatgtctacacttccagaaaaaaacaacatcagaccatgatgcattacttttgtgcgttaaatactcttcagtacaaaaagaaaatagcattgttggaacctctacttgggtatatgcaagctcaggtgaataatgtactgtgttttggtttgtaactgtcctaagaactttcttttaattttgacttttatgttaaatgtaaagatattacaaactaaggtcagaatactcatttttgtctgtttttaaagcatttttaaaatgtcatcagtgtgctagcttaaggaagttagaagggttttctttgcaaatgaagatttcagatattttagggtaaattaaacacacttaccttggatttagaccttgtccatctcagctgaggacagggaacagaaagctaaaggaacttccgagctactcctattgctcaagcttccagtcactcttgttttataataaatctgaaagagaatggacatgcttgagtttgtctcatgttccttgcatacctcctgagttaaactggataaactcctaagtattccaagagtggtacatcaggaaggaggctagaaaattaagtttgagtaacataagacaaaatggcagtgccctaaaaggaagagtttatgaaatttgaatattcctttgaaaatgagtgcttattattcctctgatataaaacctacttacctttgtagtaaacatgaaatagtttatctgtgtgacttacttgaaatgtttgaaaataccttttctgattttaaaaacttaccatatgtatgtgttactgtataagaggatgcatggtgaaatttaagtgtagtctcttcagtgactctgctcagtaaaaatcactgtaaactgcaacctatttttacacaaatgggaatagcgctttttacttacctatgtatcttggcgattgtgtatatgattcactctaagtattttgtttgtgtgtgtgtgtttctgttgttaaccttcccactcccacaccctgttgctccagataagtttctttaagatgggttctgaaaatctcaatgaccaactggaagaattcttaactaatattggaacaagtgtacagaagtaagtattttcttccttaaaactgaaaatgaaggttatgagaataagctaacagctaaataccataatctaaaaatatttagcacttaatttcagatgggctgttttccctgccatgggagtgtttcttgagtggcttgtggatgcttcttggttttctcaccatcttttccacagcatttgaactctgaatttcataacagtgtcaaatcggatggtattcttattgatttgaaactatgttttgtgtctgaatataacaggcacctaatagtaattatccataagtgaattatcttcacagttacctgaattgtagagtatggatgggagattattaaataaatcttgcttttccaagccatgaaagtttaaagagagaaaaagcagttctaatcagcttcaaaatcctagcattcatgtggttaaactgtgatatggagagagatgaaaatgattactgtttaaaggcacaggacagagcagtttgaaaattcctccaaagtgagtcattcggtgtggattcactagctttggaatttggtattgttttcaaaatatctaaagtttcaaaatgtaaagctgctataagcatgctactttaatcagccacgctactgctgttctttaggaaaacatacagaacaaatatacagataaatgagattggtgaggtgttctttgttgtggttggtagtaaataatctgttctctctgttagtgttcgcagggaaatggacagtgatgtagagaccatgcagcagacaatagaggacttggaagtagccagtgaccccttatacgtgcctgacccagatcccacaaaatttcctgttcatcgaaacttaacccgaaagg

SEQ ID NO: 36131 - DNA, 1426 bp, Bovine  19866881315483
ctgagtagtattcccctgtgtgtgtggatgtatgttatatatgtgttccatatatatgtatgtatatatgtgtacacacacacacatcttcttgatccactcatccattgattagtacttaagtcatttccgtatcttagttgttgtaaataatcaagcattagccttgagtctttaaaagatatccagggaaggtgcctttgtcaactaatttaatacacattggtggatcgccttctttgtgtagagcactgggttatgctggaatccggacacagacattgtgtttcagaaacaatacagctagaattattgtcatctgtgattttgaggccaatgtagaatatcatatttttttctagaaagtgttccccaatctctgctattctcattgcccatcttcccaccttcacccagcagtctccttggctacgtgttgtcatccaccaaacacactgttaggaggagactttggaggacacctggaccagtgagtggtcttgccttacagacaataaacctgagatccagagcgagaaggtgagatgcctaaggtcatatagctagtttgaggaccttaaaaagtagataataactaggtaactaggtaattattctctagttgctccatcttactacttacacatcagataagagaaaggtaataacacttgaaagtcttccctggtggctcagtcagtaaaaagtctgctgcagtgccggagacctgcagtgcaagagacctgggttcaatccctgggtcaggaagatcccctggagaaggaaatggcaacccactccagtattctagcctggagaattccatggacagaggagcctagccggctacagtctatggggtcacaaagagtcagacacgactgagtgactaatacacacacacaaaaacacttgtgatctggcaacttctcataaccttttatagaacagacttctgtaaattgttcacattgtagtaaagctagaggatgtacacagatgtaagttttagaactatttaggcttaaacttgcttttttttcccttcacagaaccattttgtatctgtgaccaaggtatccggacattttcaacagagaaggtttttaaattcctcatttgggttattttcgtcaccaaaatattttttatagtatatcctaaagtgggcatcacttggtccccctgatacacagcagagatttgagagccagcactgtgacaacagagaggggagacgccgcccacaaagccaaccaggaaacagattcaacaggcctcacttcccactcactccccaaagctgagcctccacccctcccctcccaaaaaggggcaggaagaaggttcagaaaagataatgtgcccatccttcaacaaagcttggctcaccctttgggtcctccacactctcccgtttcctgtg

SEQ ID NO: 36132 - DNA, 1619 bp, Bovine  19866881338272
aaattggcattctctgggtttctgcaaatacaattatgcaaatataaagtctatgaattaaaaaaatgtattattatctattcaggcattaccccctcagagcctgaaggagaaacaagaaatccagtgtgaaaggaggcaagatctgagagcaagatcttaaaggcaagacattttctttcttcataacattaaatggaaaaggaatagaaaagtaacatttctgtactttaatacttttggtgaaaacttggtaattggttcttagctatttcaaacagaactagtaaccagtcaacagagcagtaacaggaacttccttgtggaagaaataaattatctttttcaatggaaaacaataactaagttttttttgcacagcctggatccaattattagcaactctaacattttggattctggttacaaaataattatgcccaaatgacatttggccaaaatgcaacctagcttcagatgtctcaggagttgagttgtgaattaaattctaattaaatgccaaagaatcagaaagaaaataatgaccaagagacagacactgacatgggtgccacgcatctagtcccatgaaggaaacactaaggcacttttaagttttataggtatggatcctctttctcaaaaccccacattaaattagagatgcaaatagttgtttgcagctgaccggaaagttttgaactttgaacgtaatacaagatctcacaggaccaagaacatattattagaaattaactttctaatctaaagaaagatcccttacacgtgtctttacttagctgaatcaagtctcacggacttgcaaatcttttcttaccatcataacatttacccagaacatgcacgcctcatggacgtgaagtatccgagtttcccatgttaagtcctcatcagtgaaagcacccatgtcagcaactgtgggcgtgaacttgacatccgtacttgtatttaaaattgttaggttgcacacatgacctcaaaaaccctgctttagctgtgttgattccagaggcccaagtgtgacctccagcccttactcgtgattctccccaagagacgaatcaaacatcaggagtcactaatatgaatcaatctccttcctgtcaacattcttacctataaattatggctcgtaaggctaaaattgctcataattctatataattaccttctagggcatgaaagcagatgctcagagggggttctacatgcttcatcagaaaaaaaaaaaaaaaaacccaacctgccctcaggaaacaatttggtctgaaaaagtcacaattccttgacagaagggcccaaaaaggtgcttgggttccagctccagttgaaatgacttctgatagtaacaggtatcagtcactgagggcacactgaaggccagatcccgagatgagcagttacaagcattacctcacttaagtctcaaaatggtgctgaggaagttaatcattacttcacatgatgagaaaaccgaggtttcgaacagtggagtcgttggccatcgttcacggctgatgaggtgggggacagggtgagaactcaggcccccatcagagatggctgactggagacgcccaggcccatctgagacacag

SEQ ID NO: 36133 - DNA, 1385 bp, Bovine  19866881362247
gtccccgcctggtctggctggatgcttctggcagcttttttaggatcgtgcagactttgaaagtgtacttagcaacaccaggtggcacagctgctgctctggcgggtggcaatgagtcatgtcctcagacaaaatcaaagaatcagtggttttcgttttttcaagcaccatgggagtgtttggattcagtgggtgttgtgggtgtctttgatgaggtagtgttgggaacaaaagttgtacctttgtcacgctgtgttaacatccaaaggtgctctgcttatcactgagtctcttggtccctttggcaggtcctaattggattctttaacagcctggctgtgaatgacgccccctcaagttcacatcctcctaagagttcctcttccgcagtcaccttgccctctaggcttcttctgaaaaagaataaaccccagattactgggtcattgtttggtttcagatcactctgtaacattggaaaaaattttgaactaacctgagttattactgatttaggtaaactgtcagagtagtaaaaaagtgaatgtctgatacagcaaactccagaccttacataatcctccaaccactttaactcaaaagcgagggggtgatagtgttatacataaaccccactgcagcatcttaacagttttccacacagctaacctttgatgtcatctgtgggctttgaggcacacatctttaaatagagtagatttggctaactccgagcatgctctgtataatttgagaagatgaacttggaaaaagaaagaaacaaatgtttaaatctaactgtcctggttctcccaaccctctagactgcaccacttacttgaatccagtggggaagcacatgatcgctgacgcccagaacatcaccatcagtcagtatgcctgccacgaccaagtggctgtcaccattctttggtcccccggggccctcggtaagtggtccaagtggagtctacgatggtgggtggtacccaatacagaggtcctaagtgcagtggcctcctggggccaagtaggtcttgacacaagtgtagcttaggtgtgcctctgcacagacactacttgattgtaactcttgctgcttcatgctgtgcttcatggctcatctttttttcccttggctgttatcgagagagatgtaggtttgtaaaataatagtgtgtgaatggtaaatgtcactgaggtctttgcttgtgtgtctcagcaggagtggggggatgagtggcctagccaagaatgtaatggattcaggatccagcatttctgtggccacatcgagatgcaccagcctagccttggcacattttgtgagttgtcaggacaaccccagttttcaggagaaatcacggaatcaacaatttttaaat

SEQ ID NO: 36134 - DNA, 1156 bp, Bovine  19866881364072
aattttatgtaatgttttattttccctcctttaaaacactaacaacctcatataccagcaggtcaaaatcaattatatttattatattaaaaaaaattttagtcatttgaagtactaaagtaatacagtacaaagcttatcataacagactgagtgtcttaaacagggattcttaatctaaaatcctcagaagcccaaggattgcatggattcaattcagagcatctgtgagcttggatggaaaaaaaaccccactgaagatcaattttactaacaagtgaaatttagcacttcctttatgaatggagaccacaaatcacagaagcactagcagacccatgacgtggtcaccataaaaatcactgtgttttcaaatcacagtgtggctggtgagggtatttcaaaatatcatttactcttatcatttcatggaaggtgtatgagatgttggatttgttgccagatcttgttacttaatgcactaattaagcacatatgtaactcttaccacaattttgtttttaaatattttgataactatatttcagtaaaagtgggttttgttctaatcatatattgtattttaagcacatctaaacagtcttggtggtggtgggaggttcatgggtttcacaagatgcaaaaggttaagaacccctggaactcaaccaccccttcctgtaaacccattctcccaacgtaaccactacccacaatgtagtgtatgttcctccctgagtgttccttcaagtggacacatatatacataaccatctagaggcgtaacttacacagttatgtgctctgtaatcacgcgttacacttctattttgcaatacatttacaagtctctatataatttagtcactcatgctgtttccagcttaaggctattattttaaaacactgtaataaaactccttgtatacatctctttatattctgttttttttttaatttcataatcagttctatgtatggaacatttgtgacaatgacatcttcaaattgaaccacagaatcaatattgtattatgaaatcaacagcaacaatagctagtgtattttgtgcttaccaagggccaggtactatatgctctacatgaattaacttattttaatccttataactctaaggcaagacactgctatgatt

SEQ ID NO: 36135 - DNA, 1032 bp, Bovine  19866881364431
tccaataaataccagtcaattgaattagtgcatgaatcacttcccatgagtgcactaaacaataaacaagtgaactcattaattctatagaaataaatatctccttggatagaattcatacagacctggctagcaaaagcatcactttggcaaataaaggcgaagaagatactttagatttattgacttttgtgttcactagaagatttcagttttagaggctgatgttttgaggtgtgtgggagtaaaagaaatctcatttatgtaactacgagaaaaaaaaaaaaaaaaaggttagtctgctaaagaaagaaacaaaataaacactttcaattccctgcaggatttctaaggagttaacccaaaactttgcatttggatcactgaagataataaacctgtgattcaaacacttcaccctcagctctccacaaaatgagccaggcatagcagtgttaagttagagagctgggtggaggaagacatgcaaatcctgagtattctcatggatcctttttacatttgtaaaaagaatctcatggattctttttacatttttcaaaagttcctccaaaatacaagtactaatccaataatgtaaaaagtttatatacaataaatgtttagggaacaaagtcaacccaccaccttttcttcacagagaaggggcagcagacacaaataagaagagaaagaagaaagagaaacagcttctgttactgaaactaggactatataaccagatcaaagatgaggcttgatgcaattacataagtcatttagaggaaaaactcaattaggtgggaatataagcccggatggtactttctaaccaagattacttatgtaattttcaggtggacagacccagactatgtttcagaaaaaaataaactataagaaaggtatttgtaaacaattattttctagtgactttttactgcaaataatctgtcaaaatagaattaatgataaactgcaaaaatttaaaagcagttgagatgtaatctggtcaatataacaagacttttc

SEQ ID NO: 36136 - DNA, 1437 bp, Bovine  19866881364912
agaatgaagccagcgatgaagggcaagatgccaggatcggtaactgcatttgcatcccaggtaaaaagctgcctggatttttcagttacatgagggaatgaatttaatttttgcttttatcaaaaattttactaaataatcaatcctaaatgatatactgtctttcatcatccaggtgtctctaagccctcttcctttatttgcagtgttcaaaaccattcatcctttagaccagctcacatgctacctcatccaaaaaccatctgctttcttatgttaaaaaaactctctcccttttttgaattcccggagcattttacatgttggtcttttatgacacatcccttactatactgaattacataggttatcatctgagggctattggcaaactgaaggcaacctggcaaccctgtctaatgacaagatgcttttgacaaagtgagtctcaattcacatctgaatgaacagatgaatcaataaaatgaacgttgtctctgagtgagcagcacactatgggaaggagtcagctttgcttcctgggaagaagagaacaaaccactgctggagatgctgcaactgtacaagctgccagatcaagaagaggtaaagaaagagatggagctcagtaagggtacaagccaggcagaacgagcaccatgcagagaaagctgtaagaacccagaaagcaagtatatagaacattcccttgctcacttcaggtcttcatttagccaagaatgtcatgaatgtctgggtcagctacttacatatccataaaatctctgaactagctaccatttattgtttagtgtatgccaggagctaggtgatttacatgcatcacctcatttagtccataattcagtgagttaggtattattcctcccattttgccaatgaggaaatcaaggtgcaaaaagatgagtatcttcttcaaagtcacatacatactaaatgttggatcctggatttaatctgagatgccagccagtgtgcaaaaaacttaaaaaaaaaaaaaaaggcacaggctggaggaaaggaagataagcagggtgaacggtgagagagaaatgagaaaaggggggaaaaaaactccagaccactcatttgtttaatttgttaattctaagaaccattaggaggtgaaaagacagtgtcttcaataattattactgggaaaactggacagccacatgtaaaagaatgagattagaacattctctaacaccatacaaaaaaataaactcaatatgcattaaagacctatatgtaagaccacacagtataaaactcctagaggaaaacacaggcagaacaggcttgcacataaatcgcagcagatttttttgaatctgtctcctaaagtaaaagaaataaaggcaaaaataaacaaatgggacctaattaaacttaagttttgcatagcaaaggaaa

SEQ ID NO: 36137 - DNA, 1551 bp, Bovine  19866881366232
ttcagaatctaaaattactcacttactaattgctgcagcctgaataatgatttatggcaagaattctaatattacttattacttgtcatattctctagaagaagccttttggctgtggaggatggcaggggtgaagggcagcagacagcttatctcacctatgattcacctactactaaagagtctttgcagttgaaactactgaccttgttctgtcccagcgggctccatcaagatataatccatggatataaacaccatcttctggtgcttccttagaggtatcagaaggaataacctgaaggcagaaacaaatgctagtagagatttcctccctaggtaaatgtctcataaagaaagtattacctaaattttcagaacacgttcagagaaacttgtccataaaatagcttcttaaactatacttttttctcagtgaaatgtaattttaaaataatacagttctttttaaagtattttatctggttttactgtacatcatattgatttctgctaaaatagaaaagcagtgttggattatttgaattgaatattgagatgtataaaaattctctcatggagacagcaaggcaaatactatatactttcttcataaatacaaagaatggaaagaagaagaattatttgcaatgggcaataaaaatatgaattcttcatgtcctccttgcttaaatacatgcctttgaagtaatgatatgctctggagtttaaggagtttactgtacctcaaattcatatcccagtaagtcaatagggatggtatattttctggcataattctgcattgctccagttaaaaaggcttgggtaaaaaagaagcctgagagccaaaacacacaaggttttcctgaattataccagtcctataaaggaaaaacaaacattatgttccttttacttcctcaagaattacctgacatacaattactgattctggtttctgtgtatgctgcccacactttccatcatgggactctctttcctgacaccaaacatacaacctttattggccctcctacctttatcccttttagttactcttcttgggaaattcaaactaattttaacattaacctgaataaaacaaactttacttgttgtgaaagattaaaatcttctgtaaaaaggcaaattaaattatttgagggcttactatattacttaatcccactcaaaagcagccatctttagaaatcctatatattgtctaactacagccctcatgtattggttccaattccttgattctcttaacctccttgcctccacaccacgattctggctccactttagataccctggtcttctttcccaatcatgtgtacctctttttgtttcttccctttctctgttcaatacatctataatgatgctgccagagtacacctctccatgcatggtttggatggctcaacatctcatacaatacttcagtgatctactactaccctaccaaagtaaagcctaaaacaccctcaagtctcccattcaagatacttcataagctggtcccagattggatttatatat

SEQ ID NO: 36138 - DNA, 2698 bp, Bovine  19866881420808
tgatgtcaagaggagtaatatgtgcattcattgtaattgtagttttcctgtgcatttgaagtgtgggatagtaaaaagcaaaactcaaatggacagagaatgtatttgatttcatagtctaattatcattttaaagaataacagactctaagagtgaaaagataagttacaaaatcaaggcatgttttctctggcaaccatctttcctgctgataccaagttatataattcgattccaggagttagagacatggacgtgactggtttcacttgaaaagttctcatttctataggaatgcttgttcactgtcagcagcctcctcatttgtcctagcatttcatatgctctccttgttagcatgctggacttgaacagagcagattggattctcaaaacaatatgcccagtgtgcgaccagctctgtaatttgacgggcacagtacaaagtaaaaatgagggaccttttgtttaaaaaaagtattaagaatttcgagacaacagagtccttctcaatgcagaccctgtgtaagttcacacgcttacgaaattggccctacacaaagcccagcagactccaccaatggtctcctcccaccaaaccttatatgctgggcatgcttggtgggaataggcgtggaggaggagcaggaactctagactcattttacgagtctctttactccatttcaaccaaatgtcttaggaatgcttgcaatcaaagattccatctatgaagtctgtgaattattaccattcagtgagatgcttttgaccattatcaatgacactgctgtatagttatagaacaatacatttatctgaaacaaaagctctaatgtagcttattaaaaggaaataaaaataattatattaatattaaaaaacaatgatttaaaatgttagtcttctcaaaataaagaatatactttaaatattttttaaaaaatcactagatgaacaaaaccaccatgtataaacagtctctgatattttgattggtaactaagttatttaaaaacaaaccccaaatataccagtaaaaattgagaaagaaaatgcctcatgtggctttttgacccatcccttttattcttaagcatttgctgcattccagctaacattcttaaattgattataaaaagcaagagaacgctcccagtaatcaaaagaagacttacacaagagtgaccgaaaaaacacagtttcttatcttcttctttctccccctaatccaagctttttgctattgatataaaatatttatcctatctagcaactgaacaacagcaacaacaatagtatttatcacgtttagtaataaggctcctagtgttgatttttctatttctgataatatgatattttaaaaagggcatgcctcaaatgggcttagaaaaacatctggaaggatatagctaataaactgttaacagtagcttgccctgggctgaggatttgtgatgaggatagagagaatttttactttccttacttttgcttatatgaatatatgcaatgaatatgtgttcactctatcaataaaaaaatcaataaatttttcaaaaagaacaacaaataaagcctatactttaggtctagcatggcgatttagaatcagtcacttaatctctttagtctcagtttccctacctataaaatggggttagtaccacacagagatgttatgagggaaatgtatggtaaatacactttcaataaatgttccttctctgagcctcaggttctttgcctgcagaatgagggaacttgattagtcgtccatgatctttctgaaagttaatcttcggattccttctttttatattcacagaaaaagactgctatgtgaaaaataaatctctttatttgtgtgcaggtaattgtgtttcttttatttcctgaagaaccaggaagccaaaaaccaatgagcagcacctctggaatgtttgggtaactccaccctgggcacctgggaaatgacagagtatttccactcattagaatctccctgatcagagggggatgggtggtgcggggagagcttttcttattgtgaagaagataaacttcagtttcaagaagacagtgtgtgccattaaaaatagtatatcctctcagttttaatctttgactactccagttcttctctttaattagttcgcttacttatatgtgtttgcaactcagatactctccttaagcagttatgcaagttattcactatatcatctgccattggttaaaatccaatttgatgattatcgaacgcatattaaatgagtttacagagtaaactctgtaagttgagttgtctcttacacatctgaaatgctaataattgcctatctttcatggtacttgggaaataattttgcagttcttcctttctttttcttagattgaaaagtagcatggatcatggcagtggtagtaatgatcagtttatttaaaaaataaaaatcaaagaggaagagaaagctactcattgggaaatactatcattccacatttctcaaaacataacatgctttttatttaattaaagtattgtatggatacagaatcatagagagcaacacccacatggcttagaattcaaaatatctcatgtttgagatgtcttaatttaagccttttttgtgcctaccaaataccagtgggtgaagaacgccttcaatgccattttagcatttccag

SEQ ID NO: 36139 - DNA, 4020 bp, Bovine  19866881456963
gaagttggcagattggcctgactcaagccactgcatggctcaaaggccagaagaagtgtctggcagcatggctgagggaatggctttggtttcagcagcttagtttgaatgaagattctatacttagatttgtatgacacctatcttctcctgttttctcatgaggaaaagacttaacagaattgttgtgaggatcacacaaaacaatcaaagtgagagtaccaactgcatagcctggtacatagtagacactcaccaaatgttaacctcactatattttcctttaaaagcggaagtttgcaaaagatgtttgagtgacctagtaactgtgctagtgatgacagaagtcaaaagctttcttggattttttcaggcccacatctttgggtgctgaatttcagtagttttctttgtgtggcctccttgtctccccagtgacacagttggggaggctccccgggcagctggtgctctcattgtctagggccggggggtcagggttctggcctccgctgtgctcctcatgtctgttcatcgttcacactccctggaactttaatcttcatgcgtgcatggtggatccatctaacattagggcctggtcctcctcctccacagacactgcaaaacccactgttgtgagatgaagcttctatgctaagaattaagaactggatcatggtgctggctctgtctgtaactaatgatgtaatgttgggcaagtcagttcctctctatgggcctcatctgtttaaaaacaattttgagatacagtctttaaaccattgtaaaaatgtgaagctctgttgaacacagattactgggttctcacctgataacatttgtttacccatataagcaatgctctcttagttatttttaattgcggcagagttttctatgatgaacatagctgtggtggagggagcctgcgctagctaggtaaatgtattcgcacatctttatttaccacatggtgtttgttccagtctttagcccatcatatcggtgggttggaccagtttattctgttgctatggtaataggacaaaaaagacgatgttattcttgcttactggaagaagctgtgtggccagcttcttcttactcattgaaccttttattgttgacaagtgaagtctttgaaactttctttattgacaacgagttttttggtgttagcaaatgtttttaattttgtggcaattattagaatgattggtgttcagaatatatagagcccttagccgtcatatatccagtcccctcaatttgaaaatgaaaaagtagaagcccagggaagtgtagtgatttaataagactttaacctagatcatttctaagatcattcctcatcctatgttttttcctgaactatgtttatttttcagaaaaacacgtctctagaagctttattcaaagaactactaaactcttttatatgaaaggattatttgcaatcatgagttctgatttggttttcatgttgatcggcatccatgagcttaccttctgatcagagtcatctaagctcatataatgaattatttgatgtcttttctccttatgcacatagaaggtgatggcaccccattccagtactcttgcctggaaaatcccatggacggaggagcctggaaggctacagtccatggggtcgctaagagtctgacacgactgagcgacttcactttgacttttcactttcatgcattggtggaggaaatggcaacccactccagtgttcttgcctggagaatcccagggacgggggagcctggtgggctgccatctgtgggggtctcacagagttgaacatgactgaagtgacttagcagcagcagcagctctttacacagccacaaaagatacatctccctcccttgctgtatctcttaaccatatcgtatcatgttttgtcacagtaaagagactttcatggaagagtctacctttatgcttagggattcacctgtggccaaactcctttctgatttctctgttattttttcctgtttcttggcaaacagattccagaacctggacagtttcctccaaatattatcatgtgatattataatcattataaagcttaaaagaatcctagaagctgttggaggacatgaaaactggtgttttgcaagtttactgacagtccaagctgtacagagatgatggggtatgtggcagatacacatgtggccatagaggaagtactactgattttcagtgccttgcacctaacaggtatttggtagagacgagttgaatgaactagtggatagagccactcatgagaaaattgtagccataaaggctgcaatgtctgagtaaatatctgagtcccataaattaataaataaatggctttgtagtctccccaaaggtgctttttaaatggtgatgttcagtagagtcacagcagcattaatgaagagttgttttgagcctatttctatgtgtagtggaaagtatctgaaaaaaaggtgggttccagtggatgactcataccggaagatgtgagggcttgggaaagtaatattagtaactctcaattttgattccacttcataagtggaaagacggtcaccagatgtatgcttgaacatgaagttgcttaattggggacagggatctttgggggtcaagtttccattgagtcctagcccaatgctgtacaatgagctcttcataaatacttattggttagtgaattttaacaacaatgaaaagagtggatcttcccagtgtgtatgtggaattcaacacatgtacccccgttctagaaatatatctgtggcctaaagttgggaagtattaacacaaaaactttccccttttgattaaaagcacatattggtgtctgagtgtggataacaccaaatattctcgttgatatcttgctttattttaaagcctcagatgacaattctggtacgtgcctgcgaaagggttttccttctgaactcctctgcaacctcctattgaacttgaacttagagaccaaacaggagtgggtaagctaaggaaagagtgtcccttacagaacagggatcctgttgtttgagggccgggtgtgtcatggactcttaagaatctgatgatagcactgggctccagacaattttacaagattgacatatgattttatgggtctcacagagcccagccaacaccccaagtgaggaattcctcttaaaaaggaaactggaagggtcctaaggcatggtgacgtatctccgcagaattattctcccaccctccacctccagcacttggtgaaaaatgaattgtgactggagagtccacactattggacagtataattggtcttttttttttccccaccactttacgcagtccactggctgagcccccggcttcctggcaggataaaacgcaaactattccagaggggggcgggaaaagcagactatattttttaacacttttgagaacaatttgcagagtggagaatgctcccagaagccgcctacaaatcttctctcacgtcagaggatatgagtgggatggtttcagggacaccgcttcccccacagcacttttctcatttgaattcgagggggcgagagactcccgagtaaagagctgggtttcatggtccctcaagcaaggcacttggccgaagagccaggtgtgaccctgatgcagggcactgcttagcatcaaacatcctttatcaagaaatatacaaatgttgggataggcctaagaacagtttccaatgaagaaacagtgtaaaagataaaaaggagtatatgttctttgttgcagatttggaaaatgtgagcactagaattcactatactcttacctcaaagtagtggctacatttttaatgtattaactttctagagttatatacacactcacttaaaacttttcaattatgaaatatttcaggcaaagtggtataaaggataatgtaaaattccaggtagctaccaaatgcaactaaagacatgtgcccttaacgacgccacaggcccttaaaaaaat

SEQ ID NO: 36140 - DNA, 641 bp, Bovine  19866881575104
tcccccgcccctaactgcggcggcgcccttcagacgggattctctgagcagagcagagcatggtttccctcaaggaactcctccccactacttgagctgtatgacaggaagtgacagggggccatcagttacattgtcagaagccgagaaccacaccagcccagagctccccacctccagcggtttccttgccggctgctgcttttgcagagcaccctgcctcctggcattcaaaggcacaccagaaactcagtttctggctggcaactcccagcctgtaaggaacaacaatgcttaagtgggtccccacctaaaagccatgctgggcattccggcagctctaaagggctcactgccaggataccatgctttgtagacccaaacgttggggtgaaatggatagagaagggacactgggaggagaactgtgtgtgtgctcaaagaggaatcaacagtccacttgaacttcacccaagagtcagggccctgcctggcatgcaaagtctatgctgaatcctaatttcatagcaactcaacaaatgagagtgatggtaaacaccccacccatccgttcctttctttttttcctagacaaattttctcttcagagccccttaaaagagttgcttctggaaacctct

SEQ ID NO: 36141 - DNA, 2245 bp, Bovine  19866881794490
tgttcttttaatttccttgcacagggtgttaactgacccagtcagcaacacagaaggagtctgcagtttaaactttgggcccagtgcaaacacgtgacagggtcactaggtcatgtgctcattcgctgtgttcaccgagcacttccgatgtgcgaggccctgctctgggtgctaggatccagcagcgaacgagccaggcatgctcccttcccactaactgggaataaaaagaaaacaacatattttagactgtgatctctgccgtgaatgactcagacaagctgcagagacagagaccagcaggagagactcacttcagagagatactttaattttctgttttcgggttgactttctcatgagatgcaagcacacagaggcaggatttggtctgtcatgatcacattcttagaacaggctacagtacctggtacctagccaactcccccagaagagtgtttcttcatttcttgttgttgttgatacttctgaccccgctgcctttgagaagcttgtcttcttcactattatccaacttcggggaaggagggcacggtggaggggaacaaacggggtacccattccaccagcccagcaccacccttccgtgcgcatcagaagtcatggagagatgacccggggcagctccaagggaggaagaactgtgtgtctcaaacacctgcatttacatacttggtctcatgggttctcagcctgtttgaagagccagagacccaccctgttattcttgtcccagtcactgaggcgaatgcacagtccacttccctttcaactatgaaaaacagtgcaccgtgggtgagcccagggactgtgctggagtctgggctctctgatttgagtgcataacttaaaaccccagcgtcctgtgctgagcagcaggtcaatgaataatctctgaatgagtgactaaaaaaagaataaataaaggaggcccgtgttcttggggcgacacccttcccttccgctaaccacctggctgccaaaattaaatcaaaacctcaaaagcaaagatcactgaaggctaaaattcttcaacctcaaatttccttggggactcaaaacatgcaagttcatgctataatttttgcttttcaaataagagactctttttcttaaccagcaggggcatttattttccttaaattatacagataagttaaaaaaaaatgacaacttttaccaattacaattttaccaataagttaaaaaaaaaattcagacgttggtccaagtggaacactggtgattttcactcctaatgtgagaagaagtgtcaggtctgttcaagggtgaggcacacacatgactaggcagcaagcatgcacttccctgagtaacaccatgcacacccaggctctgtgcttcaggagcaacgagtccaggattgataacagcccaactgaaatgaaacagctggctgaatccaaccataagcgacctgatttggcatctgaaccctttttctgaacacctatctgagtcagggaggaaaagcagttacggaagggaatgtacgggaacaaagggctagagtatacggtctgattccttaaccctgcaggctacatatttcatggagatgctttctagaggtgctcgggtgctggaaaaacctcatgcttcttggctcaaaaaccgaccaggaggctctctgttaatctgcaacagggcaaagtcttctgtacatgtggatctgagttctaatggagatacaggtctctctggacagatggggaggactctgagactcattcctggtgacaccatccactttcacagcacatcactgttctccaggcctctctgtgaccacctcctcttaggcttggctaccttctgacagcacaaggcagacacataaatctcatcagtaaatggtctgggaacaagtgtttttctgtggttccgggtaaggctctctgccaagagcagtgaccctacctgtcctcagctgatggatttgcagaagagctggtcccaggtctaagcctgtctgattcttattaggctcagcttacagtctctctagacccaaatcttgggatcctttgaggttttgagtcttggaagcagaggagaatcactctcagatatacagtgggggtggagagaagtgggtgcaggaactgggtgtctgctatgagccactcactgtgctcaccatttaaagaactgttcctttccagcttctcctcagcctggcctcagtgagcatgcctggtgt

SEQ ID NO: 36142 - DNA, 1243 bp, Bovine  19866881871359
atgccctgagtacatttcagatttggaatgcaaattgttgtctgtagtaattatagtttgtgccatggccctgctcggcccccatggtcattatcttggtacagaataagtagctctgtgctttcggagtaggaggtaatgagggggagaggggcatgtgaaggacattaaggggtgttttcagaacctgtctccaagcctgtgtgaaagtaggacagacacagatgtgtggtgggatgctgccactgacaagctcagtgaccgtgggccaggacctcaacctctctgagccccactgtcctccagtcgctgtctcagagcgttgccatggtgatgagatgtcagtgatgcgatgggacattcagcaagatgcctggagaataataggtgtttaacagcagggaatctcattgcctagcaaatgcctgaagggtagggatctggagtggaaaacacacacccttcttaaaaggtaattcctgtgcacacaggagtttcctctctcgtcctgcagaggagctgtggtacatccttctcatgcttcttgcgtctgcagaacttgagggctggcttagggtgctggcttgtatcagactttctgtgtgtccttcagtgattccattaacatctcagagctgtgggtcttctcacttgtaaaatagacatcataattgtatatgattcacatgactgttggaaagactttctgtgaaaacatgtaaatttcagcaccagtgcttggtacaaactctaagaatttaatattgttatctcctttgcagagatgaaaaactcaaggtttgaaggactaagtaactttcccgagcctgtagttcatgggtggcaaatcccagactctgacccagcaaattggctctggagtccacattgatgtcattgttactttacccgaaggggatcaaagtctactgaggctcccctcctcagacccttcatttttgttgacacattctttcttcaattaggttacaaccaatcataataaaataattgtattattatattaggtaataattacgtgttctgtagcacagtgttacgtaatattgggttagaccaaaagttcattcaggtttttccattacgtcttacagaaaaactcaaccgaactttgcggccaacccaatatttaaaaataaagttttattcaagatacgtgattatatactataataaatattatatattttaaataatgatagtagcaacagctatttgcata

SEQ ID NO: 36143 - DNA, 1077 bp, Bovine  19866881917235
gcttcattacctcctaaggcaatccacatcctgcctctccaggtcacagcccggcagagagcggcttcacgtccctccggaaaggataattagctttctaccctttaatcaaggagtagcagattgttgtttttctgaagttttgcctggggagagcctgttctttcccgagcgtgtgtttttctaaccaggactccttgtacgcgccttaccttccaatgagccaacagtgagagcactgaccccgacccctcatctgaaataagaaactggagctctccactgatgagtcaatggcccgcaactccaaggatgtggaatcaggtctcggtcaccccagtttatcaacaccactgacctctgccttatggaccaggagaatactcaacttctctgtcatgaaaatgacacttttaaatgtttatttatttttttttaacacttactatgtaccactatactcagtacttaataaatattaactcatttagtcctcaaaacgattttacaagtaggcattgctattattcccacttcatagatgaggaaaacgaagctcagagaggttaagtgacttgccccaaatcacacaaccaggaggtgcagagctaggattcaaacccaggcagcctgcttccagaaaacctggaaagagaaacggatgtgaaaaccaccgcagaaccagtgacaacagaggaaaggagacgggaactaagatgcttactacgtaccagacccagagccagtgttacagggttggttcctctttatgtgaaatgcaattaatcttaaacaatgataataaataatcagagattagtcttaccagtttttctacatctgcaagtaaaaatccattcaaattggtacactttactgtgtgcacattatgctttgattaaaaaaatagttgcagcttgaaaaagttagtggctggacttccttggtggtacaggggataagaatccgcctaccaatgcaggggaccagggttcaatccctggactggttaagatcccatgtggcacagagcaactaagcccatgcaacacaactactgagcccgagctctaaggc

SEQ ID NO: 36144 - DNA, 1245 bp, Bovine  19866880444876
aaaatttcatggatagaggagcctggcaggctacagtccatgggttcacaaagtgttggacacaactgggggactatcactttcacttaaaaaaaaaatatttatatacacacacacacacacacacacatatatatatatatttgagtctttctattaagttagtttgcctgaaaaaggtggtgagcaaatgccagggttgtaggagtgaacttggctttgtacaataaacatattctttgaatttgaatgtaggtggactcatattttaatttcacagaatagcaggttactaaaagtaatcctgtgtgaatcactgtactttgaatgcatataaacacttctaaagtacgataggcttggaatttttcaaactactttcttttttaaaactgtatagtaatttatgtgaaaaaaatagatcagatgttctttataacagtataaaagtatataacatgcaagtactaaatgtgaagacatttgctttcaaaatgtggtagatatatttttccttttctgccttctattctaaatatttaataatgccatgaaaaaatttaaattgccaaaaacacagtaaaaagcccttttaaaatgacatatttggagttagttactgatcatcatttcaaaaatctggtttaatatccctttaaatataatatttaattaatgaagtaatgtagaaattctcccctgctctctcttcattcatattatatacataatatatgcatagcacgtgtgtgtgtgtgtgtataatatacacagatatacatgtattttgggacatagtcagcctgaggctttattgtgtgatattatgataattaaaatataaaattgctctttggaacaaaatagataaataatttgtctctgtcaatcagaatgcacatgttttgctgttcacttgaagtattgagttaaaaacaagaaatcacagtagaacatctcattgacattcaataggaaaatagtgctgacagaatgctacaagaactacagtggatccaggccaagagagtaaattaaaaacagtcttatagctgtcttaacattttacaaggcaagcagtatgatcaagttgttgagctggcatcataaaatcatttgaaaccaagattcggtttctgtttaagatacacactttttataaccttgctactttgattaaacagtacaacttgaagctttgaaagtaggacttctatacagattgcatacccacagcccactcat

SEQ ID NO: 36145 - DNA, 1017 bp, Bovine  19866880752303
atacacagcaatacatagcatagtgaaaaacccttgaaatactattgggtaaattcatctgcaagcatgacaaaagtatgaccacaaaataagtattttgatccattatctttaagttccctttttattttcaccttacgttttgttcactggagtcagttacaagagtggtgtccagaaatgaaaatgtctgtgaaatcaagtgaaaatagattttttagcatgtatttatgcacaagtactctttgtgtaaaataagaaaggaccacagaggttgtagacatattatttttgctctgatttgaaatatcctctgaaattgttgaacaagtctgaaaacacttttgggagtctcttggtatttagggtttgaaatattaatgattaaaaataaactaaaattggaaaatgagatattcctgatattaaaatgacctacctcacaaaaggtaaattaccaagtttaagctcttggggtttcatgtaaagatgctaaatttttcatggacccatgcaagatttgttcatttaaatgttgaacatatatctgcccttgcacacctgtgtatttgtgtataactgaagcttacatgtagcatttttctagttgtaactgttcatttctataataaaatagttcattggacagtaaaaatttatagaactttttcagtcataatatatactaatatatagatagatagatagattcatggtaatatggaggaaagttgtagttcaaatttgccaaagttttctataggccagtgtgaatgggctagtttagcctgatgtactgtgatgtgaagcattatgaagtttctcttaggctgagttaacactgcagtcacttagattaatggttctactaaaagagaagaaaaactagctgtgtgtttactggtcatttgctaatcctattagggtatggtaattttcaccctagttttgattctgccactaatcactaaatttcattgactaaatcatataaactctctagccctatttacatcc

SEQ ID NO: 36146 - DNA, 723 bp, Bovine  19866880792479
agaggagcctggtttgctacagtcctgtgggtgtaaagagtcaggcatgactaacacacacacacacacacacacacaccacgtgggtatgttaggaaagtattactatactccaagtgagagaagacagtggatgacaaaggggttaatagtggaactggaagaaattcagaatcttttataaaggtcaagctaatagtacttgcttatagaactgttgtggtatttgtgagaaaaattaaaatgaacagtaaattctgggttttatactttttattcagagtcacaataaaaatgatgatttcactaggggtgcttaagaaaagaaaagcagggttgtttgaaagaggatataattgagaactcagttgatagattcctattgttcacccaagtgaagatgctaaaaagctagtgaatatatacaaatcttgaatgtaatgaagagctcaaggctgatgctattaagcagagactacatttagaagttatttaaagccatgggcctggtcaaggtcacccacgtaatgaatatggacagagatgagaagaggcacgtgtagttccagcaaagagaatgatgatgattatgcaaatggtatttattatttatagaatatgggaaaattctaccaatctgactaaaatacagcactttttataatatctacaattaagccctattttctgaatatttgtgggttttcaggaagtgaatacatt

SEQ ID NO: 36147 - DNA, 1596 bp, Bovine  19866880798816
aattctaggatatatagaaacatatgtaagtattattgtaagattattataattctgtgcaaccacacagcaggctttcttagctacagtgaaagtcaaaatgctcaacctgacacggtggtgatgatttatgagatataaatctctttcagtacatagtaaataaaccagtgctttaacctatatatttgaaaatattcagtatagatttgcagttgccaaaatacctttatatgctgtttccaaagcattatgtaagtatttatgcatgtcttgacttgttccagaaaggattaaatgtgatcaaaatacatactcaacagaataaagtaaaacttggcaaagatgaatgtgattgaagtgctgggtgatacagagaggcaactgctttgattaaggatagagggatattttgactgaatatcttcttttaattcattggaaatcctgtgtgccacatgtgtggaaaaaaaagattctcagaatgtgagggtatagctaagtaagtgtttagttcaatgtttattttacatattagttacaaaatatgtattccttgattttaaaaagtctaaagtagacatacaggaattgtgagcctgtttcctctcctatatggctttcactttttttgttgtgtacagatgtgtcattttacaaagtataaaatgttgggtagaatcaataccgaggctattaggagagacggaagatcagtttcactgatgtattcaacacacatttgttacacatctatggtacaccggggtatcttttgggcttcttacaaaacaatggtggagaaaaatccacatgtgccaggcctctgagaactaggagaggcagatgcattattcagatgtaccaaccactgcataattgaagttctggatggatgccatgcaggctattaataaagctgagtatctgacctcagcagatgatcaggaatgatttccttatttgaagttattttgaacagtggaatcatgcatgagcaaatcaaccaggtaaagaatacagtgggaaaagggactgtggaaacattacctgaaggagggagcattgcaaagcctctgaagttggaaagaaataagttaatatatgcaaatccaattagaaagaggctggttaatacagggaacttcaaaagaagtcagcatattttaagtctgggggagagtgttgtcaaaaggagttgacagagacataggaaaaggctgggtcatgccgtaggagactggattgtgggcattttgctgtttgtgactcctttgctggctaatccactacagaatctcatttagataaaatatgaaaataagactctaatcatgtgcaataacaaaattccgagactcccttacagccttacttggattaggtccttacgttgaagtgtcaggtatgtccccaaatagctaatcagtgtgtgtgtgtgtgtgtgtgtgtgtgtgtgtgtgtgtgtgtgtttaactgttaagtaatcactgaaaacagtatagttttggtttcactatttgtgatgggctcaggagaaatgcttcttctgtggtacttaactgtttctatatccacataaaggaattactcact

SEQ ID NO: 36148 - DNA, 2859 bp, Bovine  19866881008518
cggacagactgagagactgaactgaactgaactttgtggaaataacaaacatcatcacaaaatgtaatattttaccaaataattaagtaattggcattctgagacattcatattacttccatgaatttaacttacttctgtgcccttttacatcatgtgaatgaaaccaaaatcttagtttagatataatgcctagtaattttttacatttttttccaaaagcagagaaaatatgttggtttaaattgcaagtgtatttggtcctagatgggatggtggtttagtcactcagtcgtgtctgactcttaggaacccatggactgtagaccttcaggctcttctgtccatgggatttcccaggaaggaatactggagtaggtgtcatttccttctctagggaaacttcccgatgcagggagtgtacccggctctactgtactgcaggaggattcacaaccgactgagccaccaaggaagccctagaaggaataacaatgtgattaaatagaaaagtggatataagcatgcattttcccttcaaaaatcagaatggaacacatcataataaatatgattctaggggaagttgggatcgcattactaaaaataaaaaaattccttacaatgactaaaagaagagaaagaatttgcagacttgctaggaagggggtgataattgcttcagtgaatttaataatgtaaaacccttcaaaaatactagtggttttgattggagatctactcaattcaagaattaaagtgcctgtaattgtgaatagacaacttaaatatcccctaccaaggagatataaaagcaattgtattcatataactattaaaatagtattatatattgagaaatgaaaggtgtttctttgattaattttatcttcaattattttatatttgttacagaaactataattctaagtagaagacataattagaggaaagaataagatttttttaggagagtataaatttagcaaggggaggtgaccagcccttcgtttctcacatttgattaagggatttatgcttttgcaagatatattcaggctaattaaaatcatgcttgtgttttcattaatgggagcagaacagaaatttctcaagctcatgaatatatatatactatgtgatatcaagttaggttccagttttgatcatcagaggtaagaaaagtaaatgattcagttttccttttatgaaaaatggatttttttttacttatttacttttaacaggaaggaaaaatgtttaaatatacagagacttgcagatatacagagatatacagatacatagagacttgcagatatacagagatctcagtttccctttggaaacatactttactgaataataaatgttaaaatagtaacattaaaattctgcaatgcctgccttttttcatttagcaagaaaaaataattcctgtaccctcaccaaggtctaaaatgtgaacatattaaatggtgtttcgaagttaggtttggacagcgcccttttcagatccttttatatgtgtaccaatttttttcataaaatattgctacttgttattaaaacaatattaatattagtgactcaaatactttggccatctgatgcgaaaaactgactcgtttgaaaagaaactgatgctgggaaagattgaaggtgggtggagaaggggacgacagaggatgagatggttggatagcatcaccgacttgatggacatgagtttgagtaaactccaggagttggtgatggacagggaagcctggtgtgctgcagtccatggggtcacaaagagtcagacattactgagcaattgaattgaactgagtaataataacagcaagagtaaatagctaccattcattaagaattattactgaaacttttctgaatgttttactgaaattaactaagatcctaaataatgtagccactatcttcattttacaaacttaaagattaaggttttaaaaatttaatcactttcccaactttgcagttattaagtagcaaagctgagaacagaaaaaatatccagcactgtccaagtcttatattatctgcaaaaagacagtgaaagacatggaaatattaggaattcaaattctatcctaagacaacccagaagggttcacatttcttatggaaaaaaacaagggtggtatatcactgcaaaggaattgccgtgttgcaaaatgagaatgagattctcatctcacaggcagagtaatgaggctatggggcttccctggtggctcagtggtaaagcatctgcctgccaatgcaggagacacaggtttgatccctggtccaggaagatcccctggagaaggaaatggcaacccactccagcattcttccctggagaaccctgtggagccttgcttgtcacagtccatggagtcacaaagcatcagacatgacttagtgacatgaccacatagatgataaagttgctgctgctgctgctgctgctgctaagtcacttcagtcgtgtccgactctgtgcgaccccatagactgcagcccaccaggctctgccatccctgagattctccaggcaagaacactggagtgggtcgccattgccttttccattgtgtgaaagtgaaaagtgaaagtggaatcactcagttgcgtccgactcatagtgaccccatggactgcagcctaccaggctcctccatccacgggattttctaggcaaaagtactggagtggcttgccattgccttctctgcatgataaagttaggaagtgaatacaggccaccagggaactaaagaaagataacttttccacatgttttgttttaatattgtgaagtttcttagtgtttgagcaataaagaaa

SEQ ID NO: 36149 - DNA, 1848 bp, Bovine  19866881237862
gtttcccctgtcttctacaagtcgttgtcttaatcccttttatacatagtagtgtatatatatcagtaccaacctcccaatatataccacctcctcttttccccttggtgcccatacttttgttctctatatctgtgtctgtgtctgctttgatgcagacaacatgttacaacaacaacagaaaattaccaattcaaaatttgtgcaaattaatttattaaaatagtgttacctgtacatatattttataaaatggttatgatattttgctgctttctatgttctgtcgtgaaactagaggccctgctttcttaataaagttatgaaatacaaaattcagaaaaaattataaaaatttcatctcaatgtcccaaagcatataaacttgagtgcttaaattttagcattaatattatctgattacaaggaaatgaactcttaagagtattcagttgcttgcctctttatatcgatgaaatcacatagaatttttgttatctttgttagtatctctaaaataacttctgcaaaaattctctgctgcagagcccagtcgcacagacctcacatcattggataaggagatttctggcctaaaggatgttacatttttctgtattttatataaattttcataatcacttgtctattgcttagagatgaccatagaagtatttgagggtcttcccatgaggtgctactggtaaagaacattcctgccgatgcaggaaacacaggcaatgtgggtttgctccttaggtcaggaagatcccctggaggagggcattgcaacccactgcagtattcttgcctggagaatcccatgggcagaggagtctggttggctacagtccacagggttacaaacattcagactggacatgactgaggtgactaagcagcagcagcaatttagaatatttgatcattttgttatcagttatagagtatataatacttaataccattaattttcaaagtaatctttataagtgagtgatcaaattcactgatagagaagtgatacacgtactcaggagactcagttcatactcatttgcataagtactttttaaaggcaccattaataagtacacttatttaaggtttgggggcatttgtcgaacttcagtgaattagatacccaagtactcttcacatctcattttcccttataccccttatagttaggagtaagctcccagcgaaaactctgcaaggcctatttctttgcagtaaaatcaatccattaaaagtacattaatatgaaatctgtgttaaagtttctcctggatacaaaatttatcattactcaatgaagaaataaaaagctacaaagttagcattaatcaaattggtagtagcacatgatacatattaaccaagggcagcctttttcaggctgcagtcctttacaaacctataaaaaagaattaagtgcaaataatttatattcattaattattccaggaagaacttttattttgccaaaagttgttattctacttaaaattactataggcatgtggaaataatatatgactgtgtttgtgtaaaaagaaataatcaagtttatctttatcagaaacactatgagatgttgttgaaaaggaattatccaactgacagtataaaatcaaaatatatgtattgagtatacttatgatttcagaaaagctggaggtagcacaatgacagctagagtattgataaatgacttcttgaataaggagattatgaaaagggaaagcttggctaacaataaggactatgtcagtctgaagcggaaaatgaaacaatggtttgctaagaacaatgaagactgcagctatcctgaaaagaaattag

SEQ ID NO: 36150 - DNA, 1248 bp, Bovine  19866881410171
tctctaaagttaattggactgttcaagtcatagaatctttgaatgagcaatgaagagtacccaattaatattgatagccagataataaggtaataaagtctgaaggagactaataaaacctcaatgcaaatatacctccacaattatctcagtgtaatataccaattacagtacctaccatttatcatgatcaacactgactacttttccatttgccttttatatatacctgaatctcttttactactgatggaaataccttcaatacatgcagttgtagtgggggagtgatcttctgctaaattaatttgttagaagtaatctactgactgccaatgtatcccttccatactcagacactctagttatttcaggtgttcaaactaatagtcctcccagtaataatagggatcactcaaacctcctgaggaccacttgcatctcatggtttatggcagacagatgaaagaattttccatgatacatctctgaaacagggaaacaggatactggtggctatcttgtgcagatagaagaataaagagaaaataaattttatcattgcatatagatatgaagatttagaaaagtcatttggaaaatgaagaagaattaatattcatctaaatagctagcaaactgagatagcaaattcatgggaatttttaaaagtctggttttatttacttagcatttttcatatttcttctcattttttctttctcactgagtcctgtagttattgaaaatcaccttcaagactgtatctgtcctaccttttatagcatatgttacttctgaataggtatactgaaacaaattgtttctaagcaattgagaaactacacctggaataagaggcaatcacacagtagaaatattggcaaatggaattgtttaccattgtatgtaatgggacagctcgcaatgatttggttttgtgtttcctgcctaccaagaagctaaatgtagatgctattttttcttggcaagtagctcactttcaatttcctgcaggttaaacattcttttgaggtttctttgtagtaggttgttgattttattttatgtaaaagacagacaaagtagtagtagtatgtatatatatatatgtatatatatatatacacacacatatatacacacacacatttactaggcacatcacagtacagcttatttatattaataagaacatattaaactaagaaagattcctatgcctatatgtttgcagtggtcttacaa

SEQ ID NO: 36151 - DNA, 787 bp, Bovine  19866881425138
tttgcttcttttcctgttcaaatacacctttagattctatcaagatcttagcaagaaatgtactcaggatcacagtgattattttaatctctgtattactagaaaataaagaacatttaagaaaaaaacactttaatttctcaaatcattaatggttttaaagatccataattgttcaacagatatgaaacaccatttttttcaacaaatgctttttcaataaaaattgaacatttcccattttgttcttcactgaaatagtactatttaatctttctaattttttattatcagcttacagttttttattatagaaaaaagtaaatctttgcctcttttcttgctaactttactcttataactagaggtacatttttttatcctcactgaaagcattatttctctcagtattccccttcgtttcaattttggaacctctgttgatttttctctctctcttccttctcttgctctctcatcttttcttcagtctcaatctctcctctcgccttccctccctctctctctcttgttcattgtgcttttgtatttatatttttaggtacctcaaagttcttcaataatgctagcctttagtttaccatcaagcaccaggattcattactgccaaaggtcttcaaatgtattatcataacactttctcttttcctctggctgatgaaaataaaattacagttcaccctttagtcatgtttcattaagaattcattttcaaacacagcatactaataagtttcttctcaaacatccctgggatggtcaaaat

SEQ ID NO: 36152 - DNA, 1384 bp, Bovine  19866880357108
ctaggctgctctgggtcctcctggtgtgctcaggcacccaggccatgaagagtcaggcttagcccaccccagaccctcacggctgggaggccggcgctccctgcggagcactctgggacgacgacgggcaatcacgagatgtggccaaggggacgtgggggtggtgcactcctgcaagccaagaaatgcctgactcagagcattttaattagggtcagtcccactctctgctccgagctgaaagagccaggccctctcggccttgcctctctcatagatgcgtagccatgaaatgatttttagttttatggttggtatcaagaaatccttccagaattggtccctgatagctaacttaagggcagctctgacaggttaaaaacagccagaagaaaatgagccggttacaggtgtcctcccatctttctccctggtcagtcaagaccaaagaggctgtgatgcagcccagcaaacagacagggaatctggaattttgctcggctggctactcacaggctgtacagggtggagggggtagggcggcatgggggcatcccattcctatatttcagagcaggataaaacccctgccccaataaagccaggagagtctgcgaggctggagagacccagggctgacgacatgctcacgtgaaccgcccaaccactttggggctccatcctcgctcagcacacacagacctcaaacacaggagtccctcctgctgccagggaggaggtcgccaggtaacagtagccaccctagtggctccatggagaccagatgtatttagatgagagtgtttagagcagcgtcctcagtccaggtctaggaagtagaaatccaaaagcagaagagaacccaactgaagggagggtgggccacctgacctcagagcaccttttacctattaagccgatggtggtcctggtcacacaagctcaacccaggctcagagccaccatgagctacagggcctcctgggacacttcatctctggggctgcctctcaagggttgtgggtgcgctgagggcgatggacgaggcctgtggggagtgagaggcttctgcctgacttgcctttgggattctagccaccgagggtctcctgctgggtcaaaccatgcctgtggtccttaggaacacttgctcttctttccgaggcagacactccaaggacaggcagacatcaggacgtatgataccatctattacctttggggtcagaatggccccatatcttgatgcctggacatgcccagggagagggacccaaggagggctcgtccttggcagagatggcaggagaagtgttggggtggctgcccaccctgattctgcaccagcagtttgctctggcttcagatactgcctctcatggat

SEQ ID NO: 36153 - DNA, 3176 bp, Bovine  19866880372509
tcaggtggccaaagtattggagtttcagcctcaacatcagtccttccaatgaacaccccaggccagatagtaaatatcttagccttttgggaccaatctgtcacaaccattcagctctgctctggtaacaagacagcatgcatgtgtgctcaatcatgtccaactctttgcaacccggtggactgtagcccacccaggctcctctgttcatgggattatccaggcaagaatagtagaatgagttgccatttcctcctccaggggatcttcccaacccagggattgaacctgtgtctcctgcgtcggcaggtggattctttaccattgagccacctgggaagccccaataggacagccttagacaatgtgtaaacaaatgagcgtggctctgtcccaatagcatttcatgtagggaagcaggtagagggcagggtctggcctttgggctgtagtctgcaacccctgtgctaggctaacacaactgggcctctggaggcccaggttcagggagacctcaacgactaattgctgatgttctgtggtgtgtgcatgtatcgggagtgtttggaaggatgagaccctctctttccagaaccaccatggccctcccaatgttcagaaggatccagaatggctatgttttggtgggacgtcctcagactctgccaggggcttggccagcccctctaactctgtagcctctactgagctcctggctataaacatgagttattcccactctcagggctgagacagaggggaaataaaggccaggattgatggaatcccagacataaaatctggcaccataatgcctacattttggaaattgcctctaattaatggtttatggccacaaaggttccctccccccacccttcatccttctgtagcatcttctccctggtgatcagtcctggggatgggaacagggagggggtgaaagaggagggctagtgaatagctggtttttcagaaaccaaaatgtgtggttttgcttatatgaacccagcttggcctctggcattcctcgagcctggactccataaataatgtgaattgaaaagccagctccctgcacaggcctgaggcctgttagctacagactcacccacacacacgcacaaaaacacatcaagctcaggaaaacacacactcacaagtgtgtatacacacacacacacacatacacacacaccggaaatttgcttttttatttttttggtccacttatcagtctctccttcttcctgtttatcttgctgtctttgtgttccgtggcactatttcttccctgaagttctgctctttgagtctctcttccgttctctctcctgtctttccccttcccatgccctttgatctcccctacttggggacacatagccaagctacacaaacacacccccagctgcccacctcagcagagaatccacaaatcctcccctcccatcacagacacccctgcccctcccacctggaccaggcttgactctaaccaggacaatgaacttctgcccaggtgcaagaagttcaattaggttccctccctaagcacctgagctgaactcaaaccacatttcatcccaggaatacaaggggacggaggcaactctgccaaattctaggtatagccaaaaatattgcccaagccccagggtagaggccctttattaccaataatagccaccttgactgagtgtctactatggcttcatattcagaatatataatagtcatgttaacctaagaggtagatattcttattattctcattttataggtgggaaaactgaggcttcaagaagtaaaggaatttgcttaaaaccaaagtctgttcaactccaaagcctagtctcttcccacatgctcagtcacttcagtctttgtctgacttattgcgaccctgtggattgcagccctccaggctcctcagtccatgggaattttctaggcaagaatactggagtgggttgtcatgccctcctccaggggaccttcttgacccagggattgaacccacgtctcctgtgtctcctgcattgcaggtggattctttaccctgagccactggggaagccccagtctcttcccacagggctggtccaaatagacaacatgggttgtgtcttgggatctgggattaccagattcagccacatatggtctctcatctccccagaaacatgtaacagagacatgactccaatacaggaataaggcagaggttctcaagtctagccaacaggcggacacactgttcagatgccagtggtcagcagctgtacacccaaccagaaaggcttccctgccagtcaagcctgtccttgggggcccagctctagcagtggagggaggggaacacctaggctgaggcccctagccaggcaaggacttggagcctcccaggcagggctgcagaggcagccgctgtttctgcattccctggcgccatggcaacaagagtgctcaaattggtgacccgcagagtctgtaccatctgctgttttcggggctgggggttgcagggtcaccttctgtctgcctgagaaaggaaatatagtaatgtggcaatgacctctcacccttgtctatgcagtgtagaaaggccccatcagcctcgctgtcactgagtccgcagagcagcccaggggtggaggcaggcagcagagagcagtatcacgacaacatgcagagatgggcactgaggcatgaggcaccatctctgcccaccctgcgttaggtcgttctgcctggcgccctgctggaccagcccggcatctttcaggccaggtggctgtgggccccgaagggctcttagctgggtagttaggtgttggggagaaaggtttcggtggagctgagatgagggaggtgggtatggtcaccaagctgcagttccccaagagtcgtccaaggcgtttcaatggagggaggcaagtgactgggggaaagggcttcatacaaactcagtgacttgaagaagtaaggtctttagtctgtgggggtttttttgtgtttttttttttcaatttcaaaaataatatagccaatgcagaaaacttggaaaacagaaaaatatgcacacacattctggcacactcacaagttcatgacacacacacacatgttcacacacaaatatcatccctttccagagataaagacttttagca

SEQ ID NO: 36154 - DNA, 837 bp, Bovine  19866880397257
aaaaaaagcgagagagcatcccaggtcctgccccctgccttagtcccgcccctccagactcccacgtgaacccaccagcaagccttgtctcccagcacctcctgctcccagaacgtgacatcacttccggcaggtgccccacccagcctatgtgggcgaaggggcggggtctcaccatggccagctccgcctccagctccttcatccggttgtccttgaggtccagctgggagcgcagtgctgtggcgtggtccgtggcctccttggcttggcgccgcagctcccacttctcgcgctccagcaggtccttctccttagccagagctttcacggcatcctcgctttcctgcggggagaggccagcattaccaggggcatgggtggggccaacctttggccaggagatgcccagaggcccttgacccctggactagtagaacgtgcgggggtgggggtgggggtcccccatgctcggggcctggaggaagaaagccctgggttcaagccagtctctgccacacactagctgggagactggaacaaagacgaaccattagtagatgctcagccattattttttagtggataaatgagcaaacgaatgtcatgcataagttcttttaactcaagtctttgtccgtatttgaaatgggggcagggaatcaacactactctatcaaaaaacttataaagattaaatgactccatgtgaaggaaatagtcaaacggagtctgataaagggtcaacagtgggtttgggcttggtcttctgtcctattgtttggtaatgtgtatgtcccgggaaaactgacagaggagacatctacagcccggcca

SEQ ID NO: 36155 - DNA, 1081 bp, Bovine  19866880470448
ctcgagcttctacagctagtgtaacttttcatgcaggtcccttggtgaacatggatgcatgtttatcgggcaggcacgggctgcggtaggaactgtttattccttttttacaatgtgaaaatatgggatctgtgacggcctccaggtcacacctctcctgaggggccaaactggctttgaacccagacagtttagctccaggatctgcttcctgtggctgctctccttctgctgggactctgctggagagagggcatcgcaagaccagcccccaaatcactgggtacccagggaaacttcctgaaggctctagagggcctgatggaccaccttgagagtatgacaccaaagcccagagagggtgtgtgagttcccaaggccacccagcacactggcttgcacccttgcatccttcctccctgacctctgagcattccctgcctcctctcagggcccagccagcaccatggtctcgtctgaaatgacctcacactaacatgagcctgaataatagtttacactgtgtggagcatggagcctgtgggccaatgctgtgtttccagaaatctccccccgccccccggagtctagggaatgtcacagttccgggcccatcccctgccactatttttagtggtgatctggaggaaggaggactttcctggacttgccttcagagtctggaaaacaaacaccaccccctccccaccctcaccctcccagttcccctggcaggaagcgggagcccggattcccgggcctgccactcaccctccatgcttctgcttgagctctgagctcttcagagctgagggacgggcggcagcaacagtgtgcccctgccctcaggtaggacctcagacagcctgcaacaggtcccctctgccccctacagtatctcttcttattacactgtctgcgggtgtctgatcccctcctgagggttggccttgccctccgtctcaagtgtttcccagggccccaggacttccctgatggtccagtggttaagactccgctttccaatgcatggggtgagggttcaatctctcattagggaataacgtcccacatgctgtgg

SEQ ID NO: 36156 - DNA, 1334 bp, Bovine  19866880565763
tcctctttcctcttagagaggcatacctccttctgcttggttatacggttctccagatcttggcacctttttcttttccttctctatggcctcctttgctttgtttttctcataggcgatgctgctctcggaaatctggaagtcaacaacaagcgttatgagggtgtgcgcatgagaaaggaagggaagtgacacccaaggggaaagctagcattagtaatagttgacaccagtgagtcagggctggggagctagagctcaaggaagatgatgcccgttggagagagagacatgagaaccggaagtcaagtcgtggttagttatgtcctcaacagagagagttattcgtcattcagggtttctgggctggtgtgcaggaagtgacaggctggtgagtgctcaggtcaaggcgtttgattctgagccactgactgaactactaaacggacagacggtggcaccaatgtggtcctttgttggtacctggcttctgggaggtggggcaagtgaggccaagggcaggggtgggggtggggggatgcctcctgtcccagtaggcctgaggtctgtggtttcaaaggacaccggcggtctctctccaacctacgaaggcttgggtctaaaaaccgaaagtccaggacagtttgctgcagagaacatttaccccatagatcctgagatggggaggggattggaacccagcctcacctacacaagccccaggagggacacagccagagtggggtcaagaaactatttgcagctgttgaaactcttggagtgatgcctcccacataaatataatgtccacgagaacattttaatgaaataaataatttatctatgcataaacaaaagactggaaagatatgtaccagaatgtaaataatggctattttggggcaattgagattatggtcatttatattttcttcttttcactggtctggatcttctaaattttctttagcgaatgtgcattattgggtaaaaagggaaaactattgaaaactgttatgctttggggataggtggtcctggagaacagatgatcttcccaacaaccctttgattctcgcatcgcgcccttggcctccatccccactgccccgcgctgcacacaggcctcgccgctgcacctggactctgattctcctccctgcatgggcttggcattttcccactgccaagtctgcctgagaccatccagtccccaccctgccaggctgcgtcctgcctgatgtaagaggccaccgcatgctctgtcggagggcgtgcgcccttctcttattttgtgctgctggaaaattacagatgaaaatataatgacgatg

SEQ ID NO: 36157 - DNA, 2457 bp, Bovine  19866880605698
tcgtgtccgactctgtgtgacctcatagacggcagcccaccaggctcccccatccctgggattctccaggcaagaacactggagtgggttgccatttccttctccaatgcatgaaagtgaaaagtgaaagtgaagtcactcagtcgtgtccgaccctcagcgaccccatggactgcagcccaccaggctcctccatccatgggattttccaggcaagagtactggagtggggtgccattgccttctccagcccagcaatagggaaactattaaataaattgcaatacatctatatgatgataaattatgtggccattaaaatgataaattgtgaggatctgaatgttaatgggaggggcttccctggcattctagtggttaagaccctgagcttccactgcagggggcacagattcaattcctggttgtggaactaagacttccacacgctgtgcagcgcagtcaaaaaaaaatgaaagaaaaaaaattgaagtgttacgggaaaatgttgacaatgtactttgactaaacaaagtaagggatgaaactgtttactatagttcaggccacatgtttaaaagatatattttaactataagaagaaaaaagtttaggaaaaaatatactacgatgtaaactgcagctatctgagttattaggtaataaataatagtgttcttctttctccttttgtgtatgttacaagtaatgaacatgtagtatttaacagaaaagaaatatatgaaaactacctgtgaaaacaagcatgccaaaatcagctacaaaagcaattttcagtttctgttggtttaaaatagtgttttacaaaccacagaacatgctgtatgcagcttcatttccaggatcatacagttactgctattatttggtatttaaatacgcctttcatttgagagtacttacacaccttgcacactttttttttgttaaccacatgccacctacaggggtaaattataacaatgtttcaaaaatgcaaagatattaattgcaagtgaagttaagttcctataattgtttgaaatttctccagccaagtctgcatcaaagcatcaaacagggccatgcctggcttccaagcccacacttgtgttaagagatggaacatgcccagctttaatcacatgtagagattgtgtctattctaaatttgttatcactgcattataactattacaacgactagagctgttaaaaattaacaccttttcccattgtaccctcatgcacaatccatgccaatcttgaaaaactgaaatataaaccagtgatctttaatgtgggtcagacattcaagatagttcttcaaggatgcaggaagaaaatagaaaatattagaattttcatttccattttaaggaagtttatccttccttaaattctatcctgggcctgtttatactgtacctaacgtattacttcatgtatgtaactgatgtttacagctattatatatccatacatgtaatatacatgcatttatattatgcatataccactagttcatatatattaattatatgtatcacaaagatgaatatttcaaaacattttacttagaaggataagtaagcaaaaatgtttgcagaccagtggtctgaaaacacagtgacaggaagaaatagtcaggaacaagaaaaaaaaaattcctttagaaacggcatcagaaatggaggtgaaggaatgagaacagagaaggtaaataaggacagtaaaggtaaagagaccaggagaactctgagagggagtggggggaggtgagaaacaggggagaaccctgggaggtaacgcagtggaagggaatacgccaaggaagtgaaaatgatatatatgtgtacaaaaactacaatgatgtttactattatgatttggtgaaaggaaatgactcaaatgtctagggtggatcctgttcctgcctgatgggcaagcaactgaaagacaaccgaccaccagacatcctaaaatagacactgtattaggttacaatggagccaacagaagaaacttgaaaaacaggagttgtttactggctacttaagacaggcttaacaccagtcggagcccaggtttccatatgctaatttggcttgggaaggaagtaaatgccaaaacactgacgatgaataagaaagaatttggagttagcctaaacgttcaattagcaaggtatttcaaacctgccacgctggcaggacagtgcgtgccttgaccatacaattaatcgtctttgactctaaccctctctttatttacatttttggctacagcaatttcaaaaagtgcaggaatacagaaatcacaatctttgtcttctctcaagcccaacaacaaaatcaatttacatttttttagtccacttactaactggtgattgtaagcagggtaaaaagaacagccagagggaagagaaaaactgaaaaaagccaccttaaaaat

SEQ ID NO: 36158 - DNA, 1710 bp, Bovine  19866880617831
actttgtacaaatgtaaatataaaaattaaaatatactgcgcactataattttagaagctgtactttttactgagcatagggattattcagtaaaaatttgctgaattaatctggccctaagaataaatttcttttaaggcgggtttaaatgatacaaaataatgacttagcattgtaataaagtgttgtcaatttaaaaaaaataaataaataaatttgcaaaaaaaaaaaaaaaagaaagtgaaagaggagagtgaaaaagttggcttgaagctcaacatccaaaaaacgaagatcatggcatccggtcccatcacttcatggcagacagatggggaaacagtggaaacagtggctgactttgttttggggggctccaaaatcactgcagatagtcattgcagccatgaaattaaaagacacttactccttggacttcccttgtggctcagatggtaaagtgtctacctacaatgcaggagacctgggttcgatccctgggttgggaagatcctctggagaaggaaatggcaccccctccagtactcttgcctggaaaatcccatggatggaggagtgtggtaggctatagtccatggagtcacaaagagtcggacatgactgtgagacttcacttggtcttagtcactttactccttagaaggaaagttatgaccaacctagataacatataaaaagcagagacattactttgtccacaaaggtccatctaatcaaggctatggtttttccagtagtcatgtatggatatgagagttggactataaagaaagctgagcgccaaagaattgatgcttttgaactatggtgttgaagaagactctttagagtcccttggaatgcaaggagatccaatcagtccatcctaaagcaaatcagtcctgggtgttcattggaaggactgatgttgaagctgaaactccaatactttggccacctgatacaaagagctgactcatttgaaaagaccctgatgttgggaaagattgagggcagaaggataaggggacaacagaggatgagatggttggatggcatcactgactcaatggacatgggtttgggtagactccagcagttggtgatggacagggaggcctggcgtgctgtagttcatggggttgcaaagagccggacacgactgagtgactgaactgaactaacccaaagcaatctacagattcaatgcaattcctatgaaaatgccaaaggcttttttcatagaaatagaaaaaatcttaaaatttggaacctggctctctggccagtgatttgcctgggcatctccatgcactgggccagcggcctctgagaccatctacaggagtgcacagggagccagcaggtggtagccctcaccagggaccctccagtgagcccagtgggacaaaatccagcatatgcatattgagacaagtcgaaagatttattatgaggcacagaagcagatagtgccaaaaagcaagcagtagttggtacacatttagagtagggcagcatttccttctcccactgctgctcagatggcagacattagtcaaattcagtatgaaatggcattcactgaaggcattagtgaatgagggtcctggaaaaatttaaggtagcaccaccaaatgctgacctggaacaaggattccaagaaggagtttcaaatgctagtgtgattctgcagttccagagagaat

SEQ ID NO: 36159 - DNA, 722 bp, Bovine  19866880621913
cccgggtcagggagcctgggcgggggcaggggaggaggacaggccggccgccagtgtggagcccacaggggcttccagaaggcgccatctgggatttttcagaggggcactgggatcacgtcctggtgtcctgatgtgaaattggatcctcccgctggaagtcaagccccaagccaacggggggcagaggggagggcccttccgggcctgggatgctttcccacactccaagggcgccccggtttccagccaatcaagttaattgaaaaattaccttgggctgagaaagagcagacccgggacacgtgggctggttcacaggaaaccctgcttggtctctggcatgactatatcttcaacaacctgtatttggaaggccagggaccgtgctcagcaacccaggaacagaggaagctccacatgccaggcacacctcggagggtaatgtgatgcccacattacagacgaggagacgaaagcgccgaaaccagggctggctggctcccctgagatgcttcttcccagaatgctcttcttccacttgcctgggggccccccaaccccaaatcctaacaaacagagctcaaatggaaatacaggatgtacaccagctagcaaggccggctggaggccttctgcccaggctggagcaaaagcatcttcacattcagaggctgcctgcactcgggctgatactgttaagctgagtacagtacttttca

SEQ ID NO: 36160 - DNA, 1654 bp, Bovine  19866880752822
tgtggggactgaaggggttcatacgtgacaagcacttagcacagctctggctccagaaacggcagctaccagcactatcatgagatttagttacttttatgaagctcctactatgtgccaggcagtttctctccacacctctatgctcagcaatcctggggggtcagttatggccccacgtgactgattagagaacagggactataaacgtctgggcactggccaggggtccagccccccatccctgcgcttcccacacttgactctctccaccgccccactagcctctcctgagtctcagctctatttattgctcaagggtttctcctgcagccaggggtggctcagtttcagaggaagtgcagataaagtgtccacacttggacagaaacgagggctctggatctcggtctctggcagctcccaggcctgtctgggctgcagctcaaaccgcggcctgaaccgctgtctgcgtcaatcaagcatcaatcaattaccaggtctgggctcccgcccccagggggacagtgctggccgcagtgccggaggatcagccaccaaggggaggtgacagagagcagggagaagcaggtgctggagtgggaagtggggccccagaggtggtaacactggaccccctcccccctcgggggagtggacctccaccatgtgccctgggctctgggtcactggatcagctagattcttcctgggtaaaccctggaggtttgtgctcacagcacctctgctgagactgacccgagtccaagccccagctctgccatctgcgggctaggtgaccctgttcaagtcacatgaccccaggcacctcaatttccccattcacaccatggagatcagacccatctcaggctcaaggcaagggttaagtgagggtccacaaagattctgagcacagaggctggcccacaataagtacttaattaatacacactaattacagtaccactgctgaattattattattgttaacatctatcattagggtttgagagtaaaggagattatggatatataaaacgggctttccaggtgttgcagttagtaaggaacttgcctgccaatgcaagagacgtgggttcaatccctgggttgggaaaatcccctggaacagggaaatggcaacccactccagtattcttatctggaaaatcccatggacagaggcgcctgctgggtgactgtccatggtgtcacaaagagttggacatgactaagcccatactgaagctgaagctccaatactatggccacctgatgtgaagagccgattcattagaaaagaccctgacgctcggaaagattgaaggtaggaggagaaggggacgacagaggagatggctggatggcatcaccgactcaatggacatgaatttgagcaagctctgggagatggtaaagggcagggaagcctggcgtactgccgtccatggggccgtgaagagatgaacacgactgagcgactgaacaaaacaaagcccacacacgtacgcacacaaggatataaaacacctaatatgtaatatgtgcctaaaacctgctaacttgattataatagctctattgagaacttttaatgtgccagatactacttaagtactttgtatatataatataaaaatagtgataataa

SEQ ID NO: 36161 - DNA, 825 bp, Bovine  19866880804881
tcatcttccttatatttaattaaatcttagtctatacaggaatctgaaaagtctggaaacataggggatggttcctattttaaaaagtattttagttgtattttcaaataatgtgatcaaaatggtttcctttcatatccagatacctttcacagatgaaatagccctaaatttaaaggcactggctccttaatctgaaagagcaataagaagtgttttccctgtctttccagacttttcagatgctatgtatgcatgaggatgcctcagccatgccatgcccagctaattattttaccatttcctcagcaccctcactgccctactgttcagtcatttacctggctcctctcccagatctgcaggggtctgccctgtgtggggcactctggtagcaacagcagcattctccctcttcaccgagcttcacaggctctccctgacacctggcagaacctactcactcttcagggctcagctctcagggggatcttctctggcacagccaatcatttggtcctaaagtgccctggactgacatacccctctattatcatagctgttcatctatgttcatctgtttgcaacgtgaagcatagattctgactgtcccagggtcaatgtttaactgcctttcagtaacatgtgacatgatgagcaggggcaaggccttcagtccttacttcctttgtcggtgagatcgtttcacagggcagagttcatggaacaacttctggctggtgagcctggctgccaacagatacttgttttgggtataaagtcatcaagacctgcctcttcatacctcgggccggagaaaaacca

SEQ ID NO: 36162 - DNA, 1725 bp, Bovine  19866880815892
gggctcggcggctttccggcagagccccgtaagggagctgccgagggaggtcaaggccacgggagctgtgcgatcccgcggcgccgggagacccggcctgggtcggatcccgtgcctgttctgggaagcgtgggaatggggccaagctcgcggtgagttggggaggccccctgtgaccgcacctgtaacccacctggcaagcccatcaagtgccgaggggagcgctgccttcccgccgcccttcgcagacgaaagtgatgactcgcctttgctaggagcgaagagatttctcctacacttgaacgactaaggcagaaagagaaattgccgcggaggagacacaaatgcaatggtctaattatgtatcgttggctaattcgccctaagcggagaacagcgtttgagcgttaaaggttccgagtggatgctccggttccattctgttccggcctcagctggttcctccccagctcaagttaggtcatggaaggtggggcacaggaacccctggattctccagattctagggtaggaagctggaagacgaagggcttccgagaagactgtcatcatcagtttgaagttcgaatactttttctaggaaaaatggggtggggggtggggaataggtggaccacatgattcttcattatttcttgaacacccatgtgttcctgtaatttacttgcagtgtcttaaaatcttattacgaccttggcagtgaggctgttatctccaggaagatgagatcagaaaaggctggagtttaagggacttgcccaagtcccaaagccctgaagccctggtactggaatttcaaattctgtctggtggggggggggaatgcctctcccaggcagcaagcttaccaactgagaaacaccaggcttatttacctaataattctttcctaaaaacagccaactgcaagacctcctaattccaggctgcccatattggtttcctcaggagatgagattccagaggtcagagttctagtcacaggagctgggaccaccaatcaactgactctgattagttgagctgcactggtgttctggaacagctggtgtcttgggtcaccaagggtctggaagcgggacactgaggcctggaaggagcttgagtccctgggcctttggtttaggagctaggcttgctggacccaatcccacctcctcccctgttgcaaagagcagttagaacccgagacagcttgctgtgaaacagaatatagacgcagagaataagcaaatgggagggcttgggcaagttgtttgatctttctgagactcagtttacatctgtaaagtggagatattaataatgtcagatacattttgatcattcagaagctcatgtctgcaaagcaccttgcctagttcatatttgatgctgatgaatataagtcatcagctttacttgtggggcgccttttgatgcccctactgactcagtttttctttaggatgaactgttaatctgtcccatctccctgctcctgaactatgtcgaaatgacatctgttttgtctgtaaaatacttccgtgatcccaagctgactgttgggccaatggaggctgttattatgtacacatgtagaagagggctggttggagataaatctgtttactttttgtctatatagactccacttatgtatcatgataacaacatcctaatgacatgatgtagctgagaaaagcctgtctctaggtctggggg

SEQ ID NO: 36163 - DNA, 906 bp, Bovine  19866881028676
gcgtcgcaaagagtcagacacgatttagtgactgaacaacaacaacaaatataagtcactttatgttcttaggacaggccatctcacttgaccctttcaataactctgtgcaggacatgcagtgggaggtgaaataacttgtccaagaccgccaagctaataaggggttaggacagggccaaactcacataagtgtgaagctggccgccccgccaagagtgcccagcagtccgctctgccgcaagtctgcctcctgggctctggagaagaattcctggacttcacctgtgctgggcctttgcttcccaagccctgggcatggcctctcctctcggctctgcccagcctgtgcccaccaggggcccccaaaggcttctcctcccactggtgctcgctgactgcccctcattctccctgatgcctcaaaccatgttccatggtctctggtctcattcccattcttgctctgggattcttggcaacaacctccgcagttctaggaatgctggccctgggcttggaggttcttgtccgaaacttggctaacagcctgtggtgatgccaggaatccttcctgcccttttgacctgtgatttttgttttgcagagatggtgtcatctttgcaaaaggatatgttagcaaaggatgagcaagttcaacaactaaaacaggaggtgaatcaactaaaaagtgagaacaaagaaaaggatcaccagcttgaagccctcaactccatagtgagtgtcgggtcatcatcaaagtgtagcttcgaaaagcagacacggtgcagtcaggtgtctgcagagaagtcaacttcttggcagcttttaaagtacagtatgtggctcagaatagcatgatatattttcaaatgcagcaaacattttttaacccctatgataaat

SEQ ID NO: 36164 - DNA, 1376 bp, Bovine  19866881049717
taattccatagcaaagccctgcttcctatctccctgacctccaaaggcaagtccagctcccaattccttctgccctctcccgtctcttgcactctgatctgggggacggtttcccaggaggcctgggctccccttcccctctgccatggaggctgcagatcagggtggaagtctctcggcaaagccctggctgtgatcctccagccctgcttggacccaggaggctgcagcccctcttggatggcagaagcagaacgggggttttgtcttccatgagagcctgtctgttggctgttcacagctgggactcggctgggctgggctccgctggcacagtgaagccttgtttccttgaatacaaaatctgccgccttccctcctcgccagggccccccggcgggcggtacttccttccctagaagtccagctccctggccccttcctgccctcctaccccatccctgccaagcagcaccccatcaagcagcagtggtgccaagatggggctccaggggttcatctccgctcaattttcaccaaagtatccctcgtcaaactcataccaaaaacagcctccataaaacagtgagcttgctctgcaaatgcaggttcacgatcactccccaagccacgtgctccttctaaacaagctgcagcttcccatttagtgaaggtgttagtcactcagtcatgtccgactctttgtgaccccactgactgtagcccaccaggctcctctgtttatgggattctccaggcaagaatattggagggagttgctgggcccttctccaggggatcttcccgacccagggatcaaacccaagtctcctgcattgcaggcagattctttactgtctgagccatcagggaagcaatcccaagtccctgctcatttggcatgtctgggttctccaaactgttccttctttttatttttcgtgggggtagaagggatgtcatggaagcccaagagtaggaggtggtgggtccatgtgggggaaaatcagccatgaatatggaagggggtgctgggtgatcgtccccttgtggaggcagacatctgtgatgggaaacccaggagggaagaacatgaattctggagtcatagacctgggtttagagcctgactccatcattttctagctgtgtgttcttggcaagttacttcacttctctgtgcccagactgcccaactgcgccacagtggtgatgacagttctgtgtcatggggtgctgggaggaatggaggagctccttagtccttgggcactgtgaatatagggatcaagcagctgaataatctctcctatacttccctgtggggggtgggaggggttcagcagagtctacaaggaagttgccctctattgggt

SEQ ID NO: 36165 - DNA, 799 bp, Bovine  19866881057837
attttcagcttgtcctgaaaaaccacaaaggtctgacccatcaggcccttatcctcaaagagcaaaattctggcctgtggctgggctggggccaccactttggtcctttcattcacagcgcggcccctggacggcagcatgggcatcgtctggcagctcaggagaatttaagttctcattcagagcctgtgctttgacaagacccctgtaaacacaaagtttaagagtaattgctttagagtagtcgttctcaatgtagctgtaacagaggtacccgaagggccagatatctggtccccactacccaggtttctgatttgggaaatctgggtgggaatttgcatgtcttgtaagtttccaggtgatgctgatgctgctggtccagggaccacattttgagaacaaccaatctagaggaagctggccagtgttcttgagttaggctatctggtgcttataggcatgtgagtttgagacccttggaattgaggctgcccgggaccaacctgctgtgtttcactcagccttgtgctcccggtggaaccttctaaatgcttggtccccacaaagcctctgcacaaacaggccattggattcctactgtaacttcttgggtttgtcaccagagttcttggtcttctaggccagccacctccagttcccaggggctgtttatggcacagatggatgtcctgtgtccgtcgagagaattgtgaacactttcaatggtactggctgccccagcttgagagggaagcccaagctcttcttcatccaggcctgtggtggaggtaagcag

SEQ ID NO: 36166 - DNA, 1674 bp, Bovine  19866881058655
tctttgagaccccgtggactgttagcccgtcaggctcctccgtccatgggattatcctagcaagaatactggagtgggttgcattttttttcctccaggggaatcttcctgacccagggatcgaaccagcggctcctgcattggcaggcagattctttatcactgcgccccctgggaagccccctcagccaggcaggagccccctaaagttccttctgcttaattagctcatgtcccttgtttttaagatgagaataaaaatggcacctaactcggtagccttggatgaaatgggaggttgcttacaaaacccttggtacatgggaccacgtaggatacacgctcacctgccatcatggttatcctcactcttctctttaactcaccattttccaggatttccttgggcccgcgtgttctcaagatcctggtttcctcagcaccatttgtgtgtttttagccaacaagtagaaattggtagatgttgtgtaggaggagcgtgcgacgggaggggcttgtgggtgcccacgaagatgaagtagggcaatgtggctaggctggtgcagcatacagacagaagatggccaaagaaaaagaccctcacctgccccttcttctgcccaccaatcccagtgagtcccagcgtctcctagcaacctcagaggtgtgtccccgaatggaacaggtggggacacattgaacactgtcttgctcacctgatattttcacttaggaacgtttagaggacctcgaacagagaaatgccaaagagtcagcagcttgcaactgttccttcaaagagaaagagaggcaggtacagagaccctttctgatcttgcagccagacacaaagtagataccttattttcaaagggtaagagcatgtggggtgcaaacgccagcgtgggcagcccaaaaaacattccaccctccactcccttcccctcccccaccccgggccctgcccctgcccctgctcctgcctgcaacccgcacaagggacctgaaagacccaggatctggaagtgagagaaggcagaagggcagcgcagccatcctgggtgctaaatgatttggggacatagagacaaaaccataagaagagaagagggtaggagtaaggaatcccagaaacctctgccctaagaatgaagtacagtaggtggaagaagcggagaaggcaatggcaccccactccagtactcttgcctggaaaatcccatggatggaggagcctggtaggctgcagtccatggggtcgaggagagtcggaaacgactgagcgacttcactttcacttttcactttcatgcattggagaaggaaatggcaacccactccagtgttgttgcttggagaatcccagggacaggggagccctggtgggctgccgtccattgggtcgcacagagtcagacacaactgaagtgacttagcagcagcagcagcagcagtttctagtgtacagcaaagtgattcagttatacacacacattctttttcagattctttttccattgtacgttattacaacatattgaatatagttcctgatgttatacagtaggtcagtgtctcttttatatgtgaaagtatgtatctgataatcctaaacttctaatttatccctccctctcctttcccttttattaaccttaagtttgctttctattt

SEQ ID NO: 36167 - DNA, 942 bp, Bovine  19866881135106
aaggccctggagagagggtgttatagcttctgtctacctttcatactaaattaatgcctctcaacagggggtgattcccctccccctccccccctaccagggagatgtggcaaagtcagaagacagttctggtggtcacacctggggtagggtgccactggcatcttctgggtggagctcagtgggtgctgctgcgcatcctaaaatgcacaggacagccccccaactccccatgagagtcacccacccagaacatcaacagtacggaggctgagaacccctggtctaaaccacacacggcatcatgatcttgcgtcgaagggagaattctgccttccctggaaggcactgacttaccattttcgtcttggcagtttccagttcagctaatgtttcatttaatttcatggtgaggttctctgctttcagactttcagctatctttgttttctgagccttttctagcatggccagtgcatcatttaatttattatttaaaatgtcttctttttgcatttttaaatccatttcctagacaaacagcaaacatcaaatgaacagaaattcaggtgtaaatatttaccccagcctcccccttcccctgttttcagagaggaggggacctctgttctgttattgttctgttgatccttttaaagtccaaagtccatgctttctctggaaagttccaattattgcagaactcaaattcagctgagatctatctccttgagatttctggcccctgagctcagttctgttacttggagctcattgaacaagttttatttctttcgtatgagacagccctttaaatatttgagaaggctgtcatgtttctccctaaatctgtcttccaggataaatgtgccgagttcttcacccttgagtcataggatctgtgttcaggacattcctccaacttactccgtgacttaggcc

SEQ ID NO: 36168 - DNA, 667 bp, Bovine  19866881157712
taattttttctttattatatgccttctatctgcttatattttgagtgaaaatagcatgctctgttgtggaaatcaattaggatgtttaatcagcttattataaattatataattttgtgtgctgctagcttttttttagtatgtggaagtatgctttgcagtgaggtgttcttggtgtaatgttaaagtattgagacagtcacatttttttccccttacatgtgtctctctctgccaagttaaaaattttaaacatcttaaaaaaacccacagtggtatgtctctataaaatcctaacttaaatttagtgaattcttggattaattacttaggatttcattttgattataggatgaattgaaatctagcatgtttaaagatttttattataagagaactgctccgtttcttacagttaaggaatatttgtggaacattcaaatggaaaacatttattattacttttgttttatacttggttctaggtttttggtccagcattaaacttcgggattatgtgtatgtctttgtatctttgtattagatgctgagtttcggttacattgacaaatgaaatgaagatttttctggttatatcttgtattgattttgttacagtcttaatcatgtttatgcacagtatatgtactcttacatatgatccatt

SEQ ID NO: 36169 - DNA, 1233 bp, Bovine  19866881334636
gatctacttctagagccgctgccgctaggggaccttgtgggtctagacgcttgactagccgcctctgaggagactgatttctagactgggatgagtgtggtgaccgactcctgctgtgctggtaattccgctcgggccttctgcctcgtacctcccgggtaatgtcatccctgtaggtatccctgtgtaccacactgggcagtgtaaactgctcccgagccctaggttcgtatcgggggtcatgagcatcaaaacggtttggacttcgactccgagaagtataatagagcccatgttgtaaagtccgctctcgaggatctctatagtaatcctgatcgtaatgtcttgtccgatcaaatcctcccgtcccccgttcatggtgtccataggcactatgttcataagcacgctccctgttatctgaagccctgcatttaggaggggggaaaaatatttaatcaatcagaaacgggaaagcaaatctaaaagcaagtcatgcaaacattcacttcagcactttctttgtgcaactggtcattttctaaacagcagtaacctactttagtaagcaaacattaacaagcttaacattttacttgactccaaaacttatttccacagctaagcaataactgttgtaactgtatattgggctttcatgactagtgttctgtaagtcaagctgctctttttattagggattttctggcttatatacagaaatagacatatgccatttccttttttattttaaatttaatggaacaagaagagacttttattttaatatgaaaattaaactttctatactttcattggattaaaatatatgccaaactgtatttactttgtaaatgtatttcaggcaaaattttcatgatatgtttttcacacagacatgaaagcctcattgcaatgcatgcccatgtcccagcaataggagggcattttcaaataagtatagaaaaaaatgttaagtataactttttcatattaactttcaatttcttgggtaattataacattagtaaattatgtaaattgctgtgcccaaacaatcacacttaataataaaaacaggatcttaaaaaagaaaatcaaaccaaaaaccacttaggatatcaaaatattgggctgccacatgctattctatgataaatttaactaattaaagaataatggggtattttatcttcttgtgctatcaaattacaaataatttttaaatgccta

SEQ ID NO: 36170 - DNA, 694 bp, Bovine  19866881366177
cctcgtggcgccggcgctcatcgaaaggtgatgctggtgggcggtttcgttggttttttcttttttttgcaagaagacttcctggccgttactgaagccccctgagatttcctggagggtgaaccgcctcatggttcttggaggcctggcagatctgctatggccctccaggaaacccaaggcaggagaccccactgccaacagcttgcatgtatcccccaggggaactgaacgagaagcagaagatagaactggagcggaacgtggcactggtccagcaacaaagcagtgagctaagcgtgctcaaggacaagatggtgcagatgaccggcctggtggagaagaaggacaaggagctggaggtcctcaagcaggctctcaggtgggtgggaaggcctgcacagcaggtgtggggagcccaggcatacccaagtacccagggagcctgacatagagagaggaagggctcagtcaatgatggttaaagagttgaatgaatgagtagatgaatgagtgaatgacatatgtttcattgcttcacaacctcatcatttagaactttgctcagttctgagccttcagagattcctgcccaatatttcagataagtctcagtttaaatgcggcttcctccaggaaatcctcctttactcaccctcaccaaacatagccaagggctcctgctctgcccagg

SEQ ID NO: 36171 - DNA, 811 bp, Bovine  19866881495441
cctttgccctaagtttgaatattgaaagcgcttttcttttttccctttggtcatccggaaacatattttggaaccacccatcttgtttccttaaatcattattttcatcacatttagctgagtttttttcacactaatattcataacaggattaaatactcaagggaggaacaatgtttaaattcaccagccaacaatttgaagttcctttatttttagagaagtcagaatattataattcaaatatgttcctgctagaataagttagtcaagttgtaaatttctttattcaaatgtacttggtactgtttttagtagtcatttgcttcccagtggattgtttctctttccagaacctttgctagaagaactttactagaagttagcagtagtgattattaaaaaaaataagctctgaaatagaatctcttaataaaatgaacattgaaaaatcagttggtataaaacactaatttagatgttagagagttctaaggaagtaaaacccggcccctactttccaagactttaatatcgccaaagctgaaattggtaaatgtaagaatattacagaataatatatgacagcaagatagatacagttaattgccagctgtgtataatagcaaatgttagttccaatattagttgaaatcactttgcataaactgtagactttcctcacatttttaaaacatgtgaccttgaaatcattatccatttgtaaataaaaggcaatgaagcagaatggaataaccaggataatattgaaaattaaaacgttctattgagcatcagcaacaagatactg

SEQ ID NO: 36172 - DNA, 723 bp, Bovine  19866881499949
ctgttctcccgcctctattccctctccagaaacctggattactattttggtgctgtccctcccccatacttccatctggagcctggtgcccagatccaggggtaggacttgtccttcaggtcctaaacctgtccaatccacacttgcatcccctctcccaccacaaccattggttcagagatggtcatgtgacctgaggcaggtccaatcagagagagttgcaggacttctgtgggaacaaccaggaagctctcgctcattccctgatgggtttgaagatgagtgatgtgaggctacagtagcaaaatggaggggatggttttgctctctagaatacgttcaacaatgagtagagacacttctggttgtcacaacttggaggaggagggaagagactactggcatctagtgggtgggaaccaggactgctgctaaatatccttcaaggcacaggattgtagttcacaggattctgggtctcataacaaagaaccatcatccaaaatgtcaatagcgccatagttgagaaaccctggaccagagattctgtaacccgcttgtccccataggacaacccggagctcctacaggccatgtaatggagcctgagagtggactctcacagtgaaaagcagagacaaaagatagagataaccctgagtgctggggacatcaccagagccctggatccagccgtgcctgaaatgagccctgctcctgggg

SEQ ID NO: 36173 - DNA, 748 bp, Bovine  19866881539197
tcgtgtctgactctttgcgacccatggactgtagccagcagcctcctctgtccagggattctccaggcaagaatactggagtggattgccatgtccttctccaggggatattcctgacccaggggttgaacccaagtctttagcgccacttgggaagccccgaaaaacactaactggtttaatctcatgatgcaggggtagttagcctccccatgttatggatgatgaaactggtccaggaggtgaggtggtctgccctagggtcatacagctgttgagtcttgtgatgtgacatcagccactctgatcagcggcacagctccccatcagcctgctttaccacctgctctacatccgggtaccaaaacacagtcttgcatctggttctgaagctgcttccaagggctttcggctgccaccacccacgtcctctctctctgctccccatacctccttctgctgtgttaagtggttctccagatcttgcactttcctcttttctgtctctaaggcttccttggcttttcttttctcatgggccatgctgctctccaaaacctgaaaatcaatgaccggtctttttggttgcctgcacatttagcgggggaaattgctagtaagcatgataccaatagtaacgacagtagctcaaatgttgggggctggtcttatgtgccagggcccaaggccagtgctcctcacccagtttattctcatagcatcctcatccacagagaagttgtgtccc

SEQ ID NO: 36174 - DNA, 1931 bp, Bovine  19866881723477
aaaaaaaacaatgccattctatagagagggaaataaaaccagaaagaacctaaaaatcttcaaaaccttcacagaactctccacctgtttcctctctcttctctgtttaatttctcccttcccaaatgtcttattttagtttcagttttggtttgactgttttccactgtgaatgtacagtactatagccccagcctgttcaccaccaccttcggcaccagcctgggccctccagatgcccctttgtaacattgattccaacagacacagggtttcaagggctgacatcaaacccccctttaatcacgccaaacttcagagggcacaccaccccttgcagaggggaacacaaagccagggacccacagacagacagtacagctgctcatgtccactactgtcccattgagggtcattcttccccagacacttacattgattggcttgaccccagggactcatccagaagtatcatcgcaggcttgagtgctaggttccccaattttaaatgaacatggcactgtcaccccccaccctttctaaaaatatgtgtgtcaaaattcattaattaagctcctcacaatcctgacttgtcttaggactctgcttcaatggtaagaaattctaggttcccttatagagcttctctggtggctcagacattaaagaatctgcctgcaacgcaggggttcaatccctgggtcagaaagatgccttggagaagggaatggctacccactccagtattcttgcctggagaattccatggacagaggagcctggtgggctacagtccatgggttgcaaagagtcagacacgactgagtagctaacttatgaagctatcgttcttttttaattattattatgatctgctaaccacatcccttttaattattattatgatctgctaaccacatccccctgacttatgcacacactaatggtttagatcaggggtcagcaaacttctcccataaagagccacatagtatctgttttcagttgtgcaggtcatgtctttgtcctgatttctcagctctgtggttgcagtgccaaggcaacccacgatgagcatggtggagttccaataaaactttatttacaaaaaaaagcagacagtgggccacatttggcccacatgccgtagcttgccaactactggttctagaatcaaagggaccagggttcagtttcccattgatgtgattcattggtaaacattcctaaactctctaagcctatttcctcctcaagaaagtggaaatgacagaagaaatgattgatctttactagtgaatgattatcatgtgacaagcatttcatgttcatcatctcatctgctgcttctatcaacccaatgcaggaagcactcttactgtccccattgtacagatggagaaactgaggtttctaaagcttctcacttgcccaagactatacccctaggaagaatcagccgcaggctctaatctgaccccgccaactccagaccccattatcttaggccctagatatactgtccacagttttccttgggtttgttgtgtgttgagatgtgaaagagttaatctgtgaagggcctggcctggagtccagattcctaccatggtaactatgtctattaaacaacagtcatgactttcaggctttggaggaaagcattactcaagagaaaaacagagcgaaagaagcattagaagaagaacggaagagagcccaagagctggaggactggttaacccgccagaaaaaggtatgagctcggggaggcagagccggcctgagcccagggcaaggtcaggcagccaggacggactcacctgggacactcatctgggcctgcccaccccagctgccaggctctcagctgcccacagtctccccatggggatgctgtgagtagtaaagagttcacctgcccatgcaat

SEQ ID NO: 36175 - DNA, 3915 bp, Bovine  19866880113610
cagaaatagatgtttttctggaactctcttgcttcttccatgatccagtggatgttggcaatgtgatctctggttcttctgccttttctaaaaccagcttgaacatctggaagttcacggttcacatattgctgaagcctggcttggagaattttgagcattactttactagtgtgtgagatgtgtgcaattgtgtgtggtagtttgagcattctttggcattgcctttctttgggattggaatgaaaactgaccttttccagtcctgtggccactgctgagttttccaaatttgctggcatattgaatgcagcactttcacagcatcatctttcaggatttgaaagagctcaactggaattccatcacctccactagctttgttcgtagtgatgctttctaaggcccacttgacttcacattccaggatgtctggctctggatgagtgatcccaccatcgtgattatctgggttgtgaagatcttttttgtacagttcttctgtgtattcttgccatctcttcttaatatcttctgcttctgttaggtcccataccatttctgtcctttatcgagtccatctttgcatgaaatgttcccttggtatcacacacacaatccttcccaaattcttgctcattaattcctctacatcctcttctccaacaaacacattcccaatcccacttcaaatgctcactcccaaggtcataccttagacctacttagtattaatgagtgtaacccctataaagtatcactttcaagcattacaccccaactaccagctcactccccctaatagcctaactccaacaatcccaagagatattcagtgcattaatccttatcttttcacttctgtgcacctccccaagtcctcaatgcctttcttacccaagttcaatacacattcaatcatttaattagtcccctcccttgtatacaccctgtaatacttgttctttctctttctttgcatacttccgtggctaaaactggtaccaatccaattttctgcatattccacattagaacccacatagctgaatgtggtaataaggacacacaaacacacacacaaagtatgataattggtttccctttaaactcatgatcaggaacctcaaatgagacattaatgctgcctagcaatttcattttatttttgtgattcattcattctgccactgtcctcctacatgactaatgtacttttctctacttaaacttccattaccttccctctcattctcactcatttgatgaccttgttcactatttcattgaaaaaatagaagaaataagaaaagaacttccacaacctctcacaactatatctacccacctaactgcatttgtgctcacatattttcatttctctttcattaccattttggactatctctgatcctgacctttgtacctgtgcactagatctccactaaccaccaccatcatcgctctccttacctactcaaatttgccctctctactgcatctttcccagacccctataaacatgtgaattttctcatctaaaaacaaaaatttcttctgaacatctcaagctactactatatttcttttatccttcattagcaaattcctcagaagaagcattctttctgcctgtctacaatttctcacttccttttctcaagaatccattccaatcagactttctcccaccattctaccaagtctgctattgtcagaaccactagtaaattccacattgccaaattcaacaatcagttctcagttcctcatattatttgaactatcaggagcatctgacagagatttatcactccttccttccttcactctatctccctctttcttccccagcaacaactcttgttgactctaccttcaaaataccaattacttaccatctccactgctaccactttggtctaggccaccatctctcacctagattattgcaacagcctcctaagtggttttactacttttgtgtctgttcagtctgttctcaagagagtaggcagaatagttctttaaaaggaaaatcttatcacatcactattatgttcaaattcatccaaagtccttctatatcacataccacttagactaaaagtgtaggtctttaaaataacttataagacctggattgatttaaccatcatctgcccacctccaccgccctctcacttcatcctccatttacccctttactccactgtgaacaggctctcagaattaaatacctcaggcatgctccagcctcaaggacttggcctttgctattttcctggatctacatctttatatttgtctgcatacctcattcacagactgccttcatgtcattatttaaatataaccttcggcagtgaattttcctagcaatactttgaagtgcaaccactccaatactcaactccactttccctgttttattttccctctttgttacttatcatttaacatgctagtaatggtagcatgttatctttttttatcatcactgatgtgtttccacagcctacagtgtgcttggcataaagtggtcataaaacatttgctaaataaatgaaaccatttccctccttcaaagatgatatcaaattatccacaatatcaagattatatagaaatgggccaatgaaaatctctctctcaactttattttaaatacatctagttagtagctggcttatgtaggattagaactagagctagttcaactaataactatactaatgttgtttccatgaagatttttctggtctctcttttctaatctttgatcaccctgagctctcaaagcaataaatatgttctgcccttttggaacttaccaagttctgttctttgttcaggattgtttatatatctttattatctccccataaacctaaatgtacatccaaggactccatctatctagcacaggtagtctattctcagtagagtctcaaaatatttgtagaaatgaatatgtaagtcaggcacaaaaaggatgaacgtcaaatagaaacaagtgctacaaaacaaactattctgctttgtttatggcaatactgagggctaagaagcagagacagtgaactgatttagcagattttattcataaacaatttatatacctaaaacttacaatgtgagtgcttagcttggggttcaagtaaaagattttgggaaatctgtgaacatcttaaaataatacataaagtttccttttgggctgcaatgtttaaaatattctcaaagaagtctactaagaaagcagttgcaagcaaactttttaaggaaaccattttaaagttgtacttcctattattttctaatgtgatattgactgaattcgtacttttaaaaaatctaatgaatgactccagaacacatttcactacaatttaaattttataattcttcacaaccccatgactgatgagatggctaactataatgctccacttaagaatggcgcattatatttgccatgtttctaaaatattaaattctagaatatgcaatcttatcatttaaaatcatagttcaacatcaataacatatttttcagactacaacatagatattttgtcagtattatggcatcacaggtattaattctgtttagaaaaagaaagataattattacctgaccctggcttgacatttttctttaacaaaacatttgatcccaggaaggtagtttggactgagaacactaaatcgttagtaaaatacattcaaagcattttaatagtagaaataaaagcaaaatgaaagttcatataagttcccttaagtttgcattttacctttaaaaaaaaaactttacaaaatagattataagccttaggttttctcaaagggaaaataaagggtttgtttttttttaattgtatggtttgccatatatcaacagaatccgcc

SEQ ID NO: 36176 - DNA, 2486 bp, Bovine  19866880464286
gatacgcataccttagaggtgaagaaagcagatactcaaacaagcactcactatacatagaacttagcacatgccagggcctgttgtaggaactttacctatggaaactcattttcaccacagtcatataagataaatacattttaactctatttacagatgagaaaacagaggcacagagactctttttaaaagtgacctgccaaagtcacataactggtaaattacagagcgtctgtttgtatgttggtggttcaaatcatcttgcagaataccatcctcagggttactctgagactatgatcagagtagtgaaacaaaacaaggtcacttcataatgttaactaagcacagatgagaacaagatcactatgacactcagaaaacactcaacattttttcagttaaaatgagtgattccttcttctttaccaaataaaattttattctaattctagtctgccatccgataaataagatttattgagatacctaatcctagaatttcccctgctttctgacagcatccagtctagagcagacctctgcttccttagactttcttcccaaatcgcccagtttagagtcctgtctatagtacacgttcttccttgctgcaaagaacagtaagcctaacttaactactggcttgttcctggtggcctttgcttgaagggcattggcacctatttgtcagtgttaaagagctagatgtggtagctaattttccagatgactaaatcactatgaagaagattaatgccatctaaaaaatgggccaaattcaatgaggtaaaaatttgtaacaataaatataaagtcctttgtttaggtttggaaaaaatcaagcacataattaagaacagataacttgacagctatttgtattaataggaaaaaagacttgggaaatgaacaaacattagcaacatcaaaatgagtcaaatgtggaatatgactactgaaaagcactactgtaatttaatgttctatgaaaagtgcagataaacagggggatattgctggttttctctgttacatcctgatcatgtctgggctgtcacattctgtgactcatacttcaagatgtcactatcaaactacagaaagggtggccagtatgctgagggagctataagctgtatcataggaaggacttggtcagtttagcccagaaactttgaaaaggccttccagttcaccatgtttaagtgtttaaagggatgtccccaggaagagaggaaggagactttggtccttaaggaggagtattggtctgactggggacattccaggaccccatgggtgtgaaaaagccactcctggatgaacatctgctctgggtccttgtcttatggccttcagcagtggggcttgggtcccactgggatgggagatctaaggactctgaaacattggggtggaaatagcacagagcttctggacctactgagtggagggacagggcttcttctaaggtgttctcctcctgaggcatggccctgggatttgaggctaaagcctgctgctgctaagtcacgtcagtcgtgtccgactctgtgcgatcccatagacagcagcccaccaggctcccccgtccctgggattctccaggcaagaacagtggagtgggttgccatttccttctccaatgcatgaaagtgaaaatcgaaagtgaagtcgctcagtcgtgatcaattcagcgaccccatggactgcagcctaccaggctcctccgtccatgagattttccaggcaagagtactggagtgggtcgccattgaagataaacagaaaaggaaggaaaacagaaattcattaacaagcattttgtcaactaataatagtaggtacttcatgtgtttttcatgtttctcattttactggatgtctgtcttcataatcattacagaagatataaaacaaacaaaacagagtgcaaatagcaaaagatgaaacactaaaactcaggctagtttcattaaccccactggcttgattccatggcaattagatgggctacagtgagcttttatattttactgctggtatctggggctttgtcttgagttcccctgcccccatccctacatcccagtgctaaccactgcatttttcaaccaatttttatctttctttcctgcatgtggatgcacagtttctcttccattttattggctagcaattttgaaatctttacgtggtaacaggatttgagcatggtttatgttgaccattaccctttgtttgaattcaaaactgcaaggtgtggggatgtctgtgaggtcaagctgcagagcctttattagcctcgagtttcatttgatttctaccagcactctgatagtgcctttcctctctgtgatatttccttttaaaacaagatgctttccattatttcagacctcagaagtgcactgcatgaagtaacacagaggaatgaatcactactggctcttttattaccaagtctcattacatgaata

SEQ ID NO: 36177 - DNA, 1577 bp, Bovine  19866880468494
tggtcagagttttcttttatttgctataaaataacctatttctaattatttaagctagaggaaaactttctttatgcagatagtatattgatgaaagtgaaagtattagttgctcagtcgtgtccaaccctttgatcccatttgatcccatggactgtagcccatcaagctcctctgtccatggaattctccaggcaagaatactggagtggttgccatttccttctccaggggatcttccccaacccagggattaacctgggtctcctgcattgcaggcggattctttactgtctgagccaccaggaaagcccaatatgtttactggtcaagacaataatatcagtcaggtagaatatggttgaatatagtcattagcagctatagactaatccagatgtaatattatagcctaaataaccagtgtgatacttctaggcaacagcaccttgaatgaaatacataatattgtgttatgttttcccaggaaaacaaatcttgacttgtcacttggtataatggggtttgtgtagctacatgaatcctctatgtgtgtgtgtgcgtgtgtgtatatgtgtacactcacgtgcccattttccttcctcctagatttatttatagtgaaaacaaatttctgatcatcttattctgccagttgtcttaaagatgtcagatactttttttaaaaaattgaatcatcgctgtctaaatgtttttcattgttgcagagtttgggatactttacacttcccaaactagctacttctcagagggaaaaaaaataactccatgtttaggctggcaaagtagaatttgaggtgggaatcatgttcgtagaaatttattcaagtgtattccaagaatagttagactgttatatggaaagaaaaaaaaaagtgccaatattgtactaggcactttggaaggggaaaaaatccattcacatatggtttctctccttaaggagttattttctgatataaatgcaacaatgagggcatataggacattcatcctgagagagttacgcactttagattagtctaaaatcatagactgtttgagagtgtttctgtttgagtggaggatgtattaatactatttggggaggattggagaaggaaatggcaacccactccagtgttcttgcctggagaatcccagggacgggggagcctggtgggctgccatctgtggggtcgcacagagttggacacgactgaagcgacttagcagcagcagcagcagcagcagaagtaaagagtcggacatgactgagcgactgaactgactgactgactgactgactgagcagaagtaaggaatgaggcagagaatatacaaatgagtaacaatttcctaataatgtaaagaaatcattaatttggcattattaaagattgtagaatatccatatttaggtattttagggtaattttccttctaaggctgcaggaaggtatactgacttagaatttgatgagtgatcttaaggagttgcttacagaaaaatgttcaagttgggcatatttaactttagggtgctctatacctctacgagttttagtttctaaaat

SEQ ID NO: 36178 - DNA, 896 bp, Bovine  19866880501203
taacgttcacgtgcagaggatactacagactttgccaaaggaatggaaacgcttggtgagcttgtgataaatgtagattccccaggcgaatcaggagacgctgctttaccagtttaaaatgttggtttcctgcagaaggtctgtactgggacaagttccccaggtgattgtcaggagggccatgggccaaacttgcagaaatgccggtgtcacgaattcctgaatgcccagggcccatcagctgtgttttgattggtctaactttcagcagctcaccacctaaggctgtgtcctctgctttccactctgtggagtactgaaacactgagtattttctcacctgttgcattactcattaaaagttcagtatttcgtggtgttttcatagagtacagaaatgctgaggcccatcactccctgacatgcacttgctgacgacttaagggaccatccatcgcaatgcaggagcctcttctgctgactcaggaacaccccagtttcttagaacactgcctctatggttaactggcccagacgtttgaatgaccttgtaagtagctcatcagctaatactctgaagacaagtagcaatttatatcggatatgagtggtcaacaaatatgatttcattagttttattgtctgtttacttcctctggggaaggtagactgataaaattatataggctggtaaatttttggtacattaattgcaagctgcacgacagaatttgtttttttggcaagaggttgacactattactggaattgtactccagcaggggttctgggcttccatttcatcttactgtaacttcagttttatggtggacagaggtactaactttaagtactccattttagtaatgccaaaggcatgaaggcttcttaattct

SEQ ID NO: 36179 - DNA, 1116 bp, Bovine  19866880516458
tgataaatggtttagcctccacgattaaggcccctctataactcacagcaccaaagagggcccaggagcatcggtctcgtgtttgctgtttttctcaaggtggaggagggccatgcttaaaagagtgagggaaaaaatggccaagccatcctgctgcgccctcgggagggaggccctgggatgctggattccacattggggcgtctcacagattctacctccattcttgcagtttaaggccctgcttccctctgattcacaagcttcctgctgctcctagggagctcccagaggttcagctctactggggtgcctccctaactcagagacctgtgattgctcccctttgcctgcaggaggaaagccacaggcctcaggtaggtctccagagctttccgggcaccaagccttctgttaccattcaggaatactttcctgtgaactttttcttccagctctgaaacctgtactgtaccctccagttcttgttgaccctggctgttttcccctcctggaatgcccttcctcctccagggagtcctccaagaagttccacttactggaattactttttcctttcatggactgtgtttggatctctgctgcaaccctgggttcagtcttcttgtagtaacctgtgtgtgcctctgtctcctcctagtgtgagaacctctcaaggctggggacctgatttattcgttctgatctctccttgaggtttaacataatgctttgcacacacaggaaatgctcagtgtttgtgaagtgaattgactttccaatggggagctgctttggtctattctaatttgagacctttgcttagaggcagacccagttcccccatttctaattagacaaagtcttgaccttgactcatggcctgggagaaacttgggacatcaggtttggcaaatacattggcccaagaatccataaatattgatccgttgtttgcagagtaatttaaatgtcagttataagcccaaggcagataaagatctgtattaacaataaaactggatacaagccaccaaaccctagggaagcagctttgggttaagacggaaatggaatgcacaggcctggggagggagggcattagaggggaggcag

SEQ ID NO: 36180 - DNA, 2486 bp, Bovine  19866880554092
agagttggcccaggaatgaatgagagatcaggaatagattcggtcattcatgtgttcttttctgtcctgctctttctttcccctgcctgagttggctcctggctagcaggcaggcgcagctctttgccaagagggctctagttggtcccttccagactcagtttccccaccagtaatagaaggagcacagacccttccagggctgacctcgttctgacccaagctcccactcccccaaagtgacagccgcccactttgtcagcagcctcagtgtcaacagctgaagtgcagcaagaaactgagattaactccactccagaaaaaccgcaggagccagagaaccttgttgaaaatgcctgcttactggaatgcctgctagaaatgacaatcacagtttaattacttctcagagaagagctttctcttcagggctgtggatttgtacccttccagctgctgctttcttgtcatcaccatcctctgggctagctgatttgccccagacagctcctctcgagtaagagcaggagcctgagcccctgtggcaggagctgagtagggactatctgaggcaccagcctggaaatcaggtgatctggggaccaggatgggcctcattgccatgtgaccttgcacgagcctccttatcagtctgggcttcagcttatccatctgtacaatgaggtgataatgcttagactacctcatagagttaatagaaaatcgacggaaatgtaagaacaagacaaaggatgcagctaatatgcctgagaccctatcatatacccggagcccagtggctcagatggtaaagcatctgcctacaacgtgggagacctgggttcgatccctgggttgggaagatcccctggagaaggaaatggcaacccactccagtactcttgcttggaaaatcccatggacggaggagcctggtaggctacagcccacagggttgcaaagagtcggacacgctgagcgacttcacttcacttttacatatcaatacatcactgtgctgtcttttgtgcggattcctctgttctacagaggaggagactgaggcttagagacgttgatgaatgctcatggtcccatggtggtggaattgggatgtgaccccaagtctgcctaacgctgaggaccttgttctcccttccaggctgcactgtctccatcgcatggactgcctgtaaaacctgagagtcctgtccacatgcaagcctttcccagaatcgccatctcagcacacattcatccttcagtaagggttgaagtgtatgggactgaggcaaccctggaggagaagaggaaagaacgccgtgtgagctggaggaggtgggattcgacctgggccttggatggtgggacagagaggaccaacaagggccttgcagtcagagagaaggacaagacctaagacacagcatggggatgggcctgcgaagtgcaggtggtagtgagaagagcatctgactcgagtagaggccacacaggaaatgatggtgaaagggtagcggagatgggtgcatcggggggatgggccatcttctctgtcctcaatctatgaaatgccactctcagattcctcacactctggggtcaatggcagactagttaaaagaaaaattcagaagtagaacccttggagataattatcattttaattgggatcagtgcttcaggctggaaggagaaggttttaatgtggctcagctggtaaagaatctgcctgcaatgcgggagatctgggttcgacccctgggtttgagaagatcccctggagaagggaaaggctactcactccagtattctggcctggagaattccatggactgtatggtccatgggggtcgtaaagagtcagacacgaatgagcgactttcacttcactttcattttccagttagcagctggcaagtccagttggagctgggatgtggtcacaccacagcgatgcagccagaccatcctcttccttctcccccacctttctgttcaatgaacctcaactggtgcctcccctctagcagaccttccagtaggtgatctccacgctgtatctcatttaattctctaagaagccccagagctgacagcaagttatttctctccatcccactctcaggctgcccagggtttcttcaaccccatttgcagatgtagcagctgaaggctagatggttgaagttacttgtgtgcagtcccctgccagttctcactggcagaaatgacactagttttcaggtcctctcagctccctgcctggtgctctcttgctgatagcccttggtctgatggaaagaagaaaaggaaggtccatgcctgccttcaccagacctcagtttggagtctcagttggtcagagtcaccatgaatctcccttggcctggagagcaaggaaattgaccaaaaagccaacttccagtcaattgcactttctcactttaaggactacattatttaaaaaagtatagccatttcat

SEQ ID NO: 36181 - DNA, 1339 bp, Bovine  19866880620256
gggctttcctggggcttgaaacacacaacagaagatcaattagattgctctgacccatgtgtcatcaatatgatggcagacaccagcagtgctcagctttcctgatttacttcctcgcaatttccctagcacagaagccaggtcccatcatgaaagaaagccagtgttcaagagagaggcatttctatgcctggtagcctttgtgattacagttgtcacctacaatcagtttaagttatgaaaaattagagttggaattaatggaaatacatggcatatgaagctatagcttgtaggcacccaatgtacacttcctcttagcgcttaacgtaagaattcaaatggtctctttatgggtcttcttctgctattagatagtaagctttccacaggtttttattttctttttctagcagtgattatgagtatgtatcttagaatcagatttctgagattcaaaccctatcacttaatagctctcccacttaataattgtgtggcctcagtttctttattggtaaactggtaaaaattggaatcataacagtattaatatatagggtcattaggagaattaaatgagtaaatgcttaatacaagccactgttcttattatttttatcatctttgtgtcctagtatctagcctttcaggtcttctcttgtggctcagtaggtaaaaaatctgcctgtaatgcaggagaaggaaatggcaacacgctccagtgttcttgcctggagaatcccagggactgcggaagcctgctgggctgccgtctatggggtagcatagagtcggacacgactgaagcgacttagcagcggcagcaacagtaatgcaggagaccacctcctccaatgcaggagttgttgctgttcagtcaccaagtcgtgtttgactctgtgattccatagactgcagcacttcaggagtgccgtgttcaatcactgggttcgatcccagggttaggaagatcccctgaagaaggaaatggcaacctgctccagtattcttgcttgggaaatcccatggacagaggagcctggtgggctacagtccatggggttggaagagttggacatgacttaaggactaagccactacaaccatcaccatcgggcctttcacccagcagctcttccaaagatgtttgctgagctggaaacacaagcaaaaatattccttggagttgcaaatgataacagtgctatatttttgcaaattcaacaatagaacacaaagacaataaaaacaaagtttgttgtcaaggaattgggaatacacattattattctgactacaacacaaacaaacaagactcatattccaggatctaaaa

SEQ ID NO: 36182 - DNA, 1298 bp, Bovine  19866880647163
ggttctacattgtgacttggagaaaataagaggcttaattactttgggctaaagtacacaggcatttgacattttgaaaaatagttttatgacatttctttgaaaggtctggaccaaaggcagctgcttctactttgaggagatggcagaaacggagaaggatagcaagcaagtgagaaaaactttgcattttaacaatactccctaacatttaccaagtgctttatacttttcaaagcagctttacattcattactaaattatttgatttttacaattactgaccatgagagagacagcagggggtgaagaaattctgttacttactaactggatgggccttgtcaaattaacttctctgaccttagctttctctttcttaaagtggagatattacctgcttgcaggcttgtggtaacaaatgaatgaaatgcaaattgtaatcagagtccctagcatagctgctagcaccgagcagatgcttactagctgtgagtttcctttgcctcccattgtatatatgtgccagctgaggagagagatataatgtgagtccataaagggctggaaccagtgcctggcccagagatttttctcgctacaacatatagacactcaggaaaggctagttctcaaaataaaacaaatacctatttgcagggtagtgatggagacgcagacagagagaagagatttgtggacacagtaggggaaggtgggacgaatggagagagcagcattgaaacatgtacatgactgtatgtaacatagaccgccagtgggaactggctgtatgacacagggagctcaaacccagtgctctgcgactgcctagaggggtaggacaggagacagagagaggttcaagaaggaggggacataggtatgcctatggctgattcgtgttgatgtatggcagaaaccaacacaatattgtaaagcaattatccttcaattaaaaataagtaaatttaaaaactcaatattcaaaaagactaaaaaaggaacaaataccgattatcacatttccccctaaatttcatactgggagtagaatctgaaatgggtctgtagggcttctaatagtagaataagaggcaagtgagagaaaagagactcagtgtggaagacaacagccaaacagatgggtgaggggagaaggaagcgcatggtgaggctggcttcagacaatgtgtcttctctgccaagcttccagtagaaacggctgacagaaggcacagaaccaagagcatccagagctacaggaagttccaacaccaggcgagaaagacctgctg

SEQ ID NO: 36183 - DNA, 1520 bp, Bovine  19866880649821
cgcccaaagccccagagcagccaaggagctggacagggagggctgggcccaagggcactggctcccacaccgcattgccccctgccctctgccccagctctcagccctgcccagcctggcacagagcagaaaccatgaccacctgtagggtcaaagtatgagggcaccagggatggcacctggagcagaccacagattctgagggggcggtgatggtagcacggggttgtgggtccatctgggggggcccctaactctccccagactccacagggcccagggggacctctctgctcactccctcctggctgtggcccatatgctcacagcgcactgatctatgcaggcttcccatgcccaggccacctgccctcctcagcaggccacctctcctccccaacctgtacctgactcttccacgaccaggccctggggcgggggagggctcctccttcagcccggccgacccaacacaaaccccagcagagcccccagacgtacgtatcggctcaaactgtccttctcttctgctttccgcttcttggcttccatgctgtagtctgcagatccccggtgcttctcactagctcgcaggctttccgagggcgacactgagttattctggaagcaaggaggagactcagtgtgaacatttcattcgtgcatcgatatagctcagtggggtgacccagaaggtcagttgaggtgtcgtgtgtgccctgtaggtcttggctccatcagagcctcaccagggagggacgccctcccaactccccagatttggttcctctgggagaggccctgagagcatgacaattctcttttgtagcaatgtcgctgctgttagataattaaccttgcacgagccactggcctctggcctattagcctgtgcgcttcatgaaggcgggggtcgcacctatctccttttccacccctctgtgctcaaagaatggataaactgaatttgtacagagtcttgaagacggatctgagccgacaaactggggctatgcacaatacctcatctgctaaacctgacaggaagagggactgacaggcaggggagctgccaggtgccaacaggtctcccagtgtaagtacgcaacgggccattttgtgtgaatgcccctccatgacggcttggcctcccgcaattttagagagaaacaccagggttgcaatgatgcagaaaacacaatgtcatgaagcctctccctctgaagatgggaaaaggcatagagggcaggtggaattcccctccactctgtgatgatggccaagtccaggtcccgagacgacgggaaacgtgcccaaggtcccccagcaggaggccacttgaagaaaacccgaggcttttatgcctggaaagaactaatgagttctcccttcaactacaaagcaagtgaggatgagaagagtttggaatgtaaggcctgggaagagggaaggtgggctaacaaggtgaggcaggagaaacaatgacagtgggtctgaggatggagcagtcttggaagttg

SEQ ID NO: 36184 - DNA, 1171 bp, Bovine  19866880660915
tgttgtgggggttgtcctgtgcattgtaggaagtaaatagtgtccctggcccctacctagtagacgccagcagcaccacccgctccagttgggacaaacaaaaacgcctccatgttttgccaaatgtgccctggaggcaaaatgggcctagtgagaaccaccccttatagctggcacgtgttgccaagcacagaaacgcatgctgatggggggagggcacggtctccctttattggtcttcacctgaagtcataacggggagtttctgacattgtggggaaggcaggcggcagctggcaacgtgccctataaactgcagctcagagacgacctcagctttgccacttgctccctctctgaacactaacctggaagcctggcctgaaccactttcaaaactctgagattcccaacctacatctaactacattctttaggttctttgggttttcaccctgaactaccaacactctgcttcttagactcttttattgttaagtctacaagggcaataaaaagcctcaaagggtttccgggacatcaaaaacaaaggagaaggggagacctccaacctttgtattttgttacacaagtgaattagacacatatggaatatgtttccttctagctgggtgctattttaagatttaggagaaggtccttaaaatatttcccagccctttatggctgcctgcgtttttagaggaactggctgtcacataggagttgcagtcaccaaggctgtagcccaggattctgagagagttggtagttgcttgacgaggagccctggtcatcatgacccaggacatccaagaagatgggtattgcacctttggactggagtggtcagggagggctttgaaagaaagaagagcatagacatttttatagttctcaacagtctctgaacatgagatacactttcaactctcaggatctttgctcaagattttctctctacctggaaagccctatctcctttgtgtacttaaagtgaaagtgaaaatcactcagttgtgtctgactctttgcaactccgtggactatacagtccatggaattctccaggccagaatacgggagtgggtaggtgttcctttctccaggggatctttccaacccagggatcaaatccaggtctccccagttgcaagctattctttaccag

SEQ ID NO: 36185 - DNA, 1923 bp, Bovine  19866880689865
gtacagatcaaatctggtttgctctatactcctggctcctaacagtagtacatgtcccatgatacgtgcttagtaaatagttaccgaatgcctgaaggaaccatgctttcaacataaagttccctctccttaaatagagaagtagagtgaatggaaactgaaaactagctcagaactttaagccaagccaatccacccaccgactgattgaatagatacacagacagagcatagccagtgtcagaggctagggactgacatggagtacaaagagaattgttcatgcttgaagcagtgcactcatcagtggggaaaccaaacttgaacaattagagcagttataaaaccgtgttattaataagtagtatggacagcatattatgggcgtgaggaggatcaggcagctctaagagggtcagaacgggatatccataaaggagatcacatttgtcccaagtatttaaggatgaacaggagttgtgggttgagagaaagcaaggcattttagacacactggcccttgaatggcctgcccctctgtagtgatgagctagtttgctcctggatggctaaaggttttacagatcccttatgctggggctggaggctactctttggagcaatggtccccaacctttttggcaccagggacaagttttccccaccctggggttgtggtggtttccagatgatccaagcacatacatttattgtgcactttatttctattacatcagctccatctcagatgatccggcattaggtcccagaggttggcgaccgctgccgggaggaccctcagtatctcccatgagggggctataggagggcaggcacaaagtatgagggaggaaggaggaagagagggagcccacaggcctgagtcactttggagagcacagcagagaggcggccctctctgcagagcactatttggaaaccagcgccaagtgctgtgcatgcatgatgtagatcagcgtgtcaatgaaagttatttgcatttaagcttgtttggggacatactccctagtccctgggaagcctcaaggaccgatgttaccagttggctcacttttatcagggtgtaatacctgcctctgaccctgctggcctggttccaggacctacagctgtcaggcctccgagccctgccccaacatggggcagagctacactgctgatgcagcaccctctgaacccaagggtcaaggaattgcagtcatttgtaaattatcatctggtgattggtgccctggtttactaaaactcaccaggcagggagttacttcgtagttattctttaaaaaaattcacttttaaagcttaaatataagcatttaagaaagaagctttatatcattctcctaaatgggacagaggagcctggtgggctgcagtccatggggtcacgaagagtcggacacgactgagtgatttccctttcacttttcactttcatgcattggaggaggaaaagacaacccactccagtgttcttgcctggagaatcccagggacggcggagcctggtgggctgctgtttttaaagtcacacagagtcggacacgactgaagtgacttagcagcagcagcagcagcaaatgggtatcactcatctttttaaaaaggtctccatactactaagtgtaatgtcaataaatctaaccacacctctcttctagtcctcctgactccctctttgttacttgaaagggacgtggggcagtgtttgagaggtgctaaggactcatcagcatcctcgagaattagaaagagaaaaactttcttgctctgtgggcaatgattttctttttcttttgattgaagtatagctgacttacaatgttgtgctaatttctgctatacagcaaagtgactcaattatacacatatatacattccttctttatattctttttcatt

SEQ ID NO: 36186 - DNA, 1461 bp, Bovine  19866880693894
taacaacaaaggcagacagacactgatggtgtcccgagctgtctaaagctccgtccacacgctgagctcaacagtggcctcagtaagccctgacatgagtgctgaagcagcaggcgttcacctcggtgtcaaacctgaccaagtcccgcagagacaggccctcactccgactccctgcctggtgctctggcccatctgtgaggctccagccctggcccggggcagaccctcccctcaagcacagtcagctcagccccattgtgcctacccattatacctagcgggtccatgcctggaggtttgcctggcatcgaccggagccccggggtcgtgctggtgccaggagttggggcatcattccgcggggttggtgtgttggacttgagtccaggggtggaggatttgtcattctgcaagggggaaacgcagacaccaagggaggctatggagattcctttctccaagagctagacaccacatgaggcctagttctcaatcttctgccacacaaccccttcattcttgcccaatcttgtttggcagggactgtgttcattgttcccattttacagatgcagcaaccgaggctcagaaagagtaactaagcacagggttcagcctgtacgtggtaaagccaggatgtgaacccaggccaagccccaatccatgtgctttctgctccacccctccaccttctaatcagcagcactccaggtgcagccccttttccagaaactttttctctctgccccaaccctccctagccctctcctagtctgcggtgtcaggagcagaccccacatacatgaccaaggtctttggtcttggaggagggcgtgctgctggaggaggccaccgaggcggggctggtgggggcatccttcttcaggccacgggccttgtccagcccattttcaggaggggagtgtgccgggctgacccggggtgtcgcagggtcctaaggacacaagtgaggcagagatgtgctaagagctacgatgagcctgagtcttctctggtcccaaggggaggccaccagctcttaacaacctagtctgacccttcctcatcccagagacggggagactgaggacagagcgggtgggtggacgggatctgctcaagatcaaacatgagttcaggcctccatgctggggagctggccctcttgacttcgtgtagatcccttctagctcctcattcccagctgaggctgacccacggggctcaccaccctaaaaccctagggatggtgcggagaatagagctgacctagaggaccaagggagccggccccccactgggatcttcaggggtctctctctctggagacccatcctaggaagccagcatgctgaatgactccccagccactaagcagccaagccctgtcttcctcctcctgaccagcctgatgcccccaacccaaaggcctcaaacccagctggggctgccggtaag

SEQ ID NO: 36187 - DNA, 1412 bp, Bovine  19866880734418
acaaaactctctgcagatcctgagagttggtaaggcccagagccccaggggtagatggtgaagtttttcttcctggcttgcctgccacaaacccttggggacctaggcccaccgcaacccatctcagggctcgtctccttttcggcaacaggcagggcctcagtgggaccctctgtggtcttggactcttccagccgctgggtcgtgacaacagcccaggagaggagccagggcaccctgccattaaaaagagaattcttttgtggctgcaaagccgaggtgagtccctggctcccacacctccccaggagctgccttcggggttacccctggtcagtgctcactttggggttctggaacccgaggttattagcttataatcaccttgttcgaggctggctgggagatgtgaaacgcgtctgaccccgggcaaggggaatgcagccaagttctctgattgcagttaagagggttcaccagcctctccctgaaggtgagctgcaaaagtctgggtggggattttagaggcaaagaggaggcattaaccattgtgagggccagcgtccctgcctccaccctgcaaatgcagcaagctggcatcattcaagtccttgggtttggacggtgtcctgtgagggccagaatagtccagtttttctccagtacagaagggcagacctatgcaagccggcatcttttggtcatggaacatgggcagcctttgtgacttccgatgctgaggccctcacctgcagaacagggaagacggcagtggtcacctcacagagctcagataaagagttgctgcataaaccattcctggggtttcttccagaaagatcgtggagtacaatattaagactcgaattctccttggtgactaaattataagaaacctcagataactttcatggctctgaactttagtcttcccaactgtatgatgggtatactgagccctgtctggtgagctggctgggagattacatggcagacatactgtgtagaagatgccagactctgcgcccaggcacagactgggtgcttactgagcagtctaccaggacctgctggaggctgggaccataggttgtaaagagaggaagacctaggggcccaggacagctggttcaaatggttcaaggctcaacttcccagagggagagagcttcgacttgtgtatctcaggagcgctgaactgggtccagggactaagcattgtaacctagaagtattttaatccaaagtgaagagcagctagagggctcgatggtcaggcagctgcggtgggcatgagtgccctgtccttggatgtatccagcatgtatcatcgctgggtcgaggggctctggtaccagggagggcggaggctcactggctgatttctaaggtcccttctgtgatcacgagtt

SEQ ID NO: 36188 - DNA, 1126 bp, Bovine  19866880735890
atttctagctcagaccttttatctggatttcagtcttatgtagcctaaaacccactcaacatcttagaattctaacaggcatttcaaactcaacatatcccaaattcctaatctcccctccttaaaactgtctccaccaacaactctcctcaactgagctgttgcacctccatctttcccctcgcttagcccaaagcctgggaagtgccttcaacatctttctcttatgccccacatccaagagagaagcagacccggaagtcccctaccttcaagcagatccagattctggccacttctcaccacttccctgaccccacgctgcccaaagccaccactgcctctcctctgtgtgtgtgagtgccaagtcgtttcagtcgtgttcaactctttgtgaccctatggacccatcaggctcccctgtccatgggattctccggtcaagaacactagaatgggttgccatgacttcctccaggggatattcccaacccagtgaccaaacccacattccttctgttttccgcattggcaggtgggttccttaccactggcaccacctgggaagccccccctcttctctacatcgtagcaaagctttcctaagggtctccccactcccctcctttcctccctaccatctcttcttaaccagaagattcctttgaaaagtgaaatctcatctctcctctgctcaaaaccctgaaatatccttccacatcattcagagtcaaacctcaaatccttacaatggccaccgaagccctgtggggtctgcactttcccacctccatctcagtgactttttctgtcccctccaccccattattctggtcccagtcacaccagcctcctccttgttcttgaacactacacaacagctttgaaattctgtataatcatcccttttgcctaggaagcccctctctcatctctgcttggccaactccctcacctgcatctcatctttgctaaaatgtcaccccttctgtgggggtttctagcccacacctcccactacattctccatccccctttcccagctctacatttcatttccccttagcacttgctgcttttaacaactgtataatttacttagggactatagttactatatctctcc

SEQ ID NO: 36189 - DNA, 3772 bp, Bovine  19866880752849
aatgaaatgcaactctttcattgttcagatagaggaaccatgtctctgagagctttttatcaaagtgacaaaggtaccagatcatggtgactggaaagatgtatccacagaaataatggcaattattcatacacatttgagtacatttttctatggctgtggtacagtgaaatactgcccctatgcaactgagattttaccatacttgaccattttgagaaagaaaccaaaggaacgaagaaattatggactcagaactgctgccatggaaatctatccgagctccaggtccacttggcactgtcttccacagtcaccccttggtctcgccctgggaaggtgggccccgggcagaatccacaccagcaaggccatctccagtcacaaccctagaaaggctctctttctggagtagaagggtttgtagccacaagagttgtaaccaaaagagcttctaatcatttagaagacttggttccccatggggcttccctggaagtccagtggttaggactttgctctccaatgcagggagcatgactttgattcctggtcaaggactaggagatatggccagaaattaaaaaagaagaagaagatttggttccctagaatattccacggaattaatttctcctctggagtcctcttactacgtagcattgaggtcactcttgctgttaccttttattcagttatcacctctataaaaagaccaaatcctttaagaaactgtggctcgtgtccttttgtcttcctctccgttcctggtggagaacggtgacaggaaagtggagatcatccccattttacagatagagaaggctgtagagaggtgcagagaagggtgcagctagcttctgaccgtgccagactggagtgcagagaggagaggtctgcaggcattggtcctgggaagttctgtcactgggggtggacagagtaccacttggcctggccttgcaaagaagagccagctcagctgctccaaagagagccaggccagtgagaggagagcatgtggacaggccttaaaatcttttttccccctttttattacagttcaaaaagatccaggtgactcattttgtggtgatgctgtgaccctctgtcccctttcccagggaagtgaggggaggttatgccctaagtctattcttactgattctggcataaaagatgctcttcctggggaataaggattgtggccatcaagctgggggtatgggagagacaccatttgattaggtggaaggggtacttggtctgactacctgaattttaatctcaattattatttttattactagctgtgtgatcttagacaagtcacttaacctctctgaacctcggtttatgcttttgtgaaataattacccttttggagttatcagtagtcttaaataaaataatacgtgtggccatgtttcatagactgaagagcattgtaccaatattagttactgttattgtaaaaatgattttatttatttatgtattttggctgtgctgggtcttctctgctgcgtgggcttttctctggttgcaccgagtgggggctactctttgctgtcgtgttcaggcttctcactgcagtggcttctgttgcagaacataggctctagggcttcggcagttacgttcccaggctctagagcacaggctcaatagctgtgtatggtcttagttgagccatggcatgtgggattttcccagaccagtgactgaacccatgtctcctgcactggcaagtggattctttaccaatgagccaccagggaagccctattgttattttttgatacgccctacaaaagatatttgctaaaacccgtgttggggctctgagcgcaaggacacacagacagtgcacgtcatcccttgtatgtgacttctgcttcgaaaacagggtgaaataaacatacacagcagatcttcagactatcacagaccagggaaggaatgagtttcccgaagaaaacccccagcaatcacgttccctgaggttgggaaatgtgggctgtaatagctttgccatcatcaacactatgccggaatcacttctgggtagaatttagaagacaggggacagagagtgcagtgggcaccacgcccacacacatggttcaaacgcaagtttaccaccgaaaatgacccgaggattctggtaaaaagagttgtcattcaagatcagccttgactcatttctcccacaaaggaggaaatggaaagtcagcaagggagagcagacttcatatctaggtgatcttgagtgccccatctctcccccctcccttctactgaactatttcccttttcacctctctcacagctaatttcactattagagatgaattctggacttccccagaggtcacagactctgcctttcaaagcacagggtgcaggttcgatccctggttggggaactaagatccacgtgccccggggtgtgaccaaaaagtaaagagagagagaagtgcctttctctggttattcagtctctcagagttctctattacaaatgcaaaacttcctgagagaagtgacaggtaaatccagacagtgttccagttcaggcaatcccagagaccgcaattgtttccactgggtacctgagggagcaaaagggctgagtggggaaacagagattgttgtcccattttccagatggggaaactgagacttgggagaaataaagaaaacaattagcagtctgaggtgggagaaggccaaaccccgctttctcaccctcattgtgtgttttcttcagagtcattcaaaggcaactccaagcaatttgtctcagagaaaataagcatccattgtcttccctgttcttatctctggggcaacccaggctatgtgggcagcatgtggtcccttctcaagcacatccatgcataagctggagggtaatcatgactcctgtgcctggttctaaataacataactaggtcaatcaggccctctctctctggaattcaaactgaggtctaagggacgttgcaactgtgtcacactggagctcagaggtccagtagacacaagggtggtgtggccattacagggctataaacaccccaagtttctgagtaagaagaaacccagggagccagtcagccaggggagaaggggcacaaagaaccacaggaagagatacccaaggaacagtcccagtccctgagcaaggaagatgccccagtcctagggcagcgacccttaaatgtctgcccgtgggatgttaggataactgtggagcagcgtctgccaagatgtgtctcccaattatgctctttctaactgggcgtatcgctgacattaccttgtccttgctgtttcactgaatgctgaatttaagggaggcagataactttgatttccaggtaacaacctgaaatcaagagatgccccgtctgtgagtgatacaggagttatggcacctcattgctgatgaggataccccaacatgccaccctgatactgtactgacggtacctgtgctgctagtatgccagaggggaactgggggctgtacagagggagaaggagccaaatgtttggtgaccctaagagtaaactgacctctagtcatcatgttgttctctgaatatttccaatgcctggacttctgcaggttactgcaacctgctagggttgcacgtccaggccccttgtgtagggcagggccgtgtgaccttatctggacaatgagttatgagcgaaagttttaaagatctacggaggcccctcagtctcctgccttctctca

SEQ ID NO: 36190 - DNA, 866 bp, Bovine  19866880783953
acagatgcccacctccaccagtatatgtatgtatattgtttattcattatgcacattcaaatgtaataatatattatgtatacaatgaacatggatgatttgaaatgcaattttgaaatgtaaataacattcctatacttttcttcccagcctattatttcttcccatttgccaatgtccagcctggggattatgcaccccatttggtaaccactgactaaaaacatgggctttggagcccaacagacctctgtttgaattcaggctttttttgtgaatttctatatggcattagaccagcctctcagccacaatttcttcttctgtaaattgagttgataatttctaatttgctgtgtggctcagatgaggtggtgggtccagggtcttgcagggtggaagagcccacatatgctaactatggtgctgatgaccatgattgggtttccctttctagtttaaattatttaaactcaaccccagataccacaggctatgggcttgttttctgagctgccgcatagtcaccagagatggtgagtcatgcccagtgtaggatgggcctaagtcttctgtccccctaatctgatggccccagattccatgcagatggatggacctgggacctggatgaagcaaggtggacttggtgaccccgcaggttggatggaactgagagataggtcaagtttccgctttctctgtgttccttataaaataatggaagtgtcagcttgggttcatgggccggtcacagtttcaatccctccctaacttcataaggcaagtccatgaattatacagtgccggagcagacggcgcgaagtacggatgcatcacaagccgggcttaataaggacattcca

SEQ ID NO: 36191 - DNA, 740 bp, Bovine  19866880789420
ggactccccatggtgagtcaggagatttcacgaggcagggcctcggcccgtggggctgcccacgtgttataccaaggcgtgtctgctgttactgagagggccccggcctgtgttgtcgctggaacaggggctttgctctgctcagccatcttgggctctgaagaggcagcgtggtgctggtgggacaggacgtggtggaggaggaagctggggtggcggcgttgtatagtagggggacggagggcggcacccctcactaagggctgggcttgtcttgccttacaggttggctttgaccctcaccctcccatgcgggccacaggcctgccctcaagcctcgcctccattcctggtggaaaaccgtaagccttgactacttattttctgcttgttggggagggcagagagcacaccacccactcacccatcccctgccctgatgggcctctcctggggaaaggtgtctgcctctctaggggtgcccctggggcaggttgcaatcccacggatggctgcctggctgcactcctgatcgcccccaggctccctctgaaaggggaagaaggtttggggttgaggttgtgatccctggacttgagaggggaggaacatttcacatgttgggcttcccaaccagatgccacggatcttccctgccctgggggttcctgtgggttctagccgcagctggcactcctatgacctgaaccagcgggcagactacacggctcaccccggct

SEQ ID NO: 36192 - DNA, 1442 bp, Bovine  19866880803812
ctggactgtgcccaagggctgctttatggctagtgtggctgataagtcaagattcaccaatgttaaacagttcattgctccaggtaagtcctgctttatgtgtgtttgctaattttatgttgatttatggcacctgatactcccttaaaatggtttttatggttgtaaaaatcacattagtagatgccttgatattacatagataaagacacaaatagtgtcacccaaatgaaatctaaaaaaggatcagctaaaaagttcaaggttatataaggaatatttactgtgtgaagagccaggccacaagaaccaggttactgcatgagggctttctccttccagagctctatatcccataggaatgaagttcctcagtttaatatttaagcatagtgttcatcctttaattttcaaactattttgcattaaagtagaaatttttctttctagagagagccatcctttcctttgcctattttttaccagtagctttttattttttcaagttaatatagcatcaccaaccaggcctgcttcctatgtggaattttgttaatgtgctagattgtttcaaacttcatataaagccatttcattaataaaatcttttataaaatcaaattaactttatgcaacatttccccttttaataagacagtctcattaattgggatgtaatgtatttctctccactaatcaatatccatgagaattaatgagttcattagttaaaaagacaatggaataattttagttagcacctcaggcttagttttctgtggagaaatgttgtcaagagcagaactcatccttcctcgcaccagccttgccagttggtaaataaaaagagagaaaaggttagaagaccttttctgtattctctccttgtcctttattgatggctgtgtaattcacagaccttgaaagccacaatacaaatctactccttctagatggccttaagtaacggatttatgagtgtttaatgcagtgcaaataatgagtgacctttagttttgtattctgtgactaaaacttcttttatcctgtggcattctgtgatattctagtacacagagcatctttgcctattgtaaaacaacaagcttggctgggtgagaaagtacatggagatgtttaagaatatttagcttatggcttgtagcaggaaatgcttagactaaaaaggacttttgattttgggttcttctagagggcttatttttacactgatgaatagtgtagtctggattagggtggaaaacagcagccctcatcttgatctcctcaagggctgagaagctttttagaaccatcccttgaattctgttctatttagagcagtaaaagaaactgagcatattataagcaaacaggtagcagcaacagggaagaagaaacatttttgttgttcgatttcttcttccttcttcttcctgctg

SEQ ID NO: 36193 - DNA, 693 bp, Bovine  19866880822882
acctctctagttctttggccccagctgatgatgaaggacccccaacttctgaaaatgttccactctcgtctggtatcaagttctcaggcaatgcctcattcttgctcagaaagaagtccaacattcccagccatattgctatgccattgccttgtccaaagacatcagctagggagccttgtccaattcatgggtaccactgctttctcacccataggcccaatatcccaggtatcacagcctcaatggggctccatctctgctccatagggcgtcaccatccttgtgccactgctctcaggggcccagagcctaggtgacggtgggcatgcgcatctccactctctgctgacttctgtttcctggcgatcttgctgctctattagtgtagggccaggcttcttacactgggatggggttccctgatgctatgtcagggagtgagaacaccacaaaataaatacgtgcatcttagtggagcatcagtgtccttcactggtagctaattgaaaatatatatatttaaatattaaaagaataattatatggaagggtaggatacaaaactaccctacaattttaagtcaaacccaaggtgcatccatagttgtcatttgtgactctgtcacagatctcccaggagtctctcatcatctttcagtggatggttaattataaatatgaaaagtcctg

SEQ ID NO: 36194 - DNA, 1040 bp, Bovine  19866880832099
agcataggctgaggttgagagagcaatagagactcccactgaccccctctgcactggtgacaagaagcagaccacgagagtttgggggcatttcacctcagctgggaccactctgtcatcagagcagtttcacacaaggccctggcagtcttttcatcgggtgcaattggctggaaatgaggcaggcagatgcctccagaccttccctggcaaaggcagacaggaattctatgactggcttggaccaatcgtgcaccttccaagctctgccctgagaaaggtgttcgcttactttgctctgattttgtcccttggggtggcatggtttcagatgcagagggcctggcgtggagtccctgctctattacatcagctacacgagcctggaccacggggttgcctgtgcaacccagagcaagttcagttatcctctttgtgagaattccaacttcacagcattctgaggactagttgaatgtgctttataatctgttgagtgctagtcccatgtacattctgatcactgccatttgccctgggttttgggtgaggggccagataccaccatgggttgttttgtcccctctttcttctcatctctaatttccaacacagagcactcagccaaaaagaggagaattgggcacagaggccaaatccccagcatagaaacagtagtgccattgtaaatgcctccagcaacggcaccccacccagctgagggagcctcgttcccaaccccgcttaacaacgcacagcctgatttaatacgagcagctgatctcattgcttccatagcaagtttaatttgctgggaaagcgagttggtgaagttctaataatgcagagctgcaaataataccgaagagagtttgcattatgataactttccaattaaaatggattaatggaggagaaacggcagcagtagtgtctagacaacatattactaaatccttggagagggagatggaaaggagttggggaaacgggagaaataaacaggggaacttcacgagttggaggcacccttgtgtgat

SEQ ID NO: 36195 - DNA, 1399 bp, Bovine  19866880842293
ccctctgtgtgtgtgtttatgagaccctccactctcccccagtaggccttcatctgtgggcatcaaaagccacagtgaggagttgggggaatgggatcatgtgttacagaacagggtgattgtctgtctgtggccctggctaagtttgtgagatcctggaattgccctgcacatctctgggcctggagctgagccggcctgcaggacaagttggctggaaggatgggtcccttcctaagttgtggctgatctgtgctgtagcccatctggggagtaactagttgtggcgaccactactcgttcactaaagaggcatgctatactaaagtgtgacatactctgggctgcaacaggtggcagttcctgcggggcaagtctggggatcctgacaagatgccccccacccttgtcctgtccctgggtgcagggtcctcctgcaactcagttaacagagaacgaggacttgctccctgcactcagagaccagctgcagctgtcccctccccgcaaggaggaaacacagcagctcacacctggaccaacaggaatggagaagcaaatgaagcaaactaccgcctggccatagaaacctgtagaaccctagtgtctggctggctctgtccctggccacgggctgcttgggtcctggccagagctcagaagtccccagagtgaccccaggggctgttcgcaggtccgcacttcccactcgaggctcccctggcagctgctcctgctcctcccactagaggaggaggccatgcttagcgtgccaatgacggtggctgaggggacctggcctcctgcctccctcctttcagtccagcacttgatccctagtcaccttccctccccaggctcctccacatcctgctcccttctcattagctcaagctcctcttaacttagtgctaatgcctttggctccaacttacccatttccctggagagtcctgatgttgtgtttcttaagcccatcctgaatctctagtcgatgaggctgtgtttcttggtttcagtcccttaatgggctttcagaattttctgcctcagcttttctttcccttcacaacaaaaagacatgactattaataaggagagtttttttgaaatttcttggttgttaaatcagtttttctttttactcattcaaaggagtgtttttgtagccaggagggtgtttgtctcttcagagtagcggctgcttctgtccagtagaatggaagccccacgagggcaggggcctcgtcagtcttgtttcctgtttatctcctgcttgtcatagtgctcggtacacacacagggcaggggatcgctgttggttggaccctgcccagtgtatctaaccacttcaagggaagagttattcagagtttcatctgtgaaagttagaatctat

SEQ ID NO: 36196 - DNA, 1522 bp, Bovine  19866880886131
atttgataatacatagtatccagcatttatactattatgacaacctgaaacttgaatattatttatggctgagccgggtagtgtactatggttagttttcttttttaactttaatttttttctgtggttaataattgcttttttttttgtttgtttgcttggttttctatatttctgtcagtaacttatctctggtttacccagactaatttacccaggtctcttgcactgcaggtggattctttaccagctgagctaccagggaagcccaagaatactggagtggatagcctatcccttctccagtggatcttcctgacccaggaatcaaactgggaactcctacattgcaggtggattctttaccagctgagctaccagggaatcctaatttatctctagattttccaaaaaatttgtagaactcctctaaatatggtcatacatatcagatagtagttcagttccatttttttttcccacatggagacaccctctctggaactcttgaccctctgctgcagtctggaagggggtctccaagtctgccgtgtggctcccgtccttggccgccctccactgtcctggtggcttattcaggggcctctcttctacgctggctcccctgttgtatcttctcttttcttcttcactggtggttgagcatcgtttctaatgacatctgtaattttcagtcccttccagcacctttgcgtttaggaacgctggtgtttgatttccgagacttcctagggttctagtatataaatcagcttgctgcttctcacttagccctgataggtacttcaagagagaaaaaagctgaaatctaagtcatttcatcagatgttcagctatttcttatcttccaaaattttcttgaaacctcttgtttactgtcttctctttcatctttcctgtttggggggttcttatccttttaaaacctctctactataattttaataaggtttttgagaggaagcagagatgagctgggaatccaattgatttaagaaaatttaatgaatgtaaaattgattctttaggtcatattgtgtctctgaatgaagagaaagtgtctttgccttaatttaacattcagaagtcagaagacagcttttcttccaactcctctttggctaagttttctttgaaatccacacttgagatgagggtgcattagggaccacaactgttcatgacaaactatcagatgaaaaccaatgaactatctgttttggttgtctattacccaacaaggctgcatcacaaacaaccacaaaacctcacagttacaagataactgcttactgctctcaggtatacagggaggcgggaggctctggtattcttggtgggttctctcctatgtctggggttggttggctgtcagctgatttaggatgacctcatccgtggaaatttggaaactaggggtacttgggtttggcttcttgtgtctctcattctgcagcaggctagcctggaggtccactcacgccagggcagagacacaagg

SEQ ID NO: 36197 - DNA, 1184 bp, Bovine  19866880949994
caggagattgaatggctgtgtctcactttcacaggtcacccacttgccaagttgtgatactataaaagagtgactgggaggtgaccaaactgtggagactcagagggtgtgtgcagcaggagcgtcatacatgcagatcgcagagctcatcgcttttccaggaatgagttgcaaggcagaaagaccagggatgctcagagcttgagtgccccgggcagttgctgtgtccctggcatgactgggctgccactggaatctcatcacctgcaaggactcaggaggaagtagggaggacatcttgggtgggatggcaggggcagcggggccttccaagcctctgtggacaaagcctggaggggccagcactagggaggacctctgtgtggtcttaggcctgtgcaaggccctgcccttgcataggaagagatgatcctcattcctggctttctccaaagactgtctccttgagttcttccacagcggtcatcaactggagacctgggggccttgtgtgggctgcagacaggttttatttgattgaattgttttcaataactgcaatagcagtcagcattgaaacactgatttcaaatcaaaactctgggccttttctgagaacgtgggccatctggccacccaggagcccagccctgtgtggccactattgctggggccagttgagtccctgctgccctttagcacatgtccctgggttcccacccagccagcctccctcattttcatcacctgcctggcatgggtcctgggacccatccccaagtctgtattttattgatggtgaagccggagacctgccttaaaagatgtagaaacagaaactctgagagtcctccccatcccagcccttttgagcagcttcaggtttctgtgggccagagacagctgggccaacagaagaggaggtgatggtggccctcactccacctccaccgtggatgtgccccctccccacccccaacaaccattgcattttccagattaaagattccaggcaggctgggacttatttcccactcagtgtctgggacatattttctccatcaagtcattacaggttcgagatctccagcaaccccgggtcttgaaggcggggctgtcttttctgacagccccggggtgctcagacaccaagcttcctctgttccctttccattcgcccggct

SEQ ID NO: 36198 - DNA, 645 bp, Bovine  19866881004983
tctatggacctcagtcttcaggggtttgtgcagggtggggtccacagaagtctcttccagtgggagaagcagatctgattgcctctctcagccctgcctctcactagctgtttccctgtgtaagtcacatggcatctgcatgggtgtttgtgtcagcatcatgcgaggatggctcccctccctctcgggctgtgagcaccgccccaaagcaggtggatgatgttcctaacacaaagctgggggaggaagtggtttgaatcccacatcttgatttactgagtggggtagtcagtctttcgaagtttcttcctcagctcggggccagcccagaccgaatgtggtttcctctcggtgtgtatgcacgtgtgcaggcaagtgtgcgggcaagtgtgcgtgtgtcagagcgactcgcctttcatggacctggggttcatggccacctgaggagcccaggactccctctcagacctgcccaacatgccaagacgttttgggacccagatagacactcatagacctgggcaagtacctggtgagtgttaatatggtgtgcctcttgtaagggtggggatgggggtgggcgggggggcttaaccctgggaaaaatcatatagtgatgtgggtcatagaacataaaacaaaatt

SEQ ID NO: 36199 - DNA, 884 bp, Bovine  19866881054700
tgatttcctaggttaggtctaagagacattgcaacttcttccttagtctgtctctttgatcactcactctagaggaaacctctggaggaagtcagctaccacgccataaggtttcaatcagggatcgaacctgtgtctcctgcattggcaagtggattctttaccactgagttgccatggaagcccttgcactggtatcttaatggcaggaatgtactggaaagaaaactctattcttgactccactctctccttttgtggcatcttctttccagtgccttgtttcacaaagtgtactattctataactcccttatttatcagtgtatcagaaacctagatgtctctaaatgtgagaaaagagaaaagctgtgaagcactcttagcctagattggagcttggaatactcacatttgacttctaaattaaaatgctttggaaatagaagctcctgaagaggcccagtgtgaagggtacacaggcaggatgagtaccaaaaaggcagtaagccaccacagacaggggcacccctctcaccatctgtctttgtggcatgatgctttgctctgtggcctcagagtcatgccctatcctcgcaacctctccatctggtaccaagtgctgtaccagcacattgtgtgttaagaactgccagggagccagaaccaccatggtttctgttttcaagatccaaggcttgaattctgcccacggatcctgtatatctcttggctgtgctgcggatgatttcagcagaaggctctggcacttcttaatcccaggaccagtgtctactcataacctcactcttgctcccgcatctgtggctggtcttcgccaaccagcagcaggacagaaccagctaatttcttactcaggtctta

SEQ ID NO: 36200 - DNA, 835 bp, Bovine  19866881119930
ccagtggttaagactcaatccttccctgcagagggcatggattccattcctgatcagggaactaggatcctgcatgccttgcagtgtggcaaaaaaaaaaaaaaaacaaactcagatgagattatattgacagttattttctagttttaaaaaagtaatacatcaaaactcttcattttttactgttatgctattttagaatgacacctttattaaaaaaaaaaagaaagcagtgaagtagtatatgaagtaatgcttgaggattttcacaaatctgtgactgaattgttataataccttttgatcttctttgtcacttaattaaaacaaaatcagccttagtgtatgaagcataagtagacttaagacttttctccttatatacttttatacatatatgtatataaaacacttcagtagttgtgaccatactatacttcagtactataaccataaatatttaccagtttataattggtataatttaagtatgtcatgactttttaaaggttccaagtttaaagtctattgatatcttttcttttcatgtctagatttaattcttttcatgtctagatttaattttcatgttcataaggaaacatctgaatgtgtttaagcagatgtatttctatcctagatatagtgcgattccatttatgtcctttttattttttccttctccgcagactcagtattcatttaaacaagtatttggcattcataccacccaaaaggagctctttgatgttgtggctaatcccttggtagatgacctcattcatggcaaaaatggtatgattctggagttttgctgaattttactttttctctt

SEQ ID NO: 36201 - DNA, 2117 bp, Bovine  19866881152497
acccagggggaggtgagcaggaacgggattgcaggggttaatgagcctgactcaccactcaatagctgtgtggctttgggaatagtccttgttttcctggggctttgtcttccccctgtgctaacacaagactggatcaagtgccccatggcctctccctaccacattcaaaaccctcacatctgtgactctcccttttcccaccgttttgttcagcccaggctctggaccccattggtactgaagcaacatttggcaaggagaatactggcacccctttttgtgcaatcagttcctattttgcattttagtgggctccttaaaccaaaatacccttcagaaacctaaagaaaaaatggcaaattacccaaactccagaacataaggacatattcataatcattgggtttccagggatctcaaaacccctatgcaaagcagataaataaatgccccctggggagtcctgaggaccagaggcaatggtaggttacaaacccactggaaagttccagtccggaagcccaccaaaccttttagagtcaccaatctcttcgtggatgatcaacacccttatttcatgagaggatgaccaagaaaacggttaagccccaaaagcttccattccttgattctgcctgctctaaaatctgggatgattcctgctattaatattttaagcaactaatttgacatttttccatttaattaacttgcatatatatgagaacagggtgctgagagtaccatgacatttaaacaaagtcatttaagtttgcctgtttctggtcggggggcggacggtgttgctcttttctttgccttttttttcttttctctccatttctgtttcgcattcctgatcctgaggctggcttgttagctcagagaaatgaccaaatttctcaaagcaaatgtgccataatctcaacctaggtgacgtgggtgggcccggcgctctaggctgcggagcttttaaattcgatcctgctcttttccaagcttttgtgcaaatggcgtttgaatcagagcaggcccgagtcacaggctaatgttttccggttgccacaccaaccctgggttgggggtggggaaggggcggcgggcatgcccaacatttatcaaacgtcaccatctcggcagaagagctggggtttcaagaggcaaacaataattccgtggcgattttctcttccaaatgacaaataattgctgtcatattatcaaatgattaagaaataaaggaaaatggacaaatagagtttagccattgagggatggtgtgggggggaccagggagatgctcactcagtgttccgtaattgaaaaattgtaccctaattagctcccaccccagaaaattcatgagttctaggcgccatccaatccccagcccgccaagtcacagaacttgcggcccttcaagtttagtgctggtttcagaaggggttcgccgtctccaaatggtttcagagagcgagacgcttcagctcgcacagccctcagaaaggatccattacttcatactttcatctgccataattaatcacagatttttctctgcctatcagcttctccggctgctctctccacgtgaacctgggcattcctggctccagcttctccgtggtggtcagcccagccaggctcggacgtgccgcagaaactgcattccccggatgcaaaacggcaccccccaatccgaggcatctcagcgggagaaatggtcctgcatttgaaatgaaaccacatttgcaaactaaactcacaggactctagagatattcctcgtctctgtttctacccacttttgggatactccctggggatttctaatgaggctgtcagacttcaggaagaatataagaaagggagcgtccccattctcccccatcccctccccctgggcaagggtttcaacaagcccagctccatgacctcattagatgcgtgaccctggggaagagacttggtctgtctgagcatgagtttttccttttataaaatgcagctaatggtgcctacctttccagaatgtgatggtgtatggttgctagcaccgcctcttgatccttctatatgaagttggggataataatcttacctacccactgggg

SEQ ID NO: 36202 - DNA, 1045 bp, Bovine  19866881173526
ccagggcagagcagagtgggtacacttagggcagagcagagtgggtacactcagggcctggggatgggtctgggggtgggcctggtctccaggcacacaaggagcttcactgatggacagctccaaggcttgctaactcctggtcctcgggtggcagcgtccgcggtgtccactcacagcagggcccctagagcctctgcccacaccccacccccgcccttgcccctgccccggccccgggtcgcacctctgtggtccagctcatggtggttcttctcgtccttcactgacaggtgggcctggctgcccagtgcaccaagcgccagcagccctgagctgctccccgtcactggggggatccctggaggctggaggcctgacgggtggggtggcagctggaccggggggccgtgtgtggcatgggagaggtgctgcgcctggagctgctgttgctgcaatgaagtgggtggtgagcacggccgagccagcagggcggcagaggcctgggccgccctctcgctcctccaggaggcagcaggggaacgcgcaccccccaaagcttcatccccagctcaggccacatgctgtcatgctggaggaagtctgttaatggactgcaatttagacacaagatttatgatggcaaacaccacctcctccccaaccaggacagaatttctcaatgtatgattcccagcccaagataaataaagcatgcatttaaaaaccacagtcatcagggctccctctctgtggagggcgatccacttttaagctcccagcggtcacagttttgctcatgcttacatgcctgccaacgtcagcagccagcgtctcccacccttaaccccaaccctgggggaagactccctaattctgaagaactccacgcctgtcttacagagcaagagcagcacacagcagaagagtcctgggatcaagaagagtttggggccagaggaatgagaaccaatgtcactgaacaggagagtggagaacagggtgaaaaggggggcttggaattaagacagatctggatccaaat

SEQ ID NO: 36203 - DNA, 1397 bp, Bovine  19866881175789
gatgagttctgcaacctagtaagctgaacgaaagaagaaaaaagtcccaacaagccccatttcagtgcccttgaccttgcagtagagctctaagtgcaaaatctgtcatctattaatctgttagaagttgacaaaagggactttgatcagaggttgttttttccccccttcttaagtttcctgatgacacataatagcccatttcagcccggggccggaagcacggccatcattcttttgctcacttcaaccccagcagcctccccgccctgtggctttttccccgcctctatattaattggcctgtaagtggttacatgtgtttctttttatgtgtcagttggagtctgttatttgaacttcacagctatttgggaacgcaggagtgatgctccgggccccagtctgtgccaagtcacactcgctcccacctccaatctttgtcttctatccctgaggcctgggggcctgggagccttccatcctcacccccactcccaccccatctcactcctccgagttaggtcccctactttgcagtccagctcttggaaccgtggaagttcacaggcaggagaaaccttcagagccgcgcactgtagcttctggttttaaaggagttgaagactgggtgggatggggagaggggcagaggatgttttttaatgaaaataacatttgatgagactctattatgtacaagtttcttatgtattctctcatttcattttcagaataactcagggggatcacatggccatttttttcatatggggaaactgagtctctgggaatccaaggagagaggactctagagacgacttgccctggactgtatcctgcctctgacaccagctgtgtggtctttggccagtgggttctcttctcggtgtctcaggtcaacatcaacaatgagtctagtaatagtacttacttccaagggttgttgtgaggattaaatagatttcatgtttttaagggtttacaaccacacctagtagacaaaaagcacctaataaatgccagcagctgttgctgcagttctgtgaggcagggtagcacagtggtttagaacactgattccggagtgagacgtccttggtttgaatctcagctaccccagctcactgtgaacttgagtgagctgcttattttcttagtggctgctcccccatctacaagtgagggtattcctaatggttggggttccctcaatgaagtggttagttcccatgtgattaccttgtagtgaatttcaccaactgataagccctattcaaccccacaagaggttttcatctgatctttagtgacctaaatacattttttggacttcaaaaaaatatttaatatcagagagattagaagatactccatatccaaagccaaaatcagaa

SEQ ID NO: 36204 - DNA, 1044 bp, Bovine  19866881181649
ttgagcagagtcccctgtgctatacagtaggtccctgtaggctatccacgttaaggcttggcgtttctttcaatacctgcaggtattcctgctccccggggagagtgcggagaacgaagccaccgtgtaccaccagaagcacgtggccatgaccctcctggcctctttcttctactctgcgcatctgccggagcgcctggcccctggacgcttcgactacatcggtgagcgcgtggtgaccctgctgcccagggggcgctcccatccctgacagcagtgctgtagttgccaaggggaggcaggggcagggcgggaagcaaatccccaggaagttgtccaggcccaggccaaggtgagtgaaactgtcaggtgacagatgtcaggatgtgcacagaccgtggatgcccagggagggtggtggaggatgcagagaaggtgggtctaggattctaaagcatttctggagggtgtggggacaggagagtcccattattacctcgaacgtgaaatcccattattaagtgaccatggaaggcagctgtaaagaggaagaggaaagacagggtacagaaggctctgagggtaccagccggtgaggggcgggcagtgccaaggagaggaaagagggtctcattcaggtgggtgtgatggtgccaggaatcatggtagagcagtggttcccagactcagcagttcccagtctggacgagtagtctcagcctcagctgggagcatgtggatctcagcccccacccccaagacatcctgctggggtgggcccagcactctctcagaagctgagtgcttctccaggtgagcctgaacgccactctctcagaagctgagtgcttctccaggtgagcctgaacgtgctcaagccagagaggccatgtggtgaagaggaggcgtcagagctacaggggtttatacctgctggcagagttccttcccctctgtcgagggacgtgggtagcgctgtgcaacgtgtctcctccaccctggctctgggactggcttggaaggagggagccttggccacttctg

SEQ ID NO: 36205 - DNA, 1457 bp, Bovine  19866881286902
tggtctaagtctaagccttctagcccctctccccctgctctgctctcccagagtctcaccatccccaggagcctctcattcctccacatccttctccaaagggctcccgtttaatcattcagctagaccttaatctccctaagagcagaggtgggaatttgtggcacttgctgaccagctgttctgccaagacattctgattgattaatcagtaatccactgaccatgtctctttaccttagtaaactcttattattaatcatatctaacctctttagtttcccaagctgcaaaccagaggcctgccgtgactgggagtctggggggtcacccttcctgctgtctgtgtatgactgtggggtggggtggggtgggtgcctgtgcctgctgcagtgtttacagggtggggatgaggccagctctaggcttcaaatgcctcataacccattcggtctgtgaagcccattactgccatggccatccaaaaaaaatagcacacaccctttgccttcccccttcaaagaacttcatatctcatctggtccctttgtaaggcaaagccaggattgtttacaagggacctgttcgaggccactctgaattcaacaaaagctaggactggctctttgtcaagctctggtttgtacaggatgactgcctgtctggttgtacagtcacatcacttgcccttcaagaacttaagtctgagaggccaagttagtacacacccgctcacccaccctcttacaaggtatgtagccacaggaaaacctaataagccagatgatcaatagtgtggttgaggatccataaaacgggccttgggcttcccgggtagctcagttggtaaagtatccacctcaggagacctcagttccattcctgggttgggaagttcccctggagaaggaataggctacccactccagtattcttgggcttccctggtggctcagatggtgaagaatctgcctgcagtaccagagacttaggttcgatccctgtgttgggaagatctcctggaggagggcatggcaaccactccagtattcttgcctagagaatccccatggacagaggagtctggtgggctacagtccatggggtcgcaaagagtccaacacaactgagacgaagcacaaaaaaggccttagagcatcatcagctgcaacccactcaccgtaaactgagactcagaaaggacagcaatttgccccaggttacagaactaaaaggaggctagagcccaggtctctggactccaggtccagtgctcttgccgttgtttgcacacctagcaaacatggcaaggaagggagcagaaggagctcagagagcctgggccacaggtgggatgctcctctacgctagtctgggagttgagagttcctctgggaggaggagggctgaggccggaagtggctgcaacctgggagtagccagggagtctgggtggt

SEQ ID NO: 36206 - DNA, 1229 bp, Bovine  19866881288422
gatttctagagcaaggaggaatgaaaacatgctcttggctctggcctgcacactgagccctcacaggaggcgcaccgggcgtatgagcaaactgggcagctttttttttctgagcagtgttgtctggtattaaagtaagttcattttccatctcaacacttcaatataaggagagaggtatggggccagagaaggatccagaaagaggtatgagagagggaagaggctttttttgtgtgtgggttttcaaagcctggggcctgacgctgcactctccctcgctcactcatatacactcacacagagagagagacacacacacagtcttgcacacttacacagtcacacacactctctttcagagccagtaagacattctcttgatgcagtttggaagtctggcatctggtgcatcacacatgtaactttcaagagtctctagttacactggatacacctgctctcagctcagaaacgcttcttcctatttgtaaactcaggatgcaaagctcacactcaagtgttgtgttttgctgctcggagctgactgtaaagatcacatctggcccagttaatgagcttttccttatggggaagcaggcagaaggggccccactgatgggaagggctgtgtttgaaggcctcacagcatgctctccagggtgggcagagggcgggtgaatcccacgagtaccaagaaagcgctgagtacccccagagagtgaatttctgtcctttctctcctcctccagtctaaggaatcctcgtcagtcttgagctgtgacatttcggcggatgacaaatatatcgtaacaggctctggggacaagaaggccacggtttatgaggtcatctactgagcaaggactgtgacggggctgtcaagctcggggagaccccgactcggctgtgccagggagaccccgcagacacggaggacgggcagcgagcggcccagccccgcgctccggcgggctgagaggacacgcccgtcacgtcgggactcctgtgtctcacggactcccatggatttctcccctcctcctcccataacgatgctggcagaggctgcacgtagatttggaggctcatggctccggctctccacatacaccctcatgaatctctttccttcccctttcttttgatgtgtcctccttccccagcccggggacactggagtgtggaccacacgtttgtaccagggagtgggggagggtttcacgtcc

SEQ ID NO: 36207 - DNA, 1284 bp, Bovine  19866881290303
taagtctgtgagtctgcttctaaaacatgagtagttttagatggagtaacattaaaccattatgaattgacattttggccgggactgagccaagagtgggcagagcacaagctaggcctaggggtgaagggccggatagggtgccaagggataggagatgggttcaaaggggtagaggaaacagcaaacacctgtatttctcatttagcaactcagagtgtttctggggagggagatttcacattgtatcattcacgctgcagccaaactctcttttggaagaagttgagacttttacccccaggtaagacgttccagatgaggaaaaatccccacgacgtccagataatggcatgacttgccccagatcacacggagagtagccagcagggaggacaggcccccaggatcccaggtcagtgttctctgggaagggccaagctaaccagtgtccgtggctgccctccccatatacacaatgcctgactccctggccccatgtcgattctgttcccaagaaggctttctcttgacagaaaatggagctgaaagggcaagggaatagttccaaatggttgatctgacagctgcaaatttcattttgtgttacgtgctgacctctaattgtttcccaagtagcctgggactgagagatcaataaatcccagagatagttaatatcccctctggcatcctcagctttagttagaaaacagtcaaattcatggctttctgcaaatttcagctttctgcaggacccgatgaactataattcagccaaggatcagattggggtctgagaaattcgtggtgacccagagggccaggaccgagagggaactcagagttgctgacccaatctctccttgtccaggtggaaggatccaggacaagagaggttcacggtggccaccaagagggcgagaactccaatccagcctcctgggctctttctactcctccaagcttcctccattagtttattaatagaacaagggagttggggtcttttggttaacctgtccccagagatcttcttaaaagaaggcttggatgtagtagaggaaataacagatttgcaatgatagaagctatttcccttcttccccttcctctgcctcttaacagccagtcgacccttggtcatggcactttccctgctgagcctcagctttctcagctgcacaatggggatggtaattgtccctgcctacaaagattattgtgaggattaaatgaatgggtgggggggaagtcctcaccctgagcctgcacaaaatcagt

SEQ ID NO: 36208 - DNA, 745 bp, Bovine  19866881303825
ctggcactgcgagtttttgaaagttgtagcaataagtaaatactatgctttgctcaccagcttcacgtaatctgttcccttctgcttttgtccggttagttctttcacttccagcaagatctaccaaggacaactggctaatagtgatttgttctttttcctgaagggaagataatgccaatcacatgagtttacagtgttctttaaatatgttcaagtgaaattaagtcttacgaatataaggtttacataatacaaaatgcataataagggggaaggatacatgtttggggggaacagtttactaaaagcatatgataaatatcctcatgacattacttgcagactaagttacactgtaagctccataaaaacaggaactctgtcttttagccacttcatctccagtaccgcagtttcaagtactcagtaggagctcaataaatgtctgctaaatagtctagaggaagactaaacatttgtataatgagatatttaataatcttacagcgtaataatttcatgatactctaataacttttataagaaagtcaagagacacataactgatattactaatacattagatgtgattcagaggaaagcaagtgtatagagacttagaagcattttctagctaacgtttatcaagtgctgactgtaagccaagcaatggctttacatgcatcacctcatttaatcctcacagcattacaactggaatttgtgtaaaaaggttacaaat

SEQ ID NO: 36209 - DNA, 750 bp, Bovine  19866881311806
tttaaatggctgtaatgcagtcctccaagcaggttgacaccccgtattttatctggccagtccaagtttctcatccagggtgaggtggttgccaagagccttgccaggtgggctgcctgaggcagggggtgtttgtgtgggccttctcctccacctgcagcccaggctgatgccatcatagtcttcatcaaaaggcctttgtgaagcgctctggtgaatgtaccctgggccccggggggatctcctgcagagatcatcccaccagcccctgacatgcagggcttgtcggctcggacaggcagcatatatgtcaaccatccgaagaccaggctgtaggccccagccagagggtgcaaaaccagattcttaagcaacattcatgacagaagtaagtgcctctgggaatggacagacaggctggattcccagaggaagtcggggccttgaatctgctcctccagctgactgcaggctcctgggaggacacgagattttggaaaccatgggaaggaagcgggaagccgcgtgacagatcaaggacccggggtcaggtgttccaggctccagtggacaagtgcccagcctgggagaaaggtggatgctaccagggacgttcccctgagaccttccggccaccctcttgtgtaacctcagcatccctttctcctccccttgcaggtgttccatgaacagggcatcctcttcggctaccgacacccacagagttccgccactgcctgcctcctcagc

SEQ ID NO: 36210 - DNA, 513 bp, Bovine  19866881333233
cctcgcgcacaccaggcagcgccgcgctgcccgcggacccgcccccgtcaggagcccgcctgccccggttgctccgtgtccccgctccccgaccgctcctcagcggagacgcgctccgggcttcctcacctgggcagcgtcgtagggcaagcggaccggggaaccctgaggaagagaaggaggcggcagagaaggggcggcccaggcctgcgtctgccgcagctccaacccctcggcgaggaagcgcttgtgtgaggagatccctcccgctccgcgcgcagcttggagacagagccacagccgtacccgccgctcttcccgcgagatcccagccacagagtggggcggggccacggcgaggggcggatgcagtgaatcgagtgacaactctgagagcctgttggcggcagcgtgggaggcgggacttagagcctaatactaccaatcgcaaaataggaaaggtgattctcccaccgcttcttctctcccccgccccgcatcaataaactaggg

SEQ ID NO: 36211 - DNA, 785 bp, Bovine  19866881365146
tccaagcacagggagacaagttctctccataatctggctccagcctcagcaaagcactttgcatagagtagatcctcacagaacagatatcagaaagtcacatctaactcttgtgagcccatggactgtagcccacaaggctcctctgtccctaggatttacatgctacataaatctgaacaacaaaacatttgaaaacaattttgcattcgtgcctagtttgacccccaaaggcaaaccacagtcattgccttaatgctctgtaatgggcctcatttctaagcagccccgagttagcagacactggcttatttgcacagcagaattgattcgactccaccttgcctccctggttgcaggccaaccaatttagagtgaaatgaaatcaaattgtgtgcagcctataatttaggagtgagaacccccaggcagccaggtggaagggcatgtcagtgggttttccgcttagtgcctgccacacattgggcttccaagaaaggccctgtgcacctgccagctgatgcctgaaattccactgcgactatttcaaacccttggtgtttccagctattaaactgcaaatcacctggggaaaataatcaaacctggctagcggtaaataagagttggattttgatggcaaagcggagaagctgccagagtggggttatcaggccacaggcctctgtgtggtaatctgaattttttcgtctagatctcactgaatcctcatggccctagtaggggacaggtttttttcctgtccccatttcacagaaaaggaa

SEQ ID NO: 36212 - DNA, 2280 bp, Bovine  19866881368221
tggctctgctgttatcacgtcaggaacttactcccacccctgggcatcagctgcttcctaatatagtccagtaagagagaactggttgatcttaaagtttttaaaataaactaccaaaaagtaatcactaaacttaagcagtggtgctagaaaaatatatggacaccatcatcagctgctagtttttatccttcctgccatgtgctatttctattagcccattctgaatatagaactccaaagtattgcaaaaagtatattcagatgcagaatatatcaaaattgtaggttatggtgagtttttttttcatgacaatttaaaaaatatcaagtctgcattactgtagctattataaatagtgaacaatatagggacaaaatactgtctttcattataccagctcattaaggatgtcaaatcaaaactggatgtgaatttaaatgctgtactagtgatgagtttcagtgtttgctgctcactttctggtggaaaagatacagttaccatctggtaagaatgattggtaacttgtgtgtggatgctgcatttcctgaatgttaagtagcagcaacactgtgtaattttgctaatcctttttcaggagtaggattttgtgaaatgacaggactgcaaagtaaaccatcaaagaggagctgtagccaagaaaacagcaaaagaagaaaaaagtcctgtgaagggtcagaaatagagcaacccacaaactggtggtgaacacacagttcaggtagagtattatcaggcaaccccacactgcctctaagctgagcacctggaagagccagtgccttcctgggattttgctctgttctcatcggcacccggaggtaagaatgactgctccatttcagcttagaaaatctagtagtgttaactagtgtgcgtagttgcttagttgtatccgaccgactctttgcaactccacgggctatagcccaccaagctcctctgtccatggaattctccaggcaagaataccagagtgggttgccatttcctccttctagaggatcttcccgacccaaggatcgaacctaggtctgctgtgtctcttgcattgcaggtggattctttacccgaagtccctgagatccggtgggggtagaagggtctttggcaaaagtgcatgatcttaatttaatacctgttattctgcctttgcttttttaatacgggtgaaatgaaatctctgcaattcaatggaatatagggtgggaggccccaaactaattcccaaattccatcgatggtgtggcaaggtaatcaggagaagagtgcatcatctccactcctatgggcaacaaaaagagatgctgcctccatctggaaacacccaccagaaggagtcacccaggtagcttatcagctagagctctgagcttatcggctagagctctgagcgtcagggtacagcaaactatggttctggattggtgtttctagatcatttttgcttgggaagaagtaccactgttgtcccccaaactcgacctcatgtacagctcagcctaactcgggtggtagatgagaaaacaaaacactgtttaagtaactctctcaaggtcatgcaactcttttcatgtgttccctgtctcaggacagcagaggtaagatgctgtgcctgccctgagccacagccagaagtgctcttcctcggatgggctttgcgtagcctccccttccccaaatcagagccaagcagtagtgggctcaggcaaaaggactccatgtactcgccttttaattcttttgtcagtctcaggaggaagtactatgtgaacttcacagataaaaaaggaacttgcagaagtcaaacaatttgccagaagtcactcagtaatttgacagtgtggtatgtctgcccccagattccatgtttcaaatcatcatccccaagcaatagccacgatccactatctcctgactccaccccagggggctcgactagggatgcaggtcacagccccagtcttggcccaagaaggggaaatgagcccatttcatctggggatgctatcagaactgctgaaatggatacttgctccactgaatgattagaagagcccagaaaaaggaggtttcttcagcgatcaggtctccttgatatgtgccctgcttattctgcatccccggactatttacattagattttggatgacttagcatcgcagcccttccaagcccctctaacaccctcctgctgtttactgtcttccataatggactttcaaaactctatatgccacagagtaagatctaag

SEQ ID NO: 36213 - DNA, 1677 bp, Bovine  19866881395718
ctatccctggcagaactcgtgacttgctgcgaaccaataggccaggataaaggtgatgtggtgttacccccttgatttggttacattatccagcatgagtaaagggctgccaatttcacgatgatgttgctttatagaaaactctgtgctgacatcctagaatgagagatcctccttgcctgcttgatgaaggcagcagccatgttttggaagacacatagcgaggaacagaaggtgggcagctctaggacagcctccagctcccagccagcaaaaagcaaggtccttggtcatacagcctcaaggaatgaattcagccacaacctgagtgagcttagaattggatccatcccagctgagcctcccaatgagaatgcaatccagccaagaccttgactgtgaacctgtgggatctgacacagaagacccagctaagctattcctggtctcctgatccatgaaaactgtgagataataaatgtttgtgttgttttaagttactacctttgatctactctgctactcagtggttaacaaactgatagatggctcttaaagacacatgctttgggatctggaagtcccaagtaatctgggggaaattcagtttcactctaatcagtcaatgcattggcaggaaatttttgccagccaactcatagcaagacttcagaacaagagcttggagagtgaaaatggggctaggcctggggagagtgagagagaggcttagaaaaatgagagtcacacagtcagacagggaacaggtagagccctgggcctgaagtcaggttctgggttccagactttgcagatggtttgctagtaggctttgggcaaagcagcctctgtctgggtctctgtgatctcatctgcaggccaagtggtataaacagtctgagctccacagctccctctggctctggctttctcagtgaatggcaattcaagtttgccaaggaactctacagcttagagtatgctcagtcttttacttgttcattcattcattcccctttcaataactcttaggactactaaccacgtagaacatacatttactaacaccattaaaagagtgacatacaatgagttaggggagagggaaagaaagctatgtgggaatcccaggctgaagtagacatctgcttgcatagctgttccccacatctccttagggtggggctccttttcccacctatgggagtgtcatttggtccagatttgaccaatcagagtacctcaagcctctggccactgtaaatggttcaaaaatgggcatacacaccaagcaggaccaatcagaatctccaataggactttgctgccagaggtggtgggaaagattctctttcttctggggttgctaagctcatagaatataagtttgggatagtttggggctgccttgtggaagaagcctatctgaaagggatccttgaatccagctcctgaatccagccctctctgaagtcatctcaacttacttgacctgataaattatctttttatttaaagtagttgaggttggatttctgccactcataaccaaaagtatcttcaatgaatgtagatgttatttctaataatgaatgcggttatttcaactgagcatgtaattgagctctgggtctcttggaagccaaagtgaaaggggaaccacattgcctcacaaag

SEQ ID NO: 36214 - DNA, 1933 bp, Bovine  19866881445811
cggggagaaatgggatcgaggcccccatccaaggaggcactgggctcaattctgcagcagcctgtctccagcttccactgtcccctctaagaccaggatctctctgtccatgaagtgaaaggaagtcaacaaaacccccctcaaacccccaaccagggggcaaggcccctcgcgagcgccccctcctcttgcctttcacatttcatgccagaacagcagcctgtcagagaagacatcctgggggcaggcgtgtgtccctgccttcctcatggggccaagtgccaggtcctgggctcagaacacagggccactcattcacaggggacactgacgggaagcccttgctggccaagtctgtgtgactggatgatgcacatcatgcttcacgcctctacctgatttaatgcttcgcttctccggttcatgatatgggttaaacctagtgaagtggtctaagcctttccagggctgagacccactgaggacgtcccagttgtatgagatggagacttctcacctcccgggggaggggagagcagccccgacctctgcctggtccttctacttcttgcccacagaagaggccccccagctccaggtgaattgtgcatctgtgctctactgcagcttggagggctcacaacaatgctattactccatttcagagacagggacaggctcaggggcagtgagatgactctgctaagccaaagagaccagagccagaacgcaagcccagcgtgatttttctctaccatggcccccggctgagagaaaaggatgcgttcattctaaggctccctttctgcaccatccatccccctgtcaaccgaacccagctcatcagcactgtggagggaatgcgagaacctcaggactggcttcagcacaccctgtgcaatttgtgacaagctacaacctccctctccctcttcctcaccccacccctacctaacctgaaaaaaaagtaaccaccaccaaggacccattgtgtagcacagggatcgctgctcaatattctataataacctaaacgggaaaagaatttgaacaagaagaaatacacgtgtatgtataaccgaatcactgctatacactcgaaactaacataacactgtaaatcaactatactccagtacaactacactccagaaaaaaagctaccaacactttaaatctcttccactaacaattttcaaggggacacagcccaaattgtcagtggacaagtggggtgagttggccacttgacacgaagagccgactcattggaaaagaccctgatgctgagaaagattgagggcaagataagggggtggcagaggatgagatatataggtaacatcactgactcaatggacatgagtctgagcaaactccaggagatagtgaagcacagggaagcctggtgtgctgcaatccatgggttctcaaagagtcggacgtgactgagcaactgaacagcagcagcaagtggggtgagaacccctccacctgccaggttcagtgacctggagccagcgtggagcaaactgaaacgtgagctctggaagtggtgggtaccatcagctcactgtgtctactctgcctagagaaaccttttgcaagttgctgaccaagggacaatactctgcccccgcccccatgctcaggaaccttttgactgtctaaggttcccttaataacctggatccaagaagagagggtgtggatcaggtctgcagtaaccgggttttgtaggccctccacgagcacacacacgccttcaggcctgctttccccagatggacataagttccccgcagaccagcaagcctgggcctccgtcagtccctccatcccctatcacctggagggaagaccctagaaatcctctaactcgtgtgataaacatgcccctcactgcaggcacgccagtgaccaggcttgccag

SEQ ID NO: 36215 - DNA, 1212 bp, Bovine  19866881578305
cccatggacggaggagcctggtaggctacagtccatggggttccaaagagtcggacacaactgagcgacttcattttgctagcatgttaaatgagtgcaattatgatgtagtttgaacactcttatcaacgaggtgtattaatctcagtgtctgttttagttaggcttctttcatctctaagtatcagaaagcccagttcaaacagcctcacccagtaaggagatgtataacataactggaagtccagaagcacagtaggtttcagaattagtcggtctttaatgaagacaccaaggatttagattctttccattgttgcactctgctctccataatgctggctttgtaccaaacaggattctctttgtagttgtctgatgggttgccaggaaggaaccatatgttctacaaataagaaacaatctggcttcctcttatcagaaaggacaaacttaaccagaagctgccataaaacttcttttcatatttcattggcacaatttctcttcacttctgaatcagtttctggcagtgggacaggcctacttttgagctgaagtcagttccccaggtcactgccactgagagttgaatggcattgaagtagatagtgaagcagtcacagtatctactttagttgtgtcctagtgctctgaggttttttaattagtcctttttcctttatatttctataatgagtcaaaatatgcttagtcatatatactggtatagttgcccatgttcagagctttctatcatataaagcagtacagcaattattaagcgtttctgtctataaaaagagaaaaacaagaatagtgaaaagactgaagatagttggcgaatttgaatctctgtctcattgatacccataatgtttaacctttttcaccttcaggtaatcatttaccatttacatggagactttagtgattcgatttgtatctcctttctctcttaaaaacttgcctggagcattgtgctaaaatagaaagtgaactggattatgattaaggttctgtttaatcctaacttcactactttctagttttgtgtttatggacagatcacttcatctctcagaccttcaactgtcttctctataagctgagataatagtacctgtcttctcaccaaattgttcttataggagttaaatgatgtgatttttcagttcaagagattgagtacagagtagcatacagttttaa

SEQ ID NO: 36216 - DNA, 1501 bp, Bovine  19866881681800
ataaagaagccagggggagacgagggacaggtgaccacagcttgggtgctgttgggttgcctgagtaaagctgtctggtaggcagatggacatggggtgctggggcccgagaagcagcctagaaatctttcctaccaaggtgacctctggagcaaacgagacagacggccaaaactcctggcagaccacagattccccatttgctggtcctggacccatgtccttccagcaacccaacaccctcctcacccaagccctctatcccctcctccccggggaaacaagtcccccactaatgccagttaaagaggttccccatgctatctctgctaactccaaagctggcatacctaggttgctttccaactctctcctcctccttttccttttcatctctttctgcctgtcttttctcaccctttctccgtctgtctctgccttcctctcttatgctgtctctctctatgtttgctcaaactcccaaatacatacgaatttttaagagaccaagatctcagggacacttatggaaagggctccagccgactggcatcagcgttcctccttagccaccttcagtgggtgatatattacagaaatacattaaggagccgtcccgctgacagcaagctaaggtactatgtcaaggtaccagccctgggatgatgaacgccccccatagatcaggacaccatcactctgattacactccagtactgtgtgtcagagtgctgtaggggcatgatggacggtggggatccatcaccagctgatggcccattcccaacacaacactcatatccaggagatgatttaagggcagagctgggacccctccaaagatgcacacacagcaaaagtagactttttcctttctactaaagggagaagtttgaggagagaaacacttttagagtatggcttcaaggtcaaggttttgtaattcagtcaatcctgggtttaaattctatgcacagtcactcagtcatgtctgacccttcgcggcaccatggactgtagcctgccagtctcctctgtccatgaaattttccaggcatgaatactggagtggattgccatttcttccttcagtgtatcttcccaacccagagatcaaaattgtgtgtcttggacctcattggtaggtggattctttaccactagtaccacctgggaagccccaggtttaaattctagttcctctatttaaaagctgtgtgacatatgggcaaaatttcatctttctgagatcattgccttgtatgaaaaatgcggataatcatactaatcttccaggattaaagtgaggcccaaatgaaataacgcaggtcaaaacatacagcacagagccagactgagggtcctgggaccaccaccacaacctgttcagtgtgcacacagtagaagctgcaaggcccagcctcagctgttagtggagacccaggaggctgcagccccctggacgttctcttctctgcactacctaactttaccttcttcc

SEQ ID NO: 36217 - DNA, 1149 bp, Bovine  19866881807034
cgagtgctcataaagctttcagaggcctaagggagatcacctctaagaaggggaggctggggtcggggtgacagctcctcacataattcattctttcctaacctgcctcttgttatagcaagaagtgttcattaaaataaaacggaatggtgaaatctggtagggaaaggaatcacatattaaagacatagccaagagtctggcccattcttttactattttaagcccccttttttcaagtatctaactatacaggtccatgtgtctacttctgacacatgtatgtactccttaggcaatttggaaaatcagataaagatgggaagtctaattaaatactggataagcatattttatttgcttttttagaataacttttcccatgataaaacaggaattctctcaaagccctcctagagattcattgcaaaactcaacactaaatgctggctttcattttaggcgcaagaagccatgaattgacagtttcaataacaaaagaacattttcatcatttgtgttggtgatttctccaaagcagtgccttctgaaaaccatcttataaaactccagctttgttgaaaatcacagacctcatgtcatcacacactggcctccatcagggattcccctgtggctccaaagatatctaggattctacaaactttttatattatacaccttgccatatttaatattagtagcagagaaagacccctctttctcattgctgtatgaacttttttatattgctattttttgtatatttcttgtataaactaattcatgcatgtgtttgtcttggataattaaggaaaaatatatctagatcacgctttgctttttattgtgattttccacctgctgtctgaatatttcttaaggatttataaacagaacaaatgctgctattgattagctgcgagaatgcactttagacatattggacaattcaacctgagatatcagactcgccaatactaaaaccattttaggaaggtgtttggaattttgtatgtatgtactttctgacatttagatatgccaaaagaaatgaaataaaagcactaagaaatataaggttacgagatggtaatttaacacactcccagaacctggcatcgtgcttgtcatttagctggcaatcat

SEQ ID NO: 36218 - DNA, 1544 bp, Bovine  19866882026098
gcagtagcgaggcaaagacaagcatgcgcagtgagaggctcggggtggagaggcttgtgagcttctttctgtcaggacagccgcagcgcggacaggcagggtggaggcaccagcactcagagccgaaggatgtgttcccaactgcactttcacaggtcaggtgtctctccctggcctccactgggagcttccgggcccgaagtgagtcttggtcgtctccccatgctcaattgtgcccagaacctcttggtagaagagcctttctgagatggtctccccttctcagcaatgggcctcacattggccttcactcccaggagccaagagtggaggggagcattctgagacattcttcctttctacccactgggacctgcaaccctcaggcacagagagaatgttctggccaaagactcccccatttggccccgctagccctctgctgtgatgatcagactttgacaagcaaggaaagcatggttcaaaggagtgttcctttactcaagtttgtgccaccagtacaagacagagatgtcagccaaacatagccgcagacgggccttcttcctacatgctggaagcttctcttctgcaagcctgacaggaagcccagctccagctaagtgaccctggtacgtgcagtccagctgtcctttcgaagcttagaataaaggctgctctatctggatggtcactccttttttcaaatgttcaatcctctttcttgaatgaaataacagcaggcaatcatttttatgtgctcatttgcagtgactttggcaggacttggaaaccacattagccccacattctggaaatttagctcatggctgcgtgatgcccaggaacctgggaaccaccaccccaggccagtcctgcaccctcaagggcactgcccccatttcctctctgtaaacccctcctaagtggggttgccccacagcatctgaagttaagcttaaaaaaaagagggtagaggttttcagggtcctgatggtcatagacactttgcaatttctctgcaagttcatcccatttcatctttttccgcaaagagttgggcagtggcagctacacaggacatgggtgttaactgtggacttcccctctgggaactgccctgaggagacccccccaccccaccctgccttaaactggggagacagcacagggctggggtcatgaaaacactccctttttaactgttccacgtgatcactttctaggggtgtgggggcagtatgggaacgctttaaaaaaagaagcgctcacatttatggatgacaaaggagatcacccaggacgtggggtagacagcaccccacccctcttcttgggagcgtgaggggagggagaatggagataaactactgggggtggggcaggggggagggaggaagaattaaaacgcaacaatcaaacctttaaatagtaacttttaaaaatataaaaacaggtcattacaatgacttttcattttctttttttcttcaggaatcaattttgtcttctaccctcgccttcccttgtggcaagagccttaa

SEQ ID NO: 36219 - DNA, 1095 bp, Bovine  19866882067868
aggttgaaaggctgtagctgcaggtcaaggatcgcctgcatcgccagagcctaaagcagattagggacagaatctgagacagattctgcctagctcttcaaagaagtggggtcctgccgacaccttgaccgtgagagaatccgtttgttgttgcaagccctcttgtttgtgaagctttgttacggcagccctagaaagccaatacgctgcaacaggaagcccctttctaggtgatattcagagaacttctctctccaactattaccagcacagatgacaaaacagaacacaaaacagatggcagacagaactagggcagtgggtttgaggaagtagcaaggggctggacaagccctttaggccctcagctcagagcatgagatgggaggaatcagcagaagggtttggctgcaacaggagagtgaaccctgaaaatggcccactgtgctccgggaggcacccagtccttcctccagaccaggctccgagggggtgctgggccaagtccaaggtcaagttgctcccgttggcagctggagccacctttgtgagcccaagatttgagtgatctctgcttcctaggtggcacagtggtaaagaacccatctgccactgcaggagatgcaagagacccaggttcaatccccaggtttggaagatatcctggaaaagggaaatggcaacccactcaagtattctttcctggagaattccatggacaggggagcctcgtgggctacagttcatggggtcgcaaacagtcagacatgactgagcatgcacacacatgtcactaagtgccaggaagcacagtgacccaggcagctggagcccagggagaagcccacacgctgctcattcagagcccacagtcagggaccagtggatggagcggccgggccattgagtcagaactaaccaggggcaccacatggctgacctttctgctcacagctctcccagcagcccagctgtacataattgaggtctgtgaacaaagaaagatgccagctacatgagctggaaagggactttaatacgtgataccagagtattcagggtagaggaaggggtcacactcacgaccggcgggac

SEQ ID NO: 36220 - DNA, 1007 bp, Bovine  19866880035798
ggagggcctggcgtgctgcgattcatggggtcgtgaagagtcagacacgactgagcgactgaactgaactgaactgaacaggtacgaaacccaccattcagggatttatatactttgactgtaaaagtatggcattagcaagataggtgctattattgtcactttacacttgaagacactgggtttatgcaatttacatggtttagccacagcgaacacagctagttaaggttagtgcctatgtaaattatttacatctgtctttcctagactatgagcttttaagaaagcaaaatccatgtagtcttcatatgtggctttgaagtgcttggtcctatggtctgtcgtagcagctcaatcattgtttggtttgaacaagtactttaaagcacaagagatgagaggaaaacctagtttcttggctgcgaaattaaaaattcacacacacacatatatatttcatgatagagatgagagaggtaagggagaaaaatcttgaaaagaactctattcaggtaagttcccttatctcagagcagtttaactctcccacctcaaagggattcaaataaagaatgaggtatggctgcttccgtgagccactttcctaccaagattactaacatcctggcttgctcattttgagttcacagaccttaattatgtagcacacagcatgaatcatcctgtctgttcctacagagaataccaattcatcttacagacagtgcagcaaagccaccacaggaaaacatgagggagaaagttccatagaccctcccctgcccaccaggcagggagcgtctcctctctgaggtgataataacctgtcctgtgaccaccactgggagtgcagagctctgacacattatgggttttgtttttcttaatattttttttttttttttgtcctgtgtggcatgtgggatcttagttccttgatcagggatcaaacctacaccccctgcattggaagcacaggatcccaactgcaggactctcaggga

SEQ ID NO: 36221 - DNA, 1646 bp, Bovine  19866880440068
tacttaatttaaaatctgtgagataattattactatctatacttaacagatgagaaaataggctcagaaaggttacaatgatttatcaaaatcactgtagtctatttttggaggaacaaaggcttacagtaggtctttatttaacagcattttaaaatactttagctgaagaattgatgcttttgaactgtggtgttggagaagactcttgagagtcccttggactgcaaagagatccaaccagtctatcctaaaggagatcagtcctgaatattcactggaggactgatgctgaagctgaaactccaatactttagggccacctgatgcaaagagctgactcatttgaaaagaccctgatgctgggaaagattgagggcaggaggagaaggggatgacagatgatgagatggttgaatggcatcaccgactcgatggacatgggtttgggttaactccggaagttggtgatggatggggaggcctggcgtgatgcggttcatggggtcacaatgagtcagacacgactgagcaactgaactgaacttaacagtattttcaaagcaacacagacatatctaaagctagaatgtgtggagacagaaacaaaaacacacctgtgaaagaacgccaccagccttgtttggatgggcccagaattcttgtctattgggtcctacccatgatagttcacccaggcatctgatggaaatcttgtcacatcaagtaattgttatatttgtatccaaaattgtgggacttggtagtgattttaaatattccaatatgtgtttctctgcctacagcacctcggaccctgtactggttagtattcatatcctcaaatttaatttttaaggcatagtattttaagccaagttccaaaacatgtcttttacattagtattgaactactgtaaaaactcgatatttttatatggggttttactgtaaaccatctcaaatcatttttggaagtattcagggaataaattatgaataaataagtacataaattaaaaaaaaaactcagtttctgccagcaaagaacaacataagtctagattttgtaccttctctggagtgattattattcgtagaatgttcaagtaaaacttttacataccaaaaactctctctcctttctactgagtacaacagattatttgaaaacttctacctattaatctctctatactttttaaacttttgtgacaataaggtaaacaatcagtccacttgaccaggtctcttcagattcctgcactgaaacacacattggtctaagcaaatcaaaacattagtcatcctcatagacaacagacttgtggttgacaagggggaggaggttgggggagggataagggggaggttggggttgacagatgtaagctattacaacagttcagttcagttgctcagttatgtccagctccttgcaaccccatggactgcagcatgccagggttccctgtccatcatcaattcctggagcttgcccaaaatcatgtccattgagtcagtgatgccatccaaccatctcatcctctgtcgtccccttctcctcctgccttcagtctttcccagcatcagggtctttttcaaagagtcagtttttacattagatggccaaattattggagttt

SEQ ID NO: 36222 - DNA, 1815 bp, Bovine  19866880488038
cggggatggtccccaggctgggctgctgggttagccgctgcggagcgctttagggaggggtgacccgaggccggcacactgctcctggggccaccaaaaccgcagggtttttaagccgcgggaagaggcgccccggatcctggctcagacccaggtggggtcgggagagagtgggaggaagtgtcccctgttccccggacttcaccctgccaccgccctgggacccctgtctctcgccactccttcgcagtggcccaggatgaagtcgagaggaggagacctgggcaccggcgaggcttccaactcgactcggtccccggccacccaccaacagcccccacgtcgcggctcggtgactgaggccgagccgctcccaacaaacatgtgacatgccttgagcagcccgggcgcttgggggcagatctacactcagcgttgtttggggtgtcgggaaaacagggtacgtaatcgcgcaggctgcacggaggctaactctcctccaccgcctagcccacaagcccgcaggcgaaggcaagcagccgggctattccgggttgtggggtgtggggcaaacagctctccccatctgcgccttacaggtgccacctggcggttctcttggagaggtttccacttagcggctcaaaggtaatgggggtgtcgggaaggtgagcgccggtccagacaggctccctcaagcctttcccctcccaaccagcactttacattttaaaaaagaagtgagaatgctcgtacggcttacagtttgttccgcagagagaccggactccccaagttgggacggagaagtcgatttgggtaagtcaggactcaacagttacacaaagcccgaagctggagctgcccccagctgtcacctctgctgtcactccctgcgtctaggcgtcccttcactccgcaagcactgaactgcctctagagtggaagctctaccgatgagagcagagacttgggtgtttggttttgtgttttctatttttttccccccatcactcttctcagaacttggaacaacgcttaacatcctgtcccttccatatatgtttacagaatgaataaataaacattatggaccagaaactgtgcttggctcatcctccccctgcagcccttccccttctttctcttcaagctctttctgctacattcagctaccatcacaggtgaggtggatggagagaagctgaaacaaaacaggcaagcaatccatgcaggccctggaggatagggatcataactgaggagcccattacacagtgaaattccccctccatggggtactacagaacacactcctctcaagaaaagcaaaaaaaaaaaaaaaaaaacaacccacctctgtcatacttgggacttgatgcaatggataaatcctgtttgtagagatctaatggcaagatgaggcaattttctcactgggcaggagtttcagcctttttttattaaaaaaaaatacagaaatagtgaaagaatatcagaatatcagggtgccagagctttgccactaaattgaaaagatgtttggcatagctgtcttctaactttgaatggagatttgggtggatggtgtgggtgtgtggggctgggaggaatgtccataaagacagtgccagatgtattaaacctttccttctaaaagagctgtaaaacagatgcagcaactgtctttgtggaaatgaacacttaaagtgagatacccagaaaaccctcttataattaaaaccaagacattcatcatgctgaccaagaccttttacagaccattcacagggctgctggggaaaaggcaacata

SEQ ID NO: 36223 - DNA, 4763 bp, Bovine  19866880533347
tttttgaagtctggtgggcatgtcgaggcacttattgatctggcctagtatatgtttcaagggctcaattgccacaccaacctatgtattgaacagggcagttctagacattagagacttgggaactttaaaaatccagtcattgaaactaggttggcaaagctttttatatttaaaaagccagatggttgctcaggactccactgtgaagtaatctataattccattttcaaaacataatgaggttaaaagcacagtgacaaggagaatgaatataacgaactgaaagttatattctttctctaatgcttgatgcaagaaaggttgatctcttatttttatgtttaactgaagaatctatggatcacatagccttatgaatagggatattattttaacatggaccaaagcaatactcactgtatgtgctcagcagtccttcatattgtactatcaatcccaccgtgtgaagctgctcaaggaagccagggtcatacagacttgtgtgcaatttgatgataaaaccacaaaccaatccagcaagctaaaaaaagaaaaaagaaaagaaaaacactgaagaaattcctggggtcagtgagctttaatttaaaaatatttaagacttttgagacatcacagacttcattagaaacttccaaggtatgtgtaacaaaattgtaactatttatatatccattttgaaaccacggatgtctaaacccatgctgcaggacagtttgggaaaggcagcactgtgaaaagggaaagaccaggcagtaaaatcataaaaagtcacttaacacttccaagactttctcacatatttttgcacatgaagaatagagataatagttctcattcctcagagtcattgaaagaacacagtggagagatttgtgtaaggcagagcaaagtgcttgacacttcgctccatttactactgggtcatccatgaaatcataggggacaagggatattttggttaaattattccctttatctggatggtttacaaagacagacttctgtctctttccctccaggtgtgtgtctgcaaaactcagtcatgggtgcaggcaggagaggagtgggaacacggctattctgacggaggccaaccttgttgccacgggctagggtggggtgtagcaacggaggtgatactgcccagccttgttccaagactacggcctggcaaacttctatataaacgacaaaaacaaaaagcaacaacaaaacagactattataaggccctgtccaggaattcatgagggagctgtagaaataagggttgcaaacagatcccttttgccagtcctggctactctctgcacagtgcatggtgcagaaaccccaggaataatatgaggccaggacaagggactctttccttcaaagactctgtgccctgtgaaacaatggacatttcagggacttggccacctttttgcagaaataaatatttaaggtctcacacactgtttctattcagctaggtatctattatgaataagaaaagctgggtatcaataccttaagaaaaggatcctcttaaaaagcaaactactagactttcctggtggtctaatgattaagaccccaagcttccaatgcagggggcatgggttcaatccctggtcatggaaccaggatcccacaggccaggtggtatatatggccaaaaaaaataaaataagcagactatcataagaagatctctttcctcactgaggatactatctgacagcccatcagtgcgctgggctcaaaaaacaagaggcacctactgcttggctgaagacgatgtctcttctcaacgtcagcatcaaacactggggcaggctgtaggcgagctcctggaggagcacgaaggtcagggactgcttagctcgattcaccacttctcccatgcagtccttcagggtaaggatgaggggatacaactgctcataccagtcttctgtggggtggacagagcataagaagagtgggatagatagattaaagaaggtcttggaggacagaaccaatttatttattttcagtgatgttctacaccatacttagaagttacaaagataaaagatttccaatcccaatctttcctctgaactcctgatgtctataaccagccacccattggactctccacttggatcctatctcactcatttatagaagaactcctcttcctctctgctcatctctaatctgggcattgcctggatcttggtggatgatgccaccaaactcttccccggctggaaacatgttttcctggactccttctatagtcttcacacttactgggtaatgaaattagttctaccatcataatagggcttccctgtggctcagatggtaaagaatctgctgcaatgcgggagacccaggttctatctctgggtcaagatgttcccccagagaagggaatggctaccgcctccagtattcttgcctggagaattccgtggacagaggagcctggtgaactacagtctaggggtttcaaagacccatcaaacactcatcttccttttgccctctcccatcatcagttatccgtttcccatggactgcgtttctatcctgctctgtgagtgactcctcttcctccaggcatatccttctccaatcttttctcaacagagttgctacagagatctttctaatcaatttgaattccattactcactctttcatttccttacaattttaaagacaccaaagcattcagaacaaagtcccaaagcatgacagaccctgcattatctgatctctgcctatgtgtccagtctcatctctcagagctttttcatctgtagccttgagtcccaggagagctgaacagacaaatttccccacacctgttctgctgtctcatctcagtgtctctgcaaatcctatctgcagtcctggagcattcttcccttgcttatcttcctgacaaatactttatcttctctgcagactcaattcagagtttctctcttccaggaagtctccttgatttcccccctaaatcccctcctcatttactaaaatttgggtcaggttcactttcctttgtgttcacagctccttgcccatactcttctgcaagaaagtgaactcactgagggcaagaaatttctgttttaatcactggatctccggatcacagcatataaaatattcagtttttaattaaatgagtaaagttggaataaataaaacaaaagtcttttaacatatagggtatgaatgagaaaatcaagtttttgacagtatttggaatctgaatagcctttcttcaaatcaggatacaaaactgaaacccatcctgtgctttctgtatgcctagaaatttaacatgtttcagttatataattatgactttggcatgtgatatagaaacaagttatattctatttcaatctatttgaaaatcaaatcctgacaaatgtcaaatattataaattccagactgtgtgctattccattaatatataaattgacagtggtatgacaaatacaaatacagttgaaaagaaatgagcgcatgctgaaaaattaactgtgaatcaagatctgaagtgatacaatcttctcagtttacagagggagtaatgtgaatggtcaataatcagttaagaccttgaaagagttataggtagtgatgaaaagaatcataatcattattgcaccatatctaccgtcacttacttattttatgttctataatagattagatgaaataaacccaaaaatggttgaaaggataattaatggtcccaacttaataaaaagagatgctcctgttaatactctatgtaaatgcttatgtgaagttgtaatacaaaatacattaggaacattaggagttattattttaaaatattgtagaattaagtgttatgacaggaataaaaaacactagagaaaagagaattcaatgaaagcctattaaatctgtaatcatttaataaaggactcatttgtgggcagcttaggataaaatatgaacagtggttcaactgaaataggcactgggtaactattgatttttatgtcattagtagacataaaagggcaaatggaggtacattagacttattttcagagtaaaagacacatcaagagacatcaagaagaaatacttgatattcatattgttttcatatttatattgttttacctttcactctcttattcgattactgttctcaatgtgaatatgcagacacatacacgtggaaaacaagtatctcaataaatcgacccagatgtatatcttaaaagataacagactgagaacccattttcctttgtgttgaggtctgcaaaaatgaatttctcctgaagaattctccaacacagaataaagcctgtgtgcagtagatggcgctgctttatcagcctgaagtaaaactacttggtcacttactccattccggtaactggtttacactcttctacgcatttgcaaagttcccaaatagcaggtacatgttgtctgggcacctagcatcctattctgtgtcaagtgatcaataacctcgccaaaagtgtgataagctctttctatcagaaagtggaaaattaacttattcccaccccaccttgcaagatactaagtgacagctcaaattaaacagagctggtggtttttcttaaggatctttaaaagaagaatcttcacagatttcttcatcggcataatttttttagtcacttctaaacctatcttcactctaatttaaccattgattcctaatcaga

SEQ ID NO: 36224 - DNA, 1016 bp, Bovine  19866880597906
ttttgaggttcaagcatgacttggaaccatgctgctatattttaaagtctccttcctaggttttgactgggtagcaaagaaagttaaaaccttcgtatacgatcttaaagatcctcaaaattggtcttttactcaagcgcaataattctcctgtgcccagacattctgtttctcaaacaattcttgccatgcctactcagagttgctattaggatccaatatggaagatgatgactcacattttttgataatctagtacctgccaggcatgatgctatacaaagtaatgttgaaaagtatgttctatctccctcatcttgtagataaaggaactaatattcccatagtttaaattaatgttaaagtttgttttgatgtcagctgtgtctagttccaaatccctgtcttgtctaaggcagcctgttgccatcgatgtatacatgcggtataaagagtaaacattctgcgaatgtaaaaggagcaggatatttaacaggaggtttcagttgtcttagagtcttggctgaggtcctgaaattgaggacagcaggtgataaatgttcacacattctaaatggaggtgccagacactcccacccggacgtgcggagataaatctaaacatgtctttacctcttttgtctatcaccagtctaaataaagtggatgaaataatggagcttttaaggagcttgttagctgaggaacttgttgagctttttgcctccccactttcagattacactcatgaagcatcccattacagaaagagctggtgactgggcatctgaaacaaagggcagtgtgccagatttctagagcctcaggcaggagacaacttgttcctttccttctgtttcttcctcccatcccaaccctggaggactcatagacttcagcgctggggaaaaagagagtttaagaacgaaatggaggaagaacaacaacaaaaatagataattcatccatccttcctttcccacagttgttctagggtattcttgtgtcaggattaa

SEQ ID NO: 36225 - DNA, 719 bp, Bovine  19866880598426
ttgattgtgattcacacagtcaaaggctttggcgctgctactattcgactgctgtcaaaggaccctgatcttctgaattgaaattttattttcagctcattgcagaacagactctgatgtactgacctgttaaaatttttagattaagttcattttttaatttgatatgtctcttaaagcagtcctgtatctttttgaaaagtgataacaaaagaatattcagttttaattttctatatcatgtaaaaccagacatagacttctagtgtctcttaacttgtagggtgaatcacagcagtgaatacaaacaacgctacaagtaacaaagatagacacacatctttgcatacacacatgcaaatggccacctccctgttcaagtcaccattgatctctgcatcttctttgtcacttcatgcccctcacaaatcagatgcatcaaccctgttctccagtttgtgtggatcaagactcacatttctagccttttagtcatccttccatttttctacattcctttttttcccagtggggtcttctttctttagacttcaccactcactgaagattggctggactcccagtaaacctgtctatctagtatgcaccaaatggcatgaaatccaaagatatgaattcaattaaaagttcatttaggtgaatcatttgatgctttggagtgtctccatttcattatgagctaaatgagaataattaat

SEQ ID NO: 36226 - DNA, 1494 bp, Bovine  19866880672753
gccattacagaatactgagtagagttcccccgtgctatacagttggtccttgttgataatttgtgttatatacgcagtgtgtacctgttcatctgaaactgttctggttggcttggtgactcccacggatatgcattttaattctctaggtcattctgtgaggatgatctgaagaccacactttaagaacttctaattcttagagttgtcagattcatagcaacaaaaattacagtggtggttgccagggttgggtgaatggatgaatggacaattcatgttacagggtacaaattttcagcttaggaagatgaaaaattgctggagccagatggtgatgatagctgcacaccagtgtgaatgtatcaatactgaatgccactgaatgatatgcttaaaaatggttaaaatgcaccagccccaatcatccagtatcatgaattgaacttggaccggtgatttgtttcatatatgatattatacatgtttcaatgccattctcccaaattcatgttgatgtatggcaaaaccaatacaatattgtaaagtaaatgaataaataaataaaatatatttgactattttatagctaaaaaaaatggtcagctttgcattatgtctatattatcacaataaaaagaaaaataagaaatttgaatgcaagcggcagtcattattttaaaatattggtgagtctttgctttcatactaattattgataaataaaatagatatctccagtgtaaaaggtaatttgtgctcagttagggatccacgttgtacgatagttcctcattgctttatgacagggcgaaaacaatgacctaaatagaaagatcatagcacttgatttatgctttattaagagaaaatagatttcttgtctatgcataatttggccaaatgaatggggggattagagtcactcagtctgcatgattgttcctcttcctgctgttctcaagtggattcatctgattttgcctcgtcttggttttgcaatacagatccatagtgatactcatgctcttttcaggacagggtgtgggccagtgtggggaagagcctgaactgcattattgcaatggtggataaactgatcgaaagagagagcggtggcgagggaagcagcaccagcagcaaagatgtagaaaaggactcttctccagtggactccatcataactcatccaaagggtaaggaatcattttttttttttccaatcattgactgagtaaacaaagtgagaaagccaagataaaatgagatagaaaaaagaggagtcaatagtgcttttgatgaaagtgctgatagtgtgcttttccactgctctggctggggtgatggaaggctatttatcaaattgcatctcggttgtgttttcagaactgcttgcaatgctcatttttttttttttaaactacataaaaaccctcttgaaaggagagcactgttttcttttacagagtctgatatagtttaatctacttttat

SEQ ID NO: 36227 - DNA, 1808 bp, Bovine  19866880696712
tgtcgtcttggagaagtcatttaaattctctaagtatgtttttacctgtttgcaactacactcttacttgcaccctgcacaaatactgtgactactggttgaaaattcatcattaaatatactcaaggtcttttcccaagtatactaacttgtcagcacaaatggaagactttcataattttgttaaactcatcaacacattttacttataaaataaaacagacagtatttaaaagaaatactatttcttttattatattatattaatttcttccttgtttggatttaaccctcagtaataacgtgtaagaccaaatgaataaacaataaaacacaccgtagagaacccatatgctactcttgcagatgcagagtttaagttttgccagagaaactgatacatgattaagaaggaaaactgaccttgagaattacaatataatatcctatcttaaggaagaactctcagaccataaacatatccaacttggacttgccgttctactaaaggagaaataaagaatatttattctttaagtcagaaactctttatgacaaatcaacatactaactacgtcaccagaattaaaattatgccagaactaattttaactaagtttcaattgttatgcttacatctctcctcagctaggacatcttccaagtaaaataatacaagttttgcttaggaaaagggaattttaaatgaaaaaatcaacaaacacatttaacaaataaattgtcaagagagatgaaattattccaactttacagaaaagaaacaaaaagaaagttccataggaaattaatggttaaacatattcactgacagctttctgaaagttctatcctgctgtttaaaattctttgagcttattcagttttaagatgctttatttcaaattcaaaaagttataacaaaaggctaattttattacttaatttatgagagcataaattgttcttcgctagaaaaagctttattacattctcaagatatttcctatctcccttttccatgtgtcaggcaaaattacacatgtgcatatgtgtacgcaatcaaaaataaagaattcacatccaaaacataaactgaattaactgtactttgtaagtaaaaaagttcaaataaacccaagacaacagtaagggctctttttctgactaaaattgttgtgctcatttcttgacccttttaaaatggtggttgaaaaagtatatgaatgaacagatacatcaaacagatactgaaaccctcaaaggtcatttcttactttatacagtcatgaaaaattcaaggcaactgtcaaaaaatagctagcacagcaccatactgtgctgacatcaaagaagctgttgatattatagttactttcaaacaaaaataataacttagttcaggctctgattatactggtatcccaccctgggattttgacaagagcaaagaggaaccagctgttctccccagagcatattagaattcagagagccactatcctcgggagatgttcatgatcaccaagggtttctctattatgcatgtctctattcccaccctttcacctcccactatcaatgatgatcagagcctatcctgagatccttcaggaaacttaagaaactggagaccctcaaatacagacacaagagcatggatgttgggactagatcatgaacggccttgaatatgcagtaaagaagttggataactgagaagggcagtgaagaactgctaactccttaaacagggaacatacaatcccactcctgggcatgtatcggagaaaaccaaattccaaaagatg

SEQ ID NO: 36228 - DNA, 1667 bp, Bovine  19866880719485
aattagagccttgccatttaaccttgtatacccataattaaatgagctacattgttcaaaaatgcttgctcttctgaaattaaggaaaagctctaatcgcatagagaactactggttcacttcctaaagaaataaacctaatgaaagatatatagtactctgtatagaaatatataagagtactaagatattcttcaaagacagagagccagagagagagagagattccattcactgaaatgctcaatttttaaatttatcaattccttccagattaatctataaatttaaagacataccaataaaaattctaccagagattttggtagacactgacaagttgattctatcatttatatgggaattcaaaaagaaacaaagactagctaagacaaagagagagcaactttggaggatttatacttactcagctatcaagacgcattataaaccaaagtaataaaaaatacgattttgccacagtagtgataaataggtcaatgaacagaaacaagagtctagaaaaataagcaaacatattcatttgatgtatgacaaataaattatactgggtcagttttttgtctgcataaaataaaaacaaatcttaatccttacctcacataaaaatcaattccaagtagattgtgactctaaatgtgaaatgtaaaatagtaaaacttccagaagataacatcaagaaactcttccagactgtcagacagactctagggtagcctccatgccatcacccttgagtgcagatgggacctgtgagttgcttccaacagaatacagcaaaagtgtaaggctgcatgactggttgcgtgctcagtcgagtctgactctgcaaactcatggagaccccatggactataaactggcaggctcctctgtttctgggatttcccaggcaagaatgctggagcaggttgccatttccttctccaggggctcttcccaacccaggaatcaaacccgggtctcctggttggcaggtggattctttaccactgagccacctggggagctccaaagtgcaaggtattccaatgtaattaaagcctcaaaccatctgatttgaaattattatcaaaagagggattatcctatacggatctgagttaaccacgtgaaatcctttaatagcaggactctccttgggcgcctgatgaagtcagcagccgtgagaagaagcccataagacaatgacctgaaggatgcctgcaggaactacaggtggcctctgtgccccgaggtggcggatagtcattggaaggtgaaaacggatgccaacaaggacaactgacagctgccgaacagatatttcacccctctggttctgggcactggagaaaggccctcagaatatatacaacgtatattctcttaggcagaattgaaaggagaaaatcctgaatggactgagaaattgctgaattaactaaaatgaccatggttaaattcgtgccactaggcaggggacagaaattaatttcagttgtagaaaaatacaattatatttttgaactcccaaatttgtggaaaattaaattaaaacctatataattactttaagctttggatcttactggtttgatcattttaattattcatataccacaattcaaaaataactaactctgatgagtaattttttctgtcta

SEQ ID NO: 36229 - DNA, 1241 bp, Bovine  19866880752932
ctgttagttcactgcctcactctaaacaaataataactgagcaactcttatcctgattcttaaacaaataataaatgagcaacacagaggcaaagtactgtgagtaattcagaagcaatatgtcactgtgcccttaagtgggatttacaatctggacagcagaatccaaaatactcacaataaaacacacacacacacacacacacacacaaaaacaagcaacaaatagctcaggtaaaaggagtaatgaatctgccttctagtctttgccttcaaggtacagaatcaataagcagtttctgaatatatggtattggcaatattctgtgctagatattaaatgtaccttctcaactccagttttgttccttttcactttttctctttttccccttctttctagaactgaatatatctagtcagtgtataagtcaagagacaaatgcaaaagaaaccacactgtagaatggatattttaaaaggacatcttaaaatatctattttattaatgggtaaactgagattgagaacactttgaaaatttgtccagggtcagacagagaatgagttagggagaagggatttaactccagtttgaacactttaaaaatccattgtttttatgctgagcaaaatacagtccctgaaaacaatttaaagaaattaaaagaattgtcatttagttgctaaaattccttctgaaaaaggaaacagtaaagttcaatttcatgccagaaagcatgttccccaggcaccaactcattctaaaacaggtgattattcaatctggctgtaatattaccctgttttcctccctgttttatgttttcatgttaatcattttactttcttttctttttttaagccatattcaattaagatttgtaattaggtttcaaatttgaaacacatctctagtagaaagcaaacgacaagagtagtaattaagggacagctgtctcatctttctggggatgaaacaaggcttttttgtttctaagttataaataccagagaagttttcaagattttttttaagaaatagttaactgagtagtcaactgattgatactgatattgaaagatactgaattgatctaaaaaagtcagtgttctttctgacacatgctgagaatctttcttctgggataagcttaggttaactccaacactatgaacttttattgctgcaaatacagaatctccacattttatacaaaaccaaatcatttctttagatt

SEQ ID NO: 36230 - DNA, 1269 bp, Bovine  19866880915849
gggatatgtgtgtacacagtagctgactcaccttgctgtacaatggaaactaacacaacattgtaaagcagctatgctccaataaaaatgcaaaaataagatagaacacccttctctactgtgtattctgccccagctatgctcatttctcttccatgagagagccaagcatcttagaggagatacttaatgtttcctatgctttcctatttcattgtagtccgggcttttatccccacagctccagagaaactgttttggccaagatcacttagagactctgggttacatttcacaaatggttctcttgtctttcaccacttggcagtatcagatctattaactattcctttaaaaaaatgtctttctgattttcttgatactgaatatatatgtaaataaatatatgtatatgtgtatgtatttgattatacgtgggcttcctaggtggcgcagtggtaaagaatctgcctgtcagtgcaggagacatgggtttgacccctgggtctagaagatctcctggaggagggcatggcaacccactccagtatccttgcctggagaatcccatggacagaggagcctggcgggctacagtccagggggttgaaaagagttggacacgactgagtgactgagcacacattagattatgtaaatgtatataaaatgtattttgggggggatttcttcattgcggcgaaggctttctctagttgcagtgagcaggggcttgtctagctgcggcacatgggattctcttgttagagctcacggggtcgggagttgcagcgtgtgagaatagttgcccccattgcatgcggggtcttagttcccgattagggatccaacctgcatcccatgcgtgggaaggcagattcttaaccactggaccaccagggaagctccccctcccccaaatgtctgtatattataagaaagaaataatcagcatgcttgtacacctctctcccaattctgttactctctttgactggaaccgcaatcagatccaagttgattcatttagatcagcttgggtagatttgacctcttataatattgattatgatctttgtatgcatgaacacaatgtatctctctctccttaagagaattttaatacaatttaaacatttgctccgtaaatgctgcctaaatcctgtgttagttgtatttttaggtatctcatttttattgtagctgttcaaaatggcatctcttttgaaataacattttcaaactatttgttaatggtgtatagaaata

SEQ ID NO: 36231 - DNA, 1580 bp, Bovine  19866880986228
tggtgtctgataggtattgccttaagagttcaaaattttccaattttatttcctgtgatattagtttctgctatttgagctttagaagacccataggggaagcagctacaaattgcaaaatatgtttacagagaatgctattcaaagttctgtggtgacctaaatgggaaggaaatataaaaaagagtggatataggtatacataggagtgattcattttgctatacagcagaaaataacacaacattgtaaagcaactatgatccaataaaaattttaattaaaaaaaatgtctacttgatttttttagggcttcctggacattctgtgaattttacattgttcttaaatataacttctattcagtcaggcaaagtgtcaaatggttcctatgttcttctgtcccatttcctttctctatgtctattccttctgctggtggttcaattctttcttttcagcaccttccaaagttaccaccctaccaaagatttaatgccaacttctctagaaagtgatccccaggtactttgaactctgctgatttcttcattatttgaccctgtatagcaattataacaaatgcctataatttatattgctttcttgggttgtcttgtgttatcatgtctttccaactatatttttaagttcctaaaagattgtcaggaacttgcacctcttggtctgttcccttcagtacttaattcaatattcagcatatgtgaaggagagtcctagtaagtacacagccacttgtatgtattaaatatctatttacaactataaaaagaagtagcttctgtagcataaatatctcaacatgttctttgatagaaattgcataacatccctttattgtagcataaaatttaaagaacatttgaacaaatatttcagataggaaagaggcagagggaggtaataaatgagagagataataggccatcatataacaaggatgctattactttgaaatagatctacatttaagattttgcatttttctatgttggactccacctttctgccatgggtagcattttctctacctaaggattaggaatgtcataagataaataaaagggttacccaggtggtgttagtggtaaagaacctgcctgccaatgcaggagacaaaagagatgcaggttcaatccctgggtctggaagatctcctggaaacaggaatcacttccactccagtattcttgcctggagaattccatggacagaggagcctggcaggctacaggccatagggtcgcaaagagttggacatgaccgaagcatcttagcatgaatgcatacaagataaaaaaataaaaaataaaaaaaaaaaacaaagatgtttagattttaacatccaaaaagaattctgggtccaaagcaagaaaacagtattgtataccaagttttccttagagaaaacaggatctttaaaaacacgttagttaccattaatgcattagaaggcacacctagagaaacagatcagagttctgcaatattaagagtagagaaaatgtagggtgtgatgtaaatgataaggaaaactatccaggctcaagagctgtatg

SEQ ID NO: 36232 - DNA, 1436 bp, Bovine  19866881027647
cattttaagctttgggggttggttgggcagtattcagttttttaacaagtaaattaaatgaacttgaccaaggcttctacttctgtttatcatgaactgattaatacaaattaatactgttactgacagcaactagaaaagctgaatacagtgttataaaaaaagaacgtattttaaaactttgtagagctaacaaggaggcttctctggtggctcagtggtaaagggtctgcctgcaatgcaggagctgggtcggaaagatcccctggagaagggcatggcaatccattccaggattcttgcctgaagaaccccatggacagacgagcctggcaggctacagttcatggggtcgcaaagaatcggacatgactgaagcaacttagcatgcatgcatgcagagctaacaaaagagtaaaaattgacaaggccaagatacagaggaggacagaggttcaggaagataagtctgactttagggccactttttcatggaatctgaagggtcatttaagaatcaatctacatagttcatcagcatatgggagaatgagagtggagtccaggtcctactaaggtggggagataaataaatgtgcctcttcaggttcagacatgaaaaggcttaatgttagaggtaacagtgaaccacaagcgaaacccctcacgggaactgcagcttggctccacaaatgactggaatggattcaaggcactcctgtctcatcaaagccattaggcgcctggaagtagataacataaatcctctcaggagggaaataatatcatgccaggactctaactatttttccaattttaaaatactgtttcaccgtataaaccaaaatgaggatacagggcaacaagtcagtagggataaaactctccagatacaattgaaatggattaatgtgacctcaaaatatcagagtagactttcaagtgactaggcttatatcatcagagagataagaaagagagctcatacattctggcagacaagtagaagccataaagaataataacataaaaattctagaaacagtaagtatgaaaactaaaattaaaaactcaatggatgattttaaaagcaaaatagcaacagctgcaaaaatactcagtaaacttgaaaatgagttggaagaagctgtgtttaatgaagtataaagagaaaaaaagtagaaaaatatcaaaaaagagactaagtaactagaaatacagaggcttgaagatctacaatttggaaaataggagcaaaataaaaagagaagaaaagggtaactgtattatgtgcaagaataccaagtaagctacaaatccaaaagactgcagcaacttaaactacacaaaaatgtcacccatagctaaacacatcacagtaaactaacaaagaattaaagataaagaaaaaccccttaagaggtagaaaacaaagg

SEQ ID NO: 36233 - DNA, 1602 bp, Bovine  19866881117151
atagatggtgaaaatctagattttagtctaatcagcgtacccatctggagttcatgatctatgaagttaaactcaattagaagctttcttcttttaaagagtacttaaccagatctgaatataaaattactacatctgtgtaaaaatttaccactgtatcctttctcctctctcagagaatgatgtttgagacattgctgtaaattgtttttacttttcaatagactttatatttcagagcagttttcggttcacagcaatgttgagggcaggtatagagatttctcagatacctcctggccccacacatgcacaccctctccggttacagacatccttcttcacagtgatccacccgatgaccctgcactgacacatcgttatcaaagatcatgctttacgttagagttcccccttggtgctgcgcagtgttttgggttgtgacaagtgcacagtggcgtgtgcccaccattactgtgttattcacaacagttccatttcccccaaccttctgtgctctcatcttcctgcctgactcctggcagccacttacctccttacaactataattttgccttttccagaattagcatatagctggaatcatacagtatatacctttttcagataggcttctttcacttcgtaagacacattattccaagtattttcttgatagttcatttctctttagtgttataaattattaaaaaattatgttttcttctttttatatagattatggattttgacaaatgcatagagtactctatatattaccacaaccaagttatagtatagttcaatcacctccaaaaatttcctcatgttatctttttgcagtcagaccctcttctcacacacagttcttggcaatcactaacctcttctcgccaaaatgccttgaagcatacagtatgtggtcttttggatctgaatattttttaattagcacaatgaatttaagatttatcagtattactgtacagggaagtagtatgttcttctatgctgttgaggagcactataatgtgtgaatgtatcagtttttttctatccattggtgattgaagggtatttgatttgttttcaggttttggccgtaataaatttcccataaacgtgtataagtttctgtgaacatgcacttttatttctcttgagtaaatgcctaagaatgagatggttgaattatgtaggaaacttatgttaaccttctctggtggttcaaatagtaaagaatctgcctgcaaggcaggagacctgagtttgatccctgggctgggaagatcccttggaggagggaatggccacccactccagtgttcttgcctggagagttccatggaaagaggagcctggtgggctacagtccatggggttgcaaagagtcagacaccagctgagcaactttcactttcataatatgttaacccgtataggaaactgtcaaactgttatccaaagaggctaaatcattgtgcgttctcagcagcagtcacgtgagagaattccagttgttccacatatttgggcatcttatggtggtttcaatttgcatttccctagtgattactaatgttaagcatctttctgtgtcat

SEQ ID NO: 36234 - DNA, 1748 bp, Bovine  19866881121364
tccgctttctatattttaatctgttgcttctgtgagtagataggaaacgtttatagcatgtgaataaaataaaccttagtagggcaggaggcatgatggatgaaagaaacaggtatttttcagcatgtactcaaaagtgtattatattacagtcatgggtttagatatcaatctcttcggtagaattgagacagactgggtcttaatcttcttgtgcccctaatatttcaaaatgtccagtgcatagtgatgcttaaatattacttgaattttgagaagcctgagggataggtccaatttagcaaggtttatggatctcaatggagttattagtgaaagttgctcaatcatgttcaactctttgcaactccatggactgtacagtccagagaattctctagaccagaatactggagtggttagcctttcccttctccaggggactttcccaacacagggatcgaacctaggtctcccgcattgcaggtggattctttaccagctaagctacaagggaatagttaataaaacttaaatatcattaatagaatagtatgtaaaagtagggaggcagtcctgtgatacactgtgaaagtgaagtcactcagtcgtgtccaactctttgtgaccccgtggactgtagcctaccaggctcctctgtccatgggattttctaggcaagagtactggagtgggttgccatttccttctccaggggatcttcccaacccagggatcaaacccgggtctcctgcattgcagacagacgctttaccaaatgtatctgttagctatttctacataacaaatagccccaaagctcaatggcttaaaacaagaatttattatttgagttcacaaatacatggttgtgtgtagaaggaactcatgccaggctcttggttcaacaccttacacacctttctcacttaacccttgcaccagccctatgaggtaggcactattaccatgaccatttgacacatgagactgcagacaagaggttggagaagcaactcaatcccatggcttgtaagagctagaaccaggatctgacctcggagcctgtgccatccagcctgcccagcccagccagttcccccaggagcatcttccccaacttaggacgtcaagcctctggactctccaacgaaggtcaccccttcctctgcttgccttcttctctccctcagcgccaccaagtccccagcatgaagatcatgctaagcagaaatcctatcctacagaagatggttcctgtggctaaacaagaggctggtttacaggaaacaatcagcagaaaggatgctttgcaacagcttctaaacaggatgaagtgtgttggaacagagtttgtcattctgatggggaatcttggaatatttgggttagaggactaatccagtccaagtctcagacattttttaagccacggagtcttcttcaagtgaaacttgatatagaaactgagtatgtaaggaataccaaagccaagcttttcaggctgtgaggtcagggaggtctaccttgggctcatagagggtacccttggggctccatggagcactatttgagaaccactgtggtggccccgttgggtcatttaggtgatgggaaatagtctcagggtcacagagcactagagtagaagaaccaagacttgaactcagatctcctgcctcccatccctaggtgttctcttctgtgccaagtattcaagaattaaaacacccattcccaaaggaagg

SEQ ID NO: 36235 - DNA, 826 bp, Bovine  19866881153256
cctgtcaggctcctctgtccaagggattttgcaggcaagagtactggagtgggttgccatgtccttctcccagaggatcttccctacccagggattgaacctgggtccccagcattgcatttggattctttaccatctgagccaccagggaagcccatgctacacagtagcttctcattagtcaatgttgaggtgatgaaccttccagatgcctttacttcttcagatgcactttgatgacctacacacaagacatctgagcaagcaacagccctgtctgttagtagccaagctagcatttagtgagtgcttactgcctgccaggctgtgtcctccccacaattctatgaggtcatttttatgattacctctcttttatattgaagaaactgagaaacagtaaaagtgcatcatttttcctattcacaaggctgttgactacataagaaacaatttgtatttacagttataactggcaactcacagaagaaactgtaaaaataaaaaaaatatgttaaataagactccctagttgatggcaatttgtgaaagaaaatatgaagataatgatttattaatttaatcaggtaagccaataatataagaaataccaggcaggctggtaacttcttggattattctaagcagcaaagcaagaacattctccaccaaaaagaatatagccacctgtgatgtcactttaattaaggcagtgtgtatttctaacataatgtgtgaaaatataaaactgactgaaatataaacctaactttccatgagcaagtggtgtataaatcaaataaataaattcactaagagaatttaa

SEQ ID NO: 36236 - DNA, 1379 bp, Bovine  19866881234369
tataagaaaatatggctgcttatcaaattaaattgttttctcaatttgttttgctgatttttttattactcacattttcatcaggagtttaattacaggaaacatcaatctttcatcacctgattaacagtagaaccatttctaaatcacattcatcaacagtgactttctaaagttttcttactgtagatggttctcatcctccatattgcattcacttaggtggaaagtttacgctgattttttttttatgttctacttgatttaactgtatatggggattttcttttttaataatatcaattttattaatgaagctggtccagattcataacttcacatgaatcaaaatgaaagcctgtcataatttatgtcaaaaagaaatagtatacttcagttttctttaactgaatatttattgaccatcagcaatgagccaggcactgtgctgtgctctggaaaatgaggtaaagaagcagaatccatattagtgatttgttctgtccattaagtgttcaaggcacttggaacagagtaagattaagaggttaagggatactgaatttagccacatttttttgatgttgcagaaaactgcttattgacgagaacagagttccaaagtattggaaattatgcatttatttgtatcttgtattttatcagaagatcgtatctgtgcaatcagtttccatttaaaaagtaaaaatatttggtaggtaagtcatctgtaaaattagatgaatcacttttatttgaatgtaagatattctttggatatagcctaaaaaccatgtagaatttgctcctaaagtgaattcattactagatcagttttatggatggctggagtcaaattataacacagtgtcctataatttatttcattatttttattactttttattaatatcttattttccatgttgatttcattcattcttttttgagttataaatgttttttaggagataagacactgtttaaatttataaaattaaatacatactttggtctgaaaattatttagtattggataatttattatatagtattagataatgtagtattatcaaataattctaaagtgaaagctgttaacattttatgtgctggatgattgtgtatagaatgcacaacagaatgttttggtaaagatattggttcataaaagggatgattaacaaatataaatgtgatgtattgcaaatgaatgtgtgctcaagtatacttaaaatatattaaatatgtgatggatgttattgcatatttaagtgggattattatcagttgtttaagtaaagtgtattcttattaaataataaaaataatacttattattaatttattttaatcttcctcttaatttaggaaaaata

SEQ ID NO: 36237 - DNA, 1171 bp, Bovine  19866881294954
aaatcaaagaatgtgtgtgtgactatgaacattttctaaattttaatatattttaaactgctgccccccaaaagtggatatttattttctctgacattattccctgattcagacttaagtatgtcttccataattctgaaaggagtaacgctgagtgatatatcaaaggtacgctatggctttagatatgctgcttcccttttacaagccatggcaatattacttaataagcagaagctgacttctgccaacacagtcctctacttgccttagacagggaaatatatagtactttacaagaacatttgaatatttaccattttatagatcctccttgactgcacagaagaggaaaaaaagccaattgcactttagaacaatccttcattggggagacgtttttagtgagtaatatttcaaagactgttcaagggtgaaaaaatgttttataaacaataaatattttagtgactccatggtgaaaatttcatagtatgggttttttatacagggttcttccattccactatctgtagtcacttctaaaaatacaaacagtcaagagtttcctaccaagctaaactcatctgtaaatttccacatcaattgcactttctctagaatcagataggtttctatgtatttgtaaatgtatccacagtatttaaaaaatacttatcaagacaattgacttaaataggtaagtctatgaaaattatctactgttgtatagtaacaagagattaacgttatagaataaatgtaccatagattcaaaagtagattattgaagttagtaaaaccaactacaaggcacatgtctgtatcctcgaaagcttattttcaacactggatgcaacagaacccctaagatgctgatctgattttccaaaccctagaactggaattgagacagggaatatcaagactttaaagactttatcttctgttgcctagatagcccataagggtttattaaattctctagaatgtttaaatgcttaagcaaatattctagttctcaattaatgggaaagtggaagtcaagacaagcttagggaggaaatgaaaaagtcaccaactgtaggttaagaacactgagcagggggaaactctgattctgataaccttggctgccaacttgaaaaccaatatatagttgtatcatgtg

SEQ ID NO: 36238 - DNA, 619 bp, Bovine  19866881345946
tttagttcttcttgaaaatttgtctcgtctctctctctctttttattagaatagtactcatttccagaacaaatttactgtggagttagaggctttttttttttttttcaaactacattctgttaaagggagtaagctcctagcttggtgataatttagttactgttgcctgttacagttctaggtgttccaaaaaaaggcctggtagacttaaagatcgacagtagcctttaagatagatggtagatattttaccccagtgaatacaaattgtactgagttgccactgactggtaaatgacacttaccatgatatgcattgagtctccccaaagggaagatgctttcagataaaggggtttaccgtggcacaagtctgcttttgaaacctgctgatagtcaccttccagaattgaatcctgtgtcaagaggggattatttagtttttaggataaaggggagttctgagtggctcaaggagtcagtcaagtaaaaaattacctaggtctttgttatataaaaggcttcccaggtggtgctagtgatagagaacccacctgccaatgcaggagatataagagacttgggtttgatccctgggtcaggaagatcccaagaa

SEQ ID NO: 36239 - DNA, 2296 bp, Bovine  19866881355852
tgtttaaaatggaacagaataacagtctttatttttgtgcataatcttactaggtacagagaagggtatttctatctgactaggcaaagttgcctctctttgggaattaagaacattgtaatcaacagacatcggagactttacataataaaacactacatgaaaagttatttttaaaccctttcttaaaaagtcaaatgtagaactttcaggtatctgcacacgcaaaagtgcctactaacacaatagattgctctccaagccccattgccagagttaatggtactcaaaatgagtgtgttagtcatcatgcgcaactgagaaaagctgaatggtcccatttgtccaaaaataacagctttactaatatgccttgaacttctactacttaaacattgaaattgaaatgcatatatcccatttaagataataaagacagacatcacaacatcaccactctttgccttattaacaggaattttttataaagttgcagacacccctatttcaatgggtccaaaggaccaacccagtgaggcgatgacgtgaacaccatttctcccaccccagtttctccttcacaccccactcccaacctccacacaaacagtatcctgtagcatcatctctttgggagcattatcagagcaaagcacttggactgccaacatacagaactggtccaattttatttgcacgttgggaagaggcaaattttgctaccccaggtacacaatgctggacgttctgccacattaatggggatttccctcctttgcctcacctctttcttgattacatttagtttgaagtaagtttatccctatcttaaataactgaaaaaaaagtctaataagatcgaatggattagtatatacatacctctggaaaaaagaaacacttcacatgaactcatcctgggtagttggtgcatcctcccttcatccctgtttcattgtaaagggcatggacccctggccctcttcattatctccatctcagcgtgtttccttctctgtctttactgtgtcatctcccattaacgccctctcaatcagcagttttctaccattcatatccctatgcttatatcacagtgctcagcttcaacgacttctatatactgtctagatattggtttttattataatgctcttcttgaggagtcacagttaatatttttgataaaaccaaccttcaactgatttcattagccattaaaaaattccttacagtttgatttaacattttcatatagagtgcctacaatcgcaaatccccattagagtagttacttccttaaagagtttatgtctcccctgaagcattaactggagccagaaataaatagaaacaccccagtttgtaattcaaactagcaatttatttttgctccactgcaaattaaagttcagagcctagttttctgctgatgtccattcaattcaaaggcttcctttgtttcagcactcattttttttttttaggaattcatcaatttctcaaaaacagaacccaattggttccaactagtatgcagcctattatacatttcaacaaatctagtatgtgtgttcatatatgtaaagcaacatcatatctttcacagttatataagtagataatattgatagatggctttagttcccatcataagtctaaccttctagaaactttctagtaaaaactcttttgagacagcagcttttttcatgaaacatacattttatatctgcatctgtgctcagctttgtttacgcatatatgtcattagaatatttgcatgagcgttcacattctagggcccacgtatgtaaataaatcacactcagttggaaaatttagtaactaaacatgcaatctgttgagtataatcaggcatgctattcaacaactgcatgatataattcagtctttccaaagaaaatatatgctttgcgtaagagtgtctccatcaaactcgatgaaatttttccaggaatttgtactaaaattgttttgcctattcaatatatatatatataaaaccatctgactaatgcttaaatataaagaaaatcttataaaaatttaccaattctctcattgtctattatttgtaaatatgacacactaattggagttatttccaaatgagtgcaacagcagtccccaacttctttggcaccagggaccaaagattttgtggaagacaatgtttccatggatggggggagtggtttggggactgcactgtatttattgtgctcctatgagaatctaatgctgccgctcatcgacaggaagggcgctcagg

SEQ ID NO: 36240 - DNA, 1167 bp, Bovine  19866881358359
atcctattttgtttttacggtaaggggtggaaattgaagaccaaagtaagattttaaaagtctgcttttagttatatagccagtgggaatttgctgtatgatgcacagagctcaaatccaatgctctgtgacaacccagaggggtgggaggtgggaggaaggtttaagagggaggcacagtattgtaaagtgattatcctttaattaaaatttaatttttaaaaagtctacttttgagatagggttaaattttcacatctatttcagagacagatagattctagtaattttcctatgtgtgtatataatgtataatatccgtgaaacaggttttaactgctggatcttttaggggacaaatacttgagttttttcagaagcagagaggatctccacactatacaacatcctgacatacatgtcatctcttcctagtcctttctaaaccccaccccgcttagcctttgcctttggcatattatccccaaacttctcactgatgggactcttgacctggagtcaccaggttgtctgagatcaacaacaaagcatctcaagcccagcatgctttcatggggcaatgtggaaaaggcagctatccagctctgactttggctatatccccgtcacaccagaactcctgagtagagggcaaatgtgagttatgagagtctgccccatttagggccacaggggatggatataggaacccaggaagcataaagtagagcccaatgggaggctactccattttaaaaatattgcctgatttattgctaatcaataatattcaatttagttgaatattattgaagttgaagttgtctaagatagaattttctattttctaaagaaaattttatttcctaattaaggccagtattgtacttgatcatttattgtgaaggcaatgataagtgttaaatagggcttctgtttgcattcactgtgtgagatatttatttaagacaacccaacaccttggtgggttcgggtaaattagttcttgtttcatgatgggggctgagaagtaataaataacaagataaaggggaaaaaacaagtatgaaagactcaggctcacataacaccattgatacttctgcatcataaacatttattctttctactttcacagttatccagtttacattccgtgtatttcat

SEQ ID NO: 36241 - DNA, 1764 bp, Bovine  19866881444551
cttaaatgctctctgtagctgctttaactactcgtttctcttggtggagttacggccccagtcctcccttctaagaatgttgaagcaacctctacgcaatccaatgtgtggtctagaaatgcctagatctttaaaataggaggaaaaaatgagtaatgacttttgatttcattatgtttaatgacattccattgtgagttcatatggtaaataacacatttttcaaattaagtaaatgggtgcttaaatttaaatgaaatgattgatgtcactttaatttcaactttccaaagatattcaacaagtatctgttgaatatttacctcgtgtcagccaccaggacaaatattctttacctagcagcttaatagggataacacagggagtcttagagattcaggactagtgtgtattagtttttcagaagtgctaaatacactccaattacctgactatttttgaccagtggtcatgaggggaaagtagagtccttatcattatgaagcactagcagtattgcatcaaggctgaaacacaaaaggcaggttggagcatgccaagtcaatactggtttgagcaccagcctcagggctcaaaaaaattcacagtgaaattaatttattcactcccagctaaattagcaatgatgccaatatttttgtttaattttccaagtggaaaaatcaaaatgaaaaaattaaaattcaataaaaaacattattaaaagtcagtcattaattaaaatatctgaacaaatcatttccatgtgacatttctcctgagacctctctgatatcagaatataaaagactaaaaatgaagtaggaaggcatttatgagatggggagactgaactaggagaatatattttttttctagatctaggtacatgtctaagagcagaagtggttcagaaaaaggagacaatctcctctcaagggtagcaagggtcatcacacttgcacgcagaagttaaatatccccatcctaaatcacagcaatttcctaaactgtgaagagaaagagaggaagaatcaggaaactacaattgtccaaaccatgacagcacatctcaagcagatcatccataaactctgctgtgtgattatcaaacagaatcgcagcttcatgacgtggctgcgtacatacccatgtgactcagtggtaaagaacccgcctgctgatggaggagatgtgggttcaattcctgggtagggaagatcccctgaaggagaaaatttgcctgaaaaatcccatggagagaggagcctggtgggctacagtccataaggtcacagggagtcagacacagcgctgagcacatacacacatgtccatacatttggacaaagtgtacatcaataaggtgaactgtgaggtccatctcatgaataataccctttcatcttgaagaccttcttatgaataggggtgggacggggcaagggtcttagatgtgaggagggggcactgcaaagactcccatcccaacactgcacctgcaaaaagaaaagtggaaaaataattccagaaagaatgaagagatggagccaaagtgaaaacaatgtccagttgcggatgtgactggtgtggaaataaagtccgattctgtaaagaacaatattgcataggaacctggaatgttagctccatgaatcaagttaaattggaagttgtcaaacaggaggtggcaagagtgaacattgacattttaggaatcagtgaactaaaatagactggaatgggcgaatttcattcaggtga

SEQ ID NO: 36242 - DNA, 1088 bp, Bovine  19866881469793
acattatactaaattctaccagtcatataggagttatgtggttctttacattaatggcgactgaaaacgtggctctggagtcatataactctgggtaaccctgccattatccacattttataccgtttccctttccaaatcttacagagatctattataggctggtaaaaaaaaattaaaaaaagtactgaatagccaaaatatctttagacattctcttcctttgttagagagttactgaaaaatataagctctgctgaaaataagagacgctaaaactgaggtctagttttcatgaaatcagaagaaggtctctctattgctgttctgtgagtaaatccttctgcctttcagactctactcctggctcctccgaaaagggtcaccaggctaggaaaggcaacactggtcagagcccatggggtgtcctgcactgcatctcagagtcaagacttgccctgggcactcaccaaaaacaaacaggacaaaattccaaagagctgtacaatttaaggccaaagttctttttgtgtgtgtgtgtggggggggtgtattggcatatatacattactctgtataaagtagttaactagtaagaacctactgtatagcacagggaaccctactcaatgctctgtgatgtcctaaatgggaaggaattccaaggaagaggggatatatgtatatgtctggctgattccctttggtatacagcagaaactaacataaaattgtaaagcaactgtattccaataaaaaattaaactaaaaaatagatatttagctatttttaaaacagaaataaagaataaaggactctttataccaaaaaaaaacagaatataaaaatgtgtttgtaggcaccgaagatattaactaataatctgctaaataaccgctcattatagttgagaattcaactcctgctgacttccaaagccccgtatgagaatattaacatttcaggacacagatcactcaattcaagtatcatatatccatattaatagctttttggtaaggtcaaacgtccatcactgttttcatttcccttcctctatttctccacttctccaacatacaaaaat

SEQ ID NO: 36243 - DNA, 1398 bp, Bovine  19866881515213
tatgttgatcatcaaaaattattccttctacttttcagataatgatttactcttctgattgattatccaatagctaaaactaggaatcaagaaaaaaccaactagttgaatgcactggaattaaacagactgaaaaaatatatgtcaattcaaaataagcattaccttggtctgatttttcatgaagtatagcaaatctcttgccaggcaacaccatttctttgggttctgtgggcaaaaagaaaagagattaataaaaacaacctttcttttcactctataaatgcttaaagaagatttattagtaataaaggtcagagaagaaaatcatttaacaaaatattcagctccattcagcagctgccttgggaaccacttgctttaaatgccaaataatttccccaaaggtcccctctcccctgcagctgagagcatgggtgactgctgcagatcctcagccccgttttctttgcctctctctcttttcttacatgggaacaagaccagcactccagcaaggaaaagcaatagcttcaatcatttcaaaagataagatgtaatccacgttgagacagaacatttacttggaatataacagactgaaatggaatttgcaattatctaaacttagtttccttcctcccctagtgaggagggcttttcaaatgttcacagaaagtttgggtcttttcctattatgcctttccacaaaaatgataaaatgagatattgttgggatgactcagtaaataattgcagattgctctccttatgagctgcaatttcaggctttttctatgctgctctgagaaggaaagtacttgataggagtcaaaagttatgaaaatatatcttattccctcccttagcatataaccatcttgaggagtgtcccataaaagattttattgcatcattatctgaatgttcagattgcaggataagaaattcaagtctgagcaatagttttccaaaaagaactgtcatatagataggtaagaattttaaaatctcctcttaagaaagttatttgaagaaatattagcagttaaaagcaatgttgattaattgactgtaacagtcattataagaacaatcatataattgcaatcacaacatcttactagctctgcgaacttagggaagggaatgaaactctataaacctacttttctcatctgtaatattggaatggtaattcttcctacttcatagaattgataagataaataaacaagacaagtacatagaaaagacacagacctaatgaatgttagtataattatgaacatcattattactattattatcattgttctccttttaaaaaatcttgcaacccttagaaaatcagtgccctaggagccacaggtagaatattaaaatcataccatacgg

SEQ ID NO: 36244 - DNA, 1112 bp, Bovine  19866881820114
tccacgttcctgtgggaaggactggggtgagatttaggatagcggcctctggctgggttccatgttcctttaaagatcccagccatccctgcagtcaagggcctctgggtttgtgaactggcctcattctggatggatcaggtatacattttcactatggggatttaagtttctgatgactaaatctagaatatttctgccaaggtacatatagaaatgccttaatgggtaagttgtctgctttatttctagggatccctgatgattccatggtctattcaccagttttgatctttgtgggtcgaaacaggctgacttccttttccccagaggcttactgcttaattgccagcaccttatcgctgacagttaattgccaacacctggtctctccccctctgggatcacattatttccactgagatcaggaaactaaattttaatgcagcatcctcagtgttatctccatcttgcagaggacatctaacgcagagcttttcaaccttctggtgcctatttcatcaatgccttggtagccgaagtattttctgcgccatcctatgaggtacggttagggtggtgagcaagttgccatataatggattcattcctgccttctatttcccagtaggactccttcctcccttacaacttctgagcattcccacattttgacctcagtgatatagatcaggggtcagcaaagtttttcagtaaagggttggatagcaaatattttacacccttggtggctcagtggtaaagaatccacctgtaatggaggagacacaggagacacaacatgggttcgatccctgggttgggaagatcccttggaggaggaaatggcaacctactccaatattcttgcctggagaattccagggacagaggagcctggcgggctacagtccatggggttgcaaagagttgggctcaactgaacatgcatgccctcactcatgaggaccatatagtctccatcgaaactactcagctctgccatgatagctcaaaagcaactacagacaatagaaaatacacgagttttactgtgctcctataaagttttatttatataaacagattgagaactggatttggctgacagg

SEQ ID NO: 36245 - DNA, 1540 bp, Bovine  19866880443006
ttatagtatcagaatacatcactgcctggtaaggaggaatgttcctgaaggcatgtagctcccccaatagtcattgtgtgtgtgtgctacaaaggtcaccacaataaatcttctggttctcagatagaattacagttccccacctgttaaaaaccactacacacagtaccaaaccccagacagggatgactcccaataggtacagagattgtctttcccaacacctatggggggtaatcaattaattttagaatagtaagtaacaagataatagttttctattgagtgagccagttaacatctttgtgcttctttatcttcagttgtacacatggtctcataatttacctattccagtgggtttttgtcaggattaaattaaataatgtttataaaatgcctggcaagtaaaaaatcatttaatgaatggcagccatcactattgttccaccaatattttgagcttggagaatgacttcatcttttgagtaagggttaccattggtttgtagtgagttagaaaagcagagagtatatttcagaagcaaatctgagaattattattaaattaggctacattcaaagctatcatgaagaacagcaacaatagtgacttgttaccaaaaaaaaaatcttaagggcctttcaatgaactgtgtcaaaaatacctccaaaggagttatgagacttgctctaggctaggttgtaactagcttcgtttaagcaactgtcttcttgcgcagttgggaacaaagcacatacatgaggtgcaaaatacttaaaaacaggggttttgaaacacacatcacacctttgctatctgacttcatactggcaactaaaggtacaggtaacacaggtgtgcttatggtgtttctgctacttagccagtgatcctttatgttaagcatcctggattatgtaagagaaatctttgtctttcttcctttgtccttagataataatgggaggccatttactatgagctgataagctgatggatcaatacaaatataaagagtgtctctgatcgaggaaaaggttttctgagctgtgtttctctccacttaatctctaagatggcacaatgatagttatctctacctggatccttccctgacatcactttaataactcaaaagcctctcagaatcacctggattccttgtcatattcttgtcattgagaaaggtactatcacccacaacccattcagttttgtaagccagaaatttaggagtcattcttgacagttccccactttccttccaaatccaacccatcatcaaggactgttgattttatttcctaaattactccctctgtccatctctcttcatctcccctaccatcagtgtaatctaacctaccatcatctctctcctggactattgtaatagtttcttaactggtctgactccataagctcccccgacatggctacccctacccctaaaccattctcaaatcagagcatgaaccagatcacattattctgccaaccgaccccatgcctaaaactcctatatgactttccgat

SEQ ID NO: 36246 - DNA, 1643 bp, Bovine  19866880545949
taagggacatgtttttcctacaaatttcataatttcagaatagtgtagaagtgagaatattacatacttcatcaactagcatagccgtaacaagatatccatagcaagagaagtattaatagcaataaaaaaaaggggagtaaaagggatctaagtagataaaattcagtgaagtaattagcagcagtaaaaacagaattttgggagggaatatgtagaacatcctaaggatttgaaatgaaagagaaaaatggtggacagttagttaagcctggaggagcagataggaactatgagtgcctgtgtggcacttcctgcaaatacagtcaagccatttcttctccatgaagtttatttacccttattggtaaaaatactggttagattggcaaaaggaaaaaatacctggccaaaaatcccttggccatatcctgcctgtaggtatgctttgtggaatctatccaatattgtaaataatttgaaatagatgataacatttaacaagagggaagtttctcaaaaaagaaatctagattttaagcttctttggaaaaattgttaaattcaatagtctcctggcccttaggagcagtccctctttagaaagcacgtgggctgtggagttttttagtcccaacctgacttgctttactcatttctctcacctgcatcatgcatgtaggaatttgggcttgtttcttggagaattcattcttaagtgtatgccatccatggtgtaagttccatgaaaagaaattgctcggaatactttgtctatggccctaccatgctgaatgtactcagtctcatcagaatactttgcaaaagcaatttacataaagaaaaataaatgttacaagcaaaaacagcaaggacacagagaagctaacaaacaggtgattggttctcaaatagaggcgtgagcccattaaatgtgtcctattaataagctctgcatgaatatttggggtttggttcagaagtgcaatgtcacttaataacaggagctgggatttagtgaattattccagttcaagctcttggaaaaagaaaaggacaaaatgttctgtacgaccgaagtaagaatagagtatcttctgaatattaggagattaaaattcccaaaagtgagcttcttggcagaaaatggccaaggttatttaaggagtgacttcccatctttgaaatcaccattgaataaaacaatattaaactactgtttaaaaatttaaagaccatcatttctttctctttcctccagctcagagcttaatcacatgcagggctccctatatgcagtctgcaaaatcatgaaaacctaattcaactattacagaaataactccaaacttttaaaaggtttctctgaactaaaacaacccctgagaatttcctaatacagctaccacctagcatatgtttatatgcactgtatttgtgtttaataggtagatttaatttgtaagcatgcttataagttactttgcagttactctctattcatttatcttgagcagaaatttctttaaagttctctctataaagtccttttttacttcaaagcctggacaaaagaggtggagtattataagaatcactcaataaataggaggcatattaaaacttctgttagcagtgagtag

SEQ ID NO: 36247 - DNA, 3920 bp, Bovine  19866880546417
aaaatcttgccacatagaaatattggatttttaaaaatatatgcaaaatgttcctgtgatgttatttctagatgcataaattatacaaattatccagcaactgtgttaaagataaatacagaatgactaccacactatcagccacagaaatggattgtcctttccaggcaggcaggctaggcagctaagttctgtctctaatttaccagaatccagagttcaggctttagagatttagactaagtaggtacttcagaattcagccagaatcctgtagggacaagctagcagggattcctgtggaaaaaaaagaactggtgcaataaaactggaaagatcaatgagatgtcttgtggaatagaaggagaaagtccacatgtgtctccagggcttagtgagcagagaatgatgaggagaagctgacttcacagttaagcactggaaggagatacagactgagaatgccttgcctagctgtagagcaaaggacaagttcacaggtattaattaagttttccatagaattaacaaaattttaaaagcaaaaattaaagactttccaggtattgagtaaaagaattccaaatagaggatgagatacattttataagctcctttctcagaaaaaatattaatatatccaatattgcttacactagtggaaatgttaaacattgggctaccacctaaaattaaaacaccaccagtacactgaatttaacaataaagacagggaataatttgccaaggcaagccactgaagcaaataatataaacaagttcaacagcctattcaatgcattttagagcaaaaagagagagagaactggttgcctgccaacaccttgcctcagtgagacaatgcagtctgctctccaggaatagtaacaggttagaggtttgggttggagagtattgtaatttcatgttgttttattggggatggactacaggtcaattacttctggcatttcatcctttgggtttattggcaaattaccagcaactctggagatctctccagtttaaggattaggcatcacctagggatttattctgattccaagtacttctagctttaagtcaagaaattgccttacaatttactgcagaatagtcattaacagacacccttaaccaagaatccgtctcacgtgaaaacaaacaaaaaatcccaagcatgtattaaattaatttttaaaatttatgccatttctatatcaataatcattactgttatttctgatttctttcttattgttaaccatatctccaacaggtaatcacttggattgaaaatataaatccacattcattcaagaaaaaaagttatacaaagaaagctatggaaaaagaaattataaaattatcattaaaatgcagtaattaaatatcttgttatacatttgctgtacaagtcacactataagttagactaagaaacaaaacttttgtcttcttggagtcttcagatacctaaaaggatctatgtaaaaatattaaaaaatacacataaatttggggaaaataaccaaatattggacaaattggtgaggcttttatatcatgtaaggtgaaatgtcacataggagtgaggggaaaattagaaatgtacatgataaggaagaaaaccaaattgattaaccataaaaattcagtgtcctagttgggcggggtgaaggaaaaaacaaattattgtctattcctgtttctctgtcagggagacatgagagacctaacatgaagccacagaataaaacagtgcatactgatgtgtcgattttactgaagaaacctagaggaaacgcagcaagtagtcaaaacaccctattgcattataataaacataaatacaccatggagttgtatgcacagagtgtgtgaattttaaagataaagggcaagattcaaagtttaagcctgtcttggttgcttaaacatcacttcaccttcccaacctgatgtcccgtgatagttcatactttccaaaaatctgtcattaaaaatatttcttcaccaaatgtgggaaaatttgaaatatagtttgggttattttgaagtaagaagtgatagaaatttacacataacaatttttgctatttgagaattggctagggcagatacctatcaatggcaacagatgctaaatccttcaaaaattaggtgtatgtccctaaaatagtattcacaaatgttattgtcacattccagaaaatatgtcaagatccgatgaaagataaggcatttcattattctttaatgaaaggtaggggaacaaatcaactgaagcaagatactatttctattcctggagacaatgatgaaaaaatgggagaaatgtcaaggcaaaatactaagaaggatgtcactgaaaatgtcaatgactcatttcaaaaacaattccacgaaagggccctttaagaccatatgaaaacactggaacaccagacacatttccgtcatcccgagttatggaggaagagatggaatggaagtgcaggcagtgggtaagtggtgtagaacacagagctacctactttcatgcattggagaaggaaatggcaacccactccagtgttcttgcctggagaatccctgctgcctatggggtcgcacagagtcggacacgactgaagtgacttagcagcagcaaggggaggaggaaaagaagggccatgaaggcctgggaggcagacacaggtggccagagaccaggcagcagggaagggaggccgacaagcacacgccgtggctctgggagaccaaaggaaaaaaaaaaaaaaaaaaagactctcttctttgtatatctttcaactaaatttcaattcctaaaaccacacacacatttccacatggaaatctaaagaggcatcagttcagttcagttccattgctcagtcgtgtccgactctttgtgactccatgaattgcagcacgctaggcctctctatgcatcaccaactcccggagttcactcaaactcacatctattgagttggtgatgccatccaaccatctcatcctctgttgtccccttctcctcctgccctcaatccctcccagcatcagggtcttttccaatgagtcaactcttcgcatgaggtggccaaagtattggagtttcagctttagcatcagtccttccaatgaacacccaggactggtctcctttaggatggactggttggatctccctgcagtccaagggactctcaagagtcttctcaagcaccacagttctagctctgtgtgaaagttattgaaagtgtgcagcaggctcacacaggcaggactatccagggttcattggtttaggaagcatagcaggtagcctactgaggcaagaaccccaacttcctgaggtgttgacaaagagaacatagaatgaatagtggaggttgggagtctaattatcagccacagccttgtgaacccatgtagaattgaggattatgctgtttacctgtatttcctttcttactgtgtcttttaaatacatatgcatttaaaaatttctatttttttcctcctgttcttttcatatagagtgtattaatttatggtttagttcattggattcagaacccagatatacttgacagaattagagggaaaagtgccggggaccagccccggctgatccagggtattcgaaggagagacggcataggcgaggatcaggatacaatagcttcaattagatattaattaaagatataaagagtaatagaataaggatagctcaagtaggaaaattcagtggagaaaagaggctgagtagcttggtttacgcgggagaccaataaaacttcaagacaagaagtttgcaccacttacgtaggccgcaggcgtccttccgttctcccgaaggagaggagacactgaggcctccccggtcggatcttagaagcccaggcata

SEQ ID NO: 36248 - DNA, 814 bp, Bovine  19866880588650
tttaaaaaatcgattcctgtaaagatatttgaaatgtttctattttataagtttctgctttgagaatttatcattaaagcagaaatatctatggttatatttttttttaagacaaattacaatcctacttgtctttcagagaattaattttgaggtacttagaaggtgttaaaaaagttaatctgttactctgagatagtaatgtttagataacacttacttttccccaaatgttattcctagactcttacctctttcatgaatgtttaagctttaaataagcaactatcctttctgaaccacaggagaattaaaaaaaatgtgcataattacagataaagtcaaagtcacctccaattgcttctgaaatctggcagaagcaaacatctacccaggaggcttccgggcattctcaatattcccaagtctttttgagtctgtgtgatggcccaagaaggccacgtgaagaactacatgatatattcaacaaaaaatcgagcatttaatgtgaaaaaaacaggcctaaggagttgtttaaaaatatggacaacacttgagtaacttgactgacatttgtttcttttacctattattttaactcttgcttagtatgtatgtcatccaaataggaatactgagatcttaaattacacacccataactcagattttccctgcttataacctcattactgatttgcatgcccttttcttccttcatatttttattggaaaaaatctgtgtcaggagactctagagctttcaaaatttttttgctgactctttgtagaaatattcacaaactactgtagcc

SEQ ID NO: 36249 - DNA, 1664 bp, Bovine  19866880657702
ataaaatatataagctacccagaagtcctttagagtttcctaccttttgctaagacccctcccctgggttcaaaacattgaagttggcacagaaaatatttttgttagttgaactgataacgcttgagtatttacttttacacatatctaggtactcataatttttctttaaaattttgcctatatcaaataccttttcaatttagaagtgcttttaaaaaatattttcttattcctttttaaataagataaagggaaataaaatacagttgattaaaaacttgactttttctactaaaacattgttattgttaggatataattaggagatattattaggagtaagcagcacccttaaaactagaaaaaaatattcctaaagtataaaaattattattatctttgtggtcttgactggagaagagatataaattacatggtacattggcgctgtttctcacacctcacttatagatcactttagtgtataaaactgggatacatttcaaatgtcccactaccattttttgctttcagcatttcatttaggatctctgtcccatgaaagaggtttgtggcacaaaggaagaataaaatagcacaaggccagcactgcagtggcccttgattctctttgaagccagaagtgagcggccaggcgtacttgttgcccgaatgaatggtgactgtagttaaactgcatattacattttgacccagaatttcttttttttaaagacctaatgtaaatacaaataatagcatttgaagtacttcatcagtgctgttttaattatgcattccccttcacttctcatcttcctccagaaatcatttggtgatctttcaaaaagatttgaaataaagcaccgccttcagtgtaaaaattttacgtggtatctgaacaatatttatccagaagtgtatgtgccagaccttaatcctgttatatctggatatgtgagtattttcctgttcctttttatttggtatactctttgccaccaatatttatgtggttcaaggaaaaatgctgtaatactttctggtttattgcttttgagagttttacattaacaccactttcagaaattagttgagaaaatatataaaccacgtagattttttaaaaatttataacttgaaaatttccctttagattaaaagtgttggtcggcctctatgtctggatgttggagagaataaccaaggaggcaaaccattgattctgtacacgtgtcatggacttgggggaaatcaggtgagcattgcacgaaaaatcctgccttctgtttagtacctgcaaccacaagtaagttcttgcatgtctttcagaacccatatatcaatttcatgttcaggtaaactggtatgtgaaatacttttagagtaagttgggcaattaatattgaagttgcagagtactttattttgattttcactctacctctgaaaacagtttgaggttgcttacccattcagtagaaaggcaaatgagaatataatagaataatgccatctgaaataaaaacaaaaacaaaaacaggatcttctgtgtgaacctttaaggttgcatgactattagcatggtgattttgctaaattatacataaaggctatattttactggattagacagcaaataacatcatgttcatactgta

SEQ ID NO: 36250 - DNA, 1921 bp, Bovine  19866880753031
ttctcacacccccagcgcccccatatacatgtgctgccagggtcctgttacttagtagactcttttgcccctgaccattggtcaccacccatcacccttgttttcactttctttcatgttacattgactgaatcttctagactcttgactacctgtccatcttttgtcttctaggccatctgatgccttgtacaggcatagatcattctaaatcaatattcttatcaggtaaatcttcataactcccaaataaaccctttagtgttgtccccgttagatagcacacaaaatctaagttctctaactgaatctttcaggtccttttcagattggctctagctgtcttttctggtggtaattcccaattttctgcttcatacaatttccaaatttccctgccaccagactttatttatttcattgcttctccattcctttgcagctctatgtattagagctgattctaacacatccttcaaagtttaacccccaatccacttctgtacagctcagtattaggagttaacctgctggtaaactctaacaagagttttctttctataactatgatatctatggacaaatcttccctacttgaaatgcatactgtgtttagagacacactgcgttttgcatattctagtattataattgtccagtataattccttgaataaacaagtatgcaataaatatttgttgagaagcctttgatctagtaaaccacaaaagtgtttgttaccttattgctgataatggctggagttgcagaaacatacatattcaataatagtaggatctttatatcaattcttgtttatctctggttatcttatttagagaagtattatgaaactttccaaaattctatttagtgaagtcgctcagtcgtgtctgaccctttgcgatcccatggactgtagcctaccaggctcctccatccatgggaattttccaggcaagagtactagagtgggctgccatttccttctccaggggaaaattttatttacttgtgactaaaagggaaatgtttacattgtatcattaagtgaactaattagaaatcacatataaagttcaaatatgagtggaattataggatagggataggatggaaatactaacctttggtgatttctttctttctcttgttctgtactgaggttttataatgtaatacattatactatattattagaccattataatagccccataagcactaaaaaatagtttttggatgaatgattttaaaatgtgtagatgatttctatgtctacaagtgaaagccatcttaaaaaataaagttatttataatgtatcaggtaataatgtaggtgaatctcccacccacacaaatatgcataatcaaagagtgatattttttcttcatttgctttgacatattttagactgtgtgcggaagtttaagtgttgtcagataagcatagaagaaggcaaagggaaactctggtggaacttgagaaaaacttgctataagatagtggagcataactggtttgaaaccttcattgtcttcatgattctggtcagcagtggggcactggtaggtaacatgatctgctcctttacttttacctgaaaccctttacctttcccctcaatcaacctcctattgcacaaaaaggtgttttcacaagaaggtgtttgtgaagatgagagacattgtatgatatttttagcacagtgtgagaggctcgctaagtagcaacttttattgttctgccataggcctgagattgaatcaaatttagatcagtatgattttttgtgaatatttaaagtacgacccttctaacttttagtcatcagaaccagttcctattaagaatcaatatgtagacagggtatgggattatcagctaagtatcaatctgcttagcataagccccattgct

SEQ ID NO: 36251 - DNA, 1259 bp, Bovine  19866880884354
cggagcctggtgggctgcagtccatggggccacaaagagtcagactgagggactgagcacattctgacaggcgtgtagtgatatctcattgtgattctgatttgtgtttttctgatgattaatgatgttgaagcatcttttcatgtgcctgttggccttctgtatgtcttctttggaaaaatatcattcaggtcttctgaacactttttatttgggttgttggtttttttttttttctttttgctgtcaaactgtatgagctatttaaatattttgtatattaaccccttattagttacatcatttgcaaatattttctcccatttagtaggtcatcctttcattttgcagatggtttcctttgttgtgcaaaagcttttaagtttaattgtgcatgtgtgctaagttgcttcagtcatatctttcggccctatgcactgtagctcaccaggctcctttgtccatgggattctccagctaatactggagtaggttgccatgccctcctccaggggatctttccagctcagggatcgaacctgtgtctcatatgtcccctgcattggcaagtgggttctttcccactagggctgcctggaaagtcccaagtttaattagatcccatttatttattgttgcttttgtttgctttaggagacaaatccaaaaaatattgctacaatttatgtcaaagagtgttctgcatatgttttcttttaggagttttattgtttctggtcttacatttaggtctctaatctattctgagtttattttttatatggtagataactagtgctaagatatcttttaaagtctttcacagggcaactgcatccatatttttcttgcaataaggtacttctagcaacacaagttgtcattgtgtatatctctatctggaaaagaatattacctttacttcccttggcaaaatattcttccaactagagatattaatttgccccaaactggcaatgtgtagtcttctagaaaaatctttccctctgctacccagcaggcaggtggccctggctttggtccctgttgctatggatcactgcacacctggatccatttgttcagcttcaagtggagcaggtgtgatgaaggtgggctgtcctattggacataaacggacttcacacagtgctttgctcctgcgccaggcagcctcactgagtgagtgggctagtgctatggtaggctcgggaggcagtcaaatagaagggctataatgtaaacacagactttagaat

SEQ ID NO: 36252 - DNA, 2691 bp, Bovine  19866880915592
tttctagttggctgatacagattatatagatgtatgtagtctttactttttgtgctttcttaaattgttagaaattttagaatcaatatattttcttttaaaatgtagcttattatatttattcgtatttattcattgctgccagtgtaacaagaggaatcagttaaatgattgtgtccaggcactaacaccaattaatgcacttgtagctactgaattccagccaagataaatataattaaatctagtgcttcaggaaattggttgactatcaagggagtcagaatggaaaaacatttacatataattttaaagaacattgaatttaactctttggattaaatgagctttttttctatacatattaaaagttaatatgagaaataaaacaaaggttttagatctctacatgtatgtatttgatttcataagttcatatttttcaatagctttgtcattcatttctcatcacttaggctggactgtagtagaaaaagaactgaactaacagttgaaagttttgagttttggctctggtttcatcatataatggcaatgattatcttagccaagtttgagtggcctaagggcaggggtcttattttattcatttgagtattcccagctcccagcacatgttgaatctcaagcacagttgaactgaacacatcactaagctttctcacttgcttaaaagagagaatgtgatcacagccctaatgttagcacctactattaaacatgatgtttagatttctcatttatggcagaacagattgtcaagacatctaagtgagcaggtactgacttagcgatttgccattttatttagagttaaagcaaataaagttttttgaccctcttaaatggcatgatattttttaatatatataatgacaaagtttaataggttgtgttttggaaaaatgactgtctggaatcgttttcttgatcacaaaattgaatgttcaagaggtagagtttgggcccacttactccaaatctgctgtggaagtcaaatgcagaagagccattggtcttctgtgaatactagagaacttgcatattttttgaccaaaaaaaaaagaaatttcagaatttatttttatgagtgatctgaaatcactattctgttaacgtaatttctgaaaatatgtttacttttttggtctctagtgtctgtactgcctaatgctagttctttaagaacttaagttgaattggcagggaacagagaaagctgtaaagagagataaaagagaaagctgtttgtaaagctgtaataaatctcttgtttttattagtatcttaaaggtgaacttaaaagcaacactttgattttcctaaaatactgtaaatttaaacaaatatcattaattatcaggtatggcaatgtggtgggcagttggagattatgccttgctctgttgttggacatgtttttcgcagcaaaagccctcataccttcccaaaaggcactcaggtgattgctcgcaaccaagttcgccttgcagaagtctggatggatgaatacaaggaaatattctataggagaaacacggatgcagcaaaaattgttaaacaagtaagttagaactaacaattaacaataaaaatccacagaagttcacatgtccttggatttgtttgagtcaactcaagtataaaacattttttaaggaattatttttgaagctggtctttttaactcaaaaatgtataactaactgatgccagttttctctctctacactctctctctcttttttttttaagtcaaataaactgcatttaaaacctgaggcaatatatagcagaaaccaatgcaatattgtaaagcaatttcttccaattaaaaataaataattttttaaattgaggcgttctacttgatgttacttttttttaacgtgaaagatatttagtttttgtgactgctttggttcaatattttacttaatgaaaataagattaagtggaactgctttcaactggttttaggtgatgtgattaactcctgaatcaaggtgctaagtggcattttgaattagagagacagtgtcagatgtggcagaatgaaccaagatatcgagcttttttgtttccagttctggctccactttctggaagggtgactttggcaaagccccttgacactataaaatgatcatggtactttatagggtgattggcaggttgaccagacatggagtgtatgctccaccacatttcttctctctccttccctgtcttgatataaaatacttacctgtctcccaaaacagctgtgaaataaggaaataagtactaacaaaggcatggcactatggttattattgacctgtcctagataaaagctctgtagaatcatcatgcctaatacatttagaattgagtcccaacagtttcaatattggatgtggtaactaaactagacagtttaaggacatgctttggtaaatggcatccaattctttgtaagaaaccgtgccagttcgtaaggaagtatatattgggattaaagggcatcagcacctcagatgtcataaagatctggtcccctcatttgtctttttctctggtctctggtatctccctataacatgtcagtaccaagcaatatcagagcagtactggactggattgctagcccttcacccgcggccaccgacacaagggggtagtttgtat

SEQ ID NO: 36253 - DNA, 727 bp, Bovine  19866880988388
tggaactgtacattagaaactcttatcctatgtaagacatccaccatcagatttcacatgccatttagaatacctatcattttgccttttgatatttccacttcctaaatactatatgtttatttgtagaaagactgtgtttcaggaaaaatatgtgttccttgggggaggatgctttgtcgaacagcttctcattacttgtgggaagtgccaagaaccctgaaagggtaggaaaaaatcataccggcttctctgtggctctccctgtgacagagctcaagtgcaggctgattggctatagagccacagggatttgatgaaacaaagcgttccacagcaatacagaatccagcggcttctatctcaagggaagtacaagatatgaccttggttgatcgcgggcgagtatgctagttgcctagcaaaactccaaagtccaaggaaaaaggcataatgtctttactgatttacatttcgaagcttttaatatcataatgtgatgtgctacaaactgaataggcttacagaaagcatggaatagcatggaattttctactaccatagatgctgcctcgttccacatgatttgtatcaattcctatatttgtaatgataaaatgttatgttacacaatatgttagtgcttataaagcactgggtgtacctgacattttaaatttgaaagatgacctcacaatgagtgagatttaaataaccatatcttaaa

SEQ ID NO: 36254 - DNA, 2273 bp, Bovine  19866880992543
gatgtgccttatttcttctacattttaaatttcttgaagataaagattttattgcttatctaccacagtcagcaggatattattagatatcttctgaatattattacctaaaacaaattctgctagtgccctatccagtgtgttagctctggtcacatgtaggaattgaacacttaaattatagctagtgccaaatctgaaatgctaatatttttggatattggcttaaattaaaaaaaaaaaacagcattagtaaccattagtaaccttaatttcacttgtttcttttgtctttttttaatgttatcatctagaaattttcaaagtacatatgttcatctcatatctgtagtgatgagtgctggttcagtgtatacctttctcctattccttttccatccaccaaatgatcaaacctactaacaaatgaattaagaaagcaggcaatcccctgttctgagatgctctaaaagggagaggcacactctgtctatcattttctgttttacttggttagatggttgttttcgtctttaattcctaggattttggaccaagaaacaaaagtgaacattgtgtgtttgtgcgtgtgtgtgtgtgtatgtgtgtgtgtaagagacagagaaacatggaaggtaacatttaaacacatttaaacatctaaatcagaatatatccagaattatagaaagctttctattttgaagtaaactggcatcaaggaaaatagaaagcaaataaagttctcagcccagtaaacagcccttgatccatttctatcgtaatgtcagttttgcttcagccataatagagagccctgcaagttgcccccagccacgtctctcctcctgcttgctggtgccttgtgctttaggcagtttctttccaggcaaccacagactgtttactgactgtaatcaaaatgacagcacactgttttcacaacccagcgttgagtcgattgcctttttcacttggcaacctaagggagcttgaggtataacttgcatcacttcaagatggtggtgcttacttcatatgtaacctgcatcctctgaggcttaaactacagaggaattgagagttatctagcatgcagcagggaggctgtgaaatcagccttcagattagtgctagtggtaaactccactggagcacactatttagggtgtggctgcagttctgctgtggttcttccccagccagaacccagccacctgagcagcttctcttttaagcatccccaccccacccctggtgggctgccgtctatggggttgcacagagtcggacacgactgaagcgacttagcagcagcagcagcaccccacccccaccccaccccagctagatggttataatgttgtggagtctgaccaccttgaagatggagaggagaggcagaggagagtgtaatccaatagaaacatgtcctgcccctaagagagacagaagaaaacagataggggaatgcctgtgactcaagtaatctgtaagttctaggcttgtctttgacgtcacttgctgtgacatgttgaatgctcagtgtttttggtattgagtgtccacatctgttatggagaaggaagcggggatgtgactagttgatatgcagcgcctcttttatctctacagcactgaaactctgtgcttggtgtattccaacatttatcccttctgagagacagtgatctgaaggtgcagcagttgccttatactctgaactcaaagggtcattgaatattggactaatgatgtaactggggttggctgtgttataccttttagagtctgtcttcatattcagaatactttatgggctatgtgcttgttcaaatttgagctatgtttttttgatgaatcaatattatgaataccttgagaagagtatagctggagggttggttgctgaagagaattgtccctcacatcttttctatttagatactcaattctgtacacataatttcttcctaaattggtgatatcaaaaatcttctgtacaaataacaattaaaaaaaaaaactaacaaaacctcgagtctaggtttcaatgaaatatgatcagtcattgaagaaaatgtgaaaacagagagtctatgtttttccttcagccacttagcacatcatttgtaccaaaatagagcaaagacctccgtgtgctgcctgagttaggtgtagatgttaccacttatttgggattccctgttggtcagtggtaaagaatcactctgtaaagcaggagacattcaatacctacattggaaagatcc

SEQ ID NO: 36255 - DNA, 2481 bp, Bovine  19866881008262
aaaagaactagtagtgacttcatttattaggtcaaaaataatactgttatgtactggtgtggtagagaaaaataggttgggcactgagctggaagtcttgatttctgattcaaattctgctactaatgagttttgttgcctcagaagggacacttgtaaaatatggaaatgggaatcaaggatatataaggacacttttcattcattgttcctaatttatctggattttcaccaattgatttctcagcttaactgtaatctgatatatctctgattttcactgagttttatattaccattaatctgtgctaaacatgaggatagagaaatagagatgtttaaaggtccttagccagttccttctgtggtgggaacaaccagaaagcaacatggagaagcggttaagagcaatggctagtggaatgaatcttatatgtgtgtgtgtgtgtgtatgtgcttgattcatatatgtgattgtgtgtgcttagttgcttccatcgtgtccaactctctgcaatcccatggactgcagcccaccaggctcctctgtccttggaatttttcaggcaagaatactggagtgggttgccatttccaacttcagggatcttcctgacccagggatcgaatttgtgtctcttgcgtctcttgtattggcaggtggattccttccactgagcaacctgggaagtcccaaatgaatcctaggtccactattaactaacaaagattttaatcttatgagcctgtatcatatcacctgtataaacaggaatgatgatgctgacattgcagcattgtgtaaataaatactgtctgtccagtgtttattacatatcctggggcacaattaagtgccaacccatccctcctcccctgttcaccaacgcttgccaaaaggaacaggtattattttttaatgctggtgatggtagtgcatcttctacaacaacaggaagaatacagtgaaactgccaagaaattccgtagttgaaaagggaatagttcttatcctggaagcatgcccttgctgaaacacaacaaaatgtgttctctataataatatcaattagtgttaacatcctagccatttcctgaattgctcatagaactctcataccttctagaagaccactcttttgccaatgatacattatcatggaccccacttctaaggcctttttctttttaacaaaataggggcaaaaggctttatttcgcttgtgctttaatcaatacaactattagacagaaggcctctgtgaagtcagaaaaaaaattaggtttcaccaagaattaatttcactatgaccatcaagttaaagaacctaaatcccagaaatgactgcatgtgtaggctgtgtgatcaactcaaactatctactgtttaaatagaattgatggtgcaataaagggtggaaagtcaaactgtgccggatgaaactgttgacatacagcaaaatctctgcttctctacaaaggattttttctacaaacccagcttcatgctcttgacagctgtgtgctactagggatcttagggagctagagctgggaggtcttttcagcaccccaggcctcccaatccttcccttcaaccaccctaggcctctttaaactgactcaaataactgtgatgtcagtttcattttcatggcagccaagacgacttaatgggcttatgattagacagatctgagatggccttgagtttgagagtcttcaagacacgaggggaaagtttctcaattagacagtgccctgctttagtccatcttcctgactccagctcattcccagctcttctgattccttatttttaggggttaaatgaaagcacccataagtggaagcatattaaaaaaacactttttttccactgaagaatgaaatgtgactagatggtgaaatgtctttgcatgagcggctgttcagattgctttctttctcatcatcattcatgtataggaacactgtgaactcactgaaggttgggaataatgtttaccttgtcatctaaaatatattattcattctaccttaatattgatgattgttttaccagttttctaaaacttgaggattaatttatccacctgctcctgaaataaggacttccctatagctcaaatggtaaagaatctgcctgcaatgcaggagactagggttcgatccctgggtgaggaagatcctctggagaagggaatgcaatacactccagtattcttgcctggagaatcccacggacagagaagcctggtgagttacaatccgtggggtcacagagtcagatatgataacacacacacgtaactcctgaaatataatttaggatattaacagtataccttccgtcctagggatctatttgaaatttttattaactttaatcctaaattatctgtacttccacttgaattttacaccataaacacctttaatggcaatcctatgtagaacctggtatccaaactacaagtt

SEQ ID NO: 36256 - DNA, 936 bp, Bovine  19866881065984
ctgatagttttggcaagtttatactacataaagaatgaaaagtgggttggtttggcatatagagccccttgaattttacggaaatgctagacttcagggtgccatgtgctaaaagctgcctttaaggaataaaattttgttgctttatttcaatacagttttcactaatatgaacgtttgtttgcaaaactaattaaagtacagttggtggtattaaatttatagtcaatgaataacttcattttgatgaagtagaagactatgacatgaaagtgattccatttattgctcatttatcagatacatttaccttgcaatatatattctaatatgtattctcaaaatatatgcggcatatagttaatttggctaacaagcaaactctacatttaaaatatgtcacaacaacctgttttatgctacaactgtttcatgcctttgagcttaacatgtttttaaaaatactcacgccatgactatgacactgaaatccagccagttccatggatcacgaaggaatgtaaaatcttctaagcaaaaccctcttgccaagatttttataagtgactcaaaggtatagattccagtgaatgtgtacctaggaaaagcatccaaacaaaaattaacaatttcattcgaactgttaaaatacagcaaatctgattcttttgtggtttttcagttcactaagatggaattccttattcccacctacaaaaaaatctactagtttagtcttacgagtaaagggttaaactgaagagctaataccttctactaagagtttgatcttgtttaaatatttaggtttgatagtaatagtttcatgtgttttatggataatcatcaggcttgatcctctagagtaacactgtccaactgaaatttaatacaaactacatatatagttttcaaatttctagtaatcaaataaaa

SEQ ID NO: 36257 - DNA, 2025 bp, Bovine  19866881087862
ttgatatggaaaaaaggcctcctgcaaaagtgggtgttctgaaaaataatccattgtcaaactttgttacacacccaaataagaaaaaaagaactattttaagagcaactgaatcaaatttacaaataaagagagatcacaatttcaaggctttatacagattaataaaaactaaaaatgcaatcttcaaagtcaagttctgggggatggggaggaactggtaagtatccttccctagcagagcaaaattattttgtcttttaactaaacttaaagattcttaagtaatgattataaggaagacatagagctcacttaattctacttcctactaggtaaattgtgtataagcaagtccataaataaagtacttttttattccttccatacagaatattctttatttttgttagtgtgaatcaccttggtggaaattactgtaaaaaacaaagaatgcatagactttcaaacaactgactatatataagactttgagagcaatcgtcttacttgattggatatgtctcatccttccttctttgcttctcatgatcgggaagtgtttcccagccaaatgaaaggctccagtcaaaattcccacggttatggttacttccataaggagaaggtttgttgaattcaaacgtgttcaaatctatggatgcaatatctgggctcacgacagcagtgtagttctcagctattctggccaacaaaggttctaaccaaccgtagaaacactcacctggaaagaatacagctttaatcaattcaacaaaacactccaggtttttttttttttctttttgtattttggaagagagtttgcagagaaatgagaatatctaagtcattattattattttgaacatttacataagggagatttcttaaaggtttcttgtaatgagataagggtaggataaaaaaaaaaagcaggcaagattaagtatagctaaggagtgactttgatggggagggagtgacattttttgaaccttagaatggaagtaaaatgatactgatatatttaagtttcacactgtgtatttctctttaaaatggactatgaatccagggtgactttttgctatcccagggatgggggagcctggtgggctgccgtctatggggtcacacagagtcggacacgactgaagtgacttagcagcagcagcagctccaaaaatattctgatttccttaaacttgtctccttgagtaaggtatagaaatggaaatcttcatttctctgacagggttgcaggagaaaataagtaaaggaatcagaatattctgattttagcaattggaaaagaaccattcaaaccaactcagcacttcacaggggatgaaggtgtggcacaaaaggtcggattctggccccaggccaggctctcacatcgcacacagacttcaggggatatggcatgtgcagtcctactcaggacttttcatcatcaagccatccgcagtcatggcccaggaggaccctcagacaaatctgcctgaaggggaagaatgcccagtctgatattactgtaattttggaacaggagaaggaatactggagaaggggccatttccttttgaaaacacctctcttggattacctttagacttttcttaaatgcctggtattgagagaataccggatgtgaaagctctaaagagactcaagcaaatccaaaagcccttctgtaacaattagtgtgtgctcaaaaccatttgcttggtcaaacagcacctgagggctggccaatccaaagctaaacactcatacacagagtaaaactcaggaagcttggagctccagggactatgtgacatttaagtaatatctatggtgaacattaaacattgactctaaaaatagtcttcaactactgtatttacaatcattgatgctggagaaaaaattaaaatacaaagaaaaaaaaccccagcagcaacaaaaacaaacaaaaactaacaacattcatgggaaacacacaggaagctatgaagggacacctctcagttggca

SEQ ID NO: 36258 - DNA, 1758 bp, Bovine  19866881128735
tttcccaaaaaaagtaatctaataaatctgttctagaaaagtatatctaaagcatcactttagaatagttgttccactttctgctgcagtattgctttgccatcttctgctctcagcaaagctgacattttatgtcaattaaacacaccctctgttatgtaaatagttattttatcctgtgggggcatatttgcatatatatatatatatatatatatatatacacaccccacacacatatatatatatatatatatcctgataaacaacctctattaaatcaaatatgtaccacaagtatatgtgtcttttgcaagcttccaacagggatgtatcctgcaccattcattaaacataaatagtttgaagattatcactaatgcatgttaattgcctatgctgctctattttacacaatccattcttcacaagtcttggttagaagtcacatgctggtagtacagtgatttcaacctgctctatgtctagtatgtcaagcagaatagcttacagttatttaaaagcacttttccttttccatttttaattcaatttgagtgtcatatggtgtctctctagattcaaggaaacacactgcatactgcctactgtcaaaacatatactttgtattttgctaaaaatatgtccaaaacttgtttaaatataaataatgtaaaaatatgatcaattttatttgctgcattttatacataagataattattttcaagttgatgacatggcaatttattttactttatgcttttgctttttatttttaatcacaactccaaacttttgaatccattagacttttcaatggataatttcctaaaataaaagttagacaagggttttgtgaatttctttgttataatattttttctatcattccagtaggatatacattggtcaaaaattcaaacctagggtcattttctaccaactatggttgcctcaatataaccctttattcatggaaggttttttttttaactcaacttttgtagtatttgcttatgcagactagtcttatttttttaattcctgctgcactaaagctatcagagatataacttgggctctgtcccttttagccatgaacatagtggcaaagttgtgcaattacttaacatgatataaatttttgtttttgcacaaaccaaaagagtaatgttaattccttttacacaactatttacttgtagtgtattgatgaactgcatgcagggaattgctattattaaaaagaatggtgagctatgtcattattgagccaaatgaataaatatttcattttttattgtatttaatttcttggcttctgtttttattgttggaagtttaaaatatatataattaatgaaacctgtacttgatctgacatttgtatacataaaagttcacatgaattttgttacaacctactgaatgatttattaagaaatactataaagtcaattaaaagcagtttttatgaacttttctgtgtgcaaaagatcaagcccacgtattccaacttgcaagtttaacaacagtaatagtagccatttacaacagttatcaatttcaattaattctcttggttgtaaacattttaatctcaactcctcactatgtaatctccaaatttcttggtagtaaataaatgttgtagtacatagtttgttacttaaattcattttatgaatttctatttacacataaaatattaatgatgtagtgactgagaaattaatctttttttttccagggtcc
